United States Patent 6,902,887 (METHODS FOR MONITORING MULTIPLE GENE EXPRESSION) - sequence listing, part 2

SEQ ID NO: 3573 - DNA, 434 bp, Fusarium venenatum
  misc_feature (1)...(434): n = A,T,C or G
accgacatgggaggccactggcgtcatgaacgatatccccaaaagaggccgttgggaaggcgacgccgcacccgagccaccaaaacgccccggtatgcaacggactgntagtaagcaagccattcagaaggcccagttcgacgtcaaacaaaaagtttccgatgccatggatacagcacgtgctgcggagttagcattgcgggagcttcttagttcttggagggcagccaaggtacaactcgacaataactcgatgccattcgacttcgaccctctgtctctcgacttccctgcgttgaccctccaatgcttacaacctcctccaactctcttctcatcaacgcagcatcctacatcgacatcatggtccgtccagtcgccaggacagcgcgaattcgaagctctacagacttggttcgcagggcaattcaagg

SEQ ID NO: 3574 - DNA, 130 bp, Fusarium venenatum
  misc_feature (1)...(130): n = A,T,C or G
nccanccatcnaatccatgatgagtgcacangatcntctntacgggcgcannacatttctctnccanccaacacttctgaantcttncgccgtcnttngaaactggtacggaccnntcaaggantactcc

SEQ ID NO: 3575 - DNA, 259 bp, Fusarium venenatum
  misc_feature (1)...(259): n = A,T,C or G
gcnagcaatgttatggcgaccagcaccaatgagacagcgtatgctccaattataccacncgatctgagcgggtanatatgtcngtgtctacagggcctcctggtataggcttgtctgtgtccccgagctttnagcaccgaggatagaaagaaggtccagggttgagcagatgcaaaggagtgggcaggtgttgtatntagtaagtagtagcaggccagacaagaagtaacaagcgancaccgtnttgaacanaaaaaan

SEQ ID NO: 3576 - DNA, 457 bp, Fusarium venenatum
  misc_feature (1)...(457): n = A,T,C or G
ntttcaacttcagccgacatacccttcgcaacacttnattattgctcgtcaccaccgacagcgcttgatttcactcatacatcaattaaagcctcttccgacaacgtttctgcgtcacctcccgaacagtcgtaaatcatacatatattcacagacgccatgagtgtcgcattcnagcctcggagtttcatacatgangggggataccctcccatnggtgacgaccacgaccatgatcacactgccgatcaacgatttacagacaacgatgtcgccgagcagctcanccaatacacaaccgaggcgtcaatgcttcagactccacaggcgttctcggagacnaccgagggatgatgccagacgatgctgctggtgtacacgatgcgactcaacttgacttggggcaccccacattcccctcccccatcgaggttactatccacgacggtcttctgaa

SEQ ID NO: 3577 - DNA, 629 bp, Fusarium venenatum
  misc_feature (1)...(629): n = A,T,C or G
ctcccatcccgcccatntggttccgtcttccgtccgtcctcccgttgccttcccgccttggatcaaacttgttcccctttgctcccgcacatcgcctttacgccgtcgtcgcaccagcactctnggggctcaatattaagcacagtactaaatctgtactatcgntacggcccttctctcacaatcaaactactgagctaggtcattacctagcccactctctccacgagggacccgaacgacctcncttcgaccaacgctaaatcacaccgattctcgcatatccgtccacctttggcaccacataggacctcttggccggcgtatctttactcaagttgngaccctctgacccctgaggccgaataatctcgttccaatactgcactcatacttgatattcctcacacaacagccatctgntggactaagcataggcaaaatttgacccaacgcatctcgctaaatattcgagggtgatggcacgcaatctggttgaacttcaccttttaataacccgtttttgccccgccaacgtananatatctgcgcccttattccaaccccacgttcacacacgattattatnttacgacttgancggcaaaantttaaaaacctnggcgaga

SEQ ID NO: 3578 - DNA, 482 bp, Fusarium venenatum
  misc_feature (1)...(482): n = A,T,C or G
caacgaggttgaattcttgggattcctgcccagccgtctcgagaatgccctgacgacttctgcccgacagatgaccgatcgtatttatgtggttgcgctccctatcgacggtgccaacattacagttgctggtgagagcagcaggttcgtctttcangacattactgaagaggtggatttgatgatctcccccgagagcaaggacgaagcgcatgaggaaatttaaaaggcccaacagttagaaggtgggttttatgtcacatgaaatatcactatataattacatcccaaccaatatgcaaaaaggctcatccaatacactaaatatatcgctagttttggctgcgcccaggttgaccttggttccgtttctatttaaggattttgcccggcttganggatgggagttgccttgtattacaaaaaacgtcttttcaaaagggagaaagatttttaagaccagncgaccactgaccataggg

SEQ ID NO: 3579 - DNA, 117 bp, Fusarium venenatum
  misc_feature (1)...(117): n = A,T,C or G
nngtacggcttgatagctntacagctagnacatatanncacataactgtganccnataccaccatncctctaacgaatatacctatgactagggagtntngatcatgcgtttncaga

SEQ ID NO: 3580 - DNA, 600 bp, Fusarium venenatum
  misc_feature (1)...(600): n = A,T,C or G
ttcatgtcaaacatgcagcctcaaacggttcttgtccctttggtccggcgcagccctcttcaacagggatgaatccgggcgtgcattgatccaatcaggcaacatcaacagcttttacgtcatgcaatttgaccaatagaggagattagtcggttatgctcggctatccaaaccagaagccaagacgacctgatcaacgaatcataacacagtgaaatctctgctcaaactccaattccacttacaacactcaattcagtggaattatctggggggtgacggaagatcaacaccgctgttaatattcactgtgatgcacgagttggtgggacgcctgcagtctgcaaaacttattttcgaaacggtgtatgcagatacagcatcatggcctaataccaagaacaatggaaaaccaaagaagtgttcccaggtgtcttgtcatggctagtcatatcatgttgatgagacaagtcgatcgaatacaacttggctccatgaacatgcttaatcgccatcacaagttcgtacgtgcccgtgcttgcatgtgcatatcgacacacagctgcaaaaagtctgtcctgcaattcgagctgatgcgan

SEQ ID NO: 3581 - DNA, 628 bp, Fusarium venenatum
  misc_feature (1)...(628): n = A,T,C or G
caacaacattgccttcttttattccgtctgttcaaaacactacacccaagcccatttcaacctgttatactcgaatcttaccattgtataacaaacaaatccttctgatcctagactcttacttataatttacaaagcctctcgagttcctttcgactcaagtcagtgtgtgggtcgttcgccaccatcgtcgtctcagcattctctctctggtcttagttcgacaggtaccattactcgctccagtgtgagattgtgttactttatacaattccggcgcagaaccgcttcctgcggttgtctgatgcttcagtcttttttgtcgcatcgtctccgttcacgtttataacaatcaccgtctcatggctcataccattatgagtagacaaactacccagtcacataacaaagaaagcatgccggcctcatcgcctcccagcatcaaccactttcaattcactttcaactgttcagcttccaattccggaagaaatagtttcatcgagccagaaccctgatgcacagaacatagactcagaatcttctgacagacagcgtacanaattttcccgaaaaaatcgggcgcactatacccctaccnggctgggttataccncttttccaaccg

SEQ ID NO: 3582 - DNA, 584 bp, Fusarium venenatum
tgcccattcattcacacctctattgagctaccaagtctcggctgcagattatcaagagggcttgtcggaggatcctgacgcatcgcagtcttaggagcacgaccgaatactcaagatcacagtctagtttttgcatggtaccatctccgaccaattgacaacgacccctgttgatctggtggtaattgttggagatcgattgtttttcgcactggaattctaaggcgcccgaaagttgagccggcttctacccgaatccaacccacgctcgtcccgatatttgcttcaagcaccgcatatacatacgttacgatggcttcgatattctctctccgcgggctgttcagccgccaagctgctcccgccgcgcctacaactcgccttttctctacgacagcaaacatgcttgcccgcacacctccgaaacccgtcgcaaagaagcccgcagtaactgctccacgacgaaagcatgtgcagcaaaagtccgaaaacttctaccgcattcgtactctccgccaaaacatgttctctcctgcgcccccacccctgcgtatggcccgtcttcgatatctccgacattggac

SEQ ID NO: 3583 - DNA, 171 bp, Fusarium venenatum
  misc_feature (1)...(171): n = A,T,C or G
ntgtgggtcacgctcaatacactggngctctgnatcagtnctcncctcgtgtncnaggaacgttggatcgtancactaancctcaccagggtgacccgcatntgacgatccggggtcccatcaacactganaagnggcttccnangtcaaaacgtanccgccnaattngtt

SEQ ID NO: 3584 - DNA, 552 bp, Fusarium venenatum
  misc_feature (1)...(552): n = A,T,C or G
cttccaagaagccncagtncctaaaactaaaaacatctttgntacccctcactactcctattctccctcgtctaaggagcgaagctccaaggacaaatgggcggcactgggtgagcgacgtcgagctcaagctgctacctttgattctattaagtcggtggaaatttctaagccccgacgacacaattttggttttggatacaacaaatcttacgaagcgggcgtttgggatcattctaattatcataacaaatttggggccgctaaagaacggtctagtattaaggagtgcccttggaacaagggaagagattggaactggcgtcgggatagacgcaccgatctcggagacgttgagtgggttggaggttggtaaacgggattgagtctctacaacttccaaatgtagtttggccgtcttgagtccctggggcgatactcgaagatatttcgtgccgttgcttggattatgacgagagccttactcgctttctgtgtataggatattttagaaacaattcaaataccagaagtacctactcaaaaaaaaat

SEQ ID NO: 3585 - DNA, 611 bp, Fusarium venenatum
  misc_feature (1)...(611): n = A,T,C or G
gcccgctttctggatcccggcctcatatcatgccaccactccttcacccaaagtcgcgaatgacgtcgtcnntcttcgcaacgaccgtcgccgcctgctttattgtcgtcacaatccctcatatgcttccttgtcctgttccccgagcccgattcgccgatggagatattatggttgacnaaaatggtcgacgattaaggtggagganaaaggatgccaatcccaaggtcgaagatggaatcgtccaattcaatgatgtgtcaaccgaggaatctgaaaacgcacacgacagagccaagagggaatgtcctctaccgaanccaggaggcgtgttaggcnaatggctgggttttcataaaaacgataatgaggcggggcgatgaccgacggaaattgttccaacaactttattcaaactacatcgagcacattccncccaatcacatccgatccaatagccttgacagctacaaaaatggactgggnggggcgaactcctgcnactctcgtttggctggttaactnttatcacnaaatattggntgggcaacacttacnggcttacaaaatctnaaaatacnggatggactnttttttnaaaaagggtttgc

SEQ ID NO: 3586 - DNA, 498 bp, Fusarium venenatum
  misc_feature (1)...(498): n = A,T,C or G
ccgaccaccaacagggcagacctggatcttctgtccttcactcacganaacacgttattcanacaaacaaactctctatcacctggtctgccctccattcnaaaataaacttcaaagcttcgtacgttttgtctcgacgagcgactggcaacaactatnctctgacaacccacacaaccttcgacaaactcgcccgatggcattgcagactttagcctgcacagcgctccagttcttcgagggacactgatgagtgaggactggcgaacaaaaccatatacacattcactncttgacaatggcaccatttactcgcgccgctgtcgattnaacacttgcccctgcagttcaactccttaagancacggntcgaccttnagtgacgccgaaccgtcttggtttttacctgcgaaacgacgcncaaaangggacattaaatacgtttggntgnctgcccgatccgtttggtcganaaaatactnaacatgcgcgaactgg

SEQ ID NO: 3587 - DNA, 615 bp, Fusarium venenatum
  misc_feature (1)...(615): n = A,T,C or G
ggctcacatacataaagattgggtactcaccgacaaatataaactctgccacaacgcgcagcagtatctataaaaaaaaaggccgctattcccattctctntttctctcagggggacactttcagggngtgtttntttttactccacatggtccccttcttaagcgctgtttccctttggatggtttttctgtctttctgcccgccagaccgcgccctctctnttttctctccaatatcgcgaataccggtgagagataaaagagagtcaagaaagaaaaaaaagaggggtccctgtttttacaaaaaaagaacaggcgagagcaaaagatcctctttcctaccgcctcgttctttgaggngagtaagagtcgagacgagaganaactatccccacaacggngggcaactcacagacagagagacgacgagacagatnccgcctcatcaattgtattatctttcgcgcttaattattatcttctggngggttggggggctcattttgcttattggagatgagcgacaangggatcttgtcttcacgtgccacctatttcccctccctcccatgtgancaagcatntatccccgttgngggtatnccacacngtnt

SEQ ID NO: 3588 - DNA, 140 bp, Fusarium venenatum
  misc_feature (1)...(140): n = A,T,C or G
ctaatttggccgcctgcagcacatanaagataccccantggatgcacacgganacttttgtaatcacgcaagatgtatctatttacctgcgcagagtacagagttataggttatcgtgtgattgtattgattgtnggtcc

SEQ ID NO: 3589 - DNA, 270 bp, Fusarium venenatum
  misc_feature (1)...(270): n = A,T,C or G
cacgaataaagctcaccgacgctgagaaagaaagcgattgcagggagccgcattaaagaaagggctacccacctgcangaagaatcnattggcgcttgggaagaaggaanctcaaccgagggacgtctgcctttctggtattcaccgganatgctatggaaagaataatacttcgcatgtatggagtaaggcgactggccgagcaggatatggatggggtttacagaaaatatcatgattattcgtctttggggatatatatcctcctgc

SEQ ID NO: 3590 - DNA, 580 bp, Fusarium venenatum
  misc_feature (1)...(580): n = A,T,C or G
ggaaaaagcgaaaagaaacttccttgaagccgccaaccgctttgcggctctcaaaatttccccaaaggaaagaaaccatgggctgggctaatctccagaaccaagggtcgaagaatgtttcagcacttgaagaaacgaatgctcttgacgggcacagaattacccagctaaagggaaggaaattcgtccaacctgaaaaaccctccttcttgctcataanggactgccctgttnccccagcaacaaagggatacacggcgcttttatgtctcangttgtggagccttacaacccccaaatgaatccttatggcatggcagcacccatgtccaaccagcaagtcatggctgggcaaggtgtccnnaagcgatctcctanaacgagacaaagccccagccnagtcnacaaatcaaggtggagcaagcagacatgtcttcaccaagtcgcatgatagaaggacttgatgatcctattttcctccatcncnaggcgattagcctttccgaagcagttatcattatnagccttttccccnggtttcagggtttggcgttccgggggctgccagctcctatcttcc

SEQ ID NO: 3591 - DNA, 624 bp, Fusarium venenatum
  misc_feature (1)...(624): n = A,T,C or G
ccgtcaactaggatgattcgccaacagggtgttttggagcttcttgcggcatcagtatcggaagagcatttctacgatatcgatcggtgcgcatttacacgcgcattagctgaacaattaaggatcagagcggcacgcttgagtcctctgtcagcggcggagctacatgcgaatcttttctcccactactccaagatggtacaggacaagcatccagaaaaggaagttctaaccagcttcccgtcgccgctgcatatgatgatgtctggcaactcaaggctcccttccatctttctctcgcctgtatacgaaaacaatcatatgcggagtaacttctcgtcatacgagaacagccgcagctacatctatcaattcgactagatgatgacaacgtggacatcgaaagttggaacgagtggttgcgtctgatgcctganggtatcaaggntatcaaagtcganggtccgttccgagctaccttaaatgaacacatcggctcctgaaggcttggttatgaaatgctgaaaacatcattgcaatttccangctanactccagaacggggttctgnccccgaacaagggaanngttggtttcctaaatggaacataaaaccttgatcgg

SEQ ID NO: 3592 - DNA, 192 bp, Fusarium venenatum
aacaatcactccccggctctctatttcgagtagctgaggagtaggtacgggtatgcaaaaggtcacagcttgggaacggtcgcggtggaatggcgatttatgctggctgaggttgattgatctgtacaaacaaacaaaaaatacgacttacatcgggagaaataccaatctctaatgatgtcaatgattgct

SEQ ID NO: 3593 - DNA, 278 bp, Fusarium venenatum
  misc_feature (1)...(278): n = A,T,C or G
cagaccctacttgtggaggaccgggcggatcagggcgtgagcgcagctcaatggttgggaatgttgagagaaaaggttgttcagtaaaacagcttgttaagcgtcaggcgtcggtagtcgggagaaataggtcggatcagtccttgtaatattgtgatgaggagggattcaatcaatgactggagtcggggtcctggagatgcagccggcttgtttttttttggcaacagagatgcgaacggtatcaactagatagaatcaaatgttttgtgtgccng

SEQ ID NO: 3594 - DNA, 158 bp, Fusarium venenatum
  misc_feature (1)...(158): n = A,T,C or G
nccgaangttaggtntgcactataaaaaaaaaacnggatccctggttcgggggtggcanaacnatttattggcccctgggcgacngataagatcccctggccatgcccgntggggtataaaaaattncccnggcctttaccgccgggattttcgggat

SEQ ID NO: 3595 - DNA, 442 bp, Fusarium venenatum
  misc_feature (1)...(442): n = A,T,C or G
ccaaattgtagatcaaacgtgagtagccaactggccccagcatttgcattccacatcatctctatgatgatccaaaatgaaaacgacaagcntatgtccgagctcacgctacgacgataactcatttatcgactgatcgagatgcttcacgtcacgtcaatgcagtnttttcaacgacagcggctgacatttngaaagcatactcagccatactcccacttttaatccaaacaacaggatctttggcaacaaggttttccccaaccacttgccatagtattgggatcggtcgtatgtatgcggtttaacaacgcggctgnnatttcaacaatcttgtcaagtgacaaggtagcatgccctgtcaaagtcaacccttcggttgattagaaggcatccatcctgggtctgcatccaacaatgataatctttgcagatnccagaa

SEQ ID NO: 3596 - DNA, 537 bp, Fusarium venenatum
  misc_feature (1)...(537): n = A,T,C or G
gctgatcaagacntatatcgcaagactggaagaggtggagcaggcanttacgttgtccaaaacaaggctgacgangccgacanggatcttgaagctcaaagcctanccaccgacgaagncccccctccagatcgtgcaacagccaacgtcccagcgcgcgctggacgcggnggatccggtaactacgtcaacccgtcagacctgcccgacgcggtggagcaggacgagatggctaaaaagacggctgctgcggtgaacgcnatccttatgaanaaccatantgtccggggaggtgggctgggcggtccggangcgcggngaactggaancatctnttttttcgnggaggaggagaggatganggaanaaattgtcgaggggtgaggctttggaaaagaaanttaggnacaccggtgaaaagggttgaaatncctaaaaggnnatcatggccttacatatcaagcgtatgattattactttgntacggggggaagaatagngtaaattnttgggnggaataatnngtattttggngac

SEQ ID NO: 3597 - DNA, 565 bp, Fusarium venenatum
  misc_feature (1)...(565): n = A,T,C or G
cctcccccacctcattacggcaccacttccagccaccagtttcgtttcgttccgtcccgttgagttcgctcatcaatcagtcaagctttgtctgctctgcttcacattgttccttcgcctcttacccttggcttggcttgcttggcctaggatttcctaccgttgctttcgcttctcttgtctctcgtcaccccccagtctaggtatcctgtaccttggctcgggtcgtcctgaacctacctattccatagccctgagattcatcctcggctgacttccactctccaacgttgtactctgcctgtctacatcggtactccgtacagtaccattacctanctacctaactacctacctacctacacttgaccagactcatttgctcgctcgcaaaacggnacgggacagaacanagaaggccaaccccacacaggcccaaggccaagacaagacaaggccanaggcaacccggcgccgtancagagcanagcanttgctcaaaattcggngtacnaagtgctgactccgaactgcggtangnccggagcattnccacacaagncct

SEQ ID NO: 3598 - DNA, 499 bp, Fusarium venenatum
  misc_feature (1)...(499): n = A,T,C or G
attacaaagttgagtatagtgtacactcaaactccaacattgctcatactattcattaccattccccaacattacctcgagcatcgacttcaacaatcaacgacaatggcaacgcggccagagagagatattgaagagatggccaagggatggnccaaagccatggggttctccaaggcccgattacagcgcgtgcacgatcttgcanaanatcaacttgacgacnccatcaatgccggtcatctggttctnganaatgtgtgtttgtttattcatgcatgcgtaaggcatggacaattccgacctcctctgaactttgggcaagttcttnattctgagnacggtattatcgtatatcctctgcattccaggaggacataaatatccaggattgggcatngagtgacatttacggaggcatatcggggcatattatgatntgtgggggacacncncaagtttcctcctcctgccctttgntttatgcaaaaccaccccg

SEQ ID NO: 3599 - DNA, 179 bp, Fusarium venenatum
ttcttacataccatcgcgcaaaggcacattcttcaggcgccgaccagaaacatgggtagtgggttgcgtttctagacgagacggcgtttaccaagggcactcgaaccattggtgtggcagcgattgatgacttatgatagacatgtagcaacaaaagaaagcgtatccaattgttgcgg

SEQ ID NO: 3600 - DNA, 543 bp, Fusarium venenatum
  misc_feature (1)...(543): n = A,T,C or G
ctttatcaactttactacctatctaggcaacaacatcatcattattgtcatatcgcatcgcctattctaattcatgataataatttgggaccattcagcattgtcgccgccctaaaatatttcttgggacttttatttggaattttttcgtcgatctcgtcattcgttttgcatttcctcaaccatgggactccctctgtttatcgctccagtcgagtcagatctcatatccaaagctgccgacaagagtgcgacagcgccacctcgctccagcatccgtcgcacacgcactactggtcgcgtcactgaacgcgccgaacgccgcaggatcctgcgccattttgaatcactacgacagtctggccttatacatggcccccgtgatgatcaatctacatcatgggaaactggtttcccccctgacaatgaactgacaacaaggccgctgcgtgatgtgctganaaacatgaatgcctccgaagaacccaaaagggaccatgttgaaaaacgnctgccncttttttagggatggagtactcctct

SEQ ID NO: 3601 - DNA, 662 bp, Fusarium venenatum
  misc_feature (1)...(662): n = A,T,C or G
cggcttcttcactcgcggaggcatcggccaagtttaccgtgttttgtaactcttggccttgcaatggctactggttgatcttatcagatctgattggacctgataccgaaatcggttcagtggggtataaataagtagcaaaataaaatctggagatgcaaagatcgcattgtctgtctgatagcagccaaaacaaacaaacagttcagattaatcatcccaaaatgtcttcacagcccttccagcaaaagtcaccaatcaagattaggctgcctgagccttatctcacaacatactatctcgagcccattgctgagaacaagcagtcctatcgtctgcgcaaagacgagtctgcaaaggatggcaagccattccccaaggctcttcacggcgatgacctagtcttctccaagatcccaactgcggaatctgacaagattcctgattctgataaccgcgagtatgcgcgcgcgcgacgaantcccgtctggttgctgagctgggagaaggagacacccacactcgcccagacctggatgtccttggacactttcttcgcatacactttcgacgttgagcaattccgtcttccgtcttcgaaggcctttggggccgaagactggcaaggctctcctncaaggcncatnaaagctnaaccccag

SEQ ID NO: 3602 - DNA, 226 bp, Fusarium venenatum
  misc_feature (1)...(226): n = A,T,C or G
nctggactggaaatgtcttggttncggacgcccctataacaggtngtgatcgtatacctatccgcgtcgtcgactgggaactatctcagcttggtgtccggcctcttgatcttggccaattcatanccgagctctggtcgctgaagctatacagggacatagatgctggcgagtggctcatncaggctttnggctgctggntacggtctggtagacaataactttg

SEQ ID NO: 3603 - DNA, 412 bp, Fusarium venenatum
  misc_feature (1)...(412): n = A,T,C or G
naanttcattaaaactgatccaaccatttgtgtttctcgtcgcagatccactgcgtcatgagacccctataaactctggactcgatatatttatggaccatttttacgatactaattagcttgaccttcctccaaagggactgtcgctctatctgtcattcgacacatcccatctgtgctactactttcggtctttccggctgtanaanaaacactaccagnttttttcaccaagcattgcaaacacaatctagtcattcatccattgaatactttacacttactctaagacaatatcgaggggaacagatagattgcctgtttccaactcaattatcttatatcatcaaccattaacaaggaccaccaatcgacaagatgagctntgngtacaagccnggcctttttcgcc

SEQ ID NO: 3604 - DNA, 626 bp, Fusarium venenatum
  misc_feature (1)...(626): n = A,T,C or G
gtcctcattgacttgcagtacaaggcattggatgagattaccttgtctcactgtggtgaatcaagtatccaatgttggtcgatgagctggttcttgtgaagccatccatctcaacttgacaggcaggctgccgtcaatagatgccctgttttgtttctgtttctgtttgattgaaccccatccatcggaatgatttttttcactccagaccacaaaattgaaacaagcttatcggcttcccgagcccgaacaaagagcacatcaatctcagattaaaccccaatcctcaagcttggcaatcacgatctttactcgggcaggcatcggacgagaatcgaatattgatgggagggaacttttgagcaaaagtcctagatttttttggttggatgaggttcttcttggtctgatccaccgttccacaaggtcaaaaacttatgaggcatttggcaaacaaccatttttgacggtgtccgcttacgtatctgcagtacagtacgtactacagttcacagtgtttgagcaagcgctttctattcaattgagttggcaggtatncatttcangcgttcattcatcggctgggaaaagttgntgatggtggggcaanaagttganagaagaag

SEQ ID NO: 3605 - DNA, 329 bp, Fusarium venenatum
  misc_feature (1)...(329): n = A,T,C or G
ctaacacagaggtcactggcaaagaatcggatggaaggatgaaataaagaaaattcaaagatggttgatgagactccacgtggaagatagaggagattaattaatgtcacatactgtacatactgtgagcccatttacttttttccttgcgttttatgagcttgggtcaagcggacgagagcgggagatgacatcttccattgaatgcatgacgttgtatatcttctattcccaccattatggtgaggacagacttgcggatgatttaaggtgttgattataggtagatatgcntcaatcaaacgatattgaagtcnaaaaaaaaaaan

SEQ ID NO: 3606 - DNA, 483 bp, Fusarium venenatum
  misc_feature (1)...(483): n = A,T,C or G
actaaaacattatatttctgttccaggcagactacaaacctaggcagtcttagttggagagcccacgtgtcttagagctgcgacgatgcctattaaagctgacgtagtgcctggngaagggatcccnttgcttgttagagctgacatggtgtctattaagttgcccttttggctcttagggctgnnatagatccctttcgggttgcgacnatgcttttggagagngcgcagtggagagggcattgactcggctcgtgccgaggaatcttcgtgcttggtcattgcatacaagtntggggtcaaagtgttgtgcgctggaccctgaaaacaganattaanactttggtggatcaggtatgtgcatttagagctatcgcggnaagtttgccctacttatgccaagactttgganccacaaatggaagcgggggggccaanctttttacaacantttttttttgttantggacaaantattcncag

SEQ ID NO: 3607 - DNA, 597 bp, Fusarium venenatum
  misc_feature (1)...(597): n = A,T,C or G
atttgcaacagcaacgacaactccccgaacgctcttcgtcaggccggatcctccagaaaatatctcatccagtcggacgaaacttccgcactcacaccaatgaagcgtgaatcgtagaantggttcggccgggtaaagaaaaagcccatcacacccctcagaaaaggggctggatcggggtatctcaaccttggccgatgacggagaaagcctacaggcagaaacaaaggggcgggtgcaacccctaaggggaaagctggatgcgctattgaaccgttctggtgctcaagatgcgcctgctgctcgattgactccccggtcggctgcgaggccaaacaccatagcagaagatctcgctttcccagggcggcgaagtacttccatttgaagcggcgggtcgagctaaagacaggcctcccgttcaacagatgcttacgcccaaccgaacaccagccgcagcttctacatccaaggttacaccgcaaaacgcaagatctccgctagcctccaagcaaggancgcaatcggggctgcggcacaaaccactttctcaactgcgtctggatgatttcaagatcaaccctcaggcgaacnacg

SEQ ID NO: 3608 - DNA, 207 bp, Fusarium venenatum
  misc_feature (1)...(207): n = A,T,C or G
tcnacagatgagtgttggnaacaacngacctaccggctcgtctaggtgatataatcggcttcttttgcgcccttcctgatcccgcagtcgtnggtggtgttacattnatgagatctacagttaanacaagtcaananatagactgangtatgagcgtggtttacgatncgcttgtgggacatggaaaacgcacttccaaaatcatca

SEQ ID NO: 3609 - DNA, 341 bp, Fusarium venenatum
  misc_feature (1)...(341): n = A,T,C or G
ctttttgntaccctcctccaggtcgntncggcctcatgggatactgncggttattcctttnttntatatatcactcgtctttccagttnggactgggtgatcttcanatcatggtgggaccattggtntaccgcatnatgctggtatgggcatttgacgacgtttgtttgattaatccggcgcctggngtctantattctcctttcctctatcctgtcatgagagaagcagtggtgttnaagaggaggccttttcttttaatgttgagaacggnggcaaagctcatgctggtgcataaaaatgatgggaggcggttntcatagacagnccganttaatatg

SEQ ID NO: 3610 - DNA, 267 bp, Fusarium venenatum
aggcatacggtgtcagcagccacacaatgagctgggaccagattcaagatcgcatcgatagctggaagcttggcagcttgccatagatttgatgtggtatcgtaccaagagatgatgtgttggtcacttgcatgacgtcctccgtgaagaggagttgtataatagagtgggatattgtaaagcatataccggacattgggatgtagcattatgaggagtagaaagactatgatggtcgggaaaatatgtattatatgagcccaccga

SEQ ID NO: 3611 - DNA, 274 bp, Fusarium venenatum
  misc_feature (1)...(274): n = A,T,C or G
natagcgtttcacctttcaagcaacagcnccggactganctttgggcggagcaagaggaagaggatcccctnttcacagagacacatnctcgccttgtgaaccgagcancgcnaatgtcggtgccaggcttctatgangctttcaacaatagtcatgatgatttaaggatgtccccgttgnggccgtatctatctaagcgagttggaggaaanaccttatcttntncattatgggaatganttacccccnncaatttttggcacccgttcaaag

SEQ ID NO: 3612 - DNA, 624 bp, Fusarium venenatum
  misc_feature (1)...(624): n = A,T,C or G
caacctttaacaaagctatcaccacgttcgctatcctcctcgccctcctcacccttctcaacttttaggaagtcctcgtcgactcctgtcactcgcttttatattacggngccttgatactacaagaacggtctcacttacgatcctcttctcttacatttctggacattcgatctcttcctattgcggataataaggaacactcgctctgtacaaggaatcctcatcgtctacaacgtcaagctagaattacctggactcgatccccaagctttcgaagatcggctgttggttcattcaaggatacaagatcctcaactccgctcacatgctcattcaagcttgaagctactcgactcatctttgtacatccacactcgctttacggatcatcaaactctcccaganaggaaaaaaaacaaatcaagaacgccatattcgatcgctccctcacctggatatttggaaaacgacaactnattgcacccccaacattccacagccaagatttcagattctncaagactcatctgcttttatcttgggaaaataatcgactgggggaaatattggattggtacctttgncctaacgctcgctttcaatccacaagttcgtctttgn

SEQ ID NO: 3613 - DNA, 628 bp, Fusarium venenatum
  misc_feature (1)...(628): n = A,T,C or G
gggngggggttacccacaccaagaatgagtcagaacacaagaggtcaagacaggaatgaatgacaacaacaacacaacaatcaacaaccatgatctttagagttcccggtcgtggccgaaactttctccatcaagagaaacgttgccatgacccgaaccggatacatggaagccttcatcccccatcttgacactttctagccctcgtcggactgtcggcgagctcggccatctgccgctggctttctccccgcattgcggcccggtcaatactctatcatcatccgctattcttttctgttgaggcttttatcaaagccgatgttttatcttaggctcggcgagtctatcttgtttaatcattttctttttcacacaccatctgggtggatcgcatacatggatggagtttcattttatttattgcatcattagggcatgggacactggatacagtacaggttcttgcatcaatcctccaacactgggatgaatcaactggtacacacttgggaacaggaacataagggcataggatatgcccccnccccagcatttcattggttnacggcgacatggcatggaaatatttaaaaaccttaaganagtttgggcggcctaatgcttg

SEQ ID NO: 3614 - DNA, 619 bp, Fusarium venenatum
  misc_feature (1)...(619): n = A,T,C or G
aggacatgtctgcataggttctattggcatgattaccatctaatatcgacatttactatagtcattacccaagaaaggggtggtgtcaaaggaaatggtcgacacttaatcgtgatggttcatagcgganactcactattgtttctaggcaggtaggttgttgagggaggtcgctccttntttacgagttgcctaactgacctaatcacccctcatcacaacaacatggaatttctcctgaagtaaatccagcatctgaactgaataattctttcgttcattcatcgatcggaataaccacctaattgatcatggcacgaggaaacacaggcaacgaggaaagcnaccctggcgtaatcgggtttcaagcccaaaccaaactgattcanctgaagaaggaaaggaatgaccgcatgtctgagatcgtgcagcaaacagccaccgaaatggaaaacttgcgctctcgcgttgtcgcatttcaacaagaccgacatgccacagaacttgaagccattgcttctgctatcaccagggttatcgaggctnttgagcgcaggaaagccatcgaacaacagatggagacactcgtcgaccaagttgcctntaccacccaggtgng

SEQ ID NO: 3615 - DNA, 616 bp, Fusarium venenatum
  misc_feature (1)...(616): n = A,T,C or G
tcnaatttgatataacattcttttcagggatctggactactctatgatatgcatctccatcccattcatgacccgcataatatcgtatgtatcttgcttatagttcatcgggagggtccatcgtaacccgaactgtctgcacatcatgggcccgtgctattatgcatacatcccttctcgattcctataccgccttcatccctaccggcttttnaacgttctcggccgtctgcctgcctttacttcaatttgagccacgtanaccgcagccaatagttgaggctggagaagtttctaccttctttgggaactgcttgtacacaacatcaaggaaagcatacatattttccgaccctccaatgtaatcgagtgtctccataatggtctctttccattcattattgaggtctcccttgacaacgcgttcgaacaattcggtgacaacgacggccatttccatgccgcaacgcaagtcttgcnaagttggtggctggtggtacacggnttccactcatacctanaaaaagtggccgcttggtgctccttggggcccccatgaagctcggggngctcgaanagtcatggccnttnttgcccgnctggaggaaaaaaggag

SEQ ID NO: 3616 - DNA, 199 bp, Fusarium venenatum
  misc_feature (1)...(199): n = A,T,C or G
ntgcatttanaggncccaattgnccttaaanaattccgtttacaaatcaaangcccgggggnttaaaaacgnttggaatagggaaaaccttggggttttcnaatttaantgggtttggagncaattcccctttttccancttggnttnttggccaaaagggccntcccggganctcctttccaaggattgggcnggctt

SEQ ID NO: 3617 - DNA, 392 bp, Fusarium venenatum
  misc_feature (1)...(392): n = A,T,C or G
tccacccgcctcgaatcttcctttccccgctcttttgcgtgggctgttgttctcctgcgcttgcctcaccttcttcgacaacgacttttgtatttcagtctcgctttgataacttggttgatcacttccaaacgctcgttgtgtattttatccaactttggtcattaaggaaaccgtaaagttgcttggacgttcttgtatctctatattccaaacacccgacgacgctggccgctcgacgactttgccgctacaaacccgattancgaaccgattgtcccaatattatatatcttgtcttggagaatcctcggtcaaccacnaggacatatctntgggtataatcacactcacaccacgncatccgcaactgtatgacacatatctcaaga

SEQ ID NO: 3618 - DNA, 114 bp, Fusarium venenatum
  misc_feature (1)...(114): n = A,T,C or G
tttttttttttttnggggggcgacgcgngaacacgngacttttatattanctttacctacactacctactaaggtattgaacctacctacctggtacctaacacaaacatgagt

SEQ ID NO: 3619 - DNA, 102 bp, Fusarium venenatum
  misc_feature (1)...(102): n = A,T,C or G
ncggtttttntttcggttggccanagggttacaantttanaactggggaaacctntggttacccntttgaanacccaagncatatnttcccttttcggngct

SEQ ID NO: 3620 - DNA, 413 bp, Fusarium venenatum
  misc_feature (1)...(413): n = A,T,C or G
ttttctctccaaggactgattaatttgtagatgacttgagaataagtcaagatcaattaaaacatcatggaaagtgaaccgagagcgccgcctgcgttggctctgccgcccgctccaatgcccgcatgggaggtcttgcaaaatcttcagcagctccgacagaatcaagatgagggacaagaaagtgatcatgatatgaccgacgagggttttgatgaccacgacgactcggacatggattcagctcttggatctaactnggcagattcgacttactccttgagctcaagcattttcgactaccgaaccctgcatggccgaacatatnattcanatagaggcactgcccaggcttcgaatgatgatcaagcaagcgagtcgctggatcttgccaccncttnacttttntttta

SEQ ID NO: 3621 - DNA, 483 bp, Fusarium venenatum
cagactctcaaccaaagctatcaacaattaagcataaaccttctctactacaacttccgtaacccaaacacaaccttaacaacattcatcatgggctggttcagtgacgactcaaaccaagctcaagcgtacgagacagtgactcaacgtcctcatgaggcagagtggtcacacgaactgataggtggagctgcagcctacgaggctgccaaggcctatgagaaccatgttgctcggaatggagagcctgatagccacgctcaagcaaaggagatcttggcaggttttgttggtgcctttgttgatcgagagattgagacgaagggattggattacgtcgacgcagagaaggccaagcgtcatggaaggcaacatgcagaagaacagttgagctacaacaacaaccagggctggaactagaaccatgctgagaaaataaaacttagctatgttattaattgatcctgaacgcaaattgataag

SEQ ID NO: 3622 - DNA, 341 bp, Fusarium venenatum
cgagaggactgtgctgggagaaaggaagatatcacaaaggtcgacgacgactgctctcagtgtgaaaacaagcccagccgattcaggtcgtcgcggtggtgctcagtcggatgctgcgtctgccagtgagggaacagtctacaagggaacaagaagggagggtaacgggaatgattcgattcggtcggagtaacacgggtttgaatttgggaatacggagtatggaggaagggcttttttctgtagcaaccgagttacctggagtttaccggcttctcaatttattagttatgaatcaaatgattccaattcactcgcattggtatggttaaaaaaaaaaa

SEQ ID NO: 3623 - DNA, 603 bp, Fusarium venenatum
  misc_feature (1)...(603): n = A,T,C or G
gtctccagccagtccttcaagtgagattgtctcaacgacacttccattccttcttctttctttccaaaggctagtccttttacctgtctcgacnacattcacggattgnctggtgcaattcnacccttnattcacatacccaacaatcgagctacgactcttcagtcctatacccatatcactcgattctgtcttgacgacaatctcacaacctgaacatcaaatctatcgccggaacgtttanatttacctccctcattcaaaatgttcgcgaaggctttcaccattgccactttggcttcatacgccagtgctcacatgctcatggccaaccccaagccttacggaaacccaggcaatgcccctctcgacgcttatgggcggacttccatgcaagggccaagtcaacgacggttcatntancaatacctacaaggnaggnagccccacaacttttctttattgggtcggncgtcacnggggagggttatgccagtttnctcccccgacaagaacccaccanggcttttgttggaaggcatccttntatgnggggggntgcctgcnaaaaacaaagccgggaataccccgaaaaagctttgt

SEQ ID NO: 3624 - DNA, 132 bp, Fusarium venenatum
caattttctcttgacgaaatgtaaactgttgaagatataaaaaagctagcctgatattcgttcaagtacttaaagaaatatcaggctagcttttttatatcttcaagtacttgaacgaattgatcatggaag

SEQ ID NO: 3625 - DNA, 605 bp, Fusarium venenatum
  misc_feature (1)...(605): n = A,T,C or G
cataaggtcacaaacactttccaggcttaacagcctgtgctcgtatctcgtcgctcctttcaaccccatttccttgtaccgtcgatcacttcccataacccggccctaaaatgcaacacgatcttcaaacatggccgaaagtcaataccaagaagcggcactgtcgcaatcgtaatcgcccgtctttatcaagcattcgccttttacaatgtcctcgagctcaacgcctacatcttcggcagcttcaagaancgcagccggtctatacttttgggagttttgtcgttgcgacatggggcatagcgttcaatggcaccggataccttattttgcatctgtcgctgtcggagcagaagtacctatactctacactcattcttatcgggtggtgcacaaatgatcactggacagtctgttgtcttgtactcgcgtttgcacattgtgatgcataaccagcgttggtatgaagatggtcttgattatgatcatcgcccatgccctttggntggatcttcctgttatcattctggtctatggcgtaggtcntccaaccaacgcctttcagaaaccnaagaagtctttgaaaaaatcaacttacgttttct

SEQ ID NO: 3626 - DNA, 275 bp, Fusarium venenatum
  misc_feature (1)...(275): n = A,T,C or G
gatagattgtacagnggcggtctatgatatatgtccttgtccatatccaaacagtcagtcaccgttgtacggttccatctggtctatctttcagnggagatgaccaacttggctttccagccggagacagttcccgttgttagtgtagcggtatcgcaggtcattgggcgccgttgtctaggtccgtctcagggggcattggaacttggaatcacgggccaccaagacgactgttaggtgttgggtactctgtacgtggttacagaattgatccg

SEQ ID NO: 3627 - DNA, 597 bp, Fusarium venenatum
  misc_feature (1)...(597): n = A,T,C or G
gtcgccttctgtttcagaagatgaaatcactatatggagacttcagctcgagcaagacccagattgggccagcaagcgcgagtcatcactggtggacgaccttttcacagaactcttggagcttcagagcttttgggatgcgcaaaggttcaaaaatttggcccatctggacttgcaaacagcccaagacgacttgaactattgtaacggcgttctggacactttttcaactactgatcgttctaacaagcaaccaaatagacgaaaagaaaagcagggtaaagttgaggctgagataagtagctggaaagcagcttgggggcttcttttcaaacgcttcaatggactgatctctgccgctctcaaacaagaggcgaacatgtttccacaaacggttgatgacatctttgagttacccgagtcatggtngggtgcttataagaacaagcaggagcttgtgaggttactcgaanatagatggatgcgttgcaccaagattgctgtccttgtcattgagtctgctcaatgctttgaanaagcgaagcaggtgatggagggacaacaagagatactgggcatgtttgggattggaagaaa

SEQ ID NO: 3628 - DNA, 246 bp, Fusarium venenatum
  misc_feature (1)...(246): n = A,T,C or G
ngatacttcctgaacttggtccgccaaagtgatgaccagcgcgtcaaggttgaggctgtagacctcgagaccccaccgcccggcatgcattaatgacgaggcatgtatacccgaaggaacacaatgcggatgtatacacctgnggtcagngcttcagatcaagatggaaaanaacacaccaaaaagtacggggttgaattgggaacgancgattgcatgtgttatgcctgatgaaaganaatgagt

SEQ ID NO: 3629 - DNA, 237 bp, Fusarium venenatum
  misc_feature (1)...(237): n = A,T,C or G
ncgggngaanaaaccngatccaccttntctttaagcaccctgccttacgcgggcgttctttttttnnacgtcctnangggaccaggtcaacatccntcccgcgnngtgtctgangacatngantccaattgtggtgcatgcnggggntataaaaaaaaaataggttgctttaggtcttnaagaaggctgntggtggcttcctntggaccccaagtaacggggcanggatnttcaaag

SEQ ID NO: 3630 - DNA, 314 bp, Fusarium venenatum
  misc_feature (1)...(314): n = A,T,C or G
ctcgccgagcccaagcgtngtctatttatgtttcgaagtagataccgacaatgtaacacacgatattatgatggtctatcggtggtaatacgggaagccgggaacaatgacgtacaacttatagnggcggaagaccgaccacattccgtagatgagttgacgccattgtggtacaagagatgctggaaatcttttatttactcataagaagttgatcattagagattaatgaatatgggccaaggactaccaacggttaattgnccccaaggcaaaaatcccgtggctgaaggtccgaggtaattgccatgatc

SEQ ID NO: 3631 - DNA, 567 bp, Fusarium venenatum
  misc_feature (1)...(567): n = A,T,C or G
aggaaatgcagttactaaaaacatcaaccttataactcttcccttgatgccgtctttgcctggccttgctcttgaccgctcttgacttntttttccttaagtgcttgaactctgatgtcaaccttggtcttttgatcaggctggcgctccgaatgtanaacccaaccaacaactccgtcgtcnacaggctttgggctgtacttggacaagtcgataagttgatctgcgatttggttataagccattgcacaccaaacacaggaccagactgggtatctcatcttacctttacattcacttgttcccgctacccagagaggaaggataccgtataaagcaccaggtgcaaaaacggcaaccttgtttttatcattttcccgatcgatctggtcggcttcgggaaacctaacgacctcttcaatctcatcttcgcgttctttggtctctcgagcacgggaaaaagcgccttaccctcgccgcgggtcgctctgntgtcaatccattcgcgaaccccagangaatctgatcatagttcatcacagtccctgcgaccaccagcgggagggt

SEQ ID NO: 3632 - DNA, 619 bp, Fusarium venenatum
  misc_feature (1)...(619): n = A,T,C or G
gtggnggtgacatccaagccctccaacgctttgccaatgcccaggccgttgctttccgaaagattactaaaaaatataagaaatggnctggttctacaactcttgccactcgtttatacaaaaacatcctctccgatcctaaaagctttactcgtcgcgacttctcctccctgcaacagcgatatgacgacatcacctgcactctcaacgccgctgctcccgtattgagtgaacctagctcgccagaatcagcagctcatncttatcgccgccaatccctcgcaggttctatcaattcggcgcaccgtnattgtaccaaccgttctcaacccaccttcgaattcctacccccggcacatatggatgagccggtcaaatactggaacgaatacgacantgggagcgagtgcgcggacaataacaggggatatgctatttacataaatcctgaagaaagcncccacttccctgggttgactatctgcacggtatntttacaattnctttgaacaaaacaaangggtgggtttaagcacantaaacccggagagngggngggtctactnggggcaaaccattccccttacaattttncaacccaacttttaatagccgcggg

SEQ ID NO: 3633 - DNA, 443 bp, Fusarium venenatum
  misc_feature (1)...(443): n = A,T,C or G
aagaagcaggagcttgccctcaagcgtcttgttaccaaggccatgtcctcccgataaatgcacaacactgtttgagattgcagtggtgtagatatcccggagtactgatattggaacttttgataaccaaccaccctaaacgcctcgcgaggggtgatagggtttaccaccggcctgggtggaatttccctttgtcattaacggtaattggacaggggagatgaccaaggcatatgaaaagttctgcatgtttcatgggtatgccgctcccggacgtgggcggntatgactactaaaatgagagccgatggaaaacaaaaagggtccaagatgattgtanactcgttggccagggtttacaaggggtggacaatggcctgtgaatttaagcatagatatggtagattgcanaaaaggaatgatgctnttttacctattccaaa

SEQ ID NO: 3634 - DNA, 138 bp, Fusarium venenatum
  misc_feature (1)...(138): n = A,T,C or G
catatctnnccatcgaangggcccataccccgggatctntncttagttccagaaagcagaaagtgggacaacagggtcgagatccttggaattatggcgatttgatctagaagatcccgattcagcataactcttcgc

SEQ ID NO: 3635 - DNA, 240 bp, Fusarium venenatum
gcctgggacaggacctacacgcggtcggcatctggatggcggggtaagcaggcgaatgaataatatcagtgccagtctcaagcactttgatgagcagtatgaagatcgcaaatcctcaaaaagtatctgcgcaggactaccagaatgcagctaatttcaatggctggctttcccaaccgagaacccatgatgtttaaagttgaacttctaaaaaagaatgatagctctacgttgctccag

SEQ ID NO: 3636 - DNA, 246 bp, Fusarium venenatum
tttcatgggttatgagcgcgggtggctagaccatcaggatacggatatttgatacctgccctacgatgggaaatgaaacggccacgacgacgctacaggacgcatgggcatggcctcagtagagaggcccggaagcgttcatgaagatgtggaaatgttcacgatagattttctttttttcctttgggtccggctcttgaagcctttagtagtaccgaataaatgggattcccatttaaaaaaaaa

SEQ ID NO: 3637 - DNA, 418 bp, Fusarium venenatum
  misc_feature (1)...(418): n = A,T,C or G
aaggtaacctatgttgcactgctgggggcgctgagagacaggcagaaacggcacagcaacggccatttttaggtatgcaaggagcatggaaaagccttcttcatcatgccagggtgctgtgagggacaggcctgagcgtacatgagacgagaagatgtctcgtanccaacaaagcaaaggaaagaaaggctcagcangggagtgagaaattgcaagagactgttgagtccagcttattgagtgtggctggtcgtgttgctggggcaaatgatcatttttgctatgtaccaggtggtgaaaactcaaatgtcgagggaggaagaatgggattgtggaaaaaagccccggatgtctggttacccgtgtagaattgcttttctccattcaaaacaaagttattagcaccaatgcaaagctc

SEQ ID NO: 3638 - DNA, 340 bp, Fusarium venenatum
  misc_feature (1)...(340): n = A,T,C or G
ggcatcagcatcggagcatctggagttaccatagcatatttatatgtggcagaccggaaggcctgtcttttgtttgttggggacagcggtgcatttattgtttttgtcctgttcacattgtatgatatatctatatctatacctatctgcacatacagggaggagtttcggcgttttgcccaaggtcaaggccttgcctgacagggcttaactttttagtgttctgaagccaggcaggcacacgatgatgaccagcatacgaggcatctgggccacaccaaagtctgtnaaaatatattgatgcccttcgatttgnagggcttnnggagaaaaaaaaaaa

SEQ ID NO: 3639 - DNA, 540 bp, Fusarium venenatum
  misc_feature (1)...(540): n = A,T,C or G
cacccagcattcgagtctccagggacgaaaccgatagtctcgcatcaagaaccacanggaggggagacgaagacacgccaccgacttcgcctgacgtcccgtcacatcgttctaanaaaggattcttgagcaaatggcgaaaaaactaggaatnctttagctaaaagtctggcctcataacggnggggtgtacacctggcttcgacatgaccatgactgctgcaacgacgtacacggccgaatattatgacctgcaacgaccgcattccaaaatgcatttgcatcaaaaaggatcactctctttctcccttttcatttgggggcttggacagcggggcgtttatgttgaaataaggaccggacttttggagtgggacggagttttgtctgcaacaaaaggcaaaagcttggatatgtactatagcccctctggcagggcaaaaacagcaatgtcacccatatacaggagtcggctcaccttgtagtaacccgacataaacactcgttaaaaattaatagtttaccngtnccttctccctt

SEQ ID NO: 3640 - DNA, 341 bp, Fusarium venenatum
  misc_feature (1)...(341): n = A,T,C or G
gatgccgccaatgggagtcagtgagcttcgtattggcgatggagctgtagatatcaagggcaaggagacgcgtggtgttggactacaaccagttccccagaaggagccagtgcccgctcctccagtaccagcgaagaggataggtttaggccgacagtttggacgattggggggcgctgtggcaggtaaaggccgacgcaaccaatagacattgcacgaaagttggatcatcgttgctctgcctggtagtcaatttgcgactcggggcacttgacggcgtttggatgccattaatgtatagtatcaagcaaaaaattaatggaaacattgtcaacgtnntc

SEQ ID NO: 3641 - DNA, 245 bp, Fusarium venenatum
  misc_feature (1)...(245): n = A,T,C or G
ctcccgtcggtggaaaacaggcttctggaaccgaggcccctgctcctgttcccctagcataatcaagccgtgtgctgttcaagaanaaatgtataatagtgggtgatncgtgcaagaacgggcggaggtcatattatntganattaattgtcatggagcgttatcatttttctatctcaagaaacgtccgacacaaatntctgagcagggaaatgtctggacagctataaagtccttcctgtgat

SEQ ID NO: 3642 - DNA, 586 bp, Fusarium venenatum
  misc_feature (1)...(586): n = A,T,C or G
gtcaactatcggactaacaacagcgctgagaaacttgcctcctcaccatagtgtcgggtttgggaccaattcagcacgcttctggaacacagactaggggtggctacctactaaaagcttgcactgataaaaataattatcttgcctacctagatagagcaagaaaagggaacgagaatgagaatgtcttggtttgatcgtcccacttaatcaatatggaaaactcatccaacttgttagcaaaaggtccttcgtcaaacaagatggttccatttgtctccagccaatcttcatcacgtggcgaacttttgttcagctcggctcacattgtcaccaaaaggtgttggaacctttggccaacccactcatagccatgaaattctgccaaaatgtcaaacatgatcttcataattgtcacnggcgatcggcaatttcgttaganatgttcaatttactgcgggctcnggcttataattgccatactactacagaattttggactacctaaatactggttcctggtnctaactggatgaaaatgttattagtgcgtcaggtcatcctgttaattggtaacactccaaga

SEQ ID NO: 3643 - DNA, 128 bp, Fusarium venenatum
  misc_feature (1)...(128): n = A,T,C or G
ntttctttnttgggganctntcagagaatcaccctgcgggcagnttctttctgactggttgtgtgggnaacccgggaccctttctaaaaggggttgaaacaaacccgggtgcaaccctgnggtttcca

SEQ ID NO: 3644 - DNA, 577 bp, Fusarium venenatum
  misc_feature (1)...(577): n = A,T,C or G
cagaagtcagacggcttccgcgtaagccggtcgatcaagttgtaaacagtcattctttaaacaattttaatctcactcattcctttatacaggttactaccctaagtcgttcctttcctccagttgtcttcttcgaatgtaaggctgcncacccatcttnaatataacgaccagagataccaaacgattcanggcgattgacaacaccactctaacgagcctattaagctccttcgctccgatggtcacagaaaccgaccgaaaaatggaagatggcgttggaatgcggctcttattggagggcaanaaaagactgactataggagccgatggattggagttcaatggcccgattgccaaaaaaaccggccgctcttnttgtgctcctnttacaagtactggatcttccaaggacattatccccttctataatgtgctatgggccgaatgcncccacaatcacatngngatcgactttctatccccccttcnaaaaaactaatcaaacctgggaaaagggaatttgaacttgctcccgggnggaggatgaccattattgangggaacngcccccccc

SEQ ID NO: 3645 - DNA, 286 bp, Fusarium venenatum
  misc_feature (1)...(286): n = A,T,C or G
ttcgtgtcccggactttgctcttcaacccacgagcaactactaacccgaacgattcaagatggtgagtgaataaaaaatcaactcgactctaatggccacagttttgtgagtcaaatgtgctttatgcgcaattgaagccgcagcgtcgtccatnttttgngggcnacacatgctgntggtattccgccagttttcgatcaccgnaaaaaagtgtcgagctggngaaaacttggctggagatgcggcgtgtgcaaaaatgccatggcctattctcgttagagttca

SEQ ID NO: 3646 - DNA, 289 bp, Fusarium venenatum
gtgtcggcgatgtgttcgcgtgacgaaggaaatgttctctcgacaaccgcccaggccttttccaccaactcaccctcagtctgtacgcaaagttcagccaacgcaactgccaaaggatgccactgcacatatgtgtctgaccaccaagcgaagcggtcctcccattgactcttggtcatacgctcgcgtagctcaatgatagatattgccgtacgtagcatagtttctttcgatacacgaggtcggtccggcgccggtcctccattgaacggatactgtatgttcaacc

SEQ ID NO: 3647 - DNA, 511 bp, Fusarium venenatum
  misc_feature (1)...(511): n = A,T,C or G
gggttctttttctgtatcaacaagcccggtcatgatgaagactanaccgccccgtgtgctgtcgagtcccgatgttgcagaaggcactgcattcaatgttacnccgcctnttgatcaaaggctcgaagctgcgatatcgcctaaatcagcgggttggacacatcctccaggatcaccggatacgtcgtntntttcaatgagtcctgaccatctccgatttgggcgtggagaagcaggtcggttacttgcnagaagccactccgacctgtttgctactgcaacacaaaatcggctccggaaggactcgaaagacaagggaaaggacgaatcanatggcaagaaggataanaaaccgtctgcgttgagggggattcgagggtttatgtatgaatgatgaggcatgatatagttagcaactaggagcggcaacggatagctagaccccttggatagggcgcttttatttttataaatccccgngctngatgccttttgnttctttaaaaaaaaa

SEQ ID NO: 3648 - DNA, 158 bp, Fusarium venenatum
  misc_feature (1)...(158): n = A,T,C or G
natttattatacnatcgagttctcaacagagtgaaacggctggaaccacttcacatttctntcacttcaacataacttttttcaaacaattttaaccacaaaacgaacattcaattcatcatggctttcctnaanacattcctcgcctctctgntcat

SEQ ID NO: 3649 - DNA, 601 bp, Fusarium venenatum
  misc_feature (1)...(601): n = A,T,C or G
atagttacgagagggtgaggagtttcgcctacacatagaagctgctacgcaactccgcaacgcacgaagtcgctggaaactgatgagccgcccctcccagcagctaaaccaagttggcacttttttggctttgctatctcgtaccatgttgtttaagccttcttcacttccatggcgcgacagcaatgagcaggctactgctgcagaagatgaagccatacaatcaagcgcttgttatgagtacatatatggtatcaagccaagtattgccgtagcaatcaaccgggcttgtcgtcctgctgagcaattgcttcgggttcnagaagaangagaacagcaaataccgggacacctttgctgggaaggttgttaaagaattaaggtgacatgcctanaatccntggcnggttaaaaagaagagaatcccacancaaatatcnnagttgaccaatganctttgggggccctggattttttactccatcaanccaaanggtttggtacnctggctggcacttatcctactactatnacccgcatcccaaaggtgctcaagcccgacngggcctcantccaagaagnttactgctgtccncggaaa

SEQ ID NO: 3650 - DNA, 104 bp, Fusarium venenatum
  misc_feature (1)...(104): n = A,T,C or G
nattgngaggnatggctctgatgntatgttgntggatctgaacaatncacaaancggatggactttcgatnattattccagtttnacctncagccccnaaacgt

SEQ ID NO: 3651 - DNA, 424 bp, Fusarium venenatum
  misc_feature (1)...(424): n = A,T,C or G
cgagtacgattctattcccactgtccatgctcatctnaaagggcttgacaaggtttgccgtggcgctgagtggacaagggcttttcaacgtttccttgggagacttcaactgggctccaggaacgtcagcgtcntttatgacaccaacctccgaaagatgggaattgancccccagaggaaaccgagtcttgggttgaccagagcgagccagcaaagttcgctggacatgtctacagattcgttggtcgtcagtgcagatccgcatcctcggaccgacatntttacatcctctaccatcccgatgcagagtggcacgcanatttgtacgagctgctacaggataagcctcttnctacaacttcttggcttctccgacaacctngatgccctngtgcctacatncgtttcatccgaaagcgacta

SEQ ID NO: 3652 - DNA, 623 bp, Fusarium venenatum
  misc_feature (1)...(623): n = A,T,C or G
attttcaccatgggcgagaatctcgtcatttattataatgactccatcgactcggacaacctcgccgccgccatggctctgtggaaggcgacataccagaggccgaacactcgtgtgatttggattatagagcctcgtcaagtgtgttttggactatccatgactgcggagcaagtatccaaatgtaaagatttgatacaaaagcacttttcgtcactagggaaccctttcaaggtgcttctgggtggacttatcaagcagaaggatcttgataagactgagggtctcaaagaagctgaccgtcatctacttcaaatggctgtcaaatcggaatacggctcaaaggacaatgctgcacttcatggtcgcctcactgcttgggactttgcttcttgtttggccgagtggtcaaacaacgactcaaataaagtttccgtggactttgaaagcctagacgaaatcgaaaatcctgtgaaccttaattttcatcaccatgaagagcttgtcaaccggagcgcagacgaactggaggcatacgataatatcctgaacgaacctttgccacagcgaacgaagagcctacaaaactgggtacgaggaatgtgttaagagaagcgcccana

SEQ ID NO: 3653 - DNA, 479 bp, Fusarium venenatum
  misc_feature (1)...(479): n = A,T,C or G
ggggcacgccgacaatggatctagcatgcaattgtcaagatatctactcgctaggtctcgtcttcctaaacatcgcaacagttctatacaatgtccggttggccgactttgacgaagctctgaaatatccatccaagaaatacacaagaagaacagctttgcgagcgagagaagaagctgaacgcccaacttgaaaagctcacatcccatgctctggtcacgccaacttttatgtttacttatgaagggcaagaaacggtccgtcccaagncaatttgtaaacttaattgctccaatgatcacccgaaacccgaaaagtcgactgcatgcgtacaagatagacgaaaaagtttgtccatgctggggaaggattcatcaaatatatcaangggaatgnttncaaaagaacgatttcctggggccaaggcaaattgggacaaagaagctcacgacnttgacaagtccnccgaaggggaaac

SEQ ID NO: 3654 - DNA, 590 bp, Fusarium venenatum
  misc_feature (1)...(590): n = A,T,C or G
caactggcgcctggtcattccgcttaacaaggttattgagtaccgaatcaccgatgccgtcaatgatcctatggagttgaagcccgtggcagcatggtctccagaggaacttgtcacagccgcgcaatctgctcttggcgacnaggcagctcagtgggtttccgaagccatacccatagcgcagtggtgggtcaaggaacgccaacgtctctggcggtaccacagcttgtcatcatagacgttgacattttttattatttttatctcttgcatcacaaggcgtttttggggactttattcgctcaaacttcatctctcgtgtcggtatttccacacaaatgcatctactatatatcatcactacaagcgtgaacgacgaacacccgctctaacaccagatttgtccccggatggatgagactcggaagggctcgcggtggtttacgatcatctcttgaaaacacagcgataataatatcttgacattttctctctacaattcttgtaaaaaagantgtgacaaacttgggttgggtggcggcagtcgatccaatgcggaatagaacggaagaattccaatcttgtctttt

SEQ ID NO: 3655 - DNA, 357 bp, Fusarium venenatum
  misc_feature (1)...(357): n = A,T,C or G
ttcgcggccgnaagaatttttttttttttttttnccatngaataagtttnnaaagttcaatcgtacaatgtcaattnttntgtcctgcactcgctacgcctgaaaacanattaaggaaatgcnaaacagttcgtcctttccctaaccgnaaccttaatcacctggncccctaaattccattccaaaggacgtnttccatgcattgcatttcatgccccattcctgtgtctttgccactttatatgttccatcgcagcataccattanagtaaacaaaancctataaaaanaaaatcgaaaaaaaggaattggatgtcaacaagcagccgccaaatccaattcgcatgcgtttgaagt

SEQ ID NO: 3656 - DNA, 588 bp, Fusarium venenatum
  misc_feature (1)...(588): n = A,T,C or G
gagcggtcaactttctatgtcacgagaagaagaacagacagtacatcccgctctcttccgtgcaaaacaactactacgagagattgtgtactacgatgcatctcagccgaaacccctcctacgaatcgaagccagttttcctccccggactcccattgatagtcgtccttcgactgaacggaacgtgctcttaagggaatgcacacgacggtacctagtctcgttggatttcgcagcctcaaactcgcaaagcatgagtgtcaggcaatggctaggagtttttatctctctttgcatctttagtgctgtggacactattttggtagaccttgcttggtccttccagggaaatgacccgtcgcaagcaggtncaacaccgacagaaagacctgaccaagttatccgaagcgtgtaccaggtgctagtttctctattcagtacttcgaacgatcccttggcgaacagctctgaatccgacgacgcaattgtccacaacatcgctcgaattatcaggcgcgaatactggcctcctaggcaccttttctcaagcatcgactttcttatgaancttggtgcaggcgaaacacc

SEQ ID NO: 3657 - DNA, 401 bp, Fusarium venenatum
cgacattgacgacatttaagctccttcctggaatcaccaaatccccttctctctccaccgagcccccgacctggtcccgggtgctttacgcgttcctcggctggcgttgttgatactgtcttctctctcaaacccggagccgagcactaaaactctgtgcgtcgggtcccacgacagtagttgctgtggagtcatagacagccatggtgggagggacgtcatggcgtgtcgctctcttgtcggtttacaatatcacgtttgagttttctgtcttggtctgttattaaggtagttttactggacgaacatggtttttttcttaacgcgtcatggtcatcgcattcatctcaaaagcacagggttacttagacaagacaagaaaatgcatacaattctttcat

SEQ ID NO: 3658 - DNA, 438 bp, Fusarium venenatum
cttgaaagtgttgatgccgtgaagcaaagattgaggaaaagcaggatcacttctctacgattgaacgaacccgaaaaaaacgaaacaaagaaattagatattacacgattctgttcagagcgacggttgactcttggtctgttgattctttctgtggagctctttgggactctgcctgtagtgagtctttcttatagcggcttaacgtcagtcttgatgaaagagacagtgcaatactttggggaaagaatgtcaaggcattacgaatgatgccaaggaaattcatcttacagcctttgcggagaccagctacacttgtatgccatgtctcacaggggattgttgtatactaaaaaagatttgcaagggctcttctgacgtatctgcgtcttgtagctttttatgactcggcaattgatgttgtttatggaaaaaaaa

SEQ ID NO: 3659 - DNA, 462 bp, Fusarium venenatum
  misc_feature (1)...(462): n = A,T,C or G
gtctagagcctgcagagggcatttatctacacgtacctcttaattatcccacgagaatcaacgaacggagttggttccaaccaagcaaattgcctattgagggcctgtcgtggacgtaaacacgcccgtcggttcaaggaccacacattgggtcgtcctattcccggctctanaatacgttggcgatactggaactctagcagacctcacaactttcaatcgcaagatgtatcacgatgcgtgtgtagtggagaaggggttactcaacttgaacttctttcaagtttttgaaaagacaggttcaaacgcttgtcacggtatcacatggcacggggaacaaaagttatgggttatagttattcagcatttcgtcaatcataaatgtattaagatttgaagatcatataaacccttctgaacaacnattcccagccgagggccaacccggcagaagccgtttat

SEQ ID NO: 3660 - DNA, 184 bp, Fusarium venenatum
  misc_feature (1)...(184): n = A,T,C or G
atgatactactttgactggtgtctactttgatcctaagcgagagagggctcagcctcatgccttgacggcagatcaagataagcaggaggctgtagttaaggcttgtgaggacctcactggtgtaaagcttcaaagctcctaggtgtagaaaatacaaacgcataaagaatacatacaaaanan

SEQ ID NO: 3661 - DNA, 321 bp, Fusarium venenatum
  misc_feature (1)...(321): n = A,T,C or G
tgatcgcaattagattggtagagctccaacataattcttgtggtctttagttgccgttgtgcatcgtctcggtcatctaataccgaacaacagcatcatgacaacgacgagataaactcggatcagcaacttggacaatgttattttatttcgaatgttaacccggctgataccgaatagttgcatactggttgaagataccgcatacatgtgaggattttctcggctgacgaccagggttctttaccaatacgagtcgtggtcagtcaaatgcgttgagcactacatacgtctttcaatttacaacaactttggaanttt

SEQ ID NO: 3662 - DNA, 636 bp, Fusarium venenatum
  misc_feature (1)...(636): n = A,T,C or G
ggaaacatgggtatggtgtaaaggtctgagagctcacttaagttgaagctgagttgtanactactgagttgagatgcaacccaaagggggcagagtcgaatacctattccgagtattgatggttttaaaactacaggtgtttttctatgaacacgccctgagatgtcccaacccacgctaggatcatcgtggacggcagctgcggctgtaagtactgcatgtacctgtccactaaagttgggcgctcacagcacatctnggtacctacnaagctgccttcctccactttnggggacctagtgcaacgaatcttgggaaacccagtgggaaccgctcctcagttcacactgtatattttctgggcgcatccatcaatcgagctcgacatctgcatcgaacagatgcctattggacatgacaaagacgtcaaccatgtgcttttgcaacgtctcgcacacactgnaactttccatcgcatggncaacgcttggccaggttgccaaaccaaaanactggtnttgggaccccaagaagacccccccntttgcanattgccctgtncaaaaggnggggctaacaatggttnttaaccttcatcaaaanacaggcaaggatgnctttgaccctccctttgtc

SEQ ID NO: 3663 - DNA, 360 bp, Fusarium venenatum
ggcttccagtgttgccctgcgtttaggtaatggcgataagattatgactcagcctgacttcggaggctcttggggaagccttgtcggacgttacactccgtgggtagaatagagtttgggcggcttggtcctattgttcttgaatactcagaattgtgatgggtggattgcaaggcataaggtttcctttgaaatgccagttgctacccaggcgggttgtgtggagagtgcgattgaggatataaggggtccgtctgcgattcgatgtgcgaataaagaaggtgatctgtggttatgattcagtactacatttagtcaagagatccttctatcaattaagtataaaatacatgtgctttt

SEQ ID NO: 3664 - DNA, 789 bp, Fusarium venenatum
  misc_feature (1)...(789): n = A,T,C or G
gaatttttttttttttttttattgaacatgttttttatttgtttagttaattaactaatactgcaacgacaaaacaacgagcagggaagcgttgtagcaaagaaaacttgtccttgtgcaaggaaatcgccaccagggcaatctatttccttgaaacgccatttgaaccagcatcttcaaccgctggaatcatcaaaggtccagagaaggatggaaaacactgctcggcagttcaccgttccctcctctttggcggtaacccataggcgcgcataaacaagtctgggcagaccaagctaatctgtgaaccgtatgataccaaggggttgtaggggagatgaatcctacattctgccctaggccatttcctcatcttggaactctcagtatttcaatcaattccgaaagtgagcagctgtaagatccatcctcgaagcgggcgtccttccaactcacccagaggcccgtctagcaggctcaattggtaaagtggttgtcacctcaactcggcaatctccaaccattcactttcggggcgctaaatacttgagagtagagatgtttttgatggttggccagggcaagcggccagacagaaactgcgcaatcaaatctgcacaagcaaatgtggtgcacagctcattgggaagaatcccatgacttcactccgtctttccattcccgcgcgtccggtagaatttcgngaaaacctgacgcgcaanaacataaccttgangncgaagtcttnggaaccatngacaatgntcaagtccaanatccaggacaagg

SEQ ID NO: 3665 - DNA, 189 bp, Fusarium venenatum
  misc_feature (1)...(189): n = A,T,C or G
ggctagtatcaatgcatagtggcttgaaagatctcaatgaggggacatgctggttttcccggagaattatggtggtctggagtctattacaagcatgtggaaactttacggtacactgtgtcgcggactccgagcatcgtgcccgtcgctcacnaataatatcggcgaactcccgctaatgtcgttcct

SEQ ID NO: 3666 - DNA, 213 bp, Fusarium venenatum
  misc_feature (1)...(213): n = A,T,C or G
nactgaggcaantantgaaacttngagtgaagnttggcaacggtgagagnnaggagcactaaactntatacccgaaaaattgntgcggctcttggagaatgnatttggaggaatanattggcctannccgactgttnntcaataantgcaccgtggttggaaaattcncacngtaaancccnggtgttncgaatgaattcctngnaaaaaata

SEQ ID NO: 3667 - DNA, 106 bp, Fusarium venenatum
  misc_feature (1)...(106): n = A,T,C or G
ntcctctatgataagacgaatccattgcattggcctcgaatgcaatgtgtcgacngtanactctgctatncccatgnaaacctctngccatnatcgtatttggtca

SEQ ID NO: 3668 - DNA, 344 bp, Fusarium venenatum
ctctcaggggtcagcgagcccagcagccgaccaacctcaggaatcaacaagcctttgcctggcccgcctgtacccacaaaggaggacgacggatttcagacagagggagtcgtaggttcgaaggacaaactggctggtgcaagtcctcaccctgacgtgaatggggcggcgacgaaggattgatgaaccaatatagtctggctatatgggacgaccgcgccatgggatacatgatatgatagcacaaaccgaactgtgtgacttttctttttagcgacatccatatatatatgacatttagtataactcgtcagaatctataatttatacttgattaagtcaca

SEQ ID NO: 3669 - DNA, 1476 bp, Fusarium venenatum
  misc_feature (1)...(1476): n = A,T,C or G
atagaactatcatccatcatggacacggcatatcggcgtttattgcataaggaacggtgtttcnaacaagtcttaanaatatcccctctcgcattttttttttgttttttttttgttnatatatctttcttttgtcttcatagcaagcgttnttttgggtttcgganaatttggtctattattcctctccgggaaacaactcttcaacggtcgttcacacaactcctatcgtctctggacttttctttcatctaccacaacaccacatggctggatccggggcgggtatttggatgcatttacaactggcagggactcgatacaggcggcttgttttattttggcctttttccttccgtcatatttggttctcaagaaaaagacgtacacgcagcaatgcacgacgctcggttctagtccgagacagaaacttctctatggaatcttcgctgatatccttggaactttcttttttccttcttctttcatatgttcggtttagagaggcttcttggaagataccccccccacaaggacaacaccagagttcaacaactcgaatcgacacatacttttgcttctttccttggcttttcctgattcacgacgattctatattaatgacgacctttcctacgactcgacgacgaatgacgactactttcagacatgatgcgacttacgaacggaatcacgaataatcggcttgacgtcgaacatgacttcttttcgaaagcttatcgagcgctgagcttcacactccattcggcacgatgactagcacaacagatggtaactggaccggctccaggacgccaattctgaccgcaaggccgtctcgactacatcgcgtagccacttcggaaatatctggaatatacccgtgaaggcttgacactggttgtcaaacgggatcaccacccagcgtcggcgttccaaactcaaccggacgcgcgggaatggaaagacggagtgaagtcatgggattcttccaatgagctgtgcaccacatctgctgtgcagatttgattgcgcagtctctgtctggccgctgccctggccaaccatcaaaaacatctctactctcaagtatttagcgccccgaaagtgaatggttggagattgccgagttgaggtgacaaccacttaccaattgagcctgctagacgggcctctgggtgagtggaggacgcccgcttcgaggatggatcttacagctgctcactttcggagtgattgaaatactgagagtcaagatgaggatggcctagggcagaatgtanggatcatcttcctacaaccccttggtatcatacgggtcacagagtancttggtctgccanacttgttatggccctatgggtaaccgccaaagaggagggaacggtgactgccgagcagtgtataccatccttctctggacctttgataagtccagcggtttgaagatgctggtacaaatggcgtgcaaggaaa

SEQ ID NO: 3670 - DNA, 678 bp, Fusarium venenatum
  misc_feature (1)...(678): n = A,T,C or G
tcagcatatatcaagatgctcaaccttgctacaaaccgcatagttgacgcctctgtaccggtagaaatgctgatacatgccatatgatcaacaaggcaatcaatgatccataggtaagacagagtcatcaatatgcggcaagccgttgctggcatgacagcgaacagagatgagatgagctcgagtgagtatcaacacagctccttcaccatcacctctggaaacttggaagaagtcttcttcgaatctaagccctcttttctatctcatttgtctttctcaaagacttggaggcactcaaaaccatgttgcagtggttgcgatatcccaagcctcttctctctcacatcttgtggtagcccagcttcttaccggatttacttcggatcttgcagctccgagctgcgggcaaaaagccagagctaccatgtacgtaccgccaaaactacagatcaggtcgttcttgccagancccagcctgctgtttgtctgcctgaangaacaacctagctgcagtacatcagcaccgcaccaccgaatncatcacccactaaatttctgncactcgattactcgatcccgcgtttttttatcatcaacaacatcaatcgattattcgacgttcgggtaccgngttcgaatccttgggcacccatcttaaaattttggatccttttn

SEQ ID NO: 3671 - DNA, 104 bp, Fusarium venenatum
  misc_feature (1)...(104): n = A,T,C or G
nagtgaactganttgangagagcgatgacgctatggcgaaatctaatagctagcttgngaaggaggaaatgggttagaagaagacaaatcccatgcctttanct

SEQ ID NO: 3672 - DNA, 272 bp, Fusarium venenatum
gctttctggaagtatcacaatgagggcgtcctgaagaagtacggaaaagacctcaagattggtgctgttggcgagagtgccaagctataagtccttctctctgctggcctcttgggtttcatttgacatctgaatcggctgcaatgctttgttaattttggctgtatttattctgatttgtttgtacggcatggcgtataccatatattggatagggaaacttgacaggtggatttgcaatagattggaagagcatcttgaaaaaaaaaaaa

SEQ ID NO: 3673 - DNA, 115 bp, Fusarium venenatum
  misc_feature (1)...(115): n = A,T,C or G
nggtgcctctanaancgccggtgggntgttatttggggcttccggggcggngntttcccccaaaaaaagggaggggttnatttgnggttttcacancanaggcggtttttaatac

SEQ ID NO: 3674 - DNA, 560 bp, Fusarium venenatum
  misc_feature (1)...(560): n = A,T,C or G
ccgagacagtgcaggggaaatatctgcaaatgaaagcttggtacgacagcatggtacaagaccaggaagtccttcagcgtcggttaagactgccaaaaaggtcatcaagcagagagaggatgaatacaacacccttgctgaagagcgggatatgttgttgaacagaatacgagaaaacagagagcatatgcagatgctctgcagccctggaggtatatttcacgccctagcacccaaacagagaggcgttgttgtcccgagctcacacggacagcgtggctttcagcagcaagcttccagaacacangtacacagtagacaagagcatggcctctcggctttgttacaggctatgagccaggataacaacagcgcgccttcaacgccgatgcatattcaccgccctccacaacgacacgtcggaaagcatagtcggaatgcccaatcaatgtcgtctttgcctacaacgcctatgagtcgacccgcaggaccacntgttggaacttttaccntcggttgatcttgttcctcaaccgggaacctccaacgattatacccgg

SEQ ID NO: 3675 - DNA, 904 bp, Fusarium venenatum
  misc_feature (1)...(904): n = A,T,C or G
gcaatagccgcaaccgtcatgatgaagagcctttggcgccaagactgcttagaaaaggacaccactcgaggaaccacgcaagaatcatgctgttgtctagcgttgaaggcatcactattgtgtgctgctactacttacatgcatgcgcatgagataaaaacgcagatatatcgtacatagattaacagcatggataacaccccttcatcataggcgctctcataactattcagtcatcctccttacatagggatcctcgctatctcctctttggtccaatactttctcatattgttggcaccaagagtctcaacctcctgatccaagtgagtccagaggacctcaccccacgactccatcttggtcttgagcacgctcagctcaaactcctcatctccggtacggcacttcttgagatattcctcgaacccgtccaggcccgcgtgtatctgcttatgctggcgcaacagctcggcgcgtccgccgcgaaactcgggcatcttcttggcaaggatgggaaagacatatgtctcctcaatattgtggtgtacagtgagatgttcaacgaattgcaggccttccataatgaactgtttgagggacaaaatttgaggtctgcggttgtttgtgcatgcattccataagagattccatgatcttcggaagttatcgtgctatggatcatattaagtctatgttgtcgaacttttggtcagcctaatcttacaaaagtagttcatatgaacagctagtccggtataaccttaaaggcatngncagacaacngggggtagttncttccgctttgtcttgacgggctttgaccatcttcgnttttgggtcaaaaatgaatgnttgctgatgataantccagatgtaaaacgtcttctanaaataaaagttt

SEQ ID NO: 3676 - DNA, 613 bp, Fusarium venenatum
  misc_feature (1)...(613): n = A,T,C or G
ccagtcagctccgtccgaggaagagaacggcgattccnttcatagcaacaagcgcccggaagaaacacccgnntatgtcgagcgttccaggcaccttgacggaaacattatcatcactactgacagaacgggcaagatcaaagtattccgacaggactgcncccataaaaaaaggcagcagggattgtgggagtcaggctctagattgtccaatcgcctgtctggcgttggtagaagtggaagtgtcatgaccagaacgagtgctagcagtcgtgtacagtctaggcgtggatcgctcactattcctggncccaaccctattcaacttcagcatgcttccgacagaatcaacagttggcgacaagatatcgatggagggcgacccggtctagcccccgccccancacgaagcgaacggtccatgtcaccaagtaaagcaggctcagtcacctgtcaattcggctgcaaagctggcggcagagtcttcnaaaacagccttacgcatcgagtctaattactcgtcctgcccaacaagtccccgttggcagtggcttgtcccncccgnccacgattagagcttcgaatgcccgngatagaaataacngtttcncac

SEQ ID NO: 3677 - DNA, 590 bp, Fusarium venenatum
  misc_feature (1)...(590): n = A,T,C or G
nggggcccaccanccgtatnaagctcgagttcagcaactatgctcgtgtagacattgcacgacgaggtggacgcacaaacaagcgatatgaatttgagnggnggggtcacacgtacgcctggaaacgtgtcattgacaagaacctcaatgttgtctcatttcaccttgtccgagacggtcatggtgcacctattgcacacatcgtccccgaaatgcgcagtcctaaccaagttctcgacnacnaaatggctggtgcttgggttactccttgctacatctggattagcgacagcagcattattgatgccataacagacgtggctgatgtgattatttccaccggcctnatttcccttgtcgacgactgcatcaaggagcgatggcaagcaaagaaaccttcgcaccgtgccatccggagggacaccgaccatgtgaaccactccaacccttggttattcatgcccaagtttttttcaacgtcccactnaaaaaaccctcgtcaagccgtggctngttgangtttggncccaaacctattgntgngtactaacatgcaaccgctttcaatactttaatcgaaccgttttgat

SEQ ID NO: 3678 - DNA, 390 bp, Fusarium venenatum
  misc_feature (1)...(390): n = A,T,C or G
tgcctctcgtcgntcccggtntcaactcaacttctggcgacaaggccgaagagtggnagaacaagctcatcggcaagaagctntccgatgatgatgcttccaccgagacggtgtttgccaagcgagatcttccccangaaacgcgcatcatcgagcccggaatgatggttacaaaggactttaaggaagacagactcantgtccacctcaaggatgacggaactgtctcacatgtcgtcaagggttaatggggctgctggtgtcgagacagcccctccattnctcgnttgatgatggggcaataattaatgtncgataacgattacctacgaatgggaacaggatcgccgtaataataaaggcgcaagagaacaacgngattatactttn

SEQ ID NO: 3679 - DNA, 643 bp, Fusarium venenatum
  misc_feature (1)...(643): n = A,T,C or G
gcaatattggcagcgtcatgcatcgctcgagttcttanagacattctatctcgcgggaatgcgcgttttctcatggcaattacatgctggtattgtggaacggccttnattgcacttctacaagcagctcggatcaaacagttctcgcaggaagcanaagagggtttagacattttggatcaagccgttggccagctccagcatatgtgggcttctgcgaatgtcataanacaaggctttgaacgacttcgcgcaatgcctcgaactatgatacatgctggcaaacccaagactactaccaacagtggtggnggaggggatacaagttcaccatccagagattttgactgggtgctcctgtttccatttgngacgagatcgacgagcaggatcacggattgtctccttgctgacaatgagtttggtaccacnacaacagctttaccatcgccggaaaatgccgtttttcatgaagacttactcaatcgctatcatgatttactggaaccttttggtgactacaacttttgactttggnactatcgagttggatattntttaatcacaaacncacgcctncgggtgtcatgtnctgngaaaaaaatncccctgcttaaanaaaactcttgatgaaaaaaaaaaa

SEQ ID NO: 3680 - DNA, 236 bp, Fusarium venenatum
  misc_feature (1)...(236): n = A,T,C or G
agcgctatggagtctgggtcaactgtgagggcaaatcaagtaatgagtgtcaagggcgcacagggttgacacggggactggcaagacctcattgtcatgtttttgttcgagtttcggttaggcgatcgtgggtatttgtagttggtatgttttttgttggaagtctgtggtaacagattgccgacactattgtatagtactttgttaaaattctttataaaacctcagaccagcnn

SEQ ID NO: 3681 - DNA, 635 bp, Fusarium venenatum
  misc_feature (1)...(635): n = A,T,C or G
gttccgtctgcgattgaggatgtagtcgagtttgttgatctggctccatcttcaaaggccggcaaggcaaagcgcagtcgtgctgtcaagccagtgccanataccctgccaccaccatacaagctctntgtggnggacgatctgcgtaactgtagtgaaagctggactcccgcttgtatccgaaaactctacggcattcctcttggtaccaaggccgcaaanaacaactccatgggtctctttgggtatggggacccgtatcaaccctcanatctgaacattttctgggcaaagcacgctccattcatccccaagggaacgaagcctaaagtcaacagtattaacggcgccaaggcagagggcgtccccgtcgaaggcgaanagctgctcgacatccaaatgtcgtatcccattgtctaccctcaactgttacaatgttccaggtcccctacaacaacaagggnggcttgggaatgacttcctcgacnccgntgatgcaacttttgtaagtatgatggnggcgaagacccttgtttnatctccgtttcccctttnanggatacaaaagcccttccatgtgcngnaagtccaaattacaaacgttgttttaatttntttcgcaattgatgaacaaa

SEQ ID NO: 3682 - DNA, 192 bp, Fusarium venenatum
  misc_feature (1)...(192): n = A,T,C or G
agacagagaggtttatcctgacggagcaagccaatattattgaggttttcanggggcagggtgacttgaagcccatcaacgagtcggatccgacattctgatctcctccttgggatttttctagatggatcagatgaatagacgaaagcgtntntttagacggngaactgaatagatattgtactatccgtc

SEQ ID NO: 3683 - DNA, 653 bp, Fusarium venenatum
  misc_feature (1)...(653): n = A,T,C or G
gttccgcaatatggacatgttctttgtcaagctgtctgacctaatgtataccgtgtccaacatcccacatctccgcaacacccagcttgcggtcgaataccgtgagcttctggagtcagaggcacaaagtatgcattggggnnggggtaccgngccagaagtggaagcaagatccagatgctgctcgctatcatggactcgctcctcgttgcaaatactatgtcaacggaacactggtgggcgaggatatgcctcagctagcacaaacaagtagcactnctttccccgataagaaggtgccacgacgcggactggtgcaagtatttccagatgatcctgactatgcgcggctctgtttggaacaaggtctagagcatnttatcaacggccacctcacccacctctcgtcaatggcatacattcttctccaattaagncaaaaatcgatcgtgtcaggacacgatatcaacggccttttaaaggctttgacncccggatcgacaattgagagcttgccaatgccatcagcaggccacgaagatctgaccaacggnttaatggaaaaacnaatgggacctcncnctgaatcggatgagttccacatgatgatcgaacatnccttgtttattattgctttcangttttntttggaa

SEQ ID NO: 3684 - DNA, 732 bp, Fusarium venenatum
  misc_feature (1)...(732): n = A,T,C or G
ctttgccctctctaacatccattcaaataagctgaggtcatcatagaaccaacgatgactactattcctacgacaacacgtctcgacatattgcatgccttttaatttctattgacatttcatatgctttcctatgctcaattataaacgggcaataactcgcataacaacaatatgacactcttgtcaccgttcctaccattcatttcatttatcagatatcgtcaatcttgcaaacatcatgttctatgcagatttgcgcaggcgtgatgttgcgtttggttctaatgaatttgagcgggtcaaattgcttccaagtttggaggaatgagattgaccaagtggccgatcctcgatgaagtgacatgggggcgttcatgggagcatatttttcagggggagtcgttttgtgttacaattttgagcttttgcgacaactccggttatgtttttttagngggacaccagcttttggcctaaatgnacggacgccatttcaccttttaagacaatcattgggtgnggggggaaattgcactgttcaaggncccatataaggnggggaaaaacgtcgtttcgtttacttttgaaccaaaacanacaatnttntcaacgttcaaactacggggtaaaaaaacaccgcggccaaaaagagtttcgaagatgcggcacccaccaacagggttgatggagggatcttgctttgggaattgggtgggggcccaaattccc

SEQ ID NO: 3685 - DNA, 171 bp, Fusarium venenatum
  misc_feature (1)...(171): n = A,T,C or G
tccttatgggtctatgggtcatgggtctcacgacgttacaaaaagtagttgtattggtngagaaagactctttctggtgggaanagcatgtcccttcttgatttttgggcaattattgaaagtgatgttatataagaaagtctaatacaaagctcatgaatcgcgacgaan

SEQ ID NO: 3686 - DNA, 265 bp, Fusarium venenatum
  misc_feature (1)...(265): n = A,T,C or G
cttgcagctagagaaattgccgcagcttgtgattcaaagactaaacaagaacaagaaaggtgccatgcaacgtaagcccgttatcgaagaagctcaaaagctgtgagggagccaactcgacaccaatgcagcttnttatcgtacctacgcagagtatcaagtgaacaaggcagcatatcatcgtgagtgcaagggcaagtaaagtgaccgggtttatcttatatgaatagtaactctgtattaccaaactagtcatcgaatcctg

SEQ ID NO: 3687 - DNA, 299 bp, Fusarium venenatum
  misc_feature (1)...(299): n = A,T,C or G
naggagtcacaacaactctgagatatttatntnctgtcatcacatcngcngagattgaaaactcacatggatctganacngacactgggnttacgcacgttcatacagngctctngcatgcgatgtcaacgctgctaagcntcgatcagtcacganaatgtngactcnctcaaatatgctgcgtgatgcaatgggnctctnggtccacaacatcacaganatttctggactaacggccangcagtgcatatgacaagtcngctntggagtgaacatgccangganacaacatgggggtc

SEQ ID NO: 3688 - DNA, 442 bp, Fusarium venenatum
  misc_feature (1)...(442): n = A,T,C or G
acgaccctgacctccagaacgctgctcctcgatcagttggttcagtcctgggtgcagttgttggtatggtctttggcggtttcattcttctgtgagcagaagactatcttcacatttctccgcatcacgcgacgatcaccacacagtcattgtggtagatgaacaaagctgttcggtcatggacggcagctcatataatatgggctcattatgaattttacggtcctttcctcacgggtacaaaattgggtaaatagaataggacaacatcagacgcttgggtatatggggaagcgtgttatcattagacgagagcttncacgtaaggttgcatctcgaaggagatatggatcattaattgggcgcttagcatattagcagacagcgatcgtatntaaaggcatagtacatgagcgaatacaagccattgcttanaaaaaaa

SEQ ID NO: 3689 - DNA, 610 bp, Fusarium venenatum
  misc_feature (1)...(610): n = A,T,C or G
atggattctcaagtggccaaacggacttgtttctcttacgcgcctgattaagatgatccaaggaaaaaccattggccatttgttggttaatagtctctgaagctattaaaccgaactccaaaattgtctccatccggaacccttgagctttcacccgtatatcttccgtgaactccccgtcacaggtggagccaccgcacaaactccgacaaagaaagtgtccccggtttgaaaaacaacccgctcgcctacggccccagatcactaaagggaattcatgacacatattttcgaggatctgagtgataatctgccttacttcggatctattgatatcatcgacgatacctcacgaaattgcttcgctctcacagtccattttggtggctaccgagcccttgaaatctgccggactagatctgcagtgcaagccaaggcagaacgtcatagcccctgctcatggctgacgcgggggcttctaaggtcctacaaaacaatgcaaagagaaccctgaaccgttgcagaaaatcaattcctaagggcggaccgcgggtgtcntcaataanttgcctccgtcaagtcnaagtcacgttcgaatccaacggtaacg

SEQ ID NO: 3690 - DNA, 183 bp, Fusarium venenatum
  misc_feature (1)...(183): n = A,T,C or G
caagaaagccacatcaaagtgcaacggaaaaagtcaatcagatatgtttgaccagctgtgatgcgatattgagcaaaaacagcattgcagtcgagtcattgatagaatttacgtattagatccttgacaaggataacgttatgccgttatacccggcgcatgggttntatttccggcttctcg

SEQ ID NO: 3691 - DNA, 320 bp, Fusarium venenatum
  misc_feature (1)...(320): n = A,T,C or G
nccncgccgtcanccggganggtcaaggncnttcataaccgccgcccaantcttctgagttnttcccnctcnaagcaataatgcactgtcattaacatcggcgaccctganggtactcctcgantgatctcttanctttcttcnanccaaggctttgcctgtaaccctgaaatcntcnttccgtcttanatcgactgcgactatgttnccctcgataaccgccgcgattctgtgnacgagatcattctaagtgaccacgaatcaaanaacatgcttcngcattaaatcgccctgcantgcaccgtatactccggccaaag

SEQ ID NO: 3692 - DNA, 52 bp, Fusarium venenatum
  misc_feature (1)...(52): n = A,T,C or G
aacacaggaatacctgaagaatgatatntcgatcttgattcatcttagcttt

SEQ ID NO: 3693 - DNA, 589 bp, Fusarium venenatum
  misc_feature (1)...(589): n = A,T,C or G
tgacactcaagtttcaatgcgtattcagcacgatcgacaacctaaaccactatcacaacagactccgtctattcacgcaagtgcataggcatacggtgggagtcaaagcatcttatgatccgggcttggttcctcattccgccatggaaccttgagtttacagacatgaggtcggcatagtcttgccttgcacaaaagcgtcatcgtccttcaagcatgttggttcaatacatgtaagttctgttgcttttcctgacaccattcctcctggttcaccaagggttgaactgaagcgaccgttgttggcccgcgagtcagaattctttgtcgaaaatagttcaatgatcaatcgtttctctccacttctctactactttgtagaagatgttgaatggaaacatccacaacgctgaatctcctttggtgctgatgcagtaaacgcccagggctcgcaggggtgccaccaggatgctgggcaagccaatcaataacccaagccaaaacccagcagtttggtcacngcggctttagcaacgctaaaacgaaccagtggccccactanccnggggcgcagggancacatcccttc

SEQ ID NO: 3694 - DNA, 627 bp, Fusarium venenatum
  misc_feature (1)...(627): n = A,T,C or G
ctcgtcaatgttgttaattccgcggcccaaccgtacataaagatagacagcttggagctcttgaagccactgctcaacgccacatnttgggccacttggggaagcacgcctttggntatagcagccgatatagcgtccatatcccacagctcgtcgatgacggacacgggaatctgaacattggacggtaacgggtgaacagtgagtttctcaaaccgctcgcgaatgaggtcagaggacaattnttgtgtaccagtaccactccagggaatcaacaatctcccgcgttcgcgctcagactcggttccaacggttcgtaaaacatcatgaaaatgatctgcagcctcccgtgtgcatacgagcttacgacctgccaagactggatataacacacgagccatgagtccaccttggngcgcattttcttnatttatctgagcgcgcgttgccgtgactgccacgggtgnggttcaagatctaaatgtgtcaaatccgaaattaggtcgatgangatagtgngaacaaaaattgatcgnggatgtaagtgatgcccgttcatcccaatganggtcttaatggctttatcgagngggggactgggggcaaganacaaaatcgntgttttgn

SEQ ID NO: 3695 - DNA, 117 bp, Fusarium venenatum
  misc_feature (1)...(117): n = A,T,C or G
natcttgacgtggacggacgnttntttatccccctaccgatatcgccgcaangagatcttcaanaacganatgccctccaacatngangcttggcgcttacnggactntttgnggtc

SEQ ID NO: 3696 - DNA, 215 bp, Fusarium venenatum
  misc_feature (1)...(215): n = A,T,C or G
ttacggnttcgttgtctgttagttgagtcggtatctggggtctgtatacgtgtgttcatagcaggttcgaggctggtttcctcgtttcctaatgcagngacggtcctgtatctcctggttgcgaggtgctttctgtaacggcttcggcgttcggcatcggttatttcacgcgccgtaatgatgattgtggtaggctttaatcggaacatgttgat

SEQ ID NO: 3697 - DNA, 209 bp, Fusarium venenatum
gcgacagtcaccgctgctgttgtttgcctgtagccctggggtggtcacattgaccgatatgtgcgtttggtggttgtaggtagctgtggggaagacgttgcgtgctagaaggcgccctaaccacgatcatagtatagaacgaatcatcgatataggctcaataactctaacgcatctggacttgccaagttccaccgcgttttccagtg

SEQ ID NO: 3698 - DNA, 541 bp, Fusarium venenatum
  misc_feature (1)...(541): n = A,T,C or G
cgttaaaaaagaaacgcaaattaacatagcgatctgaagcaaacaaatactcaggatgaacccaatcattgacattgcccatcgccccgagacaccaaaaccagagcggcctgttatcccaaatganccacacgttggcgatggcgatggaactaccgactatctgcagtgaatacaacaatatgtgatcaaatttcggggaatatgctttctcttatgcatgcaccaaattgatgaaatgctgtctctccttcaaaggcgttttgggtgtgaaaggcggggaaacgaacactcatnattttcactgaacaaggctgcatcgactttacgtttgtattttgtctctcttttngggatattattttggatgngggatttttaaagtatatcattgttttcgttgagcgactgggatatttgtttttcgcatccgattgaattatcgttagctacgggctcaagtgttatattgcangctactggtataaattgnaacgacgatttggtttcnaatatttacaaagatttatttctcataaaa

SEQ ID NO: 3699 - DNA, 106 bp, Fusarium venenatum
  misc_feature (1)...(106): n = A,T,C or G
ctaatncanaacgctcacantctatttcaacatctcaccactcgcctacttgtgcttctattanaaaaccaagcatagtaccttgatgctctgtcatccnggagca

SEQ ID NO: 3700 - DNA, 647 bp, Fusarium venenatum
  misc_feature (1)...(647): n = A,T,C or G
aaagnccccccaaaagagttcatcaacgctttatcagcacgtcgttcatcgacgtcatcgctcatttttttctaatcactgntggatctctccagcttcgtctcgccactactaccgggttccacgggatctggtgcctattcctccaagtngaggagagatttaatacccattggtcatgttcgccgtcgcaaaanaatcttctaacctnttttcttccgactacataccgnggngacgggcttaataccatcacctttccttgggcgtntcttccccggcgcatcttgattgttgaatctgctttgcttgcatgcagtcttgacatttttgacagccttctcaacttactcattagaaaatatctacaaaacaaaactcgaacaaccaaccgacgaatccgtgagcgaccacaacccaacaactgngggtgctcgggaggagaacagttgtttgaaagcctggaaacaggnggatgtcagctgggcatnttttcacaatatcatgagttaccactcttcacgaacttctggatcgaccccgatccacgactacgacaggtttttcgaggatgtngtccgnaacacctacccctttcccgangccacctgggcaanacttacttccaaggcgaccaggggacgcgg

SEQ ID NO: 3701 - DNA, 452 bp, Fusarium venenatum
  misc_feature (1)...(452): n = A,T,C or G
ttttttttttttttttttttggnccgaaacccgaaaaacaccattgatttcatgctagtgtattgagcaaggaaggtgaaagcgtaactttcaatccccctcgtcgagtccagataacccccgcgtccgccagcaagtccctgtaccctatgccaaagctgacgccaacgacgaggatggaccgtaaatatgaccaccgaatgcaagcgaatcgagtctgtagcccaggatttcacgaccataaacaaaagagaagactgttgatcatgatggagacttagacggtcgttcagcggacataatcgtctgtatcgctgcactcgcgacttcagcattcgcatggcgtttggggatgttaactaagaacgactttttacgcttgtatatcaaaacattgccaggagangcttttagacatatttaataatcaacatcgtcgtggctaaaaaaaa

SEQ ID NO: 3702 - DNA, 115 bp, Fusarium venenatum
ggcttcaacgttgtttggtggtgttttgagcgcacgccagttcggcatggagtaaaagagttaacgacgcaaagtcacagtctcagcgcatgaattttacaacttcaatattaag

SEQ ID NO: 3703 - DNA, 374 bp, Fusarium venenatum
taatcgtcaaagcgaggacaatttcacggctctcatgagtgtcatgagtgaggttggcaagaccaacatgtttgcggcttcactagctgttcggttagcgcataacatgagagcttgtgctgtggatcacggcactgtcgggaaggttgagatgttaatggctgatctcgatattgacgcgccaattcctggtcaagaagatgcggagaatgggattgtggtgctttgtccaattgtaccaaaaccgggaccgattagcttggatgatggtctgttttggtagactggacttgcctgtcgggcttatctcgctgttatgcaataattaagaaaagtagatctgatctcaatacgaatttactttaaacgattaa

SEQ ID NO: 3704 - DNA, 733 bp, Fusarium venenatum
  misc_feature (1)...(733): n = A,T,C or G
gatgggagactnatttccgcattcagaagttattgccaccgacctttcaccaatacagcctcgaaacgtaccaccgaatgtcaactttttcgtcgaagactcctccgaaccctgggactactcgcaacctttcgattacatccatacacgagttacctctgggtgctggtctaactttaaggagcagattgcggaccaggcctttgaaactctgagaccaggtggctggttcgagtctcaagagtatgatgctaatgccatgtgtgatgacggaactctcattccagacggncactttgcaacatggnttngagaaatcaacgaanctgcgggattgatgggtcgaccaacaaatgtggntgggactcttcgtgattcatacgtcgaggcggcctttgttgatgtccaagtgcgcatttttaaaatggccatgaacgggtgggccaaagatgagcgttttaaagagcttggtncaatgtgggaaagaaactttctaatgggggtnaggtggtttctctttcgcccttttcaaccgtgtcttttagaggacaccggcccagatcgaggtttccgttggttgatgttaggcgggaactttttgacacccgaatcccnncctatataccaatacncgttgtaatcgnacanaaagccattccccggtgaaatatncaccccangggtgcccgttcacatgagggacaaaggaattcggaatcatacntancccccg

SEQ ID NO: 3705 - DNA, 300 bp, Fusarium venenatum
  misc_feature (1)...(300): n = A,T,C or G
tgctgagcgcanaanaactgttgctcaacctgctccttatcctcccgagtggtgatatacaccagtggtgatgagacgatactaggtgttggtactgatatgatttatgtagatgtcgaatgggagatggactgatttatcttgtttttatgatgacnaattgcattgatatttgggcggattggcaacttgctatattttacctgctgcttcanagacacccgcgcgactagaagcacatacacagacaaacacacaagctgttctttaatatatatgttntgntatgagaaaaaaaaa

SEQ ID NO: 3706 - DNA, 153 bp, Fusarium venenatum
  misc_feature (1)...(153): n = A,T,C or G
ntctgggcttacanggnccccaanagcccacaatcatggggtgggaggtttggaaccccacatnggattgcctntgcnaacanttgggccgtnactgacaaccgtgaggtggaaaaggttgggaaaggtttgaacctgactgnaaaagccgcc

SEQ ID NO: 3707 - DNA, 202 bp, Fusarium venenatum
  misc_feature (1)...(202): n = A,T,C or G
gaacaacctgcatgaagagcgagatcactgcttaaatacgcatcgcttatgagtttctctaacagaccaacactggaacgataggttttgtacggataacggttgaaccggngggtaggataatgaaacgcctgtaatagtccaantntacacaagcgccaatggatgtagcctacaatgacaaacaatgtncntttcctcc

SEQ ID NO: 3708 - DNA, 330 bp, Fusarium venenatum
tttacaacctacggcgcaactcaattctgtcgcgatggtgtcgcccttgtttccatcattgaacgatacatccccaatggctcttctatcttcgacagcttaactgaaggtattcagctactgagtttgccagttgaggccggggaggcagacggtttaacactcaaagaagctagtgatagagtattcacggataacgaggaggcacgcagggttctcgaggaactacatcttcaagagttgtcgccacaaagcgccagaaacattctgcaacgccgtgtagagaacaacgaaaatgtaggatggtaaagaatagattaaattgggtat

SEQ ID NO: 3709 - DNA, 261 bp, Fusarium venenatum
  misc_feature (1)...(261): n = A,T,C or G
cagctttgatagcaacggacgtaggaccaggacagcggctccaacgcaggggcggctcaagaaggaagagagctctatctacggtcgaagatggtagaatgctattaggcaaagccggcaacttgcgcaacgaagtgaatggaagttgcctccggctttgcctcactataatgactatacgcatggctctagaaagggaaggaaaggcgttttagaaggctgtaggattttatgatgcagtttancatgaaaaaaaaaaaa

SEQ ID NO: 3710 - DNA, 478 bp, Fusarium venenatum
  misc_feature (1)...(478): n = A,T,C or G
ngatttgtttgtctaacccgnaaatgagctgcctttnttttcttttntttaatccccccaaaaaaaaacgggtacgaagtccaantttnaacaaagttgtcgtnattgatgggaagggccattttnttggncgactcccttnattggcgccaancaacttnttacgggcaaaaaanngttatcgcccntgggaggccttaaatnttngagaattttcccccaacttaantccncccccctcgaaaaaaaccgaacaacccccccgggggggccttcaattcggctntttnaaatttttaaaggcgcggggatgatccccnaaaacnccggggccgttttttancctnaggtttangggncccttntaaaaaaaaaaagggggtcccagtttcggtttcatccnccgccaatttnattgggcgntntcaaaggngtgaaacaaatctnccatggagaaaaaagtanggccctttaaaca

SEQ ID NO: 3711 - DNA, 356 bp, Fusarium venenatum
  misc_feature (1)...(356): n = A,T,C or G
gatctgcgtcagcatcaattcatgccaatatgtgcgttactgccaagtcttagcagcagcgtttaacacgaatcatatctacatacctacctaggcaccttgctaccgaaacccctcgactnaaanggtgtcataccaaagtactttcaaagaccttgaacccaggtacaaaagccggacgcatacgaacacgcaaattcatttcttccactattctcagaactcgaagagcgacaaacatgaaattcgctattcttcttgccagtgtcgnggctgttgctgcagcgcctntatcacggacgacagatggcggnttatgacttacaacattcgnntggccctaaccccctgagcga

SEQ ID NO: 3712 - DNA, 451 bp, Fusarium venenatum
  misc_feature (1)...(451): n = A,T,C or G
caattatctacaggtcaattatgcccaacacgaaattcaaacatcgaaagcaaccttcgaattcacagcacaacacttgcacttccagccaggatgctttcatcaattatatatgccgaattctatatcttctcttcaacggcnaaagacgctcgcggnttanacatcgaacgataccgccatctagatctgtttaccgttcgccgnggctgaacatctactaatatgcaacaccaaaacttttntgggactgcactacccgtctcgttcaatcattacttaaagtgtttgnacaaatagtattgctcccttgctctactctangcaggaagtcgctcaaaacttgaactcgtgttctggcccttcngaatctttgccataatctgnatgattgaatcatgcggctggaaataggtaaataatgcctgcgaanggaanacacatggccctt

SEQ ID NO: 3713 - DNA, 349 bp, Fusarium venenatum
  misc_feature (1)...(349): n = A,T,C or G
gtcgcgttggacaagttcaagtttgaattcctgcatcatttgaattctttttacgcttgtgtaacgtcattnnaaaatcccgttgatatctntatcggatcagttcaatgtcagaagagttgactctccctcctctccctgctgtgtctngggatgagcagtcccaaactttcagcaacaacccccggaaacgcgtccgcaatgccggttccaagcacgcgcctccctngggcttnaacaattcaagtgatcccgccatattctctagtgatgacgatcccgcgttggacaactatgtagaaggcaggcgaaagaananatacattggttcttggtttcaaaaaaaaaa

SEQ ID NO: 3714 - DNA, 135 bp, Fusarium venenatum
  misc_feature (1)...(135): n = A,T,C or G
nacacatatgggacttcctcctagaggtangagggnctttgaaaaggctatgaagaataaaaggaatcaaaacgtnaatgcaantntgtcgtnaagggcattcctgcggcngatcgancatgcatctagagggcc

SEQ ID NO: 3715 - DNA, 591 bp, Fusarium venenatum
  misc_feature (1)...(591): n = A,T,C or G
attaggctccgtctacggaaattatgtcgctctatcaccgcctaaccccagtcaccatgttgcaccctcgaccggagactcggttcgtggcttgcttttgacaaanaaacactcgaccaaggtggcactagctccttgggggttattagcgctgcagtctgctgctctcaccttgcgttacccagacataccaacctctgtcatccggcacggtgcagagaacgggcttaacaccaacctcgtaacatggtctcctgcaactgtgataccgttggcccttattttcagcgctggaattcctcttcgtttgatcccatacgcatcgctggggaagaactttacatttgcgctcaaaaggccggaccagttgaaaacgacgggtatatatcaatatgtccagcaccaagttataccggccttctcatcctcatattttccaacgcagcacttctcggcagactggatgggcctatcagctgttggattcctccacaatattacaatgccttgtattggacagtgggcatactcgcaccatgtgcatcacttttcctgtgtggcatatggaaaanaatatgttgaagaaaaaaa

SEQ ID NO: 3716 - DNA, 426 bp, Fusarium venenatum
  misc_feature (1)...(426): n = A,T,C or G
nccccactgaatagcatcctacaccccttgctagaagcctggaagcttacaaggaagcnttacaagaggaaaggtaaactaaaaaggtgagagcacgaggattttatnggggcttnctttctacaaattcacattccgactttcgacacgacctgtgacataaagctctgattttgcgaccctgcgtgcttttccattacctgcttagtactcacgcatttcgagccagtgttggcaagccccgtctcaaccatgctttgaaataantgcttcttgcttgcttttgncgcancctcaacatcggcacanaatatctcanagatgccagcaatagcgactgnaaccgcgactgngacatactatcccggctacattccactgcataagttatnttcaagcgagacnattcatgccccgcacacattt

SEQ ID NO: 3717 - DNA, 129 bp, Fusarium venenatum
  misc_feature (1)...(129): n = A,T,C or G
nttggtataacaggacaattcctgtgtacacaactattatacaatgaccgatttgntcancattgttggtcnntagatagggcngatatacatggcagatgatagttgancgaatgatantatgnaact

SEQ ID NO: 3718 - DNA, 543 bp, Fusarium venenatum
  misc_feature (1)...(543): n = A,T,C or G
cacttcccccttaatcctcaactgcaattcaccatgtctgattggaagcccccagcctttggtactcccgtctggatgggtatccctgccaaagacgtgactcgcgcctcggaattctacaagactgtcttcaagttntnttttaaggaggccaccgacaagtnccccaaagaacagctcatgcaattcgactttaacccaagccttggcctgacgggcggnattcaaaaagcccctgaccacactggaaactttacccctgggaaaggaggagtatgcatttactggtatgtcgaggatgttgacagtatcggctctgttatngagaangctggtggtaaaatgttgaaccaaaaagaaaaaggaagcgatcatggttatcccattntttgagganctgaaggatccgcggggccgtgtatnaaatggttgagccggacaaaacacggttcaancacaatgcatcctttacagtttatatnaantggtttggcaattgattttgcaggttaaagnacttataccatctccctgaatcttggg

SEQ ID NO: 3719 - DNA, 444 bp, Fusarium venenatum
  misc_feature (1)...(444): n = A,T,C or G
cgcgctcctgactgccacgtcggctctcgccagtgccatctcacctaacgaagcgaatgctttgcaaggcagacatattgctacctggggcaaatgtaacggaacctcttgcaaggtcaatggaaagaactatgggtgcaccaagggctcttgcactcgtcaaagcggcggtggcgatggtgcccaatgtgccaagttgggtggatctatctgctgcctggcggaactcaaaagggaaaaggttgcaagatggtaaaataccatgatcgacaaatcattattgactcggtcaaccatacacttcatatcacttacgtccgnctagtttgttgnaaaagagacaacggttgggctgaattatcagaactaggttgacgcgttatgaatatagccctttcttactttgaaactcaaaatagatactaaatacatatctctaaaact

SEQ ID NO: 3720 - DNA, 474 bp, Fusarium venenatum
  misc_feature (1)...(474): n = A,T,C or G
cgggcgtagcacttaacggtaaatacctctcttcctagctttaaccgactggtcgggagagaaagaatgagaattgttcggcccctgcagcctctttttcgttctttcttacgtttctatggataatggctctcttttctccctgaaggcttagggctagagcgttcttgttaggttgtcttggctgacccggctganacttggctcttctncaagacccgggtccgcgctcgttcatatctcggtctattcaacctgaattgcatttagccggccaacaagatgggtctacacaagattaggnggcagactttttgngnggacatgctcatcaagtttgccattggcnaaactggtcaaacgatagatatgaaatgacagggcccgagcangaacaaatgcatgcatccgatgtctatcactgcggccgagttttactcacaggtcgcanantttgtggctntggacctcgga

SEQ ID NO: 3721 - DNA, 244 bp, Fusarium venenatum
  misc_feature (1)...(244): n = A,T,C or G
nttttttctttaccancantactaattgtgacaagtcaaagacnttggccacaaccctttaccatgnataaagaaatgccgttcnactgtnggnggtattgtacatacccatcaacaccaccattgttgacaangnatcatctgcactccatnttaccccaaanaaggangcntttccggacnccgtcccagttgggctctacgccttaanggggttataaaaaaaaacanaagaacatttggt

SEQ ID NO: 3722 - DNA, 617 bp, Fusarium venenatum
  misc_feature (1)...(617): n = A,T,C or G
cgccagtctagcgccaggttagaaacggcgtttcaggggagtgacatgtccaagagtgctcccgatcccgaagcgcatgcagggcaagcaggcgagggcgagtctgagctggtatcacgactcttgcagtcatttataacaagcattctcgaagcctacgtcaactcaaacaacttggaatgggcagcaaggcatctggaatatctgaaccctgagaggattctaccgaggaagccaaccatgctgcaggcatttaagcaagtagacgagcttcaaaccagggacgccttggttggacaattagttgctgttgcccgcgacttgggcctggcggaattgccctctgacgaggtcaagaagattttgaggtcaccattcgctacgaatccattgtctatcgaacccgatcccaacaatcccgaagctattaaactatcgactgggtggctttctttgcctgactgcttatcgcatgttcgcatcanacatttttgacgccaattacgaacagcccaatgccaatatttttcctgagcatcacaacctgttgaagaagttcctccgtgatgaaccacagactcagatngaaggcaacccccggcaccgtanaggcattn

SEQ ID NO: 3723 - DNA, 357 bp, Fusarium venenatum
  misc_feature (1)...(357): n = A,T,C or G
ttttttttttcttgaagggggtttcctatttctgttcctaatacgatttcaacgtcaaactcaatacgtaacctgaaagcgaccaataattgaaacgataacggacaccccnttgcctncaaaagcaattgctnttatacgagcgtgttgctgcaaatatnaaaatgtcgccgagaactccaattcgcgcgcctccatctcaatcaaatttcatgagtgtttatcgctcgttatggacccgctcgtnatgacgctgctgccggggcatctgctcccttggtctgngccgcaagctccgatccaggtcgcaaccacgttctnatatgccggacttgcagctcgngatgatagcatctt

SEQ ID NO: 3724 - DNA, 574 bp, Fusarium venenatum
  misc_feature (1)...(574): n = A,T,C or G
ggcaacgggtcaaaagacaacacaacacgaaacatcaaaactttagaccgcgttcaacaccgcgttttctacagcacctgctacatctctagggacccagaccacatcttcttttgttctagcgaaagaaccgagacccttcggccccagctgtgccaggacacacgccatagcattatggattcgcctcacaaatgaacatctcgcctggcttcatccccgcgccagttgtcctgtccacatgtcgaaaattgccaggggaagccagtcaagttagtcttgcatcctacgcacgagcggatggatgtttgggaaactcggcgatagatctgagatttctcggatatcagcttaagcgagctgagcgctgcaaactactctttacgcgangctctaaagcaagcgtgccatcgagtagaacggtataccatcgagcagantcccaggcaacgtctttgatttcgtaatcaagttattgganccttgancatcatccaacttgacaagagacatctccgacaaatgccngctgttgatcattgcagacganaacaccacaaatccatcttttttc

SEQ ID NO: 3725 - DNA, 307 bp, Fusarium venenatum
  misc_feature (1)...(307): n = A,T,C or G
tcacttatacctatcatcattgcattgcgaaatctactgcatcatgaccgacatctctacaactcctcctctgactcgtgactcagtcattgaagctcacaaactcatcggccaatacgtccactatacgccagttctcaccaaccggaccatcactaaacttgcctcaacccctcgcacagnggaggaacttgagggaactcgctatgctggaaggacaccggcccgcccggtgttgagactctggtttaaatgtganaatatgcagcgcataggagctttcaaagctagaggccctttcatgcgg

SEQ ID NO: 3726 - DNA, 166 bp, Fusarium venenatum
cgactcaaaccccgcgagctagaggacggcagtgtgattgagcctcagagtggtcaattcaggaggtagtggatggaggtcggtgtttttggttgacatcaaggaaacgtagttctgttcacgatccggctgcgatcacagtcaagctccaatggtccttgcttac

SEQ ID NO: 3727 - DNA, 189 bp, Fusarium venenatum
  misc_feature (1)...(189): n = A,T,C or G
ngaatcaataaagcnttgggaaaaangtacttccanatctngttctggagaattntcnacaaggaattntggtaaaanttggaccataangtttttgnttcggncaccaaaggcnntgggttaaagaaactnggggttggttgcatttagccaatcccnttcgggctttccgctttgttttgggccttt

SEQ ID NO: 3728 - DNA, 281 bp, Fusarium venenatum
  misc_feature (1)...(281): n = A,T,C or G
cattaaaggatgcctctcgtttaatctgatgatggttctgttgtatagtgctcgcacgtcgtggaatttaaggcaactgaggtgatgagcaatattatttgcgatgcggcatcacgaatggaacttggaggttaatgtttacggnggtcctgtatattgctcgagattaagacatgaataacggcaaatgaatgatcagacttctgcacgtttccgagtataccangagatatggctgcattnaaagactgntttttttgcntattttacgtncgccntag

SEQ ID NO: 3729 - DNA, 390 bp, Fusarium venenatum
cattactttcattatttttctttgttttctttctcaatcaccttggataaggaagagtcacaggcggatattatacccttttctatataacaattttgggatgggttgagggcggcctcagagctggccggcactcgctatggagtttaggtttctttcttttactgaaatgatgttacagtcatcaaaaagttggaaggatacataggcccttccgtcattgctctggtcagaggtttgtcacaaccctggcgaagaagatttttgcctacagcgaaagttgctgcaaggccacacataagttcgatcctgccccgaaggccaggtacagttggacttgaaagaattagatagtaaaaatataaatgaagaccaggcatggcctgtttc

SEQ ID NO: 3730 - DNA, 593 bp, Fusarium venenatum
  misc_feature (1)...(593): n = A,T,C or G
gtgaagagaagagaggtagatatacaagcgatacaggctcttccggagctcatatatccaaccaacaacatgcgaggccaattgacgttatcaagagcggcccgagggctgagactgagggcattgccttcatatgcctgcacccagtctcagtgcaggtccatacagatcagcgctgcgccgagcactgaagcgcccaaagttggtggtgatgctttcggagctcttgagacgaaggatcctgcggatgctcgattcgaggtcctcggcttgccatattccctactatctgtgacctgtcggcatcgcagaactctatactcggcggggcacattggttgctgttgccggcaacctgaaaatgccaatctacctctcgatctcaaccgattacacaaccctcctcgggtcccttctctacagcgcatctcactacacaccatcacagcttgattcnacaatcccacaacacntcaaatctcactcgatgacacagatgatatcccaagatcatgttggctggaagantatcttccctcacgcctcaaacactgacccccctggtatcntgtnaagaaagttgtctttcccng

SEQ ID NO: 3731 - DNA, 134 bp, Fusarium venenatum
  misc_feature (1)...(134): n = A,T,C or G
nnccccatacttnggaacatncccacaggaccggaattaanacgtgccgcgcctnaacccgntttattccnncactaccccntttatatccggatctgttgtggcctncgncctaanattaanaaagacncccc

SEQ ID NO: 3732 - DNA, 175 bp, Fusarium venenatum
  misc_feature (1)...(175): n = A,T,C or G
naaagcgctcgngaggntctggtttnagttttnactntcaccacccaccacgangatgatgatgaattctgnggcccccantcttccaatgngggccacttncaaccggganccctttcgaactttgtttaatacantcccctgccggngacaatggtgtttttncctgggccaa

SEQ ID NO: 3733 - DNA, 429 bp, Fusarium venenatum
  misc_feature (1)...(429): n = A,T,C or G
ttttatttcctgggggtatagggcggcgcttttttttttaaaatacatattcccagaagaatgcctctatccctagtcctacggaccagcaagctcgggattacaggaatcaggaatcagccagcaacctatattgagaagtaagaataattaataatatatggggttaatttcaaaaattacttacgcgttgctttacgagactccgtctataaagctcgctatgtaaatttgaagcgaaatttatcttagcataaattataagataaagacgttcaacgactataaggngagttatatgcagttttcgaggaagagcaagctagccgatatataaagctagttgcttttacttgcagttttttcttcgaaaaatactaaacaataatccttttttacncccaacattattattatatatatatatat

SEQ ID NO: 3734 - DNA, 486 bp, Fusarium venenatum
  misc_feature (1)...(486): n = A,T,C or G
aatgaaatcggcgggtttggaggtggtcaaaacttcattttcaaccaagcatgtggaaatcctgtcccctcggggtgaaagcttcataccctggtcccaatgtcaagggtcaagggtctatatgcagatcccgtttcttgtaccgtggtcctgaattggcttgtcttattctcctaccccagtctanaagaaattacgatctttctgagaccgccacaaaaaagttcctgcanaaacgttgcanacttttgacagggcttgctaaacagcggaaaggaagaaccgcctctacggcttgtcgatctttcaggagactgttccttcaaaaaaggaaggtctttaactggactaggttgtcctggtgatcgccaattggggctgtccanacctaggccaggatactgtaataagntggggttcaaagttacacccanggcccaggttttgatcgatcaagctcaaactcaattgatgaaattatgngag

SEQ ID NO: 3735 - DNA, 225 bp, Fusarium venenatum
  misc_feature (1)...(225): n = A,T,C or G
ntaatttgcgttcccnccatttttttgcntgctctcgtcgccanttaaatccatttcaacgttcggnttcccccattcgacgattgganccaatgaaattggatgaaaacctccctcttttgcctcacccnaaaccttttggggaatccttttgtcgagtcccngacattaangatcctgngnggtttttggnttttaaaacccnngctttttaatccncaaccn

SEQ ID NO: 3736 - DNA, 226 bp, Fusarium venenatum
  misc_feature (1)...(226): n = A,T,C or G
aagaaaatncnggggacgaaagaaggagaataaatggattggttcaacaaatacaacccaaccatctgacaagggatagtctacgggacgtacaaggtacatagttggagcgaccttgagaagactcacctttctgactgtcgagggtctgtggacatgcttccaggtcgagtttccgaatcgggtatcctaatcgntgagtactaaactgagtcaatcctcaccc

SEQ ID NO: 3737 - DNA, 341 bp, Fusarium venenatum
  misc_feature (1)...(341): n = A,T,C or G
aaaancctcntcctgcaagancaactaatttccaatcccggttcagggttagccgcgtgccgttcgctggaaccgtgtaatgatgaagttgtctcttgtacctgattgcaatggaatgttatacttagctttgtatcaaggnggctttgcttacatcagtgtgaaagagcataataaggtaacttactctcaagccgtagcttttctaacaatctgaggccagggtcttctgagagtgaagtcaaaacctaactgtatgcactcaccggaagcacatctatttttccatactataaaaacacaaggagagtgaatcaaaactgttttacgggaaaaaaaaa

SEQ ID NO: 3738 - DNA, 626 bp, Fusarium venenatum
  misc_feature (1)...(626): n = A,T,C or G
cggccgcaggaatttttttttttttttttttttttttgcggaanaaagccgagttaaaagctaagcaagaagcaaacaaaagtgatggaaatgagctcaatgacggagaaggggaagaacaggcgggcctgctcttttgagatacaagttgctgtacactctgattcctgaacatagcttttttcgctcccaatacccgtaatgtacacgtacgttcctgtctgggcatgccaggacccatcctctctatatctctatagaatcgttcacaattctcattacaagttcccacgaggttccgctatganacaaccttctcgacccanctttttctctagcttttgacctcagccttgaaggttttcacctcctgccagcagtngagcggnccttcggtcgtgctctcacttttgancntggtaccgctggtgtccaattgaaccagcctgaggaccctacactacttgttgccgaaactttgtntttgnacaagaccatagagactaccgggcaaaaagttttgggtatttagcaagcaccatnaccttcgacangaaccacaanattnaaccgcacatttcccaaaggctgggcacccatttctctttgngccccaatggcgacaa

SEQ ID NO: 3739 - DNA, 418 bp, Fusarium venenatum
  misc_feature (1)...(418): n = A,T,C or G
natgtgtntaatttacnccaccctgataanaaccttccattgcaatgccccggnttcggaaatagcgcaggcaaggcntcctttttttcgtcgactgangagggcataccancntttttgagcacagagcgcacaaaccaaantttccntgtctganccnaattgtcgtttcctggactcaaaatgcatttgttccgcgggagggaaactgcctcgtcgctgaacaatttttntttggngggtancctctcgangggggganattgaggcccttntgataaaggnggggangaaaaaanaanaagcccccggtcgttttntattcnaaangcctacnggggttaattggaggggcccnaaaaactnttaaagcgggggggctgncctttaaaaactcganagnggaagaacagcgtat

SEQ ID NO: 3740 - DNA, 333 bp, Fusarium venenatum
  misc_feature (1)...(333): n = A,T,C or G
ctggaagaattcgcggccgcaggaatttttccagtgacaagactctgaagaaagacaagaaggttgtccctccagttggtaagacggcacgcaagacgcgaagtcaaggccctgttgaagtctaggcgcgatttataaatctttccttattttatcattaccgttttatgagtgttgagcaaaacattgctccaaggatggtacggnnaaaacggcacagtcggtgatgggaacaggaccagcttcccaaagtctgcctgattggaggtattacgtgtatatttatgcgccaggtantaaaacaatgattattcgcctctggaaaaaaaaaaa

SEQ ID NO: 3741 - DNA, 293 bp, Fusarium venenatum
  misc_feature (1)...(293): n = A,T,C or G
ggccaacctgtaatacagttggtgtgtattgtgacaaatttttggtgtatcttgantcaggggtgtcaggggtggtgataaccaaaaatatttttgacactggagttttgggggggcntttngggggttntnggcaagcgactggcagatacgttttnttaccttgcattgttnggagggtacaacatttgaggccatatacgcaacagcngtgtaatatgaggtttaggggatcctnccgaaggaaccaaattaaaagcntcttctcnatgccaaaaaataanaaaaattat

SEQ ID NO: 3742 - DNA, 374 bp, Fusarium venenatum
  misc_feature (1)...(374): n = A,T,C or G
tctatgatgaagagagcaacggtacgtttcgtatacgggaacacgttcaggaggatgctcgttggagattaaactagtggtgcaatgttgagttgcatattcttctgatgaaataccccctttgtcgaatacccttcacctaccacttttaccggagttgaccggcttggtgtttttggtttggaaaagancatggcgaggatgagttgaaatgaaacgagaaacgctcagcgcttggaacatgaaaggaagctacattcttacacttggtacgcggtcgtcgtatacctatttataccttaaattctagttactattggacactgcgagagctcagtcttagcctcgtacgtgacatcaataattggcctggt

SEQ ID NO: 3743 - DNA, 339 bp, Fusarium venenatum
  misc_feature (1)...(339): n = A,T,C or G
ccagctctcctcgtcggacaattgatgccatggtttgcnaacaaagtattcctgtccacagcttcgctgtatggtgtctaccacgtcatgcatgatgacagcttcttcgattggcctccctcgcctcagctcgcgatggccgtgttcccgtacattcgatcagtntatttgaacctntggcgcnaattcnttctcccgtacgaagtcaacctgaaccgacagataatgggccttcccccaatcnaaccccgacnagatcagccgcccgccaacgaacnacnaccggagcaacgcggggaaggcggcnttttgggcttcctcaacggtnttatcgaggct

SEQ ID NO: 3744 - DNA, 286 bp, Fusarium venenatum
  misc_feature (1)...(286): n = A,T,C or G
gttttttggactccctaatataacgttcccagcttcccggncacgatttcttttatgattttcccgacatccatctttatccttgcttctcagctctattaatccccacccgacccgataatatttatcccctgcctgtccttgntggaccctttacttgtcaagctccaccgnttgtcgctcgtcgcattttcaccatcatcatgcatcgacttattttatgcgccaaacccgggcgcctactgcttttaaatttaaaacccccaccacttccttatcaaaaggc

SEQ ID NO: 3745 - DNA, 263 bp, Fusarium venenatum
  misc_feature (1)...(263): n = A,T,C or G
aaaaattaagaatcaaccactatacgagatactatcacattaatcatacaagcntgggtttatcggacgtcattatttctatgctcggngaaccccttctgcctccagcaccgccgaccgacgccaaaaaagaaacaaagcagcagtctgggccagtaggccgatttnttggtaataaaccacctcggcaagttgatactagtaggaagtctacatctggggagaaggangccccaaaatgatgtgtttcgttgtctgcctcc

SEQ ID NO: 3746 - DNA, 265 bp, Fusarium venenatum
  misc_feature (1)...(265): n = A,T,C or G
gcgctcagctgggtgatgacttcaagtgtttctttgacgagaagatcaaccctgtcctccacggcaccgccaatgacgctgccgccgttgtctaagcgctctttgatgacaagtttggactattcaacgcaaaatctacgacactgttttttcttttaatcggcgtttggaactgggatctgagaggtctacgacgaatttgatcatgggacttttggcatagacagcgatatagaatcttgatatcaattngaaaaaaaaaaat

SEQ ID NO: 3747 - DNA, 343 bp, Fusarium venenatum
  misc_feature (1)...(343): n = A,T,C or G
acccatacttntttctactactaccccaaantgggcaacacatcaacatcaccttcaaaccccgagacaaaaganaaaaagtcnctctaccgtcgctacaaagatagcaaagcacccgtnccactcagtgacgaggacatacaaaagtacacgggcaagacacgcgaagaactcacaacgtgggctgactcaacgcctggcgtgggaaanaatcacctcgctggtccgtgccatgattggggaaacttctgggcttgctggagtanccatggcagatggatatggaggttggggacctaccccgacccaacgatgcaaatagaggaatgantttnctccaaag

SEQ ID NO: 3748 - DNA, 577 bp, Fusarium venenatum
  misc_feature (1)...(577): n = A,T,C or G
ccacaacacactctttagaatggcaatgccacgagccaatggacctttaaggacttgtctgcgccaactggtgcgctcagagggaccagctcctctccgctcgatagccgccagtcctcgcgcattcaccacatctcatgcgcttcttaagaagcgcaagatctcggcacctgccaacagtcccaataccgccactgcgaaagccgctgcggggtctatgaacaaggccgagtatgacacggctaaggtgcccatgcccgacccagaagatcctctcgactttacagctgttattgctgcatacgcacccatcgatgcgcatttcaagactcaacttgcaggcatgattcatggcggtcgcttcaacccaacaaacttgggttcgttgcccgtggctatcaaggatgaanaaagtgccgacgcttcgtttcccctacgaaancttgcgcangttgttcctcgatctggccganctatttcgctacttgtcaacgacaangaatacattaagcccatcatgtnagcantgcaatcgaatcnggaattcaaccagcagcctcagcgatcagaananaac

SEQ ID NO: 3749 - DNA, 348 bp, Fusarium venenatum
cttctcgtcactgtaatgtactgtgttcagaaagcaacaaaggtaatcgtccgagaacggctgtaagaatcatgcgttatttccgatggtgacatatcactcgaaagaaaattaaaaacccgcaaaagacttgcattgcaatccagtgagaaagaaacagcgacatcgcaatgtcatagcggcttacttactatcgctgtgtttggcaggttgcacgagtgatggggctaaataaaagaatagcgaacattgttgcaaacatccatagtttcatttgatgctgatcatttgaatcaaaatattccgagtcataataatactcactgtttatctggccgaaaaaaaatc

SEQ ID NO: 3750 - DNA, 493 bp, Fusarium venenatum
  misc_feature (1)...(493): n = A,T,C or G
aagtcgaacccaagtgcttgatctgagcccagatgattctgtgtgtgggagcaatcaggtaccggctacaggggtatcatccgccaaacgccaaaccagggcctctccgctccgcccacgattggatccttgatgtcncgcccggtgccangaaccggttgcagggggagttgcgagtacaaatttcgttgtgaatggctcaagtctgaaggctgacacgatacgacacagaccacaaacgtactgntagtccttttaattataaactgctttcgtcattcattttccgntggatgtttctcaacatncatcgctcgatgcccaaacctacttgggcctggcctgggcttggtgcttgctttgtccgcttaccaagtatactatcccaaacttccannctgcagtctggacnaatctcgctcccctggttgcatcctgtacatatttatagnacaaggaaatngctcgccttgatggangtttttgtntttaa

SEQ ID NO: 3751 - DNA, 585 bp, Fusarium venenatum
  misc_feature (1)...(585): n = A,T,C or G
gtagatactcgctcatccccattccatcatatcttacctatcatatctgtcacaaccttcagccttacagatttcagagatcacatagcgtttagcaagaccaggtagatgggtagcatcatcttactgtaacggcaatacgaatccttcccacttccccccgatgctaattgtacttcgcctctgagcccctggcgttcggttcggctcctccacattaggcatgtcaatgttacaatgatagactgcagttccaacaccgtacgatgctcggaaacgatggacaattttatctcctattcgagacagctacctccaatattctccgagactcgtccgtcgccgtcaggcaatagcccaaatttggtacgacgcaattcgccgatcccctatttgccaagcttgtttttggtgactaagtctangtactaangtggacttttgaattgtgctggcatataacgttaatcgtcagggatgacagaactaaactccccaaggtttctgtgcaaaaagcactgtttcagcctctctttccaaattcngantttaacgantgcgcagaagggtgaactttgctccgcg

SEQ ID NO: 3752 - DNA, 399 bp, Fusarium venenatum
  misc_feature (1)...(399): n = A,T,C or G
nngcactccttcaactactggcatccattcttactctcactcacactgtgattatactttntggtacttcttttcttctccttctactctcttctcttnaaacaatcttctactcgtctcctatatttgtacttctccataaaatacgtcacgcaaacgagacagatccatcgaatcgcacccgcatctgactttgacgctttcgacgcctcgtcncattcgttcaacccccctttacaatctataccaccacttttttttacgcgcgccgnagcctngattctttttcccttcggcacctatgaccgcagagctngacgaccttaaaanaaacccnggcnggcggccctgatnatcaanatggaaaacagaggatgcgaatgggaacggcacattaac

SEQ ID NO: 3753 - DNA, 539 bp, Fusarium venenatum
  misc_feature (1)...(539): n = A,T,C or G
canattcacagagtatgaaccaatcccacaaactcanccacagcctcctanggatcataccctactggaccttccttnagagcttcactacactatntttgatcacctcnaccccattgacagtgtttgtttcggtctcactaactccaacttttacgatattcaccgacgattgcacggcactgtgcccctttccagtcggtactcggggccaaacaacatggaatgggcttggcgaggagctggtcctnttgttcatcgacaagagagagatcccganaaagaaggtccattgagcanctgcgtgtcaanggggcaagtttactgcaaaaagngcggaatctcgcgatgcgagctacaccgtntttnaaggactggattccccganggctccnatacttgtntatnaaggaaactttngaaaacccgttggngaggactcaagccnnctggtcttgaagtcncccaanacccncacantttggccccctggagnaanaaggccattaacnttttaaccaaanaattaaaaaaaacgg

SEQ ID NO: 3754 - DNA, 138 bp, Fusarium venenatum
  misc_feature (1)...(138): n = A,T,C or G
cgaaagggcttgacaagcccattaatgattaattatatatacacacatacacagactccggtgcctcaattttacgtgttaggtgattattgaagacagtgatccatggagcaaaattaaactccattcgctcaaann

SEQ ID NO: 3755 - DNA, 337 bp, Fusarium venenatum
  misc_feature (1)...(337): n = A,T,C or G
cgatcccttgaatggggacggcgtttaggaatcaaaagaaagggattttacgtggagcgtttgtctctgaatgatttgagtttggggtcggacgttccctggatagatcatcaccactccaagaaagggaaatcatttgcatgtcgtgtcatgacatatcatggcatttcgtgttagcagcatagaaggggccgggcgtgttatatatcagctgggaggaaaagattagggccaanaagatncttggccgagtcaaaggaaagcacagcagaaggtcctgctgcttgtatcatcaatcaatcaccattaaaggaatggcgtttttgccntttactat

SEQ ID NO: 3756 - DNA, 595 bp, Fusarium venenatum
  misc_feature (1)...(595): n = A,T,C or G
caagatagtcaaggaggcgcttattgtgatttgagcgtgtggttcctcaagcgcaagttcatggaatatgctaaagagaataaatggggtgagttctgtcgacagttcaatgacagggcgcaactaccggattgtccaaaactcaacgttgtcaaggctagccaatatacgtggtacaagcctaaatctggaccagaaggactgcaggcttgcggagcgtgttaccatgattacttcctggcttcagaagacgaagaaaaatggaaccaaatcattggangtgatttcggcacgaagtgcaatctgggccaactgaaccatgtcattctcatgcaccaagccatggacgatgaagacagaagtctcttttggaacgcggtgaangagatagacaagtatccgttctgtacagtcagggcatcaggggcggtgtttggtatacgcccattaacaaccctcctggggtntctgcnccgcatgttaccaaggtncgtgaaaccanttggaagatcnaagtggtttatganaaacacaatgtccccnggatggctnttcntgttcggttccatctggactcacncgcttcaaacctgga

SEQ ID NO: 3757 - DNA, 636 bp, Fusarium venenatum
  misc_feature (1)...(636): n = A,T,C or G
cttagaccggtgacgtctatcaaacagacagagggtataccaatcacgactattctgacctatccaacaggcctcagaaggtntntttcacggaactcccanaaacaccaacaacgccaccaagaacaatttcatcaactggcttatgaaatctgattcgatggctctgaaagttatccccaaagcctnatctgcaggcggttcagtgcaaaggaaanaaacttcanaaagtggtggacggacctgctaccgggcagtgtgccagataccttccattggacaatttcatgcancacctagaatggtgttctccgcagctcgctctctanaagcctcctcgagagcaaggtgtcgtcgaagacagntataccaccagcagaagcctgactatggaaaaagtcaagtgaccaaggtagacactccgacttgtcatgttgtccaacacaaacagacacatggcgacttgagacatgtntactgggaacatgatcaaacttgggatcggggtctgccanctaaaaaaaacggccttgatcccagtctcgagaggatcaaatacgtttacaaaagcnccgaccaaactttggagcttttagccataaaagatttaaaaaacaagctagggtgcttgggcct

SEQ ID NO: 3758 - DNA, 635 bp, Fusarium venenatum
  misc_feature (1)...(635): n = A,T,C or G
aatttccagaatatcctccanaaggggtgttaggtaggcagtctcatcctatggctgctgcacctaattaggcatgcncgcaatagagattntatttaagaactggcatcctatcactacccgcgaagctgcgtgaaatgagtcaaaattacttttacaaagccctagtctgtcgcaaaaacttggggtatgaggcacaaccttgcgatcatgcagcaagccgttggtcttggtcagcctggacactgatttgccgaacggtttaacaaccggtcaagatttagagggatttattccccatatacatcaccgacaacacggttcaggaggcgtttctggtgtacaccgaaggggggaagctgcatgcactgtcnaagccacaaaacgctgcaattcggtcaaccatgtgctgcagcgcatagccgacagatttggtgtggggatatgcaaccaggaatgangccccaattcgggacggcagatgtgataattactatctcggctcattngaacggttttgagttcgggcacaaaaccaattcgactnttttgcctanagattcgagcctaattaaggcaccaaacattctttgacttgatcgtcaccacaagggcccggttgcacccggcattan

SEQ ID NO: 3759 - DNA, 589 bp, Fusarium venenatum
  misc_feature (1)...(589): n = A,T,C or G
cttattactatcgacggtcaacggtcagcaagacaagacaaggccctgtttcagcttccttacgagccacgttgatttcaacacgctagcagttccagtataccaaatttatttttacatattggatccaatacagccgcccactctggctggagtactctggaagggctcgccggacactcagaaagagaagtccttgcgaccaagtaatatcatgactcaaccatcagcacaacctcgtcttgcgccacaattttgcttttcatatgggacgttacgagactttctacgactgtcaagatcatcgatagatgattcaatcacccagaatctcaatgcactgttaacgccgtcacgatccggattcgaccatcttctaccttacaacgtacttcccgcccggcttcgaagcagatcgactctcggtcatgctcggaatttaaggagaaggtgctgttcccttcctgggaactcggaccaggtccgaattattgtgctttggtagcggcaacccngacccgatgatccggaccgtacatccganacttgaaagaaacaagacgtgacgaattgttgacaacaatggatc

SEQ ID NO: 3760 - DNA, 476 bp, Fusarium venenatum
  misc_feature (1)...(476): n = A,T,C or G
tccctctattagaattcanaccttttcccaataaagaagaaagaagaaaaagaacaagacctagaacctaagatattatatctcaggctctgtcatattaacataaacatctccaggtttcactccggcttcgcaaagtctactcactctgtcgtcatcgcttctcgccgccctctatcggcctaagtaacaaatacaaacaaacaaaacctcccggatccggcagtggccaatacaacgccactgctttttccgagaatccttttattttcttttttataccaacttgaattcttgcccaccgttgggtggcaagctgagttnttcatcccgnctaaaccttacttttaccgntnccgtctgttcanggnccggccattgatatccttgcttaaaanaattgaaggntctncttttactctacccccccgggggngctttgcttcccaccttaaaacaggctatttgaccttttg

SEQ ID NO: 3761 - DNA, 450 bp, Fusarium venenatum
  misc_feature (1)...(450): n = A,T,C or G
agcgttttgtttcatactaaagttcttccctttgtactcgatctctacaaactcttttcctttgttcttctatagcgaatctcgttttttcgcgacagcgccatatgctcttgatccaactgcaaccgtcatgaccagtcatcctccaccatgattgaaccatntattcgtgtccgncgggcaattcacgccaacgatgcgaccctactgcaccgaatcctnaagacacacccgaactatctcctaaaccccgattcctctccttccggccagtccaactngaatatgcacctagcagcttntntaggcaccacgaagtctgcgaagtctgttaaagctaggccacnaagaccatgccctgttttaacnaaagccaccaaactgcttgatgctgntgcagtggcggcatccgaagcgtccaaatttttgngaacaccaanaaaaatgctt

SEQ ID NO: 3762 - DNA, 447 bp, Fusarium venenatum
  misc_feature (1)...(447): n = A,T,C or G
tgccatgtcactcacatacttgactggggttcgtggcctcgaaaccccaagtcggtgacctacgactcgcctctgatccggatttgttctgcgacttggaaggatgcgattttatattcgtcgaatcatcagttccgtcaaatccagagaaagaactagctgatatgtcatcatggcaaccgataatagtagccacgccacgcaagatgactgtatcgacaaagtgcgaagcttatcccgtgataagtggcggcgacgggtcatccactgagattgggtatcgaaagaatgcaaccaatggcgggagtcgggaaaccgtccttgtcagtgttccttgaccgcagacaccgaacagacatatcntaaccaacacatcctttactgtggcctggctgcacaccgtcccgcgtttganaatcggccaagatccctgttttactcctgcat

SEQ ID NO: 3763 - DNA, 331 bp, Fusarium venenatum
  misc_feature (1)...(331): n = A,T,C or G
caccatcttgacaatactacgacactaataatcatttcatcatgtctcgcagncccagtggcaaactcgacaccgatcgcgctgagatggaacatatccagccagctatgagcattccgctctcccctgagttgttcgaacagttatacctccanccccanaacagagtgaagggcgatctccgcaagacgtttggcaatccaacaccagttgcgttggccggctttttgctatgcaccacaccggcgtccatgtcattactgaactggcagggcgcaggtggattcnctgctgcancantcgttggtgtctacttcggtatcgggggctt

SEQ ID NO: 3764 - DNA, 213 bp, Fusarium venenatum
gttttttcttctggtttaccacgaatcatgcgcaggctgtcgagcttctgctacgccgaggcgttggatgtggattaatggcgttggagagcggatttcagcatacccgttgggtcaagttggcttgtacgccacttggggcgtcgaatttgcattgctagatactttatttaagtttgtaggatggcagaaaataaagttagagatatcccg

SEQ ID NO: 3765 - DNA, 194 bp, Fusarium venenatum
catgaaagaaacacaagttcggtgacgggcttgtgagtgagcgcaatggagagcaagcctctggcgactgtggcaaggcgacaagcatatggtgttcgttaccataatgacttgaactaacacctgcgagaaatgcctccaggtgaatagtttttcacagtagtgagatagaaataaagttcaagttctctccc

SEQ ID NO: 3766 - DNA, 226 bp, Fusarium venenatum
  misc_feature (1)...(226): n = A,T,C or G
ncgtncatgnatgaagcaaatnnttttttcaggccacacccgaacgcttcaggncagcgcgtgctattctccnaanccccagccatngtgnggctcaaaacttnggtttggtgccgccgcatnggtttacggggggggatggctcgnttgnttccnaattaaaanggggtnccnaacctgcctgggnaanctttttntaacaattnggttgataaaccgggcacgg

SEQ ID NO: 3767 - DNA, 343 bp, Fusarium venenatum
  misc_feature (1)...(343): n = A,T,C or G
tgactgcccggtgacccanttttcaaagccacncgccangggataaagcgttaagtcagaattgaaattgtaaagggagattcagagcgtcgtgactcttgactagactagtctattcttgagtatccgtaaagtgaagcaagtgctcatgattaaattgctttagggtaggctgctgatccttgaatgagcttcaagagtgacaggcatgaagtatgctcgttattcaggtcagctggaatgtaattgtctcgacttgatagcagatcttacggatagttanacnccattgctatcgtttgttaaactaatggccttcttacccttgactagcaatcaacca

SEQ ID NO: 3768 - DNA, 377 bp, Fusarium venenatum
  misc_feature (1)...(377): n = A,T,C or G
gataagtcattcaaaatgggcggcggcggaaaagtcccttaccctaagcacgtctggtccccagccggtggttggtacgcgcagcctgccaactggcgcggcaatactctgattgctggtgtcgtcatggccggtatcgtggctgttacttggaagttcagctctgagcgagaacaatgggcgcaccgacctgagccaggtcaatggtacgccagccgacactggtcaaagcagttgaagcagtgggatgcggaggaccgtgagaactcaacaaagagcgaatagagtctggataaaaagacctgtgtatatttctgcgacagctgaagacaacctcgagttaaagatcacaaaacaaaanaaaaaaaaaaattcct

SEQ ID NO: 3769 - DNA, 286 bp, Fusarium venenatum
cccagggcaagcgctgggttgaggctgccggcgccatcgttgttggtgacaaggccgatgtcggcgtcgaagtgtcccctctgatcagctacggtggtgagggtcttgagaagctcaacggtaacgagattacccctcctgcagttctggagcgggactagggaaagaatacatgatgataccatgaaccagccaggataacattatgatgctgttgtcctaggtttggcagaaaaaagttgtttgtcgtaatcttgtgtagttcaagaatataatcgatacaagt

SEQ ID NO: 3770 - DNA, 425 bp, Fusarium venenatum
  misc_feature (1)...(425): n = A,T,C or G
ggttgtctgtacgatccctacaccaaggcacggtacggtcacggtaactactcacgtaggtaagacacgagacgagacgagactctgagttgaactcgtcccaggcacgaaccatgatgtacctagattagcggaggtccaaagcgtaagtagccagcanttctagggcatcgtgggctggccgatgctgaaagccatttacttgagaagtccaaacaatcaaaaacaaccgcaattccatggccaaccattgttggcaactaatgtaccaagangtattacaggacccggtttacaaccctcctttacctactgntggctcgctcaacagcgacgataacgacttangttagggccagggtagggcttgactaaagaagtgtgcataggggacatacattcatacaacaggccaaatccgaact

SEQ ID NO: 3771 - DNA, 2258 bp, Aspergillus niger
  misc_feature (1)...(2258): n = A,T,C or G
ccagcatcattacacctcagcaatgtcgttccgatctctactcgccctgagcggcctcgtctgcacagggttggcaaatgtgatttccaagcgcgcgaccttggattcatggttgagcaacgaagcgaccgtggctcgtactgccatcctgaataacatcggggcggacggtgcttgggtgtcgggcgcggactctggcattgtcgttgctagtcccagcacggataacccggactacttctacacctggactcgcgactctggtctcgtcctcaagaccctcgtcgatctcttccgaaatggagataccagtctcctctccaccattgagaactacatctccgcccaggcaattgtccagggtatcagtaacccctctggtgatctgtccagcggcgctggtctcggtgaacccaagttcaatgtcgatgagactgcctacactggttcttggggacggscgcagcgagatggtccggctctgagarcaactgctatgatcggcttcgggcaatgggctgcttgacaatggctacaccagcaccgcaacggacattgtttggcccctcgttaggaacgacctgtcgtatgtggctcaatactggaaccagacaggatatgatctctgggaagaagtcaatggctcgtctttctttacgattgctgtgcaacaccgcgcccttgtcgaaggtagtgccttcgcgacggccgtcggctcgtcctgctcctggtgtgattctcaggcacccgaaattctctgctacctgcagtccttctggaccggcagcttcattctggccaacttcgatagcagccgttccggcaaggacgcaaacaccctcctgggaagcatccacacctttgatcctgaggccgcatgcgacgactccaccttccagccctgctccccgcgcgcgctcgccaaccacaaggaggttgtagactctttccgctcaatctataccctcaacgatggtctcagtgacagcgaggctgttgcggtgggtcggtaccctgaggacacgtactacaacggcaacccgtggttcctgtgcaccttggctgccgcagagcagttgtacgatgctctataccagtgggacaagcaggggtcgttggaggtcacagatgtgtcgctggacttcttcaaggcactgtacagcgatgctgctactggcacctactcttcgtccagttcgacttatagtagcattgtagatgccgtgaagactttcgccgatggcttcgtctctattgtggaaactcacgccgcaagcaacggctccatgtccgagcaatacgacaagtctgatggcgagcagctttccgctcgcgacctgacctggtcttatgctgctctgctgaccgccaacaaccgtcgtaactccgtcgtgcctgcttcttggggcgagacctctgccagcagcgtgcccggcacctgtgcggccacatctgccattggtacctacagcagtgtgactgtcacctcgtggccgagtatcgtggctactggcggcaccactacgacggctacccccactggatccggcagcgtgacctcgaccagcaagaccaccgcgactgctagcaagaccagcaccagtacgtcatcaacctcctgtaccactcccaccgccgtggctgtgactttcgatctgacagctaccaccacctacggcgagaacatctacctggtcggatcgatctctcagctgggtgactgggaaaccagcgacggcatagctctgagtgctgacaagtacacttccagcgacccgctctggtatgtcactgtgactctgccggctggtgagtcgtttgagtacaagtttatccgcattgagagcgatgactccgtggagtgggagagtgatcccaaccgagaatacaccgttcctcaggcgtgcggaacgtcgaccgcgacggtgactgacacctggcggtagacaatcaatccatttcgctatagttaaaggatggggatgagggcaattggttatatgatcatgtatgtagtgggtgtgcataatagtagtgaaatggaagccaagtcatgtgattgtaatcgaccgacggaattgaggatatccggaaatacagacaccgtgaaagccatggtctttccttcgtgtagaagaccagacagacagtccctgatttacccttgcacaaagcactagaaaattagcattccatccttctctgcttgctctgcttgatatcactgncattcaaaaaaaaaaaanaaaaaaanaaaa

SEQ ID NO: 3772 - DNA, 810 bp, Aspergillus niger
gttgtttgacctggcccacaccacgggctccactgtaatgcgcgcactttcctgggaattccctaatgacccaacattggctgcggttgagactcaattcatggttgggccggccatcatggtggtcccggtattggagcctctggtcaatacggtcaagggcgtattcccaggagttggacatggcgaagtgtggtacgattggtacacccaggctgcagttgatgcgaagcccggggtcaacacgaccatttcggcaccattgggccacatcccagtttatgtacgaggtggaaacatcttgccgatgcaagagccggcattgaccactcgtgaagcccggcaaaccccgtgggctttgctagctgcactaggaagcaatggaaccgcgtcggggcagctctatctcgatgatggagagagcatctaccccaatgccaccctccatgtggacttcacggcatcgcggtcaagcctgcgctcgtcggctcaaggaagatggaaagagaggaacccgcttgctaatgtgacggtgctcggagtgaacaaggagccctctgcggtgaccctgaatggacaggycgtatttcccgggtctgtcacgtacaattctacgtcccaggttctctttgttggggggctgcaaaacttgacgaagggcggcgcatgggcggaaaactgggtattggaatggtagtgtcagccacaagccaggtgtgcgcgtacagcatgcaacatgggaacgatgctctgcaatgtagctctttggttataattcaaaattcaacttycacctttgaaaaaaaaaaa

SEQ ID NO: 3773 - DNA, 619 bp, Aspergillus niger
  misc_feature (1)...(619): n = A,T,C or G
cggtctcaagctaccgctcgatcatataccagcacggctgcgaccagcgttagcatatctggtgatatctctagccagcttcattctggctatagtcatccactgagtagatcatggcaagccgagaagcagttgaccaaggagatgctcatatatccccttttcattaccgataaccctgatgaggagacgcctattccatcccttccaaatcagtatcgccgaggactgaatcggttggtccccttcttaagaccattagtacagaaaggcctgcgttccgtgattctgttcggtgtccctttgcatccatctgcaaaggatgcgctgggaaccgctgcagatgacccgaccggtccagtagttcaggccatacgccttcttcgttcgcgctttcctcaactttatatcgtgacggatgtttgtctttgtgaatacacctcacatggtcattgcgggatactacgtgaggatgggacgctcgataacgcacagtccgttgatagaatctcagatgtagccctcgcctatgctgctgccggtgctcactgcgtggctncgtcagatatgaatgacggcagaatccgngccataaagctgaagcttattggaactggca

SEQ ID NO: 3774 - DNA, 1174 bp, Aspergillus niger
  misc_feature (1)...(1174): n = A,T,C or G
ggaaccacgggttgccgttgtagtacgtgtcctcagggtaccgacccaccgcaacagcctcgctgtcactgagaccatcgttgagggtatagattgagcggaaagagtctacaacctccttgtggttggcgagcgcgcgcggggagcagggctggaaggtggagtcgtcgcatgcggcctcaggatcaaaggtgtggatgcttcccaggagggtgtttgcggtcacagatgtgtcgctggacttcttcaaggcactgtacagcgatgctgctactggcacctactcttcgtccagttcgacttatagtagcattgtagatgccgtgaagactttcgccgatggcttcgtctctattgtggaaactcacgccgcaagcaacggctccatgtccgagcaatacgacaagtctgatggcgagcagctttccgctcgcgacctgacctggtcttatgctgctctgctgaccgccaacaaccgtcgtaactccgtcgtgcctgcttcttggggcgagacctctgccancaacgtgccccggcacctgtgccgggcacatctgccattggtacctacagcartgtgactgtcacctcgtggccgagtatcgtggctactggcggcaccactacgacggctacccccactggatccggcagcgtgacctcgaccagcaagaccaccgcgactgctagcaagaccagcaccagtacgtcatcaacctcctgtaccactcccaccgccgtggctgtgactttcgatctgacagctaccaccacctacggcgagaacatctacctggtcggatcgatctctcagctgggtgactgggaaaccagcgacggcatagctctgagtgctgacaagtacacttccagcgacccgctctggtatgtcactgtgactctgccggctggtgagtcgtttgagtacaagtttatccgcattgagagcgatgactccgtggagtgggagagtgatcccaaccgagaatacaccgttcctcaagcgtgcsgracgttgaccgcgaccggtgactgacacctgggcggtagacatcawtccaatttcgctataattaaaaggatggggatgaagggcaattggttwtatgatcatggtatgtagntgggtgttnatnaatagtagtgaaatgggagccaaagtcatgttgattgt

SEQ ID NO: 3775 - DNA, 1389 bp, Aspergillus niger
gtcaacctccggcagcatggacgacctctacaacatgatcaacaccgtcaaatccgactgtccagactcaacactcctgggcacattcgtcgagaaccacgacaacccacggttcgcttcttacaccaacgacatagccctcgccaagaacgtcgcagcattcatcatcctcaacgacggaatccccatcatctacgccggccaagaacagcactacgccggcggaaacgaccccgcgaaccgcgaagcaacctggctctcgggctacccgaccgacagcgagctgtacaagttaattgcctccgcgaacgcaatccggaactatgccattagcaaagatacaggattcgtgacctacaagaactggcccatctacaaagacgacacaacgatcgccatgcgcaagggcacagatgggtcgcagatcgtgactatcttgtccaacaagggtgcttcgggtgattcgtataccctctccttgagtggtgcgggttacacagccggccagcaattgacggaggtcattggctgcacgaccgtgacggttggttcggatggaaatgtgcctgttcctatggcaggtgggctacctagggtattgtatccgactgagaagttggcaggtagcaagatctgtagtagctcgtgaagggtggagagtatatgatggtactgctattcaatctggcattggacagtgagtttgagtttgatgtacagttggagtcgttactgctgtcatccccttatactcttcgattgtttttcgaaccctaatgccaagcacgctagtctattataggaaaggatccggattaatgtgttttcataacgcggtactgtatggtacttctgtattatatcaccgaagctcatgtatcttacatgtatatattatacagacacaaccttggttatgtacatcaaactcaaactcactgtccaatgccagattgaatagcagtaccatcatatactctccacccttcacgagctactacagatcttgctacctgccaacttctcagtcggatacaataccctaggtagcccacctgccataggaacaggcacatttccatccgaaccaaccgtcacggtcgtgcagccaatgacctccgtcaattgctggccggctgtgtaacccgcaccactcaaggagagggtatacgaatcacccgaagcacccttgttggacaagatagtcacgatctgcgacccatctgtgcccttgcgcatggcgatcgttgtgtcgtctttgtagatgggccagttcttgtaggtcacgaatcctgtatctttgctaatggcatagttccggattgcgttcgcggaggcaattaacttgtacagcactacgccggcggaaacgaccccgcgaaccgcgaa

SEQ ID NO: 3776 - DNA, 1048 bp, Aspergillus niger
  misc_feature (1)...(1048): n = A,T,C or G
cctgctgcgtcggcgaagtcgacaacggcaaccctgccctcgactgcccataccagaaggtcctggacggcgtcctcaactatccgatctactggcaactcctctacgccttcgaatcctccagcggcagcatcagcaacctctacaacatgatcaaatccgtcgcaagcgactgctccgatccgacactactcggcaacttcatcgaaaaccacgacaatccccgtttcgcctcctacacctccgactactcgcaagccaaaaacgtcctcagctacatcttcctctccgacggcatccccatcgtctacgccggcgaagaacagcactactccggcggcaaggtgccctacaaccgcgaagcgacctggctttcaggctacgacacctccgcagagctgtacacctggatagccaccacgaacgcgatccgcaaactagccatctcagctgactcggnctacattacctacgcgaatgatgcattctacactgacagcaacaccatcgcaatgcgcaaaggcacctcagggagccaagtcatcaccgtcctctccaacaaaggctcctcaggaagcagctacaccctgaccctcagcggaagcggctacacatccggcacgaagctgatcgaagcgtacacatgcacatccgtgaccgtggactcgagcggcgatattcccgtgccgatggcgtcgggattaccgagagttcttctgcccgcgtccgtcgtcgatagctcttcgctctgtggcgggagcggaagattatacgtcgagtaatccggagtggtcggttactgtgacgttgccggtggggaccactttcgagtataagtttattaaggtggagtcggatgggactgttacttgggaaagtgattcgaatcgggagtatacggtgccggagtgtgggagtggggagacggtggttgatacttggaggtagatgatctgagatttctaagtgtgatgagggtggttttggtgnatgtaagtttgggctttggtagtgttggggttgggttgggttaatggatatggtatgg

SEQ ID NO: 3777 - DNA, 670 bp, Aspergillus niger
  misc_feature (1)...(670): n = A,T,C or G
agccaaggcaccaccaccatggtcatgcgtcgtcccgccgaggtcttcctgaacgagctgggcgttccctacgaggaagacctagcgaaccccaactacgttgtggtcaagcacgcctcgctgttcacctcgaccctgttgtccaaggttctctccttccccaacgtcaagctcttcaacgccaccagcgtggaggacctgatcactcgccctgctgccagcggcgaccccaaggaagtccgcattgccggtgtggtcacgaactggaccctggtcacactccaccacgacgaccactcctgcatggaccctaacaccatcaacgctcccgtgatcatcagtaccaccggccacgacggtcctttcggtgccttctcggccaagagactcgtctccatgaacagcgtcgacaagctgggcggtatgcgcggcttggacatgaactcggccgaggacgccatcgtcaagaacacccgtgaggtcaccaagggtttgatcatcsgtggtatggarctgtcsgagatcgatggcttcaamcgcatgggtcctactttcggtgctatggtcctgagcggtgtcaaaggtgccgaggaagcgctgcagatctttgacgarcgtaagcgcgagtgcgctgagtaaatgtcttcagtcaactcaaattgagtgngag

SEQ ID NO: 3778 - DNA, 612 bp, Aspergillus niger
  misc_feature (1)...(612): n = A,T,C or G
attggcgctaccgacaccctgcacggcttcatcaagcagcacaccagccaggaccgcgtcgagtccctgtatgaccgcgcccagtttgccaactctgccattgaccgcatcgtccctcagcaagcccccaacagtggcctcgacgtccgcattgagaagttctacgaatgggctgtcgagaagactccctttggctctgtcggccacccagacattcctgccatccactgggttgacaacctggagccatacattgagcgcaaactgttcactgtcaacaccagccatgctactactgcctactttggtcacttccggggcaagaagatgattgctgacgctctggaggacaaggagatccgtggacttgttcacaaggttctcgaggagactgcctcactcatcgtggccaagcacgacatctcagaggaggagcagaaggagtacgtcgagaagatcgtcagccgcatctccaacccttatctggaggacaatgtcgatcgcgtgggtcgtgctcccctgcgcaagctgtctcgcaaggagcgtttcattggaccggcttcacagctggccgagcgcggcatgaagtatgactcnttgatggatgctgtc

SEQ ID NO: 3779 - DNA, 582 bp, Aspergillus niger
  misc_feature (1)...(582): n = A,T,C or G
ccagcacacaatgttccttcgttccgttactcgcgctgctgctcgcagctcggctgtgcccaccacgggcctgcgctcctaccgcaccgtttcgggcccaatggcttgcctgaacgctcgtcctcagactgagaagaagtctatcgctccccagcagacccgcgccgcctccgagcatgccatctcgaatcccacactcgccggtattgagaagcgctgggaggccatgccccctcaggagcaggccgagctgtggatgcagctgagggaccgcatgaaggtcgactggcaccagatgactctccaggagaagaaggccgcctactggatctccttcggaccccacggccctcgttccgtgccccccaagggcgagaacctcaagatcttcttcaaggtcgccagctcaccctcgtcagctttggtattttctacgtcatccacctgttcgccaaagccccagcccaagaccatgaccaaggagtggcaggaggccttcaatgagtatgctaagcaagagaagatcaaccctatctacggnatcagcgccganggttacganggcaagggcttcgtccanac

SEQ ID NO: 3780 - DNA, 643 bp, Aspergillus niger
  misc_feature (1)...(643): n = A,T,C or G
tttctccaagttgttcgaccgcctatggggccgcaaggagatgcgtattctgatggtcggtctcgatgccgccggtaaaaccaccatcctgtacaagctcaagctgggtgaaattgtcaccaccatccccacgattggtttcaacgtcgaagaccgtcgaatacaagaacattcagttcaccgtctgggacgtcggtggtcaggacaagatccgtcctctctgggagacactacttccagaacacccagggtatcattttcgttgtcgacagcaatgaccgtgaccgtatcgtcgaggcccgtgaggagttgcagcgcatgttgaacgaggatgaactccgtgacgcccttctcctgggtgttcgccaacaagcaagatttgccgaacgccatgagccctgccgagatcactcagcagcttggtctgcagagcctcacccgccgtccctggtacatccaatccaactgcgccacgactggtgacggtctgtacganggtctggagtggctttgctgagacgctgcggaaaacgaancgcgactaaaactgatcatctaatgagtggaagaatacctggaagtttgtgaacctgggaanttgcngatgctggattggggaaacgggggccggcaaagtcacctc

SEQ ID NO: 3781 - DNA, 621 bp, Aspergillus niger
ccactcaccttccgcgcatcgccatctgcgatcctccccacaacactccacctagatacatacaccgttaactgcgcttctacaacatgcagatcttcgttaagaccctaaccggcaagaccatcaccctcgaggtcgagtccagcgataccatcgacaacgtcaagaccaagatccaggataaggagggcatccctcccgaccagcagcgtctgatcttcgcgggaaagcagctggaggatggccgcacgcttagtgactacaacatccagaaggagtctactctccatcttgtcctccgcctgcgtggtggtatgcagattttcgtcaagaccctgaccggaaagaccatcacccttgaggtggagtcttctgacaccatcgacaatgtgaagaccaagattcaggacaaggagggcattcccccggaccagcagcgtctgatcttcgctggaaagcagctggaggatggccgtaccctgtctgactacaacattcaaaaggaatccacccttcacctcgtccttcgtctgcgtggtggtatgcagatcttcgtcaaagactttacgggaaagacgatcacattgggaagttgaatcttccgacacaattggataacgt

SEQ ID NO: 3782 - DNA, 839 bp, Aspergillus niger
  misc_feature (1)...(839): n = A,T,C or G
atcatcaccttcctagcccacgaaatcctctatttcgcccgctgcatcccgtggataatcgccgacgctcttcctacattatttcaccgtttcaagattcaggacaaaaaggcacccccatcggcaaaggaacaatggagctgtgtgaaatatattcttgctatccacttcattgtggaaatgcccatgatcgttctgttccacccgatgatggaactcttcggtctcaaatacgcccttcctttccccgacctcaagaccctcgccattcaaatcacaatcttcttcttcgttgaagatacataccactactggctccatcgtgcctttcactggggccctctgtatcgtgccattcaccgggtgcaccaccagtatgccgcgccgtttgggttgacggccgagtacgccagcccgtgggagaccatgcttcttggcctgggcacgattggaccccctttggttctgggctactttaccggcgaagtgcatttgatgactgtgctggcctgggtggctttgcgtcagttccaggccatcgacgcgcattctggatacgatttcccttggagcctgagacggatcttcccgctgtggggaggatcggactggcatgacgatcaccatcggtacttccgggggaactactctagctcgtttaagcactgggatatcttaatgggaacggttgccggtccccggggaaagaagatgcggcaagagtgatacttccaagaacgcgtttattattattctctgtacagtaatacattataatataatataatcttacgacccgacaatcgagaaatcatcataccagcgaaaaaaaaaaanac

SEQ ID NO: 3783 - DNA, 530 bp, Aspergillus niger
  misc_feature (1)...(530): n = A,T,C or G
cgagcggcgatacttgccatcccagctgtggntgaattcntgggcgatcacgttgcggtcccagtcataggcggnccagtcggtcaggctcttgggttcctgctggntttcgctggaacggtggtgttccaggccgntgctgcccatgcgatcggtcagcgcgagcaggaaatcgtatngatcgaaatggcgcgcgccgaatgcgcccacggcttcgtcggccaggttgcgataggcggccaggttttccggcttgatcnccagcagctcgggcttgtcggccaccanatcgaaatagacgttgtgggccaaatctgccgcgcggcataaancccggcanagatcggcgaatcgaccagggtttcatagtcggtttcggcccaagtcacggtattgcccgcgccgctctgcgtcttgccatccaancgcggtnaacacngtccanccctgccggaanctgacngtgggacgcaccttgatctggcgcacaatagtgaaccgggnggganacatggtcancctctcccaat

SEQ ID NO: 3784 - DNA, 586 bp, Aspergillus niger
  misc_feature (1)...(586): n = A,T,C or G
cgccgatggnttcgtctctattgtggnaactcacgccgcaagcaacggntccatgtccgagcaatacgacaagtctgatggcgaacaactttccgctcgcgaactgacctggtcntatgctgctctgctgaccgccaacaaccgtcgtaactccgtcgtgcctgcttcttggggcgagacctctgccaacaacgtgcccggcacctgtgcggncacatctgccattgggtacctacagcaatgtgactgtcacctcgtggccgagtatcgtggctactggcggcaccactacgacggntacccccactgggattcggcagcgtgacctcgaacaacaagaccaacgcgactgctaacaagaccagcancagtacgtcatcaanctcctgtaccactcccaacgncgtggctgtgactttcgatctgacaagctaccaacaactacggngagaacatctanctggtcngatcgatttctcaactgggtgactggggaaaccagcgacggnataactctgaattgctgacaagtacacttcagcgacccgctctggtatgtcactgtgactctgccngntggggaatc

SEQ ID NO: 3785 - DNA, 823 bp, Aspergillus niger
gctctataccagtgggacaagcaggggtcgttggaggtcacagatgtgtcgctggacttcttcaaggcactgtacagcgatgctgctactggcacctactcttcgtccagttcgacttatagtagcattgtagatgccgtgaagactttcgccgatggcttcgtctctattgtggaaactcacgccgcaagcaacggctccatgtccgagcaatacgacaagtctgatggcgagcagctttccgctcgcgacctgacctggtcttatgctgctctgctgaccgccaacaaccgtcgtaactccgtcgtgcctgcttcttggggcgagacctctgccagcagcgtgcccggcacctgtgcggccacatctgccattggtacctacagcagtgtgactgtcacctcgtggccgagtatcgtggctactggcggcaccactacgacggctacccccactggatccggcagcgtgacctcgaccagcaagaccaccgcgactgctagcaagaccagcaccacgacccgctctggtatgtcactgtgactctgccggctggtgagtcgtttgagtacaagtttatccgcattgagagcgatgactccgtggagtgggagagtgatcccaaccgagaatacaccgttcctcaggcgtgcggaacgtcgaccgcgacggtgactgacacctggcggtagacaatcaatccatttcgctatagttaaaggatggggatgagggcaattggttatatgatcatgtatgtagtgggtgtgcataatagtagtgaaatggaagccaagtcatgtgattgtaaaaaaaaaaaaaa

SEQ ID NO: 3786 - DNA, 614 bp, Aspergillus niger
  misc_feature (1)...(614): n = A,T,C or G
gggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaattttaacaaaattcagaagaactcgtcaagaaggcgatagaaggcgatgcgctgcgaatcgggagcggcgataccgtaaagcacgaggaagcggcagcccattcgccggcaagctcttcagcaatatcacgggtagccaacgctatgtctgatagccggtccggcacacccagccgggcacaagtcgatgaatncagaaaaagcgggcattttccaccatgatattcgg

SEQ ID NO: 3787 - DNA, 895 bp, Aspergillus niger
cgcgaactctacggaccgtcacaatggcctccactgctaccactgtccccaccaaggagcaggttctcgtccccgagaccctcctgaagaagcgcaagagccaggagcaggctcgcgctgtcgcccgtgaggaggccgagaagaagaaggccgccaacaaggagaagcgcgccgttatcttcaagcgtgccgagtcctacgtcaaggagtaccgcgatgctgagcgcgagaagatccgccttgcccgcgttgctcgcaaggagggtaacttctacgttgctgacgagcccaagcttgtcttcgttatccgtatcaagggtatcaacaagatccctccccagccccgcaagatcctccagctgctccgtctgctccagatcaacaacggtaccttcgtccgtcttaccaaggctacccaggagatgttgaccatcatcaacccctacattgcctacggttaccccaacctcaagtccgtccgtgagctcgtctacaagcgcggttacggaaaggtcgacaagcagcgtgttcccctcamcgacaaccagatcattgaggagaacctcggcaagtacggcattgtctgcatggaggatcttatccacgagatctacaccgttggccccaacttcaagcaggccaacaacttcctgtggcccttcaagctctccaaccccactggtggcttccacacccgcaagttcaagcacttcatcgagggtggtgactacggtaaccgtgaggagaacatcaacggcctcatccgccaagatgaactagattcatcatcggtgatggcttgtccgtaccgggttgttatgagctccgaatttcctagttarcgggtactggtctaaaatctgggtacaaaaatttaaaagcttcgtacaacctg

SEQ ID NO: 3788 - DNA, 640 bp, Aspergillus niger
  misc_feature (1)...(640): n = A,T,C or G
ttttcgacaacctcaccgttcgcaggaagtgcagccgccccatttccagcagtcaagatggcccgtcgtcccgcgagatgttaccgctactgcaagaacaagccctaccctaagtcccggttcaaccgtggtgttcccgaccccaagatccgtatcttcgatctgggacgtaagaaggccaacgtcgatgacttccctctttgcgttcacctcgtctccaacgagtacgagcagctgtcctccgaggccctcgaagccgcccgtatctgtgccaacaagtacctcgtgaagatcgccggtaaggaaggtttccacctccgtgtccgtgtgcaccccttccacgtcattcgtatcaacaagatgttgtcttgcgccggtgccgatcgtctccagaccggtatgcgtggtgccttcggtaagccccaaggtaccgttgcccgtgtgaacattggccagatcattctgtccgtccgcacccgtgacaccaaccgtgctgctgccatcgaagctctccgccgctccatgtacaaagttccccggtcgccaaaagatatcgtctccaagaactggggtttcactcccgtccgccgcgaaggactamgtcmagctccgccaaggagggcaagctcaancaaggatg

SEQ ID NO: 3789 - DNA, 598 bp, Aspergillus niger
  misc_feature (1)...(598): n = A,T,C or G
cgcaactgagagcctgagcttcatccccagcatcattacacctcagcaatgtcgttccgatctctactcgccctgagcggcctcgtctgcacagggttggcaaatgtgatttccaagcgcgcgaccttggattcatggttgagcaacgaagcgaccgtggctcgtactgccatcctgaataacatcggggcggacggtgcttgggtgtcgggcgcggactctggcattgtcgttgctagtcccagcacggataacccggactacttctacacctggactcgcgactctggtctcgtcctcaagaccctcgtcgatctcttccgaaatggagataccagtctcctctccaccattgagaactacatctncgccaggcaattgtccagggtatcagtaacccctctggtgatctgtccagcggcgctngtctcggtgaaccaaagttcaatgtcgttaaactggctacactggtcttggggacggccgaacgagatggtccggttttgaaanaactggtttgatcggtttcggcaatggcttgttgaaatggttcaccagcaccgaacggaaattgttggcccttgttaggaccactggc

SEQ ID NO: 3790 - DNA, 581 bp, Aspergillus niger
  misc_feature (1)...(581): n = A,T,C or G
cgaggactctgaggacagtgttttggaatttgactatgtggaagaaccgttttcattcaccatctccaagggagatgaggtcctgtttgactcttcggcatcaccactagtttttcagtcgcaatatgtgaaccttcgcacctggttgcccgatgatccctatgtgtatggtctcggagagcattctgaccctatgcgcttgccaacatacaattacacgcggaccctttggaaccgcgacgcgtatggcactccaaacaacaccaacttgtacggtagtcatcctgtctactatgatcaccgtggaaagtccggaacttatggagtcttcctgctgaactctaatggtatggacatcaagatcaaccaaacgacagatggaaagcagtacttggaatacaatcttctcggcggtgttctggacttctacttcttctacggagaagatcctaagcaagcgagcatggaatactcaaagattgtcggtcttccggcaatgcagagttactggactttcggcttncatcaatgccgntatggataccgcgatgtgtatgaacttgccgaggtgggctacaact

SEQ ID NO: 3791 - DNA, 592 bp, Aspergillus niger
  misc_feature (1)...(592): n = A,T,C or G
gtagactacagcgtcttcgaccccttcgattcctcctcctacttccacccatactgcctgatcacagattgggacaacttgaccatggtccaagattgttgggagggtgacaccatcgtatctctgccagacctaaacaccaccgaaactgccgtgagaacaatctggtatgactgggtagccgacctggtatccaattattcagtcgacggactccgcatcgacagtgtcctcgaagtcgaaccagacttcttcccgggctaccaggaagcagcaggtgtctactgcgtcggcgaagtcgacaacggcaaccctgcctcgactgcccataccagaaggtcctggacggcgtcctcaactatccgatctactggcaactcctctacgcttcgaatcttcagcggnagcatcagcacctttacacatgacaaatccgcggaaggcgatggttccatccgcactattggaacttatcgaaacacgacatcccgttngctctaacntcgatcttgaagccaaaacgtcttaagtcntttctttcgacggatcccatggttaccccgggaanaacagacttatcgggggaaggggc

SEQ ID NO: 3792 - DNA, 624 bp, Aspergillus niger
  misc_feature (1)...(624): n = A,T,C or G
gtcaagtcttccatcgactttcatcacaaaaaccctcgtgcaattcccacctaccacacccttaaagcaacatgtctcctcccgctgctatcttcgagcccaccgtggtccccactggcatcaagtccaacgtggtggtcccggaggccgctcccgtcactggctcgtcccagacccagctgcttgaccacttcgctggcaagtgggacaacttcaagttcgctcccatccgtgagagtcaggtttcgcgtgctatgaccagacgctacttccaggatctggacaagtacgctgagagtgacattgtcattgtgggtgctggttcctgcggtttgagcaccgcgtatgttctggccaaggctcgcccggacctgaagattgccattatcgangccaatgtttcccctggtggtggtgcctggcttggtggcaactcttctccgccatggtcatgcgtcgtcccgccgangtcttcctgaacgaactgggcgttccctacgaagaagactagcgaaccccaactacgttgtggtcaaagcaacgcctcgctgttcaactcgaacctgttgtccaagggtctctccttcccaacgtcaagctcttcaacgccaacaacgtggaggg

SEQ ID NO: 3793 - DNA, 622 bp, Aspergillus niger
  misc_feature (1)...(622): n = A,T,C or G
gccaattttatccatcagttcgttcancctccttcgaacataatccgacaagatgggtaagggacagccccgtggtttgaacgccgcccgcaagctcgcgaccacccgtcgcgagaaccgctgggccgatctgcactacaagaagcgcctcctcggtactgcctacaagtcctctcccttcggaggtgcctcccacgccaagggtatcgttcttgagaaggtcggtgttgaggccaagcagcccaactccgctattcgcaagtgtgtcaaggtccagctcatcaagaacggcaagaaggttaccgctttcgtccccaacgatggttgcttgaacttcatcgatgagaacgacgaggtcctcctcgccggtttcggtcgtaagggcaaggccaagggtgatattcccggtgtccgtttcaaggtcgtcaaggtttccggtgtcggtctgctcgctctctggaaggagaagaaggagaagccccgctcttaaataacccaaaccctggggaatttaataaagatgctattaacggggtggaanggggcccantccatggaagaaacttcngggcaaangcaaagcaaacacaagtctaatggtctgggaattgatgggtcaaga

SEQ ID NO: 3794 - DNA, 891 bp, Aspergillus niger
caacgacaccgtccgccacctacacgtatccctccctcggcaacaggtgcatacgtcgaccaaaatgtctgaacacggcgaagtcgaggtcgaaaaccccgctgcggccttccaggtcctgcccaaggaggctatcgcggagatgggatccgtgaagctgttcaacaagtggagctacgaggatgttgagatcagggacatctccttgaccgactacgtccagatccgctcccctgtctaccttcctcactccgctggccgttatgccgccaagcgtttccgcaaggctcagtgccccatcatcgagcgcctgaccaactccctcatgatgaacggccgcaacaacggaaagaagctcatggctgtccgcatcgttgcccacgccttcgagatatccacatcatgaccgaccagaaccctctccaggtcgccgttgacgccattgtcaactgcggtcctcgcgaagacagcacccgtatcggttccgctggtaccgtccgtcgtcaggccgtcgatgtgtctcctctccgccgtgtcaaccaggctattgccctcctgaccatcggtgctcgcgaggcctctttccgtaacatcaagagcattgctgagtgcctggctgaagagctcatcaacgccgccaagggttcctccaactcctatgccatcaagaagaaggacgagctcgagcgtgttgccaagtccaaccggtaaagtgggaattttgggcgtattctccgtttggtcctggttttgcgtgtactggagtggacggggggtttattaggattcagtcgatttgcatgcatctgcgcgactgtacatacctgaaaacagtcacgggagggagcgagatcctaaaaatgagagaatcggacggctttcttctacagt

SEQ ID NO: 3795 - DNA, 661 bp, Aspergillus niger
cgaaggtttaggaagacaagtcttgtcgagaccttcatcaagatgcagatcttcgtcaagacccttacgggtaagactatcaccctcgaggtggagtcctcggacaccattgacaatgtcaagtccaagatccaggacaaggagggtatccccccggaccagcagcgtctgatcttcgctggtaagcagctcgaggacggccgtactctttcggactacaacatccagaaggagtccaccctccacctggtgctccgcctgcgtggtggtggtaagaagcgcaagaagaaggtctacaccacccccaagaagatcaagcacaagcacaagaagaccaagcttgccgtcctcaagtactacaaggtcgacggtgatggcaagattgagcgtcttcgccgcgagtgcccctcccccgagtgcggtgctggtatcttcatggccgctatgcacaaccgccagtactgcggaaagtgccacctcacctacgtcttcgacgagtccaaataagtggactttgccgatcgttccgccatgtcttctttccggtagcgcctarcaatgtcggtcgtgaatgtgtggtggatgaggttgggacgtgtgcgctttgatcgtcccatagtgaccaarcaatgagaaacgaaaaaaattcgaaaccgctctc

SEQ ID NO: 3796 - DNA, 605 bp, Aspergillus niger
  misc_feature (1)...(605): n = A,T,C or G
gcggcacctgctttggctgcaacgcctgcggactggcgatcgcaatccatttatttccttctcacggatcgatttgcaaggacggatgggtcgacgactgcgacttgtaatactgcggatcagaaatactgtggtggaacatggcagggcatcatcgacaagttggactatatccagggaatgggcttcacagccatctggatcacccccgttacagcccagctgccccagaccaccgcatatggagatgcctaccatggctactggcagcaggatatatactctctgaacgaaaactacggcactgcagatgacttgaagcgctctcttcggccttcatgagagggggatgtatcttatggtcgatgtggttgctaccatatggctatgatggagcgggtagctagtcgattacagtgggttaaccgtcagttccaagatacttcacccgtctgtttcatcaaactntaagatcagactaagttgaggatgctgctagganatacatgcttcttgcctgactcgatccnccaggttnggcaaaataatgnncaatggtggacatgggatgactatcattgcggctccgnttgacnagaaaccct

SEQ ID NO: 3797 - DNA, 605 bp, Aspergillus niger
  misc_feature (1)...(605): n = A,T,C or G
ttcatgctcaaggacatgatggcgaagaccgcccagcttgaacagttcgacgaggagctctacaaagtcacggaaagtgaagacaagtccaccgacaagtatctaattgctacttcagagcaaccactttcagccttgcatgacggagagtggctgcaagataaagatctcccaatcaagtacgctggatatagcacttgctaccggaaagaggcaggtgctcatggtaaggatgcatggggcatctttcgtgtccatcagttcgagaagatcgaacaatttgtcctcacgaaaccggaagactcgtggcaagcttttgacgaaatgatggccacttcggaagaattctaccggtctcttggcctaccgtaccaggttgtcgctattgtttcgggagcattgaacaatgccgcatcgaagaagtatgacctcgangcgtggttccatttcaaggagagtataaggaataatatcctgcttcaactgtcccgatatcaatccagagccctagaaatcgctatgcacgaaaaaggttctgatgtgaanaatctacgttatgccctgatgcgactttgnggcaancgacgtcatttgtgggncttgaa

SEQ ID NO: 3798 - DNA, 750 bp, Aspergillus niger
  misc_feature (1)...(750): n = A,T,C or G
caacgcttcttgcaccaccaactgccttgctcccctcgccaaggtcatcaacgacaagttcggcatcgttgagggtctcatgaccaccgtccactcctacaccgctacccagaaggtcgtcgatgccccctccagcaaggactggcgtggtggccgtactgcggcccagaacatcatcccctcttccaccggtgctgccaaggctgtcggcaaggtcatccctacccttaacggcaagctcaccggtatggccatgcgtgtccccacctccaacgtctccgttgtcgacttgacctgccgcctcgagaaggccaccagctacgacgagatnaagaaggccctcaaggacgcttccgagaacgagctcaagggcatcctcggctacactgaggacgacatcgtctcctccgacctgaacggtgacgaccactcctccatcttcgatgccaaggccggtatcgcccttaactccaacttcgtcaagctcgtctcctggtacgacaacgagtggggttactcccgccgtgtcgtcgacctcattgcctacatctccaaggttgatgcccartaggaatcaggacggcaaactgaattcagaagtgtgctgtgagtgagactgattgccgagcgcagacgactctcgtggaacccggcttgtggagaagcttgagaaggtcttaactcctagcgtaaaagctcatgatgacgtacaatttaatgaaatgatacaatgttcatatttccaaaaaa

SEQ ID NO: 3799 - DNA, 612 bp, Aspergillus niger
  misc_feature (1)...(612): n = A,T,C or G
gcaggggtcgttggaggtcacagatgtgtcgctggacttcttcaaggcactgtacagcgatgctgctactggcacctactcttcgtccagttcgacttatagtagcattgtagatgccgtgaagactttcgccgatggcttcgtctctattgtggaaactcacgccgcaagcaacggctccatgtccgagcaatacgacaagtctgatggcgagcagctttccgctcgcgacctgacctggtcttatgctgctctgctgaccgccaacaaccgtcgtaactccgtcgtgcctgcttcttggggcgagacctctgccagcagcgtgcccggaactgtgcggccacatctgccattggtacctacagcagtgtgactgtcacctcgtggccgagtatcgtggtactggcggaacactacgacggtaccccactggattcggagcgtgactcgacancaagacaccgcgactgctacaagacagcacagtacgtcacaactctgtacatcccacgccgtggtgtgctttcattgacagtacacaactacggcaaaaatcactgtcgnttattccaactggtactggaaacaacgaggatacnctatgctgnaata

SEQ ID NO: 3800 - DNA, 839 bp, Aspergillus niger
  misc_feature (1)...(839): n = A,T,C or G
gtatctctgncagacctaaacaccaccgaaactgccgtgagaacaatctggtatgactgggtagccgacctggtatccaattattcagtcgacggactccgcatcgacagtgtcctcgaagtcgaaccagacttcttcccgggctaccaggaagcagcaggtgtctacttcgtccagttcgacttatagtagcattgtagatgccgtgaagactttcgccgatggcttcgtctctattgtggaaactcacgccgcaagcaacggctccatgtccgagcaatacgacaagtctgatggcgagcagctttccgctcgcgacctgacctggtcttatgctgctctgctgaccgccaacaaccgtcgtaactccgtcgtgcctgcttcttggggcgagacctctgccagcagcgtgcccggcacctgtgcggccacatctgccattggtacctacagcagtgtgactgtcacctcgtggccgagtatcgtggctactggcggcaccactacgacggctacccccactggatccggcagcgtgacctygacmagcaagaccaccgcgactgctagcaagaccagcaccagtacgtcatcaacctctgtaccactccaccggcgtggctgtgactttcgatctgacagctacaacaactacggngagacatntactggncngatcgactttactgggtgatgggaaccagcgacggatactttgatgttgcaagtacattcaggacccgtttggatgcatgnacttgccgtgngatcgttgatcagttatcgatgaagcatnctcggatggaaggtccaccgaatcccgtctagnggcgacgtan

SEQ ID NO: 3801 - DNA, 618 bp, Aspergillus niger
  misc_feature (1)...(618): n = A,T,C or G
gctgcccttggccaccgcgcagacctacacagactgtgaccctctcaacaagacctgccctgctgatacggctttgagctccaccaccttcaccactgatttcaccactggctctttcagtggctggattgctaccgccaacaatgtcacctttaccgatgagggtgccaacttcgtcatcagcgagaagggtgaagctcccaccattgagaccgatttctacttctttttcggcaaggccgaggttgtcatgaaggccgccagtggtaccggtatctgcagcagtgttgtcctggagtcggatgatctcgacgagattgactgggaagctcttggtggtgacaccactcagattgagaccaactacttcggcaagggtgacacatcctcctacgaccgtgctacctgggcaaccgtgtcgaccccccaggagaccttcacacttacaccgttgagtggactgaatccgccactacctggagcatcgacggcactgttgtgcgcacccttgcctacagcgatgcccanagcggtacttcgctaccccagacttccatgcgcttgaacttggtatctgggctgctggtgacttctntgagcccganggtaccatcgaan

SEQ ID NO: 3802 - DNA, 612 bp, Aspergillus niger
  misc_feature (1)...(612): n = A,T,C or G
atgattgacctgtctgaggagcccgtcgactacaacatccagaccaccgccgcctacctcaagcgtgctgctcccatgaagcagtggctcgagatggaaatcggtatcaccggtggtgaggaggatggtgtcaacaacgaggatgttgacaacaactccctgtacactcagcccgaggacatcctggccatccacaacgccctcgcccccatcagcccctacttctccattgccgctggtttcggtaatgttcacggtgtctacaagcccggcaacgtccgtctccaccccgagctcctccagaagcaccaggcctacgtcaaggagaagaccggctcctcctctgacaagcctgtcttctttgtcttccacggtggctctggctcttccaaggaggagtacaaggaggctatcagctacggtgttgtcaaggtcaaccttgacaccgacatgcagttcgcctacatgtccggtatccgtgactacatgctcaacaagaaggactaccttctgaccgctgtcggtaaccccgacggtgaggacaaagcccaacaagaagttcttcgacccccgcgtcttgggttcgtganggtgagaagaccatgaccaact

SEQ ID NO: 3803 - DNA, 324 bp, Aspergillus niger
gttgaacaagtaggcatcaactgggcttatagctttgttaaacgccacgaatccctacgaactcgatttgctagacgactcaactatcaaagagctaaaatggaggatcctgaagttataaaagactggttcaaacgcgtacaggaagttattcaagagtacgggatctcatcagatgatatatacaatttcgatgaaacagggtttgctatgggaatgattgctacatataaagtagtaactagttcccagagggcaggtcggccgtccctagttcaaccagggaatcgggaatgggtcactgcaattgagtgtattcgctct

SEQ ID NO: 3804 - DNA, 651 bp, Aspergillus niger
atcgtcccttcgcttttcgagtcccgttcggaaagcgaccttgagaggaacaccgcaaaaatggctgacgagcactacaacgccgaggaggctgccgagatcaagaagagaagacagttccgcaagttcacctaccgcggtattgacctcgaccagctccttgacctctcctccgaacagctccgtgatgtcgttcacgcccgcgctcgtcgtcgcttcaaccgcggtctgaagcgcaagcccatgggtctcatcaagaagctccgcaaggccaagcaggaggctcgccccaacgagaagcccgacctcgtcaagacccacctccgtgacatgatcgttgtccccgagatgatcggcagcgtcatcggtatctactccggtaaggagttcaaccagatcgaagtcaagcccgagatggttggccactacctgggtgaattctctatctcctacaagcccgtcaagcacggtcgtcccggtatcggtgccacccactcttcccgtttcattccctcaagtwaagaagaaaagctttagtggatggagtgtcgtcgtgtggaggaggaactccgggcgtacggaatgttgctggggaagatctctagggataaagggaaaaaaaatcaaaaactgggttgggtaccatatggg

SEQ ID NO: 3805 - DNA, 632 bp, Aspergillus niger
  misc_feature (1)...(632): n = A,T,C or G
cccaatcttagcattttgagacagtcgccatgggtcgcgtgatccgcaaccagaggaagggtcgtggatccattttcacggcaaacacccgtctcaacaaggctcctgcccagttccgcaccctcgactacgccgagcgtcatggatacactcgtggtgtcgtgaaggagatcatccacgaccccggccgtggtgctcccctcgccaaggtccagttccgtcacccctacaagttcaagaccatcaccgagaccttcatcgccaacgagggcatgtacaccggtcaattcgtctacgccggaaagaacgccgcctgactgtcggaaacgtccttcccctcgcctccgtccctgagggtaccgttgtgaccaacgtcgaggagaaggctggtgaccgtggtgctcttggtcgtacctccggtaactacgttaccgtcatcggcacaaccccgaggagggcaagacccgtgtcaagcttcctccggtgccaagaaggtcgtcaagaacaccgcccgtggtatgatcggtatcgtcgctggtggtggtcgtaccgacaagcctttgctgaangcttctngngccaagcacaagttcgntgtcaaagcgcaactnttgggccaagacccgtggtgg

SEQ ID NO: 3806 - DNA, 588 bp, Aspergillus niger
  misc_feature (1)...(588): n = A,T,C or G
aattaaaccacatcacacaccctccctccaaaatggccaccaacatcacctaccacgccagcgccctcacccgcaccgagcgcagcgacctgcgctcccagcgcggtctcacaatctggctgacgggtctctccgcctcgggcaagtccacattggccgttgaactcgagcaccaactcctccgcgaccgcggcgtgcacgcctaccgtctggacggtgacaacatccgcttcggactcaacaaggaccttggcttcagcgaagccgaccgcaacgagaacatccgccgcattgccgaagtggccaagctgttcgctgattcctccgccatcgccattacttccttcatctccccctaccgcaaggaccgcgacaccgctagacagctgcacgaggtgcccacgcccggagaggagactggtctgccgttcgtcgaggtgtatgttgatgtgcccggttgaggtggcggagcagcgtgatcccaagggattgtacaagaaggctagggaagggtgtgattaaaggagttcacgggtattagtgcccccgtatgaagcgccgttgaagcccgangtttaacatcaagna

SEQ ID NO: 3807 - DNA, 691 bp, Aspergillus niger
  misc_feature (1)...(691): n = A,T,C or G
attctgggaaacaaccaaagggctttcttttgatatcccaagttacgccccccgttggggctccaagcgcccccaaagacggggccgtgtcgtcttcaacctcttcgagaaggacgtccccaagactgctaagaacttccgtgagctctgcaagcttccccagggtcagggttacaagggctctaccttccaccgtgtcatcccccagttcatgctccagggtggtgacttcacccgccacaacggtaccggtggtcgctccatctacggtgagaagttcgccgatgagaacttcatctacaagcacaacaagcccggtctcctctccatggccaacgctggtcccaacaccaacggctcccagttcttcatcaccaccgttgtcacctcttggctcgatggcaagcacgtcgtcttcggtgaggttgccgatgccgagtccatgcaggtcgtgaaggagatcgaggctctcggtcctcctccggctccgtccgctctgccgtcaarsccacatcgtcgactgcggtgagttgtaagcggttttcaaggataacagatggcaaaattgggatatcgtcccacgggctggtgaaaaccaacatcgtgaggattaatggtggacaattctctttatccctctaaccgggtgtaatcaaaatgtccatancaattgtcaataagtttccaacaa

SEQ ID NO: 3808 - DNA, 689 bp, Aspergillus niger
caccatatcacgcttatcgccatcgtcacttgttaactacaactccctaataaattaaacaccttcgaaaggaaaaaaaaaaaacctcacataccatccaacaaaatgactggaggcaaatctggaggcaaggccagcggcagcaagaacgcccaatcccgttcgtccaaggccggtctcgcctttcccgttggacgtgttcatcgtctcctccgcaagggcaactacgctcagcgtgttggtgccggtgctcccgtttacctcgctgccgttcttgagtatctcgccgccgaaattcttgaattggctggcaacgctgctcgcgataacaagaagacccgtatcattccccgtcaccttcagctcgccatccgcaacgatgaggaactgaacaagctcctgggtcatgtcaccattgcccagggtggtgtcctccccaacatccaccagaaccttctgcccaagaagacccccaagagtggaaagggtccgggaagccargagctgtaaacaatttctttctaatttgggttctctgattcggcgcggtttggttctcttattgatgtgataacggggttctggtcggaacgtttawggctctgcgatttctttttttctagtttccacagtttatggttgtacattatgtctacggacatggaatgataccgacagcattttcactg

SEQ ID NO: 3809 - DNA, 603 bp, Aspergillus niger
cggcagcactcgcgatatcgaacttcgcttctcaaacctccgaaagacacaatgtccccgaaattgaagccgcaacttctccggaactacttctcaacccccttacaatctcccggaatgagaacgagagggtccttatcgagcccagcgtgaacagtgtccgtgtcagcatccgaatcaagcaggcagatgagatcgaacatatcttggtccacaagttcactaggttcctgacgcagcgcgcggaatccttcttcattctacggagaaagccagtgaagggatatgacatttcattcctcattacgaacttccatactgaacagatgctgaaacacaaattggtggacttcatcattcaatttatggaggaagtggataaggaaatctcggaaatgaagctcttcttgaatgctcgtgctcgtttcgttgctgagtcgttcttgacaccgtttgattagatcgccctagcttcatggttggcacatgaccttgatttccccttcctctcaggaacaattcttgtcagaagtttgatgcttggtcctttctgcagtcgtccatattatatctcgaaatcaaatttgtagccgaaaaaaaaaa

SEQ ID NO: 3810 - DNA, 544 bp, Aspergillus niger
cagcgtctcatcttcgctggtaagcagttggaggatggccgtaccttgtccgactacaacatccagaaagaatccactcttcaccttgtccttcgtctccgtggtggtatgcagatcttcgtgaagactcttaccggcaagacgattacgctggaggtggagagctcggataccattgataacgtcaagactaagattcaagataaggagggcattcccccggaccagcagcgtctcatcttcgctggtaagcagttggaagatggacgtacgctctccgattacaacatccagaaggagagcactctgcacctggtgctccgtctccgtggcggaaactaatgccttattttgatctttcttctttagcacggctcatctacggttgagtggcctgcatggcgttgggacggttgttttcatcggtttttatgatacggataaattgggcataccttagggtcaccatcttccatggtgccttgcgtcattcttttacctaggaatcaattcaataatcatattccacctgataaaaaaaaaa

SEQ ID NO: 3811 - DNA, 642 bp, Aspergillus niger
  misc_feature (1)...(642): n = A,T,C or G
cccaacgccgccgcggatcccgtcgacaaaatgcctgcccagaagtccggaaagaagactgcccccctcccttacccccagggtaaggctggcgctaagaaggctcccaagaaccctctcatcgagaagcgcccccgcaacttcggcattggccaggacatccagcccaagcgcaacctcggtcgcttcgtcaagtggcccgagtatgtccgtctgcagcgccagaagaagatcttgaacctccgtctcaaggtccctccttccattgctcagttccagaacaccctggaccgcaacaccgctgcccagaccttcaagttcctcaacaagtaccgccccgagaccaaggtcgagaagaaggagcgtctccacgccgaggccaccgccgtcgctgagggcaagaagaaggaggatgtctccaagaagccctacaacgtcaagtacggtctcaaccacgttgtcggctcgtcgagaacaagaaggcttccctcgtcctgattgctcacgacgttgaccccattgagctggttgtcttccttccgctctttgccgcaagatgggtgtcccttacgctaattgttaagggcaaggctcgtctcggtaccgttgtccacaagaagacctccgctgtcctcgctctna

SEQ ID NO: 3812 - DNA, 713 bp, Aspergillus niger
ctcggtctggcctctgccgtcggtgctaaggccaccgtccaggacttcctggtcaacatgtccgcctccgccgatgtcctcgcccaggctaaggttgagattggccttggtgccatccctgagggcaagaacgttatcatcaagtggcgtggtaagcccgtcttcatccgtcaccgcacccaggacgagatccaggaggcccagaagaccgagtggcagtccctccgtgacccccaggccgacgaggaccgtgtccagaagcccgagtggcttgtcatgcttggtgtctgcactcaccttggttgtgtccccatcggtgaatccggcgactatggcggctggttctgcccctgccacggttcgcactacgacatctccggccgtataagaaagggacccgctcccctcaacctcgaggttccccaatacaacttcccctccgaggacaccctcgtcatcggttaaacgatttagaattgattcgatctgagaccgcgggaatcgggcgatggccgtaagarcagaagtagaagtcggagaaggggaagggagagagaaagagagagagagaaggtttgtatttgtgcattagacgaaagccttcctctctcgctttctactctatgtgtgtctttttgtcaagattaaagagaccttgtgtttttaatatggaccctggaaaaatgagcctcttgttctattaaaaaaaaaaa

SEQ ID NO: 3813 - DNA, 624 bp, Aspergillus niger
  misc_feature (1)...(624): n = A,T,C or G
gttgcctccagcgagttctacaaggccgacgtcaagaagtacgaccttgacttcaagaaccccgagagcgactcctccaagtggctcacctacgagcagctggccgacctctacaagtcccttgccagcaagtaccccattgtcagcattgaggaccccttcgctgaggacgactgggaggcctggagctacttctacaagacctctgacttccagattgttggtgatgacttgactgtcaccaaccccctgcgtatcaagaaggccatcgagctcaagtcctgcaacgctctcctgctcaaggtcaaccagatcggtaccttgaccgagtccatccaggctgcaaggactcctacgctgacaactggggtgtcatggtgtcccaccgttccgtgagaccgangatgtnccattgncgacattgctgncgtcttcgntctggcagatcaagaccggtgctctgnccgttccgagcgtntggttaacttaccagatcctcctattgaggaggacttggtgacacgccntttacnccggnaaaagttccnaccgccgttacttggaaatgcancatttcccgttaagggaccatgaaggcctaanggncttattgcnttcaagaat

SEQ ID NO: 3814 - DNA, 857 bp, Aspergillus niger
  misc_feature (1)...(857): n = A,T,C or G
agtggaagggacctcccgcatcttctacaaggctgtccgcggcatgatcccccacaagaccgcccgtggtgccgccgctatggagcgcctgaaggttttcgagggtgttcctcccccctacgacaagaagaagcgcgttgtcgttccccaggctctgcgtgttctccgcctgcgccccggccgcaagtactgcaccgttggtcgtctcagccacgaggttggctggaagtaccaggacgttgttgccagacttgaggagcgcagaaaggttaagagcagtgcatactacgagcgcaagaaggccgctcgccgccaactcgtccacgcccagaagtcggcgggtgttaacgagcagaccaagagccagctcgctcagtacggatactagatacctagttgcgcggctggttgcttgtgtttgtgatgggatgggatgggatcgcgaaacggttctctgcgaagaaaatggacagcaagccgatcgacctttctctcactgtccctamcttttcatgaaataccacaattcttacgttgtgacgcacatggaggctggagagatcgattctttctaaaaaaaaaatacaggagtcacttgggatgaaaggttgtcaaaatagctgacccgttatttcgcgccgtggcggttaatccaagaatttcttttcaagagttcaaatgactttgctgtgacgaatccgatgcaccattaccaccggtttactctactactggcccttgcaattttgggnattttagggccccggacacgganagagagacagagtcctgctatcttngacttgattgcaatttgcantnccaggattnccgacagggtcttgttgtcactaaaa

SEQ ID NO: 3815 - DNA, 684 bp, Aspergillus niger
  misc_feature (1)...(684): n = A,T,C or G
gggatttctgccagatgtttgtacgaatngctccaattacaagtggggacaaagcaaggggtcgtttgganggtcaacaagatgttgttcgcttggacttcttcaagggcactgttacaagcgaatgctgctactggcacctactcttcgtccaagttcgacttatagtagcattgtagatgccgtgaagactttcgccgatggcttcgtctctattgtggaaactcacgccgcaagcaacggctccatgtccgagcaatacgacaagtctgatggcgagcagctttccgctcgcgacctgacctggtcttatgctgctctgctgaccgccaacaaccgtcgtaactccgtcgtgcctgcttcttggggcgagacctctgccagcagcgtgcccggcacctgtgcggccacatctgccattgggtacctacagcagtgtgactgtcacctcgtggccgagtatcgtggctactggcggcaccactaacgacgggtaccccccactnggattcggcagcgtgacctccgaccaagcaaagaccaccgcgactgctaacaatgaacaagcaaccaagttacgtcatcaaacctcctgtaccaactcccaaccggccgttggctggtgactttcngattntgacaagctaccaacaacctancgggggaggaacaatctacctgggt

SEQ ID NO: 3816 - DNA, 545 bp, Aspergillus niger
  misc_feature (1)...(545): n = A,T,C or G
ctccgaagtacgatgagctcgcagctctctatgctgaccaccccgatttggcggctaaggtcaccatcgctaagatcgatgcgacggccaacgatgttccggacccgattaccggattccctaccctcagactctacccggccggtgccaaggactcccccattgagtactctggctcgcgcactgtcgaggatcttgccaactttgtgaaggagaatggcaaacacaacgttgacgccctcaatgtcgcttccgaggaaacacaggagggtggtgatgtgactgaggctgtccctncgctacggangccgagaccccggctgncacagatgacgagaaggcagaacatgacgaactgtaaacagtcttccaattgagatccccttaatgctgtgccgtatcaatactaattatttggaacttcgttctctatggtaacttttgnaatcttngaccanctgtgttggttgaattactaaattggaccagttctatttggcnaacaatngatganttttaattgtcncgctgtctaaaaaaaaata

SEQ ID NO: 3817 - DNA, 586 bp, Aspergillus niger
tttttttttatgaatccttttcatttttagaatgttcttaggtcatactaaaaaaaaaaaccggtaccaccccctttgttctagaagcccttggtatcgctttttttttttctcttcttgctccaaattccaggtttaacacattttacatgacaacaccggagttggaggcaatacgaggccaaagctcagcagcctccttaccaacgggaccagtgatagcggaacccttcatctcacccttggcgttgacgataacaccagcgttgtcctcgaagtagaggtagataccgtcggggcgtctccagggcttgctctgacggacaacaacagcgggcatgaccttcttacggagctcaggctttcccttcttgacggtggccatgaccatgtcaccgacaccggcagcggggagacggttcaggcgagcaccgatacccttgacggagatgatgtacaggttgcgggcaccggagttgtcgcagcagttgagcacggcgccgcaaggcagaccgagggtcatcttgagcttgttgccggaggcaccaccgcgtcctctcgcagacatcttggctgtgtatctagg

SEQ ID NO: 3818 - DNA, 586 bp, Aspergillus niger
  misc_feature (1)...(586): n = A,T,C or G
ggtactgkcasmtgtggccgagtatcgtggctactggcggcaccactacgacggctacccccactggatccggcagcgtgacctcgaccagcaagaccaccgcgactgctagcaagaccagcaccagtacgtcatcaacctcctgtaccactcccaccgccgtggctgtgactttcgatctgacagctaccaccacctacggcgagaacatctacctggtcggatcgatctctcagctgggtgactgggaaaccagcgacggcatagctctgagtgctgacaagtacacttccagcgacccgctctggtatgtcactgtgactctgccggctggtgagtcgtttgagtacaagtttatccgcattgagagcgatgactccgtggagtgggagagtgatcccaaccgagaatacaccgttcttaagcgtgcsgaacgtcgaccgcgacggtgactgacacnkgcggtagacaatcaatcatttcgctatagttaaaggatggggatgaggcaattggtwtatgacatgtatgnagtggtgtgcataatagtartgaaatggaagccaagtatgtgaaaaaaaaaaaa

SEQ ID NO: 3819 - DNA, 437 bp, Aspergillus niger
  misc_feature (1)...(437): n = A,T,C or G
tggttactccgtcttctgtggtgtcggtgagcgtactcgtgagggtaacgatctgtaccacgaaatgcaggagactggtgtcatccagctcgagggtgactccaaggtcgccctggtgttcggtcagatgaacgagcccccgggtgcccgtgcccgtgtcgcccttaccggtctgaccattgccgagtacttccgtgacgaggagggtcaggacgtgctgctcttcattgacaacattttccgtttcacccaggccggttctgaggtgtctgccttctgggtcgtatcccctctgccgcggttaccaagccactctggccgtcgacatgggtggtatgcangaaccgtattaccaccaccaccaagggttcattacctccgtncaagccgtctacgtncctgctgacgatttgactgaccttgccccggcaacactt

SEQ ID NO: 3820 - DNA, 715 bp, Aspergillus niger
caagggtcgcttcaccgtccaccgtatccaggctgaggaggccgagtacaagctctgcaaggtcaagcgtgttcagctcggcaagggcgggatcccattcttggttacgcacgatgcgagaaccatccgttaccccgaccccgccatcaaggtcaacgacaccgtgaagatcgacattgccactggcaagatcgccgacttcgtcaagttcgacactggtgttgtcgccatggccaccggtggtcgtaacatgggtcgtgtcggtgtcgttacccaccgtgagcgccacgatggtggtttcaacatcgtccacatcaaggacgctattgacaacaccttcgccacccgtgagtccaacgtcttcgtcatcggtcaggacaagccctggatctccctgcccaagggcaagggtgtcaagctctccatcgctgaggagcgtgaccgccgccgtgccctccagtagatgtggcatggtaagtgatgtaggctgccggaaaaataaaagcgttgcaaaattccgctgtggcgatgacatcttgtcttgctttgtggacctgtatgacgccggttacgataattatatgaagcgttatccagaacaaaaaaagaaagaattgtctacaggacacaaagttacacctgttactgtaccgtagacttgtacactaaagcaaggtcaagatgccaagtctgtctacctatgataaaaaaaaaa

SEQ ID NO: 3821 - DNA, 593 bp, Aspergillus niger
  misc_feature (1)...(593): n = A,T,C or G
aggcaccgcaagactcatctcttcgatatcgacatccccggcaagatcaccttcaaagagagcgaggtcctgtcccctggtaaccagttgactgtcgtcgatctgccggactatgggaaaatcggactggctatctgctacgatatccgcttcccggaggccggcatgattgcggctcggaagggcgccttcatgctcgtgtacccgggcgcattcaacaccaccacgggtccgctgcactggtcgctgttggctcgtgctcgcgccgttgataaccaggtgtatgtggccttgtgcagtcccgctcgagacatgagcgcctcgtaccacgcctatggtcacagtttggttgcggatccgagcgcaaatgtgttggctgagacngaggagaaggaagacattatctacgcggatctggataacgagacgatccanacacgaggaanggtatttccattacacgcacggcggttcgattgtactcggacgtgatgcccacagcaaatagccctgantttgcattgagtccgtgaatatattcttgcaaccagtattncctanatgggattgacgatnntgacctaaaaaaaaat

SEQ ID NO: 3822 - DNA, 621 bp, Aspergillus niger
  misc_feature (1)...(621): n = A,T,C or G
tcgaaacatttcacttgcccttaaacatcctatcttcagcgaattaaggagacatggggggcaagtctgctaccaaggccgcttacttcgagaagctcaaggcccttctcgatgagtacaagacggtcttcattgtcggtgtcgacaatgtcagctctcagcagatgcacgagattcgtctgagtctccgtggcgagggtgtcgtcctgatgggtaagaacaccatggttcgccgtgccatcaagggcttcgtcaacgacaaccccgagtacgagcgtctgctccccttcgttaagggtaacgttggtttcatcttcaccaacggtgacctcaaggccaccaaggagaagatcctggccaaccgtgtcgctgctcccgctcgtgccggtgccatcgctcctggcgatgtctgggtccccgccggtaacaccggtatggaacccggtaaganctctttcttccaagctcctggtgtccccaacaaagantgctcgtggtaacaattgaaattaccaacganctcaanctcttgangctggaagcaaggtcggtccctccgaaggcacctgctcaacatgctgaacatctctcccntcaactaanggtatgaccatcaacaag

SEQ ID NO: 3823 - DNA, 587 bp, Aspergillus niger
caacaaaccgccaaaatgggtcgcgtccgtaccaagacagtcaagcgttccgctaaggtcgttatcgagcgttactaccccaagttgacgctcgacttcgagaccaacaagcgtatctgcgatgagatcgctatcattgcctccaagcgtctccgcaacaagatcgctggttacaccacccaccttatgaagcgtatccagcgtggccctgtccgcggtatctccttcaagctccaggaggaggagcgtgagcgcaaggatcagtacgttcctgaggtctccgctctggatgtttcccagaccgagtccggccagctcgacgtcgactctgagaccaaggacctgctcaagagcatgggcttcgacaacctcaaggkcaacgtcatccccgkctcccagcagcaggctcaggagcgcccccgscgstaccggtagatcattgcgccgktgaacggaaaatgaaaaagttctgattgcttcggkcgatccatggcgktccccatgcttgttctggktggctcacccgstatcgatttagcttagagacagctcggatgagaaatgaacacgaattctgkcaaacaaaa

SEQ ID NO: 3824 - DNA, 615 bp, Aspergillus niger
  misc_feature (1)...(615): n = A,T,C or G
cagtgggggtagccgtcgtagtggtgccgccagtagccacgatactcggccacgaggtgacagtcacactgctgtaggtaccaatggcagcgtgacctcgaccagcaagaccaccgcgactgctagcaagaccagcaccagtacgtcatcaacctcctgtaccactcccaccgccgtggctgtgactttcgatctgacagctaccaccacctacggcgagaacatctacctggtcggatcgatctctcagctgggtgactgggaaaccagcgacggcatagctctgagtgctgacaagtacacttccagcgacccgctctggtatgtcactgtgactctgccggctggtgagtcgtttgagtacaagtttatccgcattgagagcgatgactccgtggagtgggagagtgatcccaaccgagaatacaccgttcctcaggcgtgcggaacgtcgaccgcgacggtgactgacacctgcggtagacaatcaatccatttcgctatagttaaaggatggggatgagggcaattggttatatgatcatgtatgtagtgggtgtgcataatagtaagtgaaatgggagcccaagtcatgtgaatgnaatcgaaaaaaaa

SEQ ID NO: 3825 - DNA, 641 bp, Aspergillus niger
  misc_feature (1)...(641): n = A,T,C or G
gcccatgaagggtatgcttaccggccccatcacctgcttgcgctggtctttccctcgtgatgatgtccaccaagtccgtccaggctcaacagctcgctctcgctctgcgtgacgaggttgttgacctcgaggctgctggcatcaaggtcatccaggtcgacgaagcccgctcttcgtgagggtctccccctccgtgctggcaaggagcgtgaggagtactcaagtgggccgtccgtgccttccgcctggccaactctgggtgtcaccgacggtactcagattcactctcacttctgttactctgagttccaggacttcttccacgccatcgctgcgctggatgccgatgttctgagcattgagaacaacaagtcggatgccaagctgctcaaggtcntcatcgacgaaggcctaaccccgtcacattggacctggtgtctacgacatccantctccccgtgttccaaccaacaagagatnaaggaccgcgtccaggagatgcttcagtactccgccctgancaactttggataaaccccgactgtgggtctgaanacccgtcaattggcccaaaacaaaggttgcctgacaaaaatggtcaacgctgccaaanttcttccgtnaanaagcacgggaaacta

SEQ ID NO: 3826 - DNA, 611 bp, Aspergillus niger
  misc_feature (1)...(611): n = A,T,C or G
gcaacggctccatgtccgagcaatacgacaagtctgatggcgagcagctttccgctcgcgacctgacctggtcttatgctgctctgctgaccgccaacaaccgtcgtaactccgtcgtgcctgcttcttggggcgagacctctgccagcagcgtgcccggcacctgtgcggcacatctgccattggtacctacagcagtgtgactgtcacctcgtggccgagtatcgtggctactggcggcaccactacgacggctacccccactggatccggcagcgtgacctcgaccagcaagaccaccgcgactgctagcaagaccagcaccagtacgtcatcaacctnctgtaccactcccaccggcgtggctgtgactttcgatctgacagttccaccacctacggcgagacatctacctggcggatcgatctctaactgggtgactgggaaaccagcgacggnatactntgatgctgcaagtcacttcaggacccgtctggatgtactgggatntgccgtgtgaatcnttgatncaagttntccgattgaagcatnctcgggaatgganagtgtccaaccngatanccgtcttagggtgcggangtnacggaagg

SEQ ID NO: 3827 - DNA, 582 bp, Aspergillus niger
  misc_feature (1)...(582): n = A,T,C or G
ngtantggtgccgccagtatccacgatactcggncacgaggtgacagtcacactgctgtangtaccaatggcagatgtggccgcacangtgccgggcacgctgctggcaagaccagcaccagtacgtcatcaacctcctgtaccactcccaccgccgtggctgtgactttcgatctgacagctaccaccacctacggcgagaacatctacctggtcggatcgatctctcagctgggtgactgggaaaccagcgacggcatagctctgagtgctgacaagtacacttccagcgacccgctctggtatgtcactgtgactcygccggctggtgartcstttgagtacaagtttatccgcattgagarcgatgactccgtggagtgggarartgattccaaccgagaatacaccgttcctcaagcgtgcggaacgtcgaccgcgacggtgactgacacctggcggtagacaatcaatccatttcgctatagttaaaggatggggatgagggcaattgggtatatgatcatgtatgtagtgggtgtgcataataatagtgaaatgggarccaawraaaaaaaaaaa

SEQ ID NO: 3828 - DNA, 629 bp, Aspergillus niger
  misc_feature (1)...(629): n = A,T,C or G
accactacagcgtcaacaatcaaaatggggcgtctcaccgagtaccaggtcattgggcgtcacctgcccaccgaggctaaccccacgcccaagctgtaccgcatgcgcatcttcgcgcccaacactgttgtcgctaagtcccggttctggtacttcctgacccagctccgcaaggtcaagaaggccaacggtgagatcgtcagcatcaatgtgatcagcgagaagcgccctaccaaggtcaagaacttcggtatctggctccgctacgactcccgctccggcacccacaacatgtacaaggagttccgtgagatgagccgcaccgaggctgttgaggctctctaccaggacatggctgcccgccaccgtgcccgcttcggctccatccacatccttaaggttgttgagatcgagaacgccgacagcatccgccgcccctacatcaagcagctcctctccaagaactcaagttccccctgccccamcgtgctgcccacggcaagaagctgttcgcttactctcgtcccactactttcgcgtaaatgtgacgttttgggtttgggtgatcggagtgtgtggatgaatgactatgttatgggcatagcatgcacgaanggacacggagcacg

SEQ ID NO: 3829 - DNA, 601 bp, Aspergillus niger
  misc_feature (1)...(601): n = A,T,C or G
cgagaccttcatcaagatgcagatcttcgtcaagacccttacgggtaagactatcaccctcgaggtggagtcctcggacaccattgacaatgtcaagtccaagatccaggacaaggagggtatccccccggaccagcagcgtctgatcttcgctggtaagcagctcgaggacggccgtactctttcggactacaacatccagaaggagtccaccctccacctggtgctccgcctgcgtggtggtggtaagaagcgcaagaagaaggtctacaccacccccaagaagatcaagcacaagcacaagaagaccaagcttgccgtctcaaagtactacaaggtcnaccgtgatggcaagaatgaaccgtcttcggcgcgaagtgcccttncccgatgcggtgctgnatcttatggccgntntgacaaccgcagtctgcggaagggcacctactacgttttnacgagtccaataatggactttgccatcgttcgccatggtcttttttccgggagcgcctacaatgcggtcgtgaatttntggtggataaggttggactttgcnctttgatcgnccctagtggccaagcattgngaacgaaaaatt

SEQ ID NO: 3830 - DNA, 604 bp, Aspergillus niger
  misc_feature (1)...(604): n = A,T,C or G
ttcatcacttccctcttcccttcatccaattcatcttccaaacacatctaaacaatggctcccaaggtcggtatcaacggcttcggtcgtatcggacgtatcgtcttccgtaacgccatcaaccacggcgaggttgacgtcgttgctgtcaacgaccccttcatcgagacccactatgctgcctacatgctcaagtacgacagcacccacggccagttcaagggcaccatcgagacctacgaggagggtctgattgtcaacggcaagaagatccgcttcttcgctgagcgtgaccccgctgcatcccctggggcaccaccggcgctgactacatcgtcgagtccactggtgtcttnccacccaggagaaggccgccgtnacttgaagggtggtgccaagaaggtcgcatctcttggtccttccgctgatgccccatgttcgtatgggtggtcaacaacacttctacaccaagacatnaacgtctttcaacgttnttgnacaccaatgcttgntcccttgccaggcataacacaagtcggattgtgaggnttatgacacgtcantctaacgttccaaaggcntnatgccctcacaaggntgggng

SEQ ID NO: 3831 - DNA, 601 bp, Aspergillus niger
gcaacaacgaaaaccgcagccatgcagattttcgtcaagaccctcacgggtaagaccattaccctcgacgtcgagtcgagcgacaccatcgacaacgtcaagaccaagatccaggacaaggagggtatccccccggatcagcagcgtcttatcttcgctggtaagcagcttgaggatggccgcaccctgagcgactacaacatccagaaggagtccaccctccacctggtcctccgtctccgtggtggtatcatcgagccctcccttaaggctctcgcctccaagtacaactgcgagaagtccatctgccgcaagtgctacgcccgtcttcccccccgtgccaccaactgccgcaagaagaagtgtggtcacaccaaccagctycgccccaagaagaagctcaaatagacgattatcttattacggtttttctgcgttgctggggaaaagagctgctggggttacgatacgattgcaacgtgggagattttctacatggcgttggaatgatgaatcattacttatagccgaagtcaaatgtctatagttgactcctcgggaagragttgcaatcaaagcacaacctgkaaaattcaaaaaa

SEQ ID NO: 3832 - DNA, 627 bp, Aspergillus niger
  misc_feature (1)...(627): n = A,T,C or G
ctaaccggttcaagtcgacaaagcagccaagatgcctcgcggacctaagaagcaccagaagcgccttagcgcgccttctcactggctcctggacaagatgtccggaacctacgcccccaaggcctcccccggtcctcacaagctccgggactgcctgcccctgatcgtcttcatccgcaaccgtctcaagtacgcccttaacggccgtgagaccaaggcgatcatgatgcagcgtctgatcaaggtcgacggcaaggtccgcaccgaccctacctaccccgctggtttcatggacgtcatcggcatcgagaagaccggcgaagaacttccgctnatctaccacaccaagggtngntttaaccgtccaaccgtattcaagcttgaggaaggccgattccaagctcttgnaggncaaccgtgttcaanttnggaagggcgggatcccatttttggttacgcacgatgcgagaaccntccgttaccccgacccgccatcaaggtnaacgacnccgtgaagatcgnattgccactggcaagatcgccgacttctnaagttcgaactggtgttgncgccatggccaccggtggtcgaaaatggtcgggtcggngtcgttcccaccgngagcc

SEQ ID NO: 3833 - DNA, 606 bp, Aspergillus niger
  misc_feature (1)...(606): n = A,T,C or G
atcggaacctaagcctattgctctcgagcgtggcttcgccaccatccctctccggggcatcgatgtgcccttccacagcacgttccttcgttctggtgtcaagcccttccgttctttcttgctcaagaagatcaacaagactaccattgatcctagtaaactgatcggcaaatatattccgaacgtcacagcaagaccgttcgaaatcaccaaggagtacttcgaggatgtttacagactcaccaactcccccagaattgcgcatatccttgccaattgggagaagtatgaggatggtgaacgcaacactggagtggctgatgcctaggggtagattcattccgatatatataggattctggtggtcacttgnttctaaatctcagcgcttggtctancgctgggtttcgaaatgccctaatatcactgtcaaaaaaaaaanaaaaaaaaaaattctggggccgtcaacatgctttaaagggccaattgnccttaggngcggntcaattnctggccgcgtttanacgtcggactgggaaaacctggngtcccacttaatgcttgagnnatcccctttgcaagtgggtataccaaaggccccccctn

SEQ ID NO: 3834 - DNA, 616 bp, Aspergillus niger
  misc_feature (1)...(616): n = A,T,C or G
gtatattactcttataccttttaatacctcttaaatcccttcacacacattcaaaatgggcaaggacgcttctttcgctcccggtgactccgccaagggtgctaagctcttccagactcgttgcgctcagtgccacactgtcgaggctggtggtccccacaaggtcggccccaacttgaacggtctcttcggccgtaagaccggtcaggccgagggctacgcctacaccgacgccaacaagcaggctggtgtcacctgggatgagaactctctgttctcctacctcgagaaccccaagaagttcatcccctgtaccaagatggccttcggtggtctcaagaagggcaaggagaggaacgacctcatcacttacctcaaggagagcaccgcttaaattacctcaccgtcatgaactattctagaacccgcctggcgaacattgtnacttatccgtgctggaaacaggcggtgaagtcggcaacccgacagtcagggactgtacanttccacgccntattaccccngatagactttggcgttntgcgttggaccattcngatccatngagnctggttcnttcgggaccgtggntaanattccttntggtcctttttac

SEQ ID NO: 3835 - DNA, 492 bp, Aspergillus niger
  misc_feature (1)...(492): n = A,T,C or G
caggatgagatgcttcgcgctggtcgtctcgaccgcaagtacaacggtatcatggactgcttccgtcgtaccgctgcctccgagggtgttgtttccctgtggcgtggtaacactgccaacgttatccgttacttccccacccaggctcttaacttcgccttccgtgacacctacaagtccatgttctcctacaagaaggagcgtgatggatacaccaagtggatgatgggtaaccttgcctccggtggtgctgctggtgccacttccctcctcttcgtctactccctcgactacgcccgtacccgtcttgcaacgacgccaagtccgcaagggcggtggtgaccgtcagttcaacggtctcgttgacgtctacaagaagaccttgcttcgacggattgccgnctttaccggggttnggncctttggtgcttggaatggtggctaccgggctggacttnggatgaccnantcattaagccgttgttngggtgg

SEQ ID NO: 3836 - DNA, 687 bp, Aspergillus niger
  misc_feature (1)...(687): n = A,T,C or G
tgcgggtcatgtctcggccggttacggtcgcattggcaagcaccgtaagcaccccggtggtcgtggtatggccggtggtcagcaccaccaccgcaccaacctcgacaagtaccaccccggttacttcggtaaggtcggtatgaggtacttccacaagacccagcagcagttctggaagcccactatcaaccttgacaagctgtggtctctcgtccccgccgagaagcgtgacgcctacctgagcggccagaagaccgacaccgcccccgtcatcgacctccttcccctcggctactccaaggttctcggcaagggccgtctccccgaggtccccatcgtcgtccgcgctcgctacttcagccgggatgctgaggagaagatcaaggctgccggtggtgttgttgagctcgttgcttaagtgtggaaagtctgggatttcacttggaggatgaaaaaccgggacaggtgctgcgctggctacgattcggtgtaatagagattcgaattctccccggggaatgagaaaacaaaaaatgggarccgcggatcgggcaccttgatccgtgtatttacaaattcaaaagggtttctatttgtgacgagmaaagattggcctncggatgcccttacgatcacgcttctattattgaacaataccataaaggaggacaactttttttttctgtg

SEQ ID NO: 3837 - DNA, 483 bp, Aspergillus niger
  misc_feature (1)...(483): n = A,T,C or G
caggattcgtgacctacaagaactggcccatctacaaagacgacacaacgatcgccatgcgcaagggcacagatgggtcgcagatcgtgactatcttgtccaacaagggtgcttcgggtgattcgtataccctctccttgagtggtgcgggttacacagccggccagcaattgacggaggtcattggctgcacgaccgtgacggttggttcggatggaaatgtgcctgttcctatggcaggtgggctacctagggtattgtatccgactgagaagttggcaggtagcaagatctgtagtagctcgtgaagggtggagagtatatgatggtctgctattcaatctggcattggacaagtgaagtttgagtttgatgtacaagtggagtcgttactgntggcatcccttatctctcgatggttttcgaacctaatgccaacacgctagtctatataggaaaggntccggattaaaaaaaaaattt

SEQ ID NO: 3838 - DNA, 559 bp, Aspergillus niger
gcgagatcaccgcatgcggcatccctattaactacaacgcctcgaaagaatgggccgataagaaggttgttctattctccgtgcctggtgccttcacccccacctgctccatcaaccatgtccccggctacatccagaaccttcctcagctgaaggagaagggcgtgcaagtcgttgccgtgatcgcgtccaatgatccttttgtcatgagcgcttggggaaaggcgaataatgtcaaaggtgatgatattcttttcttgactgatcctgatgcgcgcttctcgaacaaccttggctgggcgagtggtggtcgcaccgggcggtttgccattgtcattgatcatggcaaggtgacctatgcgcagattgagactgagaagggtgctgttaaggtctcgggcgctgatgctatcctggcgaatttgtgaatgttgagcgttcactagatgggatgcagtagaatcaccatggttgccatttgttatgttccttcttagcgagtgagcaagatacaaatagctagtcacgaatctcaaagccttcgaagatgaaaaaaaaa

SEQ ID NO: 3839 - DNA, 1024 bp, Aspergillus niger
  misc_feature (1)...(1024): n = A,T,C or G
attagataaaaaaccaatgcccttcggggctccttggtgaatcataataacttaacgaatcgcatggccttgcgccggcgatggttcattcaaatttctgccctatcaactttcgatggtaggatagtggcctaccatggtggcaacgggtaacggggaattagggttcgattccggagagggagcctgagaaacggctaccacatccaaggaaggcagcaggcgcgcaaattacccaatcccgacacggggaggtagtgacaataaatactgatacggggctcttttgggtctcgtaattggaatgagtacaatctaaatcccttaacgaggaacaattggagggcaagtctggtgccagcagccgcggtaattccagctccaatagcgtatattaaagttgttgcagttaaaaagctcgtagttgaaccttgggtctggctggccggtccgnctaccgcgagtactggtccggctggacctttccttctggggaatctcatggccttcactggctgtggggggaaccaggacttttactgtgaaaaaattagagtgttcaaagcaggcctttgctcgaatacattagcatggaataatagaataggacgtgcggttctattttgttggtttctaggaccgccgtaatgattaatagggatagtcgggggcgtcagtattcagctgtcagaggtgaaattcttggatttgctgaagactaactactgcgaaagcattcgccaaggatgttttcattaatcagggaacgaaagttaggggatcgaagacgatcagataccgtcgtagtcttaaccataaactatgccgactagggatcggacggtgtttctattatgacccgttcggcaccttacgagaaatcaaagtttttgggttccgggggtttggatttctctcttgactgaggtcaaagcagctcgctcggacccggtattggttgatatgtgatgatggtttagacatgccaaaaagttggtattcttcaatatatgaaaaaaaaaaa

SEQ ID NO: 3840 - DNA, 570 bp, Aspergillus niger
  misc_feature (1)...(570): n = A,T,C or G
cccgacttcaagccccctagccgccccttcaagcggatgaagtactctgaggccattgaatggctgcgggaacacgatattcccaacgaggagggcaagcctcacgagttcggcgatgacattgccgaagctgctgagagaaagatgaccgatatcatcaaccagcccatcttcctaacccacttccccgctgagatcaaggccttctacatgaagaaggatgtcgaagaccgccgtgtcactgagagtgtggacgttctcatgcctggtgttggtgagattgtcggtggtagtatgagaatggatgactgggatgagctcatggccgcctacaagcacgaagcatggatccttcccgtctactggtacaccgaccagcgcaagtacggacttcccttacggtggttacgnctttggtctcgaacgtttcctggcttggttggtgctcgttattcccgtcgngantgttcttggatccttggttnanaggccgttgacgcntaagngctttgatgcatagncagattcttggttcnttgatgctccaatnacttcattgggaatcggtag

SEQ ID NO: 3841 - DNA, 623 bp, Aspergillus niger
caccacccacccccttcgtccattgcaagatgagctctctccgcttcgctcgctctgccttcagggcccgtccctccgctctccgcgttcctctccagcgcagaggttacgccgaggctgtgtcggacaagatcaagctttccctgacccttcctcaccagtctatcttcaagtcgaccggcgttgtccaggtcaacatccccgccgaatccggagagatgggtgttctcgccaaccacgtcccctccattgagcagctcaagcccggtctcgttgagatcgttgaggagggtggtgccagcaagaagttcttcctgtctggtggtttcgccgttgtccarcccgactcccaagctgagcatcaacgccgtcgagggtttccctctcgaggaattcagcattgacaacgtccgttcccagatcgccgaggcccagaagattgccaacggaagcggcagcgagcaggatattgctgaggccaagattgagcttgaggtgctggagagcctgcaagccgtcctcaaatagatacctgatgtacatatccactcgcgacttcaactttgaacctgtagaattatagcaattctcawggaaacacttttttgcaatgaaaaaaaaaa

SEQ ID NO: 3842 - DNA, 623 bp, Aspergillus niger
  misc_feature (1)...(623): n = A,T,C or G
cttatctatcaacctccatcaatctttcatcctcaacgtcatctttccatctctaaaacaactaaatccatcaaacttaatccactaagatggcccgcactaagcagactgcccgtaagtccactggtggcaaggctccccgtaagcagctcgcctccaaggctgcccgtaaggccgctccctccaccggaggtgtcaagaagcctcaccgttacaagcccggtaccgtcgctctgcgtgaaatccgtcgttaccagaagagcactgagctcctgatccgcaagctgcccttccagcngtcttgtccgtgaaattgctcaggacttcaagtcggatctccgcttccagtcctccgccatcggtgctcttcangagtcgtcgaggcctacctcgtctccctcttcgaggacaccaacctgtgcgccatccacgccaagcgtgtcaccatccagtcaanggacatcccagcttgccccgccgtcttccgtggtgagccgctcttagattacttctaatgaagtcgatctttttctggttngggaaggcgattaacgggggtttctttttcttttaattttcattgactactggccgataccatgattggggtttgccaaantttn

SEQ ID NO: 3843 - DNA, 486 bp, Aspergillus niger
  misc_feature (1)...(486): n = A,T,C or G
tgggtgccgcgcacatggtggcgagaacgtctacctgcaagccttggtgaagctctaccgattcctcgcccgtcgtacggaatccaacttcaacaaggtcgtcttgcgccgccttttcatgtccaggatcaatcgcccccccgtttcgctctcgcgcattgtatccaatgtgaccgactcccacaagggcaagactatcgttgtgatcggcaccatcactgacgacaaccgtcttctgactgtcccgaagctgtctattgcagcacttcgtttcacggctactgctcgggccaggattgagaaggctggtggtgaggtcttgactttggaccagctcgctctgcgtgcccctactggagcaaacactcttcttcttcgcggacctaagaatgctcgggangcagtgagcactttnggtttcgnccccaaaggcacaagaaacctacgttcgcancaangggacgtaagttcganaganccgtggac

SEQ ID NO: 3844 - DNA, 745 bp, Aspergillus niger
  misc_feature (1)...(745): n = A,T,C or G
ctcaaatttgaaagctggctccttcggagtccgcattgtaatttgcagaggatgctttgggtgcggcccccgtctaagtgccctggaacgggccgtcagagagggtgagaatcccgtcttgggcggggtgtccgtgcccgtgtaaagctccttcgacgagtcgagttgtttgggaatgcagctctaaatgggtggtaaatttcatctaaagctaaatactggccgtcggtcgtgcctgcttcttggggcgagacctctgccagcagcgtgcccggcacctgtgcggccacatctgccattggtacctacagcagtgtgactgtcacctcgtggccgagtatcgtggctactggcggcaccactacgacggctacccccactggatccggcagcgtgacctcgaccagcaagaccaccgcgactgctagcaagaccagcaccagtacgtcatcaacctcctgtaccactcccaccgccgtggctgtgactttcgatctgacagctaccaccacctacggcgagaacatctacctggtcggatcgatctctcagctgggtgactgggaaaccagcgacggcatagctctgagtgctgacaagtcactttcagcgacccgtctggatgtcactgtgactctgccggttgtgagtcgtttgagtacaagttatccgattgagagcgatactcgtgaatgganagtgatccaaccgagaatacaccgtcttaagcttcggaacgtnaacg

SEQ ID NO: 3845 - DNA, 513 bp, Aspergillus niger
  misc_feature (1)...(513): n = A,T,C or G
gttcgcgatccggccaagtcagtcaaaatggtcaacgttccgaaaacccgccggacgtactgcaagtccaaggagtgccacaagcacacccagcacaaggtcacccagtacaaggctggaaaggcctccctgttcgcccagggtaagcgtcgttacgaccggaagcagagcggttatggtggtcagaccaagcccgtcttccacaagaaggccaagaccaccaagaagattgtccttcgtcttgagtgcactgcttgcaagaccaagaagcagctttctctgaagcgctgcaagcacttcgagcttggtggtgacaagaagaccaagggtgctgctcttgtcttctaaatttgcggttttcttgttcggctctgggtttcatgcattgcacagaccgcaatgctgcggcggcggctatgacatcggcaatggaagatggaataggatctcatattcaagaaaaaatgaaagaatatatgactcctagttgatgagtctcttgacgaaaaaaan

SEQ ID NO: 3846 - DNA, 621 bp, Aspergillus niger
  misc_feature (1)...(621): n = A,T,C or G
cgacgatatcgacaattccctcgcggacacaccacagcccacgcagtcaagatgcggtacatttactccgaggaacggctgcccatccccgagaatgtgaaggttcacattcgctcgcgcattgtgaccgttgagggaccccgaggcaagctcgtcaaggacctctcccacattgctgtcaccttcggccgccccgagaagaatgtcatctccattgagatgcaccacggtgtccgcaagggaatggcttcccttcgtaccgtccgcaccctcatcaacaacctgatcatcggtgtcaccaagggcttcaagtacaagatgcgctacgtctacgctcactttcccatcaacgtcaacattgagaagaaccccgagaccggtctgcacgacgttgagatcagaaacttcttgggtgagaagtacgtccgccgtgtgaccgcccagcctggcgttgaggtcatcacctctcccaacgtcaaaggatgagctcgtcctctccggtaactccctggaagggtgtctcccaaaagtgctgccgacatcaacagatntgccgtgtccgcaacaaggatatccgtaagttccctgacggtctgtacgtgtcngancgtggtaacattg

SEQ ID NO: 3847 - DNA, 492 bp, Aspergillus niger
cccgcccgcgctttcgaggagtacgttgacatgaagccgatcatgggcactccggttaaccggaagatctttgagcgttcgttcgcgtacttcagtcgtgacttgaagaatgttagccgcgactgggctaaggtgaccaactatggcaagcggttgggcattctgagtgctgatttcgtggcgaactacactaacgactatttgtcgtggggcttggatgctgactcgactgatcccctgggggatcagaagcgcatggctgagttgcagaagaaggtcgctgccgagggtggttacaagcggttggaggttgcttcttcggcttgattgattatcaagctcggtggarcagcttgctcgcttgacactctaggaacagggatgattcttatgtaacggtcgtttacgagtctagctggatgtgctagcttacgcactcttttagtatgacagcaatatatcatacgatcttttgagacatgaaaaaaaaaa

SEQ ID NO: 3848 - DNA, 359 bp, Aspergillus niger
gctcaatactggaaccagacaggatatgatctctgggaagaagtcaatggctcgtctttctttacgattgctgtgcaacaccgcgcccttgtcgaaggtagtgccttcgcgacggccgtcggctcgtcctgctcctggtgtgattctcaggcacccgaaattctctgctacctgcagtccttctggaccggcagcttcattctggccaacttcgatagcagccgttccggcaaggacgcaaacaccctcctgggaagcatccacacctttcaagaacatggaattgaaaatgacatgctaagaaatgaagaagaagaagggatcatagaaagttgtccatcttggttaaaaaaaaaaaa

SEQ ID NO: 3849 - DNA, 607 bp, Aspergillus niger
  misc_feature (1)...(607): n = A,T,C or G
ccgtcatcaaccagcggcaaccgtcaagatgcctttccacaagctcgtcaagaacagcgcttactacagccgctaccagaccaagtaccgtcgtcgccgtgagggtaagaccgactactatgcccgtaagcgcttgatcacccaggccaagaacaagtacaacgcccccaagtaccgcctggtcgtccgcttcaccaaccgcgactgctagcaagaccagcaccagtacgtcatcaacctcctgtaccactcccaccgccgtggctgtgactttcgatctgacagctaccaccacctacggcgagaacatctacctggtcggatcgatctctcagctgggtgactgggaaaccagcgacggcatagctctgagtgctgacaagtacacttccagcgacccgctctggtatgtcactgtgactctgccggctggtgagtcgtttgagtacaagtttatccgcattgagagcgatgactccgtggagtgggagagtgattccaaccgagaatacancgttcctcangcgtgcggnacgtcgaccgcgacggtgactgacacctggcggtanacaatcaatccaattcgctatagttaaaggatggggat

SEQ ID NO: 3850 - DNA, 648 bp, Aspergillus niger
  misc_feature (1)...(648): n = A,T,C or G
tccgactcgtcgacacatccctcgagatacctcatatccttcgattcctcgatttgagaatctcgattccacaccgtcaaaatggtcaagacttccgtcctcaacgatgcgcttaacgccatcaacaacgccgagaagagcggtcgccgtcaggtcctgatccgcccttcctccaaggtcatcatcaagttcctttccgtcatgcagaagcacggctacattggcgagttcgaggaggttgacgaccaccgctccggcaagatcgtcatccagctcaacggccgtctgaacaagtgcggtgtcatcaacccccgctaccccgttcaagctccgtgacctcgagaagtgggccactcagctcctgccctcccgtcagttcggttacgttgtcctgaccaactccgctggtatcatggaccacgaggaggctcgccgcaaagcacgttgccggcaaagctcctcggtttcttctaactaaaaagtttacctggaagctttttttgatggcgangatctagtttgtgggtgcganggatgaactctccgtggcttggcggagttggatngataccccggcaaaagatgtctanataagttattgattcgagtgattcttgcgaatggaactgaattcaagtcatcaaaaaa

SEQ ID NO: 3851 - DNA, 449 bp, Aspergillus niger
  misc_feature (1)...(449): n = A,T,C or G
gacacccttgttgtgcttccttccctgtctcgtctgatgaagtctgccattggtactggacgtactcgtaaggatcactctgaagtgtccaaccagctgtacgccaagtacgccattggacgtgatgccgccgccatgaaagctgtcgttggtgaggaggctctgtcttccgaggacaagctgtccctggagttcctcgacaagttcnaacgcaccttcatcagccagtcgccgtacgagtcgcgcaccatcttcnagtcgctggacattgcctggaacctgctgcgcatctaccccaaggatctgctgaaccgtatccccaagcgggtgtttggacganttttatgcncngtcggcgcgcaagattgccaacaaggacacccgggacaacacggttcggagcagacccaggccaagacggccgatttgatcgagacataagctatgga

SEQ ID NO: 3852 - DNA, 607 bp, Aspergillus niger
  misc_feature (1)...(607): n = A,T,C or G
ctcaaatccatcaaaatgtcttccgagcagaccttcattgccatcaagcccgacggtgtccagcgcggactcgttggccccatcatctctcgcttcgagaaccgtggcttcaagctcgttgctctgaagctctgctcccccggccgtgagcacctcgagaagcactacgctgacctcaaggagaagcccttcttccccggtctcgtctcctacatgctctctggccccatctgcgccatggtctgggagggccgtgacgccgtcaagaccggccgcaccatcctcggtgccaccaacccccttgcctccgccccggcaccatccgtggtgactacgccatcgacgtcggccgcaacgtctgccacggttccgactccgtcgagaacgcccagaaggagattgccctctggttctccccagcgagctccagcagtggaagcactcccagttcgactggatctacgagaaggcctaaattattccggcaatgtcgcgcctgagcgcctgcattccgctacgagttgagatgtagagtacctcgggtgatataaaactncaagatctcatgagaactagaaatacaaatntncaaaaatatattcaggaa

SEQ ID NO: 3853 - DNA, 622 bp, Aspergillus niger
  misc_feature (1)...(622): n = A,T,C or G
gtagcttctccgcttctgctagccaggcctccaaggttgccgttctcggtgccgccggtggcattggccagcctctgtccctgctcatgaagcagaacccccttgtcactgacctcgccctctacgacatccgcggtggacctggtgtcgctgctgatatcagccacatcaacaccaacagcaccgtcaagggctacgagcctactccctctggcctccgcgatgccctcaagggctccgagatcatcctcatccctgccggtgttccccgcaagcccggcatgacccgtgatgacctcttcaacaccaacgcctccatcgtccgcgacctcgccaaggccgccgctgaggctgctcccgaggctaacatcctcgtcatctccaaccccgtcaactccaccgtccccatcgtctccgaggtctacaagtccaagggtgtctacaaccccaagcgcctcttcggtgtcaccaccctggacgttgtccgtgcctnccgcttcatctcccaggtcaagggcaccaaccccgcaacgaggccgtcaccgtcatcggtggccactccggtgtgacatcgntcccctnctctcccagtcaaccaccccgacatctntggcaccgtccg

SEQ ID NO: 3854 - DNA, 541 bp, Aspergillus niger
  misc_feature (1)...(541): n = A,T,C or G
acccgcttcaaggccgtcgtcgtcatcggtgactccgagggtcacatcggtctcggtatcaagacctccaaggaagtcgctaccgctatccgtgctgncatcaccatcgccaagctcagcgttctccccgtccgtagaggttactggggtaccaaccttggtgagcctcactctntgccgttaagcagagcgccaagtgtggttccgtctncgtcagacttatccccgntncccgtggtaccggtctcgttgncttccccgntgtcaagcgtctgnttcagcttgncngtgtcaggacgcctacacctgntctttcgggtcaccaagancctngagaacactctnaaggntactttncttggcgncgtcaacacctacgggtttcttaccccaaactntggaaggagactaagctcattcgnagcctntggaagaagttcggtgatgtcctgcgtcagggcaagaagtactaggatagtgctatgatgggaataaccttgcatgantggttttgaatcgaactattttnctacgggttttc

SEQ ID NO: 3855 - DNA, 505 bp, Aspergillus niger
  misc_feature (1)...(505): n = A,T,C or G
cgagggtcccgctgagagcctcttccagaagccctactttgagcttctgcgcgatgcgctccgtgagggaggtgtcatcaccacacaagccgagaaccaatggctgcacctgtctctgatcaccgacctcaagaaggcctgcaaggaggttttccccgttgccgaatacgcctacaccaccatccccacctacccctccggccagatcggcttcatggtctgctgcaaggatgccactcgtaacgtcaaggagcccgttcgcagctggacccgtgaggaggaggagaagctctgccgctactacaaccaagacatccaacgtgccaacttcgttctccccaacttcgcccgcaangntctggatgctaaactatctgaagttttgtccttccaatactttggtggtggcctcctccgtttcnanggcccacgggggctgataatccatgatgatttgacgatgaccaatattacaaaagattctggcgcttcctcaaaaaaaaaa

SEQ ID NO: 3856 - DNA, 600 bp, Aspergillus niger
  misc_feature (1)...(600): n = A,T,C or G
atcaaaatggggcgtctcaccgagtaccaggtcattgggcgtcacctgcccaccgaggctaaccccacgcccaagctgtaccgcatgcgcatcttcgcgcccaacactgttgtcgctaagtcccggttctggtacttcctgacccagctccgcaaggtcaagaaggccaacggtgagatcgtcagcatcaatgtgatcagcgagaagcgccctaccaaggtcaagaacttcggtatctggctccgctacgactcccgctccggcacccacacatgtacaagggagttccgtgagatgagccgaccgaagcttgttgaagnttttttacaggacatggttgcccgcaccgtgcccgtttcggttcatccacatccttaaggttgttgagatcgagaacgccgacagatccgccgccttacatcaagcaagttctttcaagaaccttaagttccccttgcccaccggcttgccacggaagaacttgttcgttaattttngtccaattattttcgggnaatgngacgttttgggnttgggtgatcgaatgtggggatgaatgactntgttttggccatacattgnccaagggaccgggccccn

SEQ ID NO: 3857 - DNA, 624 bp, Aspergillus niger
  misc_feature (1)...(624): n = A,T,C or G
gtggaaactcacgccgcaagcaacggctccatgtccgagcaatacgacaagtctgatggcgagcagctttccgctcgcgacctgacctggtcctaagccggtccgctnaccgccnaaaaacgtcgtaaatccgtcgtgcctgcttcttggggcgagacctctgccaacagcgtgcccggcacctgtgcggccacatctgccattggtacctacagcagtgtgactgtcacctcgtggccgagtatcgtggctactggcggcaccactacgacggctacccccactggatccggcagcgtgacctcgaccagcaagaccaccgcgactgctagcaagaccagcaccacgacccgctctggtatgtcactgtgactctgccggctggtgagtcgtttgagtacaagtttatccgcattgagagcgatgactccgtggagtgggagagtgattccaaccgagaatacaccgttcctcaagcgtgcggaacgtcgaccgcgacggtgactgacacctggcggtagacaatcaatccanttcgctatagttaaagggatgggggatgaaggcaaattgggtanatgatcatgttagtaatggggtgtgcataatatantgaaaatggna

SEQ ID NO: 3858 - DNA, 535 bp, Aspergillus niger
  misc_feature (1)...(535): n = A,T,C or G
ggtgactgcactttcggacccatgcttgcccacaaggccgaggaggaggccgtcgctgccatcgagtacatcaagaagggttacggccacgtcaactacggctgcatccccagcgtcatgtacacccaccccgaggtcgcttgggtcggccagaacgagcaggaagtcaaggctgccggcatcaagtaccgcgtcggtaccttccccttcagcgccaactcccgtgccaagaccaatctcgagactgagggtcaggtcaagttcatcgccgatgctgagaccgaccgcatcctcggtgtccacatcatcggcccaacgccggtgagatgatcgccgagccaccctggctgtcgaagtaccgngcctcttgcgaggacattgnttgnacctgcacgcttaccttaccttggctgangncttcaaggaggttgcattgntactactcaaggcatcaattntaanagtcccccttgcttganatgaacatcacaccacccgatntctgaccttttggcttggctntactaatctacta

SEQ ID NO: 3859 - DNA, 406 bp, Aspergillus niger
  misc_feature (1)...(406): n = A,T,C or G
nngggggatcgctgnagncaccttctcntcaagcaccgggaaagtaggcggcctagcagctggagggaagctgaaatcacccgttcgaaagaggaggccatcgagatcctccgcggccacgaggcgcgcatcaatgcgggagaagccagtctgggtgacattgctgtatcggagtcagactgcagcagtgccaggaaacgtggagatttgggtttctttggacggaatgagatgcagaaagagtttgaggacgccgcctttgcactccaacccggtcaggtcagtgggattgtggagacggcctctggtgtccatttgattgaacgggttcagtaaatttctatgaatgggcatatatactacgtgtatttacntggatgagatctctatatctttctacatgaga

SEQ ID NO: 3860 - DNA, 1090 bp, Aspergillus niger
  misc_feature (1)...(1090): n = A,T,C or G
ggaaaacgacaaaacttctcacccgacatcgaggaccacccgctcggcaaccacatcaagatggtccgttacgctgctcaggagattccggccgctaagagcgcccgcgcccggggctcttacctgcgtgtcagcttcaagaacacccgtgagaccgctcaggccatcaacggcatgaagctgcagcgcgcccttaccttcctcaacaacgtcaccgaaaaggctgaggctgtccccatgcgtcggtacgctggcagcaccggtcgctgcgctcagggcaagcagtggggtgtcagcaaggctcgttggcccgtcaagtccgccgagttccttctcgacctcctgaagaacgctgaggccaacgccgacaccaagggtctcgacaccggcaacctcgttgtcaagcacatccaggtcaaccaggctcccaagggccgccgcacctaccgtgctcacggtcgtatcaacccctacatgaccaacccctgccacatcgagctcatccttaccgagggtgaggagaccgtcgccaagggtcccgctgtcaaggaggtccgcctcagctcccgccagcgtggtgctcagctccgccgtgctctcattgaggcataagcggtgtgtgggtgtcgggggaagtgtgaagtggtcagaaactgaatgggaatgccggagtttgctgttgtacggatccaatacctggtcacggaaggaatacaaaagaaattattacttttttgacaaatggaaaaaattcgaaaccacccggcgagaatgatgatggtgatgatgatggtttctcttatgctctatgcagagacaacatctttcctttagacattgatctcgtttcaccccccggagattcggttcgactggataattttcctttgcagcccctggtcatgagctgtggcggctggttaaggagtccagggaaaatattccttcattatagtggatactacatggatggcgtgcatcggtacggctggkttcggacattctcctacttcaggacacttttgcgagcgkttaattcatgatgggatacngaattcattttctttcatgaagttgtaaggaaaaaaaa

SEQ ID NO: 3861 - DNA, 808 bp, Aspergillus niger
  misc_feature (1)...(808): n = A,T,C or G
gcccagcccaccggcaagtgcggtgtcatcatcaccggccacaaccgcagcatgtgcacccaccttgctgccgccaacgagtacaagatcgagcacttgaagcagcctcacgtctggtctctcgttgagaaggcccagttctactacgttggtggtttccaccttaccgtctgtgttcctgccatccaggccctcggtgaggaagctgctgctaagaacaaggtcttcatgctcaacctctctgctcccttcattgcccagttcttcaaggaccagctggacagtgtcctcccctacaccgactacaccttctgtaacgagaccgaggctcgtgctttctccgagagccacagctggggcaccgacgatgtcgtcgagatcgccaagaagctggctcagctccccaagaagaacaccaaccgtccccgtgtcgccatcgtgacccagggcaccctccccaccgtcgctgccaccgttaagcccaacggcgaggtcgaggtcaaggagatccccgtccgcgagatccccaagagcagcatcaacgacaccaacggtgccggtgacgccttctgcggtggttctgcgccggtatctccaaaggaagtccctcgaggacagcatcgacatgggccagtggtcgcttccctcaacatccaagagctgggttgctccttccccntccccaagcaagcctacaccccatcaaccgctcctaaacatctncaacaaactcaactttgggatccttggagccataactggataacnttttccctcatctaaaaaaatttcctttttcaaaaaaaaa

SEQ ID NO: 3862 - DNA, 486 bp, Aspergillus niger
  misc_feature (1)...(486): n = A,T,C or G
aagatgtcttccgctgcctgcatcttctgcaagatcatcaagggtgatatcccttctttcaagctcttcgagagcgacaaggtctttgccttcctcgacattcaaccccttagccgtggacacgctctcgtgatccccaagttccacggtgccaagctcaccgacatccccgacgaagatcttcaggaaatcctgcccgtcgcgaagaagatcgccaaggccaccggcgccgaggacttcaacgtccttcagaacaatggtcgcatagcgcaccaggtagtcgatcatgttcacttccacatgattcccaagcctaacgagaaggaaggtctcggtatcggctggccgctcaggaatccgatatggacaagctgaaggctctgttcgaggaaatcaaggctaagatgtaaaagtgtcgtagtacagatatagcaagtgctacagctgcgtctaantacataccatgtgctattatcaaaaaaaaaa

SEQ ID NO: 3863 - DNA, 515 bp, Aspergillus niger
  misc_feature (1)...(515): n = A,T,C or G
gaccaggtcaggtcgcgagcggaaagctgctcgccatcagacttgtcntattgctcggacatggagccgttgcttgcggcgtgacctctgccagcagcgtgcccggcacctgtgcggccacatctgccattggtacctacagcagtgtgactgtcacctcgtggccgaagtatcgtggctactggcggcaccactacgacggctaccccactggatccggcangcgtgacctcgaccaagcaagaccaccgcgactgctatcaagaccagcaccagtacgtcatcaacctcctgtaccactcccaccgccgttgctgtgactttcgatctgacaactacaccacctacggcgagaacatctacctggtccgatngatctctcanctgggtgactgggaaaccancgacggataactctgagtgctgacaagtacacttcaagcaaccgctctggtatgtcactgtgactccgccggctggtaatctttggtacaantttccncattgagacgata

SEQ ID NO: 3864 - DNA, 630 bp, Aspergillus niger
  misc_feature (1)...(630): n = A,T,C or G
atcctctcttatctccttctgacgttttcgtcatctcccataacacctcattcacaatgtctgctcctgctgctttctctgacatcgccaaggcggccaacgatctcctgaacaaggacttctaccacaacagcgccgccaacctcgaggttaagtccaaggcccccaatggcgtcaccttcaacgtgaagggcaagtccgcccacgagggtcccattgctggctccctcgaggccaagtacgtcgaccagcccactggccttaccctcacccaggcttggaccactgccaacgccctcgacaccaagctcgagctcgacaacaacatcgccaagggtctcaaggctgagatcctgacccagtacctccctgccaagcagtccaagggtgctaagctcaacctctacttcaagcagcccaacctgcacgcccgtgccttcttcgacctcctcaacggcccctccgcaacttcgacgctgttctcggccacgagggcttctcgtcggtgctgagggtggctacgacgtcagaaggccgncatcaccaagtactccgctgccgttggctacagcgttccccagtacttccgctgcatcaccggtggcaacaacctgaccgtttnttcggcag

SEQ ID NO: 3865 - DNA, 483 bp, Aspergillus niger
gagacgactccggagcctttacgacaaccaaacccgacagccaaagaaatccgtcaagatggtcaagaagagggcgaacaacggtcgtaacaagaacggccgcggccacgtcaagcccgtgcgctgctccaactgcgctcgctgcactcccaaggacaaggccatcaagagattcaccatccgcaacatggtcgagtccgctgccatccgtgatatctcggacgcctccgtcttcaccgactacgccgtccccaagatgtacctgaagctgcagtactgcgtctcctgcgctatccacggcaagattgttcgtgtccgctccgggaaggtcgtcgcaaccgtgctccccytctcgtatcaggtcaacaaggatggcaagaactgaacccccctcaagccgccaaggctatgtaaggaaggaatgacaacgatttcaaagagataaagaaaaatggaattagttaagggccttaaaaaaaaaaa

SEQ ID NO: 3866 - DNA, 636 bp, Aspergillus niger
  misc_feature (1)...(636): n = A,T,C or G
ttctaagcctgagaacaagcacgtcctcaagtccttcaacctcactggcaaggttgctgccattactggcggcgcccgaggtatcggactagaggtctcgagggctctcgcagaagctggtgccaacgtggccctgatttacaactcgtctaaagctgcagaagcccttgccgaagagatcggcgcccagaataatgtcaagtcagctgcctataaagctgatgtcggaaatcaggaggatattgagagggtaatccagcagattgcttcagactttggcaagcttgatattatcgtcgtgaactcgggggtcacttccaatatcgcggcagaagactacaccaccgaacaatggcgtgacatcatgaaggtcaatctagatggcgcattttatagcgcgcaagcggcttctcggatcttcaagcaacaaggacatggaaatgtaatcttcacagcctctgtcagtgcaacattggtgaatgtgcctcagaagcaagctgcatacaatgcctccaaagctggggtcgtgcaaatggcaaaatgtctgtctgttgaatgggttganttctgccgggtcaactgtatttccccaaggttcaattgccacaanaaattctggatatccaacctctggga

SEQ ID NO: 3867 - DNA, 416 bp, Aspergillus niger
tggtgctggtcttgctagcagtcgcggtggtcttgctggtcgaggtcgatctctcagctgggtgactgggaaaccagcgacggcatagctctgagtgctgacaagtacacttccagcgacccgctctggtatgtcactgtgactctgccggctggtgagtcgtttgagtacaagtttatccgcattgagagcgatgactccgtggagtgggagagtgatcccaaccgagaatacaccgttcctcaggcgtgcggaacgtcgaccgcgacggtgactgacacctgcggtagacaatcaatccatttcgctatagttaaaggatggggatgagggcaattgggtatatgatcatgtatgtagtgggtgtgcataatatagtgaatggaagccaagtcatgtgattgtaaaaaaaaaaa

SEQ ID NO: 3868 - DNA, 633 bp, Aspergillus niger
  misc_feature (1)...(633): n = A,T,C or G
gtggtactcctgccattgccgttccgtttgtttagatcgtcgtccacatccccctgtcgccatccctcgcagcccgctgtcgcatattcctcacgcaatcaccacaatcaacacaacaaacagtcatggcttcgaccaactacaaggaagccttctctctcttcgataagcgtggtaccggcaaggtcgcgctcgagtcgctaggcgacctcctgcgcgcatgcggtcagaatcctactttggcggagatcgcagatttggagaagtccatcggtggagactttgacttcgagtcgttcttgaaggtcctcaaccgccctggaggcttccgtgaccctggcgagcccgaagaatactgccgcggattccaggtgttcgacaaggacctgactgggtttatcggtgtgggacaactccgatacatcctgacgaatctcggtgaagaagatgtcggatgangaggttgacgaactactcaagggcgtcgacaccaactccggcgagatnaactacaccgacctcgtccgcacatcctggccaactaaacgacacacgataccgataccctcctgacgttcctgatgaattctgttacgaagcgaacctcctacaaccgttgccngagttgaangc

SEQ ID NO: 3869 - DNA, 395 bp, Aspergillus niger
aagtcacagccacggcggtgggagtggtacaggaggttgatgacgtactgggtgactgggaaaccagcgacggcatagctctgagtgctgacaagtacacttccagcgacccgctctggtatgtcactgtgactctgccggctggtgagtcgtttgagtacaagtttatccgcattgagagcgatgactccgtggagtgggagagtgatcccaaccgagaatacaccgttcctcaggcgtgcggaacgtcgaccgcgacggtgactgacacctggcggtagacaatcaatccatttcgctatagttaaaggatggggatgagggcaattggttatatgatcatgtatgtagtgggtgtgcataatagtagtgaaatggaagccaaaaaaaaaaaa

SEQ ID NO: 3870 - DNA, 636 bp, Aspergillus niger
  misc_feature (1)...(636): n = A,T,C or G
ggaggcccgactggtcgatggatacacgaacctgagcgctatggagatcgaccctaacggaagtattcaagatctcctggctagtggtgaaggccaaggcgacgaccctctgtctggtatgggcgttggtggaatgatgcaggaccttgcgttcagtatccccggtgttgatgaagctatgtcctttgccgaagtcctgaagcaggtcaagtcgctgtcctacgaagttattgtgtttgacactgcgccgaccggtcacactctccgcttcctccaattccccactgtcttagagaaggctctcgccaagctgtcgcagctgtcgtctcagttcggtcccatgctgaactcgattcttggttcccgtggtgggtctgcctggcggtcaaaacattgatgaattgttgcaaaagatggagtcgctganggagacaatcagcgangttaactcgcagttcaaaggacgccgatctgactancttcgtctgtgtctgcaattgcggnantcctgtccctctaagaaaccgagcgcatgatcaagagctcacaaagctataacatcgatanccatgccaattgtggtcaaacaactcctgttcccaagcaaaagcaaccaantgcgagcaatgttatgca

SEQ ID NO: 3871 - DNA, 430 bp, Aspergillus niger
gctatgttacgagaacaaggacatgctaagtgccggtatcatcatcgccggatacgacccgaagcacggaggtcaggtgtattcgataccgttgggcgggtctcttcacaagcaaccgttctctatcggcggatctggatcaacctatatctatggctactgtgatgctcactggagggagaacatgacagaggaggaaggcatcaacttcgtccgcggagcactgcaagaagcaatcaagtgggatggcagttccggtggtgtaatccgactggtggtgctgacgtctcggggcgcccagcgacacctctacctgccagacacgggctacaccggcccgggcgttaccaattaacgaatgtatctatacgggacgatgattttaattgttggtagctgctaaacgagctatttcattcaaaaaaaaaaa

SEQ ID NO: 3872 - DNA, 468 bp, Aspergillus niger
  misc_feature (1)...(468): n = A,T,C or G
ccaaccagatcaaggacttgggcaagcgcgcccgcgacaacaagctcaagcccgaggagtaccagggtggcactttcaccatcagcaacatgggtatgaaccctgctgttgagcgcttcgccgccgtcatcaacccccctcaggccggtatcctggccgttggtaccatccgcaaggttgccgttcccgtcgagactgaggagggcacctccgttgagtgggatgaccagatcatcgtcactggcagcttcgaccaccgtgtcgtcgatggtgttgtcggtgccgagtggatcaaggagctgaagaaggttgttgagaaccccctcgagcttcttttgtaagctcttccctacactgtgagaccccgaccggcgcaatatactaactatctacgatcggagtttcttttggncttgttgtaatatgtattaaaatcaattgaatgtttcctcctttcaaaaaaaaaaa

SEQ ID NO: 3873 - DNA, 478 bp, Aspergillus niger
ccgacctcaattaccgccctaactacaataattccgaggactcgaccgattttgcaaccgccaaagggagaaattaccaccaaggtcctgagtgggtttggcagcgtgggtacttcctccgcgcctttttgcacttcgaccttgctcgcaggacgacaccggcggaacggacggagacataccaacagattactcgacgcttggagggttgcaagcgggctttgagggaaagtccatggaagggccttaccgaactaacgaataagaatggtgcctactgtgcagattcctcacccacccaagcatggtcagctggatgtctgcttgatttgtattatgatgcatcaagacattcacagagctgactagcgtgttgttgatacaattttctatcttgatctagcgaagatcatcatgagttcgaattagatatatgtttgtccaaacttaagttaatggaaatagcttttatgtgctg

SEQ ID NO: 3874 - DNA, 639 bp, Aspergillus niger
ccaagacagcttcaatctacaccttgcccgttttaaactctagaggtcagtaagaagagacttctttcgacaagtcatcatcataacgctgtttgcttctctttgagactcaaaagtcctctcacccacttgcttttcctcactctgctaccaaaggactatttacttactgcagtgattacgatagtgtctgccccgctaccccgcctttccagatggacatcgatctaagcagaaggaataaaaagccccgccctttgctagaatctgaacgggagagattagaggaattcattgattctattcattattcagccagatactcagatgaccagttcgaataccgccatgtccaactccccaaaaacatgctcaagaaaatacctgcagactattttgacagttcaaaaggaacgctaaaactactgtgggaggatgaatggcgtgcacttggtatcacacaaagcttgggttgggaacattatgaagtgcacgagccagaaccacatattcctctctttaaagcgccccttgaactatcaagccgccagtatcacagtaactcgtcagctggaatactgttgatgccaacctgcccccgtcgcctctgaaacactaatacaacgaagattcaaaaac

SEQ ID NO: 3875 - DNA, 592 bp, Aspergillus niger
  misc_feature (1)...(592): n = A,T,C or G
caacaaccgtcgtaactccgtcgtgcctgcttcttggggcgagacctctgccagcagcgtgcccggcacctgtgcggccacatctgccattggtacctacagcagtgtgactgtcacctcgtggccgagtatcgtggctactggcggcaccactacgacggctacccccactggatccggcagcgtgacctcgaccagcaagaccaccgcgactgctagcaagaccagcaccacgagaacatctacctggtcggatcgatctctcagctgggtgactgggaaaccagcgacggcatagctctgagtgctgacaagtacacttccagcgacccgctctggtatgtcactgtgactctgccggctggtgagtcgtttgagtacaagtttatccgcattgagagcgatgactccgtggagtgggagagtgatcccaaccgaagaatacaccgttcctcaagcgtgcggaacgtcgaccgcgacggtgactgacacctggcgggtanacaatcaatccatttcgctatanttaaaggatgggggatganggcaattggttatatgatcatggtatgtantggggtgtgcataataa

SEQ ID NO: 3876 - DNA, 609 bp, Aspergillus niger
  misc_feature (1)...(609): n = A,T,C or G
gcccggtaccgtcgctctgcgtgaaatccgtcgttaccagaagagcactgagctcctgatccgcaagctgcccttccagcgtcttgtccgtgaaattgctcaggacttcaagtcggatctccgcttccagtcctccgccatcggtgctcttcaggagtccgtcgaggcctacctcgtctccctcttcgaggacaccaacctgtgcgccatccacgccaagcgtgtcaccatccagtccaaggacatccagcttgcccgccgtctccgtggtgagcgctcttagatttacttctaatgagtcgattctttttctggttgggaaggcgataacggggtttctttttctttaattttcatgactactggcgatacatgatgggtttgcgaattttaacgggtttcggcactgggttttcgttatttcttgctgcgcaataaatagtagctgccgattcagcggctgggtggaattgatcatggggatgcatccgaatatgtacattaaagaaagcttttattcgacgtgacttccttcgggagcgccaccggatggcatagacgcgaaatgcaagtatctatggaacaatncaacccggtttgagaatcgcg

SEQ ID NO: 3877 - DNA, 576 bp, Aspergillus niger
agttcgccgacgaaaacttcaagctgaggcatacgcgcaaggggctcctgagcatggccaacgccggcaaggacaccaacggctcccagttcttcatcaccaccgttcctacaccttggcttgatggccgccatgtcgtcttcggtgaagtgctcgagggctacgagatcgtcgctcagattgagaacgtgcccaagggccgttctgacagacccgtggagactgtcaagatcgtcaagagtggagagttggagtctgaggacaaggctggagaaaaaggtagcagccacgaggagctgtagacctgtttcctgaggtctcggcctgcttctcgataagactgtgatgtgctgatcgcttgtaaagaaacgagctccgaagaagagtcacaaccttcagcaattgctgttattccttctccaacccctttgcctatgacatctgataacgctccttatattttcccgaaattcgcaacgcttgccattgttgtcggtctcctggttgtcctggtccgacgcagcttcaagggagaacaagagaaggtgaaagaagtattgttgatagaaaaaaaaa

SEQ ID NO: 3878 - DNA, 292 bp, Aspergillus niger
acagaaggcatttatgatggtcgcgtggtggtctctatttctgtacggccttcaggtcgcggcacctgctttggctgcaacgcctgcggactggcgatcgcaatccatttatttccttctcacggatcgatttgcaaggacggatgggtcgacgactgcgacttgtaatactgcggatcagaaatactgtggtggaacatggcagggcatcatcgacaaggtaaattgcccctttatcaaaaaaaaagaaggaaaagcagaagaaaaataaaataaaaagaactctagtcct

SEQ ID NO: 3879 - DNA, 346 bp, Aspergillus niger
atcacccccatgggtggcttcgttcactacggtgaggtcaagaacgacttcgttctccttaagggttccgtccccggtgttaagaagcgtgtcatgaccctccgcaagaccctgtacccccagaccagccgcagggccaccgagaagatcgagctcaagtggatcgatacctcctccaagttcggtcacggtgctttccagacccccgaggagaagcgtgccttcatgggtaccctcaagaaggacctggagacttccgcttaaggtgtttatggaaatggttcggtgtagtgcaaattatattacgtttcaataaaagcgaagaatacctttcaaaaaaaaaaaa

SEQ ID NO: 3880 - DNA, 629 bp, Aspergillus niger
  misc_feature (1)...(629): n = A,T,C or G
ctccctatatttttcgccaactcaccaccggctctgtttcttctctttcttcttctgttccctcaatcgtatctcagtgacttcattgttatactctcaaatccatcaaaatgtcttccgagcagaccttcattgccatcaagcccgacggtgtccagcgcggactcgttggccccatcatctctcgcttcgagaaccgtggcttcaagctcgttgctctgaagctctgctcccccggccgtgagcacctcgagaagcactacgctgacctcaaggagaagcccttcttccccggtctcgtctcctacatgctctctggcccatctgcgccatggtctgggagggcccgtgacgccgcaagaccggccgaacaatcttggtgcaccaaccccntgcctccgccccggaccatccgtggtgactacgccatcgacgtcggccgcaacgtctgcacggtccgactccgcgagaacgcccagaaggagatggccttggtctccccagcgagctcacagtggaacactcccagttcgactggatctacgagaagcctaaatattccggcaagtcgcgcctgacgctgattccgntcgagttgagatnanagacctcggtgaataaactcaaga

SEQ ID NO: 3881 - DNA, 604 bp, Aspergillus niger
  misc_feature (1)...(604): n = A,T,C or G
gcaaagaacaacaacgcaagctcgtttgaatttgcaagagatgagcgagaagcacatgatttatggtctgcgcgaaaacaatcgctatggagtatgctggcgctaagagagcgaggatccgaagtatggtcaaccgacgtttccgtaccgatctctagattgccagacattattgaaatctccaagaaagaactcgatgaccttggaatctttgccagtatcctcgggcatattggagatggtaacttccacgcaagcatcttatatgatcgcactatccaagaagaaagggagcgagtagaaaaggttgtgtacgacatggttgatcgtgcattggaaatggaaggctcttgcactggtgaacatggtgtgggattggggaaagaaagattcgcttgaagaagganctggcccactaccgattggaattatgcgtctatcaagaaagnttttcgacccacacttggntattgaacctgcaggacttcgattttgagacnaacatagatggacatctagctttaactgaggntgcttttgccagcattactttggtggccgaatatgncntttaaaggtngaatctagnactttgntttttacc

SEQ ID NO: 3882 - DNA, 614 bp, Aspergillus niger
  misc_feature (1)...(614): n = A,T,C or G
aacaagtctctgtccaagaagctttgcattgagggtgttggaggtgtccacgtccagaacaccatgagcgaggaggtcgctgtttgccgtaccgactaccctggtaccgaatccgagaccatccctctcgctgtcgctgccaacagcgaacttcaccccctgacttgccccaacggcgccacctactacaagtgggagaaccagaccacttccgctcagtactatgttaaccccaagggtgtttccaccgagactggttgccagtggggtaacggcagcgctcctatcggtaactgggctcctatcaaccttggtgtcggttacaacgatggcaagtggctttctctgttccagaacagccctaccaccaccaccaagcttgacttcaacgtgaagatctcgggtgacaacctcagcggttcttgcaagtacgaggacggtaccttctactccgagtctggcttcaacgactccggttgcactgttganggtctctccggttccgncacctatgtcttctactaangtagtcgagggcccgacaccctttcgncgtcgncgtccgattcggntcgcgtccgctgatttggaatcgaaccccgtcggctcgcaaa

SEQ ID NO: 3883 - DNA, 520 bp, Aspergillus niger
  misc_feature (1)...(520): n = A,T,C or G
gttttctactcctacactcgatcttaccgacgtcgtcgacacatccctcgagatacctcatatccttcgattcctcgatttgagaatctcgattccacaccgtcaaaatggtcaagacttccgtcctcaacgatgcgcttaacgccatcaacaacgccgagaagagcggtcgccgtcaggtcctgatccgcccttcctccaaggtcatcatcaagttcctttccgtcatgcagaagcacggctacattggcgagttcgaggaggttgacgaccaccgctccggcaagatcgtcatccagctcaacggccgtctgaacaagtgcggtgtcatcaacccccgntccccgttcagctccgtgacctcgagaagtgggccactcagttctgccttccgtcagtcnggttacgttgtctgacacctccnttggtatatggaccacgagggaggttgccgaagcacgttgccggcaactcctnggttctctactaaaaagttaccctggaactttttttgatggca

SEQ ID NO: 3884 - DNA, 620 bp, Aspergillus niger
  misc_feature (1)...(620): n = A,T,C or G
tgacttgtgtgttttcgtgtgcgtttgcatctattagaattgtttgaaaatgaaggcttactggtacgataacaagccgggcgaccagcgcgaaccccacgacgacggtcgtcccgtcgacgaagcttacctcgcctctctgggtgtcttctacaagtactgcccgagcatcgaggacgtcgacgccctggccgccgagcgcggatacaagaaccgcgatgaggtcaccgtgtcccccaagaccatgggcgatgtgtacgaggagaaggtgaagatgttcttccacgaacatctccacgaggacgaggaaatccgctacatccgggatggtgagggatactttgatgtccgtggcaaggaggacgagtgggtccgcattaagttggtgaaggatgatctgattattctccccgcgggtatctaccatcgctttacgacggatgagaagaactatgtcaaggctatgcgtctcttccaggaggaacccaagtggactcccttgaaccgtagcaacgaactggatgagaacccgcaccgtgtgtcctacctcggtaatctggggtaangctgctgttgctgctgtttaaaataaatctggggggtggcaatgtaaancttga

SEQ ID NO: 3885 - DNA, 619 bp, Aspergillus niger
  misc_feature (1)...(619): n = A,T,C or G
gataccaatgatacccgccatgacaatggggacaatgttcttgacgatcaggtctggtcgtgtcggtcctgattgcaaacgatttgggacagaaggtccccttgtacactggtttcattcagctgggagcaggtctcgccgtcggtttggctggtatggcagctggttttgccattggtatcgttggtgacgcaggtgtccgtggaactgctcaacagccccgtctctatgtcggaatgattttgattctcattttcgctgaagtcttgggtctgtacggtcttatcgttgctcttctgatgaactcccgttcgaggatcgacgccacttgctaaacgaaccctccttcgttccgcgcgaaatggcccaagtgaacacccgcccgaggatgccaaccaccctatatcctcggatatgatgaacagagcccgggttgctcaacatgtgttaacgtgatgcggttattttgacttgtgttttcagactttatttgccgacaatgacggttcccgtcattgncccgatgacagctggaggggatggggagaagtggattgctggggggattggaaaagagaaaacggacgttatataacatatgctttctctttcatccaac

SEQ ID NO: 3886 - DNA, 690 bp, Aspergillus niger
  misc_feature (1)...(690): n = A,T,C or G
ggcgattccccgaagagcgctaggaactcgcgacaatgcttatccccaaggaagaccgcaagaagatccacgagtacctcttccgcgagggtgtgctcgtggccaagaaggacttcaaccttcccaagcatggcgacattgacaccaagaacctctacgtgatcaaggcctgccagtccctgatctcccgcggctacgtcaagacccagttctcctggcagtactactactacaccctcacccccgagggtcttgactacctccgtgagtggctccacctccccgctgaggttgtccctgccacccacatcaagcagcagcgttcccacgctccccctcgtggcatgatgggcggtgaggagcgtgagcgtcgtccccgtgctcctcgtgagggtggctaccgccgccgcgagcaggacaaggagggcgccgcccccggcgagttcgctcccagcttccgtggtggattcggccgtggccgtggtgctccctcctcctaaggggtgtcgcctgccggtcttccaagggcttattgggattgttgccggtgtggcttgaacgactttgaaagaagtcgggaagctatgctatgcacgtcctaaaaaagaagttatgccaagctactgtttcacagttatgacatagttaggattaatggcatgatttcatgactcaaaaaaaanaaagatt

SEQ ID NO: 3887 - DNA, 656 bp, Aspergillus niger
  misc_feature (1)...(656): n = A,T,C or G
gggcaagtgattcctttgcgttgaggcctctttagaaccgctacacacgttaaacccacatttttaaacatgtctgagacttctgccgcctgggcccctcgccgatgagggccttacccaaaacctcctggaccttgtccagcangccggtcactaccgccagctgaagaagggtgctaacgaggccaccaagactcttaaccgtggtacctccgagctcgttatcctcgctgccgacacctctcccctcgctatcctcctccacatccccctccttgctgaggacaagaacaccccttatgtcttcgtgcccagcaagcttgctctcgggcgtgctaccggtgtttcccgccccgtgattgcgggcagtatcaccaccaacgaggccagtgacctccaaggccaagatnaagaccatcaaggacaangtcnagagactgatgatctaagcgttggtcctgttgtggnaaccctccggaggattatgcctccgcgggttgctaagaaggaatctaatgggacttcnggagtttggcgggcatgacagacgangttttcgccccanaagtgcgaaaaacaagttgtcgatgaatgggttggattgctaacgggtggctcaaattgggatgctgttgggcgtttgtgcncctgggaat

SEQ ID NO: 3888 - DNA, 802 bp, Aspergillus niger
caactcccagcgccagcccgcgagacgacgacaagatggtcctcgcaaagaagcacgtccccatcgtcaagaagcgcaccaagcgtttctggcgccaccagtccgaccgcttcaagtgcgtgccggagtcatggcgcaagcccaagggtatcgacaaccgcgtccgtagacgcttccgtggcaacatccccatgccctccatcggctacggatccaacaagaagaccaagcacatgatgccctccggccacaaggctttcctcgtccacaaccccaaggacgttgagctcctgttgatgcacaaccgcacctacgccgctgagatcgcagcgccgtctyctcccgcaagcgcgtcgacatcatcgccaaggccaaggctctcggcgtcaaggtcaccaaccccaagggccgcgtcaccaccgaggcttaaatggatatggaatgaatgtaaagaaagcccaagaaatttcatcattttcattttcatttttcattaaactctttccacttataccaaccaaatgggaaccaaccactttcgggggacataaaaaagcagcaacagcaactacttcactgtggtagtggagtggcttgtttgttgtgattggggacttgcggagccttgaatcatcgcatcttctaatgtgggctttggctttgacgttgacgacgtatgtgctggattgcagcgtttatgatgattgatttacatgcatgtgggtcttttgtcatggcgcttgtggtcgtggctggtgctgccagtctgggaataaaaatcaaaatcttatgaagaaaaaaa

SEQ ID NO: 3889 - DNA, 600 bp, Aspergillus niger
  misc_feature (1)...(600): n = A,T,C or G
gagtaaattctggatagtggcgtcgaagcggtggttcctgctttcaccagctgggaactttctacggctggattcatctactggttcttcatccccgcattgcagttcatctggggcgtttgcgtcgtcgatacctggcaatacttcctgcatcgcgcgatgcacctgaaccggtggctttatgtaaccttccattcccgccaccatcgcttatacgttccctatgctttcggtgctctctacaaccatcccgttgaagggttccttctcgatactgctggcaccggcgtcgcattcctgacagcccggatgtcgaatcgccagagcatgtggtcttnacttttccaccattaagacggttgacgatcactgcggctatgctttccttgggatccgctgaacatttacatncaacaatgccgttaccatgacattaccaccaaactggggcatcaagacgaacttttgcagctttcttnnaatctgggatcgtgggtcggnacccatgggaaggcnatgtgaantaccttcgaacgttccggaatccgttanaaacanttggnatgatgtaantccgcccaattcggcctgaactcggan

SEQ ID NO: 3890 - DNA, 625 bp, Aspergillus niger
  misc_feature (1)...(625): n = A,T,C or G
atcacaacaacttcatcaacaattccttcctcttcccacaaaataactcaaaccagtcccaacacaatgtcctggtaccaaaaatccttcactctgcctgcccgctcgcgcggcagctacctcatcaccgaccacgtcctcgagcaactccccgagatcaagaactacaaggtcggcatgctgaacctcttcgtgcaacacaccagctgcgcgctctccctgaacgagaactgggatgacgatgtgcgcgccgatatgagtgatgcgctggatcgcatcgctccttatgataagaaggggaacctgtatanacattcggctgagggggaggatgacatgccggctcatatcaagtcagcgttgattggcgcttcggttacgattcccatctccaatggacgcttggctacgggtacgtggcanggtatttgggtacttggagttcagggccatgagacactcccggnaggtggttgctacgattcaaggtgagaaggcttgacttaatgcttgtggtgggtagangtggtggtggtgagggaagtgcggttgtgantgtgatgccaattgtgtagagtataatgtgtctganttggtgtagaaggatggcgtacgtttgggataa

SEQ ID NO: 3891 - DNA, 613 bp, Aspergillus niger
  misc_feature (1)...(613): n = A,T,C or G
gcgagatgatccatccaaaggtgacatgcataatcgacaagcactgtccctggggatgttatggaagagtctcaaagactatgacctctggccgatatatatcatcgggatcatgttcgaaatcccgacttcgccaccaaagtcttatttgaccttgtcgctgaaggcaatcggcttttccacattccaaacgaccctcttgtccattcccgtgaccgtcttcgccgctatcaatcttgtcctcgtcgcgctcttatctgagttctggggacaaatctcaattgtgtgccttctaacacagttgtggtcgcttccactcctcattgtactctacacatctgccggaagcctctccaactgggggctatatgccgtctcgttcatcttactgggctggccgaatcctcaagctgcccaggtgagttggtgttcgcgattaagcaacagtgtgagaaccagagcagtcaagtgcagcaattttcaatattatgattcaactttctggaattgcgtcttcaacatttaccggtcggatgacaaacctttctaccgncgaggaaatagacaactgatcgcgatcaatgttgccactatggcatgtaccccgttggca

SEQ ID NO: 3892 - DNA, 628 bp, Aspergillus niger
  misc_feature (1)...(628): n = A,T,C or G
gtcgacaagggcaagctcggtggaaccatgcgtcttggcagacacccctgcgtcttccaggagaacaccgagtggtctcgtctgcggagtctgtacggaccctccgtctcgcagattgaggagcgccaccgccatcgctacgaggtcaaccctgagatgatcgagcagatcgagaaggccggtctctccttcattggaaaggacatcaagggtgagcgtatggagattgtcgagatcaaggaccacccctggttcgtgggtgtgcagttccaccccgagtacctcagtcgggtcttgagccccagccgggctttcctcggtttctttgccgccgctgcgggatgcctcgatgaggtctccaaggcagttgttcagggtcagcggagcattggccgcaagcaatagatctctttggcggaggagcggtattttgctggagttctggtgagaaggatactgttggcggtacacaccgtctgggtttttctgntgtctgtctggggcaggtcttgagcgctgcctcatgccgttgaggcagccccaatctatacgacttcaggcccgtatggcangatcgcgtgaggataccctttgacaaagacctgaacgtncccaagtcgatcangta

SEQ ID NO: 3893 - DNA, 609 bp, Aspergillus niger
  misc_feature (1)...(609): n = A,T,C or G
cttcgcatcctcctctttttagatctcctaaataacacatccgtcaaaatggccgacttccagagcatcgcacagcaatttgtgcaattctactaccagacctttgacgcggaccgtcagcagctggccggtctctaccgcgataactctatgctcaccttcgagactgcctcccagatgggtgttgcccccatcatggagaagctgacgagtcttcctttccagaaggtccagcaccagatctccactctcgatgctcagccctctgttaacggcagcatcatcgtcatggttaccggtgcccttatcgtcgacgaggagccccgcccatgaactacacccagaccttcactctcaaccccgaggctggcagctactacgtcttcaacgacatcttccgtctcatcatgggttaaattgcgacgcaggggattggcggggatttgatgtgacgtgtgtgatgggtgatttanggggcccatggcttggcctattcaagtaggcagcttttatgagatgaagataatgaattaagttataagaggatcgacacgtgcttttggttgctgggttnaatctattcccttccttcattgngaaaaaaaaaaa

SEQ ID NO: 3894 - DNA, 630 bp, Aspergillus niger
  misc_feature (1)...(630): n = A,T,C or G
cagagatttaattctctcccctcgctcacttcctatacaccgcttttaagggccgtttacgacgaaaggccgagtttatgtccatcgaaaacctcaagaccttcgaccccttcgccgaagctgacgaagacaccggcgagactaaacagtctcaaaattacatccatatacggattcaacagcgcaatggtcgtaagaccttgaccaccgtccagggtcttcctaagaagttcgatcagaagaagatcttgaaggtcatcaagaagaagttcgcctgcaatggcaccattgtcaacgacactgagatgggcgaggtgattcagctgcagggagaccagcgtaaagatgttcaggagttcttgaccgacaagaaggagggtctcgagctggacgccaagaccatcaaggtccacggtttctaagccagacgccacgcccccgttccggtcccttcttccagtctacgttcccctcagagcggtgcggtaggggacagtatgtgcccacctgcccttctgatgtggcattgcggttccggcactggcacgagggttggtcggctgatatattggctgntggtattaccgntttttacccggaatactggacttgggccttttgncgaattga

SEQ ID NO: 3895 - DNA, 609 bp, Aspergillus niger
ccaacttcacaatgagcgcccaggcatactacgagctctatcgcgggagcagcctcggactctccctgaccgataccctcgatgacctgatcaacgaaggacggatcgagccccagctcgccatgaagatcctctcaactttcgatcgcgtgatcacagaggtgctggcagacaaagtgcgcgctcgtctgactttcaagggacatcttgatacctaccgattctgcgacgaagtgtggacattccttatcaaggacgttactttcaagctggataaccagactacggtctccgcggataaagtgaagattgtgagctgcaatagcaagaggcctggtgaagcctaagggtgagggatcgtttaccttgcgtcatcggttgatactctcgttacctcacttcctcacactctttttttctccttccgccacttgctttgataggcgttgttgaacctatatttcttctgttttactcttcatgtggattgctcttttgtgcccgggacatggcaagttgcttgatatggggctttatcatatttttggcgtttcgcgttagcatatgaggctgaattatggatttgctatggtgctactagaatagatt

SEQ ID NO: 3896 - DNA, 417 bp, Aspergillus niger
  misc_feature (1)...(417): n = A,T,C or G
aagtcacagccacggcgagaacatctacctggtcggatcgatctctcagctgggtgactgggaaaccagcgacggcatagctctgaatgctgacaagtacacttncaagcgacccgttctggtatgtnactgggacttttgccggttgtgaagtcgtttgagtncaagttantccncattganagcgntgactccgtgaagtggaagagtgntcccaaccgagantacaccgttcctaaggcntgcggaacgtnaaccgaacggtgactgacacctggcggtagacaatcaatccatttcgctatagttaaaggatggggatgagggcaattggttatatgatcatgtatgtagtgggtgtgcataatagtagtgaaatggaagccaagtcatgtgattgtaatcgaaaaaaaaaaa

SEQ ID NO: 3897 - DNA, 606 bp, Aspergillus niger
  misc_feature (1)...(606): n = A,T,C or G
gagaccttgggcaagggtacaatgaccctgaaccccttccacacagaccgccaggtcctctcgcgcgtatcagccgcaggcctgctcaccgtcctggtgtccatgatcgatgccaagcaattcgtcctcgccgaacaccactacctcctctacttcctcatcaccgccatgtacccacgcttccttgtcacgctcgacgaagacctgcagcctctcaccgtcaatgtccgggtcggtcaggctgtggacgttgttggcaggcgggtcgcccaagaccatcaccggctggcaaacacagagcacgccggtgctgctggctatggcgaacgtgcagagctcgaagacgagcagtacattcctcttacaagaccctggagggtctggtcatcttgcgcaagaacccaactgggaaaagttccactnggtctaaggtccttcgacgtgacacgacttgtgggtgactgacaaggggatatgntcaggtctggattcatgnatcagaccaatggaaatncaggaccgatggnatatgtcgactntnattaaactgtgattggacggtgacatgtagatgattcaggttanttgntgaaactaatgaatngt

SEQ ID NO: 3898 - DNA, 483 bp, Aspergillus niger
tggccataccggtgagcttgccgttaagggtaggccaccagctacgacgagatcaagaaggccctcaaggacgcttccgagaacgagctcaagggcatcctcggctacactgaggacgacatcgtctcctccgacctgaacggtgacgaccactcctccatcttcgatgccaaggccggtatcgcccttaactccaacttcgtcaagctcgtctcctggtacgacaacgagtggggttactcccgccgtgtcgtcgacctcattgcctacatctccaaggttgatgcccagtaggaatcaggacggcaaactgaattcagaagtgtgctgtgagtgagactgattgccgagcgcagacgactctcgtggaacccggcttgtggagaagcttgagaaggtcttaactcctagcgtaaaagctcatgatgacgtacaatttaatgaaatgatacaatgttcatatttcccgttcaaaaaaaaaaa

SEQ ID NO: 3899 - DNA, 476 bp, Aspergillus niger
gtccgcctgaccatccagaaccgtcaggccgcggtctccgttgtgccctccgcctcttccctggtcatcaaggccctcaaggagcctccccgtgaccgcaagaaggagaagaacatcaagcacagcaagtccatccctctggacgagatcatcgagatcgcccgcaagatgcgccaccgctctcttgctaaggagctcaagggtaccgtccttgagatcctcggtaccgctttctccgtcggttgccaggtcgatggccgcagccccaaggacgtctccgacgacgtcaaggctggcgagatcgacatcccctccgagtaaatgattcaaattcgcggcggtcgtggttttttaccggcatgctagttacggaatatgatcatcttattcgaaacaaaattgtcttatgagacatgactttagattccccatttctgttctttcgaattcgataagtgttttcactcgaaaaaaaa

SEQ ID NO: 3900 - DNA, 500 bp, Aspergillus niger
gccggagcgcacttctctcaacaaccacattaaacctttagaagtttaatcttcagcgtaacgatggcccccaagagcaagaagaccggtgacaccatcaactcgcgcctggcgcttgtgatgaagtccggaaaggtcaccctcggctacaagtccaccatcaagaccctccgctccggcaaggccaagctggtcatcatcgccgccaacactcctcctcttcgcaagagtgagcttgagtactacgccatgctcgccaaggcccccgtccaccacttctccggcaacaacatcgagctcggtaccgcctgcggtaagctcttccgcacctccamcatggctatcctcgatgctggtgactccgacatcctgtccagccagtaggtgtaaagcctagtcaatggattcatgttatgtctgaacggcggtatgccatgatgcacaacgtcacggcacgatttagataatgacaatgaactttacatctataaaaaaaaaaa

SEQ ID NO: 3901 - DNA, 594 bp, Aspergillus niger
gtggtccgtcgacagccgacacttctgtccctcattcaaaatgtccgcccccgtcaagaccggcaagaagactcgctcggccatcgccgacgttgtcactcgcgagtacaccatcaacatgcacaagagaatgcacggtgtttccttcaagaagcgtgctcctcgtgctatcaaggagatccgcgctttcgccacccgtgctatgggcaccaccgacgtccgtgtcgacccccagctcaacaagaaggtctgggaagccggtgtcaagggcgtcccctaccgtctccgtgtccgcatctcccgcaagcgtaacgacgaggagggcgccaaggagaagctctactcctacgtccaggctgtcaacgtcaaggatgtcaagggtcttacaccgccgttgtcgatgaggagtaaattactcttctccttgatcgatgaaaaaaacaacatatgtatcttattccccaaaaatgaagccagattctttgcaagcttgacgggtttcttttttcatgatggwtgatgcaacgggacggggttcggctttttggaagagatataaaaaattcaaatcmcaatttttggtaaaaaaaaaaa

SEQ ID NO: 3902 - DNA, 436 bp, Aspergillus niger
ggaacaccgaaaatgccgacccccgaatccgcctccttcctggccaagaagcccaccgtgccgccgacctacgacggcgtcgacttcgaagacaacgtcgctgtccacaacgcccgcgacgccattatccgtgaacaatgggtccgcagtatgatgtctcgactggtcggggaggaattgggaaagtgttatgcgcgtgagggcgttaatcatttggagaagtgtggggttttgagggagaagtacttcgagttgctgggcgagcgcaagatcaagggttacttgttccaggagaagaactactttgctggggagggaaacaagtctgcttagattttgctcggtggattgaattgaaattgggtttgcagggtttctgtgttatgttatgtgatatacaatatatgcattgtggtttcttttcctaaaaaaaaaa

SEQ ID NO: 3903 - DNA, 510 bp, Aspergillus niger
ccatcttcgactcaacagccgcacagagacaagatgacgaagcgcaccaagaaggtcggtatcacgggtaaatatggtaccagatacggtgcctccctgcgtaagcaggtgaagaagatggaagtgtcccagcacgcccgttacatctgcaccttctgcggaaagaacaccgtcaagcgcaaggctgttggtatctgggagtgcaagggctgcaacaagactgttgccggtggtgcctacactgtctctacccccgccgctgccgccactcgctccactatccgtcgtctcagagaaatcgcggaggtttagatgtgataatgggataaccttttctattacgtttaaattcaaaaatgagaaaatgagatctggagaatttcaataagcgaatgtctcttaccacgaagcccgctagtacgatgttggtagcgccaactgttgtcgtttgaacacaagattcttcaccaatagatttaattaccatcggtgattccagacaaaaaaaaa

SEQ ID NO: 3904 - DNA, 592 bp, Aspergillus niger
gcccaccatgtcgtccaaggtcaaggctggtcagctctggggaaagagcaaggatgacctcaccaagcagctggaggaattgaagaccgagctgagccagctccgtgtccagaagatcgctggcggtgcctcctcgaagacccacagaatccacgacgttcgcaagtcgatcgctcgcgttctgaccgtcatcaacgccaaccagcgcgctcagctccgcttgttctacaagagcaagaagtacactcctcttgacctccgccccaagctcacccgtgctctccgccgccgtctcaccaagcacgaggctaccctgaagaccgagcgcaagcgcaagcaggagatccacttcccccagcggaagtacgctgttaaggcttaaatgcttaagacggggtcgtctctggatctggatggagttaacgggaacgtcgtttaatgatgacgggttgacctaaccttgccgtgaggggggtcggattcatcaaaacggtttcttttgaaaaaagaaatcgattatgtatcttagaaaaaagaagatgcagatcgatgtttttaaatgaaggccttgcttgacatgacaaaaaaaaaa

SEQ ID NO: 3905 - DNA, 548 bp, Aspergillus niger
  misc_feature (1)...(548): n = A,T,C or G
atttttcaagtttgcgggtacccctgttggcgtgaaggagcaaataaacatggtgcagaagattgtttcttctactgcgggccggtccttcgagtttgcccgaggtgagagcgaaatgcaagaactctggagcgcccggaaacaagcactatggagcgttatgtccatgaggcgaggtcctgaggaccatgtctggacgactgatgtggctgtccctataagcaaattacccgaaatcatcgaggccaccaaacaagacatgactgaaagtggtttgttggcgggaatgtgcggtcatgtcggcgacggcaattttcatgcgatcatcctcttcaataaagacgagaaagcaacaccgaggccgtggtccatcggatggtaaagccggctgttgactagaaggtncagtnctggccaacacggagttggcctcttnaaccggattacctgcacatgactagggaagtcgacagtggttctttgcgccggttnaaatacttntgacccctttgntgnttaatgcgataaattttgcggttgaccaccgg

SEQ ID NO: 3906 - DNA, 560 bp, Aspergillus niger
  misc_feature (1)...(560): n = A,T,C or G
cgacgacgccgccgccaatctcttgagaccaccgacctagaggttcaaggacagacaaaatggcgaacaacagactccaataccgccgccggaacccgtacaacacgcggtccaaccaggtccgcatcatcaagacccccggcggtgagctccgttaccttcacatcaagaagaagggcactgctcccaaktgcggtgactgtggcatcaagctccctggtgtccccgccctccgcccccgcgagtacgctcaratctcccgccccaagaagaacgtcagccgcgcctacrgtggttcccgctgcgctggttgcgtcaaggaccgcatcgtccgtgctttcctgattgaggagcagaagatcgtcaakaaggtcctcaaggagtctcasgagaaggctgccggcaagcgctaaatgcatcatcatatcaaataaatggtgttttttgtgattasaggagcgaatatggaaaatttttaaaaatttggntcggtaatggttcntttcttcaattgaacacaaatggcggntaanaaaatgacancgacggggtaatatgta

SEQ ID NO: 3907 - DNA, 552 bp, Aspergillus niger
ccaatacctcgttgaagactcgcgtgagcgaattggagtttatcaatgaactgttccggggccgggtgacggaactggagcagagcggcgcgactgcgcgccgatcggagatgatcgtccgggactcggaggtacggctccggcggtctctggaggaggcccaacggcgcgaagacgatctgaaacggaggatatctgagctggagcgacagcttaccgaccaaacctcctctgccaacccggcgggcaatgacagtcccggtgagccgctggccaagcggatgcggctgtccgacgtcgtggagcaacctgcggagtcgcaacaaaatcccccaagagtgtctaactctcacgggcgggggggctttgttcggacgatggacgcgcatgagtgccgtcggcagcaccgacgtaaacaaatgcgcacatagtttgcggtgctgcgttctctgatcttcccggtctctttgatacctttacgagtcttggcatttggctggctggatatcggataactacctaattatatacaccttctttgagaaaaaaaaa

SEQ ID NO: 3908 - DNA, 444 bp, Aspergillus niger
  misc_feature (1)...(444): n = A,T,C or G
cgcacagagacaagatgacgaagcgcaccaagaaggtcggtatcacgggtaaatatggtaccagatacggtgcctccctgcgtaagcaggtgaagaagatggaagtgtcccagcacgcccgttacatctgcaccttctgcggaaagaacaccgtcaagcgcaaggctgttggtatctgggagtgcaagggctgcaacaagactgttgccggtggtgcctacactgtctctacccccgccgctgccgcactcgctccactatccgtcgtctcagagaaatcgcggaggtttagatgtgataatgggataaccttttctattacgtttaaattcaaaaatgagaaaatgagatctggagaatttcaataagaaaaaaaaaaannaaaaaaaannaaaaaaaaaaaattcctgggaacnatcnagcatgcatntaaagggcccaatt

SEQ ID NO: 3909 - DNA, 503 bp, Aspergillus niger
gcgcgatgcaagtcagtgcccggggtgacttggcaaactggatgctgcctggcaagatcaagggcttcggtggtgctatggacctcgtatcgaacccctccgccaccaaggtggtggtgaccatggagcacacggataagaagggcggccctaagatcgtgaagcagtgcgaattccccttgaccggaaagacttgcgtcagccggatcatcactgagctctgcgtgttcgacgtcgacttcacagatggactgacactggttgagctggccgatggagtcaccgtggatgaggtgcggagcaagacggaggcacccttcaaggtggctgatgatgtcaagccgatgctgtagatcagattgacatgataatcactgcagttctgtataacccggcgttgtcatttcgacaactgacctgattttccaaacaccatatatgccacgccataaccgataataatgccattgaacagataccaatttcttaacccaaaaaaaaaa

SEQ ID NO: 3910 - DNA, 470 bp, Aspergillus niger
  misc_feature (1)...(470): n = A,T,C or G
tgagaagttgggaaccgcgagcaccttcgctctgggaggcattgcaggccttatcactgtctatgttacacagcctcttgatactgtcaagacaaggatgcaatcgctggaggccagcaagaactataagaacagttttgtctgcgctgcacgtattttcaaggacgagggcatcttcacattctggtctggtgctgtcccacggctagcgagattgatcatgagcggaggcatagtgtttacgatgtacgagaaaaccatggatgctttggatggtctcgatccggaaaggcgatacatttgatgggatacactttggccagtangtgcgacacatggtgagaagaaccattactatttggattacccaatgcatgtgaattttataagtgtgccatgtgccatatgatatgactgtatttacatcatgcctataagcgaataactgtctttgcggcgaaaaaaaaaaa

SEQ ID NO: 3911 - DNA, 629 bp, Aspergillus niger
  misc_feature (1)...(629): n = A,T,C or G
cacgacacccgtccgagttctcccacgacctttaggtggcatattcacaatggctgtcaggaactccagtctcgcctcttctcgccgcaagtcgcgcgccgcccacttcaacgccccctccagcgagcgccgcgttatcctctctgctcctctctcgagcgagctccgcgccaagtacaatgtccgctccatgcccatccgcaaggacgacgaggtcatggtcgtccgtggcagcaacaagggccgtgagggcaaggtcaccagcgtctaccgcctgaagtgggccatccacgtcgagcgcatcagccgcgacaagagcaacggccagagcgtccccatcccctncacccctccaacgtcgtcatcaagaagctccacctcgacaaggaccgtgaggccatccttgagcgtgttgcaagggtcgtgaggccgtcaaggccaagtccgcttaaatcgggggatttttgtgaggtttaagttcatatctggcaaatggcaagtgataacgcgggaagttccggaagacgcgaacaatatgggatcttgctacagtcgggatatatctataaaacatgatgtattctgatgaatgaaaaacgaaaaaattcaattttcttttacctaaaaaa

SEQ ID NO: 3912 - DNA, 616 bp, Aspergillus niger
  misc_feature (1)...(616): n = A,T,C or G
ggccatcatcaccttaccgaaccccgatagttcaggtcttgattggcagtccagcctcccttgcgcatctcaaatcccaccggtcaccccaccgtctcaactacaattcaagatgtctttccagaagcctgagaaggatttcggcgagggccctaaggtccacaagatccgtatcaccctcacctctcgcaaggtcgcctcccttgagaaggtgtgctcggagctgatcgaccgtgctcgctccaagtccctccaggtcaagggtcccgtccgtcttcccaccaagacccttcacatctcgacccgtaagacccccaacggtgagggttccaagacctgggacaagtacgagatgcgcatccacaagcgtctcatcgacctcctcgccccaccgagactgtcaagcagatcatcatcaacatcgaggctggtgttgaggttgaggtcaccattgctgcttaaatgtacccctaccttctctgatggtttgggttcgtgacaggggtggcgcggacgatgaggatatgttttgtggtgcttnttgcggatgcanggtgcgtgctangcatttcgtcgatacccggcagtttctggcttggaaatgaaaaagttcaat

SEQ ID NO: 3913 - DNA, 885 bp, Aspergillus niger
  misc_feature (1)...(885): n = A,T,C or G
aacaaaacaacttgatacctttccacaccataccaccacacctatctctatattatattataatcaaaactttctaataccatcaaaatgaagttcactctcgcctctactcttcttcccctcctggccgccgctgcccccgcccagcagcgcgataccaccaatgccaccactccctctaccttcggcatcatgtccgcccgctccggctctcccatccaccttctccccttgaacgccaacagcggcggtttctacctgggtggaaacacctcttcttactgcccgatctcttccggctgccctgctggtactgagaccgtttttgctggtgatggctctgctttggacgtcgaagtccccggcggccagcaagtctacgtcgcccccagcggcgccctgaccttcaccgtcccccactcggcctacatccccgctggctcgtccaccggccccttcaagtacacccccgggcaaagcccttcggcagctggactttcaccggtgccggtgctacgggcttcatggcttgccctgatcagggtaacaagtggcaggtgtttgctgstactaagaatgctaccgtgcccagtggcaatgtcgctgattgcttgggctttgatgccctcgctgtggctaccaatggttctgtcgctgcttgggagtatatctaaactacttagtactacttccttttcggggcggggttagttttggtggagatggttggttggttgaggaaaagatactagagtagttatagatgaagtgggttggtagtatagtggttgtgttcatttggttttattaatgagtgttttgtatatgtatgttaatgtgatcaatgattgttgatatttttgaaaaaaaaaaaaaaaaaaaaan

SEQ ID NO: 3914 - DNA, 992 bp, Aspergillus niger
cctcaagcaggccatctccatcagcgctacattcaactcccttcgctgatcgactttttgtctcgtcaagatggttctcgcggtcgacctcctcaaccccgcgcctcaggctgaggcccgcaagcacaagctcaagacccttgtgcctgctccccgctccttcttcatggacgtcaagtgccccggctgcttcaccatcaccaccgtcttctcccacgcccagaccgtcgtcgtctgcgctggttgctcgaccgttctgtgccagcccaccggtggtaaggcccgtctcactgagggctgctctttccgccgcaagtaaacgtctcgacccaaccgtgccggagcgattatgaaagcaatgtggcgttcttcaatgatgatggattaatatatctcgtttttctgaggaaacagattcagatagaagatggaatcctcgccccttgcgagaaagccctgcggaaccacacagacaagggaaatgaaaaaaatttttgaccaggcacagaacctcgtttttgatacaccttttcaaaaaaagcgtttactactttttatcytcctacatctctgcgcaggggagttccggatatctggcacatgatcggtccatactaccaaaaactactcttgccttatatcttgctcttgagtttttcgcttgatgattttttactattcgccaacttgtgttccttgtacctacgacggatgtacctcgaacaggggcacgatggggaagaatcatacaacgccaccagtcacgtctgcacatgcgcttctgccggttgccgcaggaattcggatattgcggaaggaggaaaaacagatttcatcgtggaagatgaatgatggcggctccggtattgtgcgcagcggcgtgactggctgcaggagccggttactaagtctgagaggacggtgccggccctgcagagttgtgataccctcgtgcggtaacaatcgtatgttttatttggtcaaaaaaaaaa

SEQ ID NO: 3915 - DNA, 540 bp, Aspergillus niger
  misc_feature (1)...(540): n = A,T,C or G
cccacttccagtggatcatccccgaccccgcccacggcaaggagatcgatgagcccgagaagattgagcgtgtcatcctgtgctctggccaggtttacgctgctcttaccaagcaccgtgaagcccacggcatccgcaacaccgccatcacccgtgttgagcagctgcaccccttcccttgggctcagctgaaggagaacctggacagctaccccaacgcccgcaacatcgtctgggcccaggaggagcctctgaacgccggtgcctggagctacacccagccccgtatcgagactctgctgaacgagaccgagcaccacaaccgncgtcacgttctctacgccggtcgcgcttccagcgctttccgtcggcacttggtctcaagtctgtccatctcaaggaggagcaggaagttcttcangatgctttnactgtcancaagancgcctnaaggcgagtaatgatgtcgtggaanatnggtttggttngggagtancgttgnttngtctggcttcttgatgatttnctttgttaacacat

SEQ ID NO: 3916 - DNA, 557 bp, Aspergillus niger
  misc_feature (1)...(557): n = A,T,C or G
ctcaagcaggccatctccatcagcgctacattcaactcccttcgctgatcgactttttgtctcgtcaagatggttctcgcggtcgacctcctcaaccccgcgcctcaggctgaggcccgcaagcacaagctcaagacccttgtgcctgctccccgctccttcttcatggacgtcaagtgccccggctgcttcaccatcaccaccgtcttctcccacgcccagaccgtcgtcgtctgcgctggttgctcgaccgttctgtgccagcccaccggtggtaaggcccgtctcactgagggctgctctttccgccgcaagtaaacgtctcgaccaaccgtgccggagcgattatgaaaagcaatgtggcgttcttcaatgatgatggattaatatatctcgttttctgaggaaacagattcagatngaagatggaatcctngcccttgcaaaaagcctgcggacacacagacanggaaatgaaaaaatttttgacagcacagaactcgttttggatcacctttcaaaaaagcgttactacttttatcttctaaaaaaaaaaa

SEQ ID NO: 3917 - DNA, 621 bp, Aspergillus niger
  misc_feature (1)...(621): n = A,T,C or G
ccacccccaacacaaaaacaccaagaacgaaatgtccgacctcgaccgcacacccccctcgacagccgcctacgtggtcgcgacggccatcctagccggcataacgggctacttcatcggccaaggcagcaccctaggtctcttcagcaacaaagaaaaagaaggctggccgaacagctacaatgtgaaaccgcacctagactcgtcggacgaagactacgaatccgaagaggaagaagaggacagtgaagaagaaggcgacggcactgagctcgccaacttcgatagctccaatgaagaagtgaaattggttcttgtcgtgcggacggatctgggtatgacgaagggtaaaatcgccgcccaatgctcccacgctacactcgcatgctacaaatacctcacggcgtacacgcctaacagcggcatcctgcgacgatgggaatcgcaaggtcaggcgaagatngcgctgcangtcaagtcggaggaggagatggaggagatgcaagccaaggcgattagtttgggactttgcgccaaggtgattacggatgctggacggacgcaaattgctagtgggaatcgcacngtgttgggggttttggganccaagagtgtggtggt

SEQ ID NO: 3918 - DNA, 416 bp, Aspergillus niger
  misc_feature (1)...(416): n = A,T,C or G
tctcccttcacctatggtatgaccatccagcaggtctacgaccagggtcagtgcttcagctctgctgtcctggacattgaggagtctcagctcctcgaggccttctccagcgccattaacaccatcaccaccatctccctggctgtcagctaccccactatccccgctgtcatgcactccctcgtcaacagctacaagaaggttcttgccgttgctgttgagaccgagtacagctggcccgagattgaggagctcaaggaccgtattgccaaccctgacgcttacgcctccgctgctcctgccgctgccgctgccctgctgccggtggtgctcccgccgctgaggctcccaaggaggaagaggangagtccgatgaggacatgggctttcgggcctcttcgaactaaacgtctcgg

SEQ ID NO: 3919 - DNA, 617 bp, Aspergillus niger
ctcctcctccattcttcccccccactccacctctttcctccttattcaggccttttcttagcctctcttttcagcttcacctccctgccatcatgttccgctccgccgtcgtccgctccctcagggcctctgtccctcgtgccgtcaagactccggctcccttccagatccgtagctctcctgtcgctcgcccggctcaattcgcccctcgctttgcctaccagggtgtcagactctactccgctcccgccggtctcaacaaggacgaggttgagggtcggatagtcaaccttctgaagaactttgacaaggtctccgatgctagcaagatcaacggtgcctctcacttcgcaaatgacctcggcctggacagcttggataccgttgaggtcgtcatggccatcgaggaggagttcagcattgagatccccgacaaggaggccgactccatccacagcgttgacaaggctgttgagtacatccttggcagcccgatgctcactaaatatgaacgtaatgcgaagactcggagtggattggggggacttagaatagaaaggaaagggaatgctggcgtgcatctacatgggacttgccaccgtggaggtaacaaggat

SEQ ID NO: 3920 - DNA, 632 bp, Aspergillus niger
  misc_feature (1)...(632): n = A,T,C or G
gtctggtacaagcgcgaatttgaatggccagacgtcttacgtctctgggaaacattatggaccgattacctttccagcagcttccaccttttcatcgcacttgcaatcctcgaaaagcaccgggatgtcataatggatcacctgaagcagtttgacgaagttttgaagtacatcaacgaactctccaatacaatggaactcgttccgatcctcacacgcgccgaatcactattccaccgcttcgaacgagccgtccaggccatcgacaagaaaaacaacttccctgcacctgccgcccatcaacggaagcccacacaagactcctccgctagcacaaacaataaaggcaaatcaccccaacgaccccaaaatactgccttcagcagtggcgtcagtgccggtcccagttcagcacctgacagtgaaggagaaacaaaggtggtctccccggaactgagggaactttttcacaaggacattccatggggcacgtaaatcgcctccgaaacagcagcaagcagaagcagcaaggaagagcctgcgaaaaggagaatcgtcatcgtagagagccctaacctacacctactttgttcctctccttcttgattcncaatggngcctaatgcaaatca

SEQ ID NO: 3921 - DNA, 453 bp, Aspergillus niger
gccagcgtcaagatcatctacaaccagttcatcaacgcccagtcctatgaggccggcaccgttgaggcttactctgaggaggctatcacccagtctcccaacctctctactttcgagactgatgaccagactctggcccacctccgtgaatacgcccttgccaacaacctcttctgggctatggctgagggtcacgcttgcgaaatctccgctcgtcgtaacgccatggagaacgcctccaagaacgctggtgagatgatcaacaagttccagatcttgtacaaccgtcagcgtcaagccgccattaccggtgaactggttgagattatcactggtgccaccgccagtgcggacatgtaaaagcttccatgaagcttgtgtggggaggagtcgccatgtgtgtagacttactcataaatacctagatgcttgtcagcctgtaaaaaaaaaaaa

SEQ ID NO: 3922 - DNA, 474 bp, Aspergillus niger
ttcacggtgaccttgttcgaggctaagccggagactactaccgccgacggcgagttggaccacatcaaggaggtcaagtacattgagcggcaggcagctcgtcgcaccaagatggaaaacgtggcaggatatcgtcgggtggatcggatcgtgcatgacttggacggatatgacctcgtgttccgctactacgaacgtcttgactggaaagggggggcccctcggctcggagaagagcgcgtttgagagagcgaacacggtgtctgtccatgcatgagaggtgagaaggaagtgggagaatgatatcgtttcttgactgtttccaatttcgggttttgtcagctgttactttcctatcatcgagcgattgagctttgtcctttttgagcaatgttagtatccaccttcgcttacggatttgtggcattgtggttatttcgaacaaatattatccgtctacggacaaaaaaaaaa

SEQ ID NO: 3923 - DNA, 370 bp, Aspergillus niger
cgcaggtgtccttagtatgagcactatcgagacggatctcattcatgcgggtgaagggtatgccgagtatgatactcacaatctctatggaacaatgatgagctctgcttcccgcacggctatgcaggcccgccgtcccgatgtgaggcctttggtcatcactcgcagtacgtttgcaggcgctggagcacacgtaggacactggctgggcgacaactttagcgattgggttcactaccggatctccatcgcgcagatcctctccttcgcgtccatgttccagatcatgtgtgaattatcttgcgatatttgttatggatcaaatattagtacattacatgcagaaaagtgactctttcaaaaaaaaaaa

SEQ ID NO: 3924 - DNA, 449 bp, Aspergillus niger
  misc_feature (1)...(449): n = A,T,C or G
ngataaggctgcgcaagttgcgaagaccgagttccacccccgtaatctgccccattctcaggctttgagacacaagcatgagcatttggatgcgattactcgcttgactcatcagttcggtggaaaggtgctggatatcagtaccaacaactgcattgttgaggtctccgccaaaccctcccgtatcgactccttcatgaagctcatcggccccttcggtgtcctcgagtccacccgtaccggtctgatggctctgccccggtctcctctcttcgagcctancgaggagatcgagaaggacccgctgacgttgttgacgccaacacccttccccccggttaaatgtaatccgtctgtgcgcttttacttatctaatccaattatctatatccctcaatgttaaaaagcacaaacacaaatgtatttcatccaataatttccctttgcaa

SEQ ID NO: 3925 - DNA, 507 bp, Aspergillus niger
  misc_feature (1)...(507): n = A,T,C or G
ggaagaccactggaacgtcgctctgggaggtttcttctccggcgccatcctgggtctccgagctcgcacattccccgccctcctgggctacggcgtcgctttggccaccgccacgggcgctttcgaatacaccggtggaacgttgttcggctacaagaagaacaccgatatcgacgagtttgagcgtcgggagcagcttcggaagacatacagaattcccgcagagcagacccttgccgaattgggcgagggacgaggtatttatggccccggatacgccgagagacgggcggagagaatcaaggaggcatacggtatcgaggttcccacaacggctccggcatcatgaacatggttttgttagatatctctcctgcgcagtccctcaattctcagtctcgttgtgtaaaactactacatctttcttattttcagtcgatgccgttcagctagccgacatggcacctncaccaatgaagatttcatttcctgttctaaaaaaaaaaa

SEQ ID NO: 3926 - DNA, 631 bp, Aspergillus niger
  misc_feature (1)...(631): n = A,T,C or G
ccggcccgtaatataccttactgttgattatactattcaattgcagccagaatgtctgctgttagcctgacaaatcaaacccgtcttcgtctctcacgaggcgccacttgttttaaaccatccactctggcctcccgacgcctcttctcttcctcctcctccgctagattctctctccagtcttccactagaaccgcagtagcgccctctttcctccgtccaactccgttcatccacagccgtcgcgctttctctcacacatcctccaccatgtctcacaaggttcacgacatcacctctaaggccgagttcgccgagaaggttaccaactccaccgacgccatcgtccttgactgcttcgctacctggtgcggtccttgcaaggctatctcccccaaggtcgaggagttcaagcaacacctaccccaacgccaagttctacaagatcgacgtcgacgaactgtccgangttgctgccgagctcggtatccgtgccatgcccactttcctgctcttcaaggacggcaagaagttcgacgacctcaacggtggcaancccaanggtctgggagcagaagatcaaggctctgcttgcataaatccccgttgatanatgatataaggggatact

SEQ ID NO: 3927 - DNA, 616 bp, Aspergillus niger
  misc_feature (1)...(616): n = A,T,C or G
ccgagcaaagccgaacgcgaagaagcccacaacatcaaggctcagccagagtccctgcgaacccgctccggagccaacatcgagttcaacaacgtcgcattccgctacgcctcccaagatacgcctctgttcacaaatctcaacgtcaaaatcgagagtggccaattcgtcgccttcgtcggaccatctggctgcgggaaaacgaccgtgatatctctcctcgagagattctaccacccctaccaaggaacagtcctcatcaacggcaacgacatccactcgatcgacccctcatactaccgtcgctcaatatccctcgtagcacaagagccacgactcttcgaaggcaccattcgcgataacatncccttggactcgacgagtccgagttcacggaagacgatctgatccaagcgtgcaaggacgcagagatccacgatttcatcaacttcttccggaaggtacttcactgatcttgggaatcaaggccagacctcatgagtnggaggcaacgacacgcatgtcattgaagancgtctacnaagcatccttntttgnttgtgaacgcattgagtcttgntccatttggaagnctncagcgggatggaccttggnt

SEQ ID NO: 3928 - DNA, 447 bp, Aspergillus niger
ctacagcagtgtgactgtcacctcgtggccgagtatcgtggctactggcggcaccactacgacggctacccccactggatccggcagcgtgacctcgaccagcaagaccaccgcgactgctagcaagaccagcaccatacacttccagcgacccgctctggtatgtcactgtgactctgccggctggtgagtcgtttgagtacaagtttatccgcattgagagcgatgactccgtggagtgggagagtgatcccaaccgagaatacaccgttcctcaggcgtgcggaacgtcgaccgcgacggtgactgacacctggcggtagacaatcaatccatttcgctatagttaaaggatggggatgagggcaattggttatatgatcatgtatgtagtgggtgtgcataatagtagtgaaatggaagccaagtcatgtgaaaaaaaaataa

SEQ ID NO: 3929 - DNA, 633 bp, Aspergillus niger
  misc_feature (1)...(633): n = A,T,C or G
ggcatgcactaacgatacgctactgactgctatgattgatgaacaatgagatctgcgaaggctgtagtgactgaaaacgcagccgccgccatgcgtgtccaggctcatggcgctccggcgcgaaccatcacaagtttaaggcgatggtccatagccaacagagagctgccagcggtatcccatatacggtctattcatgtctacgactttgataatacattattcttgagtcctctgccaaacccacagctatggaacggtccgaccatcgggtttctgcaggcctatgagagcttcgcgaatggaggctggtggcacgatccgaacttgctggccgcgaccggcgatggcatcgataaagaagagccacgggcctgggagggatggtggaacgaacagattgttcaattggtcaagctgagtatggagcagaaagatgccttgacggtgcttctgacangccgcggcgagaccaatttctccgatcttgtccggcgtatggtggacagtaagaagctggagtttgatctcatctgtctcaagcctgaagttggcccgangagccagcgattctccactactatggagttcaagcaaacttttccaagaagaccttgntctcacttacgaaca

SEQ ID NO: 3930 - DNA, 579 bp, Aspergillus niger
  misc_feature (1)...(579): n = A,T,C or G
ccgagttctcccacgacctttaggtggcatattcacaatggctgtcaggaactccagtctcgcctcttctcgccgcaagtcgcgcgccgcccacttcaacgccccctccagcgagcgccgcgttatcctctctgctcctctctcgagcgagctccgcgccaagtacaatgtccgctccatgcccatccgcaaggacgacgaggtcatggtcgtccgtggcagcaacaagggccgtgagggcaaggtcaccagcgtctaccgcctgaagtgggccatccacgtcgagcgcatcagccgcgacaagagcaacggcagagcgtcccatcccctcacccctncaacgtcgtcatcaagaacttcactcgacaaggaccgtgangccatccttgagcgtgttggcaaggtcgtgaggccgtcaaggccaagtccnttaaatcgggggatttttggangttagttatatctggcaaatggagtgatacgcggagttccggaagacccaacaatntggancttgctacagtcggattttntataaacatgatgnttctgatgatgaaaacgaaaatcaaaaaaaaa

SEQ ID NO: 3931 - DNA, 602 bp, Aspergillus niger
  misc_feature (1)...(602): n = A,T,C or G
caccccgtcaattggacccgaacaaccccgctgggatcaatcaccatgtccgctccctccctcgccagctacatcgtcaagcgccccttcctcaagcgctggatgatgcccattgcccagtggtacaccgatgcctctggctacaggagactcggcttgaaggctgatgacctgatccccgaggagaacgacgtcgtccagaaggccctcaagcgtctccctcccatggaggcctacgaccgtatcttccgcatccgcagagcattccagtgctccatctcccacaccctccttcccgctgctgagcagaccaagcccgaggaggatgtcgagtacctgagccccatcatccgcgagatcgagaaggagaagcaggagcgtgaagacctcgacgcccttgtcgtcagacggtagaatatgtctctggcttcgctgaactagattacttttggtancggatacaaaaatgccgttgggtttatagacgggcnggatactaatatcagagagactttntggcccggtcggtcggcggcatcttccaanaaaaaaggaggaaaaaanacatttggctggtgtnaatgaactttgattatggggct

SEQ ID NO: 3932 - DNA, 639 bp, Aspergillus niger
  misc_feature (1)...(639): n = A,T,C or G
gctcaacccccagcgaactcgacgtgtcagtctccgcccaactttgcggttaaatcgattgattctcgtgttcaccaccacaactattcaaaatgaagtacctcgccgcctaccttctgttggcccttgctggcaacaacaccccctccgctgaggacatcaagtccgtcctctccgccgtcggcattgacgctgaggaggagcgcctccagaagctccttgctgagcttgagggcaaggacctccaggagctcatctccgagggtacccagaagctcgcttccgttccctccggtggtgccggtgctgctgccgctgcccccgctgccggtggcgccgctgctgctgaggctcccgctgaggagaagaaggaggaggctgctgangagtccgatgaggacatgggcttcggtctcttcgactaagcgccttcactccgaacaccgagaaaaaacgtaacaattcgtggggggaacaaaaatctggcggttattttcagtctaagggaggaaaattaccattggtccaagtcaagccggtgttttgccaaggcttttctgatcaagttacgaattatgcataagtgagctgggaaaagagcnttaagccaatacanaatnctcctgacctncccgaaaa

SEQ ID NO: 3933 - DNA, 549 bp, Aspergillus niger
atattttccgacgctctcgttctaataggcgcctgttttgagagataatattgcaaagatgtccgctcagaactccgcaggcattcagaccctcctcgatgccgagagggaggctcagaagatcgtccaacaagccagagaataccgcacgaagcgcataagggaggcaaagtccgaggcgcagaaggagattgaggagtacagaaagcaaaaggaggaggagttcaagaagttcgaggctgagcactcgagtggatacaagaaggccgaggaggatgcgaacaaggaggctgaggtgaagctccaggaaatcaaggatgctggtaacgagagaggcggaaaggttattgagactcttatccatgcgctggtcgatgtgaagcccgagccgtccgagaagatcgtgatcaaggcatagaggaatgatgccgaatgtcattgtggcagcatgaggggttcttgtttgtcatttgctttcagcctgtgaatatagttctggccactgtttgagcattacataaattcatgttgtgtcctgtctgaaaaaaa

SEQ ID NO: 3934 - DNA, 723 bp, Aspergillus niger
caatctcctgctcagctttgactgacatttcgcgatcctccccctccacaccaccccgtcaattggacccgaacaaccccgctgggatcaatcaccatgtccgctccctccctcgccagctacatcgtcaagcgccccttcctcaagcgctggatgatgcccattgcccagtggtacaccgatgcctctggctacaggagactcggcttgaaggctgatgacctgatccccgaggagaacgacgtcgtccagaaggccctcaagcgtctccctcccaaggaggcctacgaccgtatcttccgcatccgcagagcattccagtgctccatctcccacaccctccttcccgctgctgagcagaccaagcccgaggaggatgtcgagtacctgagccccatcatccgcgagatcgagaaggagaagcaggagcgtgaagacctcgacgcccttgtcgtcagacggtagattatgtctctggcttcgctgaactagattacttttgttacggtatacaaaaatgccgctggggttttatagacgggcgggaatactaagtatcagagagaacttgctgtcccggctcggstcggcgggcatgctgcgaagaagagagggaggagagagagagcatttggctggttgttaattgaagcttttgatttatggtgctcaatcacgtgtactgatactgtacaaattcactcgtcatcgttctctagttgg

SEQ ID NO: 3935 - DNA, 619 bp, Aspergillus niger
  misc_feature (1)...(619): n = A,T,C or G
gagctcctgacgcatcttacagaacccttctcgaggagcgaacactgtccgagttcaaggaatgtgtcgtccaggtctggcctggccccaacaagctctccgccacaggtcccaacggtgtctcgaacgaagaactggccaagagcagtcccggccggcccttcgagttccccgacggctataaccaagtctttggagtggatcgctataaggtcgtcgaatccctgttcgacgccaaagctgcaatcccggaccctgaatcggcattccccgcaccgacgccggcacaaactgtgccagagctcatcaagaatgcgctgaacggcgtcgacgtcgacatccgccgcacttgttggctaacgttgtcgtcacgggcgcctccagcttactctatggtttcaccgaccgtttgaaccaggagctcatgcagatgttcccaggtccacgcgttcgtatatcggccccaggaaacaccgcagagcggaagtttggctcttggattggtggaagtatcctcgccagtctgggtaccttccatcagatgtggatctncaagaaggagtttgacgaacatggtccgaatatcgtcgagaagcgcttcaagtaggaaaatgtcttt

SEQ ID NO: 3936 - DNA, 553 bp, Aspergillus niger
  misc_feature (1)...(553): n = A,T,C or G
ctcctatattttccgacgctctcgttctaataggcgcctgttttgagagataatattgcaaagatgtccgctcagaactccgcaggcattcagaccctcctcgatgccgagagggaggctcagaagatcgtccaacaagccagagaataccgcacgaagcgcataagggaggcaaagtccgaggcgcagaaggagattgaggagtacagaaagcaaaaggaggaggagttcaagaagttcgaggctgagcactcgagtggatacaagaaggccgaggaggatgcgaacaaggaggctgaggtgaagctccaggaaatcaaggatgctggtaacgagagaggcggaaaggttattgagactcttatccatgcgctggtcgatgtgaagcccgacccgtccgagaagatcgtgatcaaggcatagangaatgatcccaatgtcattggtggcagcatgaaggggttcttggttgcattttgctttcancctgtaatatagtcttggccactgtttgagcnttcataaatcatgttgggcctngnttgaaaaaaaa

SEQ ID NO: 3937 - DNA, 622 bp, Aspergillus niger
ctccgggagtgcatgtagtggactattaggctatacttgtctaactcccccggagatccctagtcttccactgaagcattcagaagcacattcagataaaatcggtccggtcacttgctcgcactgccttgttccactagacttgtgtcttcacaacataaatacgcggtcgagtttgcagcagtttcgtgcattgctctgctgatctcacaccggctattgggctgtcaatccaagggcttcagatttcctgcagatcaaaagtcagctataattgccggtcgcgtcacccagaaactttgaagcatgggtaagcggaagaagtccagcaggcaaccacagcaacccagaaagagagaaccgttgcctacgacatttgcctgccttttctgcaatcacgagaactccatcgtcgtaaaactagacaagaaacttggcctaggaaatttgtcctgcaaagtctgtggccagcgatttcagacgggcataaactatctctccgctgctgttgatgtatactcggattgggtggatgcctgtgacgcggttgccaaggatactgctaccaagtacgaagatagtgatcctcgtgtccgacgttcgaatgaatttgcttacctct

SEQ ID NO: 3938 - DNA, 524 bp, Aspergillus niger
cccagcctcccatccgcgtcggagaccctgttcaaggccaaagccgccaagaaactgagcttcgagcaaattgcccagcacattggccgcaatgaagtggctaccgccgccatcttctatggccaggccaaggcttcccccgaagacattgagaaactctcaggactcctgaccattccatatgatgctctggaagaaaggcttagtggcttccccgaccgtggtcgcagcgttgagatgcctcccaaggagccgttgatttaccggttgtacgagattgtgcagaactatggatacgcgtacaaggcggtgctgaatgagaagttcggagatggtatcatgagcgctatctctttctctaccaaggttgagaaggagacggatgcggatggaaataactgggctgtgattaccctgcgtggcaagtggctgccgttctcgcggttctagatcgggcttaatgactgcatatataggcttatgtaaatgattgctaatgaatggtttttatgaattaaaaaaaa

SEQ ID NO: 3939 - DNA, 451 bp, Aspergillus niger
caacctcaaccacccccccaaacaaccgtcaaaatggagaacgagaagggagagatcgtcgatctctacgtcccccgcaagtgcagcgccaccaaccgcatcatcaaggccaacgaccacgcctccgtccagatctccatcgccaaggttgacgagaacggccgctacaccggtgagaaccacacctacgctctgtgcggcttcatccgtgcccgtggtgagagcgatgactccctgaaccgccttgcccagcgtgacggctacgtccgcaacgtctggaccgctgcccgccagcgctaagcacttttcctttttgagagagacgtgcggtgttgggatgaatttggaagtgggtggttattgatgatggatgaagatatttaactatatctccacaaaaaagggaatcctttcacacaatgaaatgaaaaaacttttccaaaaaaaaaaa

SEQ ID NO: 3940 - DNA, 554 bp, Aspergillus niger
gacaaactaacttactatcctactccaatctgattctgcataacaaaaatggccgagacatcctcatccatcccgactcccccgcactgcaccgccgatttctgcttgatcccaatcggcacatcatctccctccgtgtccgcccaaatagccgatgttcagcgccttattgagaaatctggcctgaaatacgtcatgcattcagctgggaccacgctcgagggtccttgggatagagttcatcaggttattggtcaagcgcatacgattcttcatcagcagggtattgtgaggattcaaacagatattcgcgttggctcgagaaccgataaggaacagtcctttgaggacaaggtgaacaaggtccgtgagttgttgaaaaacgactaagcagatactacaagggtatgtgcgtggtactcgattgagtggaaacgctccagcagttgcacctttctttatatgctatcgcttatggacatggtataacgatcatatcaagttagatacactgtgcaacatatgataatcattccgaacgccaaaaaaaaaaa

SEQ ID NO: 3941 - DNA, 610 bp, Aspergillus niger
  misc_feature (1)...(610): n = A,T,C or G
gatctgacgcattgttcctgtattgtctagagtaccatctattcaattcttccaatcattgaatttaaccatggcattattcctcaactctcggctactcaaatgcactggcagacaattccagttactagcaggttttagaggctacagcactttctctgacataacccatcatgcacagccagcgagcgattccctccacccagcagcctcggctgaatccagtgcactacaatcgaccgaactgcaaacgaaacaatggagggaacgccttgagagcattaatagtaaggctcgacttcccaggagcgttcaagctgtgtacctacgacccctccggaggaaggccgagtttggccttccagtctgtgatcttcagttgagatcttacagtgtacggaacgtcgaatttttcgccgattttgctgtgcgggccgcttactacctgaaccttcctgtctcggggccggtgcccttgccacgaatcgttgaacgatggaccgtccctagaagtaacttcgtgcacaaaaagagtcaggagaattttgaaagaataacacttcgacgcntggtacaaatcaaaagacggnaaccctcaagttgtacaaac

SEQ ID NO: 3942 - DNA, 353 bp, Aspergillus niger
  misc_feature (1)...(353): n = A,T,C or G
gagcagtgatctccttcttccatgaaggtcaagatcattgctcctcccgagcgcaagtactccgtctggatcggtggttccatcctggcctccctgtccaccttccagcagatgtggatctccaagcaggagtacgacgagagcggtccctcgatcgtccaccgcaagtgcttctaagctcttgcgcgtgatccgtttcgtactctcgtattcccccatgtattaaaaagcccggagacactggtgacttgcgggcctctctgactcgcactangaggaagatcgcctgaaaaaggaacttttattttaactgtggaatagagatggttanttttttttgcaaaaaaaaaaaa

SEQ ID NO: 3943 - DNA, 608 bp, Aspergillus niger
gtcgccttcttcggtcttatcgccgagatggagaagcccaaggacttcaagaagtcgctgttcatgctgcaggcgtttgaaatcagtctctacgtgactgctgcctgcgtcatctactactacgtcggcaaggatgtgcaatcccccgccctcagctcggctggtcctcttctgaagaaggttgcctatggaattgccattcccaccattgtcggtgccggtgtcgtgaatggtcacatcggcttgaagtacatctacttccgcacttgctccaagtcgggtctcatccacagccgcagccgccgctcggtcgccgtctggatcgccttgggcttggcctgctggctggttgcctggattatcgccgaggccatccctgtcttcagcgacctcaactcgcttattagcgctctctttgctagttggttcagttacggcctcagtggcatctactggctccacctcaactacggccagtggtttgccaacccccgcaagatcgccctgaccgtgctcaatgccgcgatcgctgtgttcggtttggtgctgtgcgtcctgggtctcctaagcctcgggaacggcatccacaacgatgcaaacagcaacag

SEQ ID NO: 3944 - DNA, 634 bp, Aspergillus niger
  misc_feature (1)...(634): n = A,T,C or G
acggatgtgagaaggcgtatggtacgctgaaccatctgaacgcccacgtcacgatgcagtctcatggcgccaagcgcacacccgaagaattcaaggagattcgcaaagagtggaaagctcgaaagaaggaggaagaggcccagcgcaaggctgctgaggagcgcgagcgtgctgccgctgctcaagctgcccaggccaaccaggtcgacgcacccaatcctgcggatcccgctcaggctgggcaaccacctgcctacccgggtggtgttcgtcctcaattacctcccattggatatcaacctgccgacggtcaggtaccggggcagtacggagctggagccggaggtatggtgtatcanggcaatgggcagatggcatacccgccaaactaccctcactccccttatggacagaccggtcaagtgtaccaaccacgtaagtagtcagtcctttgttatgtttgccttctcggcaccgggtcatgaacaagtctcgcatgcgacattaaagaaaccaaccccaaaaaagaaagaaaagaagaaacaaaaagggacacacgaacaacatacccgggttgcaaaaactcaagaaaagttganaaggagtcttcngatntaatgctaaaaggtcgtnn

SEQ ID NO: 3945 - DNA, 313 bp, Aspergillus niger
gccaaccaggaccccgttgtcggtcagttccagcccctgctgggtattgacgcctgggagcacgcctactacctccaataccagaaccgcaaggccgagtacttcaaggccatctgggaggtcatcaactggaaggccgtggagaagcgcttctccgcctaaagctttctttatgatatgaactgtatattgacgcggcttgattagcgattgtggatctgcgtattatgtgtactatggatttggaactaatcaggctcaatccgatgccctaatgcaaattccgtattaatggcactcttctcttcttttt

SEQ ID NO: 3946 - DNA, 486 bp, Aspergillus niger
ggagcgaggcgcattgatcatgggattcggttggtggaggatgaggtgcttatggagaggattgcgagggagggcattctgttgacggtttgtccgctgtcgaatgtgcagttgaagtgtgtgaaggaggttggagaggtgccgattcggaagttcttggagaatggtgtcaagttctccattaatagtgatgatccggcgtattttgggggctatattttggataattattgtgcggtgcaggaggcgtttgggttgagtgtcttggagtggaagactattgctgttaacagtgtgagtgagagttggattgaggaggagaggaagatggagttgattaggaggattgaggaccatgttggaaggtttgcgcatttggcttagttagttttactcctacctggtgatatagaagggtatgggtatggtgtaatgagtagatgatagatgcatattgaataaagcgtgattctttgaaaaaaaaaa

SEQ ID NO: 3947 - DNA, 530 bp, Aspergillus niger
catagacgcaaatggactggattgctccaagacgtcatggcggtgtgattgtgtcgcaaatgtcgtatctgcattgtccaccgcttttgtacctgacggcgtcgcagtggtgggctgaacttcatcgatgagaacgacgaggtcctcctcgccggtttcggtcgtaagggcaaggccaagggtgatattcccggtgtccgtttcaaggtcgtcaaggtttccggtgtcggtctgctcgctctctggaaggagaagaaggagaagccccgctcttaaataacccaaaccctggggaatttaataaagatgctattagcggggtggaagggggcccattccatggaagaagcttcggggcaaaggcaaagcaaacacaagtctatggtctggaattgatggttcaggacggatgagaccctgcaaaataaataccatttgcagcgtactacgattgatatatccataaaagatggcgccatgatttatttctttgggagggccctaaaattcaaatccttcaaaaaaaaaaa

SEQ ID NO: 3948 - DNA, 520 bp, Aspergillus niger
gtccaacgctgctgcccagctcaagcagaagtacggtgttgacgctgaggtcatcaaccttcgttccgtcaagcccctcgacgttgagaccatcatccagtcgctcaagaagactggtcgcatcatgtgcgtcgagtccggtttccccatgttcggtgtctcctctgagatcctcgctctctccatggagtacggtttcgactacctgactgctcctgccgtccgtgtcactggcgccgaggtccccaccccctatgccgttggtctcgagaacatgagcttcccccaggaggacaccattgtcagccaggctgccaagctgttgcgcctgtaaaggatgagccgttgtgtatgaaccgacggtgaagaaaatctgaattaataaaatcatgtgtctagtaccctatcattgttacagccatttctcctatttcctcatattacctcgttctcccactttcctgatcttgtacgactatacaacacaatcaacgttattctgcattcttagaaaaaaaaa

SEQ ID NO: 3949 - DNA, 614 bp, Aspergillus niger
  misc_feature (1)...(614): n = A,T,C or G
cgcagctcaaatcggatgcgaacgcgagctctgataagcaaaccgaccccaagcaatgggatcgcaactactcggtagatgttgtcctaagcgatatgtccgctccctggttccaaacagcggggtttgggaaaagaagtctaagtgatccgtataacaggatgatgaacacaagcggtattagtttcaaagaccatgcaggtagtatggatctttgccacgcagctttgcagttcagccaagaagttctccgcactggagggcacttcgtctgcaaattttaccaaggagccgaagataaggccctagaggaacagctcaggaaattatttcggaaagtccaccgcttaaaccggaatcgtcgcgcaatgaatccaagaatcttattcattggtctcggtcgaaatagtacccagagtcagcattaaaccggcttagtcatntctcttctgntgaatcgaattcctatccatctacgtagcaagtgaagctttgnntgaacatgcacttgggatattgcagtgaattgcctaagcnaaaggacaaggaattccgangtgcttggagtccatacatngnaggccaaaaaggctcttgaaaaatgttaacaacct

SEQ ID NO: 3950 - DNA, 587 bp, Aspergillus niger
tgtctatcgacgatgataccatcgttgtaccatcatacatcgcctttgaaccaagttcaaagcctccgccaaagatccagaccagcacaggcagcttcgagtccgcggtggtcccggccggacgccgaatgtcaatgttcaggcaatcctcgagagcattggtagccgactgtaccaaagggagatcagcgaggaggccaatgaccgatgtcgggaattcgctctcatccgtggtgaagtacatctgcggacacgattgcgaggctcctgtggcctgaacagtgccgagggcagtttccaagggttgtgggggcttcagacgcagcgagcctgtgggggcctgcgcaaagggaatattgttgaagctctcgacattgccagattttccaatgacggtggccgatggatgcgcaatagtgacagtaggagctgcatcccgttgaactggagtcgcccagacggcgagggaaagggagagccaaaggagggccttcatgatggccatgatctgtaccgctatgggtcataggctctcggatcgggctgggagtaactctatatacagttccatttttcacaaaaaaaaa

SEQ ID NO: 3951 - DNA, 640 bp, Aspergillus niger
  misc_feature (1)...(640): n = A,T,C or G
ctgaatcttaataatgtcacgacacgcccaagtggaggaggtgtacgactccgacccggaggaagttgctccctccgattcctcgcccgccaactttggcaatgagtccctcctttctggaaccggagtacctatgtctggctcantacccatgaganccgctcccgaacctcagcgcgaaatccccaagcgttaccagtgcctgtatccgatatacttcgacaagtcgcggacccgcgcggagggccgcaaggtcggaggtgagctggcggttgagaacccgctagcgagggacattgtcgatgcggtgcaaatgttggggctgaatgtcgggttcgagcctgagaagctgcacccgaaagactgggccaaccctggacgtgtgcgcgttttgctgaagaacgaggatggcaaattggttaactcgaggatcaagaacaagcaacacctttacatcctcgtgggcgcaatacctcaaggntcaccctaccaccgaaagaatccccctaccgtcntagaattcgaggactccctatgcccgataaaactgcctgctgcgcctgccgctccccgccggatggaantncggaaagattctgccgattacactctccggcctanancggtggtgggagtcaan

SEQ ID NO: 3952 - DNA, 316 bp, Aspergillus niger
  misc_feature (1)...(316): n = A,T,C or G
atcagtgctgcttctcggctgattcccggctgctggtctcgtcgtccaaggacacaacgctgaaggtatggaatgtgcggacgggcaagttgcaagaggatctgccgggccacaaggacgaggtgtttgcagtagattggagtccggatggacagaaggtgggaagtggcgggaaagacaangcggtgcggatatggaggaattagataccacacagcgtattaagttatctaacttcgtactatactagtatactactatagaacgcatgacactgttatgactgacaatatcataataacaacaacataacacc

SEQ ID NO: 3953 - DNA, 584 bp, Aspergillus niger
  misc_feature (1)...(584): n = A,T,C or G
agtgaacgtgccattccactaagatcatggatagtctacacggcttttttcgttacagtcaatcttctcaacaactgggcctttgcatacaagatttcagtcccgttgcacattattctaagatccggggggccagtagcgtctatgattatcggttacttgtttaatgctaagagatattcgcgagggcaaatacttgcggttctattgcttactttgggtgtggtcactgctgctttggcagatgccaaggctaagggccaatctatgaatgttgagagcacttctgcaaccacgacattggttggattcaccatccttgctctagcgatgatactctcggctttccaggggatatatgcggacaggctctacgaaaagtccggncgagaccactggaaagaactctggtctactctacaccctatcactaccgtgntctacctgttatgcacaacttgcgagccagtgccggacgcttttcccacatatccttaacttctgggcctgaagtttgggcatgactggaatggtcctccagccatgcatnatnggccggtcttgaaagcttaagttcttggaga

SEQ ID NO: 3954 - DNA, 466 bp, Aspergillus niger
gagaagtaacgagcagtaccagcgttgctggccttgctggctccgttctcgaccgtggttctgtcaccaagttcgtcccctacctcgttgctggtgtccagcactccctgcaggacattggtgtcaagagccttaaggctctgcacgagggtgtggacaacggaactgtccgcttcgagatgagaagtgccagcgccatggccgagggtaacgtccacggtctccacagctacgacaagaagctctactcttaagtggtaaaagcttaagagccaaagtttcttgtttatttccttatagttttttttttatatcaagagcctttctgttgatacgttttgttacatgatgatatgtggctgttacgaaaacaaaagctcgggcatggggaacaggagttcgacttgcggtgacgcaccgacttggttagggttattcaatgcattacgcctttttcgatgattct

SEQ ID NO: 3955 - DNA, 338 bp, Aspergillus niger
acagtgacataccagagcgggtcgtggtgctggtcttgctagcagtcgcggtggtcttgctggtcgaggtcacgctgccggctggtgagtcgtttgagtacaagtttatccgcattgagagcgatgactccgtggagtgggagagtgatcccaaccgagaatacaccgttcctcaggcgtgcggaacgtcgaccgcgacggtgactgacacctggcggtagacaatcaatccatttcgctatagttaaaggatggggatgagggcaattggttatatgatcatgtatgtagtgggtgtgcataatagtagtgaaatggaagccaagtcatgtgattgt

SEQ ID NO: 3956 - DNA, 337 bp, Aspergillus niger
tggttttatctccgccgcggagctgcgccacgtcatgacctccattggcgagaagctcaccgacgacgaagtcgatgagatgatccgtgaggcggaccaggacggtgatggccgcatcgactacaacgagttcgtccagctcatgatgcaaaaataaacggttcttcatgttctatttgtcttgtgttagcggaaagggtggggagcaatgaaatatactccacaatgtcccatcttctatcccatcccgtcccttgtagtctcatcatttggctatgactcttattcatcttaatggtcgagcgcttcgcattaccaatgttggttctaatgttgc

SEQ ID NO: 3957 - DNA, 522 bp, Aspergillus niger
  misc_feature (1)...(522): n = A,T,C or G
cttcatcccacccccctccaatcaacaccccaagtttcctttttaaggttactataccttcaatctatcacaatgggtgccattcctgaagttgaccccgatgagcccgtcgagaccaagcccttcaagttcgtgactgctggctatgacgctcgtttcccccagcagaaccagaccaagcactgctggcagaactacgtcgactaccacaagtgtgtcaccgccaagggcgaggacttccgcccatgccgtcagttctaccacgccttccgctctctctgcccaaggcctggactgacagatgggacggccagcgcgaggctggtaacttcccgctcgtctcgaccggtagacgcattaactactttgttcacagttaaatttgaaagttcaaagttgttttcgtgtgtcttcttgtcactgtcaacgtgtactctaccctttaagttggatccggcgagaattgnnagctctgactccccagacacaattcggctgggtgggagacgaagtgtatataga

SEQ ID NO: 3958 - DNA, 601 bp, Aspergillus niger
  misc_feature (1)...(601): n = A,T,C or G
atggccttgcgagccttcttctcgttgcgagagtggatggtgacagcggcaccaccggggatggtgggctcatcgccagcctcagactcggcctgaagcacgttcccggcatcactcgtgtcactctccgtcgtcccaagaacatccttttcgtcatcaaccagcccgatgtctaccgttccccctccagcaacacctggatcatcttcggtgaggccaagatcgaggacctgaacgccaccgcccaggctaccgctgcccagcagcttgctgaggctgctgccaacgagcacgctggtcacgaccacgagcacgaccacggcaagggcaaggcccccgaggctgaggccaagaaggaggaggaagaggatgatggcgaggaggtcgatgagtctggtcttgaggctaaggacatcgaactggttatggcccaggctaatgtgtcccgcaagaaggccgtcaaggctcttcgggagaacgacaacgatatcgtcaacttcatcatggctctaacatatgaacaccgncggaatgaacgcatgaatcggtggctgccgtctcttggcctgctgcangatggattttgggtgccangtcagat

SEQ ID NO: 3959 - DNA, 602 bp, Aspergillus niger
  misc_feature (1)...(602): n = A,T,C or G
cttcaaccgtggtttcgacagctccaagggcgagtacgtcgacatgatctccaccggtatcgtcgatcccctcaaggttgtccgcacctctctggttgacgccagcggtgttgcctccctcctcggtaccaccgaggttgccatcgttgaggcccctgaggagaagggccctgctcctgccggtggcatgggtggcatgggcggtatgggcggcatgggcggtggcatgttctaagctagccccgttctcgtgtagccttccccgttccttgtttctaaagaggtttcccttccagcgtgttgttgcatagtacgggcattgtcctgatatgtttttttcttgttcttggttttcgactatctcctttgtctctaatgtgttatacgtctttggtcacctaaccacatcctcttttacccgacctatcctaattccacctcttaaatcctctcctcccttancatctccactccgttatattgggcacaaaaagtctcaaggagtcctgtgtatcataccatgtactttaagtgctccaagggcgtttactctgccgtggtgttttgcaaattcaataattaaattgttcaatgaaaaaaaa

SEQ ID NO: 3960 - DNA, 560 bp, Aspergillus niger
  misc_feature (1)...(560): n = A,T,C or G
gcagctctcctccgtcgaacagctacatcagacagtcaaaatggctcctaccagaaagaagtggtccaagggcaaggtcaaggacaaggcccagcacgccgtcgtcctcgagaagcaggtcgctgagcgtctcaacaaggatgtccagtcctaccgtctgatcactgtcgccactctggtcgaccgtctcaagatcaacggcagcttggcccgccagtgccttgctgaccttgaggagaagggacagatcaagaaggttgttggtcactccaagatgaacgtctacacccgcgccgtcaccgccgagtaaacgtatgacgctatgaatatttttcctcgcgcgtcgcatttttctttgtgcaacgatatgatatcactcgaatgaaaattcggaaagtagggctgggcgatttgatggacatgtcatgttagaatatgactgactggaattcaaccmaaatctgttccaaaaaaaaaaaaaaaaaaaattctgngggccgttcaacctgcttttanagggccaattcgccctttagngagtcgattacaatcactggccg

SEQ ID NO: 3961 - DNA, 626 bp, Aspergillus niger
  misc_feature (1)...(626): n = A,T,C or G
aaattatcaacaccgtcctcccggagtctgtcgaccgaaagccttcgccatgggcggtatcnatgttcaaggttgctcaatgggaactgggttnaagntggccgcgttgtgctgatccgcancggtccttacaccggcaagctcgctgccattgttgagattgtcgaccacaagcgtgtcttggtcgacggtccctccaccgaggagcagaagatcgttccccgccacgtccttcctctctcccacgccaccctcactcacttcgtcatcccccgtttgccccgtgctgccggtactggccccgtgaagaagctttggcagaaggaggagatcgatggcaagtgggccaagtccaacttcgcccagaagaccgagcgcgctgagcgcaggaagaacctgtccgacttcgagcgcttcaaggtcctccgcctccggaagcangctcgctacgaggtccagaaggctcacgctaagctcanggcggctgctcctaagtcatagacggttcatgaggctcggtgcatagagtgacaaggttgccttgggacggggttatttgctgangnttaatttattttcaagcaaaatgggctgtacgcatantgacaagcataaaaatgattcaa

SEQ ID NO: 3962 - DNA, 358 bp, Aspergillus niger
caacgtccgtgccattgagatcgacggtcttgtctggggtgcctccaagtttgttgccgtcggttacggtatcaagaagctccagatcaaccttgtcgttgaggacgagaaggtctcccttgatgagctccaggctcagatcgaggaggacgaggaccacgtccagtccaccgatgttgctgccatgcagaagctgtaagcggaacgtttaatgatgaagataaatggcgtgatgatggattatttgatgctatcccacggaaatatactgtcatgaacttgaataacccaagccgattggggacacccctcggcataacgaatccaaaaaccaaaataaatmcccaaaawamaaaaa

SEQ ID NO: 3963 - DNA, 633 bp, Aspergillus niger
  misc_feature (1)...(633): n = A,T,C or G
cttcaacgcccagcgacgacaaaccgccagccaaacaccgtctcatccccaggtttctctcgcctcagattcaagatgactcacgagtccgtttggtacagccggccccgcaagttcggcaagggttcccgttcttgccgtgtctgctcccaccgcgccggtctgatccgcaagtacgggatgaacatctgccgtcagtgcttccgtgagaagtcctctgacatcggtttccacaagtaccgttaaatcgaatcttcttcctcgatcccatttttccgttattcacgacgatgattcgttaaaacgtgctcgtggcgcttcgattctctcacatatcacccaaattaaaaccgacaatcccccacagtctcatgtcggggtttagcggaggaagaaaacagggggatacggtagcctcttttttcttttaccagtgtgtgtgtgaaatcgaaacgcaaatgaaatccgaaccgggcttgctttcaatggaatgaaataaaatggtgtttttcctttggttccaggtggaataatccttttaaaatgaggaananatggganttgagattatagagacgtgtgtgttaagttgtggctggtgtggancgtcttaaagaaanggggtctttgtcc

SEQ ID NO: 3964 - DNA, 485 bp, Aspergillus niger
  misc_feature (1)...(485): n = A,T,C or G
tctcacgcctcatctctcactccccacatcgcgcttttcgtcgctgattctcctcgcatatcttcacaatgggtggccatctcgatcctaagaatggagtcttcctcggctggtggggtgatctcggatgccctactccccagcgtgtgacctcctactccatgtcccctaaccgccagcgccctcttgctggtgccggtcacgccgccatcttcaacgttttccgcagattcagacaccaggtcctctacgtcgctcctcccttcattgccgcctacgccatcatgaactgggctgttgagaggaacgagtacctcaactccaagcctggccgccttctcgagggtggtgaagagtaaatgtaacgtgccagctcggaggatcttggnagaaagggatgacatanggcaatatgaaagggctggatgtgtgattgcactgtacagtaactagaagcaatcgagtatgttgcaatgaaaaaaaaa

SEQ ID NO: 3965 - DNA, 517 bp, Aspergillus niger
ctccgtcgtcgccaacccgcagtcgtcccaaccgtcgtgatggcgcaagaacgttccggaatcgtggtcggtctgaacaagggccacaaaaccacccccctcaacacccccaagacccggatcagccgtaccaagggccagtcttcccgccgcacggccttcgttcgtgagatcgcccgcgaggttgtcggtcttgccccctatgagcgtcgtatcatcgaactcctgagaaacactcaggacaagcgcgctcgtaagctcgccaagaagagactcggtaccttcggccgtggcaagagaaaggtcgaggacatgcagcgggtcatcgccgaggcccgccgcactggcgctcactaaactttccatttctctctccaaatatctcctgtttccagttttctctctctcctattagccaagaatgagataacgaaaacatcccacacccaacctcaaaaaatgaaatgaaagtgaaagtgagaaacaaaaaccatgtttcaatacaaaaaaaaaaaat

SEQ ID NO: 3966 - DNA, 564 bp, Aspergillus niger
  misc_feature (1)...(564): n = A,T,C or G
aacatctccgcaacggaaaatcctttacaatgtcgacgcctcaattctggtccacgcctctccgctacctccgctgggcttctcacgaacgtcccgctatcttctactcccttattatcggctccatgggccccgttgccctcgtcggattgcccccgctcagacgtgccttgggtgacgttgacccggagactatccccatgtcttatcccatcccctccggtccccgcacattccccaagggttacgatgacgagtaaatcacctcatccgggatatagcgatatggaaaggatagggtggacggacttgcgtgaccgacgactagctctacattgaatgatgagccaagtgtgactccggcgccgatagaatagaagaaagggaggctgtcaatcaacgagcaagtatcggcgggcctcgcttgtccggangtagcttgactggatctgggtatcttctctacgtacatgcgcctcggcttcttctacggcatgttatacccttgngcttttgtaaggaaggggtaaaggtgatgtaagtggggtatganangtgtggggg

SEQ ID NO: 3967 - DNA, 648 bp, Aspergillus niger
  misc_feature (1)...(648): n = A,T,C or G
ccccgtcccccttcaacgcccagcgacgacaaaccgccagccaaacaccgtctcatccccaggtttctctcgcctcagattcaagatgactcacgagtccgtttggtacagccggccccgcaagttcggcaagggttcccgttcttgccgtgtctgctcccaccgcgccggtctgatccgcaagtacgggatgaacatctgccgtcagtgcttccgtgagaagtcctctgacatcggtttccacaagtaccgttaaatcgaatcttcttcctcgatcccatttttccgttattcacgacgatgattcgttaaaacgtgctcgtggcgcttcgattctctcacatatcacccaaattaaaaccgacaatcccccacagtctcatgtcggggtttagcggaggaagaaaacagggggatacggtagcctcttttttcttttaccartgtgtgtgtgaaatcgaaacgcaaatgaaatccgaaccgggcttgctttcaatggratgaaataaaatggtgtttttcttttgtttcaggtggaatattctttttaaaatgaggaagagatgggatttgagattatagagacgtgtgtgttangttgtggctggtgtggaccgtcttaaagaaagggtgtctttggcgaaaaaa

SEQ ID NO: 3968 - DNA, 632 bp, Aspergillus niger
  misc_feature (1)...(632): n = A,T,C or G
ttttcttctcccagtcgtttctcacgtccaccagcttctccttctcgtccgtctctctgccggtgttctagcgcgtagttccgatcttcccaagcggcaaacagttttcagtctcatcgtttccattccttctacaacaatggccgactccggagaggctcccgcggctgtcgagcacctcaacatcaaggttaccgataacaacaacgaagtgttcttcaagatcaagcgcacaacccagttgaagaagttgatggacgcgttctgcgaaaggcaaggaaagcagccttcgacggttcggttcctgtttgatggcacccgcgtgcgccctgaagatacgcccgatactctcgagatggccgatggggacactctcgaagtgcaccaggaacanatcggtggctagatagcataatattcttcgatgaattatgattattatgtccttcaaaatacattaccaagccccgttgtctttctcacttcacttactaccttacntttttttcccgancacccttcgatctgtttcntccgttctatgaaacanacacaangcgcaacacggtgttctacttggntgatgggtccgagccggggcccggatttgggagaacgtcaagatnatgaan

SEQ ID NO: 3969 - DNA, 571 bp, Aspergillus niger
  misc_feature (1)...(571): n = A,T,C or G
cagaatccctccttgttgtatctgaaggtcagattttatcgccaagatgggtaaggttcacggatcgctcgctcgtgccggtaaggtcaagagcgcaacccccaaggttgagaagcaggagaagcccaagagccccaagggccgtgcccgcaagagactcgtctacactcgccgtttcgtcaacgttaccctgaccggtggcaagcgcaagatgaacgccaaccccacccagtaaacggctaaatcttcgatgaacaaccgcaaaacgacgaacgattccccgggtttcaaatggcgtgatgggaaattgaggggctgagcaaaaccatgtgatgcgtatctcatcacaaagtcgcttggaaagaggggggaaggcatcccttcgttttctcttttcaagcgggggcccgtttagtgatgtttttaaagctatttatcgactcaccttttgtgtgtggaaacgggttttcaaatggnatgaccttccagatgattgattcatgttcctcgagtttatcggattaatattggggatgaatancatcgctgttcaatctctcaaaaaaaaaaa

SEQ ID NO: 3970 - DNA, 721 bp, Aspergillus niger
gccagtccatacactcagctcgccgtcgcgacaagtcttcaagatgccgagccacaagagtttccgcaccaagcagaagcttgccaaagctcagagacagaaccgtcctatcccccagtggattcgtctcaggaccggtaacaccatcagatacaacgccaagcgtaggcactggcgcaagtcccgtctcggagtctaaattcgtcctttggaaccacacacaccaaccgactttttcgattccgccccgagaaatgtctctgtccacctgctgctttcccgggggaaaatgtttcgttcagttgctgtgataccgctgccaacatcaacaactcttgtgtgccgctactgctcgcgatgataaaaaaagaacaaaaaatccacttgcatcattatagattatgttgcctcaaatcaaaacccgctttttgagagaagtccgtttgattctctactgttttcctttacatatctctctctttcccgcataaaccgattcggggacaattttgctggcttgctatccactatgcgggtagttcgttaagcatgggaaggggagaagtgtgcataagcggttgaaatatttttcgktttggtttcttctttgatagggggtttaaactggtctgtggtggtgcagtgggtgcttctgcaagatgtgtgtcacgaactgaaaggaacgacaaaaatcgaaaattcatgatgggttaaaaaaaaa

SEQ ID NO: 3971 - DNA, 380 bp, Aspergillus niger
ctcaaagcctgagaatggggcagattacgcgcttgactcatcagttcggtggaaaggtgctggatatcagtaccaacaactgcattgttgaggtctccgccaaaccctcccgtatcgactccttcatgaagctcatcggccccttcggtgtcctcgagtccacccgtaccggtctgatggctctgccccggtctcctctcttcgagcctagcgaggagatcgagaaggacgccgctgacgttgttgacgccagcacccttccccccggttaaatgtaatcgtctgtgcgcttttacttatctatccattatctatatccctcaatgtaaaaagcacaaccacaatgtatttcatccatatttctttgcaaaaaaaaaaaa

SEQ ID NO: 3972 - DNA, 541 bp, Aspergillus niger
cgcctccattgacacctcagcatccattccttcgcttccgtcaaaatgtccgaccaggtgcaagagctccttaacgtccctcgggagttcctcagggaaggcgtgcagttcgtcaaccgcagccagaagcccgacaagcgcgagttcatcaagatcagccaggctgtcggtactggtttcctgatcatgggattcatcggttacatcgtgaagctgatccacatccccgttaacaacgtccttgtcggtggcgcgtaaacgaacaatccatcatcctttctatccggtgtcaagcgaagaaagaataataaggccatgtccttattttggccaaatcgcgagctagggtgcgcatgcgatgcgatcttcaaaacaagcgtgtaacattatacccgcctgatggatgagcagactgcgatgacggcattgtagtctcgctcaacgcggaggccarccgttggaattggatatgtgcataattagtctgggcargcgttagggtgtgctgttaatatatccattgaactcatggsaarmaaaa

SEQ ID NO: 3973 - DNA, 602 bp, Aspergillus niger
  misc_feature (1)...(602): n = A,T,C or G
ctttggagaccccgcctcccccgcaattgtctatccttcttggttctctggactgctctccgacaactactggctaatcggcgaggacaagaccctcaaccccaagaaatacttcatcatcgtccctgcgctgttcggcaacggtcagtcgacttctccatcaaactacgcccatcctgggcccttcccaaaatgctctttctatgataatgtccgtgcccagcaccagctagtgacacagcatttgaaaatcactcatgtgcgggcagtgatcgggtggtcgatgggagcagcccaaacctaccaatgggccacccagtacccagacttcatggacctggcggccctttttgtggctctgcaaagacttccttcacacaaggtcttnctgganggcgtcaaaagtgcactgctggttgnaaacacatccataacggggtccggaatgncgcctcttcagcttgacaatcttgcgacctggantgccagagaagaggtggtttgaaagcttgggaaggggtttcagatgggatntacagcnttaccggaaantgtgaacnctggattaaggnctaaggattttgaaattttggaatggcctt

SEQ ID NO: 3974 - DNA, 551 bp, Aspergillus niger
ggtagaagtttgctttcgtctaccgggccaagcgtgaggtccggggctccaacatccgggtcatctggggcaaggttacccgtccccacggtaactccggtgttgtccgtgctcagttccgccacaacctcccccccaagaccttcggtgctaccgtccgtgttatgctgtacccctccaacatctaaatgacgccccttttgttacgttagttggcaactccggattctacgcgcagacggtcgggcaaggagtcgacggaatgagccgaatgttgagatggagttggcgggttgataatgttcgtgggagaggcagggccggtcagccctacgaattaaaataaaagaactcttatcttctttttttcagcatggttattgtcagccctttttcccctaggcagcggacgagcttgatatccctggttttattctcattaaaccggccaagcatgctgtgcctttgggccgacaacatggctccccgtgtatctgatgctcataaaccacaatccataccatttcaacatatcggtaaaaaaaaaaaac

SEQ ID NO: 3975 - DNA, 525 bp, Aspergillus niger
tcctcagggccgccaacggcgagaagggcatcgtcgagcccaccttcgttgagagccctctcttcaaggaccagggtgttaacttcttcgcctccaaggtcgagctcggccccaacggtgttgagaagatccacgaggttggccccgtcaacgagtacgagcagggtctcatccagaccgccctcggtgacctcaagaagaacatccagaagggtgttgacttcgtcaagcagaacccttaaatggtttctgaatctgattgaagaagggaacaaaattgcaacatctctctgcagccgctttcctccctgtataacagtcttatgttaatccatacccacttcccgttcccctatgcacatccccatctcacatttggcttttatatcggaggaaatgtagctgcggaactcgcatagcaatgagttttgaggagcctgggactgccaggggagatggacatgacgtgtatttcctataaataagaaaaatctaatgattcaatgactagtgaaaaaaaaaaaa

SEQ ID NO: 3976 - DNA, 617 bp, Aspergillus niger
atgggtcctccgagccatgcatcatcggccggtcttgaaagcatcagttcctcggaagagtcgtgcgagggatggcattttgcgtcaatattccgcagtctatcggggcagaatccgattttgaaagatacttttcaattacactcaatcttcacgtgtgttccaacacgcgtaatctaccttttgattaatgcactgacgcagtacttgtgcatacgaggagtccacctcctctctgcaaaatcgtcttctttgactgtcaccgttgttctgaatattcggaagcttgtttccctcctcctctccatctatctgtttgggaatgccctttcaccgggtgtgctcatgggcgcgttgtttgttttcattggcggcgccttatatggctttgagggtgcgcgccccagggtgaaatctgctaaaaatgattaaggcagtcatgtttcgctagaattgtcttccccgtctttgttacggctgggaaggtgttccagacggtaaagatagaaagatgcatatatatttatatacgtctgcgtgtgttgtgtgttcgtatgtgtgtcccgagcgttgcctcgagctttatgactatgaatatatacattaagaatgcaaaa

SEQ ID NO: 3977 - DNA, 543 bp, Aspergillus niger
cttcgagacctctctcctggtctccggtttcaccattgaggagcccgccagcttcgctgagcgcatccacaagctcgtctcccttggtctgaacatcgacgaggaggctgagaccaccgaggagaaggctgctgaggaggctgcccctgccgccgccgctgccgagagctccatggaggaggttgactaaatgttgaccgcatgatgtcacgatcttcttttcgagcaaaatggaaatgagatgtaactgatttgtgatgacccggaaactgttccagcggtatttgcatcagggatctaatattcattgaacgatattgcgttattaatcggaacggcaaaggaaccctttttcctttgatcctttttctgtcttttttctttattactgaattacgaattctacctttttcttttttttctttcggcgttttgagcgtttattacccccaacctaaatacagtccgtctgatacgcttgtggtgtcaagtatggtagacttatcttgagaataaaagctttctctggtcaaaaaaaaaaaa

SEQ ID NO: 3978 - DNA, 332 bp, Aspergillus niger
caggttgtttccacgcccgtcttgaggcttcccgcaagtacctcttcggtgcccaggccgtctacggtgccaactacgactgtgtcatccagggtgtcttcctggtccgcggccaggactcccagcccgctttcgaggtcggccccgactgggagagctacgagttccgcaagctcgaccacaccaaccccgaggaccgcaagctcatcgaggaccagtgggcttgggatgtccccgtcgtcattgacggcaaggagtaccccttcgctgacggccacgtcttcaaataagctggtgcgttagacgtagccaattcatgatgatgatatccc

SEQ ID NO: 3979 - DNA, 561 bp, Aspergillus niger
  misc_feature (1)...(561): n = A,T,C or G
ctgcaacgccatggtccccggtctctctggtggcaagatgagctccagtgaagaagacagcaagatcgacctcctcgaatccgttgacagcatcaagaagaagatccgcaaagcgcaggccgctcccaaggaaatcgacaacaacggtatcctcgccttcgtccagtacgtcctgttgccggtgtccgccctgaagactggcaagccggagttccgcgtcccccgtgatcgcgacggcctggagcctctggtgtacaccgacatcgagaagatgcacgaagactacaagaacgacattctctccccccaaatcctcaagcccgccgtcgccgacgccatcgtcgagcttaccgccccatccgcgccggcttcgacgcaaccccgactggcaggaagtcacgcttgaagcttacccgctcggcccgaacagaagaaggagaagaacagaagacaagggtttcntaccttgtgccgtaagangaacccttagccggtgacatagacgtaattgatcgtttaaactnctaatagtntggcttttttttttgnggaaaaaaaaaa

SEQ ID NO: 3980 - DNA, 392 bp, Aspergillus niger
  misc_feature (1)...(392): n = A,T,C or G
atcctgccacgcccctggagctgtctcgggcgcgactctgcatctcagccgcccacaccaaagacgacctggatcgcatcctgcaggcgtgcgatgaaatcggcgatgcgttggagctgaaattctcttcgggcattgcaggtggcttgagggaaccattgtctgcgcacgatagctccaagggacccaggacgattgagcctccccgttggcctctcgaagaggtcattgccaggggcacgcacgacgcaaatcaaccgttatactaagcggatgtcaccgcttaatgtgactagaaataagatattctaacgccgcatgatattcaaagaatatncacgcccagaacatattacttaangccctcttttttttttttggaaaaaaaaaaa

SEQ ID NO: 3981 - DNA, 230 bp, Aspergillus niger
  misc_feature (1)...(230): n = A,T,C or G
nggaattttaaggtttacacctataaaaganaragccgttatcgnckgtttgtggatgtacagagtgatattatttgacaccccggggcnacggatggtgatccccctggccagtgcacgtctgctgtcaaaaaaattcccccgtgaactttacccgggggggcawawycggggataaagctgggggcatgttgaccaccgattggccaattttgccgggtccccgttat

SEQ ID NO: 3982 - DNA, 428 bp, Aspergillus niger
gtcctagttcacctgctagcgtcaagatcctacaagatgagctacatcgcccgccgcggtctctcgaccttgatccctcccaagatcgcttcccccaacgcgatcggtgctgccaaggatgctgcccgcatggaccgtgtcgtgaacttctacgccagactcccccgtggtgctgcccctgaagttaagcccaccggcatcatcggtcgttaccaggctcgctacttcggaaagaacccctccgctgctcccctcgctcacgccatcggtaccatcctgatcctgggctacagcatggagtactacttccacctccgccaccacaagaaccacccccactaagcagctcgctttttggtttctgggagcgggagatcctgtgtatataccacacactctacaatgaagacgatgtagaagaatcaaaa

SEQ ID NO: 3983 - DNA, 417 bp, Aspergillus niger
gttcgtgtccctgaaggttggatactcgcacccgattgagctgggtattccccagggcgtcaaggccagcacaccccagccgactcgtatcctgttggagagtgtggacaagcagcttgtgaccaagttcgcggcggagatccgcgaatggcgcaagccggaaccttacaagggcaagggtatcttcgtcaacggggagacgatcaagctcaaggacaagaagattcggtgaaattggcgtctatatcttgggggaacgaaactgtgtttattatttctgtacatgtatatccgagcacggttcttttggttcgcaattggtatcctttctttttatgtacttttagacgcatctagcgtgcacggtctgacaggactgatcgagaatctattacattcatgatagaaaaaaaaaaa

SEQ ID NO: 3984 - DNA, 390 bp, Aspergillus niger
  misc_feature (1)...(390): n = A,T,C or G
caggagtgaagacgcggcatttcagtgatatcttgtccgagctgaagcaggcgctggagatacatcgtgcggcggggtcgttcttgggtggaatgcatttggagttgacgggcgaggcggtgacggagtgtgtgggtggtgctggagggttgacagaggagggcctgagtgagcggtatacgacgttctgtgatcccaggttgaatgagaagcaggcgttggagttggcgtttttggtggcgggattttatagggagttggatgaggagttggcggaggatgaatctatataacccacacccctttttttttggagtggtaaaatggtatggatagtaagagtaaggtctttatgaaattaatataatgtttcnggttataaaaaaaaaa

SEQ ID NO: 3985 - DNA, 438 bp, Aspergillus niger
tggaaatgcaactccctcaatgcgccttcaatgaaggcggcccagcgactgggattcgtctatgagggcaccttccggcagcacatggtggtcaagggtcgaaatcgggataccgcctggttcgcaatggttcgcgatgactgggaggaaggggccaaggaagcgctggaacagtggctggaggaggggaactttgaccaagatggtcatcagaagaaggggctccaggatgtgcgagaggcattgaagcgatcgagatctgtacagcaatagaacatggcgatagatcgactacagcgatattattgagatcaaaagtcgcgtggtggcagggtagtgtaatggcaatcagcccagatgatattcctgcagatatctaataagttatgtctagataagataaatagatctccaatatatatgattatagacatataa

SEQ ID NO: 3986 - DNA, 446 bp, Aspergillus niger
cctcgtcaaccgtctgttagttgcgacaaatccgacaagatggcgaagtccaagaacgcgtctcagcaccacaacagccagaaggctcaccgtaacggkatcaagaagcccaagacccaccgttacccctccctcaagggtgtcgaccccaagttccgccgcaaccacagacacgcccttcacggaaccgctaaggctctgaaggagcgcaaggagggcaagcgcgagatcgcataaattacttccaactaatatagaaacgttttaaaagaaatgaaagcgatttgagttggttgatttgctttgttcctttcctaccgacaaacgacgacaaaggactggtcgagaatacatggatgaggatatcacatcccgtcgggttaccccgcaagaccgggtttgtcacataaagcaaatggattcggttctctagtgaaaaaaaaaaa

SEQ ID NO: 3987 - DNA, 618 bp, Aspergillus niger
  misc_feature (1)...(618): n = A,T,C or G
cgctcatcaaagcatctcttctccgtctctctttctgaacacttatcttcgctacaagaacactcgttcaaatttccaattacctttcaaaatgaagttcgctgtcgctgctatccttggcttcgccatgactgccgttgctatcccggccgccaagtcaagccagcagaagctgtccattgatgacgcttccggtcaatgctcgattggggatatctactgctgcaaccccaccaacgaggaggagactgacggcgctctgaacaatgcgctcagagagggtctcctgattggaagcctcgtcaatggcaagggatctgcctgcgctcccacttcgctcattggtagtctcaatctgcttgcctttttcgaagagggagaggatgacgacaagtcctactgcaagaacgtcattgcctgctgccccggcggaaactgcgcagcccttgatggatactaaaaagctccatgaacaagctccactgggctcgtgcaaatagcgcgggttcaacgggnagcaatctggggatnaagctacgtggggctttatatcagctccaaccgcttaatgagattcctgttaatggcccaagcgtcctaaaccttggtccggccgat

SEQ ID NO: 3988 - DNA, 498 bp, Aspergillus niger
  misc_feature (1)...(498): n = A,T,C or G
atagaattacctgcacgatagacaatcgtcacaatggtcgagcacgagcctgagccgaagcgcttttctcctaagatccctgtccagctcgatcccccgaaatatgatcccataaccgttgaagagctgtccaaatgtgatggtaccgatcctaaccgtcccaccttggttgcgattaagggaatcgttttcgatgtgactaggaaccaggcatacagtcctagtgggcagtaccacgtctttgctggaaaggatccctcccgcgcccttgcctcttcgtcgctcaaagccgaggattgcaaacccgattggtatgatttggaggacaaggagaagacagtcctggatgaatggtcacatttttcagcaaacgctacaacattgtgggaaaggtgaaggatgctacgaactactaaaggaacaaatggttagcagtgatgcatggagataatcaacctttcgcaatgcaagaatatanccgttgactnaaaaaaaaaa

SEQ ID NO: 3989 - DNA, 610 bp, Aspergillus niger
  misc_feature (1)...(610): n = A,T,C or G
gacgccccgtccgtctcgcatcatatctcacctcctccacttcctcgaggtctccgttcctagatcaccatgttctccgttcgtgtcgcccgcgccggcctccgtgccaccgcccagcagttctccgttcctcgcactgccgccgtcaacggtctgaggacctatgccaccccggcccaggatgtcaagcctcctgtctccctgttcggtgttgacggcacctatgccaccgctctgtacactgcctctgccaagtccgcaacctcgaccagaccttcaaggctctcgcagcctcggtcagaccctnaaggccgaccgcaagctgatcaccatcctctccgccctaccctactgtcgccgacaagcagcagattgtccaggagctgcagaaggttgctggtgccgacaagggcgacatcctcaagaacttcctcaacactctggctgagaacaaccgtctcggtctcctcgagggtatctgcgagaagttctccactctcatgggtgctcaccgtggtgagatcgagctgaacataccagtgctcangagctngacaccaagactgtcaaccgtcttgagaangctggttccaagtctgagntcaaccag

SEQ ID NO: 3990 - DNA, 557 bp, Aspergillus niger
  misc_feature (1)...(557): n = A,T,C or G
ctctccctcaaaccaacactactaaacccattaaaccactcaacaaagcaatcataatggcctccctatcgcgcgtaacccgcatcaacaacccagccctttttatctgcgacctccaagagaaattccgccatgccatctacgaattcccaaaagtagtaaataccacaaccaaactcctccgcgccacgcaacccctccaaatcccaatctacataaccacccaatcgcgcgcaaaactcggcaacacggtgcctgaactcactacacatttaaccaaccacccgcttgtgcgggccgaccttgacaaaaccctcttctcaatgatcacgcccgagatggaagcgcttctcccatcgcctgagaanggggagaaggcgttggatgtgataatcgtggggattgagacgcatatctgtgtgttgcagacgacgatggatctgttgcggagaggacatccggtgtatgtgtgtgtggatggggtgagtagtgtgaataaaagangaganggggattgcggtgcagangatgacggatncgggggcgattgtgaccac

SEQ ID NO: 3991 - DNA, 624 bp, Aspergillus niger
  misc_feature (1)...(624): n = A,T,C or G
tgtcgtggaccagttccgcctcgtctggctcaagaccgaggagggcatgaagccctccaaggatgccttcaagtcccacctcaagaactacatgaagaaggtccttgccagactcaccgagaccggtgcctccaaggagaccatcgatgagttcaaggctggtgcccccgccgccgtcaagaagatccttggcaactacgacaactacgatgtcctgatgggtcagtccatggacggtgatgctatgcacatcctgattgacttccgtgaggacggtgtcacccccttcgctaccctctggaagcacggtctccaggaggttaaggtctaaattcagacactgcagtcatgcgaataaatgttgtcatgaattgaaaaagaaagagaagagacactgaagatgcgatgtcttaatacgagcaattaagggtccccggaaagtagcagtccaggcttttggaagcctgggatcccgctatcgcgtccttctggctattgctaattatctttccttcacatcttgatatcacatcatgctcctgcgtcgcatatcttctgcgtccttcttgattaaagtcacgcctcatgaaatcataactggtacgncttttttaaaaaaaaaaa

SEQ ID NO: 3992 - DNA, 626 bp, Aspergillus niger
ggtgattgtcgtggacgacatcattgctactggtggttcggcgtatgcggccggtgaactcatcaaccgcaagggtggtgagctgatgggcttcgttttcctcctcgagctcgagttccttcacggacgggacaagctgcctgcccccgtctacactctccttactggccaggagaccaaggcttaatgaccctatgacatgcattcgaacaatatccttatctgtttggaggtctgcacgcacaaaaacataaaaaaaacacatatgcgctcactcgctaccactcacctgggaagtggtcggtcatgccgcagactatgcggcagcaaccctaccggggttcgccagagatcgctacggaatcgatcgcgccgactagatggtcggcatgggacatgatagacaaagcaattgaatccccactcgccgggaacggcaccgaaacgaacgtgacgtgttctcttccccagggctataaaagttgaaacacttgatctttactttattctacacgagtcgatgtcagtcaggcgtggcatgcattttttaaacgtttttgcatagactatgaaatagcaatgacacaatgaaatgtaataatacgctaagcttawaaaaaaaaaaa

SEQ ID NO: 3993 - DNA, 595 bp, Aspergillus niger
ggtgaagaaagcaggaatggacaccactcccctaggcaccgaatacgtcactcacgacattgatccctcggacattgctttggtgcctattctccggtctgggttgggcatgatagaggcaataaataacctcctccccacctccatcccaatctaccacctcggtctcttccgcgaacgtctcaccctccaaccagtcgaatactacaacaacctccccttccagcccgacagttccagcaccaacaccgccgctgctgcaacagccatcctactcgatcctgtcattgcaacgggtgctaccgcagaagcagcgatccagttactccgtgaatggggcgtgcagagagtcgtcatgttgagtgtgctgggttcggaagcgggcgtgcttcgcgcagcggggacctggcctgagggcgtcgaggtgtggactggggcggtggatgcgaggtgtgatgagcgggggatgattgtgcccgggttgggggatattggggataggttgtttgttgcgatggggaaagtagatgctagctggggagcgctgaacagcaggatacttatactaactaggttgtgaacgtgaaaaaaaaaa

SEQ ID NO: 3994 - DNA, 301 bp, Aspergillus niger
gcgggtcgctggaagtgtacttgtcagcactcagagcgatgactccgtggagtgggagagtgatcccaaccgagaatacaccgttcctcaggcgtgcggaacgtcgaccgcgacggtgactgacacctggcggtagacaatcaatccatttcgctatagttaaaggatggggatgagggcaattggttatatgatcatgtatgtagtgggtgtgcataatagtagtgaaatggaagccaagtcatgtgattgtaatcgaccgacggaattgaggatatccggaaataaaaaaaaaaataaa

SEQ ID NO: 3995 - DNA, 173 bp, Aspergillus niger
  misc_feature (1)...(173): n = A,T,C or G
tgcgggttacacagcccggccagcaattgacggaggtcattggctgcacgaccgtgacggttggttcggatggaaatgtgcctgttcctatggcanggnggctacctagggaatggattccgcttganaagttggcaggnagcaagaatntgtagaanntcgtgaagggtgga

SEQ ID NO: 3996 - DNA, 626 bp, Aspergillus niger
  misc_feature (1)...(626): n = A,T,C or G
ncctggataagctgaaggccttccccgagtcttccgtctaccgccagtctaccgaagcattgacccgccaccgtctgcagattgtcgagtctacgaagccgcccggttttgatgcttggttggagcgtgtgaagaaggctgtcgctgaagagcccgagcgtttcgcctcccttcgccgtcctgacggtacatatgccgcctggcagcgtgatgacggttccgacaacccccgcggtgaggaatggaatggagagagcatcgaacctactaccgagggccccgctcgtacggcagargaagaagctcggtggcacaaggscattgaggagtctamcaagcccactgctgaatcagacttctacaccgcacagatgaagtgggaagaatgagcccgccctggaggctgagcagattgccgaaattgagagacagattggcgccggcctgatcgaggaggtcattgangttgctgagggcgagttgaaggttgttgacgagctgtacaagacatccgcttgggaagagctttcggagaagcccagacccggtcagtggtcctactttgagcgcaagancgagtaagcatagaatgttttctcatgaaaggaaggtccgaaactaaaatg

SEQ ID NO: 3997 - DNA, 403 bp, Aspergillus niger
aaaactaatccttcaaaatgcatcttatgtactctctgggccccgatggcaagcgggtttacaccctcaagaaggttaccgaggacggtcgcgttaccaagagtgctcaccccgcccgtttctctcccgatgacaagtactctcggcaccgtgtgaccctcaagaagagatacggtctgcttatgacccagcaagccgacaaggaggctgctaagctgtaagctggttgacggaataacatgattgagatacaaaaggtgctttgaatcattaatggcgaatggtgttatctatggtctttggacgatgagaaacttttgttcggtttctgtgcggtgcccatggccggtatcttagtgtgcaaaatataccatccaagaatttgctctataaaaaaaaaaaa

SEQ ID NO: 3998 - DNA, 397 bp, Aspergillus niger
caagaacaccccttatgtcttcgtgcccagcaagcttgctctcggccgtgctaccggtgtttcccgccccgtgattgcggccagtatcaccaccaacgaggccagtgacctccagggccagatcaagaccatcaaggacaaggtcgagagactgatgatctaagcgttggtcttgttgtggaaaccctccggaggattatgcctccgcgggttgctaagaggaatctattgtgacttcgggagttggccggccatgacagacgaggttttcgccccacagtgcgaaaacaagtgtcgatgaatggtttggatcgctaccggatgctcaattggatgctgtgggcgttgtgcgcctggaattagtgcagataaaagtcaatgacaaaaaaaatgtgcc

SEQ ID NO: 3999 - DNA, 206 bp, Aspergillus niger
tcgacaccaccgaaggtcgccacggactcgtcaccctccttgttggtatctccaaggtagaaggcaaagaccggctcgtcgaggagtccctggtcaagcatgttgcagacgaacacacgtgatgttgtgaatggttttcctcatgtttgcagcggttgccggatagattctagggatcttcaatggaaagccggtgatattatttg

SEQ ID NO: 4000 - DNA, 622 bp, Aspergillus niger
ctccatcttccctgaactgtgccctcaggataatctgttgtgggtacatacactcgtgatctctaatgaatgtactgtttcgcggttataatcattgaaataatcatcatctgcgtttatctcggagaagctatttcaaaaggtaccaaacaggcctgtttgtttcgtgacaactatgactctatcacggagagtggcctatcgatctacggcctttcagcggactcgccgaaggcaaataccacgttcaaggctaaacaaaggttgccataccctcttctctgcaatcctaccgctacattgatagcagctcttggactcaaaaagtcgccaaaaggcacaattagaggagtctttgctatcgataaacatggcaaagtcttgataatacaggctggaggccctgatgcaacgcttgacgctgcacgaaaactggttgcagaattgaaggaacaaagttctaaagacgaaacccggcacgcgagtccaccagctaaggctgaatagtcaaagatagtaccagacatatcgagacttttgaagtggccaattgctacaagcactgtgtggcataagcactatatgcagttccaaatcatactcgcaattcatgccccagaag

SEQ ID NO: 4001 - DNA, 323 bp, Aspergillus niger
ggtgtcgagaactatctgagagccatctttggcagctaccttgccagccgcttcgtgtatgagtatggtagcagcccgagccagttctccttctttgacttcatgaccaagcgaattgcgcagctcaacgcgaaccacgattcttagacggatatacctgttttcttatgattgtttttgtttggtgacttgcattttccgggaaatacatacctaactgcacatcagcagtgttacggatactttaattatgacgatgtccattgcatgggatacaaaaaagacatgaatactacagacctaatacagcacttttgttttgc

SEQ ID NO: 4002 - DNA, 262 bp, Aspergillus niger
aggtgcttgcggacagcaagttccgcctgattctcatcgagtctcgtatccaccgtctgtctcgttactacaagtccgtcggtgtcctcccccccacctggcgttacgagtccgccactgcttccaccctcgttgcttaagcgcgtgcacttcttgtgctggggtagaagttgttgtggtgaagtggctgtcgtcgtggttgattgggtcgatctggaagggttgattcgcgatagtcatgaaataaaattatgaccacact

SEQ ID NO: 4003 - DNA, 349 bp, Aspergillus niger
gcccactacctcgaccagaagagactccgcactggtctgtacagacacccctgggatgacatcacctaccttctccccgccctccagaagggtggctccgagggtcgtgtcgaggtcagcgtctaattttttacttgtctcccttaatacatttacatctcatggattagtcataaaatccgtcattgttgacgtcggagttatgatggcctgttttcttttcacccatatttctttctgcatcggtttggttcgcttcatatctcatctatttcaacttacaatctgtagtggcacatgtggcatgactcgctgttaaaggttgatgaatatcacgcaacgattaaag

SEQ ID NO: 4004 - DNA, 496 bp, Aspergillus niger
gagaacgacgccgctttcctttctttaactcggctgatgatgttgacgctatgattgagatggcgagtatcttcggcacccgacgcatgaaagctgcagcagccatgcatgggcagatattcgaaacaaacatccctaccatcggtgaaaaggggtatagctgggagaaacttgtaaaatgggccagctgtgttgaagagctaactgaaagtgagaaacaggccactcgattgttggctggcctcatggagctggatccctacaagcgtctgagtgccaaggaagccctacaacatgagtttttcactgaccctatagatcatgatgtggagtggggaggggaccccgatgatagtgcagacactggggaagaagatgaggataaagatgacggagaagcggacgaagtacaatgatatagagcttccgagccaatgtatgataatgactcctggtttgattataaacaaagcaattgctattctactaaaaaaaa

SEQ ID NO: 4005 - DNA, 457 bp, Aspergillus niger
caggcgtcgtcaaccgactattattgttgcgtgtttgccggcgccggctggagggcagttgaagtcccctattacgatggaggtgccggagcagtggttgaggagtacgactgggggtgttttcattgatgtggcgtatggaatgccgcagaccaagctgagaattggtatgaatgaacgagcgagtatgggctgggtcgtggttgatggtctggtggtgttgttggagcagggcattgcgcagtatgagctgtttacaaggaggccggcgccggtgcatgtgatgaggggggtattgagggagtatactaatgcaacacttagcaggtagtatgtgtctcgcatgttgataccatttctgttgactttgcgaggtctaagtttacttcagtgcattgaatgatcagtacggagtactcaaggtaatcaattcggtcatctgcgatagcgaaaaaaa

SEQ ID NO: 4006 - DNA, 601 bp, Aspergillus niger
  misc_feature (1)...(601): n = A,T,C or G
acctcatccacctccagccatgttccctcagcgcaacgcccttcgtctgtctcagcgcgctgcccagcagctgcgtgctgctccggttcgctccaccgtccagcgccgtctcaacagctccgactccaagctcccctcttgggccgtcgacaacgaattcaaccgcgagagagaggccgtcaagcaccacgctgctgctaccagtgatctgtggcgcaagctctccatctacgccgtcattcctgtcctgattgccggaggtatcaacgcctacaacctttggactgagcactgggaacactgggcgcacatgcccccgctcgaggagcgtaccgagtacccctaccagaacatccgtgtgaagaacttcccctggggagacggtgacaagaccatcttctggaactccgacgtcaactaccacaacaaggacaaggctacctaaatgcccgccgttgattatgggagtacagcgtctttgattgatcttgactgttgacgggaggggaaatcaaaagacatgtatatttactgacaaaatacgcngnagtaagaataacgaagggcaaggntctcgttggtggagttgagatancgcgcc

SEQ ID NO: 4007 - DNA, 631 bp, Aspergillus niger
  misc_feature (1)...(631): n = A,T,C or G
gtcatagcagattcaagctgagaacaccacaagtaaatatcacccatcatgcttaccctgaccgtccctgaaaactacggctctgtcattgccgtcgctctgggtgccatccccgtcctgagcttcgtccatggcgccgtcgtgtctcgtctccgcaaggaagctgattgcccctaccctcactgctatgcgaccgtagagcagtgcaagaccaaccccaaggccgagcagttcaactgcgctcagcgcgctcatgccaacttccttgagaactccagccaaactatgctcttcctcctggtagctggactgaagtacccccagttggcgactggcctcggaagcatctgggtcctcggtcgctcactgttcctttacggatatgtgtactccggcaagccgcggggtcgcggtcgtttgtacggcagcttctacttgcttgcacagggagctctctggggcttgacgtcttttggagttgcgagggagttgatttcctacttctaagtttggactgaatccgtggtgtgattgangtgattggcgatgnttggctataccagctatatggaataatctctactggatactactattcaacgcattttactatgcgtgctgntagggtcgg

SEQ ID NO: 4008 - DNA, 406 bp, Aspergillus niger
agtaaatctaagagcgctcaccacggagacggcgagcaagctggatgtccttggactggatggtgacacgcttggcgtggatggcgcacaggttggtgtcctcgaagagggagacgaggtaggcgataacggggtttctttttctttaattttcatgactactggcgatacatgatgggtttgcgaattttaacgggtttcggcactgggttttcgttatttcttgctgcgcaataaatagtagctgccgattcagcggctgggtggaattgatcatggggatgcatccgaatatgtacattaaagaaagcttttattcgacgtgacttccttcgggagcgccaccggatggcatagacgcgaaatgcagtatctatggaacaatccaacccggtttgagatcgcg

SEQ ID NO: 4009 - DNA, 587 bp, Aspergillus niger
  misc_feature (1)...(587): n = A,T,C or G
cagctattcgatcgggagaactgtccctatgagtcctacagagagatggagttcaccgcagctcttccggtagcacggatggcttatttccatcgacactttttgggggttccccggccagcacgttcagaagaggactggaagatctcccccatatttgcgcctgacttttctggactagcacctgcgttggtcttcaccgccgaaatggatcctctgcgggacgaaggggaggcctacgctgccaaattgaaagctggcggttgtcgagtggaaatgatgcgtatggcaggagcaccccacacatttgccatgttggatggcatcttagagagcggccgtatatataccgagaaggtcatcgaagcgatgaaacgggaactaacagggtaaataatcaattggttcggttgaagggatatcgaagatggagagcagtgttagtgcagagcgactagaagatggaaatgcggagagacagcaggatcatggtttatccgacgagaatctttaccgtatgataccatttangccgggcagcgaangtgtggcagacgggtaaccggcgtcctgaacattaccgggcc

SEQ ID NO: 4010 - DNA, 495 bp, Aspergillus niger
  misc_feature (1)...(495): n = A,T,C or G
gcgcatcatcattatgctgggacctatcgtcggatccgccatgctcctggtcgctactgcgatctttctttactacaccacctggactctgttgatgcccttcgtcgatccgggtcaccctctccatgatctcttccctccccgtgtctgggccattcgcatccccgtcttccttactctgcttggttccgccgtggttggcacgttcataggcattgtgatgatcaacagcaacaagaagaaggcagcgaaggctaaggccgcggccaagaagaagacctaagcttccaacaaaaagaaaaccgacgtggcgtttggaggatgagttgggtggtgaacatggcgactcgaaacaggtggcatcatcttattctgcatgtaacattagttttttctgtccttggtcttttcaagctttccccttgattgggttgntctgtcatcgcagcgttcaattacaccatccgcattcctcgcattctgcaaaaaaaaaaa

SEQ ID NO: 4011 - DNA, 474 bp, Aspergillus niger
gttgaagaaggggtggatgtcatcaacctcgagactggttggccgagcaagggtaacgccaacggtgctgccgtccccggtgccaccgagcaggctaccgccatcaagggcatccgcgagtccgttggtgagctgtcggtcttcttctcctacgccaacgacctgtggaaggaccccggcgagtacgacgttgagcagtactggggttgcattgaccagttctaagcgggtcgcgcttgatttgtctatagtttcctgaacaattttttttctttttgcttccgatctgcttggagttgtttataatcctgtatctgtcgtcccaggtacattcatcacgacaggacttggcttatctttcccttctccgtacagttgaaactttcatatagtagatataaccttttggtgtctgtttctttcttcctctactcttatctatgtgtctactgaccgggtttgcaaaaaaaaaaa

SEQ ID NO: 4012 - DNA, 484 bp, Aspergillus niger
  misc_feature (1)...(484): n = A,T,C or G
gaaggccattgccctggacaacaagcacgggttctcgtcgcgcttcaccagcgctctgtcttccttcgaccagaagtaccatgccacggaccgtgctcgcggtctggacgagaactacaagctcagcgacaaagcgaccactggctggcgtagtctgaaccactacttcgagaaggccctcgacactccctcgggcaggaagttgcgggacttttactcccagaccgataagcaggtgcgcgatattcacaacgaggctcgcagacttgcggatctgaagagcggcaagtctactactgagggtggtgaagctcctgctcctagcacggcgcctgctactcacncggcgggtactgctgctcctgctgagcangcgtaagcaaattgaattgaaagaaaattangattgggggttnatgagcaccaaggtgtggnttctgttctatgcgatatgacttngctatttttagttaaaaaaaaaaat

SEQ ID NO: 4013 - DNA, 618 bp, Aspergillus niger
  misc_feature (1)...(618): n = A,T,C or G
gcgttttcttcttcttcttcgtcattctcaccggttcctacaaaactaaatcccccctaaaactcccccccattcctggtcccggttctgcagaactgcttccttagtttacaactacccctccatcccttactcaaattcaagcaccactcgcaaatcagatcgtcgtcaaggatcatgacacccaccgcagccgtggattcgggtttgtccgcttcgccagtgatgttgaggccgacgctgccatgaatgccatgaacaaccaggaattcgacggccgtgtcatccgtgtcgacaaagcctcggagtcgagaccgcgcatgggtggaggtggattccatggacgcggtggctacaaccgtggctacaacggcggcggctggcgttcccagcagcaggagcctgaggctacagagtaagctgcgcaagctattatagcattgccgatgacttactgtggaccggtctcttgncctatttttcatttcttttcacgcttttttcctcttctcgcatgtcaactgctggtaagtcccttnggacttaaaggttgggataagaacacgggcgcatgctaccaacttttatgatggngacttacgacgaaacgacccctgc

SEQ ID NO: 4014 - DNA, 419 bp, Aspergillus niger
  misc_feature (1)...(419): n = A,T,C or G
attcactgagcctattgcttcatttcaattccattcctcatcatgtcgtggctgtccggttcctctaacactgagaaggctgctgcccctgctcctgccgagtcggcacctgcggaaaagcccaagccatgctgcgtttgcaagaccgaaaagaccgcccgcgatgactgcatgctcttctccaagaccgacgatcccacacaggagtgcaagcctctgattgagcagtacaaggcctgcatggctggctatggcttcaaggtctaagttgcactatacccgactgctgccgggacagctgcacaatgaggatgatacatagagttcagcgcatgcaaatattggtgttcggttatgggttattctgggttacatgtattgnataggcatttcgacgtctataggtggaaaaaaaaaaa

SEQ ID NO: 4015 - DNA, 603 bp, Aspergillus niger
  misc_feature (1)...(603): n = A,T,C or G
ggcaagggcaaccactccgccaatcatatccagaaaatcaagccccgagtagagcaagtctgccaggaactcggtctccagtacgcgactgaggagaacgcagggcgcatttatgtgaatctgactggtggaccggcggatatggagactgcgccaacgcccaatcatcctcactatcagcaataccctcagcatcaacagcatccgtcgggtacctatgctcacccgcatcagcagcagcagcagcaatatcccggttcgcaacagcagcagcaacagcagcagcagcaacagcagcagcagcaacaacagggtgcgggcaaccaggatgagatcgagcaggtggttaatgcggttctgcctaagattctcaataagctggagaaggcttgctgtgtggtcatgtgaaaaggatttgagggacactgggataaagattttgtttgggcaaaagagtattttttggcctatacatgatatgatatgtggttggtatagacaaagaagggtgcgtgagcagacacgactgatcattggactttcgcgcaattggcatttggccggaagattacatataccccgggctgngtggtggattaanat

SEQ ID NO: 4016 - DNA, 460 bp, Aspergillus niger
gccccttcgaccagcgaccgtctatatcgatctgagaaagagccacatcgcgcttcaataaaaacattcacaatggaaagcctacttgcaccgattcaagatgctttggaaggtcaaatcgacttccaaggccagcgcattgcagagcttcttagcacagtgcttcttgttctgtcgggtgccgttgctttcattgttggatacatcttccaggatattcatctcacactttgggtcggattggccggcacgttaataactgggttggccgtcattccgccttggcctatgtacaataagaatcccgagaaatggcttgttcccttgacggcgggcgtgggaggtggtgcargcatcatggtagatggagttaaggttgcgtgagacaaaagtcgcggactttggacatgtctaatttatatcctgaatcaatcacaacttgtccgccttgaaaaaaaaa

SEQ ID NO: 4017 - DNA, 181 bp, Aspergillus niger
  misc_feature (1)...(181): n = A,T,C or G
nttgccctatagggaggcntattacaattcacnggccgtcgttttaaaacgtcntgactgggaaaacctggggttacccattttagcngccttgcagaaaatccccctttcggcaaaatggcgcctaccgaaaaggccnnaaccgttnaccnttcccaatatttgcccacctaaaaggnan

SEQ ID NO: 4018 - DNA, 451 bp, Aspergillus niger
  misc_feature (1)...(451): n = A,T,C or G
cgctgttttnttttntttnaacatcaggactttttcattattttagctcgagcatncggagagactaatttactcctcgtnctcctcctcgncaacggnggtcttggcgatacggtcaagatcacgctggccgctctgggtgatgcggcggccacccttctcctnatcgtgctcgaggacaccgacccgctttgncgaactttccgattcgcatgcttggtgtaataactnagttgggcggcctgcatggntcagcaatatcgagtgagtcaatgtagcaaacacaacgtgcttgtagttgttggggttgaaaggcgggttgggactcggaccaaaattgaaggaatgtaatcatatgcaaatctggttcgtgggtcggccgatcgncggctatcaaaccacgcccaaactatgtacagtcaaagctaaaaaaaaaaaagaaaangaaaaa

SEQ ID NO: 4019 - DNA, 641 bp, Aspergillus niger
  misc_feature (1)...(641): n = A,T,C or G
ctttcgctgctctgcacacaagatgtcgaccattcttaggacgctgcgcaatctgagacggattggcatcaaggattatggccaccaaatgcaggtatgctttcggatgctgggaaaggagaagcttgtggaggagtgaaatggatactgacgagacgtgctatttgctgcaatagtacattggtgataccaaggccggtaccttgatcggtgttgaccgttacggcaacaagtacttcgagaacatggaggaggagcttcctctccgtacccgctgggtcgactacaaggaaaaggaatacgacccctcgcagcttgagcctggctggcacgcttggatctcctacatggtggatgctccccccactgccgacaagatcatgcagaccggtgtccgcagctgggagctgcctgagcacaggcccaacctgaccctcagccgtgctgctttcaagacctactctactacccgccccaagtactccgcctggactcccgtttgcggcgccccggtanacgtcggtanagcgttngnctaaaaatcagaccatgttccaaagatgtgttaaataaatnagatgtcctactttcccgttttgaaccaaaaanaaaaaaaaaaaagcgggccgctcnaacaatca

SEQ ID NO: 4020 - DNA, 902 bp, Aspergillus niger
gagagatcggtccccgccaattaaatctggctcgggttattgcccttcattgctctcctgacgtctctaatcctcaccctcgcgtgccactttcgtcaacttcttccttcccaatttcattcttacgaggcttggtcttgctgtgcttctctcttgagcctcgctctctttttatctagccaaacgaaatcgaattcttacagcggaagagttctggtatatttacacgacggatttcagttgtattgcggccatgtctactccagagccacttccaaacccccagcgtgtcatcaccgacaccgatcccgagaccggcatctctcacttcaatacgaccctggatgaaagccttgcggtcaagcaggatcttggaggttccttgttccgtttgggatacatcaccgacaagacccccaacacgctcgatggcaccgatctcacgaactacattgagtacctggagactgccagcgttcctcccgtcaccctccccgacggtcgtggcatgatgtggtacatcgatacccctcctggtaaaggcagtcctgctcaccgcaccgtcagctttgacgttgttatccaggtcgcaggcgagatcgaagtgacgctcgaatcaggcgagaagcgtatccagaagccgggtgacatgctcatccagcgcgctaccactcacacttggagaaacctcagcaaggacaagtgggcccgtatggttggtgttatgtactcgagcaaccctgtggttctcaaaaatggcaccgtacttggtccttctggactctagtcgtctcatcaacaatggtataggctatttgtgtctacataggacacccaatctattttcaggcaaatattcttttttttcacgtgcctcggcacctaagcttctagagtcaaaa

SEQ ID NO: 4021 - DNA, 517 bp, Aspergillus niger
  misc_feature (1)...(517): n = A,T,C or G
cttgaccggcgtggaggaagacgacaagcgcangctcgaagtaactggggagatctcgttgggcgaaatggtcaaccgcattcgaccggtcaatattcaacaattggcgagtgtgacggtcactccgagggcttttctgggcacagtggaaggttccatctatctctttgctattatcaacccagagcaccaggacttcttgatgcgtctgcaggcaaccatggcgggcaaggtcgagtcgctgggaaacattccattcaatgagttccgtggtttccgcagcatggtgcgagaggctaaagagccgtaccgctttgtggatggcgagctgattgagcggttcttgacctgcgagccaagtctccaggaagaaattgtggactcagtgggcatgatgaacgttgatgaagtaaagattatgatagaagccctgcgcangctacattgagtgtggcaagtangatctgaagagcaataatgattgagttatatatggtaaagacgaggtaaaaaaaaa

SEQ ID NO: 4022 - DNA, 451 bp, Aspergillus niger
  misc_feature (1)...(451): n = A,T,C or G
gcactccccatgatagaatcactaggcggattcctcgttgtcggtggcttcctcgtcaccgtcattgtctgtgccgtgatgccccatgtcaacggacagccgtacgccacagacgacttcgtctggcgcgactggctcaacgaggctggatacagtagcgacggcttcgtcttctgtctgggaatgctgaacggtgccttcgccgtcggcacgcccgacgtcatctcccatctggccgaggaggtgcccaaaccggggaagaacattcctctgggcatgctggctcagtacgtgatgggcttcttacagccttcctctacctgattgtcatcttctacggtatcaccgacctgaacgccgttctcgaacccctactttttcctctgaccgaaatctacctcaaatacggcaccgcggnggtttttngactgataatngctcatgctccggt

SEQ ID NO: 4023 - DNA, 256 bp, Aspergillus niger
cgcgtaatgcccagtccgccctgctccttcggtagacagatgctgcaggtgcacaacgtgcactatttgctgtcgctgatgggatcggcgcggcaggcgatcatcgaggaccggttcccggcgttcttgcgtgacttctttgggaacttgtatggagagaagacaaattatccggagtgggtagtgacggctctgcggggggtgggagtagatttgatggagtaatagataccagaataaagcggagtagtatgcc

SEQ ID NO: 4024 - DNA, 435 bp, Aspergillus niger
cctcgcttcgagcagacgataatggagatgcagccccaacccttggctgccattgagctcatccacagacagcccgtccgctggacgaaaaagcgcgtcgtcagctgtgacggcggtggcggtcccctgggccaccccaaggtcttcatcaacaccgacaagcccgagattgctacctgcggctactgcggtcttcccttcgcccacgagcaacaccgtgcctacctcaagtccctccccgccaccagctaccctctcgagcctaccggtgacgccgccgaggtgaacgagagccagcgcgtgaccgagggcggattcgagcagcggtaaagattgattttataggcgttgacgatgttttgtttttatcctttagccatacggctgttgtacagatgtaccaggtcaatgaagtcgttagatcgaaaaaaaaaa

SEQ ID NO: 4025 - DNA, 446 bp, Aspergillus niger
  misc_feature (1)...(446): n = A,T,C or G
ctgcgacccaatagcgaagttctgggcccccgacacattggggtcatgtctggaccagacatcaatcattcttgccgatgcggttgtcagtgtcgttagcgatatgactatcctcattcttcccctacctttgacggtagggttgcaattgccgatgaagaagaaattgcgagtcatggtcgtattgggagccggcggactagcatgtgcatcgagtattgtccgtctgatcctcattattttgacggggcaatcgcaggacgggacactggctttcatgcgcattaacatgtttgggaacgccgagataacgattggggtcatttgtgcctgcttgccgcctttcagccctggctcccgtaccaccgcgaatatacagcacaaatactgagtcataagaacaccagcatnacagtacgagtgacaaggcagaatancgtccaatc

SEQ ID NO: 4026 - DNA, 391 bp, Aspergillus niger
gacctcgtctctgaggagaccctcaaggcgtggggttccaaggctagcaagaagtatgtcgacatccagaccagcaagaaggtccgcaaggctgctgaacccttcctcgaatggcttgagaacgccgagagtgaggaggagagcgaggaggagagcgactagatcagcgactcggcttgtcgcagtcatctgtctgctcagtagacaattttcgggactacttggtttttgtcgcgtgattgtttcgtttgttccaactgatctccgctcttttcggatgtgacagtttcgctctgcctattgtttgttccagaagtttgaaataagctcatcgaaaaaacattagtcctaggtagctgccaataatatcgctctgcgtatttgtgctagt

SEQ ID NO: 4027 - DNA, 616 bp, Aspergillus niger
  misc_feature (1)...(616): n = A,T,C or G
tctcaatcaagatttgatcaacttctagctccagcggccccagcccctccaagccccctcgccgatcgccacacttgatcgcaggtgacagtaattgtattagcaagatgagcgagcctctcccatcgtctttcgaagaacatcctcagttccaagaggagacttcgctccaaaagttccgcagacgtctcaaggaagagcctctgatcccgctaggatgtgctgccacttcctacgcactttaccgggcctaccggtcgatgaaggctggcgactccgtcgagatgaataagatgttccgtgctcgtatctacgcccagtttttcacccttatcgccgtggtcgccggaggcatgtattacggtagcgagcggaagcaacgaagggagttcgagcagatggtggaggcacgcaagagccaggaaaagcgggacgcctggctgcgggagttggagattcgtgacaaggaagacaggggctggcgggagcgtcacgcggctattgaagcccgcggcgaacgaggccgcgaatgctaagaaatcgttcccttgagcangatgctgctcgctctgctattgagcctttcgaacagaagtcaatcggggtactaattgct

SEQ ID NO: 4028 - DNA, 615 bp, Aspergillus niger
  misc_feature (1)...(615): n = A,T,C or G
tggaaagatcgtcctcactggtgctaaggtccgtgaggagatctaccaggcgttcgaactgatctatcctgtgctttcggatttccgtaaagtctaaaagggcatcgcctttctcaggaagatctcgaccacctcgtccttcccatcttcatcaacttgtattaacactcggcttttccccttgcactggcccgcgaggttgtactatgaacggacaacgcgcttcaacccagcacggctgatgcttttttttctgttccgattttctttttttccttctacacctttgcacatcacgattttcatgctagcatctgtacggcgttcgagcgattggtctctattatctttttttccttcctgtttcaacaaacaaagtgtctcaccatcttagatagtcgcacaccgcagattcaagggggcggtactgtgcgctggtcgaatggttgcctccttctaattattggttttctgttctttgcctattggcagtgaccctcgagtgatggccaaggttatcgctcgangtggttcggacctccgangacttgcttgctattgattcggagggttaactctcaagctcaaagcanccaaaaaaaatctttcgtgttn

SEQ ID NO: 4029 - DNA, 290 bp, Aspergillus niger
  misc_feature (1)...(290): n = A,T,C or G
ccggncttggcatcgaagatggaggagtggtcgtctcctggtacgacaacgagtggggttactcccgccgtgtcgtcgacctcattgcctacatctccaaggttgatgcccagtaggaatcaggacggcaaactgaattcagaagtgtgctgtgagtgagactgattgccgagcgcagacgactctcgtggaacccggcttgtggagaagcttgagaaggtcttaactcctagcgtaaaagctcatgatgacgtacaatttaatgaaatgatacaatgttcatatttccc

SEQ ID NO: 4030 - DNA, 622 bp, Aspergillus niger
  misc_feature (1)...(622): n = A,T,C or G
cctcctttctcccttttctctccagacttatacctctactctctgaatatcatatcatctccatttatctctctactacctttatccaaaactcacttcattcatcatgtctgaacgctccaccgtccacgtcgagggcattgcctccgctaccaccgacaaggaggtccaagatttctttagcttctgcggaaagatcacccacatttccgtgacccccgtttcaggcgaagctgatgcccaaaagtcggccaccgttactttcgaaaaggaagctgctgctaagaccgctcttctcctcgacaacacccagcttggttcctctctcgtgcacgtcaaggctgcccagagcctcgacgacatcgccggcgagcangccgccagcgccggacaagccaaggacgagtacaaccacgacctcgagcaagaggacaagccccgttctcgcattgtagctgagtacctggcccacggctacancctcagcgacaatgccatccagaaggcantgccctgggacaacaagcacgggttctcgtcgcgcttcaacaacgctctgtcttccttcgaccaagaagttacaatgccacgggccgttgctcgccggtctgggacganaaat

SEQ ID NO: 4031 - DNA, 367 bp, Aspergillus niger
tccagacctctgtgaggctcatccttcccggtgaattggcgaagcacgcggtgtcggaaggcaccaaggctgtcacgaagtactcgtcgtctgccaaataagcattttctttccttttttctttctgcaggattgttcttttgctacctcgtcatctgttacggttttgaggtggtgggttacagggtgttcgcgggattctaatgtgtcatgggatggctttatttctttttttccccttgggccaaatgttttatggttgttttttttttgtgacgtgaatgcggtgtaacataactcggatgtggggttggttgcgcgggtttaccttccccagcagaattcgaatatcaaattgcctagttgc

SEQ ID NO: 4032 - DNA, 548 bp, Aspergillus niger
  misc_feature (1)...(548): n = A,T,C or G
gtggatgacggcaaagactacgtcttggaaccaggcacctacataaacttgaatacgaatggtcttcactattctgaagaatactggggggacgacgccacgctatttcaaccacagaggtgggatgcgcgcaacaagggtagcttcttggccagaaacgccgatctacctggactcgctggcccggggttggaatatcctactatccataaacccgtccgaggtgcctatatcccatttagcgatgggttccgcgcatgcctgggaaagaagttctcgcaggtcgaatttgttgctgcgcttacgacagttctccgacagtaccgcatcgagttgcccgacagcagtgaaaaggcagaatcaatgctgaaagagtgttgaaccaagcacctcgattataccttggctatggggaggaagtaccgttcttttccaaggagatgaggtgtttggagaacttatgcctgatgaggatggctggataaacagatgcctntcaattggttggtcatgaatcctgaaatngccatttggttacgaaaaaaaaa

SEQ ID NO: 4033 - DNA, 385 bp, Aspergillus niger
  misc_feature (1)...(385): n = A,T,C or G
gctgagtgcctggctgaagagctcatcaacgccgccaagggttcctccaactcctatgccatcaagaagaaagncnaactccancgtgtttccaaatccaaacgggtaantggggaatttgggggtaatccccgtttggncctggttttgcgtgtactggagtggacggggggtttattaggattcagtcgatttgcatgcatctgcgcgactgtacatacctgaaaacagtcacgggagggagcgagatcctaaaaatgagagaatcggacggctttcttctacagtagttgagatgcgatcatgaagacctctggcttgtgaagtcaatacctttatctatttttttacacgaaaaagatttccctgtttcaaaaaaaaaaaa

SEQ ID NO: 4034 - DNA, 188 bp, Aspergillus niger
ctgcgcgatgcgaagctgtatgaaattggggctggaacgagtgagattaggcgcatggtgattgggcgtgcgtttaatcgggaatttgcatagatcccatccatgcccttaatccgttgatcttatgaggatatgttacatataccagcaagtcctacctgctttatctgactgaccatttatggatt

SEQ ID NO: 4035 - DNA, 385 bp, Aspergillus niger
  misc_feature (1)...(385): n = A,T,C or G
cccaagcccgctaagtgcgtcaagaggattcttcggaaaccagcatttcaaaaaatgtaatgagtggcttgctgaacgttatggtgccgacgaagtcattgactggtcattgacttcgaagagcaaaaccagctctccttttgccaccattcaaagccccgctctcactggtgccccgaataagcctatcgctaaagggtcagatgctagtttggaggaagaggtctccaggacaacagagcctgccaagtccaccgaggccgttgacgagtttgaagacgatctcgatgcgctggaagccctagcagcagcagaagcgaccagatagttgctaatactgagtacattgtaagaattccaggtctctttccttcanaaaaaanaa

SEQ ID NO: 4036 - DNA, 273 bp, Aspergillus niger
ggccgcttttttttttttttttggcaaacttcagttgcagtatacatgtgtttttaaaaacaactgcctgtcaacccctccatcccctttcataaaatctacataaaatgcaacccgtaattctaagagttttgactcaatgagtcacgctagcgtaagtgtatcaatgcaaaatcaatcgggtatttagaggcgggacttgaggttggccttgagtctgcgctcaacggcagccaggtactcgcgggtagtaacccaggcctcacgctcctt

SEQ ID NO: 4037 - DNA, 438 bp, Aspergillus niger
tggagttcgttacggggaggatggagtcttggctcttcgctaatgcagagaagaagggtcttggactgcagatccggaaattagaggctatttatgcggagaagaggaagcggttggagaagtgttagttcaaaatgcttctttaatccttttctttcctttgtggctcattcacttcctttttcttttccctacctttgttctttctacaatgctccactctttgttctttcactaataatccctcccctttcgacgatgcacgtgacacgtacgcactttataccccctcatgtcttttccttgttttagtcgcagcgttggcgtttgggttgttgtttcatatttacatatgtacttatttccttgttctttgtctgttatttatagtggcctttggtctgaatacatactgtagttgcatamattgcacgtcat

SEQ ID NO: 4038 - DNA, 558 bp, Aspergillus niger
  misc_feature (1)...(558): n = A,T,C or G
ccgatgaattggaacggctgggtggtagctgtgctattctcaccctacgaattccccgtgacgggtgctaatctaaactacgccccgatcatcatggccggtgtgaccatcttcgccctaatctcttacttcgtcacccccgaaagcgcctggttgcctattgaccgcatctcgcatttcatcgacagtaagggtgctgatgtgcacgaatccgttgaggaagttggtagtggtgataatcatcgtcagcctgaggcgacaacgtcttcctcagggagggaggagaactgagactatcatcacgaggcgtgcctcgcagtaatttttctgttgtattttacggttggtggttgtcgttgtgatgctgcttttgcggttggtgatccggttgagatggtcgctgactgatggatcgaggggaggaaggcaggaaagactgaactgctgcaccttccttcctgaatgnatggatgaaaagttgcttggatgaatatatgaactaaaaggatttgtgggttaggataccagagataatggattntttcaatgaaaaaaaaa

SEQ ID NO: 4039 - DNA, 636 bp, Aspergillus niger
  misc_feature (1)...(636): n = A,T,C or G
atccttgcaggcaattaattgacaactgcaagtccattcgttcattgcatctatcgcgagcaaaacaccaatacttctgtctctactatgacctctgtctaacaaacaccatcaccgacccaacatcacccgcccaaacctacactcacgacatcaccctttaccaagacacacacacacacacacacacacacacacacacacacgccacagccagatagaagcataacaaaaccaaaatggtcaactggctcaccctcgccgttcccttcgcctacctcggcgtcctcctcggctccctcgcaaccttctcctccctctaccgcaagcgcaaagcccgcaagtccctctccctggaaccctggttcccgccacacacgcaacgcgacatctacttctccctcctacacctcgacccctccgctagcaatgacaacaaaggcaccggcaagaaaccgccctcctccgtgcccgacagtgtcctgaaatccgctctcctgcgtcgcgccatcgaagacattaaacgcgtcatgggcctgcgcaagcagaanggcgccctcgcgaatgctcctccancgcggtantgtccggggatgatttgtggnaaaggttctgcgttgccgagaaagaaatggg

SEQ ID NO: 4040 - DNA, 719 bp, Aspergillus niger
  misc_feature (1)...(719): n = A,T,C or G
agcatacatagatacacacataccctttctactcaccttctgccctgcttcatttaagatgcctgcagccggccccatggacgaccaatgggtctctttccacatccgggaccacctggagaagggcgagatcaccgtccgacacaccgtcatcgaaggtggtgaattccacgaccccaacaaccgcagacagtccctcaccgaagacgagatcgatgaaatcaccatcccctcgtacggcatcggtgagatctgtgctcgtggtcgccgcggcagcgagggccggctggacctcttccacgacgaggaaaagatctgcgaattgcactgggataatcgccagggcaatcctgtcaacatcgtcgagatgctggacagtaatagcaagtatcgtgtcgaacatgggggatggagcccagaggctggacctctgggccacgtctacatcgacattttggagcagcagaagaagaagaatagcaaataacggcgtttgggattttaaggagttgtccggcgagttccggatgcagcartgctgcaggagagggcgttagcatattttgatctgtttctcttttgaaatcgactgattgtgtcgagtgtcgtataggagctggaaatcacatcatactcatagtcaacgcgaagtgaatattgttatttcaaagcttatgaanaaaacaanaatgacaancaaagnaaaaaagaaaattcct

SEQ ID NO: 4041 - DNA, 327 bp, Aspergillus niger
gcttcacgatgtaaccgatgaatcccatgatcaggaaaccagtaccgacagcctggctgatcttgatgaactcgcgcttgtcgggcttctggctgcggttgacgaactgcacgccttatggatgagcagactgcgatgacggcattgtagtctcgctcaacgcggaggccagccgttggaattggcatatgtgcataattagtctgggcaggcgttagggtgtgctgttaatatatccattgaactcatggcaagctattaaatcaacgcgctgttgggcaactatcaaagcctatagtgaattatatacccagtatctgtgtactc

SEQ ID NO: 4042 - DNA, 457 bp, Aspergillus niger
cggccctaagcagttcactgacaagaccactggtaccctgatgatgatgcccgctgaccttgccctgaccaaggacaaggccttccgcaagtacgtcgagctctatgctaaggacagcgacctcttcttcaaggacttctccaatgtgttcgtcaagctcctcgaacttggtgtccccttcaagactgaggaccgctatgtcttcaagacctctgagtagatattctcggggtctttgtgaatattctgggttcggtttgttttaggatttttgctgcggagcattgttttctcttgttcacattttgatatccgacatgttctcgatcgatgttcgacgaccatagcatgcgtcttagacaggcatgtcttgccgcggggcattaaaccatacaggggtggaaatgtctagatgattagattaataaaccatccttttgaagattcaaaaaaaaaa

SEQ ID NO: 4043 - DNA, 565 bp, Aspergillus niger
cagggactgaacgccggtcttgaggatattcctgttctcttttctttcatggaccagtatggcgtgtatgatgattccatcagtcccacccctgaagcccgcgcctctgcccgtgccgcagcattgcaagcatacaccaaccaacgcacagccgatacatgggcgatcaatgacctgtctaagcaaaattatcttgagatgcgctggggcgtcaagagtccggtttataagctgcgcaagatggtggaggagacgttggatcattatgtgccgagtctgggatggcagacacagtattctcgggtgagtttcagtaatcagaggtattccgaggtgatcgcgtctgtgaagagacaggggaagttgctaggtgtcgctgggctgagctcggtactggtgtcggtgatgattggagctggggtgttgatgaggtggccggagaggttgtcattgggagctgtgtggaggacagtgtttggaagaaattgagggaattgtaagtatttctcttttctgagattggtggtatgcgttataaaacagcgtgtgtaagtataaaaaaaaa

SEQ ID NO: 4044 - DNA, 544 bp, Aspergillus niger
ctagacacctactacacttttctctccaagtcaaatcctctgacagatctttctcgctaaagaggcaataaaagaagaactcatcgcttcttgaaccatggaccagctcaacagcaagcaagaaatcaacgacgccatcgcaaatcatgcgtccttcatcctgatgttcacggccgtgtggagtgacgtcggcaatgtaaccaaggaaaagtttgagagcattggtgccaaataccctaccgtgtacatggcctgggttagcaccgatgaccatcccgagctggctgaggaatgggggtacactgctattccggctaccgttggttataagaatggcaccaaggtggaatattacatcggtcctcaattagtggaccagcaggtcgaggcgtttatcaagaaggtggtctaacttggtgagggaaggtttgatcttctacttggtggttgccatttgttaactagacgatggatgccacgagtatatgtagctagactatactatcaaagagaaatatattagtcacgacgtgtaaaaaaaaaa

SEQ ID NO: 4045 - DNA, 461 bp, Aspergillus niger
tgggaaccgtgaagccagtgggtggtggatatctgtacgcactggctgcggacatccagaccatccccggattgccgacggcgcctggatacttgaatgtggatattgaccctgagaccggagagattgacggtctgttctagacggtagattcaacgtcatttagtgcttagatttgggactggttttactttcataatgtcatcgattactactgtttgatctagcatgatttcttggtcacgataaaaacgggaaaagggagaaaaagggaagggtttatttcaacatttggcggcaggacttatacagggccggtgttctcgggtcactgaaggagggtcaacttcaacaggattgcagtgtctctttctggcgatatacatacagactactatactagaagaggatccgatgtagaaattctactgtggagactatctcaatattgaaaaaaaaaa

SEQ ID NO: 4046 - DNA, 426 bp, Aspergillus niger
accacgatcattgactgccggcccccctctttctctcttcttagccgccgatgcgtttgtcatcgatcatcccattcactgatttatcatccccaaggtcgagactcgcttcgtcaactacatatctagtggcgcattccctggtaccagtacgattcatcagaactactgctcctactggtccatatcaccttgcgacatcactgcgatcaagccatcggaacatttttcctctccagcgcatttactcaccaccatcacttccatcgtcgcattccccaagactaagactactatcaaccatgtcttccgcaacgaccttctacgactttgagcctgtcgataaaaagggctcccccttccccctcatcgacctcaagggcaaagtcgtcctcgtcgtcaacaccgcctccaaatgctgcttta

SEQ ID NO: 4047 - DNA, 501 bp, Aspergillus niger
  misc_feature (1)...(501): n = A,T,C or G
ggagtggaggaggtgggaggtgtggtgaccgcgatgctcagcgctagatagacacaagcacattctgcaaaatggcctccatcgcgcgccagtcttctcccctcctccggtcggcgttccgcgctcccttcgcgactaagaatgtcgcgcaggtcgtggcttttcatgcttccgctaagaagcagatcttgcctcctttgcctcagactattcagggaacgatgaacgaccccgctcccatccccaagtctcaccctaccgagggtagctaccactggacttttgagagaatcgtctctgccggtctcgtccctctctgcatcgctcccttcgctgctggctccatgagccccgtcatggacgccgcatctgctccgctatcgcgtcactcgcacatttgggtttcacgccttcatcaccgactacttccctactngccgggtccccaagaccaaactttatgatctggttgttccggcgttaccttaagaacggntgtcg

SEQ ID NO: 4048 - DNA, 411 bp, Aspergillus niger
  misc_feature (1)...(411): n = A,T,C or G
tggagacaatttaccactttgtgacatctccgccaatgtcttggtcaagtcaacacaagaatgggcctcagccgccaggtctccctagtgaagcctgagcctgatcttctccttgtttttggttcgtttttaaagctggatggatacccgccttggcatatccgcctcactgaaatgtactgcaccggtggtaggaatagcgggataacgaattccgacgaggctgttgagtaccacgggttcctcaggggcctatggcactacgccggggctcagatgagattcggccgttgatggtaacttttttttctctctcgtgactgccaaagcgacccttggtatatactggagttcaattcgatctataattgaagaaagcggcactanctcggaattttatccaaaaaaaaa

SEQ ID NO: 4049 - DNA, 415 bp, Aspergillus niger
ccatcagactctagaaccaaatagagccagagccatgtcctaccarcagcaaccgcctccccagggatactaccctcctcctggtggccagtacccacctccccagcccatgcaatatgcgcctccccaacaagaamcctccaaagaccgtggttgcctgaccamctgtctcatcacaatgtgctgctgcttcctctgcgargaatggtgcgagtgctgcctcgaagccgccgaatgttgttgttgtggttgttagtatcgtgatgatggctttcctttgatttcttatgtgcaaggcgctgtgattgggattatacctggatcgaccgcacttgggtgaattctttttatactactgtctatattattttggtcattatcatgccaatcgatcatttgtcttcatgaatcaaaa

SEQ ID NO: 4050 - DNA, 579 bp, Aspergillus niger
aacgaattctgacaaccacctgacctttcatccataacctacctaccttattatccatccatctttcacctccccccaaaaagcaaaactataacccttaaccataaccatgctccgccaatccatcaccaagtcctctactacccgcctcctcaccaccaccactactcgttccttctctgctctcgctcccagaatgggtgctggcgataccggtgctccccggccgggcggttctcagcatgctgactcgttcaccaagcgcgaagccgccaggagaacttgtatgttcgcgagaaggagatggagaagctccgtgccctgaaggccaagctcagcgagcagcgcaagcaccttgatgagctggataagcacattgacgagttcaccaagaaccagggcggcgagcagaactagataactcatctctttctctttctctacttgtgtttcctatcatatggatgatgtgatgattcctacatacctacctacacctgsctattaactctactctatatcttcggaataccgacgaaatcgaacgatcaaccagacagatcagatccttttataaaa

SEQ ID NO: 4051 - DNA, 615 bp, Aspergillus niger
  misc_feature (1)...(615): n = A,T,C or G
aagagccttgggataccatctcgccctgttatcggcaaagtgttggccggtatcttccttgcgattagcatctttactttcacactgtactcgcctctggtctacggcaacccctggacacaggacgcttgcaacagtgtaaagctcatggacagctgggactttgactgccacacattctacactagccttgaccagtatgtgacccaaattgtggacacgcacgcggccatccccacgactcaggcatcggtacaacaagcaccccccgttgtgatggaacaaccaccgcagcagcaggtcccgcagcaggtccagcaacagaaccaggaagtcctgcaggaggaggcccaggaaccgggtgtcacgccccgggctcggcacactgccaaggcccgtgtggaataccgtgatcaacacggaaacgtgctggacgaagaacttgttgctcagttgaagaaggaaggtaaggtccagttcgagagccgtcatgagacgaagactcgcctggagaacggccgcattgtcgacatgatcgacggtcaaatcggcccgctnaccccgacgttgaangtcagaaccctgaaactgttggaaagacagccacctnangct

SEQ ID NO: 4052 - DNA, 392 bp, Aspergillus niger
  misc_feature (1)...(392): n = A,T,C or G
ggggtgagccggtattcggggcagggatagccgaaggaccgtcgagcaacgaggcaagatcaccatggcggcattgtatgctgtgcaggtcttctatagctttttcatcatgctgctcttcatgacgtacaacggatttgtcatgctcgcagttgctgttggtgcctttgtgggatatttggcgtttggagacaatacatctgccagcaaaacagttgcttgtcattagtgggccgcaagcacgaaggcttgccaggagtactggcggaaactcggcatattctcagtaatagcttcgttggatagctgtagtcgtcttgtcgtttgtaaacagcagcagttgcatactcgtccaatgaacatttatgcgttcacttgcaaaaaaaaaaaan

SEQ ID NO: 4053 - DNA, 629 bp, Aspergillus niger
cagcaacaaccacccacctcataaaatggcacccccaacaacatcaccccccaaaaccatcaagacatccctcctcctcctaagcgacacccacacgctgacccccctcccccccatccaccccaacaccagcacacccttccgccatccgctccccgccacggacctcctaatccacgccggcgacctcaccaaagtcgggcacaagcacgaacacctcacgacgctctcattcctaaaatccgcccgggcgccaatcaaactcatcatcccaggcaaccacgacatcacgctcgacgaaccatactacaagaaaatcggacactaccgccaccgctaccgcaccgaccatacagcgccgtcggccacaagcgggagcgataatgtgtccgcggggaagggaacgcccggaatggcgttaagtgatgatgaactaagggagatcaaggaactatatacggggaaagaagcttgggatgcggggatacggtaccttcgaggaagggacgcatgtgttcaggttacagaatggggccgtgctgagggtgtatgcgaagtccgtggacgccggagtttttgtcaatgggggtttggggtattccgcggcaggttggatcggtataatcctt

SEQ ID NO: 4054 - DNA, 589 bp, Aspergillus niger
  misc_feature (1)...(589): n = A,T,C or G
gaagactctcatttctaccagaacctaaactgcgccgacaggcattccttaccggaactaagaacgcataactactggtcgcgtccgaaagacttgcgactgtctccttattaaagatgtcttacaacaaacctgaccagcctcctccgtcctaccctcctccaacccacgacgccggtccctaccaccaaggcgcatcgcaagactactacaaccagggtggttaccctcaacaaggttacaaccagggatatccgccccagggctacggtcctccgccgcagcaaggatactatggttctcctccgcctcaaggccagccgatgtactatcccccgccgcagcagcaacaaggttactatgccggacaggaccggggcggatcctccgggggtggtatctgcgcgggtataatgggccgcattggcctgctgntgctgcttggatatcctggtctgagaaacgtgctgctttcagtgaccttttgattgcgtttggatttggtgcctggcgtctcttctcgtctanaatggatgcgattgactactactgatactggattggcattcttttggttgggcccaaggat

SEQ ID NO: 4055 - DNA, 566 bp, Aspergillus niger
gccacactctcggcacgttttctgtcgtgtccgctcatccaacacactgagccccggttcgaagggtcctgcacgatctcgatggagattctttagcagctgttgtcgctcccattccttctgcgtcatgtgcgctggcttctgctccgccttctcatcccgaacatgaagggctttgttgtagcggtcatcctcttcggtcaagaacccacccttcgtgtcggtgatcttggagaagtcgtattcaacgaatttggtaaagttgcgcgccggcttgatgccatctagggggcgattatctgtagaggccgcatcgcgcagagtcgccggaggatcggaggcagtcatggaggagtaggttcgcttgacacctttggtggacgaaggatcagcattgtgagctcgagcttgttcggcttcgcgttgttctcgtattgctatggctttctggcgattgttttcctggattcaatatcgtgtcagctccgaactagaggaaccgtgatcatagtatgtactattctccgcaattgctctggggttaacggattccgcttaaaaaaaaa

SEQ ID NO: 4056 - DNA, 647 bp, Aspergillus niger
ctcgcagaagttttcgaattctcttcgaagatgagagccaagtggagaaagaagcgcgtccgtcgcctcaagcgcaagagaagaaagatgagagctagatccaaataaattactcgcccactccatctcagctcttcatgtgaacgctcaagttgaacgctaaacatgacaattgcgacgacgtcacgatgatgattccagttatgatcgttacgtggttcggtatctcaatcgaggcctgtctggtctgccacaacattctcggtgcaatcgacttcggagcccgccgttcagcaggttgaaaagcgattttctccacatccaatccctcgggctcgttataacgttttcgatcttctcttgatttccttttgatccagacagtgggggtgcgagtgccgcatcttttccttcggaggtacgaatgtgtttggtggggttggaaggcacggtggaagagtcaaatggtctttctgtattcctgtactatcttactctttgccattgccgatgagcttttgcgtggggactggtcaatttctcgtgtcctgggttctgttggggaaatccgatggaattccgggccatggagaggtcatgagaatttattccaaataccaaaaagttacgacgcaaaaaaaaaaaat

SEQ ID NO: 4057 - DNA, 489 bp, Aspergillus niger
  misc_feature (1)...(489): n = A,T,C or G
agtcttgaacttgacgtcgctaatcttgttgctgtccttgtcgacgcggatctggagtttcatgacatcgccacaggccggggcgccgacgagtccgccatctcggattactacaccaagaaccctcgcaccgtgaagaccgatctgtccggcacgggtgcttctatcccggaagtgcaggtggaggttgagaagaccagcagcgcaactgcttaagtcttttctctagcttttacgaacgagtgaaaaatctgaaaaaccaaaaatatacggagcaaaaatggatacggatacggatacagataccatgattgattcccgattaagagtgctggagagaagagcaaagcagaatgatacaatggagatgagatgagttgcgatgtgaactgtatggatttggnctatggtggtgtggaatgaatggaatggnctgggtcgaatatgtgattcccccaaatatctggtgcttgcagcaaaaaaaaaaaa

SEQ ID NO: 4058 - DNA, 500 bp, Aspergillus niger
cttcccccctccgcatcggcgtcctcctcttccctggcttccaagccctcgacgtctttggccccctcgacgttctcaacgtcctctcctggtccccaaccaccactccccccgtcaccctctccctcctctccaccaccctctcccccatttcaaccctgcctcccaatttcccgcatgccctatcccaatccatcctgcctacagccactctctcctcctcgccccctctcgacgtcctcataatccccgggggttggggtactcgcgccccgctccccgaatacacagagtatattcggactgtctaccctactcttaagtacctgttgactgtgtgcacgggtgggaagttggctgcgagggcgggggttctggatgggaagagggcgactacgaataagaatgattgggagggcgtggtgagggatgcgccgggggtgcaagtgggtgaaggaggcgaggtgggttggtgataggagtgatgttgggggggatgg

SEQ ID NO: 4059 - DNA, 240 bp, Aspergillus niger
  misc_feature (1)...(240): n = A,T,C or G
gatgctcagctgggagtcgggctggacaacggcgaaaccaccagacaggaagattgccaacggaagcggcagcgagcaggatattgctgaggccaagattgagcttgaggtgctggagagcctgcaggccgtcctcaaatagatacctgatgtacatatccactcgcgacttcaactttgaacctgtagaattatagcaattctcatgaaacacttttttgcatgaaaaanaaaaaaaaa

SEQ ID NO: 4060 - DNA, 413 bp, Aspergillus niger
cccccttcaacgggggtttcttcacacatccgcaattcccaccggataacacagccggcctcgtcaccatcacaggggaaacgccgcccacgttacgctgggtcttcctcgacgtcaccacgcacgaggtgcgctggggtgggcgggccgagagcgagggccaggtgtgtgggccctttgactggacgaaggacgaatcccggattacgctggaggggtgggaggggtggttggcagtaaggtttccgggagtggatgaggagggggtttggaggttgtggtttgatcgggatgatgatggggctggattgaaggacttgggtgagaagggaatggaggtgcaggggttggaggtcgtattgaaaagggtttcggctgaatcttgattttatttacttacttaaaaaaaaaaa

SEQ ID NO: 4061 - DNA, 373 bp, Aspergillus niger
gcgggcagcggcttgattgagattcgtcgtatcgatgccagcaaggagatcgcgacgacgcttgccaacaaccccaacgtcacgtatctgcctggtaacgatggcaaggaaggcggaaagagcactagcctcttgctgggcttgagaaactagaaggcgctgtggcttggtgaatggaattacgtgtatttcttatttctcttttctttgttgttttccttcaaccggatggatctcaggcgtgcatgatctccgtggcgaattaatgtcgtttggtcttctttcttcatcacttcctctcttacacaccctctcgcacgcatgcactcctacacgcatgaacctgtagcaatatcatacccattcctctctc

SEQ ID NO: 4062 - DNA, 622 bp, Aspergillus niger
  misc_feature (1)...(622): n = A,T,C or G
cccaatctccctcaaaacctcctcaaaatggccaagaaagtcaagtcgcgcaccatcaccgtgcgcctcatctccatggccatgaccggcttctatcgcacgatgatccgtccccgtacgcaccgcccgctcagcatgctcaagtacgaccccgtcgtgaagaagaaggtcctgttcttggaggctacgaagggtggtcggaataaatagatcatctgaagttccggcacctttgtttttactcggtggctcgtttcgaatacctgcacggcgggacggtcgatatacatacatgcatgttgcttgggaacgatagtcgcgctgcgcttcgcttcttttccacggttactcgctacgagacgactgcgactttgcgggatgcagatacctataccgatactgccggcttgagcttcggaattagccatcactggatcattttttttatcgatatgagacgatcatgtacattagacggtgcagtggtgaggatggtcgtgggagctgtgccataacgacaggcttctgtggacgttcgagctgtgtatctttttcggtggtatattgtggcgtttagagcaagacattttgggttgaatcaatcttcaattactatcaattn

SEQ ID NO: 4063 - DNA, 634 bp, Aspergillus niger
  misc_feature (1)...(634): n = A,T,C or G
ctttgcacctgtgccgtgcacggtcgagccattccttcattctttgaacatattgcctgactccgagtagtctagcatccactccttgcaagagcactttgagagaaccggtcttctcatactcaaaagttatacatacacaacacttctctccgaacaaaaccgaacaaaattcgcagaacacatacacaatggtctccttcaagtctcttctgaccgccaccaccctggccaccgccgttctggccatccctcatagtggccatggccatggcagccacaagcaccgttccactcatgtcgcctccaagcggacctcttcctccaagcgtggcgctgcctacaactctgcttccagcgttcacacgctgacttacggctcctccggcaacggtaccgtctcctgggcctacgactggaacatgtacgccgacggcaccctccccagtaacgtcgaatacgtgcccatgctgtggggcaacaagatgtttggaggctggttgaccgccatcgagactgcccttgatagcggtagcaattacatcatgggattcaacgagcccgactcctcctcccaaagctcgatgactgcttccganggcgccaagctcctacaagaattacatcactcctt

SEQ ID NO: 4064 - DNA, 583 bp, Aspergillus niger
  misc_feature (1)...(583): n = A,T,C or G
cttcctactctaccttaaactcttcactacttcatacatcaatcatcatggcctggggctgggaccaatccgacgacgctcaccgtcaggtgtacgagaacaagcacgagggtcacttgtcccacgagctcattgccggtgccgcttccttcgcgggcatgaaggcctgggaggaccaccagcgcaagcagggcaagaccgtcagccacgctttcgccaaggaggcccttgccgccgttgttggcgctgaggtcgacaagctcgccgagaccaagggcatggacgaagttgacaagatcaaggnccgcgagcacgccaagaagaacgctcancacatgtacgangagcactacgagcgccagcacgtgctcccgaattcgacccggccgcttcctcccctgaccgcttcnagggcgtcnggtggctggtaagaacctcttgttgtatgggaaacaactggattggactaccgcnggggtnacacgaaaatgntgtntggaatgaaacaatatgtcatggttgaaacccgataacggctccccggatgatctaacnataacnagnttccaatgantntttccaa

SEQ ID NO: 4065 - DNA, 466 bp, Aspergillus niger
  misc_feature (1)...(466): n = A,T,C or G
aatgggctccctaacaagaaaagaaagtggtcccaaaggggcaaagggtcaaaggacaaaggcccaacaacgccgtccgtcctccgaagaaagcaagtcgctgaagcgtctcaacaaggatgtccagtcctaccgtctgatcactgtcgccactctgggtcgaccgtctcaagatcaacggcaagcttgggcccgccaagtgccttgctgaccttgaggagaagggacaagatcaagaaggttgttggtcactccaagatgaacgtctacacccgcgccgtcaccgccgagtaaacgtatgacgctatgaatatttttcctcgcgcgtcgcatttttctttgtgcaacgatatgatatcactcgaatgaaaattcggaaagtanggctgggcgatttgatgggacatgtcatgttagaatatgactgactgggaattcaaccaaaatctgttccaaaaaaaaaaaa

SEQ ID NO: 4066 - DNA, 447 bp, Aspergillus niger
cctgtacatcgctcagctgcgccaaaacaccgtccctaacacgcccggatttcccaccatgcccaaggctcccttcgtgtcaacctcgattcctcaagaccagtactctgctgctgagaacgggcagatgtgcacaacccaatttgccactcccccgactgattccaaaaagcagtcggcgttccagcttcaaccacccccaattcgggtgcagcaggcatctccgcagccagagcagagtgaattcccaccaccacccgcaccagctccggttccaagtgcccctaaccagcacatgggcgcagcacccggcgaacgaacctatgaatctgtgcccattcccggtgcttattccggccccatgagtcctagttttccccacggagcccaccagtaaaaagccctgaccgtcacattgctggctcgacatgagtggataaatcgagg

SEQ ID NO: 4067 - DNA, 384 bp, Aspergillus niger
  misc_feature (1)...(384): n = A,T,C or G
ccatccgacacgccgcgcttagttgtcctgctgggtatgatgttttggatggtgggtcgagggtgccggtgggggttatggcgatgggagagtgggggagtgaggaggagttgattgcgttcgcgagggatggggagggtgttttggatgggactgctgctgctgatggtatggagcagagctcggggttgacggttcctcggggggaaagggcggcttgggaggatgttattgctaaagctggggagagaagatgagctcttaggtttcgatgtagtggtttatttcgggatttgtggtcactctaattagtcataccatagtgaccaggagtttataactctgacgattctaataataataatatgttcgattcnaaaaaaa

SEQ ID NO: 4068 - DNA, 568 bp, Aspergillus niger
  misc_feature (1)...(568): n = A,T,C or G
ctgccagtagtcatatgcttgtctcaaagattaagccatgcatgtctaagtataagcactttatactgtgaaactgcgaatggctcattaaatcagttatcgtttatttgatagtaccttactacatggatacctgtggtaattctagagctaatacatgctgaaaacctcgacttcggaaggggtgtatttattagataaaaaaccaatgcccttcggggctccttggtgaatcataataacttaacgaatcgcatggccttgcgccggcgatggttcattcaaatttctgcctatcaactttcgatggtaggatagtggcctaccatggtggcaacgggtaacggggaattagggttcgattcccgagagggagcctgagaaacgggtaccacatcaaggaagnagcaagcgcgcaatacccatcccgaacgggaggtagtgcataatntgatncgggctntttggtctcgaatggatgagacaactaatccttacaggacaattgaggcaagttgtgcagcggccgttcacatntttaagggccaattcgcctntaggggcggtt

SEQ ID NO: 4069 - DNA, 643 bp, Aspergillus niger
ctctacttcctactctaccttaaactcttcactacttcatacatcaatcatcatggcctggggctgggaccaatccgacgacgctcaccgtcaggtgtacgagaacaagcacgagggtcacttgtcccacgagctcattgccggtgccgcttccttcgcgggcatgaaggcctgggaggaccaccagcgcaagcagggcaagaccgtcagccacgctttcgccaaggaggcccttgccgccgttgttggcgctgaggtcgacaagctcgccgagaccaagggcatggacgaagttgacaagatcaaggcccgcgagcacgccaagaagaacgctcaccacatgtacgaggagcactacgagcgccagcacggtgctcccgagttcgaccccggccgcttccctccccctgaccgcttcgagggccgtcgtggtggctggtaagaagcctctttgtgtgtgatgggaaaccaactggatttgggacctatccgcgggggttgacacgaagatggatgtgtggaaatgaaacgaatatgatcatggattgagagcgctgatacacgggctctcctgcatgcattcttatctaataaaccaagatatccaaatgaagtatttatctcaaagcaaaaaaaaaaaatt

SEQ ID NO: 4070 - DNA, 630 bp, Aspergillus niger
  misc_feature (1)...(630): n = A,T,C or G
cacttgtggtcccagcttaagcttccccttcccacacaccctcccataagagttatcgtgaaccgtcggtccgtttccaagaccgtcaacccacctacgatcaggctctccagaaccagctcgatatcactgagcgcgagtatcgtcgtcgggtcaacaaccctacctacgacgttcctgcctcttcgtacgaccgccgctctcaggcttcggtagattccttctctggtcctcgccagcagtctagggacgtttcgtacgaccgccaattcaagcagtccgagtttgacgtctcgtacgaccgtgcttaccagcctaagcctgtcgactcgtacccccgcgacccttacagccgccgtcaacagaacgttgagccggttcccgagtctcccagcagctcgaactctgtaaaagttctcaagaccaagactgtcattgattcccctccttctcgcaagatgggttactacgacgacgacgttcgtttccgtgaaagcgtccgcgaggatgtccgtatcgttgaaccccgtgccggtgggaagctcctcgaacgccgagaccgtgccgattccctgcaattcatccgaattggngacatcctgatcttcaagggcgtccctggcaagtggt

SEQ ID NO: 4071 - DNA, 546 bp, Aspergillus niger
gctgcccccgctgaggctgctgccgctgaggagaagaaggaagaagagaaggaggagtccgacgaggacatgggcttcggtcttttcgactaagcgtcttcaaccgttcgggtttcctaatttttccttttctatctcgtttccttactacctccttttcgccccctcgcatttcttgtacctgatactacgcgaccgcacgaagaccaaaaagggaaaattaaaagaaagaatgaacggacaaggacatccggtgggactgggcgctctgctcgcatgataggctccgtcgtgaaaaagaaccagaagtgtgtctcttacgtagtactttctggggggggaaccgcgatgccgttgggattccggtttttcctgggggggcgaagagattcggcttcggctcctcttgtgtctctgatgttgtgtgtgcttgttgctactatgctatatggcgtgttctttcgagcttaggtgccccagctctcatgcaatgtctgtcatgcgaccatgagcaaaacctcgttcccactgttcccaaaaaaaaaa

SEQ ID NO: 4072 - DNA, 833 bp, Aspergillus niger
  misc_feature (1)...(833): n = A,T,C or G
ctacatctactacttttctccatacttcggtagtcttatctacttatcataccactactaccaaacctaaatctaccacactacatacatacatacaaaaccttccacacacacacactacaatccaacaaccacacaacacatactcaaaatgaaatacgctctctctaccatcctcctcaccaccctcctcgccactccctccctctccaccccggcgcccgacgtcgtcagcgacgccatcggagtcgcccaaacaatcgtctctggcggtgaatccgtggcaaccaacatcgccaacgacgcgacctccatcgcctcagacatcagaaccggcggcggcgcagcctactcctccctgacctccgacgccggggacgtggcctcgaacgccgaatcctggggcacgtccgtggcgtcgaatgcgcggtctgatgcgtcggccgcggcatcggatatcagatctaaggcgtcggatgtcgcctcagagattacctcgaaatgggagagcgcgacgaccttgacggggtcgaatggscagccgacgagtacggagacggttagtgggaagacgacgctgactgctagcacggcgagtgcgacgggtacgagtgctagtggatccagtgctagtgcgacgagttcgacgagtgagggcgcgggcgtggctatggcgacgcccggagttgggttggggctgggagttgcgggtgtcgcgggtgttttgggggttatggctgctttgtaaggggagtgagttggtgatgatggaagtgggggagattgtttgatgggtaatggatgggccatgattgataccaatgnatatgatg

SEQ ID NO: 4073 - DNA, 464 bp, Aspergillus niger
  misc_feature (1)...(464): n = A,T,C or G
gccacaccaaaccaaatggctcctcctcgccctctccagcggcgccttcgcagcccttaacggcctcttcgcaaagctaacaaccgacactgccaccaccaccttcgctgcacacctcatccacctcttcacctccgccaacaacatctccgacgcagaccttatatcctctcaccctatcctcatgctcctaatccgcggcctctgtttcggtctcaacatccttagcaacatcatcatgtgggcgttgttcacgcgcgccctgacggcggggtcctccaccacgaaggtgtcgattaccaataccgcggctaattttctggttacggctatgctaggcatgggggtctttggggagagggtcggcgggtggtggtgggttggggccgcgatgatgggaagtaggttgtgttattgttgggaggagggattagttattttctatgtgataggganggggttgg

SEQ ID NO: 4074 - DNA, 214 bp, Aspergillus niger
cggcgctcagggtttccccggcttgatccctccccagtcgacgctggttttcgaggttgagctgctcggcatcaactaaaccagctatactactatggtatagtatactggcttagtggcgggaaatatgaatgaataaaaacggcggctctttgtcgatttgatatactaactagatcaatacaatcgatcagtcgaagtaatcaatcagtag

SEQ ID NO: 4075 - DNA, 607 bp, Aspergillus niger
  misc_feature (1)...(607): n = A,T,C or G
acggaagccactcccaggcactggactgcttacggacccattagtcggtttggatacagaccaggaggcttggttgcggcagcatggcatcgatgcgaatcgccaagacattggagttatcgtcatcacgcaggaggatgaggagtactgggagaactttgtcgaggatgaagaggacgaggaccggtgggatagcgaggacgcagattcgaacgctgaaaataatcccgcaaatgactatccagatgaggaattgtcgtgggacgatgaagaggacgatccaacggctatctacaacaaataccggacctacgctcggtctgatgacgaggagttcgactttgacgactcagccagtgaggggcgccatcgtagtggattcgggtttcggtcgcacgtggattcagacggcgagagctggtgatcggagggattacggtgacacacgcacacagagggagacacgcacaagccatcaatcgggaagcaagtgagcanggaatgagggcatggctgaccgaacaatgaggcagcgagactaactcgggtggctgcgtctgcagaactcacgccttgtttgggttgaggaattcatcgtatgtatggg

SEQ ID NO: 4076 - DNA, 428 bp, Aspergillus niger
gaatcccctcatctaaccctcaccgtcaaaatggcattcgcttggaaagctgctggtctcacctacaaccgctacttgaccgttgccgctcgcgcggtccgcaggtctctcaaggacggtccccgtgctgctgctgagcgccgcggaaacatggacttgcgtttcgccaagtgggagaacggcaagcagggtgaagtcaagtccctcgccaaggccaacgatgaggctcttgctgctcaggccgagtcgaaataaataccccgtcccgaaagtgtgtgaaagaagtccggaagatgtattctggatgaaggatgtttgaggtctcgggtggaagccatgggcaggaatgggatagatctctgtagcatattggcccctttgatcaggtctaaatagaaaagaactatttcttcctgcaaaaaaaaaaa

SEQ ID NO: 4077 - DNA, 440 bp, Aspergillus niger
  misc_feature (1)...(440): n = A,T,C or G
ggcgatacttgactagcgacaagcacggcatcttgtccgccaatgcatcggctatttcgcagcacgagatatatacgattagtgagagtggggcggggggaggagggttctttgtctttgggaccgggacgggagcgtcttctgcttcgcaggggggtgatggcgtggatgataaggagaagaaggaaaagaagcagacgtatcttgttgcgcggactgttgcgtcgaanacgactgcttcggggacgaaggttgaaattcgtggggatgagactactcttgatgatggggaggaggatgggggagggacgaatattcgtgtgcgcatgcaggcgcgcttcaaaccgcgcatccaagcgagtaaggagatcaaggcgcgggagaagatcggnagaaagganttgnagggtattgtggggagacngntggatgatgatgaa

SEQ ID NO: 4078 - DNA, 401 bp, Aspergillus niger
  misc_feature (1)...(401): n = A,T,C or G
gctggacgtgaccaactggctcgatgagcaccctggtggagctaacgctctcttcaacttcatgggccgcgatgccacagaagagttcgcaatgctccacgacgacgaggtcatccccaagtacgctggtcacattgtgatcggccgtgtcaagggccagacccctagcctagagctgtaaaaaccccgtgaaaatttagaatcggagacatatacgttggagaagagaaagtaaccaggaagagatcacatacccattttctttatctatttacctgtttgttttgtcgagcatgttcatgtccacgtccttggtgatgatgagtangctcttttatccggagtcactatgtgtctagtatgtaagatacaatcctaagtcaattgttcttaagacaaaa

SEQ ID NO: 4079 - DNA, 350 bp, Aspergillus niger
cctccgcgtaccgggacttatgaccggtcgtcagcagttccagggacgctcaagtgccctcagcgctgcgaggatcaacgcccttgcttggcgcggcaacggttcctcaggagaagggatcgagatgtattcagcccacggcgacgggaccattcgcacatgggcctcacgggaacccgagggtgagccggatgatgaagccgccgaagccgaacgagcagaccgcaagcgcaagcgcgacattctcgacgaactctaccgaggatttataggctaagcatacgatcaagaaaatctacgaaggcaccaaatatagcacaatagtaaaaatcgtttcattcatctataat

SEQ ID NO: 4080 - DNA, 478 bp, Aspergillus niger
gtcctccacacttcactactacacttcagcaatcatgggttggttcgacagagacagcgacgagggtcgggcccacaaggagcttgagaactttgaggtcggcaccgaggtcaccgaggagcacaaggccaagttcagccaccaggtcatcggtggtgccgctgcctacgaggccatgaaggcctacgaggagcaccaggccaagaacggcaagcccgacaaccacgcccaggccaaggagatcctcgccggtcttgctggtgcctttatcgaccgcgagattgagtccaagggtcttgacttcgtcgaccgtgagcaggccaagtaccatgctcgcaagcagctcgaggaggcctccgccaggacttctaagcgattggaatatgaacgaggcacacctatctgtttatgatgtacggtagtgtgtatgacatgaaatagaaatataccacaatgaacaacacacaaaaaaaaaaaa

SEQ ID NO: 4081 - DNA, 389 bp, Aspergillus niger
agggtgtcaacgttctgcgctattcggccctcgttgccggtctcgtctatggtttctaccaccagtcttcgatcaccgccactgctaagcacgccgaggccgaacgtgaatatgcccgccaggagcgcctgatcgagcaggccaaggcagagtggaagaagaagacggcgcccaaggacacgcaaaacagcggagtcattacggatcccgaggacagccggtttgaccttgaggctttcctgaagatgaaggctggcgagaactagaatggaatcgaagtatacggcacgcagatgaagttgcagttatctctctaagagcccgtacctcttgaagagtcgtgtcattgcgagcgaaaggaatgattttctttttccactaaaaaaaaa

SEQ ID NO: 4082 - DNA, 472 bp, Aspergillus niger
  misc_feature (1)...(472): n = A,T,C or G
aagtcaaaaattgggctccctaaccaagaaaagaagttggtccaaagggggcaaagggtcaaagggacaaagggcccaagcacgccgtcgtcctcgaagaagcaggtcgctgagcgtctcaacaaggatgtccaagtcctaccgtctgatcactgtcgccactctgggtcgaccgtctcaagatcaacgggcagcttggcccgccagtgccttgctgaccttgaggagaagggacaagatcaagaaggttgttgggtcactccaagatgaacgtctacacccgcgccgtcaccgccgagtaaacgtatgacgctatgaatatttttcctcgcgcgtcgcatttttctttgtgcaacgatatgatatcactccgaatgaaaattcggaaagtanggctgggcgatttgatggacatgtcatgttaagaatatgactgactgggaattcaaccaaaatctgttccaaaaaaaaa

SEQ ID NO: 4083 - DNA, 593 bp, Aspergillus niger
  misc_feature (1)...(593): n = A,T,C or G
catccatccaccatgcacgccccctcgattagcgggatgcgtaccgccatgctgagcggacgcctcacctccaagacgctgggccccttcgcccaccccagcagctgcaccaacccgttgtatcaagcgctctctcagacccggaccgcaagcacctcctccatgcgagtccgcagcacacagaccctgaagcccaccacagctctgcgtccctcgacgacgacaacgcagctcccgagctctctggttctccgccgcgccaactcctctgccgccgccgctgccaagagcgaaaccgtccgtctcgactgggactcgttcttcaaactccgcgctagccgccgccggtactcgctcgcctcgtcgatcgtgagctccctgttcacacggtcattggtgtgaagttctctcgaccaagatctggagtcctcggggcgcagtcatgggtcttgatcgttgtgtgtgggtatgnaacggcggctncgtgcggcggttggntgtcgtccgtttgtagggaatgtgtttggggttggttancggganataacctgtgttaggggaaaaaaaggattctcgncgnattaaagttcgtg

SEQ ID NO: 4084 - DNA, 608 bp, Aspergillus niger
  misc_feature (1)...(608): n = A,T,C or G
ctcagtttggcgttcgaatcactctcgactgtgaggggcgcatgtacaatggctgaagtgaaccaagaagttgcgccgaaaaacgacgcaatatgcgaccggcagatcgccctagcttgtgtgctgctgattgcgctgctagcctggctcaccaccttttctatcagtgtcctcagacttgtcgaacgagttgcttcatgaagttgcagctctacagtatacctatccctcgcttcttcatttctctattatagtccctctggggcatttttatttcccccctttcaccacattaatacccaagttgcttttccggtagttcttttccttctnctttcttggctacccctttcaacatcttttcaatttcttcgcattcccccnggtacttttacttggcgctatatccttgcttcgtgaagcttgcttaattatggagtttggggcttttgnggtggtcnggttggagtctnaaacattgggtcgggaangggaaaatctgattcttttttttggataccgaccctgggcntttccgagaagaacatttgtcctttgagacttttggnaaanatccccggccgttttntcgttcgaaaaaaaaaaaa

SEQ ID NO: 4085 - DNA, 255 bp, Aspergillus niger
ctccgtatcgaggaggagctcggtgacaacgccgtctacgccggcgagaagttccgcaccgccgttaacttgtaaatgcagccatttcccgtataatgtcaccagtgcaaggccctagcggtcctcactagcctttccgagcagctgcagaacagcatcgtttggatgaaactaggcggcgaaaacatcagagatgattaagatttatgatgacgaattcaaaggccaaataattgaatttagtggcacataatg

SEQ ID NO: 4086 - DNA, 183 bp, Aspergillus niger
  misc_feature (1)...(183): n = A,T,C or G
caagcccgtcnnccacaagaaggccaagacaccaagaagatggtccttcgtcttgagtgcaactggcttgcaagaccaagaaagcaagctttctctganaggcgctgcaaagcacntcgaagcttggtgggtgacaaggaaggaccaangggtgctggctccttgtncttccaanaatttgcc

SEQ ID NO: 4087 - DNA, 358 bp, Aspergillus niger
caaggctggccactacgaacgcaaggtgcaggctctcgaagcgtctcgtgaccagtgggagagcaagtacgaggagatggcgaagaaatacgccgagttgcagaaggatctgcacgacctcgaggtctccatcagcaatgtttaaaaaggagatggcgccgaggcccggaagatgctggattcagccttttcccaaatatacttttaccttgctttctttcctgcacatcacagtctgatctatatgttatgtctgcagggagacggattttagctgtatctttttcgtcttgtcatctagctggcttcatccgcatcatcaaccggtctctccgcttgtccccgtgaaaaaaaaaaa

SEQ ID NO: 4088 - DNA, 585 bp, Aspergillus niger
  misc_feature (1)...(585): n = A,T,C or G
ggagtatcaagcgacaagatggcatccaagaaggacatgcggaggttggacctcgccatcccctacatcgaccctcccaagaacaaagatgagcccgacatgtctagcgccatgtccagcaccatgcctatggctgcgatgttcaccaggaatagaatgatcggatgggtctccttcgttttctcgcttcagtcctggcttggtgagactccagaccagaagagaacagcttcgactccggcctacatgtccgtcttgatgtccttgatggctttggtggttacctacttccccatcttcctgcctccccagaatgcgcgcgctgccccgggcgctactgcatccactactccntccccttaagcgacaaccgattctgtgatacattgccgacgagtttcgatacaatatantaccaccaagtcttcagttcgcataaaaaagagatagggttggaantggtttgacgtggcaaatgaggagagacacgatcagttagtcaaagcctttggcatcgtctcaatttttgtcaggcaaacgtgagctgttgacattatatcattgcatatacattttactaaaaag

SEQ ID NO: 4089 - DNA, 486 bp, Aspergillus niger
ctgccccgagactgccactgccactgccgacgtcaagcccacctccgtccctgtggtcggtggcaacaagcccaccagcttcgtcgttgctccctctgcctccggctctgccagcctcatccgcagctctgccactccctccggcactcctgctgccagcagctcctccgtctctcccgttttcaccggtgctgctgaccgcaacgccatcagcctcggcgccgtcgccgtcggtgtcgctgccgtccttgctttctaaatggggcagccatccggcattcttaggaatttgtaaagtgatggaggttgtacctagctgagacagttgtatgtacaagaacgcgcaagcgcgagagagtgtgttgagattattcatgtttgcagcgattcgattcgattcgtcgactctttacttatgacaatatacccccatagttaatgagcaagggtaataataagagcattgtattataccaaaaaaaaaaa

SEQ ID NO: 4090 - DNA, 620 bp, Aspergillus niger
  misc_feature (1)...(620): n = A,T,C or G
tcaacctcgggttctacaagtaccatgcaacacctaagaagtgcgactacggcaattatctcttctggggagtcctttgctcgagaacatacaaccgcactagcctttggtagtacgggatttgccctcgctacggcacctattgctggccctgcaatattaggtgctgccggttttggcgctacagggcctgttgcggcttcatttgctgcagtatggcaatcttcaatcggggcagttcaagctgggagtctgtttgccacattacaaagtgctgcgatgggaggtgctgctgcgggagcatttacaacagcttcgaatattggtatcgcgatggtgggatccgtggcgatcggaacacagtggaattattacaaggcagtaccacggatgggctatgatgtcaaaagtactggtaaagctggatactgtgatagcgatcagccagatgatggatttgatcacagggcaagtaacccacagtcttgtgataaaattaattgtttggaaaaggaatgggcaaaattgcttcagatagacctatcttgattgaatatgccaaacgtcgtacaccanggttacttgcaagangaaacccgttcaaatacttatcatagccn

SEQ ID NO: 4091 - DNA, 378 bp, Aspergillus niger
  misc_feature (1)...(378): n = A,T,C or G
gatgccaccaccaatctcaccggcctggaaaaggaacacccactgtatcctgccgtgctggaccgggtgcgcaaggtgcagcaggggacgaagtaaaggcactgctgctgtcgcaaactgtctttctttaatgttcacgattacgattacgaaaactgcgaaagcattccgagtcgatcacctgcatgtacaactggccacgccgcaggacggtgacaggccatttgggatacggcgaacactggtcggcgcggatatggagcatgggtatggaaacggattagcatagtcataacatgataattatgtacatagttgcaggcaactagcacgaatacatgactggaacatgaatctattctgntcaaaaaaaaaaaa

SEQ ID NO: 4092 - DNA, 612 bp, Aspergillus niger
  misc_feature (1)...(612): n = A,T,C or G
ctgcaggtgctacttaatcgtcaccttgtctgcaatcacaaagcttcatcccgaccccatataatgccctatctgctattctttgcgctccttccccgcctcattactgctggctcagtatccaaggagcagttagaccccgttcgtcggaatagttatcccatcactccagccgtggacgagtcgctcctggccatccagatcggaggcattgtcggtgcatacgtgatcttcgttgcctacttctttcgctgcttctcttcgtgggccgccgtctgcgacgagctgtcctctcctccaactactcccttcacgtcgagatgatgaagcccatgaagccccctcccagcatggaccccagtcccgtcaccccgatctccatcaacctgcccagcccgggccctcgaagcttcagccggtcctggagcagcctcggcaagggcctcgttccacgcctcagggaccaccaccagcgtcgncacgatcgacgaatccgtcgtagcaactgaccggcagcgagcccaagaggatctggaaatgctttacgccgccgtgatggagcacgacgcccagaaggaagctgccgncgnagccggggtgccaacaaggact

SEQ ID NO: 4093 - DNA, 439 bp, Aspergillus niger
  misc_feature (1)...(439): n = A,T,C or G
acgcgtccccccatcacggtccgaatcatccgcttcgtcgagaacatctacctcttccttggactgtactttgtcagcctattctcgctggntccctacaccgcggcacagaactcccgattcaacgttactcggtcaggaaagacccccgatacccgtgctcgctggggcagtggaggcggaggtggaggcggatcatggggtccaggaggtggtggtgggccgggaggacctggtaggagaatcggtcgggtagatgatatccgtggcccggaatgtaagagctgtggttaatgctgggaatgtgatactgaagagggacttggaaaacaatatatggtggactgaatggatgggagtttgatagggcgctttattgattgtattagggactgaacaacggaatggacttgtgaatggttttcttatgaaaaaaaaa

SEQ ID NO: 4094 - DNA, 191 bp, Aspergillus niger
gaagacatggcggaacgatcggcaaagtccacttatttggactcgtcgaagacgtaggtgaggtggcactttccgcagtactggcggtagcgcctagcaatgtcggtcgtgaatgtgtggtggatgaggttgggacgtgtgcgctttgatcgtcccatagtgaccaagcaatgagaaacgaaaaaaattcg

SEQ ID NO: 4095 - DNA, 577 bp, Aspergillus niger
  misc_feature (1)...(577): n = A,T,C or G
gatgatcagtgcaccggtgatggctcgggtggtagcagcggcgatggcgatggcagtgacagtggctacaaccaaggcgatgctggtaccagctcatccggtacaaccaaggctagcgccgttggtatcggatgtggtgctgtggccggtgctgcagcatatggtgctggtatgttctgggttgcgcgtcggtaccggaagaagcgccagctgcaccagcgctccccctcgagcgtcgaccagatgagcgaaggccgcggggccgggtccgtcctcggcgcgggtggccgtctctctcgcaacagtcaaaacagccggggcactggccgcactcagatgatcagtgcaccggtgatggccgaaaattcgctcggctggaactaagcccatcagtatttcacctataaacaatggatcgtgtactttgttcaataactagacagggccaaaatataagccagagccatgacgcaacgctctagagaagcttgttgggggctttgagcccctaatctgtgtggaatacataccaaagcgttgntgatgttgncatttgttcccaactgtaaaaaaaaaa

SEQ ID NO: 4096 - DNA, 597 bp, Aspergillus niger
  misc_feature (1)...(597): n = A,T,C or G
gatcgatatagatcgccctccatcgcccctcgttggtagttgggtgtgttcctttcgcttggttttcatttcctaaggttgttgtcgcgcttctctacacttggtcggagcggctccatcgctgatactccaacttcgcctcctactacctaccacctctcgtcccctcctctcattccgcagccggtctgttgctcccctcatcggcgcatcctaccattgcactgattcaggtattcccaaaagaggcgcattctccaacggaactctacacaacaccttgnttcgaccaagaacaccggaatagcacccgtgacttcgnatttgactgaagggaggaaccaaagggaaagaaaggaaatttgcaaggagatggcatccttcatacaaccatcaacgctcggacccgggcttccttcaagccgnggcggaagccaaggcaccactagctataactgagacagntcgcggaagcgaccttgggaagtggaagcttacggaaggncgngaagtttcanaaggcgaggatcttaatgagnggcttgcaagtaaagggggccgattttataaccagatcaacttgnttctatgggcgan

SEQ ID NO: 4097 - DNA, 391 bp, Aspergillus niger
gcctcattcaaaatgtacgctgctaccgccctccgcgccagaatggccacctccctcgttgcccgtcgtggcttttccaccacccgcgctcagctcggtagcccttaccactacgccgagggccctcgctccaacattcccttcaaccccctgaccaagtacttcttctggagatactgggccttcatggttaccggtttcggtgcccccttcgccattgctgtctggcagacctacaagacccgctaaacgctctctcgtgctgtatttccacatgcaatggcattgttgggcattggcagttggtcgaaaatgtatcctacgttggaagcgctcggaaattgtgtataaagctagagaattaattatgctctgattcaaaaaaaaaaaa

SEQ ID NO: 4098 - DNA, 432 bp, Aspergillus niger
tataggactctcaacttcatcactactattacagacgcagtagttctatatcgtttggctttgcgcacacaaggcagacagtcatggctcaaacacctcagcaaaggaaggccaacgaaaggtttgcgaagcaggaatctgcaaagcgtggtaaaggcaagacagttgccaagtcaaagcagactccaaggtcgccagtgtccactgtgtgggtggctattctcgcgttcgttgtctgtggaggaatcttccttgagattctggggatcataccgaagctttggtcaacgatggtcgcaagcatcaaccgctaatgctctgaggctatggagacttgtaagactgttttcagttgctttcaaaacagcggcggtgataccattgatgtacccaactgatatccaagtctcttgtttggttccgaaaaaaaaa

SEQ ID NO: 4099 - DNA, 486 bp, Aspergillus niger
caagttctcaagcgaaagcaaaaccaatctcaaactacattagtacatctttcaccggttccataccaacttttgccaaaatgtctccctgctcctgcaactgctgctctggcaactgctccagctgctcctgctcctcttgcagccattaaatgctgtcgatgctcacttcccggccatgaccttacaaccgcccctcagccatctctgccgataccaccaatttcaggctgcgtctctggcttgaaggcaacattctaaggatattgggatggtgaatttggaaatttgggtgcgcaagtgggagtgatttggatgccttgatgatatggattcatgattttagttgtcttttctatcatgtcacctacacttaagcctcaggtgtaccaaatctaatggaaaagacttaattggaggawamaattgatccgcagtaaataggttaaacatatatagagttattataaccgcaaaaaaaaaaaa

SEQ ID NO: 4100 - DNA, 610 bp, Aspergillus niger
  misc_feature (1)...(610): n = A,T,C or G
agaaagagacgctacggcctgcagctcagtctctgaaccggtccatgtcggagcaaccaccgactttggctaaagcagaggacgatgcagaagatgtttacgacgcatggggtgcaatggacgatgatgaagacgagcagcaagcggacgaggatccattcagtgcgacagcaactagcagtccgaccgtttctgctcctgctcctgctcctgctcctaaaacagccccggtcccgtacgatgatggcggcgagccagactttgcgggttggctggccgcccagtccaagacaaagaagccattgccaaaggggttgaataaatccagtcccacctctgtatctcggccatcgagccgcagtagcacggttaagcccaggaccgttgtcgcaccagcgaagaagatcgatacaacacctaaggacactgaggaggacgacggttggggtgatgcttgggattagcagtataaattcttaatacccgattctttatgttcatcagggtacatattcccttgcgctatattgtgattatatctctcatcttgcgacatatncaaggcatgaaggcaggggaattttgggcgccatgcagtatatagtctggt

SEQ ID NO: 4101 - DNA, 1157 bp, Aspergillus niger
gacgaaccagtctgtcagtggaactgagcttctctttgcgcgtcgcccaataaactactagctgccctactatctcactttcttcccatctctatacactttcagtccagtcaatcgcagccatgttctccagtactgtggcccgtccactacagctggtcactcggttcatgcagtgggccagtgcagtcatcgtgatgggtatcacctcctacttcatccacaagggacctcgcggccaacacaccatctactgggaagtcatttcgaccatgtctgttgtcttcttcctgcccgcctttatctcgccgttcatgcccaatgccctgagcaagtttgtcttgatcatcgatgtcatcttctcgtacctctggctcacggctttcatctttgccgcgcaagattacaactggcacaactgcggcgccaactctccccccggcctatcctgctccaagaagaaggcaatgaagccttcatcttcctgaccttcatcttcaycttcttcgcatcttcctcgaagtcggtgctctctgggcctacgtcgcgagagcaacccaagtccgggagaaagaacamcggtggcgcccacggcggtcctgctgacgcgcctgtggccacagcctagacttgaaactcgactgccagataatccgtctcgactaatggcggcgacgcatgccaacgcattctcttgtgcgttcatgtaccggtctgcatgtacatcacgcacaagcgatagctgtcgtccgtctccagcgagatgatgattcgatacccttttccgtctctctctacgaccacgataccacagttgacttggctttgattgaacatctactaatactgatgatgttaatacgtttgatatccctacatactaatgtccattcgttaatgtccgtacgacttgaacacgcttgaacgacctgaagaaggagaagaggaataggtggtgggtgtgcatagatggatcggggtggtgaccgggatcgttgctgttactaataccatctttactaattaccactataatcttgtcttgtcattctttacacaactgatttgattctgttctattggatctaccccgtgctgtgctgcgtctgggttatccaatgtgtaataatagtacaataataatatatggtctgtct

SEQ ID NO: 4102 - DNA, 363 bp, Aspergillus niger
tattcttccaattactggattcagtcccggacgtggcacatatggcaatatgggatctaagccaatcactgacccttccgcacgcctcaggcatctggcacagggatcgtggagagctttcgacgtgaaagttgagtatggcaaattctgccggactgtcctgggaatgtgtcgcgattggtcaaaagtgcctactgttgttgttcaatgatttggagtgtctttttgaaattttttttcaccatcacttctcgttgacacattcatggcgttcttggggttggggggatcaggataactagcgagtatagtatcataaacggcatataagatacccaatcagacattcaccaaaaaaaaaaa

SEQ ID NO: 4103 - DNA, 529 bp, Aspergillus niger
cagacttcaagtgcagctgccgtcatcctttgctggagcaattgtcgttgccggacgtgcttctttagacccagtcaatatggttttctctcagactctccgccgcgccgccgcccagagcgccggtgcttaccgctcccctttcgctcccaagtaccacaccccccttcacttccacggsctcaccaccggcctggctactaagtacgctaccattgctggcaccttcggtgttgccgccggtaccttcgccctcttcttcttcggcgagatcccccgtgtccgccgcgacatcctccagaaggttcctttcctcgatgagtacttcgaccgcacgatcgctcccgaggacaaccccttctaaatctgtgccgtatgggatatgcttttccgaccatctataagaacccacccagcatggatatgctacctagcggatggatggtgaagaaaagagggtgctgtacgtgtagaatagcgatgagtttctgatagcacatagacactggctgcttcatttcaaaaaaaa

SEQ ID NO: 4104 - DNA, 381 bp, Aspergillus niger
ccggaaatactctcatccaccaccatgtcggggtttcatccacaaggccgaagatgctctacatcttcaccacaaggacaagggcgagcacaagcacgacgatagacatgagcatccccctactatcggtcatgatggccacgagcacacccaccgctcccacccccctcagaacaagcatacgcaccaccaccccaacgaggaccagatcgctcgagacgatttcaatgctgacagggaatacgaccgtgcgttgaagtctccgcaccatggccctggacttggctttgaggcgtaggaggtgggatcatcagtattgtgatgtttagttttgatgttctaatgatcataatgccatcttattgagtcttaaaaaaaaaa

SEQ ID NO: 4105 - DNA, 611 bp, Aspergillus niger
ctcctccaacgttaaggaactattcacagcaatcgcgaagaaactccctcttgatcaggcgggtcctcgaaacctgcgcacaactccccgtcctggtgttgacctgcggccagaagcacccggtacccaaggtgccggttcctgcaactgctaggctttccaagtggcgtgtactaactgttgtgtgtcgattcttcgatctaatccccctttcttcctttcctcctttcgcatggtctgttgttagatgcaggagacgtgtgtcttctagcttgaatgtgaaccggcacgctgggcaaacagtgtgcaacccgtcagcgacttcgaacaagactgttttatggctttctaatggtgccgtgattactgcaactttggccgatcggcgtcgtataggtgtctcttgcttcccaggggattcggttatccctacggatttgaacttgatgatcccgttcaatcttaatcaagtctttctcactggacttgatctgacaagacgaaacttttcaaataccgtcattggatgtggggagagagctttatactgtactggcacggttggatttgactgtctagacattatgcgacagggatgaacctatgatttc

SEQ ID NO: 4106 - DNA, 614 bp, Aspergillus niger
gcacatcaacacaacacaaccttatcacctacttacacctaccatctaacctccatccccctcaactcaacccaaccaacatccaaaatggtcttccgcttcgccaaaaccctcgacccgataaccctcttccactccccgcagctagcatctagcaaatccgccctcagcatcctgcaacgcgcatccacaacggcagccagcacgacatctactccgcgaggcgaattccaactcgaagtgagcacggccccgccgacgagcgaccagttgcggaatatacttgattatgtgtcgggtagtggtgcgggaggtggttcgggggtcgggaaggtgtataaggttgaagaggtggtgaggggggcgagggatgcggaggatgcgattaaacggttcaaagcggatccggagggatcttttgtgaaggccgattacggycgattggacgaaaggacargctgttgttggggataatgagtcggagattttgaasatkgtgcaggagttgaactgagcaatttactawtctgttcaartgtatactgcgaattgatgtatgcagggatgtttctacgatagctgtatcatacacaactccttttcataaaaaaaaa

SEQ ID NO: 4107 - DNA, 575 bp, Aspergillus niger
  misc_feature (1)...(575): n = A,T,C or G
gattatcacccggacggaccctctctctctccaactcttccttcttccttccacctcttacttgtcccccctcacgccttcgagactcctctcccctcgtctcctcaaactcctccctctttttcaaggatttctctacactccttggtttcgagccctctttgtttcgcctgttccataccccggtgtaaggttttctaggatcggattgccccgtctcgtccctccgaaaagttcttgtttcttctatattttccctcggcttctccccgtcgcccaactttcgcctttcgatttttttctctcttctagacacagatcacaatggtcaaggaaactaagttctacgacatcctgggggttccccgacggcctctgaggccaactcaagactgcctacaagaaggggccctgaataccaccctgacaagacacaacaccccgaagccgtgagaagttnanggaatgnctgccgttacnaaacctttcgatcccanaagcgtaaccttacgacaagttcgtgaggaggtcttgacatggcgnncttgcggtngattggcccccaggaccttttg

SEQ ID NO: 4108 - DNA, 387 bp, Aspergillus niger
cacaacaaccacaaccacaatgtccacaaccaccaaaacagccctcctcctcaccctcctcacctccatcggcggcataaccggctacctgcgcgcgcgctccctcccctccctgatcgccggcctctccgtctccttcctctacctcctctcgtacctccgtctgcgcgcgaaccagccctacggtgcagagatcggtctcttggcttcccttgtcctgggcggtgcgtcgatccccagagccattaagacggggaagggcgtgcccatgggtctgggggttttggcggttgtcggggcggtggtttttgggaatgcggttgttaatcattagatgatatatatggatggtggtgatgatatatggaggaggttgggggaggtgga

SEQ ID NO: 4109 - DNA, 859 bp, Aspergillus niger
atcagccacaatagtgggaattcaggcgcctgtctggggctagaaacggtgaaccgtcaaatcaccgttcatggtgcttcactccataccggggttgttgcattgcattcccctatcccaagaagcccccacgaaaatagcctacctactcttaccaggttgtcgacaatcaatcaatgaatgctcaagccactggcaaatgacctgaggccaagtgtatgatatccatgctcaggatctcttggtgactgcgaagagccgactccactgaggcataacgaggtatataaacccccccttcatcccctcttgccctccatcaacaaacccaaccacaaccacaaagcaatcaatctcattatacaaccacttttcctccattccctcataacctctttcacaactccatcacaatgagcttcttccgtaccgcctcagacatccgcgttgacgacggccacatcctggtcgccaacgtcgccaacgaggagggagagatggtcgaatctaccctcgatcttaactcgtgcatcggaaacgaagagggtcgcttcctgtggggcggcaacgacttcgccggcagcgccgaggacatcagcttcgccattgagggagaggacaacgtccccgttcttagagccagactccaaaactccgagggcgaactctttgatgctgatgttaacctgggcgagcacgtcaccaacaacaatggtaccctggagtaccaggaggagtcgctgttgtaagggcggggtgtattatcgagtgtatcatgacagacaagtaaccatgtcttgataagtttatgtggaactatatgaaataccatttcgtttgaacaagtaaaaaaaaaaaa

SEQ ID NO: 4110 - DNA, 558 bp, Aspergillus niger
  misc_feature (1)...(558): n = A,T,C or G
atagatacacacataccctttctactcaccttctgccctgcttcatttaagatgcctgcagccggccccatggacgaccaatgggtctctttccacatccgggaccacctggagaagggcgagatcaccgtccgacacaccgtcatcgaaggtggtgaattccacgaccccaacaaccgcagacagtccctcaccgaagacgagatcgatgaaatcaccatcccctcgtacggcatcggtgagatctgtgctcgtggtcgccgcggcagcgagggccggctggacctcttcacgacgaggaaaagatctgcgaattgcactgggataatcgccagggcaatncttgtcaacattcgtcgagatgcttgacaagtatagcaagtntcgtgtcgaacatgggggatggagcccaaaggttggacctttgggccacgtntacatcgacattttggagcagcagaagaagaagaatacaaataacggcgttgggattttaaaggagttgtccggcnagttccggatgcancattgttcaggaaaggcgtagcatatttggac

SEQ ID NO: 4111 - DNA, 628 bp, Aspergillus niger
cggctcttgaccctaccgccattggactctactgtcctccacctgcgacttttcagagtcattctttccttttagcgttttatctcctccagtggtcttcaagatgcccgccacggcgtcccgtgccgtgcttcggcaatcgcagttcctgacccgcaggtctgcggtcaggtacgcttcttcgacctccgaagccgcttccaaggctggtgagactgcttcctctgctgcctcgaaggcatctgagggtctttctcgcgtctcttcgacggctggtcccgccatcgccaacgccgcccagggtctcggtagcgccctcaggaaggtcggtggaaggaccggaaaagtcatcgcttttgtcgattccatgataccccctaccgtctactactcgaaggttggaatcgagcttgctaagctggtcttccgtggccagaacatgactcctcccaacatggccaccttcaggcttacttcagcctctgaccaacgccttccgtaaccctgccgccttcaagaactccagcttcgctccctcgaacatcatcgcccgcgttcgtaccggcaacaagaaggagatcgctcttgctggtgtcaccgctgcggagatcgttggtttcttcaccgc

SEQ ID NO: 4112 - DNA, 482 bp, Aspergillus niger
  misc_feature (1)...(482): n = A,T,C or G
ccccaatgaaccggctcaacaaactccccaaaaacccctgactctccacattgctgcgcttcgcccagcccgactcgacattatagttcttagtgtcttgaagcccagcgaaaaggccgcgtcctgccgtgggatgatgcttaggcggattcttcacccacagatcggctccaaagtcattctagagaccatgggtctttttgctggcacggtgccatctttgacgaaggacctggataagataggcactcgggtgggaatggcacttgccatgatcagcttcgggcccttgacgggaccttcggtggcgggcgctttgattgcgcagtctgagcatgatagttatttacccgcccaactctgggctggagctgctttgatggttggggcgttggctttagtgggggctcgaattgttatcactggtccgcatcttctaattaaggtttaaattgctgtgatggaatccaaaanaaaaaaaa

SEQ ID NO: 4113 - DNA, 580 bp, Aspergillus niger
  misc_feature (1)...(580): n = A,T,C or G
ggagaggccgaggagtatggtggtgatgcgcatatgggagatgccgatcggatcgtgcgcgaacgaagcttgagcaatgactcacatcggggcgggaagcacgttgtggtcggggctggcgagctgaacggcgaaaccgagtctggtggagatacgttgatgacggcgggcgaagccgaggaaaagcatcgccagttcgagcagcatcggaagaagcactatgagatgcggaacatcaaggatctccttgcccaccctgaggatctcgaggacgaaatggacgaagacgaagatgagggggacagctcaagtgccgcggtgccgcccccgatgcctaagatcccggagcgatttctaaatggaggaaagtgagggagcgaaaggaatggacggacgggactaagttatcactctactcgagaaggattaggacgagaagangtgataggaaaatangatggaggganggactagttgattcctgctgcataaacggactctgtatattccccaacgttgtttagtcatgatgggacngacttgtatgaatcnatgggaaantactttgcaaaaaaaaaaa

SEQ ID NO: 4114 - DNA, 583 bp, Aspergillus niger
ggagaacgttgttaagcctggaaagcttgtcgtcccggagaacttcactcaaacggcgcccgtctacgatcccgccgtacctctgacgactgaagagatgccaatggagtacaccaatcctcagaccaccgaattttgcgaattgattggtattgaaaataaattcgacatgagtgacgccgagcgccaggctagaatggctcgggggccccgtcctaatagcaacagaggcggcatgaaccgtcctcctcgtcgtggcggctttggacggggtcgcggacgcggtggtcgtggacgcggcaaccgttactgattttacgtctcttcacattgcacgttgcttatcaaaggtaccgcggatgaggaagtgctgggcacttgcctctagtcatctttcttttatcaagtcggccatgctacgttgctatctatcgaatttgtcatcatttcatttctcgctgccagttacgcccttaatctcttccatctgacatcctaatggaaatggagtccagctctacccatctcattaatgtctctcacaaagaaatggcaccatggaaagtcggcctctagttttgtc

SEQ ID NO: 4115 - DNA, 484 bp, Aspergillus niger
  misc_feature (1)...(484): n = A,T,C or G
attcgttttctcatcctcatcttcatcctcttcctcactcctctcctacctccaagggacaagacaaaccacaagaggtcaaacctacataccaacctccttcaattccaaccaccgaaaacacaatggccgactcttcctccccaggcaaccccacactcggcaaccgccgcaacaaccgcgccgaagaagaagccgccagtgctgccgctgctgtcctccccaacgaaggcatgaaggcccccggcgtgacggccaaccaggatgagaaatccaacctcaagatcagcatccatttgaacttgcgtgccaaggtgaagttggatttggatgcgcagttgtatggtgatatcgttattgggttgttgtaaccttattactttgacgtgtatgttggtatgagggtggggatgtatgtatggtacttgatggcatgcatgaagaattgatgaatggaatgaaatggatatatgaanaaaaaaaa

SEQ ID NO: 4116 - DNA, 628 bp, Aspergillus niger
  misc_feature (1)...(628): n = A,T,C or G
ctaacttactgtctaccatatactaccatacgccccctcatcaccccacaaggcagacagaggcaaccttgggccttacgacttacctaccttcctaatttcctctaggggctttaaaaccacacagcacactggctgttaatcctacctatctacatacgcactctcctctcctctcctcttttagttcctgcccattctcccacgcaagagagcacccaagcaggcaaataaaccttcactctcgttccacccgttctttctccatcccgcccatccaagccagccggaaatcacaaaaggtcaatcacccaaccccgttacttggtttgattttgcacttgcccagtattccttctccgataatgggacgtggctccttacccttccaaagagacataaggagaacacggaaaccagccttatctgactggttgagacgggctactaagctgactggattggttggttggggagtgagatgaggcgcgccgcttgatggttgatgctcggttgccttggagggtttatcggcggagaaaaatgagacgcctgagatatatatatggnattaatatctatatgtggagtaaggcggttatgggttgggtgggtganaaatgattan

SEQ ID NO: 4117 - DNA, 373 bp, Aspergillus niger
tgcggatgcgcgggagaagtcgggcacgggcaagttccccgtgtttgtgggcgaatgggcaatccaggcgacgtataataatacgttggcgttgaggaagaggaatgtgttggcggggttgaagacttggagcagtttttcgcaggggagttcgtattggacggcgaagtttacggggaatacgagtgtcgctggacagggggagcagaaggattattggtgttatgagacgtttattgacgaggggtatttcaattgagcaactgcaactctgcggttcagtttagttgcttgttttgtgtaggatttgcgatgtgtgtatatatgatggatggaatgaactcatgggtactattgatgactttttaaaaca

SEQ ID NO: 4118 - DNA, 490 bp, Aspergillus niger
  misc_feature (1)...(490): n = A,T,C or G
ggataactcctccttatctacccgtctgactccggcttaagtcagctcttcccatcttccaatcctcccattgtccgaaagagcacggaaaaaacaaacaaacaacccccaacaacaatcaccgccaatatgttcgactggttcaagtcttccaacaaggagtctgctacccagcagcccacctggaatcccaacaccatgaccatgcagcagccttccgccccggaagctcccgtcaccgagcaggtcgtcaccggccaacccggccagcaagagacgatgcagatgaacctgcgtggtggtggtgagggtgaggatgtttgctgtggcgtttgtgccggtcttggctgcttcgagtgctgcaaatgcttgtgctagatggaatcatcacccgatagacattttatntttccacgaaccntgacgtcatgtcnggtaatataattnggatatctatccaagttttaagccttggnattaaccnttgaag

SEQ ID NO: 4119 - DNA, 651 bp, Aspergillus niger
  misc_feature (1)...(651): n = A,T,C or G
agcaaagcaaagcaagctagcttctctcttcttctctctacatcatcgcattccaaaacctccacacaactctcaagtctatatcccacgacttccctcttacaaccaattacaacccaataatccacattcctcaaaaccaccttcaaaatgactatcccttatcccttgatcggccctgagtcctacggccttggctccaagcaggcgcgccgcaaccgcagcacttgcagcacccctcgcagcgttgacagcatcgtcgtcgatgccgctttcgccaaggaaatccagtccaccaacgcctcccaggagcatttggattcttgtgctagcagcaacaagtctgagaagaagtggaaggctcgattctcgaggaagttcttccacttcccttgagaaattaccacaccacacactacactacactacactacgaacaaaaacgacaaacataatcgacaataataatgatcgctggacggaatatagcaaagcaaagcaaagcaaagcaaagcaaagcatgggtgttagatggattgcatagtcgggagcattggattttttttgcatcatgtcatgattgktatggataatttagataatacttaattaatacccgcgggatatgcacgcttctaaaaaaaaaaaann

SEQ ID NO: 4120 - DNA, 599 bp, Aspergillus niger
aggagcgctggtcgctgggggagccggagcagctgctacagcagctacttctttcccgccagtgccacgggagcgtcgggctcttccgctaccactgccggctccaacgacgccagcaccacgaagagtggaagctcctcttcgtcgaccggctccaactctaactccaagtctggctcctccggaactagcaccgcaactggcgctcatgccagcagcaccgagaacgccgctgctgttgcgcagctcaagctgggcgtttcsgctgctggtgtacttggattcgtcctggctgcttgggctctgtaaatgagctaaataataagccttgatcgatgactacagtacgaatggaggaaggggagaaagctacctgtctactgcacacttaatccagcgcttgtgttaatatgattgattgattgattgattacgggaatttagctaatatgggaacttgtcacaactactattacctgtttatcttatcttactcatggggttaataactaacttgattgctactatttgcatggctttcacttgatactctggagattagtataccgaccaactaaattctattgattgatcattcg

SEQ ID NO: 4121 - DNA, 575 bp, Aspergillus niger
  misc_feature (1)...(575): n = A,T,C or G
cttatcaagccaaatcaactaaactgaacctcaaatcatcgctacaacattaccaaccatgaatatctcggcttctccctctggctcacagcccttcatcaagagacctgctctaagtcccgcgttcaagaagcctagtagatggtatctcccgctcatgggcgtcatagctctcggcttcggagtcgccaaccacctcgaaaaccaagctcgccagccccagttcgaccgcgaagaagaggagcgcctccgaaagaaccgagccctgatggacgcctacggcgacaaagaaacagtccaagatattgaacgggcgctggtcgtctatgaccttcagtgaacatccttgatggaaggggaccattattgcagcacacttagcgtgggatatgattacggctttcatgaataatggtgcataaggagtttgggattcattttaactctccggaagagatgaggaatggtttcgggattatggaattaactggggattttgctggtttaggtttcacggaatagcatcttgaattgagaagcaatctggnntattgcacttatgctactaaaaaaaa

SEQ ID NO: 4122 - DNA, 636 bp, Aspergillus niger
  misc_feature (1)...(636): n = A,T,C or G
agcaaagcaaagcaagctagcttctctcttcttctctctacatcatcgcattccaaaacctccacacaactctcaagtctatatcccacgacttccctcttacaaccaattacaacccaataatccacattcctcaaaaccaccttcaaaatgactatcccttatcccttgatcggccctgagtcctacggccttggctccaagcaggcgcgccgcaaccgcagcacttgcagcacccctcgcagcgttgacagcatcgtcgtcgatgccgctttcgccaaggaaatccagtccaccaacgcctcccaggagcatttggattcttgtgctagcagcaacaagtctgagaagaagtggaaggctcgattctcgaggaagttcttccacttcccttgagaaattaccacaccacacactacactacactacactacgaacaaaaacgacaaacataatcgacaataataatgatcgctgggacggaatatagcaaagcaaagcaaagcaaagcaaagcaaaagcatggggtgttaagatgggattgcatagtccgggaagcattggattttttttgcatcatgtcatgantgttatggntaaatttagataatacttaantaatacccgcngggatag

SEQ ID NO: 4123 - DNA, 557 bp, Aspergillus niger
  misc_feature (1)...(557): n = A,T,C or G
ccccaactcccacctcacttacttaccccctttcctttctctcctccaaccttcataagagaaaattaagttactaccaaaatgtccttccacaacagctgccaaaacatccacctcattcacgagcccggtgctactttcctgcacgccgaagtgcgtcgcgcgaatggagagtacgtggctcgcaagatccgtcttgatagacatatcgggaacacggatggctggttcatctggggcggctccaacttcaccgaaaccgccaaggacattcagctcgagaacaccggccgcggtcccaagttgacggcgtacttgaggaagcgggatggcggatacagagaattgcagggcctgtatctggcggataagattgctaatgagaatggagagttggtgtttaagggaccttagatatattcaacctagttatctatcgggtcgattggagaagtactagaagagatacctaataggaaaggatggatggatggggttgnttgkatgattggagatattgcatagcgaatgataatcattttttattaaaaaaaaaa

SEQ ID NO: 4124 - DNA, 472 bp, Aspergillus niger
ttgacgccctgtaaccccaggaggcgcggatgcggacttgcttgtgctggatgatgaagaggaccccttctcgggccccaccttgactgtgagacaagtctggaagcgcggagtcaagatctacgataccgacaaataagatgcggcggctttttggcctgctcacgcacgctgtctggacaagtcatgcgctgcagaaactgtctggttttcaatcattcatgcgttacgctcgaaatttctttctctctctctctctctctctatagcaggcttgggagttttggtttggtttctgcttttcgtttcttcttggctcgcgtcggtttagagacttgaatgggggtgggctctcttgggttctgttcgttacctctttctgtatttgggtcatttaaaccaccgggataaagtagacctcccacgtgaatagtaaatagaaagtcaatgatagatacacgtcaaaaaaaaa

SEQ ID NO: 4125 - DNA, 422 bp, Aspergillus niger
ctaatatccttataggaagtaacctgctatacatgccgcttcacgcaggatctacgcgaccgtcctgatatcacaccagatacaagaccccctccaggtgttgtaccgggtcaactaccgcaagcgtactatggcggcggtgcgcctttctatcccccgcagcaggcatcgggcccgcctccacaggcgtccgggggtgtggtagcgccgcagcagcaggcagagcagcagaaccatgtgtataagtgatgtatcatttcgatgctttttcgctgatgatgtattatgatgggttgatggtctgtctctgtatttatcgaataccttttgcttgtttgctgttcttgacgtctggtggttagcttactcgctatcgtgcatgtattgtatcgaatcggagttaattgctctaaaaaaaaaaa

SEQ ID NO: 4126 - DNA, 499 bp, Aspergillus niger
tcttagactcagaaggcccggggtaggaagaggatgatgagaccattgcgcgctttggggttcgttctctctggcgagcccggaagggatggggcttggttggccattcactggccgacaggtcttgaactttgaagtcatgctttggatctctcgtcgccctctttgtccctgttggccttttggtggcctcgttcgatgccgccagtggtctcggtctggtctcttacgtcctccgattgtcgcggggcttcctttcatatcttgatgatttcgatttttgcctattgtcgcaatttcccccaaagaatacctttcccttgtcatccacccgcacttccaccctagtcagtcaagtcccaccaggacgttgactcttgcttcccgaactctcttggttttacccaccttgtgccacgtacggcgtttgtttgtcgccttagctgagtttagatctaaagcccggcaatggctaaagaaatttgaaatttatgaacaa

SEQ ID NO: 4127 - DNA, 1030 bp, Aspergillus niger
gggctttgctgggtttttgttttcgttctattttcatccttgagtagttcgtttggctggtccaggcgactatctgttttcaacttcttgtttggcacgtcatcgagtaataatagtatcatttacacgcctgccttctcggaaacactctgttgatcaaagtgttcttccttgataatcttgtgctgctgctccctgcgcctgttctctacttatttcttccacccaaagaacaagacatctttttgcattcaatcatctttccaacccatcagtgtcagtcaatatgatcgctcgcaacgcaaggccgaagctttcactgtgcacatctgctgcgcaaagtacttctcgtcagccgttgtctctcaagtctcctagcgcgatcccgcgcactccgatttcccctgccagcccgagtgcaaagcggttctcgtcttttcaagtcccaagctatgcctacagcaactcgtgctcgtccaagagtattctcaagaaacattcgggcgcttcgagccatgcagaaaagcggattaagttcaaaggcactcccactgtccactgtgtcacgcccatcgagaatcccgaggagtactatggcacttacaccaagttgtcgcgcgaggagcgacgttggatggttcgtgaatgaagacgaggctgatgtcgctataaccaacactacggcgaaaggcagatcagtggggatgctgggccaraaatccgaagagccttctgacgcgccacggtttctgcgccctccccgttccgactcggttctgatacagccgatccggtatctggagcgcaacgacagctcagggtargtctgacggcgcgaaacatcgaatgtcctggagtgcagccgaaacactgggatggatgcatctggtggaatgaggatagactcagcgtgtatatgatacctgttatgttcatgatgtgatgatacggtccggcgttatgtacttagtatarggcctaccttgggctaaacccaacgacgatcgttatggctccaaaaaaaaaaaaa

SEQ ID NO: 4128 - DNA, 358 bp, Aspergillus niger
ccctggttgacgagagtggagggcaggtctctccgataatgcggctgtggagggagtcgctttcccccgacgtggaagcctgtaacgtatgggtagaaattggtacgaaattacttcgatatgatggctggggtgaaggataaggagagagtcatggcgaggctacggaaggattcaactaatctcaaaatgggcccctgggctttactgtcattcgaccacctgtattaccagagcaaggggggcacggctcaggaacacgtacgttcaaggctggatgaagtgttcattgcctcttatcttctatctgttggagagtttcttttagacttgccaaaagtttgtgttatcgttatcc

SEQ ID NO: 4129 - DNA, 194 bp, Aspergillus niger
cgatggactgaagaaggccttcgcccgtctaacccctgacgttgatgctctggacatcgctgccaccaagcttgccatcgtctagatacatttcatttagggtttgggtgaatttttattttgcgcggtggtccataaatatcagtcataaagttagctgccaatgcttgaatgagggctgaatgatcgtttcc

SEQ ID NO: 4130 - DNA, 579 bp, Aspergillus niger
  misc_feature (1)...(579): n = A,T,C or G
ggccagaataacattcacaatgaacacgatccgatctacatggataggctggggcaccctttgcgtcgctggcggcggagcctactactttgctaagaaatccatcaacgccgaccgtcagacccgattcgaagcggaagtgaagcgcaaggcgcagctggctgcgatggaagccgagcaccgacgccagaacgccccgaacaatgccccgactcctagtccgaccgaagatccgagcctgaagcgcgcccagttagtgcgtgccgatgatgtggcctcgccgagtgctgaagctagccatgaccccgcaccgactcgtcacgaaccggagacagaagctgagcgggtgctggagaagagtaaatatgaggctacgcagcctttccggcctccgaggggaaaccgcttgtangctgggaggtagtttgcacataagtatgtgangtggaggcggtgatggtaaaacaacaagggaaagaaaaggctatgttgtggcattttcatgtatcatagtgtggtgttccgaactgcaagggcttctacaagattaatataatatgacctgcnttgaataaaaaa

SEQ ID NO: 4131 - DNA, 508 bp, Aspergillus niger
cccatcttccaatcctcccattgtccgaaagagcacggaaaaaacaaacaaacaacccccaacaacaatcaccgccaatatgttcgactggttcaagtcttccaacaaggagtctgctacccagcagcccacctggaatcccaacaccatgaccatgcagcagccttccgccccggaagctcccgtcaccgagcaggtcgtcaccggccaacccggccagcaagagacgatgcagatgaacctgcgtggtggtggtgagggtgaggatgtttgctgtggcgtttgtgccggtcttgctgcttcgagtgctgcgaatgctgctgctagatggaatcatcacccggatagaccatcttatatataccacgaaccttgacgtccatgtactgktaatattattcgcatcatgcctataccatgtttttagccttgagactgaagcgatagaaggtccacgtcctggtcttcataaatcaatgtcacgataaccttttttgcaaaaaaaaaa

SEQ ID NO: 4132 - DNA, 459 bp, Aspergillus niger
ccgaggtgagcagcactgcttctgcaacgacctcgaccgagtccgcgaccacgactgccgcgaactatggcaactatggaaactacggcaactatggcaagtacgccagctacggctcgtacaagagggatggtgagccccaacccgaccaggacgctgagtcctcgaccacctctgctgcgagcacgactactactgccgcggcgggatatggaaactacggtaactacggtaactatggccagtacgcttcttacggcagttattaaaaagggagttgagtgcgtgatgacacaaggggacaagtgttacctgagcagaagtggagggtaacgctgctgggattgggagatcagtcatgatgatgtctaagaatgtgctttctgttgtatttattggcaattgactagttactagataagtataatgcagcgttgcttgaatcctaaaaaaaaaaaa

SEQ ID NO: 4133 - DNA, 202 bp, Aspergillus niger
cggttgggatcactctcccactccacggagtcatcgctctcaatgcggaacgtcgaccgcgacggtgactgacacctggcggtagacaatcaatccatttcgctatagttaaaggatggggatgagggcaattggttatatgatcatgtatgtagtgggtgtgcataatagtagtgaaatggaagccaagtcatgtgattgt

SEQ ID NO: 4134 - DNA, 640 bp, Aspergillus niger
  misc_feature (1)...(640): n = A,T,C or G
tagacaacggcataggagaaggccccatcagtaccacgctcaaaccccaacaccactcggagcaagctctccaacgtctcttccgtctcttccttgctcgaagcaaccacccctgtcaagcctaccgctgaagccgaagtcgaaccttccgaggcagctatcgaaatctgggagagcgagagtgctgcggaagaagccgccgatgccaactgaatctgcggccaccctgactatcgcccatcatccataccaacaagagttatttcacacggcgttcggattacctcagggttgtacagcatcgtttttgggataccctacttatacagtctttttgatttcgtttggagcccgttttataccgaccaagatccgtcacgaagacgaattttcttgagtctttttcctattatcatgtccaagaacctacaccataccctcctaatcgactttctacatttatccgaacctcaactacctcgacacgagtcactatcaatggcctgaagtataatgggcccctccgtcgcctcactcctttgcgcatcntacgaatgccgcgtccaattacctaactcctaatgactaagaatgtgttacgtcgcntaatgcctgtatgagatacataccctcagtttaa

SEQ ID NO: 4135 - DNA, 449 bp, Aspergillus niger
ggaaagcaccggacatgacaccgagcgcaacgtccgcattggcgagagtgccatgccctgggagcaggccgacgagagtggcaaggtctacaagtaccaataccacccccacggtgacaagagccagcccctgcgcaacgcccccagcgccttgaacactgtcattgtccccaacgttaccctgcccgtggacctccacgagcgctacaacaagtacggaaaggaggagtgggactactaaatagttcaccatctgcaattgcagaacaaggctgtgttgttgagatcctaggaagaagttgaggcaggtcggcgctgatcgctgtacactaaaacttgtgaagactagagtatggggtgagaccgttcttacaagaccactgtgcatagtttgttgttttgacgaggtttatttggaagattgttttcgttgcgcttacaaaaaaaaa

SEQ ID NO: 4136 - DNA, 568 bp, Aspergillus niger
  misc_feature (1)...(568): n = A,T,C or G
taatagatgatcgattttatttatcctggcggtctggcactgttccactctcgccctccattcttccccgtcttttttttcgccaggcaactgcatagcgcgggaagggtgggggcgcggtcgagtaggctggtgtacatgtgggtttgctttttatttaatcacaggaacggcattttggttatctatattttattaatgggctactgggtggattgcccggaagggaccgatggtgagagaagagagaggaagagagagacagcgagctgccttgacttgacagtccagaatcgccgacagcaggaacgcgcacacaccgctgggaatcattcaacagtggacgcagggggtgcaggctggatctctttctctttctctcgcccggtcattcttctattcttcttttccctcttcctttcttctccttcctcgctttcgataccgtctttgtctggttcccacacctncgtgtaccattttctttgtcatgtcatgtgtgctctgtaatatcgntggtcgatttccatacccattcggctaattgtacgatttattatcctcattc

SEQ ID NO: 4137 - DNA, 404 bp, Aspergillus niger
cgagtcacgaattggctaggtgggcttgatagaatttctgtttgagcggagtcacttgtcttctgggttcatgccgctgcttgggatggggtcaggttatgactccgtctctggcagaggcgcattcgtgtcatggcggcatctacttcggggtgcagaaaatctactaatttaggcatccttccttcttcgccaaggccatttattctggtcgtttagtgttctttaattgggaagcattctgtgccctcttttctctcctggacgccggaatgctgggtcaaaaaggggtttctcaggaggaaaaaagaagaaaactgcagagtgtgggggccagcgtttagctaggagatatcaccgtacgtaatgtccaattcatattattcacctttggaaaaaaaaaa

SEQ ID NO: 4138 - DNA, 612 bp, Aspergillus niger
  misc_feature (1)...(612): n = A,T,C or G
ctgagaagaatcatggccgccaattcaacacttcccgttctagcaaggccgtcggtgactcatccaccgttgacttcgcttacatgccatctatggcagagatcgatgcacctgctgctcgtgccgatccgcaaatcccgatcctttccgacatctatacccactatgacccgacccagtcgcaagaggcccccatgaggccccaggtttataccgtgtccgggggtgctggtgacatctccgcaagtcccatgaccgaggttgttgacaatcactccgtggacatcgatcccttctccctaaccgagacggttgggaagtcagattcggcgaggagctgaagaagcaacagaacggtncttccgaaccaggagtcgtccggaactttggagtggttcttggaagatctttangttccaaacagcagcaagctcagaaacactaatgctgccttatgtttgattatgtcttctgctcgttctagcgatgtgtgatggttacttttcaaagggcccttattgccgcttttgncaatgctttcgggattgaaacatagttatgatcctctgtagaaggactatcaatcatttgggtttcccaaggaaaaaaaaa

SEQ ID NO: 4139 - DNA, 512 bp, Aspergillus niger
cttgactatcggctgtgtgctcggcatcagctggtggcatcgtcaagcgcgcgaagaagaagagttgcgccagtggaaggccatggcggcggagaatccgtggagcgagtacccgccgccggagatgtactcgcagccgcagcagatcacgcagtacggctccgggtttcaagttgtggatactgatggtcgaactcacgaggtcgggtactccaagaaggtgatgatgagtgtgtcggaagataaggggaagagtccgtcgcaggagtatccgggggagttgaagctgtaatgcagcatcacaagcgactgtgatggtagataagcccgatgtcgttgaggaaagagaaagtgggagggaaatggtggatatgaatcatgtctttggtgtcgttggtcctgctgtattgggttggtttcatgtgcataatgaggcatataccccgcattgctggtgcacatatatctcagtttaaaatgaatgaaagattagaataagtatgaaaaaaaaa

SEQ ID NO: 4140 - DNA, 712 bp, Aspergillus niger
  misc_feature (1)...(712): n = A,T,C or G
attgaaacccagaagactggatggaaattgaacacttcaccgtcaaccattgaggacaaggatatcctgaagcttcacctgatcaaccccccggtcaanaanatcgacctgcacttcccgctagggctcgaagtcaccgctcgcaatatgaagggcgtcacgataaaggatgcgctggacgcaatctacaagcaattcaagaagaaggccgatgatgagctggacaagccttacctcgctggtttcgagtgggacaaggacgagtgctggacacgcctcattgttcaccagaccaagacgggcccccctcaacagcccagcaagaagtccaagaagaagagcaaggctgaagaggcatagactgcaagttcttcggataggccatgtccatcttacaacggcttctcttttatctctctttaaatggctactttcaccataattttgtgatactttgtcctcttcgtgcccttggcctctctggatcagcccccgagaaggtcgaggcaggagctaggcgagaggatgataatccctgtaatctgctttgatgtcttccaactccaactctctactttcgtttccttccgaggatcgcctcgntattctctagttgagttgacttactgagcaccgaacgatcttgtatcctcgagcgccattccttcattcagattcaatgtggagacagagggatacttagttgaaaaaa

SEQ ID NO: 4141 - DNA, 207 bp, Aspergillus niger
  misc_feature (1)...(207): n = A,T,C or G
ttacaagaacaccccaacgtcccagtcataccatgaaccaacccgaaaaagcaacccgtcgcgtcactgctgcggaaggacaactgacgcgccgaccgngcaggatggctaaaaagaaacaagcaggaaaataaaaaaggngtttaaccaccgnaagatcttgcgtgacaacatccagggtatcactaancccgctatccgtngtct

SEQ ID NO: 4142 - DNA, 495 bp, Aspergillus niger
  misc_feature (1)...(495): n = A,T,C or G
tgcgacttttgaacaatcacggctccgacagctctccaaagagactcgtaccgaaggccatgccagcactagctccaatgtcaatattgaccccagcgatgagctcaagccattgccgggggacaaggcgagaatcgtccgctcgcgggaagagcgcatcggtattaatcgacgcaattaacttttgaagggtttgcccaacacgttggcttttcctggctaccgatttatgccgagtattgcctcgggcatcatcaccacttcccaagagcaagagagccccgattggcagtgaataatctgaaagtcccacacacatcaaggtgtggtttttcgcaggtcaatttttgctacaagtgcatgttctacaagcgataatattacaacgacaggctgtgcataacatttncaactctattccgacggcgtgncttggttngaacctatctgngatctacatttttaatgnaccggtctttgttccaaaaaaaaaaa

SEQ ID NO: 4143 - DNA, 1425 bp, Aspergillus niger
ctctgattgaacgctgtccaagtacttgacacatgctaatcgaacgactatttataaaaataaaatgagtagtagtggtgtacaggtgagtaaaagataatttggctaccttaaagtaagggaaaaatcccttataaaagaaaggaaaataaaaggtccgctttaagatgttaatctttatctcggagagtagtaggaaaggtaatgacttttctagctaatatccgtagtcgtgactgagaggtcgatcgaccacattgggtctgagaaaaccccaatgcgtattagtacagcagtgaggaatattggtcaatggccgaaaggctgaaccagtaacttggaagaatgtaaatgtattcaagaaatacaataacgattaactcgtataaaattctaaataggataatgataatgacaatttcctatttataagtcttgaccaaattacgtgccagcagtcgcggtaatacgtagaagactagtgttagtcatctttattaggtttaaagggtacctagacggtaaattaaactctaaatgagtacttttttactagagttttatgtgagaaggaagaacttctggagtagggataaaatacgcaaataccagaaggactgataacggcgaaggcgtccttctatgtaaaaactgacgttgagggacgaaggctcgggtagcgataaggattagataccctagtagtccaagcagacaatgatgaatgtcatagactagatttaatatttagtctataaatgaaagtgtaagcattccacctcaagagtaatatggcaacatataaactgaaatcattagaccgtttctgaaaccagtagtgaagtatgttatttaattcgataacccgcgaaaaaccttaccacagtttgaataacaattaaaaaattgttacaagcgctgcacggctgtctttagttaatgtcgtgagatctggttaactcctttaattaacgaaaaccctcactttatttagttatataaagtggttcgccgctacataggatatagataatagggattaagacaagtcatcatggccttaatactgtgggctatagacgtgccacatacgccttaacaaagggatgcgatattgtgaaatggagctaatccccaaaataggatataatatggattgtagtctgtaactcgactacatgaataaggaattactagtaatcgtgtatcaccaacggcacggtgaatttattctcagctaggtactaaccactcgtcaggcgctgaaagaagtatgtgcaataagtttgatttgcttatgtattaatatatataatcaggtatataaatatgtatgtcttattttcgtatgcatgactttgattggtgttaaagtcgaaataaggttcgtgtaatggaaattgcacgggatggataaaatttaac

SEQ ID NO: 4144 - DNA, 458 bp, Aspergillus niger
  misc_feature (1)...(458): n = A,T,C or G
ttcgcatctttgataaagatatcaagaaaccagaacaatcattactactctctataaggatatatatactttacatctcacacatcatgaaatctactactactacttcctccgcccgtctccagaatgactttggagccgatctgtgggtgaagaatccgcctaagcatcatcccacggcaggacgcggccttttcgctgggcttcaagacactaagaactataatgtcgagtcgggctgggcgaagcgcagcaatgtggagagtcaggggtttttggggagtttgttgagccggtcattgggggatcgtataagcctcctactgattagatgcattgactgacgggtatggggaagtggttgacggattatgatgnatctatggttttggtttggtgttgggaatccgtatagcgtagatatagcattgngaacangggtctttgagagaaaaaaa

SEQ ID NO: 4145 - DNA, 429 bp, Aspergillus niger
  misc_feature (1)...(429): n = A,T,C or G
ccgagaggaacttacggctttcccagtcaggccaatttcaccgagcgaaacctgcaccgcgtccggtgtcctccactaactgatcacatagactatccatctcggcttgcatagctgcagtatcgccattacaaaattggcttttctcaaaatcaatcagtcgcaccgtcccatcttgaacaatgaagttgtatctgttgacatccccatggaggatgccaatgtcatgtaggcgctggagggcagcttgacaagacgaaagatcctggatttttgcttcacgcccttggagcttttctagcataaagccgattacacggccatgctcgtggacatggccaatgaatcttggggcaagacctgtgtttccaatttactatacatgagagtctncagcaataacgangtatttccactcaaaaaaaaaaa

SEQ ID NO: 4146 - DNA, 304 bp, Aspergillus niger
caacacgcctgtatatgcgtctcccacagcaacctccaccgcaacagttgaaccccattcgcaatcccttcatcttatcgaattcgatacccaatcatcccggtccccaagcgcggtacctacatccatatcccccttcccatccggacctcaggatgaatgacccgaatcatgactactatcgtgtttcacaatcccccaaccaccggataatgaataagatcacgccggtaatgtctcacttacaacgagacaaccaatgaatacgagttataatcatataataatacttataccgaccgag

SEQ ID NO: 4147 - DNA, 116 bp, Aspergillus niger
  misc_feature (1)...(116): n = A,T,C or G
ggtagctacgatttgggtgtctcttttatgatgacgtggatcaaacaattgacggatcatggtactctaaaaaaaaaaanaaaaaaaaaanaanaaaaanaaaaaaaaaaattcct

SEQ ID NO: 4148 - DNA, 431 bp, Aspergillus niger
  misc_feature (1)...(431): n = A,T,C or G
ttgaattggnacatagggaggagagtgttctttcctttttataacccattaacttgttttgctacattttatttcacgcaacccaattcacaagaaaggaagaaatctcttgttccttccctttccccccacacgccaaccatggccggaacgaaaaagcgcgcgaacgccgacgacgacttcgtgctcacattgtcggacgatgagaatgacacgttaaatcagctcgaagaggagggcgagggcgacgatggtgcgctagccacgggatcgaaaacgaagaagcgcaagagagatgatgctgcggcggcgcagcaggagaaggggaagaacaagaaggtgaagaagcaggaacaacagcaacaacaaggcataagaaaagcaataagaaaaagaaagggaaaccagacttcgaaagaacangaaaacaa

SEQ ID NO: 4149 - DNA, 531 bp, Aspergillus niger
  misc_feature (1)...(531): n = A,T,C or G
ccggagaccagcatctttgaccctcagatcctcttcctgtacttcttcctcctggcttgcttctctggcgtcgtctacttcttctacaccgtctggatcgctccctacttcccccagaagcgccgcgctggaaagggccccgagtacaagaagtccgctggtgcctccaagaaggaggcccccgttgaggctcccagcagccctgctgtctcgtctgccactacctacaacgccgagtggatccccgctcaccacatcaaccgtcctgaggccaggaaggtcaagggtagcgccaaggctaagaaccgtgcctaaatggcccttgcagtgctgagtcgatgggtgatctgtgaggagatattgggaaggcttggagtcnganggaaccttggtggtctctcancgactctggagtaaggctagcggacttgggaaaggtcacttgaaaatgtggccacaagaagttatgntgcttggatttgcgggtcattacttaaatgatattataatcgagttacncaaaaaaaaaat

SEQ ID NO: 4150 - DNA, 379 bp, Aspergillus niger
acgacaagggttactacctagcagagaacggtcctttctgctggggtgacattcagaagcaggtggcccaggttgcttatgagaagaagcttatcccgtcccctgaggttgagcccttgaccgacgaacaggttactgagaccaaccaatttggcctgtatgcctggggtagcagctctcgcggtacttcctaccgtggtagaaagctgttgggttggaacccccaccgtcccagtctgaaggagcttattcctgagattgttgacattgaagccaaggctttgggcttgctgtgagggagctcggaaatttatgtagccaactacgacgcattgatatgatgaatgacatgataatatttaagatgaaaaaaaaaaaa

SEQ ID NO: 4151 - DNA, 338 bp, Aspergillus niger
gtctcacactcccaatcctcccaagcaaagactcctgcttctcctccgagacaacccttctccaaacatccacatcttacacaatgcgtgccgctactctcctcctcgtcgccctctcggctgtggctctcgccctccctaccaccaacaacgtcgagcgtgccgctgctgacgccaacgtccgtcagatggacgagcttaccgttgctgctatcagcaagtaaatggtcaagcgggatattacaagggatcaatgatacaacgcgaagatttatgtatttagttatgaaattcaagtcaattaattaaactaagtatcttttgttgaaaaaaaaaaa

SEQ ID NO: 4152 - DNA, 463 bp, Aspergillus niger
  misc_feature (1)...(463): n = A,T,C or G
atcccgataaaatgggnaagggctcatctccgcctccctgcttcgtcccgggcaatggcncgaagcctgagnccttccattttatncggatacacttacaaaagcggtttcaaacggccttccaagggaaaattganggatacaagtcgacaatccgantgtccttgtgaacccacgantagacgtcattgaaggagtcngaacagcgggcggggcttgcantggatggcttttcagntggcgcatttaggttctggtctcgnggcatccccttgtgcatcagtttcatccaagcatctagcgcatttgacatttcgcctcagttggtcacgacctancattgttcatttcntattaccttcttgattttgcatccgntgtcgcnaagacgacgattgcctanctaccgactgtatctaaccggggatacattatgaagtgngatatcatancatnttattag

SEQ ID NO: 4153 - DNA, 385 bp, Aspergillus niger
  misc_feature (1)...(385): n = A,T,C or G
ctnaagaactacttctcttcgtcagaacaagaatttcgccaacatgcctcaccaatacatcgtcagcctcaacaaggagtctccccctgaggagcttgagaaggccaagaagactgccaccgacaacggaggcaagatcgtgaaggaatttgcgctggtcaagggattcgttgtccaatacgatgatgagcaagtctctaccctcgagtcctccgaccacatccacgtcgagaaagacagcgaagtctcaatccagtaaacagtgaaccaaaggtatcagagtggactggtccggccatatgaatctttgcgggagcttagataacttctatcttaatttttatattccatgtatgaattatgatatgacttgcataaaanaaaa

SEQ ID NO: 4154 - DNA, 408 bp, Aspergillus niger
gtaacttcagctgcagcgccttcaagaccctgcgtgagaacaacgtcatccgtggtacctacacctgcaaggccagcacttccgaccccaccaccagcgatggatcctctggcaccaccacctcgaccggcagcagcagcagctcttcctccaccagcagcgacagcgcctccgtcatgaacgtggctaacatgcccgctcttggtcttgctgccgtcctcggtggtctgatccagtacgctctgtaaaggacaacttgataccaaacatttgtgtgtacgctttttttgaaacccttatcatggtcgtgtaaagttgcctaataagcaattggtttcctttaattccaagtactgtgctgttcttatgataataattgaatatcggtttgcttgagccaaaaaaaaa

SEQ ID NO: 4155 - DNA, 359 bp, Aspergillus niger
  misc_feature (1)...(359): n = A,T,C or G
gatgctccacgccaagctcatcgaagcctcggccgtctactccaaggacaaggagaccctgtcctggttcgtcatgcagagcgtccacgacaagcaggacttctgcatcgtcgagcgctacctcaacgagggctcccagaagtaccacctcgagaacccctactggaagaccttcgacccctacgtcatccctctcttggagaagcccatggacctcagacgctttgaggagatggaggagaagaaggagtaaatgtgcatactataaaacttgaaatggcatgtatatagattgaatgatattttccgatgccgtgcgttggagtttattcatggcaaaaaaaaaaaannaaaaaaaa

SEQ ID NO: 4156 - DNA, 240 bp, Aspergillus niger
ccgcttcgtccctgtattcctgagcctctcacaaccaggcaataacaggcctggcttttgcatagctcattatatccaaatcaggcgttacttgtcccgcttcaaatcattattatggtccatgcttattgcgttacgtcaaagttctttcttccagctgatcgaacccggggcagagtgatgcggcatgaaagctttagaaatatatgtataaagctattagaattgattgaatgagac

SEQ ID NO: 4157 - DNA, 449 bp, Aspergillus niger
  misc_feature (1)...(449): n = A,T,C or G
caatgatcaccgacgacgaactccaccgtttggccgtcttcctcggctcctgcgccatgatgatgatcgttctctaccacttcctcgaagtcaatgcgaaggatgatgatgaagaagtcgacgtcaaaaacaacaacagcaagcaatctacgggcgcctcgtcggctggttcgactaccgcatgatttgataggatttggtttggacttgagcttgcttgggagggtgttgataattcgataatgttatcatcgtgttgggcgatggatttggtttggttttgggcttgcggtactactacatgtatggtctattgttcctgagcgcacaaaggtgacaagggggatggttgcaaaagcgtggtggaacagaacagaaaagtggcgatgaatanatacccggtggtctctcagaataaactacttattcctctcctcaaaaaaaaaaaa

SEQ ID NO: 4158 - DNA, 147 bp, Aspergillus niger
tcctgctgtaagcacgaagcggaagtgtggggccccttttttttcctggcccgtgaagactggtggatttgttagccgtacataattgaatccgttctactttgtgattattccaagtagcatttaatgcacatattttgtatcact

SEQ ID NO: 4159 - DNA, 562 bp, Aspergillus niger
  misc_feature (1)...(562): n = A,T,C or G
aaagagcacctgctctgactcggagattgtccagatgatccgcgatggagctatcggaacttccgccagtggtggtgatggcctcgcttctctcctggacctggccggtcggactggtgttgcagcctactaccgtgccgccagactgtacaactctggcataaactcccttaagtccaccaccaacctggaccttgcctccggcgccacttcttgctacgcctctgatatcgccaaccgtctcactggctggacgacggctacctccagttgctctagctggtaagcttcttcattcccacgcagtagtgggattgagaggtatgctttcccagcgttggcataagcatgccttgagcacttggatatggcgattttttcccttcatttcttcttcttctttgacattgatgcgatagaggtagcacaacgtgttcaggcagcatgttgtcccctcatcgcaagtttccctgactttcttggtcctgtgatatcattctgnttttgnatttcaatggtttttatcttcaattagaagcattgctcgctctgaaaaaaaaaa

SEQ ID NO: 4160 - DNA, 462 bp, Aspergillus niger
cttccggtacaccccagagcgcccaaaatacaccaagcccatctgatttctctccaccgtctgctaagggactttctaattcgtctttcgttggaaacctacgaatcacggtttcacaatgtgcacttcgttttacatacagtatacctgtgggtgcagaaaagagatggagttcgtccagtgcgccgagcgtcaagggacgaatgtgaaatgcaagcctgtaaggaaggagccaggcaaggattctacgaactattgcagaggtcatcttgtgaatcctgatgccccaaagaaatatttttccgacgaggagttgcaggattgaatagcgaaaagaaaatgagtactcgtcaagctcaaatatacttagtctaggaatctcaacttgatagtcaatgtgtcgtcttcggacaagtgtatatacgtgcgaaacgcgctcactagaataggtaaaaaaaaagg

SEQ ID NO: 4161 - DNA, 613 bp, Aspergillus niger
  misc_feature (1)...(613): n = A,T,C or G
gtcttttgttactttcctcttcctcccaaccttctctccctccacgttcttaacattccaatcctccctcgtgctcgcccagcaatcacagacacacgccaccaataacctctttcctcttcaaatccctttactctacaatcacaatgcgtttcttcgctgtcatcgctctcctcgcctctgttgccgtcgccagaccggctgagaatggcgcgctgaacgtccaggtgatgtgccttggacggaacgacggcatgtgcgttggcggcaacatcacggccgctggaaacagctgctgcctcctctcgtctgcggaagtgaccgactctgccactaaacgccgagcaacgcagtctaccatgttgacaacgaggattaactcctaagctttgaagatacctaatgtgtgttggggataaaggtgtgatgtcggatacgcgggcgtggtgatgaaggcatctcgaacggscgggttcatattgnacttgkcgaatacgactaatatgtgtcaatamcactatgcgacgctgacaaagctcgstyaaaaatcggtgatggggtagntaattaggaagatgtctaactctgncgatgcaaattaactytgatnaac

SEQ ID NO: 4162 - DNA, 207 bp, Aspergillus niger
gctccttttacttagcacagcgattttgtcctagcatttatggttggccgatttagtttgattcccccctcgagcatttgtttcttttctagtggagcagtgagcggcgaagtgtcctatctctgtctctgctgtggattgcaggtccccgatctcagccttcaaaagctttcgattgtatgtatttaatcaaaaaaatgacttgag

SEQ ID NO: 4163 - DNA, 361 bp, Aspergillus niger
  misc_feature (1)...(361): n = A,T,C or G
ctttcaccacgatttgcaaggctccctggtggccctgaaacaagttgccgangggcagtttcccaaaggggttgttgggngggcttcaagacgcaagccgaagcctgtnnggggggccttgcgcanatgggaatattgttgaagctctcgacattgccagattttccaatgaccggtggccgatggatgcgcaatantgacagtangagctgcatcccgttgaactggagtcgcccanacggcgagggaaaggganagccaaaggagggccttcatgatggccatgatctgtaccgctatgggtcataagctctcggatcgggctgggagtaactctatatacagttccatttttcaccca

SEQ ID NO: 4164 - DNA, 471 bp, Aspergillus niger
ttttttatagtaaaatgcccaattcttttgatattttccgcccgaacctgatattgaaagaaattggaatagtcgtagtgaacagagtgtagtaacataaaattgaacagctggaaatggtattcttctttttttctttttcatttcggctcaaagttatcgactgcaagaagggggtgtgaaacggccagaattgctggaggaagacagttcagttttgagggagatcaagtatgaaataacaaccggtttttcctttccttttttaacctcggcattaaaaaaaccgcaatcctaagcaaacatgaggctcgaatcgagttacatatacttcatgagctgtttcctcctgcgacccccctttcctttcgcaagtgccggttgtggagttcgaccagttgcttgcaaaagattgaaagggggttctagccgccgccctcgcaggactccttcacaataactaccgaaccc

SEQ ID NO: 4165 - DNA, 435 bp, Aspergillus niger
  misc_feature (1)...(435): n = A,T,C or G
cctgcttctccttgataatttggacaaagattgcgacaggctgagaaagacccttcacagccttggagaagccactgacctcaagagcacgaagggtgatacattcttgtaagtgacccagtgcattgagaatgtgttttagtacccgactttcgtttatgatctctcatcttccgatgttcttttccttaatcnttttttcntttttctttcttctgcattatctttgcattttaatttcgatgtcatgtttgcatttttcttcttttctgcatgaacatgaaccagaaccagaaccaagaccacagtcttttgtttgtttcatttcctttgtcttttctcctgttctcctgtctttttctatagactgatcatgatgatgactatgatgacatgttgataacgctataaatgtacgtgctctgataaacaaaa

SEQ ID NO: 4166 - DNA, 398 bp, Aspergillus niger
  misc_feature (1)...(398): n = A,T,C or G
gccgtgatgaggatctcgtcgcanggagacacggacaggcatcanggtggtggaggtcattcnggaggatcgaggaggggagaggaattgagacgtggggggaaagaaaggtcaggagggatgcgtgcacggcatgtcagggccagtcgggggcaattcggaggattgaagttggcangaggttttttgggcgaagctgaagcactcgagaatcgcagctgcaggtctggatgtgttccggattgggaggagttgaaagttgtatctttacggataccgcagcaagtatgtctcagtacctgacaggacaagtgttaccgccaggatgtatgatacctgtcacaacgatacctcactgggactagcttaacatacatacatacatcatacatcttcac

SEQ ID NO: 4167 - DNA, 552 bp, Aspergillus niger
actagacatacctccactataccaccgtcaccgcgatcgctgcagatcctgatcccaaccccaagatctcatattccattacctgtcaccagtgatttctcacaccgccattatgaacgtcacgctcaaaatctgctctgtcctcgctctagccgtctccgcactggcgttgcccacgaccgacacgcgagttatccaactccgtctttggggcgaaaccggttgtgccgaggagaacaacggcgaactcggcctgtaccaatccggccttaatgaatgtggcaccttcgcaggtcccgaagccatccactctatcaccacctactacgttgtatccgggtatgctgctcaattcttcaccgactcgaattgtcaggaaggccttcagaatgtaacaacaccaggatgtctcaacggtgacactgcgttcgccagctataagctggttctgacctagtagtggattggaagcagatgagcagtgcagagatggatagatgatattgaactatagttgtgaatgttaagagaatagtgcactaaaaaaaaaaa

SEQ ID NO: 4168 - DNA, 489 bp, Aspergillus niger
gtgcctcactgattaatgcgtcttatttttattcccctcctgtgtcccatttctctacattgtcactctctaatcattgctttgaacacgatatcataatgtgttaggcaaacgacatgccctgttcgccgtggcgaactctgatgaacgatactgtcttttatttccttgcccttttcctgtccatattggagctttactctttcgctcacatcttctttttcttcatttcccttttggattgcggtctgtctttgcacctcttggatgtatcactctttccagcggtatttctttttcacgcttgattccccctctacatttcttcttttatctatccactagtgtgtgggcctttttctattttactcagtatcctcaggaagagagttccactttatggcctgtgaatgagattactcgactttccaaatcgcctacgttgttgatagaaacaatttcaacgaattcatcaaataaaaaaaaaaa

SEQ ID NO: 4169 - DNA, 323 bp, Aspergillus niger
  misc_feature (1)...(323): n = A,T,C or G
ctatcacctccccccgcctccctatctacctgctccatcaaacttacccgaccaccgcagcatacagtgcatatacctcgccgatctcatcccgattaccgaataatcctctaaatcagcttcatcttgtctctcttcctcccttcccatcatgtatgtaggtgcggagtgaatgtccaccatatgcatcttcttactcagtatttacgcgctgctaagtcctggtcttgttctgtccctcccaggagtgactagattgggttacagtgcattagaagttcaaccagatnaccaatcaacccaatgaaacatacaaaanataa

SEQ ID NO: 4170 - DNA, 462 bp, Aspergillus niger
aaaagatccatccatcagtttgaatttgatcttaagttatataaagttttgcaggccctttatcctttgggcgaaacatctgtttggaacagctacaattgaagtcaaaccagagccgagagaagcctacagacaagcggggcatggtcaagattgttcacaaagagttcaatccctggcccgatgacctaatccaggaatcccatcactctggaccaagctggaaagtgattgagtagacaggcctatcgatgaagcctgtaaaaagtcaggaatggtgagagattgtacgtgcgggagaatagacttggctgtggctttcactgtcgggtaacaccgatttcaatatctttgaccaggttgatgccgtgaatgatatgatgaatattagtccaaggaagtgattagttaggaaggactaacaccagtagcggtctctatacggaacgcccaaaaaaaaaa

SEQ ID NO: 4171 - DNA, 435 bp, Aspergillus niger
  misc_feature (1)...(435): n = A,T,C or G
cggaacttccgccagtggtggtgatggcctcgcttctctcctggacctggccggtcggactggtgttgcagcctactaccgtgccgccagactgtacaactctggcataaactcccttaagtccaccaccaacctggaccttgcctccggcgccacttcttgctacgcctctgatatcgccaaccgtctcactggctggacgacggttggcgatatcagaggcatgatttattgtaggtggcagggttcttcacttcccttcctcctctgcaacatgacccaagaagaanatgcactgagctggagctccttanggttattcatcgaggatcacctgatgagggtatagttctttactgacagtcgctacatctatcgctatttctatataanggaattgaaggacaaagaatgcactgataatanaacnacggc

SEQ ID NO: 4172 - DNA, 390 bp, Aspergillus niger
ggtcattctgttcgagcttccatcttccaatttagccggttttcattcaaccttggtcccctttgcacgcccgatttcccccccaaggtgtgtaacagctgggggtatttcccgacttcactccaagatctttctttccccctctccatctttcatcaaccccccttcgtcccggtttggttcctctactggttattgtttactggaagggtcaatcagtacgggtgattgtatgaggtagattgattaacactgggttgacggagtgttgtagcgcgggttctttgttgactttcgggttctggtggaggatttgcgcttgcggcctcctgttgttgctcaagtctgaccaagatagctagcaagcattctacaagttccgaaaaaaaa

SEQ ID NO: 4173 - DNA, 269 bp, Aspergillus niger
ccactttttctttccatcttcgagaaaaagaagacttttgtcctttgacacccaaatccagaagactcttctacttctttaaaaccagtcatcatgggtaacgaccacggttgcagctgcggcgcctcttgccagtgccccgccggccagtgccagtgccccaaataaacttatcgctttaaagggccatatgaatagaatcggaggacgacctgcttgtacctatctgatctagatctcatggagtagtaatagaagatgctacgctg

SEQ ID NO: 4174 - DNA, 295 bp, Aspergillus niger
tgattgtgggccttggtgattaggttcatcttctggcttccgtcgcagatgctctgtcgaaggagccggactctacttttactttccatctatctattcttgatgatgttttgatattgttcgtgtgatgatataccaatcatagagtcaagccctgaaacccctactacggtatggggttgttgacgataaacgattgtttttctatctgatgaacaaacacatactcattattgatatcctcattacaacgttattataacctgaagaaatatgaatgcaactatctcccaag

SEQ ID NO: 4175 - DNA, 299 bp, Aspergillus niger
ctcgcctgataagtctagaactctagcgaggggctgtagcaaccgcattcgggacatggtgcgtttggatgttttcaatatccatcactcaacgcttcgcaaacatcctccgacccagtagcgctccactccaaatttaatttccgcaccggcactatcgcgtggatcatctaagcggcgatcggcattttcgtaaagcatgtctcttctgtacctgcttgtgactgcgtccgatgcgttgacctccaagtactttagccctccaaatcaatttatcgcttacacctacgaaaaaaaaa

SEQ ID NO: 4176 - DNA, 606 bp, Aspergillus niger
ctgctcagtccgatcgtcttttcggaaattgaaaccttgaatgaagatttgccgcccacttctcgtcaaaactcgccccttgatgaaacgaatagtataatgagagaagcacgagaattaccgtattttgactttctagactccgatcctgtttcccttcaagttggtcaaacgggacgttcgtttaggatccatcgaacgctgcttcactcaaagtcctcaccattgattgcagccttggacagtaatctcaaggaaggccagagcggcgtgtatgtatttgaagacgtggcagagggtacaattgcgcgatttattgaatgggcataccgaggcgattatcccgccacaatcagcggaaccaacattggacagactccaattttgctggaaggcacggagacggatattgacgagaagcctgaaaacacaactcctgaaaccgactcgacgtcagagaaccacccccttcttgccatatccgtctatacatattctctgagacttaccttggtcccgatcttcaacagctggcttatgaaaagttgactgcttgcttaacggacttggacaaaccgacagtctcgacacttcaacttcgcagta

SEQ ID NO: 4177 - DNA, 533 bp, Aspergillus niger
  misc_feature (1)...(533): n = A,T,C or G
ctgatgtgactcccatcactcggaacgaatggaacatgctccgtacggactttcctttgggcaagaccactgttaccaagtggacaccatcacctactgttatggctgctgcgtgaacagcatcattgattgcttgacaccatgtcaggcaaatactatgccaccaacaccaccgacaccttcagcactaccatgatcattgtcatgatcaatggangctcgaagcccganccatctgcgcatcggagcantctgaagaagtatnccggaatctaaagggaccgttctcggactggcaggaacactccaccgttgagcggaatcccgccaacaagcatggctggctgagtggagctatccgagcgatgtcngcaaaccggccaactangcgcagggaacacgcaaaaggcgggtggattccgggagagaagaaaccactgcgagcacaaaatattcngaagttgatgctcaccgcaaacggtntatcntcccgancgatctgangaatgntgacataaggtgaacngaattgc

SEQ ID NO: 4178 - DNA, 284 bp, Aspergillus niger
attctcgtgacgctgcgaagctcgagatgattttttccaagttcttccttgcttccccccatcttttattttatcattattatttatctcccctgacagcttgatgtcttttgtgtattccgtgtttcatgtcaaattttccaagggcgctgtaatgggaaaaaggggatatgtttcggtagtgggaaagttattattatttccatgatttttttttctttcattttaccccttttgtttctgtactcttgtgtcttctcttaatattaacgggtctgtacgag

SEQ ID NO: 4179 - DNA, 639 bp, Aspergillus niger
  misc_feature (1)...(639): n = A,T,C or G
tttcccctaaattgggttccgatatctccatccaaatccaactgggaactaagctttggtataaaagaaacaaagggcgggnatacgtcgctgatcttcgtcccttcacaatcctctaaatccaacctaatctttcaagatcagcacttctctacgaagcaggaaatccacaaaaagaaagaaagaaagaaaccaaaatgtcccacagccacaacaactaccacccagtcgcctcaagcaagacaaagtccctaccatacacacaatccaagcccatgaaacgctcgacttcctactctcccacccaagagagtgacgaagagtacaagcaacacgtcaagaaagacagcgcgagcaagcacagtagcctgtggcaacgaccataaagtgaaagccgcgctgacggagcttctcaacgacgacggagtgaaatgcaatgcgcgcggnagcaagtcggtgcagaacttgctgatggatacngagaaagngctgaaggaagcagcgcaaggagtcgctttcnggacgggcttcgattttggtggcgaagtgaagtgatttcngtgttgatgtgagatntaatcnaatttgactgggtgacgacatgatgaagttgnaatggggggtttgctttgattgtcg

SEQ ID NO: 4180 - DNA, 545 bp, Aspergillus niger
ttggtctcgcctggagggagaaggagacagagagcttacattgggttgcaattgatcgacaactagccccggctggccgacttatatacaatcgtcacctaggtggatttacctttttctgttgcagggcatttccttcgccgttcttgcgcactggctgcgatatcatcctttcgacggtacaccaaaagactaatccggggtttgctggctgcataatccctgcaggcgacaggttctggacggttttacttttctctccaacgaatcgtgacgtgactggactatattaccgcgggatctgcgtttagatcattctctgcgacatatttctttttcctttccctccccactgtgatggctgtcggttttggcgcaacttttacctcaacatcgactggtgtcgcaacggtggtttcaaagggtgtctggtcgacggaaatggaggtcactacagagcagggaggaaagttaactgaacataacactacgatccccatgcaaatagataatcaaatacaagaagccccgggcaaaaaaaaaaa

SEQ ID NO: 4181 - DNA, 611 bp, Aspergillus niger
  misc_feature (1)...(611): n = A,T,C or G
cactgatcgtttaagattgccttgtttctgtcgagttgctttctctcgtcatatattggtcttttccctttgaaagttatactgattaattcagctttgacgccgttgtctcccgcacccaagcctgcgggcatatttctctttcaaggcccttttccttctttgcgtctttgcctccctaagtcttgtccgctttggtcgtatatactatctaatgccttgattgccccaaagctgttgaagtgcgtcaaggctgttctcaacgactacgtgaaatcatatcctttgagctcggtcgcaagcgcgaattagatggatcgcggtgtctttgatattgcttgacatactggcaaggcccgcagagctttataactcacatcatcttactgcagactagttggcttagtctctgtattcaccagactttacaccttgtttgtatgcagtgattcgaacactggccgtgcagcactcaagacgcttcttcaatctactgagttcgagcaaagccctcgatagatactgggttttcgatctctaagcatttgagacgagtgaggntataccgtcataactgtcatctgcaatttgccaaccgttccgaatggtgc

SEQ ID NO: 4182 - DNA, 464 bp, Aspergillus niger
cgtgcagtggggggccgttctgcttgccggagaatgtacctgtgaacgttcggcaactgagaaccacccggtgacgggagcagcctgcccatgtggcaagaggtcttccacttcttgcacctgtgagaaggccagcgctattgacgctgctgttggtcttgagactgacttcaccactcgggcttaaaatccactcctgcacctttgtgtggaaattgatgatcaaattgttcttggccgttactggattgcatgttccatggagtgatcggtgttcattacggagttttcgggaggctgagattgaccggcttcatggttgcgtgggtgtttgattctgggttattgtgcattgccatgggctatcctcaaggggaagcgagagattacgtagtattagtgacgaagagtcgaattgtatcttagaattatacctaatgcgacgactgtctgaaaaaaaaaaa

SEQ ID NO: 4183 - DNA, 330 bp, Aspergillus niger
aacaaaacgcttttttcctggtgataaggcatggtgtttgttgtttcttttcagcggtgagggtttgcgaacaaaacttgacatatcccatttcccatttcgctttttccttttaacatctgtattacctacctatatctggacggtcttcttgcttgctgagaggttctctggctatttttggtgtgtccacagtctcttctctcttcttctcagggcatttgctttctttgacatatgagcgacattctgctactatgaatgaattgaacaaatggtggtgggagagggacttgtatctagcggagatagtctaattgactcgtggct

SEQ ID NO: 4184 - DNA, 474 bp, Aspergillus niger
  misc_feature (1)...(474): n = A,T,C or G
ccgtgatctcaaccatgacgagaaccgagcgtgtccgactccccgatggatccacccaaaagaagacagtctggacaaagagattctcagatggtcgtgaagagagcaacgagacgacggaagtactgaaccctccgcatggacagaacagtacaggagactcttcatctgccaatcaaaaggaatccggctggttctggagagattagactgttgttcagtctttgatttgctatcgtttcactctcttttctttttctatttttcacactatacctatgtgatctcaaggatctacttatcgttgtcgtcaattagcgctgattatcactgctggcgttgcttttcaaaagcattcatgttccttgccacactcacattctgctttacgatttcctatcatatgnctatatcttaatgatgctgatncaatctactatggcttncatctttccttttcgatgagaaaaaaaa

SEQ ID NO: 4185 - DNA, 497 bp, Aspergillus niger
  misc_feature (1)...(497): n = A,T,C or G
ggtgcttagggctggcccttcagagggacacgcctcggagaagaaacatctcagcccccgtccaccggacgaagatttcctagcagcatggaagacattttgccctccagaaaccgatgcgcggatctccactgatgccggacgttatctctgcgagttcatcctgtacaccagcttggcactggcataccaggcgggtgaggatcgcaatgtcaccttcttccatgttcccgcgtcatgcttggatgaggatatagagacgggcaaggaggttgccgcgcgctaatcaaggctcttgtgactagctggagtgagcagcagcacagcgttccctagttctgaatgactttttcaatcttctcggagttgtgacattgcatgtccaacaagttttggttatcggtggncctatctgagtactatatttttttngcaatattttgcattagtgaatacatatgggcgcctgatgggtattgaanccatcanaaaaaaaa

SEQ ID NO: 4186 - DNA, 396 bp, Aspergillus niger
gccggaacaccggagctgaatccagcttggtgataatgtctggatgctcccgtgcttctggtcctggaattgcaagacgacgcacggggtgacggcctggaagaccgctttgggttcggaattcactgcttcatgtccaccattcgcttcttgttatgtacttttgcctacgctataccttgttcccgtccgatttccttttccccgttgtggcctggtactcctacttttattcgtcttcggtacacttattatttttttttgcctcctttacaccattttagtgagatcacccacccctgaccatctttttattttctggacgtttttcttgttcctctgctgtttctgtgcgctagttgcaatctgaagtgttattgaagagcgaaaaaaaaa

SEQ ID NO: 4187 - DNA, 633 bp, Aspergillus niger
  misc_feature (1)...(633): n = A,T,C or G
gtcaagacatagactcttcccatgaacaaagactcagaaggtcgtcaaattcataccgataaccagaagttcgagccctccatccccatctcatagtccatttcacggtccttccccaatcttcaagaactccatagcagagctcaaggtatcatcaagatcgcgacaattgcgttcctccatgtctttctcaacacgtctcatgaactccttgaccatttccgcaatactctgaaattgtggtgacttaggaccgaatgtagtgtatgcgttgccgagattcgtcatcatctaaactgcgttagaggggcagacacgttatggctgtatgtgcgtgacttgaagacttacctggatgtagatttctttatagtcggtacgagggtctgtcattttggagatatgggtatggaaggtgctactggagcaaaatcaagagattttatggtggtggtgcggccccttttgattccccgcggttgtcggatctgataagcagaggagaaagttgggccaaaggtttaggcgtcagtcgtcaacgctcacacaaaagcggtctatcgatgtgtgacatgggcanatttgcntatagtttgaatgtcntgaatatgcntgtccttgantggggaaaaa

SEQ ID NO: 4188 - DNA, 286 bp, Aspergillus niger
gataaattcaacatgataccactttttcatataccttgggagggttgtttcggcgttttcgggagcgaaagtcttcaacactacctcctccgggcttaggaccgataggaacttcgagtcttatctgcgggggatgcgtgccatccggcgtggtggtgcgtgtccctgacgcactggggttcgaatgatggctccgataggagtgatatagatggcttgagagtgacatctcgccatactgctaatctaaacattagcacatagattaatgaatgcatatgcatgg

SEQ ID NO: 4189 - DNA, 355 bp, Aspergillus niger
ggcgaacgtcattgggaaagagaccccaattggggctacaatacggatcggcgtgacatcaataatggtgactcggcctaccaacctgtgagaagagactattcgcgagaaaacctgtcaagacgaaggagccgtagtcccggctccagggaaggtggtcgtgatgcagctaggaaattccatcgcagatgagttggattcgcctgtgctaccacgaccctgcaatcgctactaatgctgcgatattttgtcattgactggtcgcagaacaagcacaccgcaggtcattgaaatagagacatgtgggcttagaattagtagcacacataataatcaactatttggcatcaaatct

SEQ ID NO: 4190 - DNA, 922 bp, Aspergillus niger
gaaacggtcaccgtgcctgaccagggccaatcgcaaccagtcaacgaggtcacccccatcgtgagcaactctgacacatcccggcgcaactatcattcgaccgacggtctacggaacagggactcaggatcaacaaacaacaacacggtctcacgggatcccggtcagcagaactcccagtgtgattcggaagaaccgcgcggctcgtggtatagccggctggcggagaaatatggaagtttggaattagagaataaaggcagcgtggcccgggaccatcttgctttggaacgaacctttctggcatggctgcggacatcgctagcctttgcgtcgattggcattgcggtaacccaattattccgtctgaatagtgctgggtccaacgcaaacagcgccaacatgtcggctcatatgtctccccttttgtcatccgctgcgtatgatcccactataggggtaacatctgcctcatcacggcttcggagcatcggtaagccgttagggactactttcawtggagttgcaattttgatcctactggttggatttcatcgctactttgagagtcagtattggataatccggggcaagtttccagctagtcgtggtagtgttgctttgacagcatttgtggctgctgctttgattgttactgcttttgttgtgatccttgctatttcgcccggcgcggtcgaagtgtaagggatgggttcgggagaagcaaggggttccacgtgttctataccgtttttcttgatggttttgtatgtattgaagcgagcgaaacaaggtgtttggagatgttgtgttgcttataggtacatagcagtaattaggtgatgaccatgaatggtcaagatgaacaaaagagctactccactatagcaatccaaataccttaccatggtcaaaaaaaaaa

SEQ ID NO: 4191 - DNA, 626 bp, Aspergillus niger
  misc_feature (1)...(626): n = A,T,C or G
aagagcgccattgagaaggtcgctaaggagtccaaggtcgatcatcgcttcattctggccgtggttctgcaggaatccaagggctgtgtccgggtcccgactaccgccaacggtgtgggcaaccctggcctcatgcagagtcaccagggtaccggtacttgcgctggaaagagcacctgctctgactcggagattgtccagatgatccgcgatggagctatcggaacttccgcagtggtggtgatggcctcgcttctctcctggacctggccggtcggactggtgttgcagcctactaccgtgccgncagactgtacaactctggcataaactcccttaagtccacaccaacctggaccttgcttccggcgccacttcttgctacgctctgatatcgccaaccgnnttactggctggacgacggttactcaagtgntctaactggnaagcttttcattccacgcatatgggattgaaaggatgctttccancgtggcataagcatgcttgacacttggaatgngatttttnccttnattcttcttcttcttgaattgatgcataaagnagccaacgtnttaggcagatgttgcccctaatnnaagtttcctgctttntgntctgga

SEQ ID NO: 4192 - DNA, 200 bp, Aspergillus niger
cttttttttttttttttgaacatctgattcatccatcaattcagagctaattttctggaaaatgctaactccgatccatccagcccttttaacttaacaacacaacgtaactattcgcttttgtgtgtatgatttctttacttgcggatagcacgctggtagaaagccagctcctcaccctccaggatgtatccgtccac

SEQ ID NO: 4193 - DNA, 386 bp, Aspergillus niger
gccgaagatgtcgttgagaagctaggacagagcggcatgctgagcctggaagaaggcattgttgacgcgaccacagaggaaggaaggaagaagttggaagaaattgaggcagagaataagagggaaagagaggaacaggaagtaggtgaaccgggaggtgatatcaccgagcttgattgaggtatgaaaactagtaatgcatgttttggatggtggaaatattgtgttcgtcaacagcgactgttttaatggttgatttggatgaattcagattgtccatattgcatctaagccccgacctccgagtaggagggttacaatgtgtgaatacatgctccaagtaaaatgtacttttagcgaataccaactcttctgatgttttgcat

SEQ ID NO: 4194 - DNA, 449 bp, Aspergillus niger
caacgttgacgatagtggcatcgcgatctgcgcgatataggaaggtaccatgtgatgagaagcgttttatgatttgagccggcgaaaggcgtgcggattaccatgtcaattggcatggaccacgaatgattactgtacattaagccgaggaggacttgtcatttctagtgcttgacatgttgtgtgtttctttcttcttcttttttcccccttttcactggtcggtattcttctggcgcggcgttggatggagcgagcgataaaaaaagagggtttatttgctgagtcgccctgggagcaaggctctctcgggggtgatttgaagagtgagaactgccacggcctgaagaagaatagggctgagggtaactggatgtatcccatgactggtctgaagcaccatctagtctagctttaatacaccaatattcatctgtaaaaaaaaaaaa

SEQ ID NO: 4195 - DNA, 431 bp, Aspergillus niger
aagaagacgaggaggccgccggcgttaccgaaacgtcgtacgaactctatagccgacgcgattaagcgtcgccctttgtactatgctttgcgtgccttttcagccttactagcgctctgacacgttccacccggccgttgttcgtcgtgcccgtggaatagccgctcagttgtgttttatctcatccgctcagggagttgtatttgatttctggggtgcatgtacggagtttcgggtatggattaacagcagtgcttcacttgaagcacatgacggcttgtacatgtttttggcaagattctttgatctgtgcgaggcaacctgctaggcagcgcgctcgccttgtatctgtctttcttggatgtccggatttaccttcctcttttctttctttgaccttctcttcttgaacccacagttgttactttcgc

SEQ ID NO: 4196 - DNA, 552 bp, Aspergillus niger
  misc_feature (1)...(552): n = A,T,C or G
gaaaatggtgtcagttccactcgacgcatatctaccggggccctcgatctgcaggaaggagaagtccgacaggttcagttcgttgaggatgatacagtcgtagtcttgtggtcgaacaataaaggaaccttttaccttctcagccttcctttccagcctgcaacgacaatgagacctggcacgcttaccgagtccatggcgctttgtcccgtggaatatcatgatagcctgcaggagcctacatcgcccgacccagttacaaccgcaacaacggccgtggatcttatgtctccagattcatcatttgcgggtcttatcaagcatactttcattggaaccaaagtgaaagncaaagccaatnagagttgntgtcaatggcagacgcggtcgccggcaatctgcgtactgtatggcgatgctatgcgatatggagtgttagacttagatgcggaactggaggatgaggatgaagaggaagacgaggaagacatggaggaactggaggaatgataatacaagaacaagagacgttcatcagctctaaaaaaaaaa

SEQ ID NO: 4197 - DNA, 355 bp, Aspergillus niger
  misc_feature (1)...(355): n = A,T,C or G
atggagggaggaagttgcccatcgacgtgggggaggaaacggggctcgccgtggtttctgtcccggagaatcctgaccctcatgaacaagaagcagcattaatggagccgctatcgcagctcttaccaactccacaggtgcaattcccggaaaataatcttttgaactaggaaggcaactacgacgatgacgttgctagcattaatccgcgtttgttacgactttgcttatgttatgataccatttatccggagactatgtggcaatgtatacggcatgaangtgaactgtatgtaataaagcatgtatataggtgatgagactatcttatatgattaccgatcgtgaaaaaaca

SEQ ID NO: 4198 - DNA, 287 bp, Aspergillus niger
atcgccatcatcgttatcatcgttaccatcatcctgtaaagacagtattagctccttgccgtcctcgccgccagtcctgccattcctgtgtcttcataggactctccgatcgcacttgttgagttcggattgggcacgtactcgtgaccaggccgcaagagctcttaccactttactctcatcgacctttttatcattattcactcacgtttaatgcgagtcagggctgctcaacgtcgctccaaagcccgggtgggagggcaactcgattcttcatcgagggttct

SEQ ID NO: 4199 - DNA, 399 bp, Aspergillus niger
aggaagtccaagagcaaaggtctcatggatgctagcgctgacgctggaattgatgagggcgaagacgatattctgggaagtactgacactcggattaagttcaccttcagaggcctagaagatgaaattgggctgattgttgacattgtcggcggcgcagtcaagagtgatgaggagggcaacctcggggccggcgtcagaaagtgggaggaatggatcggtcaatgcctctgaaccgaatatttatgtatgacttgggccattgacagtgctactggccccagagatgggatgaaacgatacaagacatttgttaaaaatacaaactcatacatacaatccagacagtccatacaagccctatgcgccggcacgatcatcacgagcaaaaaaaaaaaa

SEQ ID NO: 4200 - DNA, 623 bp, Aspergillus niger
  misc_feature (1)...(623): n = A,T,C or G
gtcgggagggccctcatctgtgactacggaagcttctgcatctctgcatactaattggcaggcggatgtgcgcgtctgttgagaaatgtcatcatgactcggttgttgagtgggggagacttcccgatggcacattgagtggatagtccccctggagcatctcccagggttgacgctgcgactcaaggcttcagcaccagtgactcgaccatgcgtgcggaattcctcctttttcctgcacttcccccccacccggagataaggttgacggttgtaacgtttagcccccttgtcagcgccgcctcggctgtcaccctcactagtaggacttgccgcaggactccccaccaaactgggatgctacttcaaacagtgctgactgagagtttcatgtcctctcactcactggaagatcgcgataggataccgcaggtccatcttctttttcccttgctgcgaatgttggagacaccagatcattcgtcccaaaggagcatgtgggccttacttttaacgaatccaatgatcgtcaagtttttagcccccctagcgcagctgccgaacagaacaacagaaaagttgnctgcttattggtagacacggntcgtggcctcactcccggg

SEQ ID NO: 4201 - DNA, 510 bp, Aspergillus niger
  misc_feature (1)...(510): n = A,T,C or G
gtttcacgaacctcaacaactttcgcttcacctcttcacttcatcaaagacactcgctagtctaccgatcacctccgcacgatccacttcttcaatctacaaccgagcactccgatctcgattatcactcgctagcaagatgcgttcttccatcctcctcgtcgctttctcggctctggccgctgctcagtcctccgttgctgtgccccagggtcagccctccgctgctgtcacctcttcccctgtgatccccactcagggctctctgctgctggtgcttcagcgtcctcattggatctagcggtgttccctcttcttcgcgaagtcggccagcgcctctgcttcacttcaccaagaactcaccaagacctcagcttcgacttttcacctcaccagtgacttttcgtccaaaacgggttcagttccagttcagactntttggcgctggggcctntggtaccgtggccgtcgnctttcgcgggntggtgtgcctngccgtttntgnaatga

SEQ ID NO: 4202 - DNA, 289 bp, Aspergillus niger
gtatagtaaaggccacacaaaaatctcattgggatgatttgggatcggggcatttagggcgaaatactgagtgatctcgatttgggtttttattctttttttttaactttttttttctgtccattttatgtcaattcatgggcgctgctactgcacgtggaactgcaagtttggggtgctcggatgggatgaagcgtaactacttttattactgctatacttagtatcttctacttctacttcctcatctgcatgaaatgtgattggagatactatttattgatctgct

SEQ ID NO: 4203 - DNA, 468 bp, Aspergillus niger
  misc_feature (1)...(468): n = A,T,C or G
gcatgcacctcgatcgtgtacgaccgtccgacgtacatgaattttcattcatcggctcaacataacagaaatactctgtgccgtttcctagctcccttacctcccctatccttgcagattgcttcttcagaaacatggaattaagtaggttgcttataagactcacggagtagcttagctgtcactgaaccttggggcgcaagaagaggaagaacacctacggagaaaaccggcacggagattatgcaaatcccttgctgcgcggacctgcgagcatatcagctactacagacaaccatgccattgttgaaccataatctccttattcgccacctnatntacatcaagtnttcagaccacatgagagattaattgcagcccataccaagctganacagggaagggcttganaaatctaatgctcggaaacgttggggcaagccacttggaacttatccaggcgtgtcg

SEQ ID NO: 4204 - DNA, 328 bp, Aspergillus niger
gccggcatcaccagcagccagggacaacaaagcgagtcatgcgttaatcatattgatttttgtgtgtcgcgatggtgcttcttgatgaggtgacgcgacgaggaatgagcttcaatattttcaatggggtttgtaagataaaccgtctccgcactaatatgtggtggcctactctcattttcttctcttctttctccaaccgccattattatatttactcctttcctaatttccgggaggtttctgaatgaccttattatttgaatctctctctttgtttgatgtcctaaacctaaccgcaatttacccctgagaagggttcgggatg

SEQ ID NO: 4205 - DNA, 620 bp, Aspergillus niger
  misc_feature (1)...(620): n = A,T,C or G
atagccttctgcttgatatttcatcaccttcatagtctagcattgaaatcacgatggcagttatctacggattgcccacggtggcttccacagtagcagcagcgtgtgcgataattgctatcattcttggagcgctgtcctggtctcgtacagcttcactttaccttccccttcctgaatgggttccagccatcgccaccatcttccctcctcttacagcactggctctgtaccttgccagtcgactcgcccagcctgcagatgaccgccagtcgtctagcccttggcgaagactccttcccgtcatgaaccacctccaatctatcataaccacaatcattgccaccgtggccctcgcctacttgtacccagagagcatcacaacctgtcgactggaacaggaatggcagtcatacttccgcgcgaaagacgctcaacctattcgcgctattcaggacgaatttcgctgttgtggattccggagtatccatgaccgagcgtggccgttcaaggacaaaaccaccggagatgatgcatgtgaggtgcaagtttaattacnggacaagctgtctggtcccgtggagacagcagcagcagagtgcttcatggatggtttttgn

SEQ ID NO: 4206 - DNA, 357 bp, Aspergillus niger
cggaaaatgatgagtggcagacacacacgacccacgaacttgaatgcgcacatgccgatcaatgacgataacccatgcttggttacgaacccccttgcattgatgatcacgaattatgcatatagacggcagatgaaccacagcataccctatcctacttctagacattgctagatagctattattgatttgggaagattctttcttttcttttttctggtcgggaagctgtactttgaatgtcaggacgttcatgccatttacattcaccgaccagtcatttttattacacttctgcctactttctctataaatatttcttatatcttcttccaataatatatacttatgcatact

SEQ ID NO: 4207 - DNA, 607 bp, Aspergillus niger
  misc_feature (1)...(607): n = A,T,C or G
aaatagtcagcctctcgatccaaagttcgacccagagttaatcaagttacaatccctggatacacttggatcccttgttcttcggttccaagcatcccatgggctcaaatctgttcccatcgtgatgctacattacttcctcgtgggcggcttgcacgccatctcgcaattacgtcctatggacttcaagtggagctttgtactagaggcatgcgtggtcgggctgtggcacctgagcctggggtgggggcgcatgtgtacggcatttctgcggacgattgagcttgtcttgcaagctaccaaaccggacccaaccctggtgccgccaaggtgaccgctgtgttgcggctccttaaaaagcaatctttggacagcaacccgatggtacttcttttgtccgccgactatgtggtgcatcatgtcccggttgctgctgcaggacaatncggggccgcantttcgggccgaaggctagaacagtgatccgttcatggacaattcgccatnagctatgggcggtgaggacggattntgccgttctgaatattnaacgtttccgatcancgtanactgaccgatttgnaagttttgaattcagaacaactgg

SEQ ID NO: 4208 - DNA, 300 bp, Aspergillus niger
ggacatctctcaggccaagattagctatgtacattagcgtcacccattctcatctttaactgttaccatttgatgcaaggagtcagtcaagctctccaatatgatcgaacttagtatggggtttccattgaatgtcgagtcattctatgttgcccgatagggttgttcgcgaatagttgtggcttagaagtacgttggaagcataggtctatctctggaaagacacaaagagttggtgcagaactgttaagctacttaatccaaaatatgtatctccgaagaaaaaaaaaaaataaaaaa

SEQ ID NO: 4209 - DNA, 638 bp, Aspergillus niger
  misc_feature (1)...(638): n = A,T,C or G
cccggcgggacaacgaggatggcggacaagaacgaagccccaggcggtgattctggcgaaaatgatatcgaaaatccggagtcgcctggcgtcgctccggaagaagctggcgctgctgtcgaatcggtacacgcccccgtccagtggaccgggcaaaatgccgccgtcgaatctggtgccagtctcccctgcagtgggaagccacgccgccgaaataagaacgttgaccgttagaagcatgcaggaccatgctcattttgcccccctccttttctccatttttatttcatcctattcttcttctatttcatgtcccagctcgtgtgggcattgctagtgcangcaactgcattccaagctcgtaccttgacacgcgtgcggggccagcttcttcatcatcttcttcttcttccattctccatgccagttctctctggggtttgatatatgcattgatgcacgagtgttttaagtgtttccttatatgggtttattataagggttgccgtgatttgctctgtgtttaatggttcccttgttcctttccattttcctacangatacgcatgctttacaggcctgttgggcgggtgtttgcaattggcgttcaagctggggacccgggtacacaaattgcn

SEQ ID NO: 4210 - DNA, 382 bp, Aspergillus niger
cgctgccaagttcttccgtcagaagcacggaaactaaattttctttaatcattacattttttaataacccatgattgggggcgacattctcaacctgtcgtctcggggaagcggactctagcagttcccttcccaagtttttttgatgagtttacgatgatgataccaaaagttcaacatatgggttagggtttcattagatggggtcaccggagttttcaacatatgataacgatttcaacatcggcgttcgcatataacatcgacgccaagttttctcttgcattttgcgagttatgggggcggaatgcgggaacgtcggtgacgtctgcaacgccgagatcaataatatttcaacaatgattgtgtatatcaaaaaaaa

SEQ ID NO: 4211 - DNA, 313 bp, Aspergillus niger
  misc_feature (1)...(313): n = A,T,C or G
acaagccaaaatctccctggtgcctggatacttcgtcctgggacaagccaagattcnggaggggctcaaagggctaagcactcttcactgcatcctactttcccctgaacttcagtctccgaggtaatcgtgcatcgagaggacttgcaaataggaacgcaagacgtccgacattcagaaaacaaccgatcgcttggggaacttgaagccggaccaactatatgaaatgttcccttttgttatcctcaaggactcctgatctatatatcttgaatttcatgtcttctctgcctctcgaaaaaaaaanaaagaa

SEQ ID NO: 4212 - DNA, 437 bp, Aspergillus niger
atcatttcttaagtgaagaactacttcaaagctatcgatatggatctcgttcagaagtatggccacctcaagcacgatcgacgccggagctctctgcagcagcaactcgcggaagaggaacgccaccggaatcagatggctatcaactcactgttagggagctttggcggttcagcaaacgaccatccagaccgacgatccagtggtgcggggaatatggcgagcatgattgaggagttcaataagcggaaatcagtgtccccggataccaatgtcgaacaaaaagagtgatggaaccatctattttgttgggtgatggagcagggcggctatggttaatggagtaatgaggcttacgactgtcatttgttgaaaacaacacattatatggagttggataaatccaagaattctatgactactactaaaaaaaaaaa

SEQ ID NO: 4213 - DNA, 444 bp, Aspergillus niger
gcgcatccagagcaagcagggtgctaagggctctgcccccaaggtcgctgccaagtcgcgttaaaacggattagaggcggtactggctgttgggactgggatgaaagtaaaaggataagaaatgacaacactatggggggaatatgttatggacatagggaatttgggaggttattctaataaaaaagaaacccccgaggagcgtttttcttttgcctcatcaaagatttctattctccaaaaacatcaaacgaatctcctttttttgcggcgtatgagcgttgggtaaggggataagatatcctttttgctccttcctcggatatgaatgagtttcttattcgttattacgccgtttctttcccccctcctgcttctcccccaagtggtatgtcttacttattactacccaggaattggaaatggatgtgatatgattacttc

SEQ ID NO: 4214 - DNA, 511 bp, Aspergillus niger
ctcgggactgcgtccgagccattcaagatggcacgcatcatatcctcgacgcccttgacggcgccaggaagaagatgatcggggtgcgcggcgatcgacggcacacagagctgaagtcacagattcgactggttggaccggtcagtccatataacaacaattacagacagaccgatccctggatttagaacgaagggctcactgtctctctccaactttcatttctcgtttcgtctcgtttcctttctatgttcatgatatcccattcgcttcatggtccatgttatccaattagcctgtctctattcccggtcactctctacgtcctataactctcgtcttgtcctgcagctctagtcattaccgtgatatcccgttggcattttcagggtctctgcttggcgttggggatacacctatagatgcttatctatagctacttcactttttgatccattacattgaggatactagcttataatgacccaatatcaaatcttaccatctacaa

SEQ ID NO: 4215 - DNA, 313 bp, Aspergillus niger
ggcaagcactggatagagtggacgaagaaccggacaaactcgcgtttttagaactctgcatccaacccaatgatgtaactgacgacctcaggcggctcggtagaatgatggccgatcggagcgcggaagcgtcaagagaatctcagagtcccgacaccgaagaggtggatgagtagagcataggcatggatattgtgatggcagatctgggaggctttgactaggttgctatgatctgcttggtatgcgatgagctctttacatgtctatcgtataaatgtattggagatagaataaagatgttgtttgctac

SEQ ID NO: 4216 - DNA, 341 bp, Aspergillus niger
tcgccttcaagtatgtctttgcttcgaagtcgctgacaacctctggggcactggcgcggctaagtagtcccggattgacggccgcggtgccggtgctggtgatggtggtgttcggactgtttatgatgtgatgtgatgatatattttgatgttgttttgctccatgatcatttggcacatacctaccatacatacccttacactctccttatacccatgttccgtttggctgtgatccaacgatgatctgttttgcaatgaagttgcatgtttaatgtccattggtgttatggtaatttggaactcattacataactatatatcaaatcaatttcccaaat

SEQ ID NO: 4217 - DNA, 614 bp, Aspergillus niger
  misc_feature (1)...(614): n = A,T,C or G
cacactcaatgctcaaccgaaaccttgacaggttgtgagaaacagtcgtcatcagatgtctcaagggatgctgaaagcttggactcgagccacacgagacaacatgctagcgaagaggaccttgaccacgagttgaccgatagctttgtgactcagatctacaattatctgtccctgggctatccctctgttgctcgctactatgatcatgaactcagtatcatttctggaatctctgtagcagatctgagacgtgatgacttaaagacagatgcgaagggttacgtcagtgttatggatgggggtccgacggatcggaaggtagagaaaggcctatgtatgcggtggatcgcactgcgcttatatatacaagagtgggctaggaaacggcccaaggtggctgacgacggtattcatggaacatggggagtctgtgaacgaaagggcagctgggccatctgatacagctatattatgaatgaaacggagtgtcctaaatcatggcatatagcccagttgtgtatgaaatcaagatgcaagatctgtgcatgggaagttactgnggtcctagactagatctggctcaaatctgctggccacattgnaaaaaaaaa

SEQ ID NO: 4218 - DNA, 382 bp, Aspergillus niger
  misc_feature (1)...(382): n = A,T,C or G
ggaacgtccgctacgagctcctcgagaaggcgactagcaatggtctccccggtgcgaaccagatccagactgagctcaccagccacaagactttcatggataccctaggacgcacggcgctgactttgaccgtggaggagttgactgatgaggcccgtgactcgcagatagtggtcacttacgactactctctgtgggatggattgcgcaagcccgtgaccatcacggcggggctgttcaccgtgtttgttgccgcgtgggcgattggaaatattgacgtgagtattaagaagcggtagatggaggttgnatcatattggttcagttatccagccagacagacagacagaattcaatagtagctgttgtagaaaaaaaagaa

SEQ ID NO: 4219 - DNA, 345 bp, Aspergillus niger
  misc_feature (1)...(345): n = A,T,C or G
cgaagcaagacaaagagncaagctccgctcaagtacggatactaagatacctnagtttgcgcggctgggttgctttgtgtttgtgatggggatggggatgggatcgcgaaacggttctctgcgaagaaaatggacagcaagccgatcgacctttctctcactgtccctaccttttcatgaaataccacaattcttacgttgtgacgcacatggaggctggagagatcgattctttctaaaaaaaaaatacaggagtcacttgggatgaaagggtgttcaaaatagctgacccgttatttcgcgccgtggcggtttaatccaagaatttcttttcaaaaaaaaaaa

SEQ ID NO: 4220 - DNA, 352 bp, Aspergillus niger
atcgagacgttgcttcttagcttcatacgcgttcaattaacttcacttctctagacgagacaaacacacatcccaaatctatcaaaatggccggtgctcaccaagcttgcccctcctgcggcgctgccatccctggcgagactaagacttgtggatcttgcggaaagacctgccctgtttaaactcgcttcgcttcgattcggagatgatatctggcgtttgggggttgtgtgcgcgaggatgtgataagtaggcgaagggaggggatgtgattatataacgtgttgatgagtgatgacsacsatgatgatgaatataaatgaaatgatcgaatgagagtgtaaaaaaaaaa

SEQ ID NO: 4221 - DNA, 357 bp, Aspergillus niger
caacgggttcttttgaccaccaagtgcccgggctgtgcaaacgtcacagggggtggtgcaattgccttcgtaatgtcttgccacgtcatcactgctgatccaaggggccgtgcgttcaaagtatccatagtccatgtctgctgacgcgtcgtctatgcgcgtccatttgctgtaaatgtcgtttcacttagagtggattccgacgatcgtccggccgttgagcaactttgagtaatccagtgggcccgatcaaccagcacacaatagccagctgagcgtgttcgttgtaccggccagtaccaagcagtgcaccttaatcgcacatcccgaacgacgcgtggtttttaaaaaaaaaaa

SEQ ID NO: 4222 - DNA, 301 bp, Aspergillus niger
gacggttctccttctctataaaccgactgctttctttctgttttatctttacgaattcccttgcgactaccgtgaatgactgaaatttcgacttctgcttcgttcggccggccgggttttggatgaagaattattgactcgcttttcctacattttcttctcattgctattatcgagatcgctttgcttgttacacatacccggcgcggatgaaattcttmacctgataccaacgctgtattccagtctacatagctcttcagtggttacgttacgaagaattcatacagactttggcttc

SEQ ID NO: 4223 - DNA, 409 bp, Aspergillus niger
ctacgttaagaccgatatactagcttacaatgacatgtaatgccaaacagtcgaattcacacttacttttaccctcatatctggatgtcctctactattcctacatctacaccctcaagttttgatttctataccatcttgcactgatatcatgtggagttcgtcggttatattttcaagtgtgattgcaggtcagtcatcgggatcatatcatgttgtttgttcgcctcctgtctctacttcgtctagtgttatcgcgcttcccttcccccaccttctcttattcacccccattacgctaaaatcctttgaggtcagcaccaatatatgttgttgttgaatgactgtttcatattaaggtctttagattatatagtagaagcctatattctcgggctttcatgcaagc

SEQ ID NO: 4224 - DNA, 296 bp, Aspergillus niger
  misc_feature (1)...(296): n = A,T,C or G
tcccgataaaatttgcttttggttccaatcttcggncaaatactcctcttctactgtatatctcactcctcggacagacggttacacgagactttgcctgcgggatgggagcaatggaatcaggagatgatgcaattcttagaggactgtgcgcaggccagtccggcggtggcgaaggatttggagttgttgcggttactctaattgtaataagtatgtgtgtggatggtcttcatgtatgtatgtatgtgtggatgaatgaattcagcaaacaacattcgagtcaatatgccatg

SEQ ID NO: 4225 - DNA, 396 bp, Aspergillus niger
  misc_feature (1)...(396): n = A,T,C or G
cgcgtatcactctatagtctttctttacatgtacctcacatctacgtacctccaatcagctcttttctagaaatgactgcccccacacccaagtcggcgctcgcgatgatgccgacgcccaatatccctgcgtccgaggctgtcggccactgccagagtgtcgcaataatcgatgctccactgcaagaggtctgggatactttaatggacacctctacctggccatcatggaacagattcgtccctgccgtgactatccgagagcagcccggatccgatgggggcgatctctcccggtcctncaggctgggacgaagatgacttatcacgtgaacatgaagcgacagctcgtccagccacagcgcgcacaggcgaacaatgatactcattggtcgt

SEQ ID NO: 4226 - DNA, 360 bp, Aspergillus niger
ttttactttcgctgcagagagttgtctgctgacaccgaaccttgcagaacccatgcaataattaacataacattgcatacatacaagactctatttcgccgtgctatagatctgggctgacgcgctgcgcaggtatgtcatctggcagcagaagcttgtttgtcattgcttttggactgtgatgctgtgattggatattgtgcgtatgggtgcagaggacacggtctttacagactttgctgggaggaggggtctattcaatccattcaactgtagaactctcagggcatatgtcgcactgcaaagccttattctgacagcatccatgaatatcacatgcgttcgttcaaaaaaaaaaaa

SEQ ID NO: 4227 - DNA, 136 bp, Aspergillus niger
gtgacggagtgacttgttcttcctccttctcaatactaggcagcgacttgttgtcactctttttctcctttcacatccccgtataaaataaaactcactaattttttttagaatcaaaattaattattagcaattc

SEQ ID NO: 4228 - DNA, 433 bp, Aspergillus niger
tgctccctcgacacagcgaattgcgagcactacacgtggttctatgactgggtgttgaatacagggttgtcggatgatttgagtgcccatgtgatggagtatacatggcatattatttttggaaaggatccggtctactgccccgacgcctatcagtgctaccaggatgtctacggcaatccttatttctggtgattccgtctgtaaagaatacccctcttgcggcttttattttattttctacattgtaatctttttatttcgatttcgatttggctccggatctgacgactcacgtgcgtaactttggttgcttctgctatgctatgctttttttggatctcgaggtgttagcctgtacatgattgggaattttggttgaaaaagtcgtcacgttgagcaatatacattawgtggaattatcattctcttt

SEQ ID NO: 4229 - DNA, 573 bp, Aspergillus niger
  misc_feature (1)...(573): n = A,T,C or G
cttcaactggttcaagtcttccaaggaggaatcctccgctacccagcagccctcctgggacgccaacaccatgaccatgcagcagccttctagccccgaggctccttccactgagcgcgttgttacgcagcagcctaactcccaggaagaaatgaagatgggcctgcgtggtggtggtgccggtgatgtgtgctgcggagtttgcgccggtctcctttgcttcgagtgctgcgaagagtgctgctaaacaccttcccttccctctcatacatacgttcgactactgtctccgtatcttgacgaacaacaaagataaaagaagaataccctcttaaagaaaacggacatgtgccatctacgagacgagctatgaaatgtggacccggatgaagtggattagatttttgggtcgatgattccatggatggaatgatggatggtgtttcagttgattttggatttgccttgcgagatcgcttatacccggtgtatttatcccatctacgatttctctaatttcgcttggtgctttgaatgaattgagttaagatgaatgcntaaaaaaaaaaaaaa

SEQ ID NO: 4230 - DNA, 458 bp, Aspergillus niger
  misc_feature (1)...(458): n = A,T,C or G
nnagtactggtcnattctctcanctttgtctctatatttgcggtttgagattcccgcttgatatgttgttgttcttccttgatgacttttgtgtttctttacccctaacgagtttcctgttaccttacgattaattcaacccctgacgacgcacgtcccgaccctaatatcgagacattctcctgttggtgaaggaattggaatcctacacgagcggtgaaaaatgttcgcgatccaaggagacatagccgggtcaaaggggaacttactctattgtcgaactgattaatgtattactataccacctgcgaggaggatggggacagagagaaggggagagaaggagagagagagtatctataattgatgcattccttgagttcgtctcgtgctcgtggtttgaatccgtgtgttttgggataagagtangtacttaatggacttgtaatganctgtgc

SEQ ID NO: 4231 - DNA, 404 bp, Aspergillus niger
  misc_feature (1)...(404): n = A,T,C or G
gaacgaatacaacgggttcttttgaccaccaagtgcccgggtaacaccattcattgagttgactacagagaactatctaaccatggttcctcccccccctctttatacctttcagttctgactatctaaggctgtgcaaacgtcacagggggtggtgcaattgccttcgtaatgtcttgccacgtcatcactgctgatccaaggggccgtgcgttcaaagtatccatagtccatgtctgctgacgcgtcgtctatgcgcgtccatttgctgtaaatgtcgtttcacttagagtggattccgacgatcgtncggccgttgagcaactttgagtaatccagtgggcccgatcaaccagcacacaatagccagctgagcgtgtcgaaaaaaaaannttatttttctt

SEQ ID NO: 4232 - DNA, 624 bp, Aspergillus niger
  misc_feature (1)...(624): n = A,T,C or G
tgagagtctctcagagttgtctgagcgattctcatttacctatcaacccagcatttactgaaagcgccattggcgtccatatgacaggaagggagtgttgagccattgcaggacgtgccacttgttcatagtagtcacccatgcctctaaagtcataagggaccgaacagtgcaacccctgcgaatttccactgtacagttagttcttttgaagcgttgctctacggagtattcagcgggcatcacggcgaattcggagttggatgatttcgggggttgcttttctttcgtctttctattatctttggtttgatctactacacgctgatcatccccccaaaagccctcatgcaggttttcactactgcagttgcggttacagtctcgggaacccatatgctaccagagcagtggggatatttctggacatggcgttttgtttttctgttttcttgactgcttctacctanctacctanccactaacgacttacgaccggctgggataatgtgacnttttgaccttgcgcccgttccataatgtacactgggtttgttaataataatcctaagcagcaaactgttattaatcctgaaanggatgacctaatttgattcgggcgcc

SEQ ID NO: 4233 - DNA, 644 bp, Aspergillus niger
  misc_feature (1)...(644): n = A,T,C or G
gcctgttatctcccgactaatctcgatcgtcttccgcgtcgcgcaaattgtttgcggtgcggtcgtcgccggtatcattggtcactaccttgcccaatacancggtgacgcatggcctgaagcccgctggatntacaccgaagtcgtcgccgggttatcaatcctccttggnctgatatggntcanaccantttcctccggatttttctcctggccanttgacgtcatcanctcccttgcatggnttgccgcaatcggtatccttgtcaacgccaatcacaagttgaactgcggnantatctggcactggggtggtctccaacgcaacaatacttgcaatcnctgggaaggccctgaaagcgttcaacctcaactccggtaatgtcctggcnttgctccggcgccttgtgggtcctttgggtcactttccgtgttaaggaaggaaagaactggcccctaactaatggtcgcctcgcttcttcggtcgctccgccgtgtaaacattgaaaacaattcncaagtttaataactggtcaattgcacatggacaacgaaatgcttcattaaactgagtctcgganatacaaccaaggtattctgcgacaaggaaactttgcnatccnaacgcnctttaacgtgaaacg

SEQ ID NO: 4234 - DNA, 381 bp, Aspergillus niger
cggtcatgctgtaggacgttacttctcttcatgccaacatgaaaccagtttattgtagttcagcagggatggccgtgtcaaagcgggtgtcatgtggtatttcccacattgtcgaaacgtaccgccattgtgcaacaactccttgcagatatgagagctggacttttaccgtttctctgaacttgatgtcttgtgtactaagcattttatgtttggaaagaaacagcttttaaggtcagagcgcaggtgatgatggggttggaccatctcgggtaaattaggtggtatcggcatatagtaatcatcctaatacctctcccctcctgtcaggcagcatggcctcggccgagcactagctgcgttggcaccccgtgcaaattt

SEQ ID NO: 4235 - DNA, 462 bp, Aspergillus niger
  misc_feature (1)...(462): n = A,T,C or G
ctcaccaggtccagacaaaataaggattgacagattgagagctctttcttgatcttttggatggtggtgcatggccgttcttagttggtggagtgatttgtctgcttaattgcgataacgaacgagacctcggcccttaaatagcccggtccgcatttgcgggccgctggcttcttagggggactatcggctcaagccgatggaagtgcgcggcaataacaggtctgtgatgcccttagatgttctgggccgcacgcgcgctacactgacagggccagcgagtacatcaccttggccgagaggtctgggtaatcttgttaaaccctgtcgtgctggggatagagcattgcaattattgctcttcaacgaggaatgcctagtangcacgagtcatcagctcgtgccgattacgtccctgccctttgtacacaccttatgatttgtttttcctaataaaaaaaa

SEQ ID NO: 4236 - DNA, 544 bp, Aspergillus niger
cttctcccagttttcccatcttttttcgtggtgtatcacacagccgctcaacatggattctccatcatcagttagtctcaacatccaggatgccgtacatcatccatcctctccaaacaacttcaaatcgcgctttcgcaaacacctggagctatggaaagctggcctagctgcaaaggagcactgggatgatgaatacaactttcagcctggacgttatgctggacagggccgctagatccctatgggttctgacctcatccacgctaccgtatgctaggcatatggatacatagcgaacatcctcccaccacacacgatctccctctacatacagtctctccagaagccaccgaaatttccacaaccacaccgagggatgttcacgataccacacgagtttctttcatgtcacaagcgccttgtcttatatccatcgatttccttcttagaatagaatataccaccttcgcgctctaataccattctttacctgtgaaataatctcggaatggaatctactttctcttactaaaaaaaaaaa

SEQ ID NO: 4237 - DNA, 221 bp, Aspergillus niger
gcttcaacgtcctccgtgtcctgccccgtaccggcaaggccgtcaaggctttctccaagttctaagcgtctcgatgaggaagggtgtgttgtcgcgaggacgaacctagggcagcggcgtgactggatataaacggattagtttctagggttgggattgtttcacgatttcatgtcccaggtacccttgtggaaggaatatccaatgaaaaaattactttg

SEQ ID NO: 4238 - DNA, 187 bp, Aspergillus niger
ggatggccttggagtaggtagccatacacacccacccgcattatcctgtaccctttttggcctcttgtctcttatcttagtctagctcagctagtcacttccgtgtagcattgacctcattaaattttcctatctttggttgtgtattcaaatataacgaaatcaatagtactgcctaacattacac

SEQ ID NO: 4239 - DNA, 521 bp, Aspergillus niger
  misc_feature (1)...(521): n = A,T,C or G
gcgatagcttgctcagcgtggaaactgcggaaagacgaaaaatggcaacgtcagcatgtcatgcatgataaacagcgttccctgcggatcgggcaaaaaagactctcagcgtaagccgggctggccgaggcagagtatgcccggcgctgcgtggcagcagcattgcgaagggcagcgacggtgttacggcggacggcctgcatggttgtttgagggaagggaagaaacccggtaaggggagatcggaaaagaggggagaggtgtgaaagtgaagcactacgaaggtgcaagagggttcgtggttgaagatagagaagagagaagagagtagccgtttcaaacgcgccggacagattcgctttggggaatttcgggacaaagctttaagcggattccgagttgtcacgggcggtcggttgcctccctcggcctcgctgctctttttttcctgttgccgttgtgctgttccgccgcatctnccccacattaacttagctctacgcttcttttttcggtaaaaa

SEQ ID NO: 4240 - DNA, 457 bp, Aspergillus niger
cggcagtccgagggggacgcttcccagtcgagcacccagtgtacctgatggtgatccgcaggcgtgcctcctggaatgtggcgaggagtgtgccaggggtggccagtgttgccccaagcaatcgccgtgaggtgattcgataccaattctacctcccctatgattcttttattcttacaccctccttacaacctcaccatattaattttccttttctgttcaacatacccccttttcatattactggtacctatgtgactggactggccgttgttgatgttgcgtccgagacaaacttggtgcatgttgggtgaacttctccgatggctgcatgtgatgagacttgtcactggcaagtgtaattacattctttaaaacaagacgttcttattcttcttatgtattcttagcaatatcattgcatgtgatctgggctctatcttctgcaaaaaaaaaa

SEQ ID NO: 4241 - DNA, 423 bp, Aspergillus niger
ctggaaccggcacatcatgtggactacttactgacttgcatggcaaataagaactgaattccggttgggatatttacttgacgctagggtctatacttgacagactgattgacatctctgaagtgattgatttgatcggggttgtccgatgcaagaagtatgtggtatgtgtgtatgtatgtctgtagcgacttcttgttggtagtagccttgcggctacagatttcttttcaatatttctagatagagatattcgttcattcggagtaacatggtatataatctaccctgcagaagccaaggaaatcagatatcttggtacaaagtataaagtcccgtatacggagatgggcgggccgctatgtcaaaggcttaaaatgatcaaagtacttactcacagtcagatgtatatactaattaatt

SEQ ID NO: 4242 - DNA, 595 bp, Aspergillus niger
gcactaccaattaatatgtggtctttactcactcgcgtgccctggggtcgctcagtagcgccaaataaagctcatcgggacccaatgccagaggtctgggtaaagtcgagttttgagttaaaacccggggagaaaagccaacaccccgcaacctcgacaccgcaagggcacctggtggctaattcagtacttcatttgaatgtcctgtgctggcaaagcactggcgtcaacgatggcggacagacaaccacctttccttggatcggagaggggttgtgacaattttaacagacctcgtctcgccagttcacggggaagctgctgcctattcgaggtaagcagtatatcatctgcatcatctgccacctacttgccgatgacttttcttctaccatgtttcgtgacctttccgtggacgttgtcctctcctccctattggtgtctgactcgtgtcttttcttcaatttttagcccgcacgaacattgaaagctgaagaatcgaaatgaaaaaacggtccggaaacgcaaatgagcatcgtactttcgcgactatccggtatcaaaaattgaaagttgacgactcgaaaaaaaaaaa

SEQ ID NO: 4243 - DNA, 364 bp, Aspergillus niger
cctacttaaacccaatgaaacaccaccaccaaccctgcatcgtccatgaaccagacagagcaagggagccagaaacccgactcggagtataagtcatgaggctacacagatacttacttctacctaccacctacctcctgcttctgcctcacacatccccaccccccctacaccgcacttcattatccgaacctatcgtaacctcccaacatgcaagacaggtttgaaataaccatggcaatcgggcatatttcgtggtcctgcaatcacaaacatacatgcagcagtagttagactacctacataactacttgctgccttgagagtaaatactatagtcttacttaattaatgcagctcgctt

SEQ ID NO: 4244 - DNA, 339 bp, Aspergillus niger
cttggcgaccacacttatttgacctggaacaatgagcaggagagctcggctgtggcaaccgggcgggatggcagatttggctctcatgctacttaagaagcatacctttactttcccttgctcttcttagtctacggacataatttacacagtggattgatacgaggcgtttgtaggtggcgttcctgaagaggatctgatacccactggttttcccagtgggcctatgttttcgtgatagtttcggcatttctatccatctaggaaaattttgatggcacctgctagtcgatgtgcccttcctgatggagcgatctcaaagtgtcaaatttctcggcg

SEQ ID NO: 4245 - DNA, 937 bp, Aspergillus niger
  misc_feature (1)...(937): n = A,T,C or G
ttgttgtcctaagaagcgctctcttagaagaacatggacatctctaatatcaatattatcaggcagattgcgtgctctgattcgtctgcaatattcgaggcagagctggatggacaaaagtatgcattgaagcttttccacgacaacggngaccctggttataccgaaaatggtcgtgatttgaacagatttcgctgcgagttaaatgcttacaagaagcttctggcttctggtgcctgtgcacgcggtttcgtgccaaaattctacggctacatcaatcggatggatcccgcagcatttcagcctgctttacaatctttcgcccgagacaagctatggccgagagcaatattgctagaatatttcccaaatgcagagagtttgaactgcgtgaactactcggacgcgctctatccccaggcaattgagggcatgcatgagatacacaggcgggtgttcamcatcgagacatctaccccaaaaaycttctccttgtccgtggaaaccccgacaggctggtctggattgactttgatgttgcaacgaccttcaccgattttgaacctgaacagctggcccgctgcgaccacgaaattgcgcttgtgaagggatttgcggaagctctgagagatgaccaggctgagggactcccgccgaatacaaaattctattaagggttccataggtggttatatatygtgacaatgtttggtrgcatttacgcttgctttcttgtaacagatatcagtcggggcggagtttcaagcaagggccgttttrgtttattttactcctttgtacaaccatgaatcatcatctatatttccaagagccgttctcgaagccaattggatcctaccttagctagaccatttgcgctgcaatcctcgtctaaaataatttccgccaaaacgccgggcatgtcaaaaaaaaaaaa

SEQ ID NO: 4246 - DNA, 424 bp, Aspergillus niger
  misc_feature (1)...(424): n = A,T,C or G
ataagcgcgcgcctccnacctttgtggggttatcgaccggaatggccgactcggagatttctgttggccggccaagattcaggtgaccgtgtatttcattgcctcactgctgtgttcttttctctcttcatttgtttcctttcatacctttccctgttaatcctcggccctgttgttcaaagtcattcatttataatcttacaccgggtcgagcccgctatgtaagatgctagttatgcaggtgcgttgtgaagcatgaatcttgccctgaacgccgtcaagccctcgggcctcgcagaaacacatgaggttggcgaaacaatgcgtgccgcgggatantaagatcgtcgccacagctaaacacaatgaaagacaccacgaaagcatagaaggaaccataaaatatgatatcaagaaaaaaaaa

SEQ ID NO: 4247 - DNA, 421 bp, Aspergillus niger
ctcaagcctgatacataagtccttagacggcaggaaaatatggctgcaaaccacccaattcatattcatcccgctcgacctctctatcgtttcaccgcgactgcattgggagctagcatgtggttctttctgatgtacagagcgaagaaagacggccctgctttgttgggttggaagcatccatgggaccattagttgccgaatattctcagacctgaataatggtctcgtttgttgagattggaagacaatcgattttcttgaggactacatcagatatcttaatcgagttgttaacacaaaaggttcgcgctttctgtcgtcattaaaggaaccatccagtcagactcttaagtcaggatgacgactatatatttgaaatattaggagatatgcaaaagtggaagttcatctaaaaaaa

SEQ ID NO: 4248 - DNA, 420 bp, Aspergillus niger
aacaagtccacttctttactcccatctctgaaagcaaattataatccaatcctcctgataatgcctcacaaagacaccagctcggtgcctaaccgcacagacggaacctctgactcttcagtcaaccgcctcgcagccacgggaaacaccctcggcgagtccgcctttggctcaggcatggaccgcaacagtggtacgatacccgaatacttgtccacgggctccgaagatctcaggcctttgagcaaggaggaagcggagagattatacgaggagagaatggaggaggaatacgcaaagcgggaggggggtgcttaattgggttctttgattattatttttaacttctacggagtattgtgtatatatgtatcagattgacctgcacaaccatcatgaaccggaaggaaaaaaaaattg

SEQ ID NO: 4249 - DNA, 480 bp, Aspergillus niger
ttcaaacgatactattcgcatctttgataaagatatcaagaaaccagaacaatcattactactctctataaggatatatatactttacatctcacacatcatgaaatctactactactacttcctccgcccgtctccagaatgactttggagccgatctgtgggtgaagaatccgcctaagcatcatcccacggcaggacgcggccttttcgctgggcttcaagacactaagaactataatgtcgagtcgggctgggcgaagcgcagcaatgtggagagtcaggggtttttggggagtttgttgagccggttcattgggggatcgtataagcctcctactgattagatgcattgactgacggttatggggagtgtttgacggatttatgatgtatctatggtttttgtttggtgtttgggattcgttatagcgttagattatagtcattgtgaaacagtgttcttttgaaaaaaaaaaaa

SEQ ID NO: 4250 - DNA, 427 bp, Aspergillus niger
aaaaataattgggaaggacctctatctgaacaaaacctgctcatccgaatcatttcgaccatgagtgaccaaaaggctcgcgagagcttcgcgtccatcctcagctactaccgccacaatcgcgagtcgttggaaagggtcccaaactgggttgatgaccctgacagtcagagtatcgtcattggctttcttagggacacaccgaccgacgaacaagtcgaacaggctaaggaggaactaaaagctttaatggccatagaggaaattaaggaaacgctgtctgaaacggagaaggatttgttgacggcggcttctctttctagccgtgcaaaacgactgcagaacaagaaggacaaataaggcgatacccttgatttagatttacatatcaacgtacatgttctgattataamaamaaaaaaaaaaa

SEQ ID NO: 4251 - DNA, 139 bp, Aspergillus niger
agaccttgggcttcctgtcagccagtgagccgccgctcactttactagtgtaatggtcggatgtgtgcacagctgacatattctgttttgaattattgacgtagccgattatatgtattcatctttttttttcttcttt

SEQ ID NO: 4252 - DNA, 133 bp, Aspergillus niger
atgggacaagtcatacttacaggaccttgaagatggtggttgtactatctaagaaaggctttttttgagagtactcttaacacaagaggaggagggaggagggggaagtagtagataaataataaacacgacc

SEQ ID NO: 4253 - DNA, 103 bp, Aspergillus niger
gcctcacaatcgaggctcgtttgtaggtcaggccatgcctcgctgattggacgggaaccgtaacggtagaaatagcagcatgccatcatggacggacactttc

SEQ ID NO: 4254 - DNA, 549 bp, Aspergillus niger
caaccagcgagcaatatgagttcatcagtcgtcagcttcctttttcgcgatggctcagttgattctgtttctgtccgctacaagggacaagttatcgatacgcgaagaaagttcatggtggacggctggattgtgatgcaaaatcaaactttcctcgatgccacaatagagcagaggcaaatcgagcataatgatgccgttaagcagtttctccgggtggacgaaggcacatatcttccgggccgttttcgaaagcgcgaaatgaataaaagcaacagcctcttcgtgccatccagcggtttgcccgatcttaaactcatcaacgtgtttcacctcggtggtcaaagcaattctacttggatattcgaatatttcactccaaacgaacacttacggaaaagcgttttgctaagcggaaccgatatcatctgtgttgcgggatggatgaaggactggagaataccttacattcaaggacaggccggaattttggcccgagatagtatatttgcaacaacgaccgtttgattgactagggaaaaaaaaaaa

SEQ ID NO: 4255 - DNA, 106 bp, Aspergillus niger
  misc_feature (1)...(106): n = A,T,C or G
ncanatctcnagctagggtnctcatgcgatgcnatcttcactcnaagcctgtncattatacatcgcctgatggatgaacagactgcgatgacngcattgtaatctc

SEQ ID NO: 4256 - DNA, 567 bp, Aspergillus niger
  misc_feature (1)...(567): n = A,T,C or G
cttcactacttcctgtcaagtcttccatcgactttcatcacaaaaaccctcgtgcaatgtaattccacctgcgtcggcccctccccggggtctcgtctcaatacttcattacacacgatggaagtcatgcaatgcctttggctggactctctcaatgatcaggtatctcaggtaaatcttgggcgtggaccggtgttcgttcctatccgttggttgtgcagcattgctagcattgctgcctgcatcggctctgggttcgttctgagattatacggttaaactngatctggataataccagcgaaaggatcatgccttccctcgtttccccccacttgatggaatggctacaattccagtccacctaccaacaccttaaagcaacatgcttctccgctgctatctttgancccaccgnggtcccactggcataaagtncacgtgtgtcccngaggccgttccgtacttgcttggtncaaacccagtgtttgacacttngttggcaagtggacaacttcaanttcnttccatcctganagtanggttcggtnnttgacaaaccttcttc

SEQ ID NO: 4257 - DNA, 359 bp, Aspergillus niger
gtaagcgcaagggtctcaaggagcaggttcctggctacgagaactactacgacaagctgtaaaaaccttccatacaagccgactaaaattcgaccttgtgatggatggaatcctctgtttatgagattgacgaatgcaataccctgtctatattgagggggaggatataaaagaaaaaacagcttaatgtcgtatgtggattttcgaccgcttagagaagtagaatcgagctgtgcacgagcatatgcgatggctttatttttacgttaacgaccgcgagggattttccatagctcctttcctattccctcgattggacatgaaaaaaatatgatggttttcaagttcaaaaaaaaaaa

SEQ ID NO: 4258 - DNA, 343 bp, Aspergillus niger
tcggctcgtgcttctgttcctttccttctggtttggacaggagcgcggtcgttctgagattatactgtcaaaacttgatctagataatactagcgaaaggacatgcgtggcactgattgtcccctactatttgacctacagaagacgagagggatctcgcatccctctctgttgctgacagtttccagacctttgcaattaccctcgacctgagtgtatttgtgccaaaatgtctactgacaagatcaccttctgaccaactggtatggattgggatctctattttgatttttagaaacaggtcacagaatatatgctaaatcatgcgttcaaaaaaaaaaaa

SEQ ID NO: 4259 - DNA, 118 bp, Aspergillus niger
tggagatgattgattgattgattgattgattgatatctgctttgagatatggacaaggatgtgaatgtgtcttgatgccgccactagtactatgaacacagtgacctgtatatcattt

SEQ ID NO: 4260 - DNA, 150 bp, Aspergillus niger
agtactgatagtacttctgctgttgaggatggaggaggtactactactactaccactggaaatggaagtggaggatcatcgtggtttaagtggtggtagctatctactactagtagtagtgagaggaactttttgatgtgtttacgactc

SEQ ID NO: 4261 - DNA, 416 bp, Aspergillus niger
aactcgcagtaattgatgctttacggctctcctttcccaggctcccgcaacatgataaattgttagactggttggctcagtacgctgcatattgtttagaaaagctccgggtacaaggcccatttcatgatctccttaaagagttcccgaccttgagctcccgcatgatactgtctctgggaccagcatcgactccaccatggcggactacacaaccaaaatacccatttattcagtactctgctaaatggtcggaggacaaacatggtcactagcataagcataacagctctgctagattatggatctttccatcgttctctatttagaatatgaccttctacgatgacatctcaatttacttgatgtcgattggttaggagaagtgatcacgctattcaactcagttttacggc

SEQ ID NO: 4262 - DNA, 267 bp, Aspergillus niger
gggctccaaccatactatccgaattaccagacccgtctgaaagctcgcgcactacgcgatggtatccagtcggatgggtgagtctgttctagtacacagagctgtttatcggataggatcatcaaataatagcgcgggtgtcacggggaatagaagacctatttggagtttcggagtgccgacgaataccgaagggccgggcattgtaaattgctactattattccaaatgtatataagaacttaagcatttgcgtctattgcgagt

SEQ ID NO: 4263 - DNA, 198 bp, Aspergillus niger
cggtaatgtcctgcggcagtgattccccgaccgtcaggaccagactgacatgcagcttgagccattctcatttcccggcgtcttgagtgttctgttctgctatgatactgcattacctgtttatctttttctgtttgttttcgatgactatgcagagttagtatggcgattaagggaatggcaaagatttgtacagag

SEQ ID NO: 4264 - DNA, 191 bp, Aspergillus niger
tttactccgacttttcaattcgggaagggctaggaagcatgatgtcatgagagctggtcgggatgaccagaatagcgccgtgctggccaagggcggtaacatctatgtaatttagcaatactgctaccaggcgggcattgttctccggccaggccattcagaatggaaaccaaaaaaatcttgggaaattc

SEQ ID NO: 4265 - DNA, 321 bp, Aspergillus niger
gttcattctgagccgggccacttcccggtaaagaaatgtgtgcatctacctggccgtgatgaaagaaagcaagtacccttgtatctatttccttttcgacgtctcctttcgcgtgtcatatatctgtaaccccaagagcgtttcgtttgtgtgactagtttccattatgcattggtcaatctccttccctacatgtggtggtggcccagtcctaattgagcctgttttattctgtttcggataccgttgagttcgtgagagcgtaaggttacatacaaatagcatgttctgctcccattcgggaagcgtattagaccaccc

SEQ ID NO: 4266 - DNA, 185 bp, Aspergillus niger
ctaacttcaccctgtcggatacccttggcgttctgctttcggatcaatctcctacacactctctcaatgaatggctagaggaaagccttcacgagatatccactagcagttacttgttctggtggagttgttatttatactagctatatgggctaaagaaacaaattaatgagaatttgcagttt

SEQ ID NO: 4267 - DNA, 299 bp, Aspergillus niger
ctttggggtctttcttgtcggtggctaattatagagatctgcctgacctattttgacagtcaagatcgcgcaaaaatgccttctatcaatcctaacgcacaaatctaaatcatgactcatatgttatgcacatgatacaaagttgcctttgatgccttcgcacccacacggaatcttcaagggatcgcagtttcgctgccgaatggccgcgtggagaaagcgaccacacgagattgggaggatactccggaaccatcacaaaatccagacaaagtagtcggcgactacggtttttctat

SEQ ID NO: 4268 - DNA, 483 bp, Aspergillus niger
ctggggtgaggagatcggattgagggatattttgttgttccacctccttgatgtgctgaaacaaaaaccgtacagcgacttcatcatgtgtcatgtatctgagacaagctcttgatatttgaaaatgaccagctccaacgacggactgagagagatgcgggtcacacataatactgctgaggaatttattgagcagaaagtcagccactgactggtgtataaattgagcttcccgatcagaatcttcctccccaggttcatattgttcccatatttcacgcgattgaaattctaccaatcctttggagagatgtctcacgtgaacctcaaatttagtcacggtatcagaccagctgctgtgacttctgagctgcgttccaggttccatgtctatatcaatagaaagtgcatcccgaagctcgtgagcagacaggggtctcttagcaaatagaatccattggaacagcttgacaaaaaaaaaaa

SEQ ID NO: 4269 - DNA, 248 bp, Aspergillus niger
gtctcgtggttcgacttgagcagacttggaaatgcagtctacgctctatgagtatgatcttttagggatggtgaagtgctggtagacaaggggatggtggaaggttttgatgtgattgatcgatgagactgctgtgctcccaaacatgtcattcgttgtacagtaacagtctcactatgatgaatgccccggtggaaatgcatcgggattatgttgtccaaccgatcgttatccagacttgcgtagac

SEQ ID NO: 4270 - DNA, 239 bp, Aspergillus niger
catcagaatacgctgtgtttcccactccgacgatccttcgtctttaatttagcacccggggcgttcattctttagtgtgtatggcgttatttggagttggcctacttttcatgtcgacggagcgagttttttgagtcgacacgggtttacctattccatgtgaaaaaagcgacgagatgtgacgagggaccttgattgttgaaatcctgcatagaatccagatatccaaagtgtgatac

SEQ ID NO: 4271 - DNA, 320 bp, Aspergillus niger
gtgcccgtgcgggtgaagctggatgctcaaagagactggaaacattggcagaatcaagccaatgtgcgcggtcggatttgtcgcgatctatggcggatgtgtacggaagttgtgcccgacaacatggaccgggaagaattatgggagaatctgggattggaaggccctttccccaaatgatgatgaaatgtgagctagaggtctactggtcacaagcaaacactggtccacgatcctgaaatctcctattgccattgatactatacatacgctgtatggcccgtgatatattctaatggaaatatctttactcaatcggg

SEQ ID NO: 4272 - DNA, 280 bp, Aspergillus niger
cgacttgcatcctgctgttcgcagacaggaaacggattgggagggatgtctgattgcatttcagcggatcaaggattcaccccgcgtacagtacactcgaggattccaattacggccgtacagtgcatgactatctatttgttttttctgatagaagttttacctcctttcttttctgtccctcagttcccccatgagggaaccgggccgatgtgggcgtggaatcgcgttggagacagaggatattttgaagacaggatgatcagtcagactaggtaac

SEQ ID NO: 4273 - DNA, 105 bp, Aspergillus niger
cgaaatatcacgtgaatgatcgctgatacttattctttgctatctgcttttctagtcgtaatatgattatagcacaagcatataattaggattcttgtggtttgt

SEQ ID NO: 4274 - DNA, 271 bp, Aspergillus niger
ccaagatgaagaagggcgtttacgcttggcagttctcgtggttggtctggtctcgatcaggttaacccgggcgatgctgacatgtccccgcctctcaccatccattagggacaatttgaaccatccgattggaattgtgtttgtgtgtgtctactgaatgatgtgatccacaactacatggctgataggtgataagagttggctgggacatgggatgaagtgtcttcaagatatctgtagtggttataatagatcgtgtctagtttatgtg

SEQ ID NO: 4275 - DNA, 621 bp, Aspergillus niger
  misc_feature (1)...(621): n = A,T,C or G
gcgcatcaagcagcattgggggaacatggaaagtcgatagcgccaccatggattgtgcaggatgttagaaccaagttgaacaatctgcattcagactcgggaaattgcaacgcagagcagccgaatgacacggaggggaccacttcactctccatgcccacggagcatgatattcctaatttgctatctggcatggaaggatttggcagcgtagcttgtgggcttggtggatattcggacatatttgaacaggccgtcatggatgttgacgcggatcagtcaggttggcccacgatgaacttctacccgatgtggtagaggaatagaggatatgcttgtcgtcattgcgagtctctgtacagctgccactccattgtcggtcgagtgagattatatgcgctaaccaactgacgagcaatggccacaggccagacatcgcacaactcgtccatactcaattcgaaggctaacccccgtttctattcatcgatcaatattggacacgacgattttctcgctgctttctaaacagtcgatagtcaagaccatggtcggcgctttttatcctnctggctaggtttangttttggcgatccagaggcccgagtagaaagcanattg

SEQ ID NO: 4276 - DNA, 587 bp, Aspergillus niger
  misc_feature (1)...(587): n = A,T,C or G
gccgatcggcattgcaaaaggcgttgaatggcactttgcacaacgtgagaagacattcaccagcgacttcctggttgtggatatgaagaattataacatcatcctgggaagaaaggatatcaagagattgagaatcctcaaatccggacctggccttgaacggcgtacgatgatccggtcgtcgtcctgtgcatgaatctgaacaatttcatgtttgcacatcacgatactctaacccattgtctatgaacaccaagcccatcccgccattgggaggcaacacgcatttcttatacctattttatgattgatggtgataccagtaaggacagctgcggatattgcatcacaccggtacttttgggcaagtgctggctgccaactttgcacngacncagcaaaaggtttggaccagttaatgactcgnattttaancgaccggatgtatttgattatgattaactacgatgacatgtcccattgaggcncntggaagtgtgtgatgatttgctttttgaacctattaccttggcggcgtttgtggaaaggggttttatcttgctggttggaaggcttggaacaaggca

SEQ ID NO: 4277 - DNA, 468 bp, Aspergillus niger
  misc_feature (1)...(468): n = A,T,C or G
ctaggtgtagcgcgtgccatattgtagggcatatacgtactagatgtcctaatcgagcagtatcttgagatagagcgcttttaagcgttgaattaggtgttcaaaaagcatcattttgtatgtaaatcagaatgatgatatactactagcggaggtggccgactcgcttacgtggccgactcgcttgccgcttacgttaccttgcctgagtcaacctggtcaaccgcctcggaagctaagacctatttcctgaatagtgcaggtgtatcgctgaatgggggaataacatgctctcttcatttttttgtttgggatttcttttcttattttcttttctgcccttccttaatgttttgcagatgtgatatagaggaagttttgagttacaacggtatgccagcatgaagtanggcaagtccgtaagttagctacttaaagtactacttattgntatcgaaaaaaaaaaaa

SEQ ID NO: 4278 - DNA, 129 bp, Aspergillus niger
gacggccttcggagtggtacattgagtagatggacaggatggaacggaactattttttttacccttcttgtcactcgttgattgactgatttagatatgatgattttgatttcttgtttataccttagc

SEQ ID NO: 4279 - DNA, 442 bp, Aspergillus niger
  misc_feature (1)...(442): n = A,T,C or G
ttctcaggagtgaaatccaacggcttgtacgctagactggcagtgaatttaagctctgcgcatctttattagttctttctcgatccatgtacaatctgctcgatatgcgacatccatctcatctgattccatttcaccatgaagggacctaccgtgattctggcttttcaattaatactataccactgcattcagcaccggcgttctgaggtccatgtacgcctttattctgtctttttacttcgggcttgtggctgacacgggaattctgtctgattcgaaattatgcattcagtggacatctatatctcagaatcatgttgaaaacggcgttgtattcttcactgcgaggtgaaatagaaccagattatctatcccatactactcatgcctcagtctccgaatctcatccaaatgncatagcacagtcaaaaaaaaaaaa

SEQ ID NO: 4280 - DNA, 312 bp, Aspergillus niger
cagccctccagtcgcaaggacagtggtaactcggctaccatctctggcaagcaggagggtctctctaacactaacacggacaacccgtacgtgaacgagcctggaaagagtgcaaagggtgagggagaaaccgagagcgccaaggtgaaggggaccgtttcccccgagcgcccccaggcttgattgagatgactgtggatcgtacatgtgaaaagtccacttgtgtctttgacgaaggctactgtatttatcgtccatgtgacatgattgcaaactagatcatcaaagaggtgtcaatgtaaaaaaaaaaaa

SEQ ID NO: 4281 - DNA, 310 bp, Aspergillus niger
gacgactggaaccgctcaagcaacgcagtcagcggttgtgacggagggagctgctgtcagcactgccgtgtcgaagctgagtctgattgtggcagttcttggagccattgtcatggtctagacaatagaccatgttgaccatcataccgatcaactgtgtcggttgcatactcactcaccatcatcacttttcttggttcacttctgataggcacctttttcacacttacacttatacccttatgattgacgttcttgtatatgcttgattgatgagcatttatcgataatgtttactgttaatatagtc

SEQ ID NO: 4282 - DNA, 217 bp, Aspergillus niger
acagagcctgccacgaccgtcgtccagccttctctacggcgacgtgttgccttcggtctacggactgatcggctctggagagtaatattccttgataggaagtttgtctctcgttgggtcctcttcagtgagggcgatgaggggtgaatgtcgatgacgggatacatctcatcttaacaacaatgaataatgaatttgaatttaaaatttgcaattg

SEQ ID NO: 4283 - DNA, 209 bp, Aspergillus niger
ggggcaattgtccaacaaagaccgttcaaagatttgatcaagtggggaaggagttgtctgggcgggcgatgaaagaaacaagacgggccattaaggcggcgattacttttgattaagtgctggtcactagatgtatatattaatgagttatgtttgggtatgaagctttgcttcttgactgagtccaatatcatgatgacattcagttg

SEQ ID NO: 4284 - DNA, 231 bp, Aspergillus niger
agacgtgacaccgatcattcttgcgagtcgccagaattcctcatcgtcggtgtcgttgacgcgcttgaagaagcgtcggtgtctggaggtttgaccctaccagcgctgcggacgccaagcccccttaccataagactggcggcgaaggtctgggaattactgcataaaatgattcgacggtcggcagatatacacgttgcgtttaatcaacctcttttatagtccgggtgg

SEQ ID NO: 4285 - DNA, 139 bp, Aspergillus niger
cagcccgttcgggttggtcgcaacacgaaggcgaagctgtaggatggtttgtagtattgcattagcagttatgagatggagttctggcacttgtatataggttagggataatagcatcattcacaggttctcatatacc

SEQ ID NO: 4286 - DNA, 206 bp, Aspergillus niger
ctgccgagcagggtcttgtactcgtatagcatactgttttgagaaattgggacccttacggctcgagctactgaagcttctactcatgctttgttgatctttcttctttgtgttgtatttccagtcctgttcttgctcttgagacttgctccaaaactgttgcaatgagttttagatgaatcatgtaatatttaccatctcgcccc

SEQ ID NO: 4287 - DNA, 102 bp, Aspergillus niger
cttgttttttccctctttcttttccattgcgatgctttactgccctggcccactctggcaaaccttgaggaatgaaataaataatcagttatgtcaacagat

SEQ ID NO: 4288 - DNA, 607 bp, Aspergillus niger
  misc_feature (1)...(607): n = A,T,C or G
ccgactactcttgtatccaggaggagaagatcaagtcgaaacaattaaaagacaaaaagaagaaaaagtacccgagaaggtcgtgagaacgcatagattagatggctcaaaacagagaagagaaaacaaagacaggtttttcaacttttggtacttccggtctcgatgacagcgactgactgcagcctggagcccagcagttccataatcttacgacaaatttccccacccggatacagactttctgagatatcacggttacgttccctttaatgacatgactaagttggaatcgtcttactaagtgtacttttctttttctttttttcttttctttttttcttttttttattattttacaatacttcataggcgttttattgtgtgtgtgactgggccgcacaatcactgatgtgcagcctatcctcgtttcttgttgctttggtcaaaggcgtgcctggtttgtgacactggtctgttcaattatcctccctcagcttccggaatggaacgaaaatagatgtttgagacttttgtcgccatctgtctgtaatttctaatatgtcntgcattaattgtattcaatgtgacccaaggggctggattc

SEQ ID NO: 4289 - DNA, 138 bp, Aspergillus niger
ccttgggttgtcattttcttatgtattgcgcatgataccagctcaccgtgtcactgggctttgcttttgtcattatctcttagttggcagtgatcagatttatgattgatgacaatgtcaaaccaattaatcaaccgc

SEQ ID NO: 4290 - DNA, 123 bp, Aspergillus niger
caaagatcgtcacctctgacagggcgactaagatgacccgcatgctactataagtacaactgggaaatgttccgctaatctaactcgaaatcaacaccacgcaatcgctcatgctttcaactc

SEQ ID NO: 4291 - DNA, 475 bp, Aspergillus niger
caggaaccattggcagaaggatgaggttctttatctaagtcgaggtcttatccggttgggtcatcgttgttgctagatggacgaattctcgggcagccttggacatgcagctttcaggctctttcatgagtatgaatatcaaaatcagtcgggcgaaggcaaattcagctcggccgtgcaatgctcgatttgtttatatctcagcaatcaaccgtcggtatgactcgcggtgagatctacttcggattcctgacactgcgattccttgtcgcgagcgactatagtacagccgatactatatagcttcttgtcgatatagcttgatagtgcacagcaaggaataacggccttggctgctggttggcaatgtcgatcagattacctagcttcggacatgattagacagacagcagaggatccttggtccaagggaaccaggaccaaaagaaaagaaagttgacttaaaaaaaaaaaa

SEQ ID NO: 4292 - DNA, 437 bp, Aspergillus niger
cgatccgcatcgcaacgcagcctttctcgttctagattccctttctattcttgctaatattttgcctcgaatcgaagatcagaccttcccccaggtctcgatctcggtctgtcttgttggaagaatgaccacccgaaaagaaaattcaaaagaagaacacgggacgaagtgtctgcttcggataccccccatgacacgagctcgaagcctcttataaccaaaaaaagatgatgatgacggggatagaccagcatgggagagggttgggaagtccggacctggcgcaattggcgtttcgagttttgcttctgcatgactaggttgtgttttatcatcatcatcatctttctttcttcttccaccctcatatatcattttctccttgattatcctctcaccatattctctctacgtgaaaagataacgcaatttcaccg

SEQ ID NO: 4293 - DNA, 423 bp, Aspergillus niger
  misc_feature (1)...(423): n = A,T,C or G
cccactaccagacaagcccagtggaacaggacttttcccttgccaacgtttatacgcacgccagcaggccatggcattcaaaagattccgttctctgcgccattgtatatcactaagcgattttctcagagctcaccttacgatttgggtatttatctgcggcttttgcctttcttttgactgtttcaccccaggagatcgacgtactttttatggaaatatatcgctcgacgaaggtagaagggatatggtcaaggagcgcaagtatgactctggcggctcgcccacacggagtataaccttatgtcaatttttgctgggtacaactgtcgtaccgagaagtccaggccattgtcaaaatagtatgaatctgnctttagtggagctatattcatgttggatcattgatcattaaaaaaaaaa

SEQ ID NO: 4294 - DNA, 514 bp, Aspergillus niger
gtcctcctcttcctgctcctgatagagaccagaggacgcactttagaagagatcctggctctcttgcaggcctcgcttgtcaatcgtgtcgcctaccgtatccgggtctacaccccgtacatcttcaaaagaatatttctgaggcagcgcgtgaagctcgaaacttttgaggagtctgaatacggtactcgagcaattcgcctaggatccatcgatacggcgcccacctttcgcagctacagctttgtttgatcctgttgtggaagtctacatgaagccactctgcatgcggaccgtgattattattattagtagcgcaagagttgagtgccatacgggagcagggctgtttttaaaaatactaaggctaacggtaaacatactgtcgttactgttgacgcctttaatcaccagaccaaacctcggcttaactgactagagcaatggtcagaccttgtatattcttcatttaggcgacatactgcatggaagttttgtctgagcataaaaaaaa

SEQ ID NO: 4295 - DNA, 415 bp, Aspergillus niger
ccgccacccttcatatccaagaacaagatcgagaaatctcttcaagatgtgcatgaaagtcaactgctcaaactgcaacaaagccacctggtggggctgcggcgcgcatatcccctccgttttggactcagttccggagagtgagcgctgcacttgtgcgcccaaggtggtgcgcgacggaaaggagtacccgcctaaggcggagaaatgactctctgcgggaatcgaatggtagtatgccatatatggtatatatttggttagctgttctggagtgtggccgtggtggtggttctgatgatttgatgagatatatttgcgatgtacctgtgttcaaagtatgacatatagctcgtcgttaatgcgtgctgatattagtccattgatagtggtagccagcaccaaaaaaaaaaaa

SEQ ID NO: 4296 - DNA, 388 bp, Aspergillus niger
gtgcctttagtagtttccaacgaatctcaacccatcaggcgcgacggggattgcgggcatcgagctgctcgtgcctaaagataagctgcaatcctatgtggccacttatacgtgcatagtgggagcatccccgcgcttgtccactaccgaagcggagttcgagctcagagcgccgggttccctagatttctccggggttcttcgcattcgggctgcaacttcggagaatgatgatcaatatctgcgggagaaagggattggcatttcatctctgataatccgatcgaaagctatcggggattttctctttcctgtatcagattatctgcattgaggcgctcgtgctaatccgtgtatgtaccaatgcaacttggaacttgaatcttcg

SEQ ID NO: 4297 - DNA, 303 bp, Aspergillus niger
ggagatactctacctacactggacggtgatgagaatgatttgggaaagttttggcgcaattatggaattatgtttcttcttttcgaatcttccgtttccgattctctctgcttgtcgcgtcttgttcgacgtcactaccgggatttgcgttgcaaaaggccaattgcttttattgtcacagctcccatgcacggggaagtgaccttggggggttttttttcaaaggagacgaactgctacaagcgaagcgaaacaaaaaaagaggaagaaaacaaaatacaataaaaaggctgtactggtagt

SEQ ID NO: 4298 - DNA, 549 bp, Aspergillus niger
  misc_feature (1)...(549): n = A,T,C or G
ctcgcgcgtaagaggatatcatagggttattataacgatacctttccatttctctttttaacatttatttcatttgtgcaaaaattcttttcttctttcaatttccctcgccacgcaacaaaaagcatgtccccttgatatctttcnatttcctggatatatgatatgtttccaatccatatccgttcctgtgccaaccaaggagaactcgtgtgtgggttgaagcctggttccgcatctggcatggcaggcatcacatccaaccaatacgcaccctatcaatgatcacctgtctttctcaagaaagaaactgcgcataatattgggacggatangatcatacgaagaacgaaccaacgaagcccaaaatggaaaggaggaaaagaataagatgaaagaatgaaagaaaagagcaacgaacggcgtatgggagtccgtctgtctggcttgaaatggaaaataaaaatgggaaaagagagcagaagaggtgctttaacatacacgcgatnagcctagaaccagaagcttgcanttccgttaaaaaaaaaa

SEQ ID NO: 4299 - DNA, 211 bp, Aspergillus niger
gaaaaatggaattagtttaggggccttaactggtgcttcttattatttttctttatgttgtctgaaaaaaaaccagaacttctttactactttatgcggaattcttaaatggaaatgaacgggtttcagtttcggggttgaaatgaatatgcgcggagtcgtgtgtgaaagatgaaattctataccaatttttaaaacgaacaaaaaaaac

SEQ ID NO: 4300 - DNA, 269 bp, Aspergillus niger
ggccacggcaacggcaccttccctttccccagcggcgctgcccggcccactggcttccagaccagcagcaaggttgctttcccctctcacttccgccgcgtctactaaagccatgactgaattgaatttgactgcttcgggtcacgagcttgacgccacgcctgtactgagattcccaatcgtggcgtaaaaagcacacgctggcactgtacctacgagaggatttactgttttgcttctggtacaaacttacttcaattttttttgac

SEQ ID NO: 4301 - DNA, 165 bp, Aspergillus niger
cccgaatcatagacagtcatcagtaacatatattgcaacaaagagggcaggaaaacttgatgtatcactctcgggaatagtactagattctttctttcgtccgttcttagtctcacggtttggcgccttctggctcccaaaagtcttacctttattccatcatgt

SEQ ID NO: 4302 - DNA, 113 bp, Aspergillus niger
  misc_feature (1)...(113): n = A,T,C or G
naacaatgcgcanatttggtggaatatnangatccctgtcnanatcactgaccaagcatggntctgcagagcattaacganggcgggtctagntcggtganatganaggtgcg

SEQ ID NO: 4303 - DNA, 397 bp, Aspergillus niger
ctccacatcaatctcgtctcctgttatagagtcagaagttgcgggaatgccgtctgccgcagttctatgtattatcaacaaggttaaacaataggcgacgattaattccttagctgcttcgactctgagcattcctattgctagttatcagacacaatccaaaattaagtatactgcaatggagttacccatgtcagaggctagagagggcgaacttcagcgattatgtcatatcggcggaagggttatgtattagcctcttgttatggatgcatttttgcatggttatacgcgttctcctaccgtgttggtaaaggaagctttatagtcaaggctaagtggtttagcgtgggaaatggcacttataaaatcctgtacacggagaatagaaagtact

SEQ ID NO: 4304 - DNA, 412 bp, Aspergillus niger
  misc_feature (1)...(412): n = A,T,C or G
ctcctacctcctccataacccccattgtcgctttcgcgcaccgccaaaatgttccgcaccgctcctcgtatggctggattcgtgttccgtgagaaccgtgtcccttactaccagcgtcttttccagcagcacgacggcaagcgccagtggtggaagactgagcgcagtggttacctcatgtggccctacctgatctccgtctacggaatgggcatcgctaccacctacgctatgggtcgtatggtctttggccacaagacctggttcggcaaggcgtaaatggggtcctcgccaactttgacacagtgtacctctatttctatgataggcagctagaaagaaagataactgacgttgtatataactttctccaaagcgtcaaagcgttaatatttgaaaaaaaaaaatncgc

SEQ ID NO: 4305 - DNA, 358 bp, Aspergillus niger
tttttttttttggggatattggagacgaccatttcttgccttatcatacgcatccaattgtagatggacgcgttcgaccacttggggtgaactggaatagaaatggttgctagagccacgtgggtgcgctggggccgttctactccagatgactgaaacaagctgacggctgacggtgtgacctacaagtcgactccgtgtcagcgagtctactatttgactgctgacgtgctcgatggtttggtggctacatgccagtagaattctagacgaccgccgatgctgagctgtgagcagtggcttcggagagtatcagtcgtaaaaatatacttctatatgtctgcacagaaaaaaaaaa

SEQ ID NO: 4306 - DNA, 299 bp, Aspergillus niger
gaagggtgctaccgcaacaaacaaatgtcaatgatttctgcggtgatacactgatacctgaaatcccacacagccaagtcctacaggttcttcagctatagggctgcgtaggtggagggaaagcttgaggtgacaaatagcttggactacccttggttcgaacatcttcctaaatgactacagcaggttgagggggatcagatggtggtagacttctgtagcgttcaggcagctgggcaaaccacaacacgaatatgtttctcccacgcttctgacgagggttaagcctcttaaggagg

SEQ ID NO: 4307 - DNA, 340 bp, Aspergillus niger
gggggggttgttggcaaggtgtcaccaacgcagtcgatgctatctacctcctctccctgttgaccctcggatccattaattgacgacaagccacttccgccccttccggcgccgcgttccacccgatcgcccatcgctagcacatcttatacctcgataatcttttcacggcagctcttcttctttttcttttggcagcaaccgttgctaccgtgcgctgattgttacccttgcttgctgggacatttgtcactttattggaagaggggagggaatatagaaataaattagcgaaaatgtggattatatcattttggatattcccgattatctcggcgtg

SEQ ID NO: 4308 - DNA, 358 bp, Aspergillus niger
cgaagcagtcagatgttgttccccctccaacttcagctctcttctcatcttccttttcttttcaatcttcaacctccacatcaacactcttcaacatgatacccctttagccatggtctcgtctacatgcgcggacatcagcatggcgttgacattgccctgttcatttgttcctttgtaatttttttaggacaatgactggatctgtcttgtttacagcataggatcgatcactgcgtctccttgcttcactaccacagcatattgtgtcactggccaatagagccaagatttcccatgtaccttactagttaactgtgaaatcaaaccaagcaaaaacaaccccaaaaaaaaaaaa

SEQ ID NO: 4309 - DNA, 404 bp, Aspergillus niger
cactgcatcagtgccgagttgatcaaatgccgtttcccccgcagttcaaaggctgcagaatggctgcctctgcggggaaaggagcctcgaccgttgcgctttggttcgccaactcggacatttcacccgctttgtcgaactttccgattcgcatgcttggtgtaataactcagttgggcggcctgcatggttcagcaatatcgagtgagtcaatgtagcaaacacaacgtgcttgtagttgttggggttgaaaggcgggttgggactcggaccaaaattgaaggaatgtaatcatatgcaaatctggttcgtgggtcggccgatcgtcggctatcaaaccacgcccaaactatgtacagtcaaagctaagaataaatcccaagtaccaaaatccaaaaaaaaaa

SEQ ID NO: 4310 - DNA, 379 bp, Aspergillus niger
cagcgcccccccaaaccgcaaccatggccggtcccagcaagtctttgatccttgatccggccctccagaaatactacgaactcaacgccaaccgctacaagtacttccggtggacgccgcgccatgcctggttctcgttcctctacatggctttgattcccggtgcgctgggctatgtcgcttataagactgatggtctgtaccagctgcgtggaaagcgcaggggcgatacgattgtcgagtggtagatcgattcgattctctcaagcatgatggtgatgggaggaagaaaagcgtgatgtgatgtgatgggacgggctggatgtgtatctactactattataccgttattgaagatttcgkttactamaaaaaaaaa

SEQ ID NO: 4311 - DNA, 304 bp, Aspergillus niger
gaatagcaacgtctggcaagttctgggcggtggtacccgtctcgtgtttgttgatgccatggacatgtaaacggctattacttaatttagcacgagtctgcagtcatatgttgctgctatttttcatcgattatctttttactattctacttcatctgagagacgtgcatgaggccatgtgagattcctgtgggagggtagaccccggaccggtgtttggtgttaatttttcttggtatcatctaaatgaatggcattgaataatcaagcaagacaacgtgcataatactatatctagtaaaag

SEQ ID NO: 4312 - DNA, 336 bp, Aspergillus niger
aacccccacctccggtgtttcgatcatcacgatgtctacgcgtcatgcatccctcacggtggtgcgtttggtagaggggcggggaagctaaaaagcatttaaacaacggacccccattcattcgcctttcggaggtggaaaaacacagccgcctggcggctacaacaaaacttactacgcaaaaccacgtcatcaggcgtggctcttctcagattccatcgattcttttccctgattgtcgacctccgtgtatatcgaagcacagggacctgtgctacaagctgaagtacatactctaatggattaaccagaatccttcccctcgaaaaaaaaaaa

SEQ ID NO: 4313 - DNA, 286 bp, Aspergillus niger
ttgcagttgccgagtcgctaaatttcaatccaatggatgccatcagctctgccacgatccatttatatccaccattcagtgacgccgctactactttggttttcccgcacttgctccaccatcatgaacagccatgatcccagtgtccaccagcacctcaagcaacttagccactattgcccgttaacctagataagtacactgatgacaccacaacagatcatcctgttcagcgatagtactactatatttattactattcatatcatcaatcattccggtgggg

SEQ ID NO: 4314 - DNA, 211 bp, Aspergillus niger
  misc_feature (1)...(211): n = A,T,C or G
tggtggacgagatgaatgatttttatatggatgggcatatatgcatagtggtggattagcccgttattctctcttantttattattatctattacccttgtataacatataccactttggaagttactacccttattttatggggttggctatgtctgtgatgggcatgcatggacaggaactgaaaatatagataaaaaaggatcattcc

SEQ ID NO: 4315 - DNA, 206 bp, Aspergillus niger
ggtctcctctccgccgagactgaagaagaggtaatcaagcgtgagaatctgcagcttggcgaggatgagcaggaacagatggacacgcgcgagacgtattcaaaggctggtgacgaggaggatcgctttaacacgactgtataattttaggagtttgtttgcatatacggcagttatttcaatgaaaagcattggctatttggagt

SEQ ID NO: 4316 - DNA, 188 bp, Aspergillus niger
agactattaaactgccgttattaagcatattctgggtttagattatatctatcattattattattattattgctagacggttaataacgattaacctacccggcccaaagtggactcacacatggtccatattgattgacagtctcctccggccctcttagttagctctgctgcccacccacatggtc

SEQ ID NO: 4317 - DNA, 151 bp, Aspergillus niger
tacgaggaagttgaggcatatcagtgtcatctaagtgtaattcaattcataaggacatgcaatagagcggttgaagctagtcaacactttctccatgatttctttttggcaaaatgcaaagacggtcgagttatcagacataggattttat

SEQ ID NO: 4318 - DNA, 323 bp, Aspergillus niger
ctgcgactacataacgagccaacagccctatgtcgattgtggatgtttctggatatcctatgaggcttcaaattaacaggccgtgtttctcgctgtacgcatcgaggtttagtttgttcaattaaagctcccagaaagaaatatacctccacgagatgatgcgagatttgaccaaaactgctatattgggattgtgtacaacacgggtagtccatgattgctgggtatgtctgagccagctctgaatagcaggggctgtgatgcgtatcgcgctcgatccaacagccgcatacttaagcttattggttttgaaaaaaaaaaaa

SEQ ID NO: 4319 - DNA, 199 bp, Aspergillus niger
ggcgtttgttgcgagaatttcggcataataacatgtcctgttaccagaggatatctgcttgacccacaatttcctaaactcctcttaaattcaggttatacatcgacagcattatttgtccaagagcttatcactgactactcttgtcgtgatcttacctatccagaaaaagacaaggtcattgctttttccagcatag

SEQ ID NO: 4320 - DNA, 307 bp, Aspergillus niger
gtgctagatctgtcgcgtcccaactagggaattctaaagcgacgcgacacaagacacttggtggatgtgtgctgggctatgcggcctcaaggtatcagttggcacttggtccgtctgaaatgccctccgggaccgttcgccagagtcaggcgatgtcgtgactcaatatagtggcggcggagttgaaggatctgctgtgagaaggtgtgcgataggaagaagactgtatgtgagtaagagagaggaagacgacaagctccaccggaaggccagtgggagcgcacaacaaagactggttggatggtcg

SEQ ID NO: 4321 - DNA, 619 bp, Aspergillus niger
  misc_feature (1)...(619): n = A,T,C or G
ttgaggccggatccactggcttatgatatacccggtggttctccccttccgccgtaaactccgtcagttactcttaaatccgaagaataattgacctacttcatacatttaagggccatttggcatgctaagaatccgtctgtccatgtcttctcctattcaagccttggtgtgacaagaacaagagaagataagcggtgcagagaattgatgtgtaagagagacagagaaagcttgcgcggaacaggtggccatcgggtaatatggaagatacgagtcgtgaggtgcggttgcgtcgatgttgaacaccatcgctctgatttgttgccagcccattggcatggcttagctttcccacgagccttctgcggccggtactacctgaaacacgcataggttgcgttgagatgcgtgggatggctttgctttcactgcaggcatggaaacccaacctgagcagaatactgtgcatttggcaatagtcatgactgggtgttgacgaaagatanagggacgagatgctagaaccatccagcactgttatcaaagtggttatctatccgagcggtcatggacgcnggataaatgtgcgtgatttaacgaacaatccggcctggcg

SEQ ID NO: 4322 - DNA, 304 bp, Aspergillus niger
ggaacgaactaatgtaccttgaggaagacgaaaccgtctacagaatctaatcataaagaacaaaaactcaatttaaccacgttatacgacttagagaaatgggatggatacctacgtgacggctgactcatgcgcatgatttctttacacttgcctctatgtttcctgaatacatataacctgttttgaaggatagttcggcgtctcggatactcaacgtttatattacttgtctctaattgtctatttccttctccatgtgcatctctattttgatcgaaatgccatccatcatacatttctc

SEQ ID NO: 4323 - DNA, 299 bp, Aspergillus niger
ggcaggtgagaagtgttggtggggactcatgaaagggaggatgccatagtgtgtttgttatgttggtccagcgtgcggagcgatctatcaccagctccaatgagcatgtaccaactacatatgcaacggaccgcgaacgagcaagcagcacggcacacactgacacgatggctggtttattgcaagctgtgtattggaggggatttggagcggggagctgctaaaggaggaagtatcctccgcgaccaaagggcgagctgaagtcaagaccgtccgtactaatataacccctctttctg

SEQ ID NO: 4324 - DNA, 181 bp, Aspergillus niger
gcaagctgatacttcatggtttccatcaatatatgctgtagggaagactaattatattgcgcattaggtcatattagttggatttttaatcctggtaattcaattcctatatcgatatgagatgggcagtactgtctcacgtaaccagactccgtaacgaaaatatatactactaagtatc

SEQ ID NO: 4325 - DNA, 237 bp, Aspergillus niger
tgtagcggctcttgccgtgggcgtcgaagaggatgagtaaacgcttgattgcgctccttaataccatccgacctggatatcacttgctgcgcatacatgcatgagctgggatcccggctaccctttttacccgtattatagacttttttttttcccttattaccttgtctctactgatagagtcaatttcttttctttttacatgtatgtatgtcattaatagtggtaaatttagtc

SEQ ID NO: 4326 - DNA, 528 bp, Aspergillus niger
ggcgcactcaaagatgtatcttgtgatctctatcccccgtctggcttgtttcccggtactccgtacagtgccgtcggcttcgctatattatatgagcgagtggacatcctgaggcttctccttgaaaaagggtttctccccgccccttcagacttagacctcgctaaagaaagaaatttcgatgaggccgtgtcacttttggctccatttgcgaaacgcgagttacactatcatctgggtatcgcaaactggcatgctttcgggttgaaccccaaatcgacggaggagcgggcttcaaacaggtggcacagtaaatattgtgctgggggaatagccgacacatctgggaccagggaaccagagccagatctaggtctctatcttccacctgggccggttgattcagacggtgaccccatctcggagtccgaagatagccgtaaccggagggatcatttcacagtgtgttattagtatgtagatgtagttcggctgcttacagttaaaaaatgggaaacaactgactaa

SEQ ID NO: 4327 - DNA, 216 bp, Aspergillus niger
ccaggcgccaagacgggactgaaatcctgacttggattgttttactatcatggtttacgacttctacgttttctttgcggcttgtatatgttaataggatgggtcatagcttaatgactagtagataatgtgccgactgcccaggatcatggtcgtggatatgcagcagcatggatgggtttatggatggtttaatggataaccaggttgaattac

SEQ ID NO: 4328 - DNA, 214 bp, Aspergillus niger
agaagcaatagagtgccaccgctccccgggaggaacaggtataacaacggggtgtgcagtggatgggtagtattgggctacaggaatgaactgctgcctcccaccgcacgacctttgatgacgccggttctgtgcccatcaatcctggacacgatccttcgcctctgttctacttgtttgtcaatgttagcccaaaaagacctctgtatctcgt

SEQ ID NO: 4329 - DNA, 506 bp, Aspergillus niger
accatcgccaaaacggacttttctgccatttatgacaatggcaagatgatcatcatctggacaacggtggagtggacagtggcgctcatgatagccaattctcctgtcttgtggcctttgcttgactggctcgctcctttccattctatggagaatggtccgtacgaacgatcggcatataacccttcgtgtcacttgctaaagcgtctgcgaccaacaaatttgctggaatgcactcaaacattgacatcaaagacggccgtcgcggagacaggctcagtacactcatctcgatctattatccgagggttcggggccaactggacagaggcaatcgggcaagcacaacaaccagatccctttctatcgttggagccgggcgaagtgcgagtgcagactgagtggtcggttgaacggtcgtcagtgggtagattggatcgattaaggccgggaagaagatcgtagccgaaatgataattaaaagttgtagcaccctcaaaaaaaaa

SEQ ID NO: 4330 - DNA, 194 bp, Aspergillus niger
gccaggtctccaaggagctcgaggctcagctcaaggagatcatccccaccttcaacaagtccttcaacgcataggtgagcaacacaatgctcttgggcgagtagcccgccatgtaccgattcaatcctgactctatgtgtatagacaagatagcttgtacaatttgaacccactgttttatttttttttctgtt

SEQ ID NO: 4331 - DNA, 112 bp, Aspergillus niger
  misc_feature (1)...(112): n = A,T,C or G
gggacttgaccatggttatcgatgacgtgatacatcatttatgacttacacctgctaatatagagatatggattttaatatgagttattcntttgggatgtttgaccagctg

SEQ ID NO: 4332 - DNA, 110 bp, Aspergillus niger
tccacatactccgccgagtgcagtacctatagtgcatcggatgagtacgaatatgtaggtttttagttacggtagttagataatgggttagcaacatggtttctctggtg

SEQ ID NO: 4333 - DNA, 170 bp, Aspergillus niger
cggcgccacgtactcttatatccgtctgtttagccttgggtatacgctgagccggccatgatggtcacgttaatttggcggcataaatcctgccttgtcagagaaacagttcttgagttcagcactttcacgatagtttgacgaataaaaaataactaccttttctcccg

SEQ ID NO: 4334 - DNA, 166 bp, Aspergillus niger
ccaacaaacaccttgttcgctctgcctttatatcttctgtttcccttttaccactttcccctctattccttttgctcccctttcttgtggattcctcccccttcgttttccttttttttcttccctatattctaacctgatgagaaattgatctgattaacgtctt

SEQ ID NO: 4335 - DNA, 130 bp, Aspergillus niger
tgcgtacaggatctaatgtagatggtttttggagtgttggaaaatcagatggctagtagacgagaagacacacagtgttttcttcccgtgtcttgggccatctaaggattgcatatgtcgttcaccctgt

SEQ ID NO: 4336 - DNA, 438 bp, Aspergillus niger
gggagcggacctgaaggagtcggaacgcggatggtccacaggcgagctgctgaagatgcacaaacagctccgaccggaccttcaatttcaatacaacgaaatcctcttcagtctactcatgctccatccgcccattcgaggaatcgatgcatttgaggaagaactgcttggcccaatttgagcgagagcgacgaccaaaattacttttcgagatacccctttcccctgccgacattcatctacttttagccattgttttcttttcttggtttgaaaagaagcgtgtgttgtgttatgttgtattgtgttctgtatgtttgtatatttcgggcagaacagaaaaaagtactgattaggtacgaatccaaaacccatgattgttttccgcgacgtgcaggaacgtcgcagcagtcgtacatgaatatttaaaaaaaaaaa

SEQ ID NO: 4337 - DNA, 375 bp, Aspergillus niger
ctcgacccacgaaagcgggtaagtgactcacattgtgcagattctttttgcatttccgtctgtctagcgtgtaggggactccgttcccacgctaatatccagagctggctctgatgctcgaaatttatgaggaaacgaaaagtaccaaaaagtttgggatggcgttctaaaattgtccattcctgggatacacaaaaaagagggatacagttttatgatgaaatgaagcttggatgtgacatgcttgtatactctaaacccggagatttcctgtatcctagtagatagacctgagcgccgtacagtatcagtatgtacggcttgacattagtcaaaaaaatgtcaccatgataattcattcatacaaaaaaaaaa

SEQ ID NO: 4338 - DNA, 420 bp, Aspergillus niger
cgtcgaaagaccgaacacgccgtgctttggatgtcccccctctttccatcaaagaggttagtcactcctttggcagttacctgccgcgccaattgaagccgcctttgagcatgatgctataaaatgcaagaaagaaaaccaagaaagacaaaaaaaaagggtaccacccatctggatcatggcagtctgccatgaaggagccagatgcgctacgtggaggagatgggatagttggggatgtgggagaggaaataggaaggaatttggaaaaaaagagacaagaaccgctctataccggtctcggatggtatagccaggtggatgaaggatgaaatgaaacgagcgacgtcaaggtcatgttagctacgttgttcacataggatacgaatgatgagtgatgacttgcctaaaaaaaaaaaa

SEQ ID NO: 4339 - DNA, 400 bp, Aspergillus niger
taagcaggcactcactttatggacaaagcgttcatctattgtacgattgcacgatcggctttctctgacatggctttgaagatatttgtttttccggtgcgcatctatataccctataatctctggcggctttgcggatcatacccattttacgaccccatggcagagcgccccgacagttctttgttaccaacgctcgctcgcttgcattcttcctggtcaattgggttgcatcctcctgcgttgtgtttctgttcagctctgcgaagcctaaccggtgtttttggtgtctcgcatatggtttcgtttctttttgatcttaggataccccgtgtagatagggctgtccgtatagaagtacatagactaataccactttttcttctgcgaaaaaaaaaaa

SEQ ID NO: 4340 - DNA, 563 bp, Aspergillus niger
  misc_feature (1)...(563): n = A,T,C or G
tctgacatttccgctgacacggtgaccatgggataaatcgtctgccgaccatgacaccgggcagaccgttctgcaatatttgaggttttatacggtaccacgcacatatgcgcgcacatgatactcttacacttggtgacaccatcaagttgattattatctgagtctccagcgcacagccaccgaattacacaccatagcacagtggaccccgagcagagagtagacgagacgatgaaacgaggccaaacccacgactgaattgagccacggcccactgatcagcgacacccaccattgccgacaccacaaaaggggtcggtcaagcaatctttcgggtgtggcttgaagggccgccgtcacaacctccattagacacctgccatcgatccgatcgcggcatctctcctcatgcggggcgacgccagtgtacttacttgctcacacttacgtgtccgtgttacaggcaaccaggctaatgtcccataactgtaagggggaaagaggggtgggcaaagggaaatggaaaaagatggaggggtaaaaagnccgngaacggacct

SEQ ID NO: 4341 - DNA, 336 bp, Aspergillus niger
  misc_feature (1)...(336): n = A,T,C or G
ngttccttgaaaaccgtgtccccttacnacaagcngtccttttcaagcaagcaacgacggnaagcgccaagtggtgggaaagactgancgcaattggttacctcatgtggccctacctgatctccgtctacggaatgggcatcgctaccacctacgctatgggtcgtatggtctttggccacaagacctggttcggcaaggcgtaaatggggtcctcgccaactttgacacagtgtacctctatttctatgataggcagctagaaagaaagataactgacgttgtatataactttctccaaagcgtcaaagcgttaatatttgcaaaaaaaaaaaa

SEQ ID NO: 4342 - DNA, 343 bp, Aspergillus niger
gggacgccggtggacaatttcacttggaggacttgtttcgcaactcatcttcaacatgagcaggcgtcgatgtcacctcttcttgattatagcattgcccgctcatctgttcggttcctgggcgcttttcaaacgcattcagtaaatcctctattttgttttccagggtgtccaaatgattttccagcgctagagctgtcatttcgccactgggaacagtcttttagatgaggacaagaattgattgtcttgcacgcataccttgtaatatctttgaaagcctgttgctagcgattagcatcttcgtgttgaatgtagcaatactttaagggcgctctcgggc

SEQ ID NO: 4343 - DNA, 255 bp, Aspergillus niger
ccgtatcacgacacgactcatgtacgttttgcgaagcttgccattcatctctaactatgaccttgacgactatgactatgcatgcatcttgcattagcgaaaatgttcattggttttggacatattccttttattttctctttgcatcacactgcatccaacatccaaaattcaatttaagccgtgttgatcttctttggcatgtatatcatgatatgtttttctgtttcaaaaagaaagcaacgtctatttaat

SEQ ID NO: 4344 - DNA, 300 bp, Aspergillus niger
gtgatgtggtgatgggtatgtactgtggcgaccggtcggtcgggttcagccttgtggtttttgaaccacgagtacagagtacagagtacggggtactcatgtaggggatatcattgacatttattgagaattatacatgtcctgtcaagtcatgtcgtgtcatcctttaactctggaaagaatgtgagattatgtggtgtaagtgtgtgggtgtgtcaaactgacacattcctcggatcggtcagcccaactctactctcacatccgtccccaagtgtcggtctggcagacacgtagctg

SEQ ID NO: 4345 - DNA, 205 bp, Aspergillus niger
atgccattgaggccaatcgatgcgagccatggatcaggtacattgggcctgtggttcaaccattagaacagactgaaattgtaaacatattcgtccaatctaatggtcacaatgcactaacatccagtggccgtacgtagtgcgaaagtgaaaataataaaataaaataaatagaaatgagggcaataatcaaaagtcagggtgc

SEQ ID NO: 4346 - DNA, 198 bp, Aspergillus niger
cagcagtgctagtatatcggtaatatgtgtttcttggagttgggacagataaaaggtcctctttcagtcagtgatgactgtccagctattgacctggattgtgtggcagttatgcaaatatggactctgttacctggattgccagagtgcatgtatctgtctgtattatagttcatttctacatggaatcagaaaaat

SEQ ID NO: 4347 - DNA, 195 bp, Aspergillus niger
aacaaagcatcggcaggtacttggccactcatcatcctttccgctcctacctcgttgggaagccgtatcagtagggatttcaaaattatctattcgcctcctgagtcatgctgctgcatgggtgattataggacatgaggtcaccactgacgtggttctattatattgatagtaagaggtcattgcgaacgatat

SEQ ID NO: 4348 - DNA, 167 bp, Aspergillus niger
tggatgctgatcttgaggttggatttctcatcctggttggtgatatcgttattgggttgttgtaaccttattactttgacgtgtatgttggtatgagggtggggatgtatgtatggtacttgatggcatgcatgaagaattgatgaatggaatgaaatggatatatg

SEQ ID NO: 4349 - DNA, 328 bp, Aspergillus niger
ggaacactccaccgttgagcggaatcccgccaacaggcatggctggctgagtggagctatccgagcgatgtcggcaaaccggccaactaggcgcagggaccaccgcaaaggcgggtggattccggagagaagaaaccactgcgagcacgaaaatattcggaaggttgaatgctcacccgcaaacggatctatcgtcccgaccgatcctgatgatatggatgagatcaggtgaaccgaaattgtcatcaagagccggccctcgcggggatcagacgtgtacaataggcctgcatgaaatgaaaactgctatcttcacatgaaaaaaaaa

SEQ ID NO: 4350 - DNA, 352 bp, Aspergillus niger
cgcagagcgagatagccaaacaaggcgacgaccatacctagccatgccatcaccaggtctgcgccctgaaggcacacgtggctcagagactcctcaactaatgaaaccacatgctcgctttttcattgagcgtaataaaagcatggtcagcatcaaattcgatcctcctccctcaggacgatatatcctcgtcaaattatggagtcctcacagcggcgtttatcaagaaggtggtctaacttggtgagggaaggtttgatcttctacttggtggttgccatttgttaactagacgatggatgccacgagtatatgtagctagactatactatcaaagagaaatatattagtc

SEQ ID NO: 4351 - DNA, 398 bp, Aspergillus niger
ttcagctgttgaatggtggtggagaaggacaacaaatgcaatgcaaggacttcgataagctggtagcctggtcgaaggcaccggaacgcaatgcttgctacaagcgactgaccgactacaagccgatcgtccatagcattgagcgctatgccttctgtcctgaggatagtgagcactacccgacgatgagcaagtatttcgaggaacacggacattatgccgatcctttttcggaatagacaagggcgaggctgatttgaatcggttggggagggtgaaaagcagccaagaaaggccagccgaggggaggaggggaaaagggccttttagcgccgaaaaccctagtcagcacctaatttagtctatttagcttcaatgcaactaagaaagtagcaccg

SEQ ID NO: 4352 - DNA, 366 bp, Aspergillus niger
cgctgcctacggtggtgccgctggtgccgcccccggcggtgctgcccccggtgctacccgcactgctgacgaggtcgaggagcgccctgaggagctcgactaaatgctttaaaaagctgcggtctcgattctgttcttgtctttcttcattatacctccagccgttttgcagataggcgagcggttttaatggatttgcttgtttctttttcctagtatcatgttaacgaatttatgggaatcacttttctttgtctatgcatagattcgagttgctagttgttactgcatgatgacttgctctgcagactatgggagggaaaaagtttcctttcgacgaatacattactttaattcaattcgtgc

SEQ ID NO: 4353 - DNA, 387 bp, Aspergillus niger
gcgcattagttgcagccttttattctgcctgatgtaccgcgtgggcatgtcccggcctttctctcggccagagaggacgcgccggcggcttcggaccccgccaggctcaggcgccttggggaagtagcggtgcggtcttgtgatttattatcttagccagtcagagagatgagcatccaactgcctctctcgtttcctctacacaggtaaggctgaaaaagaagcatccaactgctctccatcagataagccctcaccgagtgtctttgcacacgtcaagacaccgagggtggtgggtgaccttgataagaaaagtgttcgatcgtacatagattcgttatggtaaatagatttgttttgtcatctcttcagaaaaaaaaaagaaat

SEQ ID NO: 4354 - DNA, 437 bp, Aspergillus niger
  misc_feature (1)...(437): n = A,T,C or G
cttaaattacctcaccgtcatgaactattctagaacccgcctgccgaacattgctcacttatccgtgctggaaacaggcggtgagtcggcaacccgacagtcagggactgtaacattaccacgcccttatttacccgcgatagacctttggcgttgctgcgttggaacgatacagatacaatagagtcctgtctccttccgcgaccgctgtctacatattcccttcttgttcccttttttaccctccatttcctatgtgtcctctacgaatgtgttccttccagctcttgtgtgtatcatggttttaamacaatttggttgcttgagaccataatgaattgaagagatctcctctcacatgacacnntagaatacggagagangcgtgtcngagattgctgcggctatgatcccaatcggatggaaagggangttcc

SEQ ID NO: 4355 - DNA, 283 bp, Aspergillus niger
ggaagattctggggatcataccgaagctttggtcaacgatggtcgcaagcatcaaccgcctaatgctctgaggctatggagacttggagatgtcatgacccgttggttcttggccctcttcttcttcggcttgcgctggccatttccatctacagctaaatcatgcttctctccactatcccgagaaacagggaccgtagtcttctttacccgcttcttctttttaaccaatgttccgtcggagggaactcctgttggatggacccgctctgactccctttgc

SEQ ID NO: 4356 - DNA, 342 bp, Aspergillus niger
ctcctcccagggatgggcaattggcatttcttcctttcttctggaatctgtcgattccaccgcttaacgaacaaagctctttttctctccatttctctttctctccacgaaaccttctcgtgaacctctcggacatgaatctcgggatgtcaggcgatgcgacatcaggcgagtgacccagcaggtggcgaaggcgtcttagcgggtacatcggctctctgtacattttgttttgtgtgtgtttgcagtagatattttcttccaagatgatgaccttgattacgaagcgattttgttaagtcgagcgaatgacattcgtctacatgctatcaaaaaaaaaaa

SEQ ID NO: 4357 - DNA, 196 bp, Aspergillus niger
  misc_feature (1)...(196): n = A,T,C or G
atgatacgntagctnagcttgggtanccngcttatcgataantcnagctccaaaactngnaacgaactccggttcaacnagtaccggccgcaattgngcnggaattctgcagatgatgagggcaattggntatatgatcatgtatgtagtgggtgtgcataatagtagtgaaatggaagccaagtcatgtgattgt

SEQ ID NO: 4358 - DNA, 112 bp, Aspergillus niger
aatccgtcaaacactccccataaccgtcagtcaatgcatctatggtttttgtttggtgtttgggattcgttatagcgttagattatagtcattgtgaaacagtgttcttttg

SEQ ID NO: 4359 - DNA, 316 bp, Aspergillus niger
gcaccttctaatcttcttgtatctgattcatttatgtgtgtgtatttggtgcatgacaaagggctagtttgaaggagttcaggagagacctagccagctgctaaggcttgggactgatgaggagactgtatcacagccggactcgtttgcgtctggatgtataacaaccctgggggattacataaaggacagcaataggcagattgccgatactgagatgtatctcggagatacgatctaaagccattgtattgcagacctgaactactagctgacatcatggcttcaatgaaacctattgcttgaaaaaaaaaaa

SEQ ID NO: 4360 - DNA, 315 bp, Aspergillus niger
cgtcgatgtactggatctgacccaacgtgtggatatgcgttcgctaggaaccatgtcgacacaagcgctgcgagatgcattggacgcctacgagaacgacgtcttcaggcgcgcagagcctagtgtacttaactcgcgccaggcctgtgtcgacgctcatgacttcacacgtatcctagacgagagccccctcgtatcagcccgcgtgctgaaggaggataccacggagcaatagtcttagccagagaatcatcacagtgttgcggggaggcagcatagataattccttcaattaatcacaaacctaataattct

SEQ ID NO: 4361 - DNA, 487 bp, Aspergillus niger
  misc_feature (1)...(487): n = A,T,C or G
tcgagtcccatctacgccacttacctagctaccccggtgatcactacccaaagtttgctgcaccgctgtacggagcacagttgatgatacatagtacataaaacatacatctggccactaggcacgtatggagcctggggagaaatgggctacgaatacgcgcctggagcaaaagtacagtgcaggaacccagaagaatgaaatctattgcttctctacatcatcacacacttcataagtggcccagaatggatttacaacgatccaagggattttctttcctccttctatgattggattgaagccagatcttctccacagaaaacttcgacttangcagatcagcaactgagacaaatgccgctttgattcagacccggntcttnacatactaataactactgntgcttcttggctaaaggttgcaccgttgacttcaatgcatcattccccatcctagcattattacaacctaagactaccacat

SEQ ID NO: 4362 - DNA, 384 bp, Aspergillus niger
cagtaatcttggatcctcctttattgagggaatatgctatgaaaggctggaaggatagacccttccaattcaatcaagtgtgacattatgtcttgccctagaggtatcaacacccttcttataatttttgcagtggcaacataagtatctgtcccttgaccatatgtctttctcgaagagaaagacccgcgaaagtgacgcttgagatggccgaagcccaggtttggaatacagatcggtcggattaagtcaatcgatgtgtgcatatccatggcgtctgtgatataacctcaggaaccgcccagcctgaccggcaacacccgccattttcctccctcccccctgcctcttggtatggttagcagaattgatggttcatgaatt

SEQ ID NO: 4363 - DNA, 349 bp, Aspergillus niger
  misc_feature (1)...(349): n = A,T,C or G
nantacatcacaaccacggaagacggccacgccgaagattctgcatctgttctcagtgacgcaactaccttggctcagagcaagactgggccccagaaggggacttctgtccaacagggcccggatagcctcgactacggctctacccgatactctatgagaggcatgtccacccgcgcatgatgttgtcggctacatcttttacgacggaaacgacctacttggcaagaaacgggctgcgcgatggatgtgcaagaagtctctattcattgaaatatatgtaatacttaatgtctcgctatgttttgaaatttaattgaatatgatgggnttttcaacatgaaaaaaa

SEQ ID NO: 4364 - DNA, 318 bp, Aspergillus niger
aaaaagatctggatgcgatccatttccctccactagctttttggccctcgtgtgtggtgaccttttccgcttttcttactaaatttagacactcactaccaactcttttttcttaggtttcatttcttcgtttcttgcatctattggtctctgatttttttcgggttcgcgatctagatctgggctctcttccgtccaacggttacaatgttggggtttatgcacgctataccattgcaccggcgttggggtttcgtgtttggtccggtttagataacgtcttaaaccttggaatacacttttcaatataatggtgtc

SEQ ID NO: 4365 - DNA, 317 bp, Aspergillus niger
  misc_feature (1)...(317): n = A,T,C or G
ctctgagcgggatcgtgtgatccgcgtcacgcaaaacggcatcaagcacgttcttcgggaaagatggtacgcctgggaggaggcacagcgtctctacagaaagggctaccggcctcaggaggatagccaggagtaagggcatcggctctatgagggataacacaaaaggaacgggggtttgaatctggaagctccgatagaaactattggtctgtacttttgtatgtagtagtatgtagtatatgttcttttattattggcaacgtttgttcttttccttttctttttcanaaaaanaaaacaaanatanacaaaaa

SEQ ID NO: 4366 - DNA, 362 bp, Aspergillus niger
  misc_feature (1)...(362): n = A,T,C or G
aaaatgatgaaagcctagtgtgttctatatgaacccatctctcttcctggagcccttctggctctcctttcggggctaaagggctgatgggttccggttgagagtgggatgaaataggcgttcggcacaccaaccttgttacttgacggacgcgattaaggcatctctgattcacacattacttggaggtgttatgcctgggggagcggctatgctgtatgacccttactggtgctgatggcgcctatgattgggctctgcagcaatgccccaggccatgtttagttaggatataaagcaaattcgaaatcttgtttataccattaaaaaaaaaanaaaanaaaaaaaaannaaaaaaaaaa

SEQ ID NO: 4367 - DNA, 481 bp, Aspergillus niger
  misc_feature (1)...(481): n = A,T,C or G
cttggtgaaagcggagtcactccctccgaggagggtgacaactgcccttctgtcaactgcgaggctggtgacactgcgtgcgctgaggcttacctccagcccgatgacaacgaggctactcacggctgccccattgacactcagttcactcttactctgggttaaacggatccctttcaatcaatcggatcaaaaagagatggagttttcttgtttttggaatataccatgggtcggatgggtttggttttgagttctcatgtatagattgacttgatctgcctcctggatgagttgcacaagacaaagcagaacacacaacacactcacttttttcgcttcgtgaatcacaccttangtggattcgcttgctgtgctatgcggtatgtatgtagtgatttgagatcacatgaattacgcctatagactggtgttngtagacaaaaaaaactccaacaattactttcccaaaaaaaaaaat

SEQ ID NO: 4368 - DNA, 289 bp, Aspergillus niger
  misc_feature (1)...(289): n = A,T,C or G
ctcgtagtcgagatggagcagccgctggagcccccaagtccattgtcagcgagcttgccaccgttctaggcgatgttgaggctggcatactaggcgtggccagccgtctcggtggagttaccgagcaagtgcaagaggtggttctgggcccgccctctgtttcatgaatgtctggaagtctgtgcattgacatcacaacatcgtcttcatgtaaattacggatggatttagatttgatgaagcatacctaaattcgctacatatgaggcgaaacttgatacaaaaaaan

SEQ ID NO: 4369 - DNA, 227 bp, Aspergillus niger
gttattcatccccagtcatatactgcgggtctgttatatggttgttctgcctttctgtttctatggccggttctgatgtctcccacttatcgggattgactcgtggccactaatctttctacctggtgtacttgacttatccgagtgccttttctgttattattgttgcgcttatgtaccagactgtgaactatggtattctccaattcaaagtatcttatatgcgc

SEQ ID NO: 4370 - DNA, 248 bp, Aspergillus niger
  misc_feature (1)...(248): n = A,T,C or G
naatanggtacacgtacgcangggtacctcctctcgccgtaccgctttaattcgtatcttactactcttcatccctctctcgtgataccctacctttttctcgatgtcaacatgtctacatatcgactcacgcctgcgtctcttttcgctggtatacctgatttcgccttccaaggtaaaccgaatgcttcgatatatgtgggtgttagaattactgcttcttttttcaaaaaaaaaanagngatcaa

SEQ ID NO: 4371 - DNA, 203 bp, Aspergillus niger
ctccagcgtcatcacgtgcaacgaaaacaacttcaatgaaggaaatggataccttcttctttcttctatcacattgattagattacccggcatggcttctcccccttttgcatatcctcacggcatgtaccgtacacttctttgctgctttcataggcatagccatagccatattcaaacatagcatgaccatacattaaggc

SEQ ID NO: 4372 - DNA, 187 bp, Aspergillus niger
  misc_feature (1)...(187): n = A,T,C or G
ncangtcagcgtcagcattatncacagtgatacccangcagtcgcggtcgcggtctccaaattttaatgcgctgatgaggaataatggcctgaatttatgtcatgtaccttgagtgtaatctatcatgtctcttccctagcctcgttagacagtattagattgtcaatacataacgtgtctggttcc

SEQ ID NO: 4373 - DNA, 198 bp, Aspergillus niger
  misc_feature (1)...(198): n = A,T,C or G
ncgagagatntcgggtcggtcccnattatgtattattgtttggtctaatttcccanagtcgtgtcattgcgagcgaaaggaatgatttttctttttccactatagacatcatccccgcatcttgtacataccctgggctgttgtgcgtctgtatcactacagttggaccagaagagcaagagattctgtatgcttcgg

SEQ ID NO: 4374 - DNA, 158 bp, Aspergillus niger
ggaagtttcgatgaagagcatatctctcttatctctctattggtcttattatggagcacgatggaggttgtctttctagtagtttgatattcattcatcatgggatttcatctaatattgcctcaaatgaggacaagtaaaaatagttctcgaccgtc

SEQ ID NO: 4375 - DNA, 285 bp, Aspergillus niger
  misc_feature (1)...(285): n = A,T,C or G
atcgaatacaacgtcaaaaccacaacaaggtccatgggattcattgttgatgcgaccaatacaccaacgctgtccctttttctcaccatcagttgctgggcaatgattttgaaggcatgcattcattgacgggtccgagtaatcactgcatgttccgaagaagcacactgcccacaggatgaaccctcaagtgggccacagggcgtcagcaatanaatggtcatgtagcggctacgtctctcaatctcacatgagttatttttcgggaaaaaaaatnnataaact

SEQ ID NO: 4376 - DNA, 234 bp, Aspergillus niger
  misc_feature (1)...(234): n = A,T,C or G
gtctgggagaaagatcctgggccaaggggtgggatcggccccntganaaaggnggatgaccttacctcccgcangcaaaaatcctttcgcaaggttttgttggtgaggagaaangaaggccaaagaatgaactgtaggatattgtatggattatgacttgtttagctagggtatatgcacctagtttctgttactctgtatgatatcaagaggcagttatgaaccggactaaaa

SEQ ID NO: 4377 - DNA, 683 bp, Aspergillus oryzae
ctaataataacagttgctcatatctccagcctctcaattctgttgtcgcccggccttctgatcatcgatcacatccatttccaatacaatggcttcatgtacggggttctgatcctgtctatcgtgctcgcacgaaagcagtcgacgctcctctacagcggcatcacttttgccatattgctctgcatgaaacacattcatctctatctgtcgttggcctactttgtctacctgctgagaacttactgccttgaccctaagtcggtctttcgacccagatttggaaatatcttcaaacttggtctgggtgtcatcagtgtgtttgctgtagcatttggtccattcatctattggaatcagttgctccaactgaaagatcggctcttcccgttctcaagaggtctgtgccatgcctactgggcgcctaacatctgggcaatgtattcctttgtggaccgggccctcattctacttgccccacgtctgggtctttcaatcaacgaggaagcccctacgagtgttacacgggggtcttgtctgaaacaccttctttgttgttcttcctgatgtgacccaagaacacacttttgcgcctacttttctgtttcagctggttccgttatataaataatggcggcaccctggcgatgggaactttttggtggtcccaatactcttagcca

SEQ ID NO: 4378 - DNA, 643 bp, Aspergillus oryzae
gatcgacgttcgtaagaacgccaaggcttgggctcgtaccctcgctgccgctgagaagatgaagaaggtcctttcggcgaaccctgctgcccccatgagcatcgaatccctgatggaggacgtcgatgtccgcgccattgtcaagcgtgaggagctggagaccatggttcagcctctcctggagcgcgtccttgttcccatcgagcaggccctcgccgaggccaagctcaagcccgaggatattgacagcattgagatggttggtggctgcactcgtgtcccctccatcaaggaggccgtttccaagttcttcggcaagaacctttccttcaccctgaaccaagatgaggccatcgctcgcggttgtgccttcagctgtgccatcctcttccccgtcttccgtgtccgtgacttctccgtgcacgacatcgtcaactaccccatcgagttcacctgggagcaatccgcagatatccccgacgaggacaccagcctgaccgttttccgtcgcggcaatgtcatgccctcgaccaagaatcttacgttctaccggaagcaagcttttcaatttcgagctcggtacgctttccccccgagaactttctgggaaagaccgacccctgggtgggcccctttttttttt

SEQ ID NO: 4379 - DNA, 851 bp, Aspergillus oryzae
cgagggacgacagcactcaactccacgaccacccaacgacccttgcccgctgcgttcctggtgaagggctgcaggattagagtcccctcgaaacagcaaacatgggtatttctcgcgactcccgccacaagcgctcggctaccggtgctaagagggccacctaccgcaagaagagggcgttcgagaagggtcgccagccctccaacacccgtatcggtaccaagagaatccacctggtccgcacccgtggtggtaaccgcaagttccgtgccctccgtctcgagtccggtaacttctcctggggttccgagggtatttcccgcaagacccgtgtcatcgttgtcgcctaccacccctccaacaacgagctggtccgtaccaacaccctgaccaagtcggccgtcgtccagattgatgctgctcctttccgtcaatggtacgaggcccactacggccagcccatcggccgcagacgccagcagaagaccgagaccactgaggagaagaagagcaacagcgttgtgaagaagcaggctgagcgcttcgccgagagcggcaaggtcgagtccgccatcgagagacagttcgaggccggtcgtctctacgccgtcattgcttcccgccctggccagagcggtcgtgttgacggttacatcctggagggtgaggagcttgctttttaccagaaggctatcaggaagtaaaaaaggaaaatcgtgttgtaaaagggtggtatcggagtttcagcaattttttccagaatacatttatgatctctggggcactacgggtgcattgtgtgtaaagctctgagctgtcagcaatggaatgatcctcgttatgttctgtcg

SEQ ID NO: 4380 - DNA, 1129 bp, Aspergillus oryzae
tctcggcaagatgtggtggagcgcccttcggactacccccaattggtccagggtggactggatgtaaacatgccggatattctgcgtcagattatctgcggtgttcggtacctgcattcactcaagattgttcaccgtgatctgaaaccacagaatatcctagtggccatgcccagaggacgttctggagcgcggtccttgcgtcttctcatctccgattttggcttgtgcaagaaactagaagataatcaaagctctttccgagccaccacggcacatgctgcgggaacatctggctggcgggctcctgaactcctcgttgatgacgacaagagctcggtaattcaaagtactgagtcccagcataccgagtcttcggagcctgctgttgttgacccccaaaccaaccgacgagccacccgtgctatcgacatcttttctctgggttgtgtgttctactatgtcctgaccaggggcagccacccatttgacaaaaacggcaagttcatgcgcgaggccaatattgtcaagggcaaccacaacctcgacgaactcgagcgcctgggtgactatgccttcgaagcccgcgatcttatccagtcgatgctgtcacttgatccacggaaacgacccgacgccagctccgtcctgacgcatccattcttctggaatccatctgaccgtctcaccttcctttgcgatgtatccgaccatttcgagttcgaaccacgtgacccaccgtccgaagctctcctgtgtctggaatccgtcgcgtcacgcgtcatgggcccagagatggacttcttgcgtcagctccccacttccttcaaagacaatctgggcaagcagcgcaagtacaccggttcaaagatgctcgatctcctacgggcattacgtaacaagtgccatcactacaatgacatgcccgagcatctgaaggcccacatcggtggtcttgccgaaggatatttgagtttctggaccgtcagattcccgagcttactcatgagctgtcaactccgtatcggggatctcaagtggacgcggaacgaccggtttgaaccgtaccttaacgtgccggattaaaaaaatgttttgttaatggatatatcgaataaatttgataatg

SEQ ID NO: 4381 - DNA, 676 bp, Aspergillus oryzae
  misc_feature (1)...(676): n = A,T,C or G
cactactgctcttccaggttttttggttggtaaaaatgccgcacgaaacgcccaatatcacggcactcgaaccattccaggttctcagcaagatcttagattttgcaaacgaggaccagcgagactggtggcacagtaccgggccaatgtatgccaaaatcctaaaggatgcaggctacggcattcatgcccaatactcatatctctgtctccaccacaaatgtgtggttccgtatctgggcccctatccgggaaacggcagagaccgatggatgagcatcctcagccgattcggtctaccttatgaattgagcctgaattgctctaattcggtcgtgcggtttgcattcgagcccattggacctttatcagggactgagcaagaccccttcaatgcacatgtcatctgggaatgtcttgggaaactcgcgaagctgggttctgattttgatctccagtggtttgcccaattcaagaaggatctggttttagatgcagaggaaacgaagtttgttagagacaacggtctggacaagggacaggttaagactcagaacaaactangcgtggacttgaaaggtggaaaattcgaggtcaagatgtacatgtatccttatctgaaatcggttgctaccggcattccaattgagcgactcatgtttgattcgattcggaa

SEQ ID NO: 4382 - DNA, 648 bp, Aspergillus oryzae
ctttcccttcttctcttcttcttgtttttatgctttgattttccttccgctctttcagctggcccttccaccagcttcattttcttttctcttccgccctactttatcatgtatttggaagctggaaagtcacaatgagcggacttcgctaccttgatctaatcaagccctttacgcacctcctcccggaggtggcagctcctgagaccaaggtgcccttcaaccagaagttgatgtggactgggttgacactcctgatcttcttggtcatgagccagatgcctctctatggtattgtctcctctgacacttccgatcccctgtactggctgcgtatgatgttggccagtaaccgtggtaccctgatggaattgggtatcactcccatcatctcctccggcatgggtttccagctcctcgctggtacccatcttatcgatgtcaagcttgacctcaaaaccgaccgtgaactgtaccagaccgcccagaagcctttcgcgatcatcctctgcttcgggcaagcttgtgtctatgtcttgactggtccctatgggcagccaagccatcttggggccggtatctcgtgtctgctcaatggtcaacctggttggtgctgggcttggtggcattcttctggaagaggtgctc

SEQ ID NO: 4383 - DNA, 724 bp, Aspergillus oryzae
  misc_feature (1)...(724): n = A,T,C or G
gacggctccccatcccagcattctacgatctgaatcccaccaattgcccttcacaataaatatctcgtcctcataccatttggtttcgttcatccgcttttttctcggttttcactgtttttctgtcgcccataatgtccggatatgaccgagctctttcagtattcagccctgatgggcacgtcttccaggtggagtatgccatggaagctgttaagagagggacctgcgccgtcggagtaaaaggtaaagatgttgtcgtgctgggctgcgagaagcgctccgccttgaagctccaagatacccgcatcacaccgtcgaagatcgccgtgctggacaaccatgccgttctcgctttcgctggattgaacgccgatgctcgtatcctcatcgataaggctagactagaggcccagtcccaccgcttgaccggtgaagaccccgtcaccatcgaatacatcaccaaatatatcgccggtgtgcagcagcggtacacgcanagtggaagtggttcgcccttcgtattaagaccttggntgggggttcgaatccgatgaataagtgccagaatatatcagacggagccttcgggtattatctggttgaaggccacgctatcgccgtctagcagactggtcggattctcaacgcaccccaggatatttgaccggacaacgatcactaacattagtctgtggaggcggccaccgcgccagacctaagg

SEQ ID NO: 4384 - DNA, 755 bp, Aspergillus oryzae
ccctcccatctccccactcctctcttccctttttctttttgtgtttagagcagagtacgactcttcatataatataatgtccgctaaagctgaatctcccgcccccgctgctcctcagcagctcagcggccttgctctctactccagattcgccttcgctggtgctgtctgctgctccgtcacccacggagctcttactcctgtcgatgtcgtcaagacaagaatccagcttgaccccgtcacctacaaccgtggtctggtcggtggtttccgtcaggttattgccaacgagggtgctggcgctctcctgactggtttcggccctaccgccgccggttacttcctccagggtgctttcaagttcggtggttatgagttcttcaagcagcagtggattaaccagctcggttacgagactgcctccaacaaccgcaccgctgtctaccttgcctcttccgccactgccgagttcttcgccgatatcgccctctgccctcttgaagctacccgtatccgtctcgtctcccagcccactttcgctaccggtctcctgagcggttttggtaagatcctcaagaacgagggtgtcggcgctttctactctggattcggtcccattcttttcaagcaaggtccctacaccatggccaagttcgtcggtttcgagaaagtctctgaggctatttaccgccgtttcgacaaagagaccctctccgatggtgctaagactactatcaacctttgctcttgtctta

SEQ ID NO: 4385 - DNA, 675 bp, Aspergillus oryzae
cactatcgaagctcgtcgagaccttggcgcccaagagtaccaagatcagtactaatggcgatctgggcgaccttgtggatcaggaactgaccaaggcggctgacgctatcgacgccgcggccgcgcgattggccaagctcaagaaaaagcctcgtgatggcttctcgacatacgagttacgtatcaacgatgtgattgtggaggcggccattgcagttactaatgcaattgcggaactgattaaggccgccactgagtcccagcaggagattgttcgcgaaggccggggtagctcatcgagaacggcgttctacaagaagaataatcgttggacagagggactaatctcggccgccaaggctgttgctacttccaccaacactcttatcgagacggccgacggggtcatttctggtcgtaactctccggaacaactgatcgtggccagtaacgacgtggccgctagtacggcacagttggtggcggccagtcgcgtcaaagcatcgttcatgagcaagacccaagatcgcttagaggcagctagtaaagcagtcggtgcggcatgtcgggctctggtccgtcaggtacaggacatcattgccgagcggaaccaggatggctcggagaacgttgactacgccaagcttagctcgcacgagttcaaagtgcgcgaaa

SEQ ID NO: 4386 - DNA, 663 bp, Aspergillus oryzae
  misc_feature (1)...(663): n = A,T,C or G
taactcgtggaatccccggattgatcctattgtccatttatcccgaatcggtcaacatctacgccgtcaatccgatcaacaccaaaatacttacttctccgcaacatctcccttgagccctccgacctccgaacaagagtcgcgttgtcttattaaacaaaaaggccaatatgggtggttcattttcgcgtctatggtccttcctctggacgaagaaggaaatccgtattctcatcctaggtctcgataatgctggaaagactacactactttacaggatgaagatcggcgaggttgtcacgacaatacctactatcggtttcaatgttgaatcggtcacatatagaaatttgaactttaatgtctgggatcttggaggtcaaacgtctatccggccatactggcgatgctactacgctaacaccgctgctgttatcttcgtcatcgactccacagatattgaacgactgggtacggctgcagacgagctcgcagccatgttaaatgaggaggaacttcgcgatgccgctntgctggtattcgccaacaagcaggaccagccgggtgccaagggagctggggagatctcggaggctctgaagctgggcgaactgcgagatagaaattggagtattgtggcatgctcggctatngatggtaagg

SEQ ID NO: 4387 - DNA, 650 bp, Aspergillus oryzae
ggttatttggcttcgggtggcaacgataacaagcttttggtgtgggataagctaaacgagacgcccctctatcgcttttctgaccacacggccgctgtcaaagcgattacctggtcacctcatcagcatcatttgcttgcttcgggtggtggaacggccgatcggactatcaagttctggaatacctcgactggatcgttgatcaaagaggttgacacggccagtcaagtctgcaacctaccctggtcgaaaaattcggacgaaattatcagcacacccggctacagtcagaatcaaatggtaatctggaagtttccacgtatggaacaaatcgtatcattaacggggcatacgttccgggtcctgtatctggcattgacccccgatggccaaacggtcgtaccgggtgctggtgatgaaactttgaggttttggaagatttttaacaaaaggtccggaaaagaccaagggcgtaaaggcaccaagttggcggaatggggcaccttccggtgattttacaaccgatatattggatgaccttagtgctacggctttttaaaattccccgcaagggttttaattttgcttaaacacggcgttcagggtttttggcgttttttctaacctgggatttccttggcgggcccagg

SEQ ID NO: 4388 - DNA, 686 bp, Aspergillus oryzae
  misc_feature (1)...(686): n = A,T,C or G
cggacatcgccaagtcgattgatgcccctgtcctccacgtcaacggtgatgacgtcgaggccgtgaattatgtctgccaggttgccgcggactggcgtgcggagttcaagagcgatgtcgtcattgacattgtctgctaccgtaagcagggtcacaacgagaccgatcagccgtctttcactcagcccttgatgtacaagcgtattgccgctcagaagaatcagcttgacaagtatgtcgagaagttgatcaccgagggtaccttcactaaggaggacatcgatgagcataagaagtgggtctggggaatgcttaacgacagctttgaccgtagcaaggactaccagcctactggcagggaatgttgacctccgcatggaacggattcaagacccccaanggagttggccaccgaggntctgcctaacctgcccactgggtgtgngggccctcttcttgaacacnttgctgacaaggttaccggtgctccggatggcttttttctgcaccgaaacctcaaccgttttttgtccacccccaaaaggctgtggatgaagccaaaacatcnacttggctacttgcgaggctctttgctttcggttccttgtttcagaaggttccacttcccggtttccggtcaagatgtcaccctggttttttttcccgcccccatccctttttgatta

SEQ ID NO: 4389 - DNA, 730 bp, Aspergillus oryzae
  misc_feature (1)...(730): n = A,T,C or G
gcggcactcaactgtgtgtactgcttcctttaacttcctttgtgcttttattaatcaatcatcctctttcagacccgttcagtctttcaaaatggccacagaactttgtcccgtctatgcacccttcttcggtgccttgggttgcacctcggccatcgtcttcacctgcttcggtgccgcctatggaaccgctaaggccggtgtcggtgtctgtggaatggctgtcctcagacccgatttgatcgtcaagaacatcgttcccattgtcatggcgggtatcatcggtatctacggactggtcgtgtccgtcctgatcgcgaacgacttggcacagacggtccctctatacaccggattcattcagctgggagcaggtctcgctgtcggtctggctggtctggcagctggttttgccatcggtattgtcggtgacgctggtgtccgcggaacagcccagcaacctaggctctatgttggcatgattcttatcctcattttcgctgaagttttgggtctttacggtctcatcgttgcccttttgatgaactctcgggccaagatcgatgccaagtgctaagtcacatttgacaatcgttgtgcgagatcttctcattaatcctcttcgcgcacggagtatattggttggnattggtcaatgtgacgtggtaaacgccttgctcttctgaacaagaacgttctcatattgtcgcgagagccgaaataaacgcaa

SEQ ID NO: 4390 - DNA, 692 bp, Aspergillus oryzae
ggataggtctatttggctttggaccactaatggccaaggagaaaattatggggtctggtcaggcctccgaggggcagtgcttgacctacagtggtctcgcgactcgagaacgctcttctccgcgtcagccgatatgacactggcaagttgggacctggaaactggacaaagaatacgtcgccacgtgggtcacgaggagatagtgaactgtctggatattagcaaaaggggccaggaattgttagtcagtgcaagtgatgatggttgtgtggggatctgggatcctcggcaaaaagacgctattgaatatctggaaacggaactgcctattacttcggtggccttgtcggaagcaggaaacgagatttacagtggcggcattgataacgcgattcacgtatgggacctgcggaaaaaatctatcacttactccatgacggggcacatggacactatcacctcattggaaatttcgccagactcgcagactcttctctctaattctcatgattcgactgtacgcacatgggatatccgaccttttgcgccaacgaatcgactcatgaagacgtatgaccgcgctcctgttgggctagagaagaacctcgttcgagcaagctgggacccgaagggcgaaagaattgccgccgggaagtggtgacacgagcgtggtcctctggggatttaaaact

SEQ ID NO: 4391 - DNA, 784 bp, Aspergillus oryzae
cctttgtcaacgattccgacgcctgcgctttcaccatccttcgataatatcgacttagttttgtcaaatcttattttctgaatcacttcaaaaatggcacccaaggctgctgagaagaagcccagcactggcggcaaggcccctgctggcggcaaggcccctgctgagaagaaggaagctggcaagaagaccgcggctgctgcctctggtgacaagaagaagcgtggaaagaccaggaaggagacttactcttcttacatctacaaggtcctgaagcaggtccaccccgatactggaatctccactcgtgccatgtctattctgaactcctttgtcaatgacatcttcgagcgtgtcgcaaccgaggcctccaaactggccgcttataacaagaagtccactatctcgtcaagggagattcagacctctgtcagacttatcctgccaggtgaattggcgaagcatgctgtgtcggaaggcaccaaggctgttacgaagtactcctcttctgccaaataagtttttttcttttctgttgtttgtttcttttatgcaggattgtcttttataacctcgttatctgttatggtttgaggtggtgggtacagggtgttcgcgggatttttaatgcgtcacgggatggctttgttttttcccattgggccaaatgtttttcatggttttatttgagacgtgaatgcgttgtaacataactcggtgctcctgggtctggttgcgcagtagcaactttcaaactagggttcgaaatttgaattactctgac

SEQ ID NO: 4392 - DNA, 663 bp, Aspergillus oryzae
ggaagtggctgctgctgaccggtgtgtctctcagctgcgtcatctgtacgaagtacgtgggtgttttcaccttcgtgaccatcggtgctgcggtcatggttgacttgtggaatttgctggatatccgccgtcctgccggcgctctgagcatgatggagtggaccaagcacttcgcagctcgtggcttcgccctcatcgtggtgcctttcttcttctatctgttctggttccaggtccatttcgccattttgactcgctctggtcccggtgacgactttatgacccccgaattccaggaaaccctcagcgacaacgccctggctgctgagtctatcggaatccagtactatgatgcaatcaccattcggcataaggacaccaaggtcttcttgcacagtcattgggaacggtacccgcttcgctatgacgatggacgtatttccagccagggccagcaggtgacgggatacccattcaatgatacgaacaaccaatggcagattcttcccactgtgcccctggaagacaatgagggccagggccacagcgtgaggaatggcgatctcgtccagctgcttcacttgggtaccgactcgatcctgctgacccatgacgttgcttccccttttatccgaccaaccagggattcacgactgtgaacaa

SEQ ID NO: 4393 - DNA, 704 bp, Aspergillus oryzae
ttctggaactctgccctggcggcgaactgttccatcagatcgtacggttaacctacttcagcgaggatctaagtcggcatgttatcactcaggttgcaaaagcaattgagtatctgcacgagacctccggcgtcgtccatcgtgatattaagccggagaatcttttgttctatcctattcccttcgttccaagcaagaaccccaagcctcttcaacccggggatgaagacaaagtcgatgaaggggagtttatccccggaaagggatccggcggaatcggtgtcattaaaattgccgatttcggtctctcaaaagtcatctgggacagtcaaactatgactccttgtgggactgttggttacactgccccagagatcgtcaaggatgaaagatactctaagagtgtcgacatgtgggccttgggttgtgtgctttacactcttctatgtggtttacccgcctttctactaacagagctaataatccacttactgaaaaaagtggatgctccgccctatacaattatctatgttgcctagattggcactcaacatctacaaaattctgttaaagactctgtaactattcatcttcatgcacgcggctaccctacatatattcaattatcgacatataagattattttggacggctgtatttacaccccccgttttgtatttgaatacgcaagggtggcccccgtg

SEQ ID NO: 4394 - DNA, 646 bp, Aspergillus oryzae
ccgtggcgagtggacccttggtcgtgtcgtgttctttgtctttttttatttcctcgtgggacctttgatgctattggtatctctcctctgctggttgctggtcttctggattccaatgggacgcgtgaccattatattatttgatcatcttcgtcgtcatcccctcgctctctcataccattctgatacctcatatacacggctaagcccaaactcctcttcatctattcttttatgcacctatcgcgccgccgggttaaggtactggaaatacacggttggcggcaccaacatcttcttgatcaatcttctcggtgttgtactgtttgtgatttttgactacttctttttggaaaaaactctaggtgttcaaaactccttgactcacccgggcttaattttcaccctggcccttgtttccatcatccccctggcttatttcattggacaggccgtcgcttcgatctccgcacaatcctcaatgggtatgggtgctgcagttaacgctttcttttcaacggtggtcgaggtttacctgtactgtgttgctttaaacgagggtaaaggccagcttgttgaaggtagtatcataggtagtatcttcgcaggcatcctgtttctcccttggatatctatgtgctttggg

SEQ ID NO: 4395 - DNA, 678 bp, Aspergillus oryzae
  misc_feature (1)...(678): n = A,T,C or G
tcatcccgttattgtcctttgactgaacccatatcctaaatttcttctcttgttccctgatttctctctctcccccgactcaagccatttatttcccctcttaaccactttattctcttccctctccctataatttaatcagtgccgttgcacctgcaccatggccgaaatccgtcgcaagcttgtcatcgtgggtgatggtgcctgcggtaagacttgtcttttgatactgctgaccgggacatgttttgcacagtgtcttctccaagggtaccttccctgaggtctatgtccccactgtcttcgagaactatgttgccgatgtcgaggttgatggcaagcgtgtcgagctcgctctttgggatacggctggtcaggaagattatgaccgtctccgccctctctcctaccccgactctcacgtcatcttgatctgcttcgcggttgactcgcccgattcccttgacaacgttcaggagaagtggatntccgaagtgcttcacttctgccaggggacttctattattctcgtcggatgcaagaaggatcttcgcaacgaccccaagaccattgaagaattgaccaagacctgccagaagccagtcaccggcgaacagggtgaggaagttcgcaagaagatccgagcctacaagtaccctcaatgctctgcacgaccaa

SEQ ID NO: 4396 - DNA, 734 bp, Aspergillus oryzae
  misc_feature (1)...(734): n = A,T,C or G
gtcaaaccaatcaattggcccatcatgttcaattacggaaccgacgaggatctccaggacaaggtctatatcctcgtcactggtgcaaacagtggtctcggattctcgatatgctgccgtctagtcgatgaattcctcaactctcctcagcgcacaaaccaatccttgaccgtcattttcaccacccgaagtcccaagaaaggaaacgacaccctccaacgcctccaggaccatctccgcaaaacctccgcaacacactcccccaccagacgggtaaccttcgtcccagagagcgtagacctaaacaacctcgtctccgtccgcgccctctcccgccgcctgaacgatgaataccccaaactcgacgccatcatgctcaacgccggcattggcggctggtcaaccctgaactggccgcgagccatctggggcgtcctcaccgacctcgtccacgaagtctcctggccctcgtacaagatcgcccccgccggcatggtaacagactaccagaccacaacgctagcagcccaagagccccgcctaggctccgtcttctgcgcaaacgtcttcggccactacatgctagcgcacaatgttatgcccctgctgcgacggtcaggacagcccaacggccnggccgcgtcatctgggtctcaagcttggaagccacggtgaagatngtcgacgtcgacgatatccanggtctncggaccacggcgccctacgaatcctcc

SEQ ID NO: 4397 - DNA, 630 bp, Aspergillus oryzae
tttgcggttaaaggcgagaaagtcggcacaactgttttgttctttgggtgccgtaatcgcaatgaggatttcttgtatcaggacgaattcaaggcttatgaggagcaacttggtgattcattgaagatcatcactgcattttcccgcgagacttctcaaaaggtttatgtccaacatcggttgcgcgaacaagctgagctggtcagcgaccttctgaagcagaaagccacattctacgtttgtggagatgccgccaacatggcgcgtgaggtcaatctggtgcttggccagattattgcccaacagcgtggtcttcccgccgagaagggcgaggagatggtcaagcatatgcgcagcagtggaagctaccaggaggatgtctggtcatgattcttccacggccgtttcttttaattgaacatgacttcttttcccttctcatgcctagatgatctttgcatatatactccggctattattccctttttacttttttatctttcggcgtgattcatgtatgcctagcacttctttttggtctttatgcagtgggcgacatggctatttgttcatggcgaaacacagctcgccaagggaaggatgatagacttaacggttcaaaaatgttgg

SEQ ID NO: 4398 - DNA, 1255 bp, Aspergillus oryzae
cttcttcttcttatcacgattcattcccttaccttgggttcgcaatacactcctttcgttagttttgttttatagagcctgtggttgctcgagacattccttcaatcacccaccaaaacacattccttgatattatttgcgttacctggtcgtactgtgacatatacctattgtgatacccacatctctcgtacataaccctggttatctgtgaacatccaacgcagttttaccaccatgcagctcaagaactcgctgttcctgctcaccgcgttgacggccggttccgccgtcgcccgtatgcacggccacgagcgccgtcatgctcaccaccacctgcagcacgaggagaagcgcgcggtcggtgatatagtctatgccaactttaacggcgtctggaagtcctgggtcaatgagtggtccggcgtcagcgctacctccgcctccggctccactcccactacagtttcctcctcgacttcttctgttgccactgcctccgctgtccctaccgccagcagtggccctaccgtgaccacacctggatcctgcaaggagtggcatgctcaccaggacggtgacgtgtacactcgcgagggcttcggaggacagaccccaaacaacggcaagccttacatcgactacatcggtaaccttggcagcccatacggcaaaaacatcatcgaggtcgccgagagcaaggcctgcgagtacaagtatgtcgtccgcatccagggcagcgagaaggatacctggactattgccttctggaacaagatcggccctgatctcaagctcactggctggtacggcaatgctgttctgaccatcaagatcaaccccggtgagaccaagtacgttgctttcgacgaggacacccaggctgcttggggtgctgccaagggtgactcgcttcctctggaccagtacggtggctacggctgcacctggggtgaaatcgacgtcggcaacctcagcaatgatgcctggtccggctgggatgtgtctgccatccaggcccagaatgccggtctcgatgtccagggcatgaaaatctgcacccacgacaaccaaaagtgctcttccatctccaacttagccaaggcggttgacaacgcctacactgccctagacgccggtaaagacggcatcggtggtgaatggcccgctggccctctccgtctggttgtcgacattgactacgactaagcgttgtttctgtgccctgtcggatacttttttttacaaatccatg

SEQ ID NO: 4399 - DNA, 695 bp, Aspergillus oryzae
cactctgcacctcacaccatctacgtctatctcgttgatgtacctagtactcatagtaaaccgacctagttgtatccattaactgattcgatccatcaatatgcgctccaagttcaaggacgagcacccctttgagaagcgcaaggcagaagccgagcgtatccgtcagaaatacgctgatcgcattccagtaatctgtgagaaagtcgagaagtcggacatcgccactattgataagaagaagtatcttgttcctgcagaccttaccgtcgggcagttcgtctatgttatccgcaagcgcatcaaactgtctcccgagaaggctatcttcatcttcgtcgacgaggtgctaccaccaacagctgcacttatgagcagcatctacgaagaacacaaggatgaagatggctttctttatatcacgtattccggggaaaacaccttcggcgatctttaagctctgataagcagttctcccaagatatgtaactgcttcgccgtcagtatgtgttttgttttagggccgggtgtgtgaccagccactccggtatgaggcgaatgagctggttagaccttgcggcgattcttcatgtgtgcaggcgttaatatcaggttttccgtattccctttatgacctttatggcaaagactttatcactattatggtttaaatgcaaactacttttgatatgatt

SEQ ID NO: 4400 - DNA, 709 bp, Aspergillus oryzae
ctccaacgacgacaacgacccatcctctcacctcgtcccctcttcagtacaccttcgattcccgctcgaggttcaaagtcgcaaaaatgggtggtgtcaccgttcgcgatgtggacgcgcagaagttcatctctgcttactctgcgttcttgaagcgtcagggaaagctccccatccctggatgggttgacactgtcaagacctcttgctccaacgagctccctccccagaacgctgactggtactacgtccgtgccgctgccgtcgctcgtcacatctacctccgcaagaccgttggtgttggccgcctccgcaaggtccacggctccgtcaagaaccgtggctcccgccccaaccaccacgtcgatgcctccggctccgtcgaccgcaaggtcatccagtcccttgagaagatcggtgtcctcgagcacgacgaggagaagggtggccgtcgcattacccagtccggccagcgtgatcttgaccgtatcgccaagaccaccgttgacgaggaagaggaggacgacgagtaaattagcctcggattaaaataatgaaaaagtcctgatgtgttccacgttgcctcttttttccttcatttttccctctggatcttaaacttccggaagaaaaatcaggtgaaaaacggtcgagtacgcttcgtcggcatggatcgagtgggattgatggctttggactcacggagagg

SEQ ID NO: 4401 - DNA, 1056 bp, Aspergillus oryzae
  misc_feature (1)...(1056): n = A,T,C or G
agagtcactcgttcgatccgcacgaggctcgggatcattcgtctatggacacgttgataatcttaccagctggccaaccggctgggccttcgtcctctcctttttggcccctatctggtccattggtttctttgattcttgcgtgcatatgagtgaggaggcgctccatgccgcgaaggctgtgccgctgggaatcatttggtcggctggttgtgcaactgtgttgggctttttcgtcctgtcgatcatcgcagcctgcatgaacccggatgtgagcgcgacaatgaactccgtgtacggccaacctatggcgcaggtctacttcgacgcactgggcaagaaaggagccctcggcttcatgggcgtgctgatcgtcatccaattccttatcggtctcagcctgatcgtcgccgcctcccgccaagtctgggccttctcccgtgacggagccctgcccttctctggttatttccgccatgtcagcaaacgcgtccgctaccaacccgtccgtgccatcatcggcctggtcgtcgtctgcatcatcttcggcctgctgtgcctgatcaactccgttgccgcgaacgcactgttctccttgttcgtagcctccaattacgtcgcatggggcacacccatcctctgccgcctgatctggggcaagacgcgcttccgaccgggcgaattctacactggaatcttgagtcgtccgctggccacgattgccgtcgtctggttggtgttcggtttgatcttgtctatgttccccagcacggggccgaatcccagtgcccaggatatgaactacacaatcgtcatcaatggcttcgtgtggatcgccgcgatgacttactatgttcttttcgcgaggagatggtacaccggacccaagatgaccatcgatgcgccaccgagtgcaacggattctgcgtccggggatgagggaagagttgagcagaaggcggagtagagttggagtaattgtttaattattattatacctttggcgntgtattttcttaaagcgaggcttcacttttgtatacctttttagaatat

SEQ ID NO: 4402 - DNA, 667 bp, Aspergillus oryzae
cattcctctctaccttgaatccttccctttttcctctttcttccctagaaccccctacacacaattcacaatgagcgacggaacaaacggtgccccggagcgtttcgctatcggtatctcttttggcaacacctccagttccattgcccgcatcaaccctgagggcaagccggaggttatcgccaacgaagaaggagatcgtcaaatcccttccgtcctttcatacattgatggtgaggagtaccacggtactcaagccaaggtccagttggtccgcatctcccagaacactgtcgcatagttcagagattaccttggcaaggacttcaagtcgatagactccacaccatgccataactcggcgcatcctcagcctcacgagtctaccgttgctttctccattgtggactctaccaacgatacccccagcactgtcaccgtctccgagattgcacccgtcatctccgtcgtctgaatcagtccgcctctgactacctgggcaaggaagtcaatgccgccgtcatcactgtcaccactgacttcaccgatgctcagcacgatgatttgaacgcctctgctaacgctgctggagttgatgtcctccatgtcatcaatgacactgtatgcgctgccctggcttacgatgccatacccgacggtactgttt

SEQ ID NO: 4403 - DNA, 690 bp, Aspergillus oryzae
  misc_feature (1)...(690): n = A,T,C or G
ccttatcctcctctcccatctatcttctccttccctcccaggtcgctattacttgttgcgacttactcctctatatcatttaactcacctgcatacccacctaataataccttcttgtttcctttgattgttttacgtttggagctctgttgacagagtaattagccatcatgtcttctaccgctcctcttgtcaacaccgacaatggcggctctgccaatgacaacatcacccgcttcgcaccccccagccgtgtgctctctcctctcaaccatgccctcttccacaacaagaccagatgtttcgtatatggtatgcagcccaaggccgtgcatggcatgctcgacttcgatttcatctgcaagcgcagcacaccctcagtcgccggtatcatctacactttcggtggtcaattcgtgagcaagatgtactggggtactagcgagactttgctccctgtctaccangacgtttccaaggccatggccaagcaccccgatgttgacactgtagtcaacttcgcctcctcccgttccgtgtacaactttaccatggaattgatgaactggcctcagattaagtccattgncatcatttgccgagggtgttccaaaaagacgcgctcttgagattcttgttactgttaagagaaaggcttaacattaattgaccccgctccccgtgaagtat

SEQ ID NO: 4404 - DNA, 710 bp, Aspergillus oryzae
  misc_feature (1)...(710): n = A,T,C or G
gatatcaaggcgtttgtccttgatttattgccatttgtttccactcttctagttttcttcccttttcctctttttgttgatttttcaccagcccggatttccttgtcagcctctttcaaaaggcctgtcaagtcacatctcctttttctttctccgcctttttgcctttccggtcggtcggagccccaacggtcgacatcaccgctatctcacctcttttcacccgcctctttctacaagtctttgtgatcttgcagccacagccgtcagctgtgtgtgcttttactcaagatgacgaccatggatttgcgtgtcggtaacaaataccgcattggccgcaagattggaagcggtagcttcggtgatatctatcttggaaccaatatcatctccggtgaggagattgccatcaagctcgagagtgtcaaggataagcacccccaacttgagtacgaggctcgtgtttacaagtctcttgctggtggtgtgggcattcccttcgtccgttggttcggtactgagtgcgactataatgctatggttatcgaccttttgggtcctagtctggaggatcttttcaacttctgcaaccgcaagttctcgctcaaaaccgngcttctcctggctgatcaactcatttcccgcatcgagtacatccatgccaagtctttcattcaccgcgatattaagcccgacaacttcctgatggg

SEQ ID NO: 4405 - DNA, 676 bp, Aspergillus oryzae
  misc_feature (1)...(676): n = A,T,C or G
ccgcattcgggtaaggggctcgatcgattacactaagaggaattcttttccttgttattttggccctttaactcaacttcaccatggccgacttcctacttttcgagggccctatgggctacggacttttcaaggtcgcccaccagggcgacagcgttggcaattgcttgaaggaggtccaggagggtgttaacgatctttctaagtttggaaaaatggttgagttggctagttttctcccattcgagaacaacaagatggccttgagcgaaatcaacgacgtctcggagggtgtcgcctccgatactcttatttcctttctcgaattgaaccttcctaagcctaacaagaagaagaaggttgttctgggcgttctggacaaggctttggccggaagtatcaagtctgccttttctttcgttgactgcgaaaccggcgacaccagcgaggttgtccaagacatgctccgtggtatcaggcttcacgctactaagttgctgaagcagcttcgtgagggtgatatggacactgctcaacttggtcttggtcacgcttactcccgtgccaaggtcaagttctctgtccagcgtgacgataaccatatcatccaagctattgccatccttgaccagctcgacaaggccatcaacacattctctatgagggttcnggagtg

SEQ ID NO: 4406 - DNA, 731 bp, Aspergillus oryzae
gttcaatgacgagattgttcccgttcacaccaaggttaaggatcctaagactggagaagtgaagaatgttgtggtcgatcgtgatgatggtattcgttatggcacgactgccgaatcgctcggcaagattcgttcagccttccctcagtggaagcccagtgctacaacgggtggcaatgctagccaaattaccgacggcgccgcagcactcgtcctcatgaaacgatcccgcgcacaagagctgggccagccaattctggccaagttcggcggggccactattgccggcttagagccccgaatcatgggaattggtccctctatcgccattcctaagctcctctccaaggtcggcttgaccaaggatgacattgatatctttgagatcaacgaggcgtttgcatccatgggtacttactgtgttcaaaaactcggtcttgacgaatctaaggtgaaccctcggggtggtgcaattgctttcggccacccgttgggatgcacaggagcacgacaggttgttactgccctctccgaattgcggcgacagaacaagatagtggcagtcacctccatgtgtgtaggaactggtatgggcatggctggtattttcatcgtcgacgcttgaagtgagatatgattgtcttgactgcgcacgagatcagtcatgatatgttaatatgtaagacctagacaataccgagcatgataatgaggcaagcacacgaaccgta

SEQ ID NO: 4407 - DNA, 707 bp, Aspergillus oryzae
cgagggtccagcacgacaacaatggcccccaagcagaagaccgctgccgctaaggagaacgtcactctcggccctctggccggagatggcaagctcgttttcggcgttgcccgtatcttcgcctccttcaacgataccttcgtccacgtcaccgatctgagtggtcgcgaaaccatctgccgtgtcaccggtggtatgaaggtcaaggctgaccgtgacgagtcttctccttacgctgccatgttggctgctcaggatgttgctgcccgttgcaaggagctcggtatcaacgctctccacatcaagatccgtgctaccggtggtaacggtaccaagacccccggtcccggtgctcagtccgccctccgtgctcttgcccgttccggcatgagaatcggccgtatcgaggacgtcacccccactccctccgactctactcgtcgcaagggtggtcgccgtggtcgtcgtctctagatatgtgcgagcgtatcttctccaacttgtgcaagtttcttgcctggctggatgggaggctatcagcagagtactctgcctgcggatgtggatggaataaacgcgaagaacggcctttatcgcctggtcttcaatttttttcatatccaaaaaagtttctacttggttttgggcatcagtagtctctgaaatagcagctacgtttcgtcaatatacctcgactagaaccgtat

SEQ ID NO: 4408 - DNA, 704 bp, Aspergillus oryzae
  misc_feature (1)...(704): n = A,T,C or G
ccgagggatgtttgtttacactcatttcgcttctatgctcgtcccctggccatgcttaccacgttcaaaggtcgtgagattttaagaagcacaaaggaactggcagaatcgaagcagttgagggtcatttacggtgataccgactccgtcatgatcaacaccaatatggatacgctaagcgacgcgctgaaggtcggagaggaattcaagaaatctgtgaatgaaagataccggcttttagaaatcgatattgacaatatcttccgtcggctgctattgcatgccaaaaagaaatacgccgctataaacatgacggagatggatggcaaatatgtggacaagttggaagtcaagggnttggacatgaagaggcgtgaatactgcgccctgtcaaaggaggtgtctcagaggctcttgaatgaggttctctccggcgaagaccaagagatcgtcctcaatcgggtccatgactatctacgtgacttggccgggaagatgcgagaattcgccgttcccgtccagaaatatgtcatttacactaaaactctctaaacgaccggaagaatattctaacaaggagacgatgccggctgttcatgttgccctccgggagcttgcccgcggaagtcattccggccaaacgatgttatctcttacattgtgacaagtggtggattttgaacatncttccttgcgccagcaag

SEQ ID NO: 4409 - DNA, 545 bp, Aspergillus oryzae
caacctacaacgagcggaagaacctccctattatctgctggttattggagcgcaccttccgtgaaaacaacctggactgggaagttgtcatcgtcgacgatggctcccccgacggcaccctggaagtcgccaaacagctccaggagctctggggccccgaacatatcaacctgaagccccgtgaaggcaagctcggccttggaaccgcctacgttcacggtcttcaatacgccacgggcaactttgttatcattatggacgccgacttcagccatcaccccaaattcatcccggagatgatccgcattcagaaagaaacggaagccgacattgtcacgggcacgcggtatgccaatcgcgacaacatcaagggcggtgtgtacggttgggatctatttcggaagtttacgtcgcggacggccaacctcatcgccgatgtcatgctcatgcccggtgtgagcgatttgacgggcagcttccgcttgtacaagaagagtgtggtggaaaaaggaatccttagcaccaaaacaaggggacagtttcca

SEQ ID NO: 4410 - DNA, 708 bp, Aspergillus oryzae
  misc_feature (1)...(708): n = A,T,C or G
gggacgaacaggcgcaaacatactgtgatgcgaccatcgacgagtacgaggaaagtgttcatgtctgccacaagggatacatctccatcttccccttcctcaccggcatggtgagctctgatagccctcgcttaaaagccatcttagacttgatcagcgacccagaagagctctggagcgattttggtattcgcagtctaagtaagaaggatgagttctatgggactgctgagaattattggaggagccctgtatggatcaacatcaattatctggtgtttaagaacctttatgacattgcgaccacacctggtccacatcaagaacaggcccgtgaaatgtactctaagctgcggaagaacgtagttgagaatgttttcaaggaatggaagaagaccgggtttgcttgggaacagtataacccagaaacaggtaagggacagcggacgcagcatttcactgggtggactagtatggtggtgaaaatgatgtcgatgcccgatcttcctgcgactgagagcaaggggcatgatgagctatagaacagcaacactcgctgcgtagcgcatggtttaggatagggaatactacttgtacactntcnanannnanngnannnnnnnnnnannannnnnnnnnnnnanaannnnanannnannnnnnnnnnnnnnnnananattttttgcggccnttaaccatgcttttaaa

SEQ ID NO: 4411 - DNA, 658 bp, Aspergillus oryzae
  misc_feature (1)...(658): n = A,T,C or G
ggaattttttttttttttttttttcgtcccataagaataacccccatattgcaattatttcgcaactatcgaaaccacatccccatccgccaaaatatgtgccaatcccacccgttgcgggatatgccgcgcacttgcaccccacaccaaagcatatttaaacgattctttcaacgtccggtgaacgttatcgcagacgtcctcgatggtaaaattgccccgtacaatcaacgcttcgctgaaatcgggctcctcccctttccgtttcgtgtaaattcggatcaaacgaatttctttccagatccgctcaaccacctcctgaacgccgaggtctatttcaaaactcatcacgggggtatgtggttcacgggcgatttgattcaggaagtcaagactgatgctgtcgatcttgttanaaacgtagagacatctgatgtattttcggtgacctttcaggatgacgtcgatgaattcgtcaatcgttgcgtaatcatctcggatcagaacttcacagttcagcatcttgtaatcacggaggactttgaagatgaccttcccgccaaggtatttcgggggattctggaaggtgatcttaactccgccctgctttctttttgtttgaggtaaatttttggaggccccttgttaaaacaaaatg

SEQ ID NO: 4412 - DNA, 900 bp, Aspergillus oryzae
gatcagctgatcaatcgacgaggccatgtcggcctctccctcgcaacctacccgtacttcgacgccaagacgaagggcctcaacttcgacggcatgctgaacggcatccgcgaggcccccgccggctccgtcatcctcctccacgcctgcgcccacaaccccaccggtgtcgacctcactcaagaccaatggaaacagctcgccgtcgtcatgcgcgagcgccgccacttccccttcttcgataccgcataccagggtttcgcctcgggcgacttgaaccgcgacgcctgggcggtgcgatacttcatcgagcagggcttcgagctgtgtgtcgcgcagtccttcgcgaagaacttcggtctgtacggtcagcgcgcgggcgcgttccacttcgtctcggcccccggtgccaccgccaagaacgatatcgccaatgtcgccagtcagctggccatcctgcagcggtcggagatttcgaatcccccggcgtacggtgcacaaatcgccagccgcattctgaatgacgctaccttgttcgcggagtgggaggaagacctccggacgatgagtggacgcattgcggagatgcggaagggcctgcgtgagcgtctataggccaagggcacaccgggcacatggaaccatgtgacggatcaaatcggcatgttcagtttcacaggcttgagtgaagcacatgtcaagttgttgcgggagaagtggcacatctatgtgaccaaaaatggccgactatctatggccagccgtcacacacataacatcgaatacttcatagaggctggcgacagtgtctgccgggagacatcgcaaaattgatttgcctgtacgtgatatcattgatgccatgtgcactgtattcgcattaacatagcgtttatatat

SEQ ID NO: 4413 - DNA, 676 bp, Aspergillus oryzae
cgacaccctcccgtccgttacctctccccgtacggttcattttcaatcgccatatatatccaacatggctgacgctgctcctcgtggacgtggaggattcggttcccgcggtgaccgtggtggtgaccgtggccgtggccgtggtcgtcgtggtcgtcgcggcggcaagcaggaggagaaggaatggcagcccgtcaccaagctcggtcgtctcgtcaaggccggcaagatcaccagcatggagcagatctacctccactctctgcccatcaaggagtaccagattgtggacttcttcctccccaagctcaaggatgaggtcatgaagatcaagcccgtccagaagcagacccgtgccggtcagcgtacccgtttcaaggccgtcgtcatcatcggtgactctgagggccacatcggtctcggtatcaagacctccaaggaagtcgctaccgccatccgtgccgctatcaccattgccaagctcgccgttctccccgtccgtcgtggttactggggcagcaaccttggtgagcctcactctctgcccgttaagcagagcgccaagtgtggttccgtctccgtcagacttatccccgctccccgtggtaccggccttgttgcctcccccgccgttaagcgtctgcttcagcttgccggtgtccaggatgcctacccc

SEQ ID NO: 4414 - DNA, 673 bp, Aspergillus oryzae
cgcagctttcgaggtcgacaactaatacgccaaaatgggtcgcgttcgcacaaagaccgtcaagcggtccgccaaggtcatcattgagcgttactaccccaagctcacccttgacttcgaggtcaacaagaagctttgcgatgaggtggccatcattgccagcaagcgcctgcgcaacaagattgccggatacaccactcacttgatgaagcgtatccagcgcggccctgttcgtggtatctccttcaagctccaggaggaggagcgtgagcgtaaggatcaatacgttcctgaggtctccgctctcgacttcagccagcactccgagactggcaagctcgacgttgaccaggacaccaaggatctccttaagagcattggtttcgactctatccccaccaacgtcatccaggtttcccagcagcaggtctccgaccgtccccgccgcttcgtccggtaaatagttagtcgtgcaggatgacggataagggaacaccaaaaaaatgacatgaaacggttacatccctcggggaatggtggtggtgatgatgctactttcaaggatgggtaatggcgtcaaaagacttcaggaatagttactttggggaaataggttccgggcatctttaggatgagaaatgatacgccaggcccttttctcccaaaaaaaaaa

SEQ ID NO: 4415 - DNA, 678 bp, Aspergillus oryzae
  misc_feature (1)...(678): n = A,T,C or G
cggtagactaccgtacggcaggacacattgtagacgatgacatgcacgctattatggtacgcccgctgcaaccgggtgttcgactgaccgctattttcgactcctgccactcgggtactgccctggaccttccttacgtatactccactcagggtattctgaaagaacctaatctcgccaaagaggcggcccaggacctctttagcgccattacgtcgtatggacaaggcgacttcgctagtgtggcccagactgcaattggcttcctcaagaaagctgccctgggcgagtctgctcgcgaacgaaccgttaaaaccaagacttcccctgcggatgtcgtcatgttttcaggttccaaggatacccaaacttcagcggataccttccaggacggacaggctcgaggtgcattgagctgggcctttatcaagacgttacaagcgcgtccaaaccagagctatttacaactgcttaactcgatccggtccgaattagaaggcaaatacagtcagaagccgcagctgagctgcagccaccctctagataccaacttgctttntgtgatgtgatatgtactgtatgagacatgatgtatgcgtagtttctttttgggtttacacgatttatgatgttcaatagcatttgcatgggccttcgagcaaagcccagaccatgttt

SEQ ID NO: 4416 - DNA, 655 bp, Aspergillus oryzae
  misc_feature (1)...(655): n = A,T,C or G
ctcgacctccctttgtcacttcctctctttcctctccattcccccactgcggatctcacccgctaaccgctaccatgccgatgctcaaagatccctcaaaaaagtacaagcggtttaagccgctgcatctccccgatcgccaatggcccaacaaggtcatcgaaaaggctccccggtggctggccaccgatctaagagatggcaatcagagcttgcctgatccaatggatggtgaacaaaaattccgcttctttaaaatgctcgtcgatatcggctacaaggagatcgaagtttcattcccatctgcctcacaaacagacttcgacttcaccaggcgtctggtggagactcctggcgtcgttccacatgatgtatggctccaggttctgtccccttgtcgtgaggacctcatacgacgcacggtggactctctaaaaggtgcgaagaaggctatactgcgcatttacctagctacaagcccatgcttncgtcgaattgtcttaaaatggacaagcataagaatttcggaataggttggcgctggaaccaatgtgcacgttcgatcactaaagatgaacccttgaacggccgtccccaatgggactttcagggtctcccccgaaaacttttttgaaaccgaaccccaattttgccc

SEQ ID NO: 4417 - DNA, 653 bp, Aspergillus oryzae
agaaggtctcgtccatcccctgtttgatcccttgcgcaatcgaccaagatccttatttccggcaatgtcgtgagaacgccgaaaagatgaagtacaagaaaccgtcgctgatccatgcaatcttcctacctgcccttcaaggccccggctccaaaatgtccgctagtgtggacacatccgccattttcatgaacgatacaccggcccgtattaagaacaagatcaacaagtacgccttctcgggcggccaagacactgctgaactccagcgtcagctcggcggaaacagcaaggtcgatgttcctttccagtacctcactttcttcctggaggatgatgaagagcttgagcgcattcgtactgcatatgagaagggagagatgctcactggcgaaatgaagcagaggtgtattgctgagcttcaaacctatgttaaaggtttccaagagcgcagggcccaggtaaccgaggagatgctcaaggagtatatgagtactcgtccactagagtggaagggtaaccccaacccaattgttgtcgagaagaaataaggcaagtggtactttcgagccactgcagttttagacgaatttgtttagagatgcattatccttgcactacacgatcaatgaccaccacacaatgtcccttgc

SEQ ID NO: 4418 - DNA, 692 bp, Aspergillus oryzae
  misc_feature (1)...(692): n = A,T,C or G
ggagacttgtgctcgtctgaacgagtccacgaagcgctttcgttcctaaggaagaatttgccagtctccttgcaaaatcctaaagttgcaattgtgtgtggctctggtttggggggcctggcaaacactattcgtgatcagccacgggcagagtttgattattcttctatcccacatttcccgcatctaacagttcccggacatgcaggaaaacttatcttcggccttctagatgagcaggtacctgttgttttgatggttgggcgtgcccactactacgagggtcattccatcaaccaagtgacattccctgtccgagttttcaagttgctgggggttgataccctagtgttgactaatgctgcgggggggttgaattcagagtatgcggttggcgacatcgtattattgaatgatcatattttcttagccggtttggcaggcactcatccactccgaggaccgaacgccgaagagttcggtcctcgtttcccccctctgtccgatgcctaccacctcgaacttagacgtcacgtgcatgccacttggggtgaggtgatgcattcaaaaagccagccaaaggtgcatgaaggagtgtatgctttccntggaagacccaattactaaaccaagggccaatgccgcatgctttacaaactcggtgcacaatgggttggatagttaatgtgccg

SEQ ID NO: 4419 - DNA, 821 bp, Aspergillus oryzae
gtcgagatccgatctcccccgtggtatatccatctatcagcagctttctccggcgtgacgggagcttccgactccaccgcccgctctctccttccaaccgaaaagcttcaaagtgcttccctcgggtatacattattcgccttttggtgtaccccagacctgaataggcatcaggtccgatcaaaatgatgaattcccttcggctccattccgcgtcggttcgccgcgctgtcgcctcccctctgtctgcccctctctcttcctccgcttatcgctcgatctcctgctcttcttcttcttacatttcctcttcgtcttcttcttctttctcgactgctgctacccctcgcgctcagagacccctcgcttcgtctcagctccctcgtattgtctccccccgccagaccggaatctaccctttgcagtggacacaggcccgcaccatggcaactgaaggccccaagatcaaggttaagaacccagcggtggaactggatggagatgagatgacccgtattatctggcaggagatcagagagaagtggatcttgccttaccttgacattgacctcaagtactacgacctgggacttgaataccgtgaccagaccgatgaccaggtcaccgtcaaggccgcggaggccatcaagaaatatggtgttggttcaagtgtgctaccatcacccccgatgaagcccgtgtggaggagttcaagttggaaaaaatggggctttctcccacggaacccttaaaaactttctgggcggaactggtttccgagaacccattatttttccccgggttcccggtttagtccgtgg

SEQ ID NO: 4420 - DNA, 1145 bp, Aspergillus oryzae
cttcttccatctcaaaacaatagaactccatcaccacctcgtcatcatgtctgacgtccctgagactaagcctgaccccaccaccagcgctcctgaggcggctgagaagcctgaggagactaccacctctaccgaagctcccaagactgaggaggacaagtctgcaactgagaccgtagttgaaacagctaaggaggcggccaccaagacaaccgacagcgttttctcgatgttcggcggtggccctaagaaggaaaagaaggaagaacctgaggataacaatgatgagccatctggctcttcgaaggctcaaaaaaccgaagaagaggatgaagcacctgagtcccctgacgttcacttcgagcctgttatccgcctgaccgagaaggtggaaaccaagaccaacgaggaacttgaagagcagactttcaagatgcgcgctaagctgttccgattcgatggcgagagcaaggaatggaaggagcgtggtactggcgatgttagactgcttaagcacaaggagaaccagaagactcgcctggtgatgcgcagagacaagaccctgaaggtctgcgccaaccactacattgtccctgcaatgaagttgagccccaacgttggcagtgatcgcagctgggtttggaacgccgctgccgatgtcagtgagggtgagcccgaggcgcagactctggctattcgtttcgccaacagtgagaatgccaacctgtttaaggaggctttcgagaaggctcagcaggagaacgagaagctcctcgccagccagtaaaacctgcgccccagagtggactgaaatgagttttacttgatgaactatcattatctacccatttgattgtttcaaaacatcacgagtgaatataagactcgccggtggacaacacagcgttaacccatctgaatccccttccctaccacaccctttcggatattgtcacttccatccaaccccatcccccgatgactacgcgacgagaaacgtttattgataccggtcgcgaacaagatacgagccagctttccgcacacctttaacctcaccaaacgatgttgaatgtatgttgatctgccagtaaatttattaaacccaacacccctggcaatatattgtttggaatgcacaaaag

SEQ ID NO: 4421 - DNA, 701 bp, Aspergillus oryzae
tttcccaccctctccttacatccatcatccacccaacttccaagaacccgagctgttcatccgaggctctcatcgctccccgttcgcgtatactacggctttgatttctcgtctctcgcagccccgtgaaaggagaatccagcagactccgcctttctcccgctaggcatctggtgatccaccaggttccccgatctcagttctgaacgcctcgcattcaccgcatcaaacaaccatgtctgaacaaccttacgacccctatatcccttcgggctctaccaccaacgccccagctggggccagtgccgcgcagaatggcgatcccaggacaagggaaatcgacaagaaaatccaggagactgtggataccatgcggtcgaatatcttcaaggtttccgaacgtggtgaacgtctagactctttacaagataagactgataacctggccgtatcggctcagggtttccgcaggggtgcaaaccgcgtacggaagcaaatgtggtggaaagacatgaagatgcgcgtatgcttggtgatttgtgtcatcctcttgcttgtggttattattgtgcctgccgttgtcgctactaagcattaacgaacgcagtgacggtcacgtttgtcttgggaatggatgtttttttcagctgggctatctgtatttgagacggtgaagcttcgatttcagcccctaatacctg

SEQ ID NO: 4422 - DNA, 688 bp, Aspergillus oryzae
  misc_feature (1)...(688): n = A,T,C or G
ctgtccagagggaagcttcactttggtcccaccacgactttattctatcttcataccccttcatctgtctccatacttatttccaatcaatcttcaaagcttgcggagatactcaaacgacctcatggcggaccgctattcgttctctctcaccaccttctccccaagtggaaagctggtccaaattgaatatgccctgaacgctgtcaaccagggcgtaactgcgctcggaattaaagcaacaaatggaatcgtccttgctactgaaaagaaatcatcttcaccgctcatcgaccccccctctctttccaaagtctccttaatcacccccgacattggcatggtgtacgcgggaatgggtccagactaccgtgtactggtcgacaaggcacgcaaagtctcccatactggctacaagcgtatctataacgaatacccccctacccgtatattagtgcaagatgttgcgcgtgtcgtacaagaagccacccagtccggtggtgttcgaccgtacggtgtcagtttgttgattgctggttgggatgagggtgtcgaacctgagtcagaggaagcgcagaagggcgacaatgaagacgagcctaataaggcaaccggcaagacgggcggtatcttgaagggtggcccgagcttgtatcangtcgacccaagtggcagttattacccatgg

SEQ ID NO: 4423 - DNA, 1446 bp, Aspergillus oryzae
ggaagcaaggaaatcgtcttctggtcggcaaaagtagaagttgctagaaatagcggtggcgccatcaaattagcggaggcgctccttagcctcggcctgggctgagggatcaaatctatcacgcccgaagaactcatcggacgagatacccttctggttaccaaacctggacttggtctggtttagctcctcttcgtcagcagctgaccgagcaggagcgacagagccgaagcccagcttcttcggagcagcaggcttcgaaccagcggtctggccaaatgctaggcgtccgatgcccattcccagacgctctacatcgctggagttacgctcgtgggactttctagaggcgctggggctgatcggcgtgggggcggcaataggcgtagctccagtagtagtactcttggccttagcatcagcctcagccttttcagcctcggggtcatatccaagcttctcaatgcgctcggcttcttccttggccttcctttctgcttcttcgaaatcgatggcctcagctgcgccgatcttcttggctccgagcttgggagccttcttggcgcccaacagactgcccttctttgcagtgctagcagtcgtagtcttccggacagtagtactagccctgatagcagcgggggcaggagcgctttccttttcggaggcggaaagaggagacttggagcgcgagccatttgcgcctgcgttcaagaacggagacgcagtgcggctgaccaccgggggagttcctgtgcgtgagggagggttgctggggcgcttgatcgagggcttgtcccaggaagagaagaaatcatcctcagcatcgccagcaggcgtactggagccgttggaaggggtgccagcgggaacgtccgtgatcacaacctcttcggggaattgctcggcgtcttgcgcagcccgcctctttaattcttccttgtacttcacggcagcattgcacgtatacttgaccttagtgtccttgctagccagggcggcggaacctccatgcgactggaaatacttggtggcggactcatttccaccgactttcataagccgaagctgctcccattgccattggtcgaggtttgtggaacgaacgaaggaaatgtggacacccaggttacggtggtgggccgagcagtcgagacacaggtagataccgaaaggcaccgacgaccatgtagggttcttggagccgcaatcaaaacatatcttgtttgcgggctttagtttgagtttctcaaatattttttgagacttcgccttggtggcactcattgtgagacgagtaagacgagacgggtcatgaatggagtgggaacaaagacggtatatgatgtcaggaccctcgtgccgcatgggaacgtcgcggtgattactttgttactgtgtggcccggctcctcgaccccagcttcggtgggcatatctaatcaca

SEQ ID NO: 4424 - DNA, 690 bp, Aspergillus oryzae
gcgtcctggatgagcccactattggtctggacagtcaggcagccttctcaatcgtgagattcttgaagaagctctcccaagcgggacaggccattctgtgcacaattcaccagccgtcatccatgctgatccagcaattcgacatggtcttggctcttaacccgggcggaaacactttctatttcgggcctattggtcctgaaagtcgtgatgggatcaaatactttgcttgaccgcgcgttcgttggccccccttgaaaaatggtgcaaaaattattttttaaacaacagccaaaggcaattaaaagggagggtagggttttggatggaatgaagagtggcgcaattccgaacagaaccgccgcattctggacgaaattcagcagatcagggaagaacgcagcaagatcccaattggcgacaagggcgtcgaatacgagtttgctgcttccacatggacacaaaactggtctggttaccgagaggttgttcaaaacatactgggaagaaccatcgactttttcggaaagcttcttgcaggggcaatattggggtttttaacggattcaccttctggaagctctcaacacttttttagggcgtgcaaaaccgcgggttctccaccttcttgaacatttttaatccccctattgttccagaacatttatggccccccattctttttctacg

SEQ ID NO: 4425 - DNA, 679 bp, Aspergillus oryzae
ctgcccgtgctctagatgccgtctccaaggagcaacaagccgacgttgacgaagctacactgaaggaaatttatggtgagaagaaggagcatgtgaacatcgtgttcatcggacacgttgatgccggaaagtccaccctgggtggatccatcctgtacgtcactggcatggtggacgagcgaactttggataagtataagagagatgccaaggaggccggtcgtgagacttggtatctttcttgggctttggatttgacgaacgaagagcgagccaaggggaagacggtcgaggttggccgtgctcacttcaagcttgatgtgcagtctcccgacggacctatcgagagacacttctccattttggatgcccctggtcacaaaacatacgttcaccacatgattggtggtgcttcacaagctgaaaaaggcggcttggtctcctctcaccaaaaggtgataccacactggattttaaaagggcggcccgacccctgacacgcttttgtggcgagaaatactggtgttataaaatgggttgtgctgtaaacaaaatgagcaaccttctggggaaaggcgcccgtctcccgaaaagagggcccgtttttcgtttggaaatttggggctacttctttccacaacggagggtttccttttggctgaggccgctccataaaaag

SEQ ID NO: 4426 - DNA, 702 bp, Aspergillus oryzae
tgtagaagacaatgctcaagttgagcgccgtgttgtctctcagctcctcaccctgatggacggcatgaaggctcgttccaacgttgtcgtcatgtgtcgccactaaccgccccaactctatcgatcctgctctccgtcgtttcggtcgtttcgatcgtgaggtcgatattggtattcccgaccccactggccgcctggagattatgcagatccacaccaagaacatgaagctcggagaggacgttgacctgaagaccatcgccgctgagacccatggttacgtcggctgtgatcttgctgctctctgctctgaggctgccatgcaacagatatgtgagaagaaggatttgaacggatctggacaatgataccattggagctgaggagctagattctcttggaggtaccatggagaacttccgtaccgcccttggcgtgtttaaccctatctggacttcagtaagagggatgagttagaggtgcccaacgttaggtaggaggactttgtggtcataaggaagacaaagcgcgagctcatagaaagcgagcagaacccccgggaacactcacagaaagagcagacagtcacacttttaaagagatcgagagagggggtcttagggacgtgaggtatctgtgagaaacatgcagacccaaggtgagtccgatagatagtcagtcacactagatatagacagaggg

SEQ ID NO: 4427 - DNA, 837 bp, Aspergillus oryzae
tatgagcctgatgaccacgaatggcggcacggacgtcgaagagaggctcgacgacgagctgactcggtccttgcaacacatcgatccccacactgttgaatacatcgatcgtctgagcgatgagaagcagcggtataccaacctggttcgcgttcaagcttacattgaaggcctggtcgaagctgagaagagtgatatgcgccaggacagcctgaaccgggttgtcatgcgcaggctggagcacatttacttcaagccttctcaggttgtgacaatcctggaagagggtacttggaaggcacttccctccgagttggactccaaggttacgcctcgtggaaatgctggtgacgtgacaggactggtccagaccctgtgcaactatcttttcacttacagtgacggtatcatcagggcccgtgccatgctgtgccagatctatttccttgcctttgacgaccagtattaccggtctcgtgacttgatgctcatgtctcatcttactgagaatatctccaacttcgacgtcaacacccagattctcttcaaccggaccctggttcaaatcggtctgtgcgcattccgtgccggacttatctacgaagctcaaaatacgctgtccgaagtttgtggcagtggccgtcagaaggaacttctcgctcaaggtatcatcctccagcgttactctactgtttctcctgagcaggagcgtcttgagcgtcagcgtcagctgcccttccacatgcacatcaaccttgaacttcttgagtgcatttaccttacctcaagcatgttcttggaagtccctctcatggctcaaacctcttcttcacccga

SEQ ID NO: 4428 - DNA, 699 bp, Aspergillus oryzae
cctgccctacccagaatgttgttccgcactgcgtgggcccgtcaagccgcgcctttgaggcgtcacgctttcactccccttgcccgtcgctccgtcaccaccgacgccgcctcgtcgcatgctgagaacgttccgcaggaggatgacaagcctttcactgtccagctttccgatgagagctttgagacctatgagatcgatccccctccctacaccctggaggtcaccaagaaggagctgaagcagatgtaccatgatatggtctcgaccagacgcatggagatggccgccgatcgtctctacaaagaaaagaagatcagaggtttctgccacttggcgaccggtcaagaagccgtcgcgactggtattgagcacgccatcacccgtgacgacaaaatcatcactgcctaccgttgccacggttatgcttacatgcgcggtggaaccatccggtccattatcggagagttgctcggtcgccgtgaaggtatcgcctacggaaagggcggttccatgcacatgttcgctcctaacttctacggtggaaacggtattgtcggtgctcaagttcctgttggtgctggtctttgttttcgctcaccagtacaatgaggagcctactactaacattggccctgaccggggaccggggtttcaaaccagtaaggggtttgagggctttcacatggccaaactttg

SEQ ID NO: 4429 - DNA, 685 bp, Aspergillus oryzae
ctagagcatgggctacggcttctgacttctccattcgcatatccagacgtaccccgaaggatccacccagcagcaggttacctgttatcaccacaaggacgccaacaacgactggttcatctatcccagccgccgcgagccagagtatgatccgagtgcgcccctaaagtttgtaggtgatggtgatgtcattcgtcttattcatggacagacaggccggaatttgcactctcatgctatttctgcaccaattaccaagtcacactacgaagtctcatgctacggcaatgtcactatcggcgatgataaagatcattggttggttgaggtggttgatgatgttgcatcgaaggatagaagtaaaatccgtacacttaccactgcgttccgcctgcgacatcctgtcctgggttgttatttacgagcaggcaacgttaatctcccccagtggggcttcaaacagattgaaaccacatgcgtgaaggagaacaaaccgagcgatgtttacacacattggaatggcgagtctcatttcaatgaaccgctcccacctggggatcccagaacctacaagtcgcctttcttggaagaattaattcattgaatgttgcctgaagacttccaacaatgggttggttcctgacccaaataaacaaaagaatctcccttgaaattttggcagggg

SEQ ID NO: 4430 - DNA, 673 bp, Aspergillus oryzae
  misc_feature (1)...(673): n = A,T,C or G
cgcaaaccaccatcatggctcggaacccaagggaacagtgggagagactccaggttatcctacagaaccgcggaagtcgtggaggctttggcttcggcggcttcccctccggtgggggtcgtggaggcttggggctgtctggagctctgatcttgctcggtgttggtggatgggctatatcaaattccctctttaacgtcgacggtggtcaccgtgcaatcaagtactcgagaataggtggtgttcagaaagagatctacagtgaaggtactcatatcaggattccatggatcgaaacgccggttatctatgacgtgcgcgcaaagccgcgtaacatcgcttccctcactggtaccaaggacttgcagatggtgaacatcacctgccgtgttctgtcgaggccccgggtggatgctcttccacagatctaccgtaccctcggacaggacttcgatgagcgcgtcctcccttcgattgtcaacgaggtcctgaaaagcgtggttgcgcaattcaacgctagtcagcttatcacccagcgtgagaatgtcgccaggatggttcgggatagcctcgctcgccgagccgctcgctcaacattgctttggacgatgtgtcgcttacgcacctgaccttctcccctgaattcaccgncgctgtcgaagccaagcaagtc

SEQ ID NO: 4431 - DNA, 731 bp, Aspergillus oryzae
ccttttttgcttccattggtcattgctgcatagtctctcttgcaggttccctattagcgacaatgtcggccaacgctcagaagcccctccccttccaataccagttcgccgccggtgcggtggctggtgtgtctgagatcctggtcatgtacccattggacgtcgtcaagacccgagtccaacttcaatccggcacccgcgccgccggcgaagagttctacacgggcatgttcgactgcctgcgcaagatcgtcaagaatgagggcgcatcccgtctgtaccgcggcatctccgccccgatcctcatggaagcgcccaagcgcgcgaccaaattcgccgcaaacgacagctggggatccttctaccggggcctcttcggcgtcgacaagcaaacacaatctttggccgtcctgaccggcgcaacggccggagcgaccgaatccttcgtcgtggtccccttcgagctcgtcaagatccgtctgcaagaccgcgcatccaagtacaacggcatgctggacgtagtcaagaagatcgtgcaaaccgagggtcctctggctctgtacaacggtctcgaatcgacactgtggcgacacattctctggaacgccggatacttcgggtgtattttccaggtccgggcgccagttgcctaaggtcgagcctggcaacaagacgcagcagacgcggaacgacctcatcgcgggtacgattggtggtacggcgggtacgaa

SEQ ID NO: 4432 - DNA, 1358 bp, Aspergillus oryzae
ttctcttgttgatccatctccatcccctttgtatcacctccttaaaacaccttcacaatggcctcagctgcgagaaccgcttcccgggccttcctccgctcgactccttccgtcagacctgcggtccgcagcactcgtttcgctcttcccacccaggccttccgtgcttcggctcgtcgcggttacgcttccgaggctggtgaggccaagtccagcaacactttcctctgggctggtctcgctgttgccggtggtgctggtgcatacttctacctgcagggcggcgattccgtcagctccaagaacttcgtccccaccaaggaggactaccagaaggtgtacgacgagattgctcgtcgcctcgccgatgagactgactatgatgacggcagctatggaccggtcctcgtccgtctggcatggcacgcaagtggcacctatgacaaggagactggtaccggaggtagcaacggtgccaccatgagattcgcccctgagtccgaccacggcgccaacgctggtctcaaggctgccagagacttcctggagcctgtcaaggccaagttcccttggatcacctactccgatctctggactctggctggttcctgcgccatccaggagctgggtggccctgccatcccctggagacccggccgccaggacaaggacgtcgctgcctgcacccctgacggccgtctgcccgacgcctccaaggaccaccagcacgtccgtgacatcttctaccgcatgggattcaacgaccaggagattgtggctctggtcggcgcccacgccctcggtcgtgcccatcctgaccgctccggtttcgatggtccctggaacttcagccctactgtcttcaccaacgagttcttccgtctgctgatcgatgagaagtggcagcccagaaagtggaacggccctgcccagttcaccgataagaccaccggaaccctgatgatgctccccgccgacatggccttcgtcaaggacaaggcgttcaagaagcacgttgagcgctacgcccgcgacagtgatgccttcttcaaggacttcgccgatgtctacgtcaagctcctcgagctcggcgttcccttcgagagcaagcccgaggatcgcatcgtcttcaagacctctcagtaagcggttttgatgtcctgatgtcgcatgcttttggttggtttgttacagcgcactgttcctttttctgtttgatatccggcgtgtcattttagatactggccatcagagatggtttcatattactttgccatgtatctgtggaggatatccacaggcaattggaagtttggtagaaaagactgaatctttgaatcaaacaattcatcgaactt

SEQ ID NO: 4433 - DNA, 592 bp, Aspergillus oryzae
  misc_feature (1)...(592): n = A,T,C or G
actgtcttgtccgtggtatctncgagttgggtatctatcctgctgtcgaccctcttgactccaagtctcgtatgctcgacccccgtattgtcggacaggaccactacgacacgggaacgcgtgtacagcaaatgccccaggtgtacaagtctctcaaggatatcattgccattctgtgtatgcgcgaactttctgagggtgataagctcagtgtcgagcgtgcccgtaagcttcagcgtttcgtgggccagtctttcacggtcgcccaggtcttcactggtatcgagggtaagctggtcgacctcaaggacaccatccgctccttcaaggccatcatcaacggagaggctgatgaccttcccgaggctgctttctacatggttggtgacctcgagtccgcccgtgccaagggtgagaagctcctggccgagctcgagaacaaggcctaaatgtaatattgtttttaagcgcccttttcttttttgttagacatggacttcctttcttcagttttccgttttctgtcgatacgtgtacagttctcgaattaaaaaaaaggagttaaaccaaaggcttattcctccttgtaaga

SEQ ID NO: 4434 - DNA, 655 bp, Aspergillus oryzae
gtctcatttctggctttgactcgtcgcgatggactccgaagcacaagcacggtttaatctcatcagcgagaatctcgccgagatcttgaaccccgagattatcgaaaacatcttaatcgaaaagagaaatcctagaatctattggggtacggcaacgacaggaagaccacatatcggatatttcctcgctgcgctcaaaatcgcccaattgctccgtgcacaatgcgacgtcgttgtcctgctcgccgatgtccatgccttccttgacaacctgaaggctccgcttgagcttgtggagaaccgtgctcagtactatagaaagatcattacggccattctcgagtctgtcggcgtgcctaccgataagcttgagtttgttcttggcagctcctaccaaaaaagccccgaatatgtcatggatgtgtatcgcttgtctagtttgatctctgagggaaatgctaaaaaggctggcgcagaggttgtcaaacagaccgagaatgctcctttgagttgtcttctgtacccggtgcttcaggtccttgacgaagagcacctgaaggttgatgttcagctgggaggtatgggccaagagaaagctctttaacggctgccacgggaatgggtggctaaggatcggtttaccgggaagcgcgca

SEQ ID NO: 4435 - DNA, 1376 bp, Aspergillus oryzae
  misc_feature (1)...(1376): n = A,T,C or G
gacagtcagaagcactcttctgctctccctttcactccacccccccaattgctgtcgagctcctcggcttcctatcttcctcctcacatattttatattccgcacatgcgataatgctgtcgcggtctactttcagccgaaatgcgccccgtgcggtccagaagcagtgctctgctgccggcatcaacagccgtcgaagcatggcctctgctgcgaccccaggcctccagtacgatgtcaccgaggctgctggcgtgaagctcgccaatagagaagtagccggtcctacagcaaccctggcgttggttgcaaaggccggcccccgttaccagccattccctgggttctccgatgctctcgaacaatttgccttcaagtccacactcaaacggtcggcgttgcggatcaaccgggaggttgaactgctcggcggtgaagtttcttcgacacactcgcgtgaaaatgttgtcctcaaggccaagttcctctcgaacgatcttccttactttgccgaacttctcgcagaggttgcttctcagtcgaagtttgcagcccacgaattgaatgaggtcgtcatcaagcacctcaaactcagacaacaagcccttgccgccaatcctgagcagcaggctgtcgatgctgcccactccctggctttccaccgtggcctgggggagagcatcaccccttccaccactactcctattgagaaatacctttcggctgaagccctcgccgagttcgcccagcaggcttatgccaagtccaacattgcgcttgtaggcagtggctcaaactctgctgaactgtccaagtgggttggccagttcttcaaggaactccccagctctggcagctccagtcagtaccagctccgtcccggcgccacttccaagtaccatggcggtgagcagcgtgtctcttccaaagccggcaacgctgttgtcattgcattccctggctccgctgctttcggcacctctggccacaagcctgaagcttctgttcttgctgccctccttggtggtgagtccactatcaagtggactcctggcttctccctcctggctcaagctactcanggcttctcccaggtccgtgcctctaccaagagccacacctactctgatgctggcctcttcactatttcgctttctggtaaggccgatcatgttgcttcagccagcaagaatgctggggatgccctcaagaaggttgccgccggcgaagttgctaccgaagacatcaaaaaggcaatcgctctggcaaagttccgtgctcttgagtcggctcagaacctttaaaacggccttgaagccactggcttttgtcttttcaacggcgggaaacctttccagatcggcgaaatcgctccg

SEQ ID NO: 4436 - DNA, 668 bp, Aspergillus oryzae
ggatgctttcgcccccaggcatttcgtgagcgagggccacaacattgccctctgccagagttttgctaagaacatgggtctctatggtgagcgtgtcggtgctttctcccttgtgtgtgagaacgccgaagagaagaagcgtgtggactctcaggtcaagattctcatccgccccttctactcgaacccccctatccacggtgcccgtgttgcctccaccatcatgaacgaccctgagctcaaccagcagtggttgggagaggtcaagggcatggccgaccgcatcattgagatgcgctccctgctccggaaaaacctggaggagctgggcagcaagcacgactggtcccacatcaccagccagattggtatgtttgcctacactggtctcaagcccgagcagatggacgctcttgccaaggagcactccgtctacgccaccaaggatgggcgtatctccgttgccggtatcacctctgacaatgtcaagagacttgccgagtctatcttcaaggtgaccgggtaaagaaaggatgttgaggctggactttatccttaaaatacatagatctggcggggtgtggccctttgtattgatatccgacatgtttaatttagcatattcttacgagcattatattatggtctgaattctctggatgaaaaaa

SEQ ID NO: 4437 - DNA, 1248 bp, Aspergillus oryzae
cgatcacgatttttactccctttctttagcttccgttgttcttgctcaacatcttgttttaattagtatattagtcgcttttattctttcgccgctttttctcgaattgccaccaatctacctttcgtctccattgaacattttagcgctttccaggtatacggtatcattcggtttttaccctacgcagttaagccgccaatttctccgttttattgcctgatgaccgctcgttttctgagccgtctcattaggtagctatcatggataacgcaaatctttggactcgccgctccaactcctctaagttgtctctgtctatgacgggaacagacggcaaagacggtgccagagtcgaacttccccgcacgaagcgttttggtcctgatagctcccatggtcgatcgaatcccttcaacgctctatctccgctctcgggcggtgtgtcctccccgtcaacgaacgcttcctctgcattcggcctgggatccggcgcctttgcatctttcggtgcccccaaaacccccggcggctccgaccttaagacgcccctcgagaaacgagacaacccgacagaacacgactcggcggagagcgcgaagacgaaagccgctaataccgccatcaaagaacacccgctgaagtccaactgggtcatttggtaccgtccacccacccctaaatactccgattacgaaaagtcaaccgtcccccttgcatctatatcctcggtcgagagtttctggtcgatatattcgcacttgaagcggccttctcttctacccactgtttccgactatcatatctttaagaagggtattcgccctgtttgggaagatgatgccaacaagaagggtgggaagtgggtggtgagattgaaaaagggtgtcgctgatcggtactgggaggatcttctcttagctatggttggggaccagttcgcggaggctggtgatgaagtttgcggtgctgtcctcagtgtacggagtggcgaagatgtgttgagtgtctggaccaagattgacggtgggcgcaatatcaagatcagggagacgatcaagcgtctactaggcttccccatcgacaccaacattgtctggaagagccatgacgacagcattgctcaacgctctgccattgaccaagctcgtcaagagaaggccaccggaaacaacggtcatcaccatcatcattaccaccaccaccaacaccattaccacaacaattacaacaacaaccacaacaacc

SEQ ID NO: 4438 - DNA, 1357 bp, Aspergillus oryzae
  misc_feature (1)...(1357): n = A,T,C or G
cagatgtacagcaagctgatgtgaaggctgaccgttacgcccaaactaatgggcacgttagcagtggagcgggtgagcctgtacccgagcatgagcctgagtacgtgcaacatgatagtgcaggctataacaccaaccgcggatcttacacatacactaccaacccttctgttggaagcttggcgggtgatcattctcaactcgcgtctgatatgtctggctccccctcgcaacagaacgggtccggacgcatgactccccgtactagcggggcgcctccccaatgggcctcgggatacaatacgcctccccgatccgctgctgtcagcagcctctacaatagcgtcagcgaaactcgcggtgcgtcggcgaacggaacgactgataattactctgtggcgtcgaatccagcaccgggttactcgacggggatgaacggacctttggggtcaggaaagcgtatgcgggaggatgatgatgtggaccaaatcgttcgaccagacagtcggggtgcggaatatgagagcaagcgccggaagactctgactgaagcgacggttggtggtccggttggaggagtaccacttggattacagccgatgaaggccggtggtgttatggctcgccgccggtaaggccttcaagtggtgtcccccatgattccacgggcttcggaggatcaaaggaaagcaaaaccaaaagtgataaaaaaaaaagacgaagaccgtggtacttctttctggccgtgaagggtcacctccgaatccctcgtgttgttcgaatgcatcgcagggtttttattttccttacatcttgaatagactacacattcgtacgactcggcactttcaaacgagatgattggtttctcaccagcagtttgttacaacacatctgcatttcagggaacatgctacgttttgttgtcgagccgttttctttcagcgtgcttatgttgggtaattgttagagatgggacataacactgtgaaaacggtatggatgtctggctacgatcgttataatgtctgagttttccccttttcggccacaaaagggcgtgcgcttggagtcttggtattatagaggaatatttgcggggtgctgatttggctctctatctgaaggcacggttcgtcttttttttagcggcctaagggcaatttctggccaaagtgctttgggccccagatatttttacttggatttaaaagagggattgcgggtgggattagccccaccatttgccactatggggtttttgaannttttttaaggcccggcaggatctgcggatttgtaaggggggcccaccggggaccccccccccacaacaaaaaaaaattttgggggcgtt

SEQ ID NO: 4439 - DNA, 1056 bp, Aspergillus oryzae
ggcactgtccgatcgccgaggggagcgcactgaggaattaaggatttccctgttccggcattcttctccgagtatggatgcaacgaccctaaacctcgcaagttcaccgatacccctgtcctgtacggccccaagatgaacaacgtctggagcggtggtatcgtctacatgtacttccaggaggccaacgactatggattggtgaaggtcgatggtgacagcgtcaagactcgcgatgacttctctaacctctctgagcaaatccagaaggccactgccactggcgtcaacagcgccagctacactgcccctgctgctgctaccgcatcctgccctgcggttggcaaggactgggaagccaccagtgaactccctccttctcctaacccggatctgtgctcctgcatggttgattccttgtcttgcgtcgttaaggattccgtcaaggaagacgactacgaggacctgtttaactacatctgcgccaaggatggaatgtgcgatggtatccagaaggacggcaccaagggcaagtacggagcgtacagtgtgtgctctcccaagcagcagctctccttcgtcatgaaccagtggtacgagaagagctccaacaaagaccaagcctgtgacttcaatggttcgggccacacccagagcgcctccaagagcgatggccagtgctctgacctgctgaagcaggccggcagcgctggtactggcagtgtcaccgcttttcccactgccgaaagtgccgccgctggcagcacttccttttccacctccagcgccgacagcgctgccggtcccgtgagcccaatggccgtcaaggttggcggttggcagttcggagcttacatcatgactgcctttgttgccggtgctggaatgctcctgctgtaaagtagtaacatgtatgggctcaagaatgttagcagaatagtgaaatgtggctggggggtgatttcgttcgttggagtgtatttatccatgtgatttttggacccttaagacgtacatactttagccaataactcaatcgttcattctttcgaatat

SEQ ID NO: 4440 - DNA, 640 bp, Aspergillus oryzae
gcacaacatcgacccagaaaccgtacgtgggattggctttgatgcaacatgttcgttgtcggtgttctccaacgttaccgacgaacctatatctgtgacgggacccaatttcgattcggatcgcaatgtcatcctttggctagatcatcgcccggtggaggagacggaaaaggttaattctaccaatcataacttgcttcgttacgttggtgggaaaatgtccattgaaatggagattcccaaggtcctgtggctgaaaaatcatatgcccaaagatctgttcgaccagtgcaagttctatgatctggcggatgcactgacccatatcgcaactggcaatgagaagagaaatttctgtagcgttgtttgtaagcaaggatacgtcccagttggggtggatggaagtgtcaaaagttggcaagaagatttcttggccgaaatagccttggggacctagctcaagaggactttaagcgaatgggaggtgttgatgggaacggcgattacctaagtgctggagaactggctggaaccctttgggaaaaagcgggctccgaatatggggtacccttaagtattgctatagggagtggagtcatcgacgcttattgcagttgggtttgggactggtggtgctaat

SEQ ID NO: 4441 - DNA, 659 bp, Aspergillus oryzae
ggtgaacggtagcagagcattttgggtcaagaattgactaaaaatgtctggccagggtgtaccagaaaataaacattccaagatcctggttgctggagctgcggggttcttagggtcacatcttgtagaccttctgctagagaaaggccatgaggtgattggtctggacaacttccaaacgggctttcccaacaacctgaaacacttaatttcgaatgccaaattcaccctcgtccgccatgatgtgcgagctcctttaccagagctacctatcgtcgatcagatatatcacctcgcctgtccagctagtcccatccagtaccagaaagaccatattggcaccctagatacctgctaccgcggcacaaaaagtctgctagaattcgcaacacaacgcaagatccgaattctattcacaagcacatctgaggtctacggagatcccaaggtctgtccccaaccggagacatactgggggaatgtgaatccctttggtccccggtcttgctatgatgaaggcaaacgagtcggggaggctctaatgtatggatatcgggaacagcatggaactgacattcggattgcccgtattttcaacacgtacggaccgcgggtgggtggctgggatgaaaggggcttttttttttctttgagagcgc

SEQ ID NO: 4442 - DNA, 735 bp, Aspergillus oryzae
cgcaggccccgacacccccctccgcgacgatacacccagctcgacttcgcttcctcgtcgaactgaattctcgcaacaatggcgaccgagttgaccgtccagtcggaacgtgcgttccagaagcagcctcacatcttcaacaaccctaagactcttgcgaagagcaagaaggttggccagggccgcagatggtacaaggatgttggtcttggattccgtacccccaagaccgccattgagggcacctacatcgacaagaagtgccccttcactggtatggtctccatccgtggccgtatcctgaccggccgtgttgtctccaccaagatgcaccgtaccatcgtcatccgccgtgaatacctccactacgtccccaagtacaaccgttacgagaagagacacaagaaccttgctgctcacgtctctcccgctttccgtgttgaggagggtgactgggttaccgtcggccagtgccgtcccctgtccaagactgtccgcttcaacgtcctccgtgtcctgccccgtaccggcaaggccgtcaaggctttctccaagttctaagcgtgtcgatgatgatgggggtgtttcgattccagagggtcatcaacctagggcagcggcgtgactggatataagcgaattagtttaacgggttgggattgtttcacgatttcatgtcccaggtacccttgtgaaggaaatatccaatgaaaaaaagctttttgatactcctat

SEQ ID NO: 4443 - DNA, 652 bp, Aspergillus oryzae
ccagcttactgatttcatgttcaactttgctctgaagagccgccgccaacggatcaatcaacgtaaccgcactgagcggttgagcgatctgttggactggaaacgtatgggattagagtatgtcaaagcgcggcagctggctcttcggcgagcctacccgtcttcctttggtagcggcgaagacttctatgatattattggaggaacagaacagaagatttcacgaccgttatctgtcccagggtcaccaagggatcgctcggggatgatgacccctggtgattttgcatccctgcaagaagtcaaagaaggactgagtactgaggactatatcgcatggcggctgcctggtgcaaccgatgaggatgaaccagacgaccaatacttcccactgacactacgaacgaaaaagacatccgatcgacccgcatcgccgctcgaccgcatatcagtcaatggtgggaactgattgacagctgcataccttactggagaattactgcctagcgttccactccccagcgcgttgccgtgcgctggttcgaatccctctcgttgtgtgtttctgtgccatagctttcttaacatttgtcatttttacttacttcaattgcatgtttattgatattctttgagagaaacacagtgaccc

SEQ ID NO: 4444 - DNA, 904 bp, Aspergillus oryzae
cgccaacgaccgtcgatacgccgacatcaagatggtcaaccttcgcacccagaagcgcctggccgcctccgtggtgggctgcggcaagcgcaagatttggctcgaccccaatgagatgaatgagatctccaacgccaactcccgtcagaccatccgtaagctcgtcagcgatggcctcatcatccgcaagcccgttaccatgcactcccgcgtccgtgcccgtgagctcaacgccgcccgcagaatcggcagaaaccgcggtctgggtaagcgtaagggtaccaaggaggcccgtatgcccagccaggttctctggatgcgccgcatgcgtgttctccgtcgcctcctcgtccgctaccgtgctgctggcaagatcgacaagcacctttaccacgagctctaccacctgagcaagggtaacaccttcaagcacaagcgcgctctcgttgagcacatccaaaaggccaaggctgagcgtcaccgtgagcgtgtcctcaaggaggagatggatgccaagcgtgccaagaacaaggctctccgtgagaggcgtcaagagcgtctcgaggccaagcgcaacgctttggtcggcgaggcccaggagtaaattcccttccgttgacaacgtgttttggcggtgcggaggttgaactgggaggataaatcaagagtctcggtcagcctacaggaaaagtctaggtcgacgatttctgttttctcttaatggctttgattcatccgggacggtttttggtacaagggtgaacctggaacgggggcttggggaaacagaaggaaatgaatgcatctcttttcttccatgggccgtctgaaaagagaaccagggaaaagaatgaaaaataccatttgattaaagcaaaaacaatggcatggcgctttgtgtgat

SEQ ID NO: 4445 - DNA, 679 bp, Aspergillus oryzae
gtacgggcacattactattggcctccaacttgcgcgagtacgatttctgaagagaaagaacgaaactactgcccgctatttcgccaataatcaatcctatgaatggtaatccgctcacaccaccggtcatgccataggtgccttggaagacaattgggtaggccgacagcagcgcataagccagtccataaatgaaggacatgtacaaggtcagaaggaaggcgatgggctcggtgaacaagatcaggaaaggccgcgcaaggttcttggtcaccagctcccggaaatcgatctcgtgttcatcctgccgtgcgtggataccccagttcctggtttgacggcgcaggatggctgctttttgcattaatacaacgggcacgtacgtctcctgtgcaaacagcgccatcaagatcaagctaaagaacccgacaaaggccggtatatagaacgtccaccgacagcctaaatagctctctgcagtgaacccgccgatgaaaggtgctgtgaaaggaccggtaaacacagacatcgtatacacagcgatcgcgacacctcgatgatggttattgaacaggttcgacagactggccgggacaagagcgatgacactagcggcgcaaaaacccgcgaagaaacgtgtcaacataatcgtttgcgtgtctttcgccgtcgccccagg

SEQ ID NO: 4446 - DNA, 516 bp, Aspergillus oryzae
  misc_feature (1)...(516): n = A,T,C or G
agcaatggctgaccaggagcaacagactcagagaaagagaaccttccgcaagttcacttatcgtggcattgacctcgaccagcttttggacttgtcctccgagcagttcatggagcttgtccatgcccgtgcccgcagaagattccaacgtggtcttaagcgcaagcccatgggcctcatcaagaagctccgcaaggccaagaaggaggctagccctaacgagaagcccgccaccgtcaagacccacctccgtgatatgatcatcgtccccgagatgatcggctctgttgtcggtgtccacaacggcaagaccttcaaccaggtcgatatcaagcctgagatggtcggtcactaccttgccgagttctccatctcctacangcctgttcgtcacggtcgtcncggtattggtgcacccactcttcccgtttcgttcctctcaagtaaattgagaaaggcatgtcgatttggatgcgtattgtgggataaaaacgcacaactctctgttttcgccan

SEQ ID NO: 4447 - DNA, 1081 bp, Aspergillus oryzae
  misc_feature (1)...(1081): n = A,T,C or G
ccgtatggtattaagataccctatatcttcgttacaaatggtggaggcaagaccgaagaggaacgatgcttggatctaagccagcaactagagctggaggtctcgccgggccaattcatttgtggccacactcctatgcgggagatggcggcgcggtacaataccgtccttgtcgttggtggtgtaggcgagaaatgccgcattgtagctgagggctatggtttcaaggatgtcatcactcccggggatatcatcaagacgaggcacgacacgacaccattccggagcttgacagaagaggagtacaagaactctcgcgtccgagatttcagtcagaccaacattgatgccatcttcgtctttgctgacagtcgagactgggccggtgaccagcagatcattttggatgttctcatgtcgaagaatggacgtctcggtacacgctccgagaccttcgacgagggcccacccgtattcttttcccacaacgatgttgtgtggtccacctctcatgagcattctcgtattggtatgggtgctctcagggcttctctagaggcgctctacaaagccgtcaccggaaaggacctgcatacggttgcttttggtaaacctcaactgggaacatatgaattcgccacccggctccttcgccagtggcgcaaggacacccacggtatcaactgtcctccgaacaccgtttatttcgtcggtgataccccggagtcagatatccgcggtaccaacgagttcgataaaatcagtgattcccactggtactcaattcttgttaaaacaggtgtctaccaggaaggtactatcncccgttatccgcccaagaagatcaccgacaatgtactagaagctgtcaagtttgctatggaacgtgaactcagcaagcaagcaaacgagtccgccatcgcagatgatgtcgactctggcatcgactctgaatctgctaagaaacattgattggctttcaccaggagactcccatattttacgttcatcaacatttacatttatatgatatcccatgttatctatatacttcttatcttcgtgctgcgcacagtttgtt

SEQ ID NO: 4448 - DNA, 499 bp, Aspergillus oryzae
  misc_feature (1)...(499): n = A,T,C or G
caaggagaacgctccttcgtctctccagatcatcgacgtgcccgctaccaagaccaccgttgaaaagcctaccgaagtctcctccaagattgctagcatcaaggaaatggaagcgaacgagcccctacttcaagagaaccctcatcgcttcgttctgttccccatcaagtatcatgagatctggcaaatgtacaagaaggccgaggcctctttctggaccgccgaggaaattgatctttctaaggatcttcacgactggcacaaccgcctgaatgatgacgagcgcttcttcatctctcgcgtacttgccttctttgctgcctccgacggcattgtcaacgaaaacctgctcgaacgtttcagcggagaggtgcagatccctgaggctcgttgcttctacggttnccagattatgatcgagaacatncacgctgagacctactctcttctgaatgatacctatatcaaggagcccnagcagcgcacctacctttttgag

SEQ ID NO: 4449 - DNA, 549 bp, Aspergillus oryzae
ggattgagcacactattgcctgggccagggatcttttccagacctactttgttggccctcccgaggctgtcaacatgtatctgtcacagccaaactacattgagcagacgctcaaacaggctggcaatgagaagcagactttggagcaactgcacgatttcttggtggccaacaagccactgacttttgacgattgcattgcctgggctcgccatcagtttgaaggtcagtacaacaatgcaattcagcagttactgtacaacttccctcgagattccaagacctcttctggacagcctttctggtccggccccaagcgtgctccaacacctttgaagttcgatagctcaaaccccacgcacctcgggttcatcgttgccggcgcgaacctccacgctttcaactatggaatcaagaaccccggagcagacaaggaatactaccgcaaggtcgtcgacaatatgattatccctgaattcacgcccaagtctggcgtgaagatccaggcagatgagaatgaggccgacctcgacgctggaaacgctggtt

SEQ ID NO: 4450 - DNA, 549 bp, Aspergillus oryzae
  misc_feature (1)...(549): n = A,T,C or G
cttgtatagttcgccgcagccgttactggtggagagaccctggagaagatgtcgacgcaaaatcagaatgaacccttctatcttcgctactactcaggtcactctgggcggttcggacatgaattcttagaatttgatttccgctcccttggtgatggtcgcagtgccgccgtgcggtacgcgaacaactccaactaccgcaatgactcccttattcgcaaagaaatgtgcgtgagctcgtcgatgattcaggagatcaaacggattatcaaggagagcgaaatcatgaaggaagacgattccaagtggccccagaagaacaaggacggacgacaggaactcgaaatcagacttgggaatgaacatatctcctttgaaaccgcgaaaatcggctcgctggtggatgttaccgagtctgcggacccagaaggtctccgcgtgttctactaccttgtccaggatcttaaagctttcattttctctctgatttctcttcatttcaagatcaagcctaatctagacctgtactcacacatggtaccaggttgn

SEQ ID NO: 4451 - DNA, 649 bp, Aspergillus oryzae
gggagaacgggaacgcttttttgcttctgttaacctagagcgtacccgagcattcggaaagcttgtggatagtgcacagagcccgattcccaagcttccatggggcgaagactttgaaaaggacaagtttcttagcccagatttcacttcgttggaagtcttgagctttcaatcttccggcatacctgctggcatcaatctcccaaattatgacgatatccgtcaaaatctaggtttcaagaacgtttctcttggaaatgtgcttagcgccaaagcccctaacgagcctgttccttttattgccaagaaggatttggacgtttatcgcagatgccgtgaccccgcgtttgaagtccaggtaggcatccatgaacttcttgggcacggaactggcaagcttcttcaaaagactgccccaggagagtataactttgatatttgcaaccctcctgtgagtccagtcacgggaaaacctgtatctacatggtacaagcctggtcagacctggagctcggttttcggagctatcgccctttttttatgaagagtgcccggcaaagtgccgtgctatggtgctcaactgcgactttagcatcctgaagatttttggattcggaaacgggcaagaagatctcacccacgaggctgg

SEQ ID NO: 4452 - DNA, 684 bp, Aspergillus oryzae
gtcacaaccgtctagtacctcagaacctcgaatgaaggcatcgaacagtttcgtgtcgcaagagatattcgaaatgaagccgcagattgcaagcgttgtgaggatcagcgtgattaccttctgcaatggagccctgtaatccgttatctgagtgacaacattcgacaactcggaggtgatctctctagccacaatatctactgtcgccggtgtacgaataggaaagctggaggctttgacccggactttgggatcctgctttgcgcaaatgagatgaaagaccaaggacatctcgaggacacaatggctcatgaaatggttcatgcttatgatcacttgagatttaaagttgactgggcagataacttgagacatgcggcgtgtactgagatacgggccagctcccttagtggggaatgcagatgggcgcgggagttctttcgacgaggtcaatggcgattcacacaacaacatcaggaatgcgtcaaaagaagagcaatcttgtcggtgcgggcaaggcctacatgcaaggatgaagctcacgccgagagggttgtaaacgaagtttgggatagttgcttcagagacacttcgccgttcgacgaaatctaccgttgacaccatggtttctctctagcctacctcatatgagttacttggtgttccatttctctatccgaaaaa

SEQ ID NO: 4453 - DNA, 675 bp, Aspergillus oryzae
  misc_feature (1)...(675): n = A,T,C or G
cgccgatcatgcattcgccgccgcggaagcttacggcagaagatcaggaggcctggaagattccaccgcccgtgtcgaactggaagaatcccaagggttatacggttccgctcgataagcgtttggccgcagatggtcgtggtctgcaggatgttactattaacgataagtttgctcagtttgctgaggctttgttcactgccgatagacatgctcgtgaggaggttagactgcgtgctcagatgcagcaaaagctggcggaaaaggaaaaggcgcagaaggaggaacacctgcgggcacttgcccaaaaggcccgcgaagagagagctaccagcagccgccgcgactcccgtgccgtttctcgctctcgttctcgttctcgcagtgtcagccgcagtccgtctccgtactctgatcggtctcgcactcctagtgatgacgaacaagctgcccgggagcgcgagcgcatgcgtcgcgaacgccgccaggaaaacgagagacagctccgtcagtcgagaatgggtacagagagacgtattcaggccatggcccgtgaacagaatcgtgatatctcggagaaggtcgctctgggattgccaaaccgactcagtctttcgagactatgtgggattctcgtctgtttaatcagacgagtggaatgggactcngattcaa

SEQ ID NO: 4454 - DNA, 897 bp, Aspergillus oryzae
cgctctcaaggtcatcgagcttggcggttccgtcgtctccctctccgacagcaagggcgccctgatcgtcaacggtgagggtagcttcacccccgaggagatcaacaccatcgcccagatcaaggtcgaccgcaagcagatctccgagattgccagcactgaggctttcgcttccaagttcaagtacatccccggtgcccgtccctggacccacgtcggcaaggtcgacatcgctctcccctctgctacccagaacgaagtttccggcgaggaagcccaggccctcatcgacgctggctgcaagttcatcgccgaaggttccaacatgggttccactcaggacgccatcgacatcttcgaggcccaccgtgaggccaacaagggtgcttccgctatctggtacgcccccggtaaggccgccaacgccggtggtgtcgccgtctccggactctatatggcccataactctgcttgtatcaactggacctccgaggagggagatgctagtcgaaatgatattatggacgactagataccagaggtcactactcactacgtatgaatagatgtaagaagcgtcgggacgtcttatcatgtgacataatgagagacgataagagatgtttcaactcgagatgttgatttatgaatcaaacgtcgacgtatgtcatatggggcaagtgatgcccatatgacacgcattatactagagatgtatgacatgacgcaagtcacgacatatgacgagatgagacacgaagatgccacgaagatacatgtgaacactaaaagatcgagataagtgatatgattataagattgcgtgccacgatatgacgctcgcgcttggagatgacaatgagtatgagatgtatacgatcatgaacgttatggacc

SEQ ID NO: 4455 - DNA, 1286 bp, Aspergillus oryzae
  misc_feature (1)...(1286): n = A,T,C or G
gcgccgctggaccctacaactctctatactatattatttactcacctcctcaatgcgacgtgcagcccttcacgccttccgtagcgcgcgtcgtgtaccggtatggagagttgctggtaggaaaccgcgtgctgtgtcgttctctagcagcaatccgctagctctccgaccctcctccgccgggaagcacccttctttcatccccgcgaccttacactcatcgatgcatctccggaacttttctcttgccgtgatatcgacggtcgttgcatctggggcctggtacgcttatcagggtggcagttcacagtcggcagcagtagcgggcttgaaccggaccatatctacttccaccacggcgtacgctgaggatccttcggagtcaacccgccgcgctcttctggtggataatgatcagttttataccgcgactattaacggagaagaaccgcttcgcaaacagacggacgactctgaccgccgacttctagaaatgttgacaccggagcaagctacgcagaagctgaggaagaatgaagagtcgtacttggttaaccgaggcaagggtgttgttcgctatgatgtggtgcaagtgcctagcaactcgcccattgaagacgatcatgccgaaaagatagtagaggtgccgtccacagtagctacagcgaaagagggcgaagccaacagcgactggatgttctggggcgtgttcgacgggcattctggctggacgacttccgctaagttgcgcaatgttctcatttcctacgtggctcgggaattgaacaccacttacaaggctgcggctgctgatccttcgctacttacaccttcccctgcagctatcgacgcagctatcaagcagggctttacccgattggacaatgatattgtgcacaacagtgtcgaaaaggtgctcaagtctaactcgcggagagtcgcagccgagacacttgcccccgctttgtccggctcttgcgctcttcttgccttttatgactcccagtcaaaggatttgaaggttgcctgcgcgggtgattctagggccgtccttggtcgtcgtgggccgaacggaaagtggtctgcaaccgcgctgtcggaagaccagaccggccggactccttccgaaatgcaacgtctacgggccgaacaccctggggagcccaacgttgtacggaatggaagaattctaagccaactggagcctatccgatctttttgagatgcgttctacaagtggagcanagagactcaagattagatcaaacgggaattcttcggaaaaa

SEQ ID NO: 4456 - DNA, 670 bp, Aspergillus oryzae
caaaattaattgcagaggctggcttcccacctggcgtcgtcaacatcatctccggtttcggaagtccagccggtagtgccatagcatcccatatggatgtgcgctgcctgagcttcactggttccacagccaccggtcaaaaaatccaaatcgcagcagccaagtctaacttgaaagtagtccacttggaactaggcggcaaaacaccagcaatcatcttcgaagatgcggatatcgaaaaagcagcagaaaagactcaattcagcatccacttcacgagcggacaaacctgcttcgcgaactcccgcatttatgtgcaggagtccgttgcggataaattcatagcagtattcaaggaaaagttcggcgccgcggcgcgcatgggcaatcccctcgagccgacgacgaaccacggaccgcaggcagacaacattcagtatgagcgggtcaagtcgtacctagaaatcggagaaaaggacggaaagctcacgatgggaggggatggcggaatgggcttcatcaagccgaccgtctttgaaaacgtccctgatgactctcggcttatgaaagaggaggtgtttggacctgttgtggcgatcaatacgttcaagacagaggaggaggcgattgaacgggctaatgcctccgagtttggtctttacgcctctgt

SEQ ID NO: 4457 - DNA, 745 bp, Aspergillus oryzae
  misc_feature (1)...(745): n = A,T,C or G
ggcgggatgaangacttcgaatcacttcggcgcgagggcagatcgcggcgacccttgaccgggaccaagagcttttcaactttggcctttgcaggcggcactgtcctggccaatgcatgcgggccatgcattggtcagtggaagcggactgatggcgtggctaagggcgaggataacgctatcttcacttcgtacaaccgtaacttccccggccgtaacgacggcaaccgtcggacaatgaacttcctggcctccccagagcttgtcacagcgctggcgtattccggccgtactaccttcaaccctatgaccgacagcttgaccaccccgagtggtgaggagttccggttccagcccccaactggctctgcgctgcccgctgatggcttcgaagacagtaaccccgacttcaagcccaccgcggcggcccccgacgcgagctgcgaggtggttgtgtcgcccacttccgatcgattggctctgctggagccatttgctccctttcccaagggaaacctgtctggtctgaaggtgctgtacaaggtcaagggccagtgcaccacggacaccatctccgctgccggcccatggctcaagtacaagggccacctgcccaatatctccgccaacaccctgatcggcgccgcaacgccagcactggcgagaacaaccgtgctaacgacaaaacggnagcatatttcattcccgacctggccgntcaatggaggccgaaggaatccaatgg

SEQ ID NO: 4458 - DNA, 642 bp, Aspergillus oryzae
  misc_feature (1)...(642): n = A,T,C or G
gattcgtcacttctcagtttaccataataactatccgataattcatgtaccatactaccaacaattttacgtactatcttctagctactttctgctaagtcgtgtaccagccgatcaccgctacgctacgtaagcgacgccatgtccggtgcaaggcattgggagcaggataaagaggccaccgtctacattgggaaccttgatgaaagggtcacagatagcctggtatgggagttgatgctgcaggcagggcgcatcgttaatgttcacctgccaaaagatcgagtcacacagtcccaccaaggttacgggtttgttgaattcatcagcgaagaggatgcagaatacgcatcccgaataatgaacggcatccgtttatatgggaaaccaatacgcgtgaacaaagcgtctgctgacaagcagaagtcggtggaaatcggcgcggaactttttgttgggaaccttgaccccatggtcacggagcaagtcctttataatacattcagtcgatttgggaacttgatcaatttaccaaagattgcacgagatgacaataatctatcaaagggctatggaattgtgtcgttcggcgaacttgaaacatcggatgccgccatagcaaacatgaatggccagtacctn

SEQ ID NO: 4459 - DNA, 645 bp, Aspergillus oryzae
  misc_feature (1)...(645): n = A,T,C or G
cttctcactacacttctcttcctatcagtttgtcgttccacataatacttgttggatttccactcgagaaagaaagcagtgattgcccttgtcttgtgacaaacgaaactagtaaagaccatgacgtccatcggtactggttacgatctttctaattcggtcttctcgccagatggccgcaactttcaggtggaatatgcagctaaagcggttgaaaatggcggaacagccattggtataaggtgcaaggacggcgtcgtgctagctgttgagaagatcattactagcaagctcctaaagccgggtgcaaataagagaatagcaacagtcgatcgacacgttggtattgtctctgccggtctagttccagacggtcgacactttgtttcccgtgctagagatgaggctgcttcatggagaagcgtatacaagggccctatccctgtgtctgctctgtcgaatcgtttgggcagctacgtacaagcttataccctctactccagtgtacggccttttggtgtgaccgctatcgtgggcgggtgggattctgaagccgagcttgccgtcgatggtcaagtcggcagtgggcctaaatcaagctctgggggaanggtgatggggctagggcttgaggaccaagcctat

SEQ ID NO: 4460 - DNA, 669 bp, Aspergillus oryzae
ggtaacccggatatactctatcccacccatcaccacattccataacagcgccctttcattgggaaagtcactcttccttgaaattggttacatcgcggaccatcgtaccttctttaatcgcaaggcttgtgatactccttgcggtgctcgttcatcaactagtactttgccaagagcaagtctccgtcttgtcgggtggtgatcgactctccccgatttacctacccctgttgcgacgaatcctgattcgcctcggctcgtcagcccttccgagcttcccttaagtacaggcttcgtcccctctttagctgcactcctcggtgctaggttaggacgagtcacatgccaccaccggcttcttcagtggatttcaccaatctgctgaaccctcagaataacgagactggttctgcaccttccacgccagtggatagctccaaggctccctctaccccgtccagtactcagtccaactctaccatggcctcgtctgttagcttactaccgcccctcatgaagggtgctcgtcccgcaacggaagaagcgcgccaggatcttccccgtccatacaagtgtcccctgtgtgatcgcgccttccatcgtttggagcaccagaccagacatattcgcacacatacgggtgaaaagccacacgcttgccagttcccc

SEQ ID NO: 4461 - DNA, 679 bp, Aspergillus oryzae
  misc_feature (1)...(679): n = A,T,C or G
cccttatattccgccaaagctatctgtgcaatctcccttccttataactcacaaatttggttatacaacaatgtcagctaaaattcccagaaactttaggctccttgaggagctcgagaagggcgagaaaggccaaggagcagaggcttgctcctatggtcttgcagatggagaagatatgatgatgagcaactggaacggaactattctcggccctcctcatagtgtccatgaaaacaggatatacagtgtcaacatccattgcggtcccgattacccagacaatcctcctgagatccaattcatctcaaaggtcaatcttccttgtgtagacccacgaactggcaaggtcgaccctacgaagcttccgtgcttggctcaatggaagcgcgactatactatggagaccatcttgcttgaattgagaagatatatggctcttccgcaacacaagaagcttcctcagcctccggaaggctcgaacttctgagttgatgatcttgcaggatacatgatcggagtattgtggttagttttgcgtcaggtctcgtcatctcatcctttctcttctntcatcattgaagcgtgtacagtctatgcataacggcangcatggcgtgatctccttccgagtcttcagttcaattattatttagaaatatctcggaatatctatatn

SEQ ID NO: 4462 - DNA, 936 bp, Aspergillus oryzae
  misc_feature (1)...(936): n = A,T,C or G
ggtaaatgccgtatcctcgtctcggaagaagaagaagaagccatcatcttcgacgagcacccctacgcccgctacgcagtcgtctgcgaccccatcgacggatcctccaacctggacgctggcgtctcggtaggaaccatcttcggcatcttcaagctgcccgactccgtcctgggtcccgagaacaaggtctcccccaaggatctcctcctccccggtactgagatggtcgcctccggtttcaccatgtacggtgcctccgcccaactcgtcatcaccatgcgcaatggcggcgtcaacggcttcaccctggagaactccctgggtgaattcatcctcactcaccccaacatgaccctccccgccaagcgcgccatctactccgtcaacgagggtaacagcagctactgggaggagtggaccaacgcttacttccactcgctgaagttcccccccgagggccagaagccttacagtgctcgctacattggtagcatggtggctgatgcttaccggacactgctctacggtggtgtcttcgcttacccggccgacaagaaggcccccaagggtaagctgcgtattttgtacgaatgcgcgcccatggctatgctgtttgaaaacgccggtggtctcgctgtgaactcccgcatggagcgccttctgggcgttgtcccggagcacattcacgacaagagtggtgtgttcctcggctcgaaggatgaagtacagaagatcatcgacacatataacangtacaagaaataaactggaaatatatcggcccatatgtggccggcttatacccgtgagaagcctgnagattccaccaccggatggtatttaatgaggatggtcatgggtatttaatgtatgaaaagcgtctaaactaaataaattttgaaataacatttgaaattttttaannnaaaaaaa

SEQ ID NO: 4463 - DNA, 629 bp, Aspergillus oryzae
  misc_feature (1)...(629): n = A,T,C or G
gcgaacgctacacatttccaatgacccggctccgggatataatattgaacaattagccaaaaagggcaagcaattagttgatctaccatacactgtaaagggaatggattgctccttctctggtatcttagccgcagtggatggcttggccacgacatatggactangtggcgaagggaaggatgatgagaccgacacccctatacctgatgctgatggtaatggaaaacccacccgcgcggacttgtgcttctcactccaagagactatcttctccatgcttgttgaaaccaccgaacgcgcaatggcgcacgtcggctccaaagaagttctgattgtcggtggtgttggttgcaatgagaggttacaggagatgatggggatcatggctcgggatcgcggaggtagcgtccatgctacagacgaaagattctgtatcgataatggaataatgatcgcgcaggcaggcttgctcgcatactcgactggattccgtacgccattgaaggattccacatgtacgcaacggttccgaacggatgatgtgtttgtaaagtggagggattaatatgccgatttaactaccggggccccattcactgggataaaatagatttacgaagacgttc

SEQ ID NO: 4464 - DNA, 666 bp, Aspergillus oryzae
gtcgctgaacttgccgacatcttcacctcgcgtctgattgaggaaatccccatcgctttgactcaccttttgaaggcgctccttgagatcccgactcttcacaccgtcaacctttccgacaatgccttcggcaagcgaacctcgaagccccttgtcgacttcctctctacccacgttcctttgcgccatctgattttgaacaataatggtatgggccctgatgcaggtgtggagattgctggagcgctggaggagctcgcaaagcgtaaggatgaggcccgcaaggcaggaaaggaggtccctcagttagagagcattgtctgtggtcggaaccgactggagaatggaagtatgaaagcatgggcacgtgcatatgaggtgcacgctgcaggaatgcgctcggtgaagatgacacagaacggaattcgtcaggagggtatctccagcctgttgagggagggcttcgccacgccagcaaccttgaagtccttgacttgcaggataacaccttcaccatttatgggctcaactgctctctctgaggtgcttccaggctggacttccctgcgcgcagctcggtgtcggtgactgtttgctctccgcccgtggtggtgtcaaggttgcgcaagcttttggctggtgccaagaacgagaagttggaaacag

SEQ ID NO: 4465 - DNA, 682 bp, Aspergillus oryzae
  misc_feature (1)...(682): n = A,T,C or G
ctcctctcagcgctccttcagcacgactaccctccgcgctcgggcacgcacaatgggccagctgaaggcccggaactccaccggtccgttttcatggaagtcggcgctactcttcgtcattaccggtgcgggtatgatcgtttatttccgggtggagaaggaacggttggcgcggaagcgcatcgcagagatgagcaagggagttggtcggccgaaggttggaggtccattcgtgctgaaggacttggacggcaagcagttcaccgatgaggatctgaagggaaagtacagctttgtttacttcggcttcacgcactgccccgatatctgcccggatgagttggataagatggccgagattattgacaaagtgaaggaggctaccaagggcgagaacatcttcttgcctgtctttgttacctgcgatcctgctcgcgatacccccgaagtgctgcgctcgtatctccaggagttccacggggacattatcggcttgactggcacgtacgagcaggtgaagaatatgtgcaagcagtaccgggtgtacttcagcacaccgcaaaacgtgaacccgggcgaggactatctggtggaccacagtatctacttctacctgatggacccccgaggggganttcgtcgagtgcattggcccgccangataccccccatttcgcctccc

SEQ ID NO: 4466 - DNA, 636 bp, Aspergillus oryzae
gtacaactagcggaagacaagcaatggcgtgtccgtcttgctatcatcgaatatatccctcttctcgccagccaactgggggttaagttcttcgacgagcaactcagcgatctttgtatgagctggcttggtgacaccgtcttctctatcagagaggctgccacgcagaacttgagaaagctcacggaggtatttggggttgactgggctaagggttctataatcccgaaggttatggccatgggacagcacccgaactacctttacagaatgacaacttgcttcgcgatctccacactcgcacctgtcgtctctttagatatcattgagaactcaattcttcccatcctggacagattggtcactgacgagatcccaaatattcggttcaacgttgccaagtcttatgctgtgttgattgacacattgcgacgcttgccagcggaggggactttggctaacgtggaaggaaagactgcaacgccatcgccgcgtagtcaggaccttattcagcagagaattattcccagcttggagaagcttcaaggggacaacgatgtggatgtcaggtacttcgcaacactgctgcgggcggtaatgacaaggtcatgcaaacttcaccgtatgccgttgact

SEQ ID NO: 4467 - DNA, 679 bp, Aspergillus oryzae
caatcgcgatcccgtcgcgccaaccgcccatcatgtcgctcgtgtccggcgagaagacgaacttccagtacatcttgcgtctgctcaacaccaatgttgacggcaagcagaagattatgtacgccttgacccagatcaagggtgtcggtcgccgttactccaacttggtctgcaagaaggctgatgttgacctcaacaagcgcgccggtgagcttaccaccgaagagcttgagcgtgtcgtcaccatcctccagaaccctacccagtacaagatccccacctggttcctgaacagacagcgcgacatcaccgatggcaaggactcccaggttgtctccaacaacttggacagcaagatgcgtgaggatctcgagcgcctgaagaagatccgctcccaccgtggtctccgtcactactggggtctccgtgtccgtggacagcacaccaagaccaccggtcgccgtggccgcaccgtcggtgtcagcaagaagaagggctaagccatacgagagggtcactatgctgtgttttttccttcgtacttgctggtggggatgggggaattcctttttggatgttggtgtgttttaacgaattctcgtgggacctgcacatgatctggtgttaaatataaaaattggcacgggtcgaaaaatgaaacaatcataccaatatgaca

SEQ ID NO: 4468 - DNA, 1705 bp, Aspergillus oryzae
  misc_feature (1)...(1705): n = A,T,C or G
cgcatgtctcgtttgaagagaaagaggctctcgtgcagaagctgaagtcactcggccacgatgcagatgctaacgatgaggccaaccgcaaggctctcgacgaactcgagaagcatctgacaccagaggagcaggcaatcctaaagaccctgaagggacgacgcatggtccgccccgaggattcgctcaacattgacaatttcacccttgactctatcgacggcctcgctccgcgtttggagaggggaaacctcggattgtccccagcgaagaaagccgaggtcaaatacacaacccatgatgcgctgtctttcctcaacggcgaagcaagagcggccaagaagacgctttcaaatggcgaatcccaaaccaatggnaaccacttgtgcaaagacacgaccagacgaatggtcataccgcgattaacggccatatcgagaacaatagccagggcgacactaatggacatacggaggccaatggccacagccaaacaaatggtcattccaatggccatgcccacaccaatggaagccacacgaccaacgcccatgatgaattaaatggacacaacaatgtcgaggtgcgctccgtcaaaagctgcatggcagacctcattgcagccgagaagatttcttcccagacttcaatcgaagaaggcactaggcaccgtttgatctcgtcactgcaccaatcggcggaggacttggagactcctttcgacactgtggtgcgattagttgatgcgggtcgacagacagcaatggtttgcataggcggggaccttggaatcttcaagtccctcgtggagagcaaaagaccgttgtcagccgaagagcttgccaaggctactatggcggacccactgctcgtcgctcgcatcatgcgatacatggtcgccagtcgtctggtcggagagacaggacctgaccagtacgtggccagcaagaagacgtacgtctttgccgacccacgcattgagcatcccatccggtttttccatgcgttcagcaatcctgccttccatgctttgcccgaattcttaaaggagactggatatcaaaatgaacccaagggcagtgcgtttcaaaaggctctcaacacggatctggagccctatccctggcttaagcagcatccggatgtgttgaagaactttcaagctgccatgcggctgaccagagacgccaatggtgtggatatgatgcctctcgatcagtctgtcagcattggacatgacggtgccatgtttgtagacattggtggcaacactggccatcangctgctgaagtgctgtccaagtacccggagctcgctggccgagtgatcgttcaggaccgtggtgaagtcatcaaatgtgcccccgatatcaaaggcattcagtggatggagcacgacttctttcaaacccagcccgtgaaaggtgccaagtattactatctgcgagctattcttcacaactgggacgacaagaacacggtgcaaaatctcttcaacatttgtgcccgccatgtcagcggattccctggtggcgattgatgaaatggttgtgccacaagagaatgctcatgtatgggccggccggcctcgatcttcaaatgttttctttattcagtacaacggaacggacggcggtccaatgggatgccatccctggacaaacagggctcctgctgtggccgttaaaagtatgcgccggtattt

SEQ ID NO: 4469 - DNA, 605 bp, Aspergillus oryzae
  misc_feature (1)...(605): n = A,T,C or G
tagtatattaccaggatgctacaaggaattccagggccacagcaggtgctaagcgccttgacggggaccctgggactttcaagtctccttggacccggaattgaatcctcacagaacagctttcaacactgctctaaggctgaactgagctgcgcgactccgtatcatggccaggacaaatgctgcttcaactatcccggggggcagttccttcaatcgcagttttgggacgccgacccggccattggaccggaggattcctggactatccatggcttatggccagattactgtaatggaggttaccctcaattctgtgattcaaaaaggcggtatagcaacatctccctgattctgactgactcaggtagaggggaccttctggatgagatgcgaattttctggaaagactggaagggcgacgacccgaatctgtgggagcatgagtggaacaaacatggaacatgcattagtaccctagagactcactgctacgacatatactacccgcaacaggaaggggtggactatcttgataagacagtggacctttttcacggattgctacacacaagatccttggcggggctggaatggtcttcttn

SEQ ID NO: 4470 - DNA, 708 bp, Aspergillus oryzae
  misc_feature (1)...(708): n = A,T,C or G
tgaatagctttccgattcggacgaggcctactatacggtctcccaattccccaattcacgcttacgaccagacaaaatggcggtccgagaacctcagttcaaccaacaggtcctggtggacaccacgcccatgccggcggacattcccagtgtccaggaagtcggcgcgacctcggcacccctgactagtgcggcgtactttatcggcgacaggtgcaaggccttcaatgatgactacatgaagtgcaagcaggaggccaatggaaggggggagttcgattgtctgaaggagggacggaaggtgacgagatgtgctgcttctgttatcaaagatatcaacacccactgcctgaaacaattcaccgcgcactgggagtgtcttgagaacaacaaccaccatctgtgggagtgccggaagcccgagatggagctgaataagtgtgtctttgacaagctgggcctcaagaagacgatccccggcgcccccgagggccagaccccggttcatctgcgtcccaagcagatttatgctcagttccctggtcctcagtattaggttttggtttatgtctgtctggtctggtctggtttgtggactgtttgtatgtgtacatattancatangaatngagtgtcctggnttctcggtctanannnnnannnnnnnnnnnnnnnnnnnnnnnnaaaatcctggcggcgctcgagcat

SEQ ID NO: 4471 - DNA, 696 bp, Aspergillus oryzae
  misc_feature (1)...(696): n = A,T,C or G
ctttcttcttcacttacctcctccatcttcatccctatcctaaccaccacctaccattatgaccacagatagccccgaaacgactagagctgacgggacaaccgtccaggccgccccttcaccagaatctcactatagcacacacattgtcttgaccacctatcccgggcaaagcggtatagaccccgtgcccctgaactggggtgcaaaagatgccaaatcccgtggtccagtagtggtctcgcgcagcgggccattgctgaaacgacgcaatgcaatgggcgcccatggcggtagctacagcatctacaacgccctggccatcgctgcgggcgacctcccccctgacttccgtccggactttaagaacagtgaacccacctttaatttcccctggcagcccgcctgggccgacaaagacaagatcgtgtcaatggacccctacggtcacgatatcgtcaaccaattccgggatgagttgaacgccggntgggacattcggcctaccatggcggtgacccgcgctaatatganactggccgaaatcggggaggcagtgcgagacggacagcttgacgtggatggttcaatcgtggtagactcctcgggtgaaagtccggtgacgaaggtcgctgtccagccggtgtggtatctgcctggagttgcgggccgattcggggtttgggaacctatctt

SEQ ID NO: 4472 - DNA, 466 bp, Aspergillus oryzae
tactggaaacactaccgatgataaggatatccccatcaaggagggtcacgagctcaacatcaccactgatgagaagtacgctaatgctagcgacgaccagaacatgtacctggactataagaacattaccaatgtgatcgctcccggaaagctcatctatgtcgacgatggtatcctctccttccaggttctggaggtcgttgacgacaagaccctgcgcgtcaagtgtcttaacaatggcaacatgtcctctcgcacgggtgttaacctgccccgcaccgatgttgacttttctgccttttcgagaacgatatcagtgatctcaagttcggtgtcaagaccggcggcgacatgatctttgcctcggtcattcgtcggggagtgacatacgcactttctgacgtgtgggtgaaagggtaggagattcgatcatcgcagattgagaccaacaggtgtaacacttcac

SEQ ID NO: 4473 - DNA, 683 bp, Aspergillus oryzae
  misc_feature (1)...(683): n = A,T,C or G
ggctggtaagcggattgagcccatggttgaagatccaaatgccggcaccaacatcacacttcataaggactctgcctggaaggagtcatggcgcgacttcaaggactccaaccctatgatgcagaaactcttcgctttcaaggaaacatataacgagtctgagaatccattgatcagcactgcccgcagcatttccgaccgcgtggctggattctttgccgaaaatgaaactgcccaagtcattaagaagttccgtgaaatggatcccaactttcagatggaggaattcttgcgggaaatgcgtgaatatatccttcctgaggttttggacgcgtacgtcaagggagatgttgagacactcaagctttggctgtccgatgctcagttcagcgtctacgctgccctcgccaaacagtacacaactgccggcctaaaatccgatggtcgtatcctcgatgtccgtggcgttgaagtcatgaacgcccgtatgttggacccttgcgatattcccgtgttcgtggtgacctgccgttcacaggaagtacatgtgtacaaaaacgtgaagaaccgcgagcttgccgctggtatggaggataaggtccagctggtcacttatgccatncgtcttacaaagatccctgaaatgttaacaacccggagaccccgggtttgagaatgatcca

SEQ ID NO: 4474 - DNA, 729 bp, Aspergillus oryzae
ctgtcgaccttcgtcgcttccttcgccaattttctagtatccgacaccgtttacgtgatacacagccaagatgtctggaagaggtcgtggttcctcgggcaacaagctcaagatgtcgctcggtctgccttgcggcgccgtcatgaactgctgcgacaactccggtgcccgtaacctttacatcatctccgttaagggtaccggtgcccgcctcaaccgtctccccgccgctggtgtcggtgacatggtcatggccaccgtcaagaagggaaagcccgagctccgtaagaaggtcatgcccgccgttgtcgtccgtcagagcaagccctggagacgtcccgatggtatctacctctacttcgaggacaacgctggtgtcatcgtcaacgccaagggtgagatgaagggatccgccatcaccggccccgtcggaaaggaggctgctgagctctggcctcgtatcgcttccaactctggtgttgtcatgtaaacaaggagaaccgtcttggaaaatattaaaggaaatagttcgataccaagcaggggaatcaaatcaaattcgttttgggtgcaactatgaacgggaaacgaaaatcaggaacgaccgggtgataatactagaaccgcgagtttcgtcacttcaatttcctctatgacgtgtttctttttggctcttatatggcgactcggaatataaaaattcagaaaatgggggcgtccttctttaac

SEQ ID NO: 4475 - DNA, 767 bp, Aspergillus oryzae
  misc_feature (1)...(767): n = A,T,C or G
tggtgtctcgctcgtatacggacaatggtgggctctagacgtctgatctgccagtgtgatctgtcatggatgatagctcgggctgaacccgacagcagagccttcgaaacttgcctgcttgcgagcgaccggggtagagtcgtggtgcagacaagccaatgcggcttgtgcgagcacctctggttcgatagcctcgcgagtgaacagttcttcgcgatgcttttcaatgtatccagtttctacctccccggcgacaaaatcagggctcttgcagaccgtcttcaggaattcaatgttggtaattggccctgcgacttagtactcttgtaacgcagacgcaagcttgcggagagcctcctctcgcgtattgcctctcacgatcaatttggcaatcattggatcgtaatgagctgaaacttcatcgccggcgacgaagcctgcgtctattctgacgtcttctgagggggtaggagtgcgaacgtgcagcagtgtgccagaatcaggtatgaatccctgatcggggttctctgcatagattctcgcctctatggcatgtccacggctcgccatgtgagcttctacttcctcctgggtcaatggaagcttagcgccttcagccactttgagttgccagtagaccaggtcctggccagtgaccatctcagtcaccggatgctcaacctgaagtctagtgttcatttccatgaaaaagaattcccccgtatcgttatcaaagataaactcaacggtaccggcaccttcatagn

SEQ ID NO: 4476 - DNA, 644 bp, Aspergillus oryzae
caatgatcggatatggcgttcaacttcaactggtcgccgctgatggcggacgcgagtttctatactcgcgctcaagatctcttaactgccgctctgaataaatcgccgaaacctccgattatcgtcgacgatatcatcgtaaccgagctcaacctgggttccatcccgccagatctggaaatattagagattggtgatttggcggaggatcgatttcgaggcatctttaagatggcctacactggagatgccttcttgactctgaaaacgcgcgttcaggcgaaccctctcaatacctatcttctcacacgaccctcttttgcgtcgccgctacccttggctgcagcaactccactcacaattccccttcaaattacactatccgatttcaagttgtccggctttgtgattctcgtcttctcaaaacagagaggaattaccgtggttttccgaaatgatccgcttgaatctcttaaagtctcgtctacgatcgactcgatcccgatcgtacgcgacttcttgcagagggagatagaggctcaactgcgcatcttgtccatggacgaactgcccgctatcattgattgactatccctgcgactgtgtgttcatgactaccggccgggcaggatccacccgctcac

SEQ ID NO: 4477 - DNA, 655 bp, Aspergillus oryzae
cgaggcatctgtcaaacctctagtgaattccacatccccattccatctgtgttgtctttttgtcctcttctttccccacacctcttttctcttctcctatcaactcctttccaccaacttactctgtcttgtaatcttcctatctgtaccctatcttccagcatgacttctgagcgtgagaacaagacattcctcgcccgcctttgcgagcaggctgagcgctacgatgagatggtcacgtacatgaaggaagttgccaacattggaggcgagcttaccgtcgatgagcgtaaccttctttccgttgcctacaagaacgtggtcggcacccgccgtgcttcctggcgtatcatctcctccattgaacagaaggaggagtccaagggctctgagcaacacgtctcgatcatccgtgactaccgacagaagatcgaaaccgagctggagaaggtctgccaggatgttcttgacgttctggacgagtccctcattcccaaggccgagactggcgagtccaaggttttttactacaagatgaagggcgactaccaccgttatcttgctgaatttgcttctggcaacaagcgtaaggttgctgctactgctgcccacgaggcctacaagaacgccaccgacgttgcccagactgatctca

SEQ ID NO: 4478 - DNA, 997 bp, Aspergillus oryzae
  misc_feature (1)...(997): n = A,T,C or G
tggcccttatcctcagaagtcacattcatgcttctatcccgtcatgtgggcgactcttcaagagattagaacatttgaagcggcatgtgagaacccacacccaggaaagaccctacccttgtccttattgcaataaagcattctcgcgctctgacaaccttgcacaacaccgtcggatccatgaggctcaacaggacggccaacaaccactccatgtgcaagatgaagacctcgaaaatgaggacaacgaactcggttcgcaggatgagggatcgtctccttctgagtctattccaagtactgtggtgaatgtttccactgtcacgtcgatgccttctactatgaccctgccttccgccatgcctaccatgatggcacctcacatggttgctccgcaacttctacaacagcagatgtagaaggcatgagggaaagtatgactccagtggtccttttcccgattctcgtgaacattaataatgagtccgattttgccgaccatgataccccacggtggattttgatggtccgggttcggatatcttacatgctttagaatatctgtatataccatttggtgaatcatttaatccacccattaaagtcttcaactgtgactgggctgcgggactactacatcaaattattgagacatattgagggtgtctcctaatctgtgctctacaacctgccgccagggtctgaggatttcagtgcaggttcgccgattttcttctggtctactgnccggactgcgtaggattttggtgtgtgtacatgtgctactggacacacctacgctgcggttctataataaatcaacaaaatttttttcgccggattgtttttgttgggttgccatcccctatgttgggattggaaggactttccggatcatttttctttcctcaatgtggggattctggattggcagaaatcacaagggaacccccccgccggaataaaaaaaagccggtttttgttgtggaagaaaaaa

SEQ ID NO: 4479 - DNA, 670 bp, Aspergillus oryzae
cccctccaacccccattatcaacttcatccccatttacacaaccaccgccgtcgcaatcggtgtttgtcctattagaatttattcttgttttccaattctgttattcctctaatttcttgtattttcctcttacacgtcaccctcaccgacaacctcacgagacccgcccactctcagtgttccgcccctcctcatccacaaccatccgagcgtcctaccccttaacgcgttgtctggcatcactctaaatggacaacaatatggaaatcgataccgcgcggtcccccgagccccaccgcctgtcgccaacgtctgaccctgggtcgataccgacattggacggatggattgaaaatttgatgagctgcaagcaactagcggaggaagacgtgcggaggctgtgcgatcgggcaagagaggtgttgcaggaagaatccaatgtgcaaccagttaaatgcccagtgactgtgtgtggtgatatacacggccagttccacgacttaatggaactgttccgcatcggaggcccgaatccagacacaaactatctgttcatgggtgactatgtcgaccgtggttattactccgtagagaccgttaccctccttgttgccttaaaatccgttacccccagcgtatcaccatcctccgtggaaaccacgagtcccg

SEQ ID NO: 4480 - DNA, 671 bp, Aspergillus oryzae
ccgcggccacacaagactggtgctgaagcctcagaacaaggaggaagtgagccaggtgctgaagtattgtaatgacaagaaattggcggtggttccccagggtggcaacactggactggtgggaggttccgtgcccgtgttcgatgagattgtcatcaatacgtcgcgcatgaacaagatccgttccttcgacgagggctcgggagtcctggtcgctgatgcgggtgttatcctgaaggtggcggatcagtacctggcggagcggaaccacttgttccttctggatctgggcgccaagggttcatgccatattgaaggtaatgctgccacaaatgctggtggactgcgtctgcttcggtacggtagtcttcatggaaacatcctcggtgttgaggcggtgtggacatagggtactattgacatctctctctcgactctgcacaagaacaacaccgtttaccacctaaagcatttgtttattggcgcggagggcaccattggtgtcaataagtgggctttccatcctgtgccctcccccgcccgaaagcgaaaatggcgtcctttatggggtgaaaaaaacaaccaaacaaggtggctcccggcacacaaggaaggaaaacccccatttttttgaaatttttcttctttttcaagcttatgggcgcggccga

SEQ ID NO: 4481 - DNA, 645 bp, Aspergillus oryzae
  misc_feature (1)...(645): n = A,T,C or G
ccggcacatctcttccctttcacttcaacccaatcactattgaatcctgacagcatggctgacgctttgaaggcagagggcaacaaggccttctctgcaaaggactatcctaccgctattgacaaattcacccaggctatcgcgatcgaacccgagaaccacatcctttactccaaccgttctgcagtatactctgctcaatccgaatacgagaaagctcttgaagatgccaacaaggccacggaaatcaagccagattggtctaaaggctggcagcgtaagggagctgcctatcgcggtcttggagaccttctggctgctcacgatgcgtacgaagaggccctcaaaatcgaacccggaaacgagcaggctaagtccggtatgaatgccgtcaagagggctattgatgccgaagctcaggctgatggtgtcactggtgaccctctgggcggacttggtggtattttcaacgaccctcaacttttccagaagctggccagcaacccaaagacctctggtctcttggcagatagcgaaattatggctaaagtgcaacgcatcaagcagaacccgaatagtgtcngtgaagagatcaaggatccccgctttttgccagtcatgagtgttctgctgggtattgacacc

SEQ ID NO: 4482 - DNA, 693 bp, Aspergillus oryzae
cttatgccgttgccatatcacgccggaccgccttattccaagctgtgtataagttctttggcaatctaagtaatagaagttctcgaaacgagaatgtctgccacaaaagcctcgaggatcggtgaagagctatggaaaacgagggttgacaaagtcaatgcggagttagtcacattgacttatggtacaattgttgcacaattatgtcaggactatgattcaaattatcaggaagtcaacaaacagctggacaagatgggctacaatattggtatgcgacttatcgaagacttcctggcgaagtcaggcgtcggccgatgttccaactttcgggaaacagcagacatgatcgcaaaagtcgggttcaagatctttcttaacatctcgcctactgtaacgaattggaccagcgataataaccagttttctcttgtgttcgaccagaatccgctagcccgatttgtcgagctgccagatgatggtagggcgcaagatgagttgtgggtctctaatatcttgtgtggtgtcctgcggggtgctttgagatgggtcaaatgcaagtcaaagcgcattttttaaccaatgtgttgcgggtgacgatactactgagatgccggtatttttgggtgagaatatttggagaagaattcccaccggaggaggatttactaagtctttgcgaccaaaaaggct

SEQ ID NO: 4483 - DNA, 900 bp, Aspergillus oryzae
ctttcaaccttctaatatgtcttccttttcccctctctcctcctactcaatctccttcctcctctctgcctctttcctgcttgcatctctggttttcccttgtcattcactccaaccaaaaccctcaccatgtctgacgaacagcacgtattcgatgatatccagggtaccgattccggtgcctctgccaccttccccatgcagtgctctgcattgaggaagaacggtcacgttgtcatcaagggccgcccttgcaagatcgtcgacatgtccacctccaagaccggaaagcacggtcacgctaaggttcaccttgtcgctctcgacatcttcaccggcaagaagcttgaagatctgtccccctccacccacaacatggacgttcccttcgtcaagcgtaccgaataccagcttattgatgtcaccgatgatggcttcctgtccctgatggacgacaatggtggcaccaaggacgacgtcaagctccccgatggcgagcttggtgagaagatcaaccgcatgttcaccgaggagggcaaggactgcaacgttattatcctcactgctatgggtgaggagtgcgctatggatgtcaaggaagcccccaagggtgcttaaataaccatagtcatggactctatttgtgctccttgggtccctgtgtgttccagggtatccttgaagtttgcaccttcgattgtgaaggatgtcacgttttggagatccgacctggctcttatattgaccacttagccttggagaaggttgcgtttagttggcagcgtaaagcatgctttgtcatgacgggaaccggtctgagtctagctttcacgatattttgacgaattccaaaaatttcagtggctctacctaatatgcaagagctcttctttcttgccc

SEQ ID NO: 4484 - DNA, 1020 bp, Aspergillus oryzae
actgcaacaattttgaaaccctttatatactattaggagaaatcaacatgggaaccaacctctgatactcttttatcccaatggggcacgaggggctgagaagacactggcttttctggcaaggtcaccaatgccgcccagaaggctggcaagaaataagctggttaatatgtgcggggatgcaattatgaaccttttatgagcacaaaaatatggaattctcatgaaatcatgattccatcgacaaccatcgacttttatctattttcatctcaaagtcgactaaatccatcaaaccttatctctaaagatggccagaactaagcagactgcccgtaagtccactggtggcaaggcccctcgtaagcagctcgcctccaaggccgcccgtaaggctgctccctctaccggaggtgtcaagaagcctcaccgttacaagcctggtaccgtcgctctccgtgagatccgtcgctaccagaagtccaccgagcttctgatccgcaagctccccttccagcgtctggtccgtgaaatcgcccaggatttcaagtccgacctccgtttccagtcctccgccatcggtgctctccaggagtccgttgaggcctacctcgtctctcttttcgaggacaccaacctctgcgccatccacgccaagcgtgttaccatccagtccaaggacatccagctcgcccgccgtctccgtggtgagcgctcttagattattctctaatgagtccggtttttctggttgtctctgggtaggcgattaggggttttatttctttttcacgactggcgatacatgatgggttcttttttttcatttgcgaatatcaatgggtttcggcactgggattagttttcgttttgctgcgcaataaatagtaggctgccgacgacgcggctgagtggattggatctcatgggatgcatccgagcatgtacattaagaaattttacttgaccaagtggtattctctatgaattgccaccggatggcatagattcgaaatgcag

SEQ ID NO: 4485 - DNA, 736 bp, Aspergillus oryzae
  misc_feature (1)...(736): n = A,T,C or G
cggcgccgtgattgtctctactcctatagggcgaattcgagctcagtacccgcggatgctgtacgaactactcgtatagccttgagttcaaccaggttattattttcgtcaagagcacactccgtgcaaatgagctggacaagcttttgcgcgagtgtaacttccccagtatcgcagtccactctggtgtgagccaggaggagcgtatcaaacgctacaaagaattcaaggagttcaacaagcgtatctgtgttgctactgatgtcttcggacgtggtatcgatatcgagcgtattaaccttgctattaactacgacttgcctgcggatgctgactcgtacctgcaccgcgttggtcgtgccggtcgtttcggtaccaagggtctctcgatctcgttcgtcagcaacgaggaggacgagaaggtccttaaggatattgagaagcgtttcgaagttgctcttcctgaataccccgagggtggtgttgactccagcacgtacatggcataaatggccggactgtcaatacagcgtggctggtgcgattcgatattttgtcattttctaacttgagatccctttttctttacttttgttgatcttttgggcgcgatggttcgggtgtgatttttgtttccggtaaagtgtcttttgcaagcttcttcgtgagggcactggtcggcaggattggaaaaggatgggggaaaagcttacacaggcatgtgttaatcactagn

SEQ ID NO: 4486 - DNA, 761 bp, Aspergillus oryzae
ttatagcctgtcgattcgcacgaggatcgcccacgacagcgacaagaccaaacaacaatgacagaccatccagatcaaccgttcacaggccaggagtatgctctagatgacattgtaaaactcatcaaaactggaaaggcaacccgtattgtcgttctagcaggggcaggaatctccacagcagctggagtgcccgacttcagatcaccagcaacaggcctctacgacaaactggcgccattaaaacttcccttcccggaagccatcttccacatcaactatttccgacacacgccagaaccattctacgcgatagcgagagcccgcaatcccaaaaacctccaaccaacaatttcgcacgcatttctggccttgctggctaagaagaacctgctggattttgtgttcacgcagaacatcgatggccttgagctggatgccggtgtccccgccgagaaagtactttcctgtcatgggaactggaagagtcagcgatgtcataaatgcaagacaccatacccggatggacctatggctgaggcaattgagacagggcaggtgccgtactgccaggtcccagattgtggtggcgcggtcaaaccggatgttgttttctttggggaacctcttcccgccgcctttgaagttgaggagaagagggtatttggcgcagacttgatgattgttatggggacaagtctcaaggtggcgccatgtgcaagactttcccgtcaggtgaaagagggaacacccagattgct

SEQ ID NO: 4487 - DNA, 922 bp, Aspergillus oryzae
tcacttccttccctcgttacatacctctttggatactttttttttttttatttcccgcaattccattccacggctcagtgtttcagccgtcagtcactcgttgtagtatatatactcttctagactttctcaatccactccgcgattgttatttcattaattcgacctgatatcactgggtctgcagatcaagttgatcaatccctcgttgtcttccgctgcagatcattaactgtcgtcgctgcggctggtatacgtttgaacgactgtcaatagattctcatcatgaaggccgcatttgctcttgccggggcttcgctcgtgggcagcgtcctggcgaccttgcctgccatcgagtcgaaggggaacaaactcttctattccaacaatggcactgaattcttcatccgtggtgttgcctatcagcaggaatattcttccaatggcaccagcagctccagcacaggctacggtaacgaatccaacggcgactacaccgaccctctgtccgaccccaagaagtgcgagcgtgatatcccttacctgaaggaactgcggaccaacgtcatccgtacctatgccgttgaccccaaggccgaccacactgagtgcatgaagatgcttgacgacgccggcatctaccttatcaccgatctgtcctccccttcggagtcgatcaaccgtaacgaccccaagtgggacgtggacctgtactcccgctacactagcgttgtcgatgccttcgccaactacaccaatgttattggtttctttgccggtaacgaggtcgccaacgacaagaacaataccaactctattgcattcgtcaagggcgctgttcgtgacatgaagaagtatatcaaggccaagaagtaccgtgaatccctgctcatcggttacgccaccgacgatgacgctagca

SEQ ID NO: 4488 - DNA, 617 bp, Aspergillus oryzae
caccaagtgtgctttcactgaggatgtcatgaagcgtttcgagtcctatggctggcaccacgtctgggtcaaggacggtgacaatgaccttgaggccattgagaaggccatccaggagtgccgtgaggttaaggacaagccctccgttatccgtttgaccaccaccatcggtttcggttccaagctgcagggcaccggtggcgttcacggtaaccccctgaaggctgacgatgccgagagtgttaaggccaagttcggcttcgaccccaagcagagcttcgtcgtcccccagcaggtctacgacctctaccacaagactgcttctcagggtgctgctaaggagcaggagtggaaccagctcttcgagaagtacgcctctgagtacaaggatgagcacgctgacctcactcgtcgtcttgctggcaagcttcctgagggttgggagaagagcctgcccacctacaagcccaccgaccccgctgtcgcctcccgtaagctgtccgaggccgtccttgagaaggtccacagtgtcatccccgagctgctttccggctctgctgatctgactggctccaacaacacccgctggaagaacgccgtcgactttcagccccctg

SEQ ID NO: 4489 - DNA, 1026 bp, Aspergillus oryzae
gcttggacacgtcctttgtctccaagaacgattctaagggcaaaggaactgaaaccaagaaggcggactccgctgagctgctgaatcctaccgcggtatcggggtcttcgtcgcagaaggcaaccgctgatgaagaggaagaggatccggaaaacatgaaggctagtgacctggccaagaggctcgcaaagatcaaccgtaacgactaccgtgccttgcttcagttcatttctgaacatccagaaatcgtcgcagagaaggaaacggatggtttgctagtcgaagcattcaatagccaaatggaaggtaaagaggactatgctcgtacatgcgttcaccacggcctgctgctgcagtattgccgctccttgggccgtgatggtatttctctcttctttaagcgtatcacgacgaaagatcatcaagcatcgacgcttttccgaaacgatgtcaatgaaacctacaacaagatcaagacccgtgcagcagaactcgctaaggatggctctgcatccaatgaccctgctggtgttgagcagatccagcttcatgcggttgatcccaacactaagatcaccatcaacattcctgctgcagagagcagcgaacctgtcgaagtcgaagcacgcaagatctttgaatcattttcgaaggaattgcaacaggcattgagctctgaatctctagatgaggtcaataaggttctcggcaagatgagtgtcgaggaggcagaagatgttgtggagaagcttggtgaaagcggtatgctcagcctcgaggaaggtattgtggatgccaccacagaagaaggtcggaagaagttggaagagatcgaagccgaaagtaaaagggagaataggattgaggaagtgggagagccaggcggtgacattactgaacttgactaaagctctatacgggagactggtcgacttcaatgacgtgtatatctttctgcatggttcaaaaatgatgcattgtctaaaaaaaaaaaaaaaacaaaaaaaaaaaaaaaaaaaaattcct

SEQ ID NO: 4490 - DNA, 828 bp, Aspergillus oryzae
ggttcttggtgtggagtgccaaaccaagggaaaaaaggattgttatttcggacacctcaccgtcgtcgccgacggctacgcctccaagttccgaaaacaataccacaccaatactccaacggtcaagtcccggttctgggctctcgagctaattgacacgaaacttcctgcacctaaccacggacacgtcctcttaagtgcaaatcccccgatcctcctgtaccagattggcacccacgagacccgtatcttggtcgacatcccagagaacctcccatctgcgtcagtcaagaatggtggtgtcaagaatcacctatggaacgtgaccctaccatctctgcccgagtctgtccagccagcctttcgcgccgcgctggaaaagggcccgttgaggtctatgccgaactcattccttcccgccgcccagaacaaaactccggggcttgtaatactgggcgatgcgctgaacatgcggcatccgttgaccggtggcggcatgactgtggctttcaatgatgtacttgtgttccgggatctgttgagtcccgaaaaggttcccgattttgcagacaccgaaagggtgttgaagcagctgaagtccttccactggaagcgaaaaaaacggatcctctgtcatcaatatattggccatgggcgttgtacgcccttttctctgcgaatgatgaaaacctccgcgtcctccagcgaggctgcttccactacttcgatatgggcatgtactccgagccaatgggtcttttgggcggccttatcaaaaagccctttggactattctaccatttcttcactgtcgcattcatctctctt

SEQ ID NO: 4491 - DNA, 764 bp, Aspergillus oryzae
  misc_feature (1)...(764): n = A,T,C or G
ggtggctatacactattatacggaggcttgactgcggaggcaaatctgctagtgctcgtatcatagcaggtttatggccggtttatcgtgggttagtcagtcgaccaatgggattcggactggatggaattatgttccttccacaacgaccctacctcagtgtgggtactctgcgtgaccaagtcatctaccctcacacggaggtcgacatgcgcaagggaggtatatcagacgcatgtctacaaaagatcttggatgacgcccacttaggttacctccctacccgcgagggtggatgggactcccgcaaggagtggaaggatgtcctgagcggtggtgagaagcaaagaatggctatggcacgtctatactaccatgagccccgttacgccttcctcgacgaaggaacctctgcggtctcctccgatgttgagggcttgctgtacgagcgggccaaagagcgcggaattacactcatcacgatctctacgcgtgcgtctctcaagaagtatcacacttacaacctcacccttggtcttggctccgaaggcgaacagtgggagtttgagcggattggcaccgccaaggagaagatgaatgttgagaaagagctgcaagaacttcgtaagcggctggataaggtcgatgaatggaaacaacgccgagaggagatcgagaacgaactacgtaaggtttgggttgaggaaggagagctggccccgccaccatatactgaacagccgganacagctganagctcacgg

SEQ ID NO: 4492 - DNA, 699 bp, Aspergillus oryzae
  misc_feature (1)...(699): n = A,T,C or G
cactttcggtcctttgggacacatactacttcccctttttttcatatcagatttgacatctgatattgcatcgagtggaaatctatcgcggttagcgattttccgtcatgcccaagaataagggaaagggcggtaagaaccgtcgtcgtggaaagaacgagagcgacaaagagaagcgtgaactcgtgttcaaggaagaaggccaggagtatgcccaggttgtgaagatgcttggtaacggccgtctcgaggcgctttgcttcgacggggagaagcgtctggcgcacattcgtggcaagctcaggaagaaggtctggatcaaccagggtgatattatccttctctctctccgtgattaccaggacgaaaagggcgacgttctcctgaagtacaccgccgatgaggccagaagtctcaaggcctacggcgagctggccgaacacgccaagatcaacgagaccgatacctacggccaggaagggcttcgaggacaacgtcgagttcgacgaagaccgcgaaagcgaagacgagaaggagatcgatgtcgacgagctctacaaaccttcatcccgttggattcatccctgcgagagctactggagatactggtngncacgccctctattctctttcttataggcaaactattttctttctgggaaatccgacaagcttccttctgtgagggctctttttgcg

SEQ ID NO: 4493 - DNA, 650 bp, Aspergillus oryzae
  misc_feature (1)...(650): n = A,T,C or G
tatcctgtcgccgctctttttacggacatatcagtgataaaaaaatggcaccacagctggaaccatttttcaaacaggttgacggccttgccgaatctttcatcgagcgtctgcgaaaggctgttgcgatcccttctgtttctgcacaggatgagaacagaaaagacgttttcagaatggctcagtttctggcctcggagttggaggctcttggcgctgaggtgcatcaaaggccgctgggaaaacaacctgggaaggaacaccttgacctacccccagttgtcatcgctcggtatggcaatgataaaaacaagcgaaccatactggtttacggccattatgatgtccagccagcattgaaggaagacggatgggccaccgagccttttcaattgacggttgacaaccaaggaaggatgtacggccgtggaagtacagacgacaaaggtcccgtcttgggatggttgaacgtgatcgaagcccacaggaaagctggtgttgagctgccagtcaaccttctttgctgctttgagggcatggangagtatggctcgaangggttgaggaatttattcaagctgagagcaaaggctttttcaggatgcggatgccgtctgcatatcagataattattggcttggaacagagaa

SEQ ID NO: 4494 - DNA, 673 bp, Aspergillus oryzae
cccccgcgtgtacgctgggccctatgatggagcgtgaagattccagggatgtactggtcatcaagcaagggctaccgaacatgtctttatccgatttgcctgcaggatctgtcgttggcacctcctccatccgccgtactgctcaattagccttgaaataccctcacctaaaggttattgatgtgcgtgggaatatcggcacacgactcgctaaactagacgcggaagattcaccttatacttgcattatcctggcagctgccggcttactgagactaggtctcgatgatcgcatctcgcagtacctggactcgaaaaacggtgggatgctttatgcagttggccagggtgcgttgggcatcgaaatccgaaaggatgatcaggtgatgcgtgatatgctgaacaatatcggtcataatgagacgacatttgccagcaccgcggagcggagcctgctacgaactcttgaaggcggctgcagtgcaccacttggagttgaaaccgaatggattaaatcatctgatggttcgaagaagctccgaatgaggtccatcgtggtcagcgtggatggtaaggaaagcgctgaggtcgaaatcgatggaagtgtcgactccgttcaagccgctgaggactttggcgtgactgttgccaaggaattagtaaccaagggagc

SEQ ID NO: 4495 - DNA, 748 bp, Aspergillus oryzae
gtattgagatggattcaagttcagcacgaggaatcgcaaccatgcagatgtaggtttccctcgtactccgcacccatattgaacctttaaacccgccgatgcgacccagaaccggctgcgattgatatgaaatgaacgatgacgggggaaacgttgctgacaagattccgatgatagtttcgtcaagaccctcacgggtaagaccattaccctcgacgttgagtcgagcgacaccatcgacaacgtcaaggccaagatccaggacaaggagggtatcccccccgaccagcagcgtctgatcttcgccggtaagcagcttgaggatggccgcaccctgagcgactacaacatccagaaggagtccactctccacctcgtcctccgtctccgtggtggtatcatcgagccttcccttaaggccctcgcctccaagtacaactgcgagaagaacatctgccgcaagtgctacgcccgccttccccctcgtgccaccaactgccgtaagaagaagtgcggtcacaccaaccagctccgccccaagaagaagctcaaataaacgattcgccctatctatcttgttacggtttttctacgttgctgtggtggagacttgctgggggttatgagtcgattgcagtctgggaggttttgtacggcgttagaatgatgaaacattacagccaaagtcaaatgttattagttgactccctctcggatcaagttgcaatcaaaagaattgtaaaaattc

SEQ ID NO: 4496 - DNA, 676 bp, Aspergillus oryzae
  misc_feature (1)...(676): n = A,T,C or G
gaggaggaggattcagaagactactgcaagggcggctatcacccggttacggtcggcgaaacgtataacaacggtcgctatgtcgtcgtgcgcaagttgggctggggccatttctccaccgtctggttgtcccgcgataccaccaccggtaaacacgtcgccctcaaagtcgttcgttccgccgctcactacaccgaaaccgccatcgacgagattaagctcctgaatcgcattgtacaagcgaagccgtcgcacccgggtcgcaagcatgtcgtcagtctcctcgactctttcgaacacaaaggtcccaatggggtccatgtatgtatggtatttgaggtattgggtgagaatctactcggtttgattaagcgatggaatcatcgcggcatcccgatgccgctggtaaaacagattacgaaacaggtcctcctggggttggactatctccaccgcgaatgcggtatcattcacaccgatctgaaaccggagaacgtattgatcgagatcggcgatgtggaacagattgtgaagacatacgtgaaggaggagcagaagaaagaccacaaagaggataaccgcaatggccggcggcggcgcaggaccctaatcacggngagtcaaccgttgcccagtccgctcaacaccacctttgatttcaaacacagcttggacc

SEQ ID NO: 4497 - DNA, 648 bp, Aspergillus oryzae
  misc_feature (1)...(648): n = A,T,C or G
gacatataccttatttgatcgcacttcctcctctatatacccccagtccgtacctctattaattatcctcccacaaaatgggtgtccagaagaaaacccgcaagttcgcccaggttaaacgagccatcaaaaagcacgatgaccgcgccaaaaaagacaacaacgccccgaaacaagacaaggccaagggcgacgaggtagtccgggcgattccccaggctccgtcgaatatgttcttcgccgccaacacggccctcggacctccttaccatgtgctggtggataccaactttgtctcccactctattcgcgcgaagacggatatgctgaagtctatgatggacctgttatatgcgaagtgtatcccgacgtttacggattgtactattgcggaattggaaaagttgggtgataagttccggttggcgttgagggtggctaaagatccgagatgggcgcgcgtgcggtgtgatcaccccggtacctatgctgatgactgtttanttgatccgaatacaaaacacaaaatctactttgggcgacgaacgataaggacctgtttcgccgtattcgcaagattccggtgtgccgatcatgaaggtcgcaagagcgaaatacgtcattggaagattgcccgacaccttgagn

SEQ ID NO: 4498 - DNA, 744 bp, Aspergillus oryzae
caacagtcgacaaaaatggggcgtctcaccgagtaccaggtcatcgggcgtcatctgcccaccgaggctaaccccacgcccaagctttaccgcatgcgcatctttgcgcctaacactgtcgtggccaagtcccggttctggtacttcttgacccagctccgtaaggtcaagaaggccaacggtgagatcgtcagcctcaatgtcatccccgagaagcgtcacctgaaggtcaagaacttcggtatctggatccgctacgactctcgctccggtacccacaacatgtacaaggagttccgtgagatgagccgtaccgaggctgttgaggctctctaccaggacatggctgcccgccaccgtgcccgtttcggctccatccacatcctcaaggttgttgaggtcgacaacgccgactccatccgccgcccctacatcaagcagctcctccagaaggacctcaagttccctctgcctcaccgtgccgccaagtccgagggcaagaagatcttcgcttactctcgtcctgctaccttcgcttaaatgtgaaattttgggtgtttggggaaggagtgtgcggatgaaatgactatgttatggccatagcatgcatgcaggacagagcacgcagagaacatggcgtgtatctacaacccagataatgggagaaatggttttgatgtctcactagtcctctgcagcgacctttctagttaaatctcttaaaaataccgggtttgtcttctg

SEQ ID NO: 4499 - DNA, 629 bp, Aspergillus oryzae
  misc_feature (1)...(629): n = A,T,C or G
gaagcgctggagtctgcttgtctgacccccaaatccggcacttgtattttggctcttcttccagaatccaccgaagctgacgccgacatccccagctccgccaaggaggccgttgtcagtttatccgagatcgtacataagcacgcggtgcgccaggcgcacctcttcccgttctacagtatcccagctattaacagcggggccgcaactctgcgtgctggtctcggtcttcctgaagatagcaagtcagtggagatcatcgcgttgaacggacgcagaggctggtggcggaggtacgacccatcggacaacgcggactacagtttggcccgtgttgagtcctgngtggacgctattcgcttgggcgaaggttctaagagcaagcttcctgaaggggtcatcgtcactgaggtcgagcctgaggcggagcctgagaaaccaaccgccgatcacgacgagctgtaagtcaaagctgttaacagctggatctaggccgtagctagagttggtggacgtctacactcctttcttagcagatggccgtttatttcaagtagcttggagcggaggcgttacgggtagtcaatcaataggatgtagcttttcaacagatataagttgattccaan

SEQ ID NO: 4500 - DNA, 870 bp, Aspergillus oryzae
  misc_feature (1)...(870): n = A,T,C or G
gcgttaactacccacccggaagttcgcagggttagaggtatatatgacgaatttgtgaagcgtttcgttgaaaaggtcaaaggcttcaaggtcggggcaggattcgaggaaggtgttacccatggccctgtcatccatggacgcgccatcgagaagatcgatgagcatgtccgtgatgccgaatcgaagggagccaaggtcgctgttggaggccgtaaattgtcagacttgggccctaacttctatgatatgactgtcttgaccgacatgaacaaagacatgttggttgcctctgaggagacctttggccctgtggctggactgttcccattcgagactgaaaaggaggttgtcgacttggcgaaccgtgcagaagttggcctggctggttacttcttcagcggcaacgtcaagcgcatcttccgggttgcggaagctttggaagtgggtatggttggtgtgaacactggcctcatcagcgatgtcgcttctccgtttggtggtgtcaagcagagcggtttcggccgtgagggcagtaagtacggcattgatgaattcctcacgatcaagagtgtcacatttggcggcatgggcgagcctttgcagtcctaaagggatatatatgacanaatatgtaaatcgagttgtgaactctcgcctttatgcgcataatccaccgacgctgaaagaggctcancttgtgcactagaattgcacaacacgcccttgggtggtcttatagattagaaccncggnaagcgcatagtcccactgggtctttgttataattatgacgaacctgggaacgacatgagaagaaatgcttagctctaatatacatacaaccaataccagcgcccgtttcccatc

SEQ ID NO: 4501 - DNA, 388 bp, Aspergillus oryzae
caactccttctcccatgaaaacactgaagtggtcatggtgaacgatccttttatcgaggttcaatacgcggcatacatgctcaagtacgattctacccacggcaactttgaatatgatgttcacattgacggtgactccattgttgtcaacggcaagaaggtcaagttctacgcggaaaaggatcctgccaaaattccatggaaggatgctggagcggaatatattatcgagtcgaccggcgtgttcactactgtggaaaaggcaagtgctcaccttcaaggtggcgccaagaaggtcattatctctgccccttctgccgacgcacccatgtacgtcatgggggtgaatgagaagacttatgcaggggccgatgtggtgtcgaatgcc

SEQ ID NO: 4502 - DNA, 734 bp, Aspergillus oryzae
  misc_feature (1)...(734): n = A,T,C or G
cgagggccaagtacgcgacaacctcccccttccccctgactcttcattctctgacccatagttccagagaaaagccgtcaagatggtcaagaagagggcgaacaacggtcgtaacaagaacggccgcggccacaccaagcccgtgcgctgctccaactgcgctcgctgcgtccccaaggacaaggccatcaagagattcactatccgcaacatggttgagtccgctgccatccgtgatatctctgacgcctccgtcttcaccgactatgccgtccccaagatgtacctcaagctgcagtactgcgtctcctgcgctatccacggcaagattgttcgtgtccgttcccgggaaggtcgtcgcaaccgtgcccctcctcctcgcatcaggtacaacaaggacggcaagaagctgaacccccctcaggccgctaaggctatgtaaggaagggaaacagaagagaaaattgggattagtttaaaaggcttggtcttttcttgtttctttattgaacagactttcttactcggttcaaatggaatgaatgggtttcagttttggggtcgaaggcttgcattacgggttgcccgtgggcaggagacgccaaataaacaaaacaaaatctaaacatttactgttcacaaaaggtaaacgaacataagccagtggagacgggaaccggatgcacccaattgggtcgggccagggctttcatgattncattgtatggcgacct

SEQ ID NO: 4503 - DNA, 1258 bp, Aspergillus oryzae
ccaaaatgtcgtcccaagcccctcaccccaccttgttgattcccggacccatcgaattcgatgatgctgtcctccagtctatggcccactatgccgagagccacgttgctcctggctttgtcaagaccttcggagagacattgaccttggtgcgcaagctcttccagtccaccaaccccgccgcccagcccttcgtcatctccggtagcggtacccttggctgggatgtcgtcgcctccagcttggtcgagaagggagagaatgccctcgtcctgcacaccggctacttcgccgattccttcgccacatgcttgcaaacctacggtgcgaacgcaacacagctcaaggcacccatcggagagcgcccctcgttcgaggagattgagcaggccctgaaggagaagccctacaagatcatcaccatcacccacgtcgacacctcgaccggtgtgctcagtgacatcaagcgcatcgccgagatcgtccgccgcgtcagccccaacaccctggtggtcgtggacggtgtctgcagtgtcggctgcgaggagatcgcctttgatgaatgggatcttgacgttgtcctgactgccagccagaaggccatcggttgcccccccgggcctcagcatcctgatgacctccccccgcgccatcgacgtcttcaagaaccgccagtccccccccgcttcatactactcctccatcggcaactggctccccatcatgcagaactacgagaacttcaagccctcctacttcgctaccccacccacccagctggtccacgccctgcacaccaccctgtcccagatcacctcccggcccatggctgagcgcttcgccgtgcacgcccaggcctcggaccgtgtcaaggctgctgtcgccgagctcggcttgaagcagctggccgcgaagccagagaaccaggcccacgccatgacggccatctggctgcccgagggtctggccccacccgacgtgctccccgggctgctgaagcggggcgtcatctttgcagcgggtctgcacaaggaggctgcgaccaagtacatccggttcggacacatgggcgtcagtgtctccgatcctgcccgcaaggacattgacaacgctattgccgctctgaaggaggccatggccgaagccaagcaggccaagggactgtaaatgatgataccttccatgtttcacgaacttaagtagaaatgaaaataaaaaataaaaaaattaatatttcatgttaagaaaaaaaaaaaaa

SEQ ID NO: 4504 - DNA, 678 bp, Aspergillus oryzae
cgtattgcctgcttttgcttgcaggccaatttgggagaccatggctttccggcgtcctttgatgctgtccaagacagcatcagcgcctttttcctcccttgctggcagaactgcccgagtggccgcgactctgccccggttcaccacagctagagcctcttccagctcgacctccgccctcgcctacaaggcgctccatcgtcgctctccccttcctcttcctgtgtcggactcttctccgcaatgggatgctccgactgccgtctcgtcgattctgtatgagactcccgttgcgccgaccaaccccccgaaacgccatatcctgaactgtctggtgcagaatgagcctggtgttctttctcgtgtttctggaattttggccgcccgtggcttcaacattgacagtctggtcgtgtgtaacaccgaagtcgaagatctgtcccgcatgaccatcgtgctgcagggtcaggatggtgtcgtcgagcaggcccgacgccagctcgacgacctcgttcccgtctgggccgtcctcgactacacagactctgctctcgtgcagcgcgagttgcttcttgcgaaagtcagcatcctgggccctgagttcttcgaggaattgcttcagcaccaccgcgagatcaccacccccggggagaccctggacggccagaatgataatgg

SEQ ID NO: 4505 - DNA, 763 bp, Aspergillus oryzae
aaagttctgtctacctcccattcttttccaccttctcctctcaccagagaaaatcataccaaatccaccatcacaatggcctcctctcgtatctttgcctctcgcctggcctcccagatggccgcaaccaccaaggttgcccgcccggccgctcgcttcgctgcccccaagcgtaccttcaccacccagcgcaagaccgctatccccatgacccccttccagaccgtcaagcgccagcagccttccatgatccaggccaacgctcgccaggtcttcgccaacgtccaggcccgccgccagtactcctctgagatcgccgacgccatggtccaggtctcccagaacatgggtatgggttccgccgccattggtctcggtggtgccggtatcggtatcggtctcgtcttcggtgccctcctcctcggtgtctcccgcaaccctgccctccgtggccagctcttctcctacgccattctgggtttcgccttcgtcgaggccattggtctgttcgacctgatggttgctatgatgtgcaagtacgtttaaacggatcgttgaaacaacaacaccaattatccgaaagggcaatatgagggcaaatgcaatttccttgaatttctcaaactggtcaaattgaatggaaaggtcttcgatcggattctcgccgttcagttaggaggtaatcttgtggtggtctttttatatatcatgtactactttcccggcatcatctatcatcccaatacactgtacatatagagtt

SEQ ID NO: 4506 - DNA, 656 bp, Aspergillus oryzae
gtcagtcatccttgaaacccctcggagcccgtaaaaatgaagattctttatatcggagtcctacagaatgcccagcagccggcggtggagctgtgtgcggagcgcgagctcagcagctactcgcgcttcaccaggggtagcatcagcgagttcatgaccatgttcagcaagacggtcgccgaaagaacaaagcaaggccagagacaagatatccaagagcaagatttcacattccacgtgtatgcgcggacccaaggcatcgccggtgtcattatcagcgacaatgaatacccctctcttgccgcccatcagatcctttccaaggtccttgatgagttcctcacgctcaaccccaacgcaggcaccgccacccagcctgtctccttcccctccttgaagacatacatctcggcgtaccaggacccacaccaagtggacagtatcatgaagattcagaaggagctggacgagaccaagattgttctccacaagactatcgagagcgtcttggagcgtggagagaagattgacgatctggttaataagagtgaggggttgtcttcgcaatcgaagatgttctacacctctgcgaagaagcagaatagctggtgcattcttatgtaagagagatcccaccggagcggggaatacaacct

SEQ ID NO: 4507 - DNA, 612 bp, Aspergillus oryzae
  misc_feature (1)...(612): n = A,T,C or G
cgattccgacagaccttcaagctccttctcgagtgatctcgacgcatttcatgaacccagttcctatacagaagggcgtcgagattatctctggtttgcaaacgtctcaagagacgatcgataccgctatcgcgtttgtgcagcgtatgggcaagattgcttctgtctccgctgactcgcccggtttccttgctaatcgtatacttatgccttacatcaacgaggcaatcatctgtcttgagactggagttggtgcccgcgaggatattgacaatatcatgaagaatggaactaacgttcctatgggacctttgactttggccgatttcattggacttgacacctgtttggctatcatgaatgttttgcatcaggaaactggagatagcaaataccggccatccggacttttgaagagaatggttgatgccggttggatgggcaagaagactggaaagggcttctacgaatactgattgagggtttgatccttgctcactagttacgtcctgatatccctgttacactgctataaaaatagattactatatcaacaatttatggaccnnnnnnnnnnnnnnnnnnnnnnnnnnnnnnnnnnnnaaatttcct

SEQ ID NO: 4508 - DNA, 847 bp, Aspergillus oryzae
cgttcaaggcagtacactggtataagcgtgctgcatccttgggtgatccaccagcaatgtacaagatgggaatgattatgctcaaggggcttctcggccaagcaaagaaccctcgcgagggtgtctcatggctgaagcgtgccgcagaacgtgccgatgccgaaaacccacacgcactacatgaacttgcgctcatgtatgccaatgcaggcccgaatgacatcgttatccgtgatgaggcgtatgctagtcaactattccaccaagctgcagaattggggtataagttctcccagttccaattagccactgcatacgagtatgggttgatggggtgccctgtggaccctcggcagagtatcttttggtatactcatgcggcagcgcagggcgagcatcaaagtgaacttgccttgagcggatggtatctgactggcgcggaggggattctgcagcagagcgacacagaagcctacctctgggcacgcaaggccgccacttcctgtcttgcaaaggcagaatatgcaatgggttattataccgaagttggaatcggggtcaccgccaatatggaggatgctaagcgatggtattggcgggcagctgcccaaggatttccgaaagcccgcgaacgccttgaagaaatcaagaagggcggagcccggatgcagaaagctcggctttctcggtctggtgccaaccaacagaagcagaacgaaggcgactgcatccttatgtgatgtcggaacggggaactatagatttaatgtctcatgcacgagcattttcttttcaattatgaacccatttgcattacctttatttttctttcggcccggtgggaaaa

SEQ ID NO: 4509 - DNA, 1402 bp, Aspergillus oryzae
  misc_feature (1)...(1402): n = A,T,C or G
cattatttggacattgactgccgcagtctgtaaggcattcacttgcctttaattccaacccaggacaggcgtctctgcatccgattccccggaccacctcaacgcaatctctgaacgagccacttcatagtttcagtgtaaccgcggagagagggatttctttgtcctctcctagcctatacatttaacggttgcctgtgaacccctgtggttctactccggaatacgccacttcatttgcttctttatctgatcgtttgatcttcctctcaggtcctctttatattttccctgcttaccccccaccttaccgctgtggtttgtgagaatcaaatcgcaggtcgtacctttctttctcggaattcccttctttgaacatttctttctttagtcgttcgttttacaggaatttttctttgtgaaatctattgcactatggcgggtattgatgaagcgctgcccttgaagggtaagggacaagccgcgtccggctggaagacttggtccgtcaagaagcgcatgctgattatcggcgctatcgctctcgtgatcgctctcgctattggtctaggagttggcttgggagtcggtctgaataagggtggaggggatgacgaaggcgaggttccgcccactaccggaggaggcgtgaccacagccaagtggcaaccggccgtaggaacgaaatggcagatcgagcttctgtacgcgctcaacgacacttcagtagacgcagatatctacgacattgatctcttcaacaatgacaagtcgaccatcaccgatctacaaaagcaaggacgcaaggtgatctgctacttctccgctgggagctacgagaactggaggcccgacaaggacaagttcaaggactccgatatgggtaacacgctggatgggtggccgaatgagaaatggcttgacctcaactccaagaacgtgcggagcattatgacgtcgcgtctggatatggcggtcgagaagaactgcgatggagttgacccggataacgtcgatgcctatgacaacgacaacggtctcgatatgaagaaggaggattcggcgaatttcatgatgtggctcgccaatgaagcgcatgcacgcaatatgtcaattggtctgaagaatgccggggcgatcatctccgaattgatcgacaccatgcattggaccgtgaacgaccaatgcgcgcaatatgaggagtgcaatacctatgccgcattcatcgataagaacaacccgtcttcaaaatcgagtaccccaagggcgacgacaccaacaacaacgatttggtcaacacgagcaaganaaagatgcttgcaatcttcgagggatcctcaaattttctgagggtcaccaagaatatgaatctggataactggttccagacctggtaatcgag

SEQ ID NO: 4510 - DNA, 670 bp, Aspergillus oryzae
  misc_feature (1)...(670): n = A,T,C or G
caatgatggtactgccgatcccatcatccaaggaggtgtcacttacttcttggccaatggcttcgcctattggcaaggaacggatattgaccatgccaccgagacctactggaatgacacgaggcttgctaaggagcatattgagaggattgctggcaacaaccaggacaagattatcttcggaaacggcgagactggttggcccaccgatggcggttctgactatggaaacgccaaggctagcactcaaaatgctgaacggtactggaaggacgctgtctgcgctatgctgacctggggcgtcgacgttttctactttgaggctttcgacgaatcctggaagcccaagagcattggtgacaacggcgaggagaaggatgagacccactggggtcttttcactgccgaccgcaaggccaagttcgactggtgtggaaagaaataaactcacaaacctaattgatggcatttgacggatgtttgccaagcgaaaattatagtgtgtgaacgcttcatgattacagacaagaaagggtaaaatttaggaaattggataaacttttggggttggccaaaaaaggggtaattgaacaacaannnnttttnttatttatagttgaattttttgtggtcgtttggaggtgttttaaggagtctgttgataaattat

SEQ ID NO: 4511 - DNA, 1229 bp, Aspergillus oryzae
  misc_feature (1)...(1229): n = A,T,C or G
gatccactagtaccccctccaacgattgcactagataaataatacagcggagaaagaaatcgtcgcaaaaccacttactccttccccaacaactgccgtaccttattcaccttatcctcgaacgactgttccttatcggtcctcgacccaaccctcacatccgtctggatgcgcacaatcccctgctgatgcagaaccgtatgcgcctgtccaataacctgatgaactttgtcccagggcccctcgagggttgtgccggcgctgtgcatcacgtacttgagaccggatttctcgattaggcgttggacgtcggcgatttgggcggaaacggagggggaggaggtgccgatcgggattaggcagaagtctgcggtgcantgggctggtgttgggatggaggagatatcggaggaggccattgggtcggtggtgttgctgggtgggttatttggttgggtgtttgattattggagtgatggtggacaatgggtaatttatccggttcggattggaatatcaaagtttaatctcactcagaccggtcttgtcgagcacaccaccgtcgacaagatgcctacccgtttctcgaagacaaggaaagcccgcggccatgtgtccgccggttacggtcgtatcggcaagcaccgcaagcaccccggtggtcgtggtatggccggtggtcagcaccaccaccgtaccaacctcgacaagtaccaccccggttatttcggtaaggttggtatgaggtacttccacaagaccaatcagcagttctggaagcccgtgatcaacctcgacaagctgtggtccctcgttcccgctgagcagcgtgacgcctacgtgaacggccagaagaccgacactgctcccgttatcgacctccttcctcttggctactccaaggttctcggcaagggccgcattcccgagatccccatcgtcgtccgtgccaggtacttcagccgggatgctgaacggaagatcaaggaggctggtggtgtcgttgagttggttgcttaaatgtggattacggggctatcttaagaaggtcaaggtgctacgctgactctggtcggcgttattgaggctcggtttctttcgaagggaataaagactcgaacatgggagccgcggatcgggccatagggatccgtgtatttacaaaacaaagggtttttgtttgtgatgagcatagcatagccttcggacacccttacgatctcactatt

SEQ ID NO: 4512 - DNA, 654 bp, Aspergillus oryzae
  misc_feature (1)...(654): n = A,T,C or G
cggtggaaagattttcgcgtctatatgcagcttacctacttggggccccggcgccttgcatatgagggacgaccctaaagtgcatggcacggatgcggaacggaaactattcaccacagacaaccaggcatggagaacaaccgctggaaagatggccgaacatggcatcggtgttgacatgttcgtggcggcacctggcgggacgtatgttgatgtagctacgataggccatgttgccgaagtatcgggcggngagacattcttctaccccaatttccacgctccgcgagacatactgaagctttcgcaggagttcgcacatgcagttactcgcgagacaggctatcaggcaatgatgaaggtccgttgttccaacggtctccaggtatcggcatatcatggcaactttatacaacatgcgctcggngccgacctggagatcggatcaattgatgccgacaaggcgattggtgtcatgttcagttatgatggcaagcttgaccccaaactggatgcacactttcaagccgncttgctgtatactacggccgaagggcancgacgggtgcgctgtatcaacgtggtggcaacaatcaatgaaagaggcttggaaacgattaaaattatagaccangaatggtgtgggagcaatat

SEQ ID NO: 4513 - DNA, 687 bp, Aspergillus oryzae
  misc_feature (1)...(687): n = A,T,C or G
cagttcctatagcccctctctgttgatttctctcagcggtgcctcgatttgaactgtataaccatggccgaaagctcttctgtggctcagccacctctgagaatcggtacccgacggtcaaagttggctattgtccaagccgagggtatccgtgatagcctgcagaaaactgcaccgaaccggtcctatgagattgaaacactacacaccctgggtgataaagacaagtctacagccctttacaacttcggcgcaaagagtctgtggaccagtgagttggaggagaagctgacctctggccaattggacgtcatcgtgcactgtcttaaagatatgccaaccacgctgcccgagtcgtgcgatctcgcggcaattactctccgcgatgatccacgtgatgcgctagttatcaaggccggtctgccttacactagcttgcagacactccctgaaggcgcagtagttggcacttcgtcggtgcggcgctcggcgcaacttctccgnctctacccccatctgcgctttgccaacctgcgtggcaatgttgagacccgcttggccaaagttgataatccagagagtgagtatacctgcatgataatgtctgccgcttgccttgagcgcattggccctaaacatcgcatcaaccaatacataagctctaaggaccgtggcattctgcatgcc

SEQ ID NO: 4514 - DNA, 712 bp, Aspergillus oryzae
  misc_feature (1)...(712): n = A,T,C or G
cgaggcgacaacttcaccacactccccttcccgacaccgatcagggccattcgatcaccatggcttccgtcccgagtgtgcaatgcttcggcaagaagaagacggctaccgctgtcgcccactgcaagcaaggcaagggtctcatcaaggtcaacggccagcccctctctctggtccagcctgagatcctccgcttcaaggtctacgagcctctcctcatcgtcggtgccgacaagttcgccggtgttgacatccgtgtccgcgtctccggtggtggtcacacttcccaggtctacgccatccgtcaggccatcgccaagtccctcgtcgcctactaccagaagtacgtcgatgagcactccaagaaccagctgaagcaggctcttgttcagtacgaccgcacactgctcgttgccgacaaccgtcgcacggagcccaagaagttcggtggtcgcggtgcccgcgccaggtaccagaaatcctaccgttaaacggccttcaaatcaaaaaaagacccatcttacggacgaccgacgggaatacaaaaaaggacgcggaatggtatctatcaggtgtactggggaggagatttggagcgtgctcccagggcaatcggttatggttcggatctggttgtcgctggggtggaattattatggtgcgatactactggctctgtcgatgctggatttagtataggccangtatctca

SEQ ID NO: 4515 - DNA, 642 bp, Aspergillus oryzae
ttggcgatctcgagttcaagataagccccgagcttgcgcccgaacagcagatcgtgaccgcttatccggatgtgacagtccatgagctcagtgatgacgatgaattccttgtcatagcctgtgacggtatctgggactgccagtcttcccaggctgtggttgagtttgtccgccgcggtatcgccgcgaagcatgaactttaccggatttgtgagaacatgatggacaactgcttggcttcaaacagcgaaactggtggggttggatgtgacaacatgactatgataatcattggcctcctgaacggcaggactaaagaggagtggtataatcagatagctgagcgggtggccaaaggcgacggcccttgcgctcctcccgaatacgctgaattccgcggccctggtatgcgtaatcaagttgaagaacacccggatgactacgatatggaaaatgatcgcgcgcgtggtttcagtgttcgctcccgccgcattattcttctatgtgacaggacaaaaactgtcccttgaccatatgacgaagagctcctttgcccaactgaagaataccgcacttgcctattcaagtgccacgcgaattggcttgatttgccacgaatgagcgtggaagaaccccgggacc

SEQ ID NO: 4516 - DNA, 675 bp, Aspergillus oryzae
  misc_feature (1)...(675): n = A,T,C or G
cacctatccttttctctttcccttaggaccaatcttttatacctgtctaatttctagaattgatccaaccaattgtctatcggtcgattcttccttcgagtatctcatctgctcagcacatttcagtggactgaacactcgttgttcaacgacagccacagtttcagattgctttgcggtatcccctccgcagataacaatttgcaatggcagaataccctgtggcctacaatgggtcggcgaccgggaccggaggtgactctctgacggaagatctcaacatctactacagctctggtgacatcgcatgggttattgtttcgacggctcttgtcttgttgatgattccaggagtcggattcttctattccggtcttgcccgtcggaagtcggcactttcgctactatggctctcgataatgtctgtcggaatagtctccttccagtggttcttctgggggtactctctcgctntctctcataccgccggaaaatatattggtgacttgagcaactttgggttcaaaggggtcctgggtgcgccatctgttggcagcgccaaagtcccagatctcttgtttgctgtcttccaacgcatggtcgcctgtattacaatggcactcgccgttggtgttgtcncaaaacgtggccgcatgcttccttggatgggttttn

SEQ ID NO: 4517 - DNA, 695 bp, Aspergillus oryzae
  misc_feature (1)...(695): n = A,T,C or G
cttcaaagctcaattattctttcttctccacactatgtcttctactcagctcaagaagctgccgctccctgtctccaaggcccatgttttctatcgtgagtccggagcacagtcagctccagtggttcttcttctccatggcttcccttcctcgtcgcatcaatatcgtaacctcatccccatcctagccaccaagtaccgggtcattgcgcctgaccttcctggttttggctttactgaattcgaggacgccaagatcagagaaggcatccactacacctttgacaccctggccactgtggtcctcgaatttctcgacgtcttatccatcaccaagttctccatgttcattttcgactatggctctcccacgggtctgaggctagctctcaagcgtccgcaatctatccaggcaatcatcacccagaatgggaacgcgtatgaagacggcctaggccaattctggagccagatccgagagctttgggagagcaacaatgaccctaaagttcgggccaagctagcgactagcctactcagcctcgaggcaaccaagtggcagtatgaggaatgaacgaagggacttgtcgctccagaggcatatatgctggactacgctcttctccagcggcctgggaatgcagagattcagctggatctattctgggactaccagaataacatanagtngtatc

SEQ ID NO: 4518 - DNA, 679 bp, Aspergillus oryzae
  misc_feature (1)...(679): n = A,T,C or G
ggcttctgagatattttacgttgtcctttttcccttttcctcccccactttttccttgtttacgcacgccatggatgtccctgagcccgagcagactccgttcaccgcggtgactgcacagacgtcgaagctcgccagaaaatatcaaacccttctcgatgcctcgacgccgttcactgcctaccgctggatcggcaccgtcgtccttctcattatcttcttcctgaggatcatcctcgctcagggctggtacatcgtcgcctacactctcggcatctaccttctgaacctcttccttcttttccttcagcccaagttcgacccttctctcactcaagacgaaggtctcgaggacggcgacgcagctgcatccctccctactaagcaggacgacgagtttcgtccgttcattcgccgtctcccggagttcaagttctgggagagcgccacccgcgccattgccattgggtttgtctgcagctggttcagcgtctttgatatccctgtgttctggcctgtgctcgctgtgtactggattatcctttttgtcttgaccatgcgccgacagatccagcacatgatcaagtaccgctacggacctttctccttcggcaaggccaagtacggtcggtcgtaaattgggatngcataggcccgtttcccgatgatgattctcggg

SEQ ID NO: 4519 - DNA, 683 bp, Aspergillus oryzae
  misc_feature (1)...(683): n = A,T,C or G
gtagccatcaaatagttaccatcgtgtctggagccttaaacaatgcggcgtctaagaaatacgaccttgaagcttggttcccatttcaaggagagtacaaggagctggtttcttgctctaactgcacagattatcaagcccgggctttggaaattcggtatggtactaagaaagcaacagatgtcaagaagtcgtatgttcatgctttgaatgccaccctgtgtgctactgagcggacgctttgctgtattcttgagaattatcaaaaggaggatggatttattgtgccagagccccttcggaaatacatcccaggtgccccagagtttctcccttatactaaggaactcccgaaggatagcacttctcagaaagccaagggcaagcagagctctaaggcagcaagtggtgcggaagaagccacaaggaagatccaggatttacgggtgtgagtgccaaaggcgctgagaaattactgctttatgtggaatgatatctgcagcaacggcggcaattgcgaatctcattacacggtgttgtgagacgagaacatgctagcatgtagagtatttatagagtgcangcagtctctatgagaaaaaanannnnnnnnnnnnnnnnnnnnnnnnnnnnnnaaaaaaaaaaattcctgcggcccgttcgagcttgcatctanaaggccc

SEQ ID NO: 4520 - DNA, 719 bp, Aspergillus oryzae
  misc_feature (1)...(719): n = A,T,C or G
ggggtattgactctggttcttatgcggcacgaggggagatcctcagactgttaggactctcgttgggaaaaagttagtattgagttctgtggcggaactcatgtgcaaaagacaggcgacattaaggagctcgttattctggaagagagcggcattgccaaaggcatccgcagaattattgcagttaccggagaggatgctcatgaagtgcagcgcgtcgctctgggattcgagaagcgtttggaccgtcttgaagcaatggccctaggtcctgagaaagaacaggatgccaagcaaattcaagtcgaccttagccagttattaatctcagcagttcaaaaatcgaggttccgtgaacgttttgcacatatcaacaagcaaatcattgattcgcaaaaagcgcagcaaaagcttgaatcgaagaaggcgctcgaggcaattacttcatacttcgaaaaccctgagaacaaagacaagtcgtggcttgttgctaggcttccaatttcagcaaatgcaaaagctgttagcgaatccctgaaccacgtgaagtcgaagctacaggataaaacggtttacgtcttggccgcggactctaaccaaggtcgtgtcgtccacggctgctatatgtcaaaggcaataagcgatcagggagcttccgctagcgattgggcggctattngttctactgccggttgtggaaaggctggtggcaaaaggcc

SEQ ID NO: 4521 - DNA, 683 bp, Aspergillus oryzae
  misc_feature (1)...(683): n = A,T,C or G
cccatgcgacctatcatgcagtggtgcaacggacgaacgatgaaccaatacattggggccgaattggacaaacgatacgaggcctggacgcagaacaagccatcgaccagggccaattcaatcattgacattgtgctcgctgagtatatgagtacacggccggtaagggcagcactggatcccgagttcaaatcctgggcgactattcaactccgaacctttctcttcgctggccacgactcaaccgcggccacgattgtatacagtatttatcttttatcgaagcatcccgagatcctttccaaggttcgcaccgagcatgacgaggtgtttgggtcagatatttccgctgcagctggcatactcaagcagcacccggagctaattaaccggctcccatatactctagcggttataaaggagaccctccgtctatttccagccgcctccgcgttgcgagaaggccagcctggtgtctacctgcaggataaaaatggcacgaagtacccgaccgagggattgtgtatctggatcatccatgggggcattcaacgtaacccttaatactggccggacccacatgctttcaaaccagagcgttggctgttgggacagatcatncnttatatnctcccanagggcgctggcgtnctttcnagcaaggcccttcggaattgcatcgn

SEQ ID NO: 4522 - DNA, 687 bp, Aspergillus oryzae
  misc_feature (1)...(687): n = A,T,C or G
ccgaccaaccaggaattcacgactgtgaccaaggatgtggccagtggtgagagacataacgaaaccttgttcgaaatcaagattgagaacggcaaggccggtcaggagttcagaactctgtcgagtcactttaaactgatccattatcccacccgagtggccatgtggacacacacaactcctttacccgagtggggcttcaagcaagccgaaattaatggtaacaagaacgtccttcagaccagcaatctgtggtacgccgaatcaatcgagtcgctggaggaagacagccctcgcaagcagaaggaagaacgcaaagtgaaacagctgcccttccttcggaagtatctggaacttcagcgcgccatgttcttccacaacaatgccttaaccagcagccacccctacgcgagtgagcctttccagtggcccttccttttgcggggtgttagcttctggaccaagaatgatacccgtgaacaaatttatttcttgggtaacccgatcgggtggtggattgccagcagtctgctggctgttttcgctggtgtgattggtgccgaccagctgtctctccgccgtggagttgacgccgttgaagaaatttggggacccggtgcccgttcccgcctatacaacagcaaccgctttcttggtcctctgctggggagcccactacttnccctn

SEQ ID NO: 4523 - DNA, 702 bp, Aspergillus oryzae
  misc_feature (1)...(702): n = A,T,C or G
cccaggaacaccatttggatgcccttgtcgtatgtgccggctttggtggaatttatacgctctattcccttgtcaaggagggcttgaatgtcaaagccattgatacggccggtgatgttggtggtacttggtattggaaccgctatcccggtgcgttgagcgacacatggagtcatctttatcgattcctctttgaccaggagttcctgcaaacctacccctggaaaagatggtatctcacccagcccgagataatgcaatacctccgggacgtggtggaaagataccacctccgcaaacacatgcagttcaacaccaagatgcaacgggcggaatggaacgacgagactaagatctgggaggtccagtgcgagacaggcgacgtcttccacgtgcgatacctcttcacggcgcttggactcctggtcaaagccaactaccccgatatcccggggatggacacatttcagggagagatgaaccacacctcggcgtggaacccaaatgtggaactcgagaataaacgtgtcggtgtgatttggcgtggatcatcgggtgtncaggtcgtgacggccatcgcttacaaggttaaatctctcattgttttcgtcccacgtccgcagtccactggtcccagtggaaaccgggacgttaccccaaagaaacccccttgttcaaaaaaaatatccaaggcttatcgga

SEQ ID NO: 4524 - DNA, 485 bp, Aspergillus oryzae
  misc_feature (1)...(485): n = A,T,C or G
aagaatttcagatactattcatacatctatctaatgcggctatgtacagttatataaacaactatttacttaataactttgcccctccaagaatatctcccccctcaacatcttcaatgtccaagaagcgcctgaaattaggcagcttagttcaaaccattcttgatgttatcatacttggagttggggtagctcagcaggttctgagttgtgtccaggcctccaagagctctgtggcttgttccaatcagcgagtcagctcccttcttgtcggctgaggcctcccagaacatgctacctcccaggccgagagacttgaggtaggcaaccttggngttgatcatgtcgggggtatcgaaagagatgagctccttggtggcggagttggagctgtagtatcccttttgcaaaagatcgtactggaccggtgggcccagctctgggaggagccttgaaatcccagataccggcctcccagctttcat

SEQ ID NO: 4525 - DNA, 649 bp, Aspergillus oryzae
  misc_feature (1)...(649): n = A,T,C or G
gcaactgaaactttcaaacagctctcctccagaacgcgcgacctgatcatcaaaagcattgcacttaactcgaccgcttttgaggaggaaagggatggctcgaaggagtttatcgggagtaaaactgaagtagcattgctacaactagctaaagactacctcggaatggatgtcaccgctgaacgtggatctgcagagatagttcaattgattccctttgactccgcccgcaagtgcatgggagtggtgtaccgggagcctacagtgggctatcgacttctcgtcaagggagctgctgagatcatggctggagcatgctcgacgaagatagctgatacggatggtctcaacggcatcgctgttgatcagttcacccaggaggacagccggaaggtactcaatactattgaatcctatgccaacaaatctctacgaacgatcgggctggtctatcgcgatttttcgaacctttccagctggcctccgagctatatcaagccctctgaagaggattcagatgtggctcagttcgaagagcttttccgtgacatgacctgngttggtgttgtaggtatccaggatcctctcangcccgaagtacctgcagctattgagaagtgccgtaccgcncgtgtgcaagtgaagatgg

SEQ ID NO: 4526 - DNA, 1017 bp, Aspergillus oryzae
cggcacgagggtcttggccgctcttttttccgatcctcctcccaatcaaccctcttcgccttctcctctcccaccatcttccctcgatcccacggtcttcccccgttcaataccgccaaagtgtcttccctcgcagttccccgtaccatttccttccccccgggggtggatactcaaccgcaacggttgagtccggattccagcatgtcccagaacaagggtggacggaggagacggtcaagcagcatcatttaccaggagccgccggaatccattgagcgcaccagtgaccaggccgccttgcccaatctaaatgcgaattgggtcaatgccaagggtgcctggaccattcatttcgttttaatcattgccctgaagatcttctacgacatcattcccggagtctcgcaggaaacctcatggaccttgaccaatatcagctacatgttcggctcgttccttatgttccactgggtgcggggcatccctttcgaattcaacgcgggtgcctatgataatctcaacatgtgggagcaaattgacaatggagatcaatataccccgacgaagaagttcttgctatgcgtgccgatctgtcttttccttctcagcacgcattatactcattacgacttgacgtatttcaccatcaacttcttagctactctgggagtggttattccgaagcttccattttcccaccgcctgcgaataggtcttttctctcccgaaccagaggagtagatattcctgtttctttctctatttactttcctttttttttttcttgataatattctccacttggcacccattatccttcctttctctgtcttggaataatggtttcatgtttcaggggctacccccgttctgaaattggccggaactctgctattctaccctgtcagatacttttgtttgctgggaagcgggatgaagtgatagcatggagtacaggaggcatcaaaagcgaagagggacaaaagaaccaaaaatgtgaaaaaaaaaatacat

SEQ ID NO: 4527 - DNA, 682 bp, Aspergillus oryzae
  misc_feature (1)...(682): n = A,T,C or G
cggtagcagcgaaaaggaaaagcggcctaccgcctcgcattcaattcccgccgattgccatcagttccacgaactcctgcccccctgatcctctcaacccccatccgcctttaagcttggcctagtcgactcactagacccgccgttgctgtggacttgtcttttaggcgcttctgttttgcgcgaaactcccgacaagctgggccccgactcttgaccctactgcaaaaaaagaaaattgtgttaccgctctctcgatccgctgtcactactacgcccgtcgggatagcttcgatcatcgccttcgcgcccttcatcctaactatcaaacacacacccgggcagaaaactctagaatggcctcaaagtttctacgagaatacaaactggtagttgttggtggtggtggtgttggaaagtcatgcttgaccattcaattgattcaaagtcacttcgtcgatgaatatgatccgacaatcgaagattcgtaccgcaagcaatgtgtcatcgacgaggaggtcgctctgttggatgttctagatacggccggacaggaggagtactcggcaatgcgtgaacagtacatgcggaccggtgaagggttccttctggtttactccataacgtcgcgccagtccttcgaagaattatgacattccagncacaaattttacgagtaaag

SEQ ID NO: 4528 - DNA, 717 bp, Aspergillus oryzae
cgaacttttgtttagtctcatttacattgaaactcttctcatttcccgcttctcgtgatatcctacatcatattccaccatggatgagatcgcccccgaatatgatgttgttgttctcggcactggcctgaccgagtgtgtgctttctggtgttctgagtgtcaagggaaataaggttcttcacattgatcgcaatgatcactacggaggagaggctgcttccgtgaacatcgaaacacttttcaagaaatacggcaacgtccgccccggcgaagagccatggaagaagtatggacgggtcaatgactggaacattgacctggtccccaagctgctgatggccaacggcgagttgacgaatatcctggtttccaccgatgtcacacgttacctcgagttcaagcagattgccggcagctacgttcaacaaggaaagagccccaaggccactgtggcgaaggttccttcagatgcccacgaagcacttcgttcatctctcatgggcatgttcgagaaacggaggggcaagaaaatttctcgatgagttggccgaattcaaggaagacgaccctattactccccggggcttgacaattgtttattgacccttaaagaagttcttgaccaattccggcttggaaaaaaaaacccgtgacttttttgtgccctttcttggcccctgtttaatcccgaccactatatcgtgaataaggggcg

SEQ ID NO: 4529 - DNA, 635 bp, Aspergillus oryzae
gatacatggacctaagcatcgtccacgacagtatctacggatattgtctcaaccatcaaggcctatgcaaacagatacctacacatcatccaaacttactctccatctaccggatccatagccaaccattatactaagatggatcggagtcagacctccgcccggaatcttacctggtcgtacactgcatttctcactgccaacactcgaccatcacacagtcattcctgcaccatggcgacgagaccggtgacaccatcattccatcatcttgctctactacttccgcctcgtgcatctacatgcattcgtggttatcacactcctgactgaccattattacgctacccaggagcaccatgacagcccgtgacaggtggcaacaactgtgtcggtgaccttcacggtgatatctactatcgtactacatgagtctatcataatctactggtcgatctcgcaactctggagcgtggcatccattcatcgcgacccctattgagctcggaatctacactactgacaacaccctgtcgaccataacactatacttgcctgcttgacattcattcgagtacaagtttactctcattcacataggagcggttacttgtgatagtgaccccaacccgaaa

SEQ ID NO: 4530 - DNA, 617 bp, Aspergillus oryzae
gggttgtgccggcgctgcgcgagcattctccgacgggggccacgcagtcatcgaatgggtcttctgcctcgccggaagcgtctcctgctgcattggctcctcacgacgatcattatcgctattacagttcggagcccatggaccattacaagcatatgccgggtgatcgtatttcaccgcaggccccaagacagtttggtttcgcgccgccgcctgttgatttcacgggtttcggctctgcgacagtttccctgccgcaccaccctcctccgccgaggctgttggaaccagaacgcatcaacgctcccagccattctcccgtctcgcaatttgctcgacgatccctctcgcctaatcctgcgaatcctaagaaacggactctcgcagagaccgcgtcatctgcagaggccgcctcgatccccacaacgttggaatcagggtcgaaccaactcccacccatcatgtcagctgccaacccttccccaccgggtcggctcagctccatttcttccattctcaaccatcctaacacgcgggacgagtcacgcgtggacccgtcgctcgctgcactgagtcgccagcagcaccaaacatcgcaccaggctctggcacctcct

SEQ ID NO: 4531 - DNA, 1230 bp, Aspergillus oryzae
ccagcaaccggtcagtgaaatcatactgataccatccgttccccactacccgtcgagtaagaccagctatctgatcgaatctttcaactatcacaatgggtgtcggtgtccttgagaagctttcccgcaagactggtgtcatcgtcggtgatgacgtcctccgtctcttcgagcacgcgcagcagaacaactatgccatccccgccgttaacgtgacctcctcttccaccgtcgttgcttccctcgaggctgctcgcgaccagaactgccccatcgtcctccagctctctcagggtggtgctgcctacttcgctggcaagggtgtcagcaatgacggccagcaggcctccattgccggtggtatcgctgctgcccactacatccgtagccttgctcccgcctacggtatccctgttgtccttcacaccgaccactgcgccaagaagctcctcccttggctcgatggcctcctcgacgaggatgagcgctacttcaagctccacggcgagcccctcttctccagccacatgatcgatctgtctgaggagcccgtcgactacaacatccagaccaccgccgcctacctcaagcgcgctgcccccatgaagcagtggctccaagctccaccccgagcttctcaagaagcaccaggcttacgtcaaggagaagattggctccaacaaggacaagcctgtcttcttcgtcttccacggtggctctggttcctccaaggaggagtacaaggaggccatcagctatggtgtcgtcaaggtcaacgtcgacactgacatgcagttcgcctacatgtccggtatccgtgactacatcctgaagaagaaggactacctcatgaccgccgttggcaaccccgagggcgaggacaagcccaacaagaagtccttcgacccccgcgtgtgggtgcgtgagggtgagaagaccatgagccagcgtgtcaaggtcgccctggaggacttcaacactgctggtcagctgtaaatgtctcttgatacgatgtctctgccgatacgaagaaagaaatcagataccagtacataaattgatcaatccaagaacggaaacgaacaaaagaaacatatttgactgtaaaagtggaggccgcttttggtgactggaaatattgcatgactggggaagctggagttgaatgattggtcaattacgatgtatgtagaagtagtatgaggatgaatccacttaattaattgatgc

SEQ ID NO: 4532 - DNA, 1273 bp, Aspergillus oryzae
  misc_feature (1)...(1273): n = A,T,C or G
cgaggttcgccccgccgccaatatttcctcttccaacacgccgcagtcggactacggtctgaatcagccgccaccagccgcgcgctctccagcttatcctgattacctcgcccgcccgccccagtaccatcacgcgccgaacacacaggccggtggtgcggcaggtatggctcaagcaacaaatccctcaatcgcggcctctagccctacctatcctcctccctactcgccttatcagccacagggtcatgaaatggcccagtatcaaggtcaccctcctccgccgcctccacagatgtatgcgcgtccagattggtcgcatgggtatggtcaacatcagcacggtctgcctggaccctataccactcctgccacaacggttggtcccgcctcccctgctgcgaccgcagggccgcgccctggccaggtctactcattcgttccgattcccggtgcgcaacagcacaagcgaccccgtcgtcggtatgaggaaatcgagcgtatgtacaagtgtggatggaatggctgtgaaaaggcatatggtacactgaaccacttgaacgcgcacgttaccatgcagtctcatggagccaagcgcactcctgaagaattcaaggaaattcgcaaagagtggaaggctcgcaagaaggaggaagaggctcagcgcaaggccgccgaggagcgtgaacgtgctgctgctgctcaggctgcgcaagccaaccaagttgatgctcctggccctggcgatccggcgcaggccggtcagcctcccgcctacccgggcagtgtccgtcctcagctgcccccgatcgggtatcagcccgctgacggccaggtgcctggtcagtacggagctcctggcggtggcatggtttatcagggcaacggacagatggcctatcctccaaactaccctcactcgccttacggccagagcggtcaagtatatcagcaacaaaaccaatcgaccagctacccgcaatagatatccaacttccctctcttctctcagcttgaatattctaataccaaattctcctaatcgtgtatcgccactccccggatctaaatctttnaaatcttgcgcacatgataccatctnctggccttgattgctncagtcaaaaagagtggccatgcgaactacgcttctgccccaggtatggttttttgaattagatcgattgacaaaaaggagagaatcttcttatcggggaatcccatctttgtttttcatctcgaataccggctataggattgtgatttgagatgt

SEQ ID NO: 4533 - DNA, 681 bp, Aspergillus oryzae
ccgtcgtcgacaactaatccgacaaaaccaccttcattcaaaatgggtcgtcttcactccaagggaaagggcattgcgtcctccgctctgccttactctcgctctgctccctcctggctcaagaccacccctgagcaggttgtcgaccagatctgcaagctcgccaagaagggtgctaccccctcccagattggtgttgtcctccgtgactcccacggtattgcccaggtcaagcacgtcaccggtaacaagatcctccgtatcttgaagtccagcggcctcgcccccgagctccccgaggatctgtaccacctcatcaagaaggctgttgccgtccgcaagcaccttgagcgcaaccgcaaggacaaggactccaagttccgtctcattctcatcgagtcccgtatccaccgtctgtctcgttactacaagtccgtcggtgtcctgccccccacctggcgttacgagtccgctaccgcctccaccctcgttgcttaagtggttttcctcacttgtgctgggtgttggtgtgttggcgcggataggtctttcgaattggtctcttaccctgagaatgggtgggtttttagtcatctagtgtttgttttacaggcattaggtggtgatggattatatctgtcgtcgacaacaaaataaaatttcatgaccaaaaaaaaaaaa

SEQ ID NO: 4534 - DNA, 745 bp, Aspergillus oryzae
  misc_feature (1)...(745): n = A,T,C or G
cgcgggatgaanngcttcgaatcacatttgcgcgcgaggaagcggccaacctacttatcagtaacagaggtattcttcagattgccgatttcgggctagctcgaccgtacgatgaacctcctcctcagcctggaaaaggtggaggggaggctaaaagagactataccacgttggttgtgacacgatggtaccgccctccagaactcctccttcaactacgacgctatacaactgcaatcgatatgtggggcgttgggtgcgttttcggcaaaatgttcaagggcaagccaatccttgccggcactagtgatcttaaccaagcccagcttatatttaaccttgtgggcacaccttccgaagagaatatgcctggctggagctcgctccctggctgcgaaggtgtgaaaagctttggcagcaagccaggaaatctatctgaggtcttcaaagagcaaaatccagccgccatatctttattaggtgagctcttgaaacttgattggcggaaaagaataaatgctatcgacgcgttgaaacatccttatttctctaatcatcccctgcctgcacaccccggtgagcttccctgtttcgaggactctcatgaatttgatagaagaaggttccgagggcagcgagcagttatgccctcagcccctggtggaggctcgtgggcatgggccctaatggcggctggagctcgaattcggaacccggaccgtgcagatctagaaataccgcatac

SEQ ID NO: 4535 - DNA, 738 bp, Aspergillus oryzae
gtttggctatcactgcttctccttccatctctactttatcggctatttagatcgccccctccccggtcctccagtgtacacctttcaaggactattccgagcgtttggagttcgattgaaagcgatcgtccccccttgacttctccattgcaaacaacaaccgacttcttctgatcccttaggcgacgaagcccccagcatcccttggtcagggcccctttcagcgcttcccaaggttagagatgtctactactacagctgagatggcccctgccggccgtaagctcgagaagaagcccgtcaagtttagcaatctgctgcttggtgcaggattgaatatgttcgaggtcaccactttgggacagccgctggaagtgatcaagacgaccatggccgccaatcgaggcgacagtttcgccagcgctatgggtcggatatggggtcgtggcgggatcctcggttattatcaaggtctcattccgtgggcctggattgaggcctccaccaaaggcgctgtcctccttttcgtcgcgtccgaggcagaattccgtgccaaggtgctcggcgcgccagactttctcgctggtatctcaggaggtatggcgggtggtattgcccaggcatatgccactatggggcttctgcacctgtatgaagacggtcgagattaccaagcacaagatggctgcccaaggtgtaaagcctccaacccctttcgcgaaattcatggacatttat

SEQ ID NO: 4536 - DNA, 692 bp, Aspergillus oryzae
  misc_feature (1)...(692): n = A,T,C or G
cgacactggaaacatctacttgcgtcgtgactaccctcgtacgcacgagcagaatgaagagcttggaatttccgcggaccccaatgctgtggagcatgaagcatctggcgaatgggaagattctgagattgtcgatggtcaggtctacagtctgcctaccgaatgtccaggctgcacgaagcctggcttcgttaacatgaagaaggtgaacatcccctacttcaaggaggtcatcatctggagtacatcttgcgagcactgcggataccgtactagcgaagttaagactggtggtgaagttccggagaagggcaagcgcatcactcttagggtcgagaatgaagttgacctctcgcgtgatatcctcaagtccgacacctgcgctctgcacagtgaagagttggaagtcactgttcaacctggtacattgggcggacgtttcactaccgttgaaggtctgctcaccgaaatccgtgatcaactgcacggccagatctttgatgtcaacgatgcgagcggcgctggaggagacagcatggcattcgacactaaagagaagtggactcgcttcttctctcgtctcgatgctgctatcaatggagacatgaagtttgtcatcactctcgaagatcccatggccaacagttacgtccaggacttgtgtgcgcctgctgtcgatcatagaatcacan

SEQ ID NO: 4537 - DNA, 716 bp, Aspergillus oryzae
gactcagcctgtctatactgccgacgagcatccaaggcctggagtcctccgtatgctgctttcgctaagagtcggacaattaaatggtcagaattgctgaaagagcatggtatgcccaccaccgaaccgaggacttttccgcccaaatcgaacaagatcaagcgtcttgtccgcaaaggcatccctcccgagtacagaggggcagcttggttcttctatgccggtggctacgagcacttgaatcgtaaccctggactatatgatcagcttgtcagccaggctatggaaagcccaagcaacgatgacaaggagcatatcgagcgagacttgcaccgaactttccccgataatatccacttcaagccggaatctactgacgggctcgggaactcaggcgctagctctggtagcagcaacctgaagcatggctcggacactgtcgaaacgcagatgattcaatcgctccggcgggtgctctatgcattcgcgttgcacaacccccaagtcggatacgcgctatcactcaactttattacaggcctgctacttctgttccttccggaagagaacgcattttggatgctgcatatcattacttctcgttacctccccggcacccacgagataagtctcgaaagtgctaatatccatctatggatgcctatggtcctcttgaaaaattgtaccccgctaagctacaacacaaacacggggtg

SEQ ID NO: 4538 - DNA, 678 bp, Aspergillus oryzae
cagctatttgcaccgcacctgcgcatcgggaagcttgacttgcgctacctggtccccacgtccttcgactccctctaataccgagattctgatatcattcgatattgctagccaagatgtcgcaaagccatgccctttccgacgatcaggtcgcgggtgagctccgcaagatgacggccttcatccggcaggaagcgctggagaaggcccgtgagatcgaactgaaagccgatgaagagtttgcgattgagaagtcaaagctcgtccgtcaggaaaccgctgccatcgacacactgtacgagaagaaattcaagcaggctgccatgtcccaacagatcacccgctccaccctttcaaaccgtactcgtctccgtgttctttcttctcgtcaggagcttcttgatgagctgttccagcaggctcgtgataagatttccagcatcgcatctaaggatgctaagaagtatgaaactgttctgcagggactgattctcgagggcttgtacgctcttaatgaggagaaggtggccattcgtgtgagggcgaaggacactgacgcagctaagaaggcgattgaggaagcgcagaaggtgttcaaggagaaggttggcaaggatgttactgtggaggtagatgaggctgagcctctgccggagggatctgctggaggtgtggtca

SEQ ID NO: 4539 - DNA, 737 bp, Aspergillus oryzae
  misc_feature (1)...(737): n = A,T,C or G
ggaatgcctgatcgccgagtgtacaatggctccgaccaatgacaacattgccgccgctacgcatgccttgcatgcagatgaggcgctgaacgtggtcaccgatgtagcccctccgctgcacctttccactacgttccggtaccctgatgatcccgaggaccttgtgccggcagcagatctcagtggttatgaccaggacaaaaccaagcatatctactctcgtctgagctcgcccaatttgaaccgattcgaagtcctcctgtcttcacttctccacggcgaggcgatcagttactcgtccggactatcggccttgcatgcggcactcgtcctcctgaatccccgccgaatcgcagttggaaatggataccatggatgtcacggtgttattaagctcttcggccgtcttaccggtcttcaaaagctggacctcgactgtcccgctgagcaattagagtcgggagatgccatccttctagagaccccggtcaaccctgagggcaccgctttcaacatcgaagagtatgccaagaaagcgcactcgcgcggagcgtatcttattgtggatagcacctttgctccgccgggccttcaggacccgttccaatggggtgcagacctggtcatgcattccggtaccaaatactttcgcggacacagcgaccttctttgtggtgttctcgctacacancggantgattgggcgcggcggcttgttcaggatttcgatgtnctag

SEQ ID NO: 4540 - DNA, 657 bp, Aspergillus oryzae
cttggaaaagagtgcattttattatggctcgcgagattctcaaggcggcaaagtccgcatcgaatgtcatcgctgttcataagaaatacacacttcaatccaccggcatctgggagcgtgttcgccgctttctttcgattgatcccaatcgctcaacaggtgttccattgaacgcccaatatcgtctaccgacccccggagctctccctcctctttcctatgacgatccggttaccgttccggctggtgatattgccgacaacccttattggaagcgtgatattcggaggagttaccctaagcttagcactgtgagccaagcagattctgtcggtcttctcaccgtaggcagccaggcagcaccaaaggatgatattctacagattggtgaagcaggagaaaagcaacttatctctatcaagcagcagggagaagaacgcggtctggctggcctttttgagaaggataagaagggcattcagggtgtcttaaaggccaatggtttgccgccgaagccttgcaatatgaacccgtcaggttccaagtatcagcttgatcatgaccatggctaccccaatgcatatccctgccgcacatttgtttgatgatgcatttcgagtagagattgaatatatcgcattcttctttaccttccac

SEQ ID NO: 4541 - DNA, 722 bp, Aspergillus oryzae
ccacacctatctatctcactctttgaggataatccgacaaggagaacaccatcagacaaaatgtcggacggagaagagactgtttccaaccccgttgttgccgccgatgaggtcgaggtcagcgccgacgccggcgccggtggccagatgtcggtcctcgacgccctcaagggtgtcctccgcatctccctgatccacgacggtcttgcccgtggtctccgtgaggccgccaaggctcttgaccgccgccaggctcacatgtgtgtcctcaacgagggctgtgaggaggaagcctacaagaagcttgtcattgccctgtgctccgagcacaagatccctctcatcaaggttcccgatggaaagatgcttggtgaatgggtcggtctttgccagcttgaccgtgagggtaacgctcgcaaggttgtcaactgctcttgcgtcgttgtcaaggactggggtgaggagtcccaggagcgctctgtcctcctcaactacttccagactgagcagtaaattcgctctttggaggtagggtagggattgtggggtcatgataggctaattcgggttcgattgatggaatgggtgtgtttgtgggtttcttttttctgttttcgggagaggtcttccctatgtctcatcactggtctgttgattgggggtgagtccctgtctttgaccatgatctctatttttttttttttatcctagtataggccaaa

SEQ ID NO: 4542 - DNA, 679 bp, Aspergillus oryzae
  misc_feature (1)...(679): n = A,T,C or G
actcattctgcgccaggggaaaggatcagtctttggccatgtcggttaccccaacgtcggttaatccagtacaatcaacgcccttctcggagccaagaaggtctcggtgtccgctacacccggtaagacgaagcacttccagaccctgtatctctcgccggagatcatgctctgtgattgtcccggtctggtgttccccaacttcgccacgactaaggccgacctggttgtcaacggtgtcctgcccatcgaccagcagcgtgaattcaccggtccagcaaccatcatcggccagcgcatccccaaacatttccttgaaaacgtctacggagtcaccatccatacccgccccatcgaagaaggcggcacaggcatccccaccggcagcgagcttctgcgcgcctatgcccgcgcccgtggcttttccactcaaggtctgggccagcccgatgaatcccgcgccgcccgttacgtnctgaaggactacgtcaatggcannactctcttctgccacccgcccncagtgccagagggccagaccnccattgacccctacgagttcaacgtcgaactctacgacatagccccacctccccgcgaggcgacaagaaacagctctcanggccatgcaagcagagcaactggnccgagacatcgactncgacattctttctatgcn

SEQ ID NO: 4543 - DNA, 789 bp, Aspergillus oryzae
gggattttatctggttagctcttatcgacagaggactacagaatataacaggtgaccggataatcttccattagacataagtcatcgctcgataacgcctttttcctgcctggtactaacctgtagtactaggcccaggcatatcgagagcgaattttaattataagaaaacgctagctaagcaaaaagttgcttcactctagataatcatcacttcggaaaacgaggttccgagaataatcacaggtgagccaagacagccttggcacccgagaccttaaccacacccctttcgggctcgatctgagcataggtcaccttgccatgatcgatgacaatggcatagcgaccggtgcgaccgttgttggcccagccgatgctgtccgagaacttggcgtcggggtcggagaggaacagaatatcgttattttccaccttattggcctttccccaggcgctcatgacgaaggggtcattagatgcgacgacagcgacaacctggacgcccttttccttcagctggggcaggttctggatgtatccgggaacgtggttgacggagcaggtgggggtgaaagcgccaggaacggagaacaggaccaccttcttatcggcccattctttggaggcgttgtaggggatggggatgccgcaggcggtgatgtcgcccttctcctcggtccaggggacgtactggaagacgacgttctcggggaaggaatctccgggtttaagggccatggtgactgatgggtatggtgatggtctgagaagtggtgagaggtgaga

SEQ ID NO: 4544 - DNA, 736 bp, Aspergillus oryzae
  misc_feature (1)...(736): n = A,T,C or G
tgccgtcaattcgcacgaggcctaaacagcaattcaaaattggcggcacagacaccatgactacattaaagaaattgaacttcatcaccagcaacagaaacaaactggccgaagtcagagcgattctgggcaatgcaatcgaggtcgataaccaggggcttgatattccggagatacaagggactattgaagaaattgccagagaaaagtgcaggcgtgcagcggaagtgatcaaaggcccggttctcacggaggacacggcactggagttttatgcactgaaagggcttcctggcccatacatcaagccatttcttgatgttttgggccatgaggggttgaataaaattctcgattcgttcgaggataaatcggcagatgcgatatgtacattcgctttcagtcacggccctggctcagagccaattttattccagggaagaacgaagggtgtaattgtcagaccgagaggtccatcaaactttggttgggatccgatttttgaatatgaagggaaaacgtatgctgagatggacaaggaggagaagaaccaaatatcgcacaggtataaagctttggagaaattacagcgttggctggtccaggaaaaatcctaatttctcagctccgcggcggacgacgttgataggtggtgcatctctaaaatatttcaattcgcgttgaaggtttggttgattttccagaagatactcaacttgagattctttcgcagttn

SEQ ID NO: 4545 - DNA, 647 bp, Aspergillus oryzae
gctggaactgcgtggcgaaaatatttccctttgctatcgcacctatgaattcctcctcgccatatgtggctgtagcaacagaccaaccatctttctccagtacaccaggtgtgtaaaatgctgcataagagtgaacatagtaatatttgctgtctgggctcaatccacagaaactttgagctcctaaaggaccaacactggtgttcatggcagaattccaacctatgtggggtacactcttcgcactgtcatcgaatttgctcattcgcttttgtatcagccccaacccggggacatcagggtcctcctcggacccttcaaacagtgcttgtagaccgacacagatccccatgaaaggtttcccagaatctatgtgcttctttatcggttctagatacccgccctctgaaagctgagagagacaatggccgaaatggccaactccgggcagtataagtttctgcgatacgattaatgcactgcagatcttcgggatttttaacccattcaacatcatacccaactttgttaattgcattcaccaacgaacgaacattcccggcaacatagtcgagcagatggacggtgggcatggcggcggggttgagtaattccactattcgaggggctcgctatgtcaaagataa

SEQ ID NO: 4546 - DNA, 686 bp, Aspergillus oryzae
  misc_feature (1)...(686): n = A,T,C or G
gagaaggaagatgcgcttttcacgcctgaaattagcaatcattcggcggaggcgatgaaagcatctagtcgactaccgttacaggtgctgaaatcagtaaactccaggaaccagaagaccaacccggttgcgttatggaaacttgccaatcagaagatctcccaattcgccttctctcccgatcaaaggcatctggctgtggttctagaggatggatcgctacgcgtgatggactatcttaaagaagaggtcctagacattttccgtagttactatggaggcttgatatgcgtttgctggtcacctgacggcaaatacattgtgacaggtggccaagatgaccttgttacgatatggtcatttccagagcgcaagatcgttgcacgatgccaagggcacaattcctgggtctctaccgttgcattcgacccatggcgctgtgacgagaggacataccggttcgggagtgttggggatgattgcaggctgctactgtgggatttcagtgtaggcatgctgcatcgccctagagctcatcaagctagtgcctcgcagcgcaccagcatgattgcagcaatacacagcacttcaatcgccacagagccgacagcgcaagcaaccggatgaggtcggattctcagcgaactgcagacacctacaacgattatgactctgctgtncgtcat

SEQ ID NO: 4547 - DNA, 665 bp, Aspergillus oryzae
cagcctcatcggtactaccctcgagatacctcttatcccgtctctcgatttgagaatctcgaatatcaaccgccaaaatggtcaagacttccgtcctcaacgatacgcttaacgcgatcaacaacgccgagaaggctggcaagcgccaggtcctcgtccgtccttcctccaaggtcatcgtcaagttcctgagcgtcatgcagaagcacggctacattggcgagttcgaggaggtcgatgaccaccgttccggcaagatcgttatccagctcaacggtcgtctcaacaagtgcggtgtcatcaacccccgctaccccgtccagctccgtgacctcgagaagtggaccacccagctccttccttctcgtcagttcggtttcgtcgtcctgaccacctccgctggtatcatggaccacgaggaggctcgtcgcaagcacgttgctggcaagctcctcggtttcttctactagacgaccaacgaaaagtttatgtcttgaatagtatcgggagtaatgtggcctggtgaggtccgagcgaggaatgtgctcaggagcaacagtgtcttggcgaggagtttacggataccctggcagaaacgccatagatagcctatgtttgagtgatcttgctcaattcaaccaagtcattttgttccggtcaaaaaa

SEQ ID NO: 4548 - DNA, 711 bp, Aspergillus oryzae
  misc_feature (1)...(711): n = A,T,C or G
cacaggaaaggaggactacgatcgggcgtttcccctgtttgtggcagctagcaagcacgggcatgtcgaggtctgttaccggacggcgctattgctactaattcggctggggaaccagagttgaagcggtgacagcccaacaattctatcgtcaagccgcgtcgaaaaaccatccaggcgccatgatgcgtatggcaaaggcttgcctggcgggcgatatgggactcggcaagcggtatcgtgaaggcatcaagtggatgaaacgtgccgcggaatccgccgactcacgagacaattctgccccttatgaattgcgtttgctgcacgaagagggatacggtgacgatgttttcccggatccttcttatgcagcacaactctttacgaagtcggcggatctgggacatgttgaggcgaactatcgccttggggatgcttatgagcacggcaaactgagttgccctcgagatcccgccctgagcattcatttctataccggagctgcgcaggcaggccatccattagcaatgatggctctctgtgcatggtacttggttggtgctgagcctgtgctggagaaagatgagagcgaagcgtacgaatgggctaagcgaccagcagaaaccgggcttgcaaaagcccagnatgcggtgggaaatttcatctaatgggnaatggggttgcgtcgtgacaatttggcacgcaaggttt

SEQ ID NO: 4549 - DNA, 732 bp, Aspergillus oryzae
  misc_feature (1)...(732): n = A,T,C or G
nggcgctcatctcgtgcatcactatacggcgctgtgtctcagcctctcaccacctctaaacggtaccaacttgccttggttgtctcagtacggatgggacacggcgatcagcggtgttcctcactggtcagtgacttgatcctctgcttgggcgatgatgtctatttggactcccatgacgttgacaccgccatcatcgagtgtcaatcctgtggtgcctaaagagtggcgtattatcatggacgtgtacctggtctcctgcggactaaggctccttcgagatcacctatcgactgttcgccaacaagttgaacatcacgcaagccgtggtggatatggagatcattccgtcagtcgatgccaatgcgaccgtggcgaatgtgatcgactgggactcagcggtacgaaccgactttgtggaatcgggtcaagatgacagtgccctcttttcggctgtgcggccctggggaatctccaacgtcactgcatatatctattcgaacctgaccggatcggccaacgtcgacctgttttcttaggctctcgccgcctggcaagccctaccagaaactcccacttatcttttaggggggcgaatcgccatgggatatttatagggccgggaccttcccctgtaaaccaatttggtggcgttaccttgaccgatcctttccgttaaccgaaacctaatcgcccttgtactcttttgtaaggggggtgggttttgattaa

SEQ ID NO: 4550 - DNA, 650 bp, Aspergillus oryzae
gagggacacaattgccataatgtcgcttttcagagctggaaacttcgcctgcttcagagctggtcggcttgccgcgcctataaatgctcgtttcttgtccaccaacaccggtcgaggcgacccttccgtgaaaaccagccctgctgatgccccggcggtaccccccaaggacagctcattaattcgccaggagggccctgctgaggcaatggctcgccaccagccggattacgaggccacaattgatcacggcacctcgaaattctctcctgtgcctaagcgtgtcatggatggaagcgagcccggtgacaccgttccagctgctgttctttctggtgctcctaccgacctccaggctcgtactgtcagaatctaccgcccctcgaagcccgccacgcaatccggtacctggcaccagcaccactggcggatggattgggatgtgttgcagaagggccaccgctgggaaaaccctctgatgggttggcaatcgtctgctgataatatgcagggcactcatctgaacttcaagtccaaggaggatgccatcatgtttgcgcagaagcaaggctatgagtattttgttcaggagccaaatgagcgcagattcgttcctaaggcttatgcgaacaacttcgttcacgaaaccg

SEQ ID NO: 4551 - DNA, 686 bp, Aspergillus oryzae
  misc_feature (1)...(686): n = A,T,C or G
cggaattgcgaaaccttcgctccggtatctatcttctctctttcctctctcacttcacttgttgatccgttcgctggggagtcacttgtgaacaccctctcctttcttctgctgatatatatgtccttaagcccggccatggctgctccccgacttttccgccctgcagctcgtctgctttcatcacgtctctctgctcctcgccgtccggccttcccccaatcggcatgcgctccctccatcctacgctcccggggctatgctacggaaggtggtgctaaggaagtcactgttcgtgatgcattgaacgaagctctcgcggaggaattggagacgaacccgaaaacattcatcctgggagaggaggtcgcacagtataacggagcttacaaagtgacaagaggtcttttggaccgtttcggccccaagagagtcattgatacgcctatcacagaagcaggcttttgcggtctggcggttggcgctgctcttgctggcctgcaccccatttgcgagttcatgaccttcaacttcgccatgcaggctattgaccaaatcatcaactctgctgctaagaccactacatgtctggtggtattcaaccctgcaacgtcactttccgtggccccaatggattccgccgccggtgttggcgctcancactcacaggactacttggcttggta

SEQ ID NO: 4552 - DNA, 790 bp, Aspergillus oryzae
tttcctggacccagcctggtatccaaatcgggcacaaggaattccgttttgggaacaccttctttttgtatactatccttttttaaaccttttcagtcttttaaactttactacacacattcacaatgggcaaggacgctggttttgctcctggtgactctgccaagggtgccaagctcttccagactcgctgcgctcagtgccacactgtcgagaaggacggtgccaacaaggtcggccccaagctccacggtctctttggccgtcagaccggttccgttgatggctatgcctacaccgatgccaacaagcaggccggtgtcacttgggatgagaacactctgtactcctacctcgagaaccccaagaagtacatccccggtaccaagatggccttcggtggtctcaagaaggctaaggagaggaacgacctcatcacttacctcaaggagagcactgcttaaatgctccattttacgtgaataaaatactttctccttcccagttcaagcggcttgtcgcatcggatctgatacgtccccagaccctcggcagtttgacggacagggcatgtaatattactcaataccttgtttacttgcaatagatgtgatttttcctttgtgcgcaggatttgcgggtttcatagagatgtgtttccttcacgaccttgtctatgtcggcccataaccttatcacatttccctctcgatggtcatgtttttcagctctgtgtatcatgggtaagtttcagggccgttggctgtaatgaataaagatatctcctctc

SEQ ID NO: 4553 - DNA, 521 bp, Aspergillus oryzae
cctgcccacaccagattgagttgaagcaacttttctgcaacctccgcaatacccgtattcacagccaaaaagacctgacccccgagaatcttttcgttggagttggctccgacgaagccatcgatgccctgttaagatgtttctgcgtgccgggaaaggataagatccttacttgcccccctacgtatggcatgtatggtgttagtgcgcaggtcaatgacgtggatatcgtgaaggtgcctctggatgtcgagaatggtttccagctacagccggaaaagatcatcgagactctgtctgcggacgactcgatcaagatggtgtacatctgctcacctggtaaccctacagccaacttgatccgcaagtccgacatccagaaggtgctggagcaccctacatggaatggtgtggtcgtcgtggatgaggcatacatcgacttcgccctccgaggctccaatcttcgccgatgggtcaacgattgcccaacttgttggtattcaaactttgagtagggcctt

SEQ ID NO: 4554 - DNA, 655 bp, Aspergillus oryzae
gtgtactgttgaactaccttagagacgcacatctccaatttactccgttgcctatttttgaaccctttcgtgcacactcaaccgacaaaatgtcttccgaaaagaaggataagctcgagccgcaaatcaagtccgtcgatatgacggaggatatgcagcaggaagctgtcgaagttgcgatcgaggcaatggagaagtaccacattgagaaggacattgcccagtacatcaagcgagagtttgactcgcgcaaaggagctacatggcattgtgtcgtagggaggaatttcggaagctttgttacacacgagacgaaacacttcatctacttctacctcggacactgcgccattctcctcttcaagacccaataaactcgccctgacatacatggttggaaataaaaagaggaccgagtccttgggcgattgggccttgactgccaattgggacttaccgacataaaatagacgccggcgacgtatctatctaaaactcgcgacacgatggacaggcccctgagatcaggcgtcatggcaattggttgctgcataatcttccctttccttcagcggtatttatttacaatttcgactcttacatgattcaatatggtcaccattggatctggatgtgagctagattggtcgtacca

SEQ ID NO: 4555 - DNA, 725 bp, Aspergillus oryzae
  misc_feature (1)...(725): n = A,T,C or G
cggcgctcatgtactgtagcaatnncgcacgatggttgatacgactctactcgactgggatggtcccgatgaccccgcgaacccttttaactggtcgactccaaaaaaagcacggcagttagtcttcatggcattcaatacttttgtcagccctctagcatcctccatgtttgccccaggcgtccaatatgtcatgcgcgactttcacaccaccgaccaaatgttgggatcgtttgttgtttccgtctacatcttgggatacatgctagggcccttcctcatcgcgcccctgtcagagatatatggccgtgttccgctataccatgcttgcaatgtgatctttctggtgttcactattgcttgtgcagtagcgcaaaccttaccccagttgatcgtgttccgtttattcgcaggtatcgctggcgtttgccccatcactatcggctctggaacggttgccgacatggtgccggtggagaagagagccggtattatggccatctgggctctaggacctatcttgggacctgttgtcggacccattgcgggtgggttcctggccgaatccgtgggctggcgatgggtgttttggggccttgcgatcggcggaggtagctctactgccgcttgcccatagagtaaaatgctgacaatccagacccggggtatgacgaacgggggttgcttgcctattgggaatggatgccccggggcttttacaacgg

SEQ ID NO: 4556 - DNA, 674 bp, Aspergillus oryzae
tgaagcgcatgaccgaaggaagagaatccttgggtggcagtggacagccggattctaagagacgggcattgacgagcgaagaagccgctgcgcgcttccgcgatggcctctttgaaccctcggagcagcagaagtataccgatcaatacgccgagtccgcaccgtacaagcatggagtcatccatcccctaatcgagccttccttgctacgcgcggtccgcaacgaaatccaagagaacttggacttcaccgagaaagagacggatatttacaagatctttcagtccggagatctggcgaacctggacgggctggacgatgcatctctgtcgcgactcccctccctgctgaagctccgtgatgccatgtactccgcccgctttcgtgagtacctgtcgtccgtgactggctcgggcaagctgagtggtcgcaagaccgatatggctatcaacatctacaacgagggatgccaccttctgtgccatgacgatgtcattggaagcagacgtgtcagctacatcttgtatctgactgatccggacaccccctggcaggcggaatggggtggtgcactgcgcctgtaccccacgaccacgaagaaggatgcacagggcgaagacgtcaagatccccagccccgacttcagtctcagcatcccgcccgccttcaaccaa

SEQ ID NO: 4557 - DNA, 696 bp, Aspergillus oryzae
aatatacttttcaatcgccgagcggtcggagtccaggggttgcgacaaaccaagcttcacggcctgaaagaagctattgaaaaggcgcgcgtcgagaaagacgaatatgagatcgctcttttgcgaaaggctaatgatatctctgccaaggcacatattgctgctataagagcttcaaagactgcagtaaacgagcgtgagattgagggcgcgtttatcgcgacgtgtatcgctcatggtgctcgtgagcaatcttatcaccccatcgttgcttgtggtgcaaacggtgccacccttcactatggcaagaatgatgatgacctgacggatcctgcaacgaagcaaaggaagaataacattctcattgacgctggaggcgaataccgggcatattgctcggatataacgcgcgtgttccctttaggtgggagcttcacaaaagaaacccgccagatttatgagatcgtcctacaaatgcagctggaatgcatcgcaatgctcaaaggagatgtgcaatgggaggatgtgcatgcgcatgcacaccgtgttgccatcaagggcttgctcgctttggggattctaagtggctccgaggatgaattgttcgagaagagaatcagcgtagcgtttttccctcatggtctcgggcactatcttgggatggatacgcatgacactgggggcaatccaaactat

SEQ ID NO: 4558 - DNA, 618 bp, Aspergillus oryzae
caagtcattgtcgacatgatcataggaagaagccaagggccgctttgagtcgcgtgcggcggtccctggtcacttccaacagggtggcaagccctctccgatggaccgaatccgtgccctgcgcatggccatccgatgcatgcagcacatcgaaaccttctccggcaagtccgccgacgagattgccgccgacgagctttctgcgaccgtcatcggtgtcaagggatcccaggtactcttctcccagatgggcggtcccaacggcctggaagcgaccgagaccgactgggcccgtcgtcgcccgaaggacgaattctggctcgacttgcagagcaccgtcaacattttgttcggtcgcgccagctttggcgagggcaagacgggctggtcttgctacgaaaactgttaaacgttggcataagaacaacaacttgcactgttaaaggcgttaatgaaagtggggtggttagattccgtgaaccgcgggaagactggtcgttttcccttttaatactagggcggcaagaacaaaacaaaacttgaaatgcagggatggctgcttcctttgtttcatgacagacaggatttattgattgaaaatattaatctccccttttt

SEQ ID NO: 4559 - DNA, 830 bp, Aspergillus oryzae
  misc_feature (1)...(830): n = A,T,C or G
gggaatgcttgtgcaatttatcgttgcactcttcgtcctaagaaccaaggctgggtatgatatctttaacttcatttccacgttggccagagaactcttggaattctccaagcaaggtgtggacttcttggtggaaactggatgggccaataaacacagcagctggttcctcgttagtgttgtcccggctatcatctttttcgtgtctatcgtgcagttgctctactacactggcgttctccagtgggcaattggcaagtttgccgtattctttttctgggctatgcgtatctcgggagctgaggctgtagtagcagctgcatctccctttatcggacaaggcgagtcagcgatgctcatcaagcctttcgttccctatcttacgatggcggaaatccaccaaatcatgtgctccggattcgctactattgcaggatcagtcctggtgtcctacattggaatgggtttgaacccccaagcgctggtgtcctcatgtgtgatgagtattccggcatccctggcagcatctaagctgcgttggcccgaagaagaggaaaccctgacagctggccgtattgtcgtccccgaagacgatagccacaaagcagctaacgccctccacgcattctccaacggagcttggatgggtattaagattgcaggcatgattgccactacgcttttgtgtattatctccctcgtaggtctcgttaacggcctgctgacctggtggggtcactacctgaacatctacgaaccggacttgaccatngaactcattgttggctacatctgctacccgattgcctttcttcttggtgtctcccgcg

SEQ ID NO: 4560 - DNA, 653 bp, Aspergillus oryzae
cgtggcttatattccacagagagctgcctttattcctttgtatttgacaccagccttgaatacctctacctaggcgaatacaagtacttgtagccatgagagcagtcgtttacactggaaaggacaccatctcggtggaggaacgtccgaagccatccctcctagaacccaccgacgccatcgtcaaggtccaacacaccaccatctgcggaacagatctgcatattctacaaggccacgttcagacatgcacacccggacgtatcctcggccacgagggcgttggaatcattgagtccttgggtaccggcgtcacacgcttttctgtcggacaacccgtcctgatctcctgcatcacgtcgtgtggctcctgcaatttctgccgcaagagaatgccctcacaatgtacatctggtggctggattctgggcaacaccatcgacggcacgcaggcagagttcgtaaggatcccccacgcatcgttctcgctgcatgcgctaccaaacggcctcgatcctaaagtcgccgtcaccttatccgatgttcttccgactgcatacgaatgcggcattctgaacggtcagatccagcccgggtcaactgttgctatcatcggcaggggttcaattgggcttgagggcgtttaaaagggc

SEQ ID NO: 4561 - DNA, 1387 bp, Aspergillus oryzae
  misc_feature (1)...(1387): n = A,T,C or G
cgaggcttcctctctaatcactcttccttcttccctctactctcgtcttcaattgcatctgtcatcatgccttccggttcagttcttgtcactggtgggacgggctacattggctctttcaccgcccttgctctcctcgaggctggttacaaggtcgtcgtcgcggacaacctctacaactcctccgccgaggctcttcgtcgcattgagttgatctccggcaagaaggctgagttcgctcaggtcgatgtcaccgacgaggcggctttcgacaaggttttcgaggcccaccccgacattgacagtgttattcacttcgctgccctcaaggccgtcggcgagtctggtgagaagcctctggactactactatgtcaacgtttacggaactctcaacctcctgcgttccatggtccgccacaatgtctacaacattgtcttttccagctcggccaccgtctatggtgatgccacccgctttcccaacatgatccccatccccgaggagtgccctctgggccctaccaacccctacggtaacaccaagttcgccgtcgagaccgcaatcaccgatgtcatcaacgcccagcgtaacaacgctgccaaggccggaaacgaggaagaaagcaagaagtggaacggtgctttgctgcgctacttcaaccccgctggtgcccaccccagtggcatcatgggtgaggatcctcagggtgttccttacaacctgcttccccttcttgcccaggtcgctaccggcaagcgtgagaagctccttgtgttcggtgatgactacaagtcccacgacggcactgccatccgtgactacattcacatcctcgaccttgccgatggtcacttgaaggctctcaactacctgcgcgcgaacaaccccggtgttcgtgcctggaacttgggtactggcaggggcagcactgtctacgagatggtccgtgccttctccgcctctgttggccgcgagcttccctacgaggttgctccccgccgtgctggtgacgtccttaacctcaccgctaaccccacccgcgccaacaccgagcttggctggaaggctgagcgcactctcgagcaggcttgcgacgacctctggcgctggaccaagaacaaccctcagggctaccgccaggagccccctgctgagctgctggaacagctgaagaaataaattattcttaatgtgagcaaatgatctaccggtggatgcttagatctatgatgcgaaggtggacggatcatcgaaatcgcccctcgatagacacaaaaagcctgtagattggttgagactaatttctnttcttgtttcttttgttgagccacatatctttgcttaaccgaataaatagctatgatggggctgctccagaatttcg

SEQ ID NO: 4562 - DNA, 993 bp, Aspergillus oryzae
  misc_feature (1)...(993): n = A,T,C or G
cgagtccaacagccacccaatgctgccggcggatgcagagaaggtcaattaccgaaaccccgggtttttgggcaagttctgggaactccagaaggtgatgtggacgaccaacgcgggattgacggagtcccatgcttgggattcgcgacccccgtcgtggccaacgctgctccgtggcattaatttctggggcgctgatcatcgccagatctacctccttggcaacccacttatctggtggtcctcgacattggcaattggcatctacgtactatttaagggaatctccatccttcgctggcaacgtaattgtgcggactatcggaacgttaatttcaagagatttgactacgaggttggcacaagtgtcttaggatgggccttccactatttccccttctacctcatggcccggcaactctttctccatcattatcttccagcgctttactttgccattatcaccttgtgtcaagaattcgacttccttgccaaccgtatccatgctcttggactagcatccaggcccgccattggcaaggcgttggccggtattttcctcgcactgagcatcttcactttcacactttattctcctttggtctatggcaacccctggactccagacgcttgccgcaaggtgaaactattggacacctgngatttcgactgcaacactttccatactgaccttggccaatatgtaacccactttacaaataccaatgtcgctataccaacaacacaggcacctcctcctgaggcccctgtagcccctccaccacagcaagaccaacaaatcctcaaggaagaagcggaagaagcggacgacgctaatgttaccccggagccccagccccctcgtgctaaggcacgggttgaataccgtgatcaggatggcaatattttggacgagaagcttgtttgccgcctttgccagganggcaaagtatnctttgagactcgcatgagactcgtactcgcttggagcag

SEQ ID NO: 4563 - DNA, 674 bp, Aspergillus oryzae
ctgaatacgactttgatgtctcacattagagatcgactccctgatatcaaagcccgtttgaataccctcatgggtcaaacacaacaagagcttgctaactatggcaataaacagttcaatggcaagggacatcgcggttcaatgatcctgcaactaatgacacgttttgcctcctcctttatatcctccaatgaggggacttcaactgaaatctcaaacacagagctttgcggtggtgccagaatctattatatattcaactccgttttcggcaaatctcttgagacaattgatcctacacacaacctgacagtgtcagatatcagaacagcaattcgaaactcaactgggcctcgtccgagtcgcctctttgtccctgatcttgcctactagttgtcgggcaccctcagagcaggttgtgggcccacttagtccagtatgtgactagcttgcgatggaggaacttaaaattgcttgccatgacggcgaaaaaaatccacccctttccttgccaggcctaaaaggctattttagtgaggtacgaccccccctccttcgggagcggcttggggccttggacaagaagaaggcggggtcccctgaattccaaagcacgggtgccatataaaaatacaaacccatctcttatttttccggggggcggggggtctttt

SEQ ID NO: 4564 - DNA, 801 bp, Aspergillus oryzae
  misc_feature (1)...(801): n = A,T,C or G
gtcctcgcatctcacctctccaactacacatatactcaaaaccctcaaccagaataccaattagaccacccaaaatggccaccacattctccctcccacctctcccctacgcctacgatgccctagaacccgtcatctgcaaacaaatcatggaaatccaccaccaaaaacaccaccaaacctatatcaccaacctcaacgccgccctctccgcccaatccaccgccctcgccgcaaacaacatcccccagctcatcaacctccagcaaaagatcaagttcaacggcggtggccacatcaaccactccctcttctggaagaacctggccccccacgcctcccccgagacgaacatcgaccaggccgcccccgtcctgaaggcggccatcgaggcccagtacgggtctgtcgagaagttcaaggaggcgtttggggctacgcttttggggttgcaggggagtggatggggttggttggtggctaatggaccggggggcaagttggagattgtttcgacgaagaatcaggatccggttacggataaggtgccggtttttggggtggatatgtgggaacatgcttattatttgcagtacttcaataacaaggcctcgtatgtggagggcatctggaaggtcctcaactggcgcactgcggaggacagattcaagaatggggtggagggctctgcgcttttgaagctgtagatcagtcgaagtctgagtctttctgcttagcaagtagacaaacataaatatgaatatgcataaataaaacccctttnngnaanagaaannaaaa

SEQ ID NO: 4565 - DNA, 654 bp, Aspergillus oryzae
  misc_feature (1)...(654): n = A,T,C or G
cctgtcttttctcaatcaaactcgtcgtatcttacttccacataaacacacattcaaaatgcctcgccaattcttcgtcggtggtaacttcaagatgaacggtactgcggaaagcattaccgccatcatcaagaacctcaacgaggccaagctcgacgagaccaccgaagtcgtcgtctcccctcctgctctctacctgaccctcgcccaacaggtcgccgacgagaagaagaaggttgccgtttcctcccagaacgtcttcgacaagcccaacggtgctttcaccggtgagatctcggtttctcagctgcaggatgccaagatcccctggaccatcattggacacagcgagcgccgtgtcatcctgaaggagactgacgagttcattgctcgtaaggttaaggctgccattgacggtggcattagcgtcattntctgcatcggtgagactcttgaggagcagtggtctaaggtcgtcattgcctacgagcccgtctgggccaatcgtaccggcaaggtcgctaccaaccaacaggcccaggaagtccaccccgccattcgaagtgggctcgccgatgccatcttgcccgaggccttcgaaaacaacccgtttcatctacggtggctccgtcagcgaaaagaacttgcgcgagt

SEQ ID NO: 4566 - DNA, 672 bp, Aspergillus oryzae
cttagctgatttgaagccatttgacatcaattgattttatagcagccacaatgttcgcccgacagtgctcacgattggtgtcttcccggactgccgtccccttgtcttcgtatctttcccgtgttaggccgtattcctcggcatcaggatatgagcacatcctgacctccagccccaagcctggtgtcgggctgagtattcacattgaaccgccctaaagcccttaatgccctttcaagccccctcttcaaagagatcaacgatgccctttccaaatacgatgaggacaaggatattggcgccatcataatcacagggagtgagaaggctttcgctgctggtgccgatatcaaggaaatggcgcccttgaccttctccgctgcctacagcaacaacttcatcgccccttggtcccaccttgccaacaatatccgtaaacccgttattgccgcagtgtctggctatgcccttggtggtggttgcgagctcgccctcatgtgcgacatcatctactgtacctcgaatgccaccttcggccaaccggaaatcaaactaggtgttattcccggcgctggcgggtcgcagcgcctgactcgtgcggtaggaaagaagcaggctatggagctgatcctgactggaaagaatttcagcggcaagggagcaggagaatgg

SEQ ID NO: 4567 - DNA, 673 bp, Aspergillus oryzae
cagcagcgccagagtggcataccaaccgttgttcatttcctctcgtgttttattaccttcttaattgtattcattttaataaaagtttctctttcaaaatgtctttctgggactcactcagcggccgcaaacaatccaagggccccgaattcgacccttccactgcgcaagatgctacgtcgttcctctcggaagtcgccattcctgatcctacctctctccaccccttggctggcctgaaccaggataccctcgattatatcaccctcgaagactccgcccttgatgaaacacctggctcgcgatcacttttgccatcgcgtggatggtccgatgacctgtgttatggagccggaacaacgtaccttgccggtttgaccattggaggagcatggggtcttgctgaaggcatgaagaaggtgcctgcgacagcaccccccaagattcgcctcaacggtgtcctgaacgctatcacaaggagaggtcctttcctcggaaactccgccggtgtagtggctatggtatataacggctttaactccggaatcggatatgtgcgaggaaagcatgactctgccaacagtgtcgttgcgggtgccctaagtggtatgctcttcaagagcaccaggggtcttaaacccatgatgatctctggcggtattgtggcttctat

SEQ ID NO: 4568 - DNA, 659 bp, Aspergillus oryzae
  misc_feature (1)...(659): n = A,T,C or G
cagatcttatcaacgctggaaaggagaccgttacactcgcacccggtgcggcttgctttggcagtgacgagtccttcggcatgatccgttcaggaagaatcgacttgaccattctgggcgccatgcaggtgagcgccagaggtgacttggctaactggatgttgcccggtaagatcaagggctttggcggtgctatggatctagtctccaacccctccgctacgaaggtggttgtcactatggagcacactgacaagaagggcaaccccaagattgtcaagcagtgcgagttccccttgaccggcaagacttgtgtcagccgtatcatcactgaactctgtgtctttgatgttgacttcactgacggtcttaccctggttgagcttgccgatggtgtcactgttgatgaggtccgcagcaagacagaagctccgttcaaggttgctgatgatgtgaagcccatgctgtgatcacgtcctgttatcatttttttgtttgcatgtctggatgtcaccatttcgcgaaaattatgggatttataagcgtatagtttgtgaagtcatgtcgggtacgggaatctgtgtatataccatttcattccaaaaaatagttcagaccttttnnnanaaaannannnnnnnnnannnnnnnnnnnnnna

SEQ ID NO: 4569 - DNA, 668 bp, Aspergillus oryzae
  misc_feature (1)...(668): n = A,T,C or G
gaacaagacaggcaaagtggaagctgaaggcaaaggccccacagttgagaagcttgagaacgccatccagaaacttgaacagcgtattgagaccatggaattgcaggctcaggacaaggaagacaataaggaagtggccctcggaacgtccaaaatcaactatatcgaccctcgtctcacggtcgttttcagcaagaagttcaacgttcccatcgagaaattcttctccaagtcgttgcgtgagaagttcgagtgggctatcaagtccgttgagcaggattgggagttctagatttttccttcccaagcagaacacacgaacgtgcgaatctccagtctctacacggttttgcatctcgttatttccgtgccctttatatttttagttgcttctatctccttctcagccacccttgtggcaggtagagggctgtgatatatgtcgcatattatggtttcgatatttccttttattttcctcgggttaatttccaaagcanatgcgcttttttggacgcttgcaaaagccgcatacacatctgtgctatacttgctttatcattggctcgctctngtgtatgtacagcatctcttcagactcgtcaacaagagangaactaagagacgggaagaggaanagagaaagaaaagaggaagcactacccata

SEQ ID NO: 4570 - DNA, 688 bp, Aspergillus oryzae
  misc_feature (1)...(688): n = A,T,C or G
catcaccctatgtcattgcgatggacagactgggtattccggttctaccgcatattgtcaatgccatggtccttggagccgccttcagtgcaggaaacagctacgtctattgcgccagcagatgcctgtatggacttgcgctggacaacaaagcgccgagaatcttcaggaaatgcacgaagaatggcgtccccatctactgtgtgggccttgtcctgctgattgcgctgcttgccttcctgcaagtctccaacagcgcatcggttgtgctcaattggtttatcaacctggttactgcatcgcaattgattaatttctctgtcgttacattttcctatacccgcttcaggaaggcgctcatcacgcaaaacgttccccgcagttctctcccgtatcaaagtctcggtcagccttacgttgcatatgcggccctggtctgtacggtggtcatggcgtttgtgggtgggtatgaagtctttttacctggaaaaagggatattcccacctttttcttctcatacaccatgattggggtattcccaatcattttctttgggtgggaactttggcacaaaacccagattccaaaacctgaaaaaattgatctgaagaccggactgatgaaattgagggatttgaaaaaaatattgtgccgtgcctgcgaccattaattctcgaggtttggcgn

SEQ ID NO: 4571 - DNA, 704 bp, Aspergillus oryzae
  misc_feature (1)...(704): n = A,T,C or G
cagctgttgccccaattgcccccgatcaactagttactgaatcatcgccaatatggaagagagggcactcgaggactttgagaagagcgacggagcgctgcgcaccattaaggatttgggtgctggtgcagctggtggaattgctcaggttcttcttggacaacccttcgatattgtcaaagtgcggttgcaaacaaccactcagtatgccaacgcccttgactgtgcgagcaagattctcaagaatgagggtcccgccgcgttttacaagggaacactaacccccttgattggaattggtgcctgtgttagcgtgcaattcggtgctttccatgaagcccggaggcgtctggaggaattaaacaagaagaaatatgccgatagtagcctttcctacgggcaatattacatggctggcggtttcgcgggtatcgccaattccgttctgtctgggcctattgaacatatccgtattcgtatgcagacccagccgcacggcgcagaccggttatacaatggccctatcgactgcatccgtaagctctctgctcagggaggcgtcctgcggggcctctaccgtggtcagaacgtcacctatctccgtgaaatacaggcttatggcatgtggttcttgacctttgaatacttgatgaaccaagatgccaagcgcaacaatgtcaagcgcgaggatatcttcagtctcn

SEQ ID NO: 4572 - DNA, 746 bp, Aspergillus oryzae
ctgtcatccaattaaccacctatctctccacattttcccactcaaccttaaacaagttaactctttaatcaaccatcaatatgtctggccgtggaaagggtggaaagggtctcggaaagggtggcgccaagcgtcaccgcaagatcttgcgtgacaacatccagggtatcactaagcccgctatccgtcgtcttgctcgtcgtggtggtgtcaagcgtatctctgccatgatctacgaggagacccgtggtgtcctcaagaccttccttgagggtgtcatccgtgacgctgtcacctacactgagcacgccaagcgcaagaccgtcacttctcttgacgtcgtctatgccctcaagcgtcaaggacgtaccctctacggtttcggtggttaaatgctttcttttctcgccttttgttttcagccatcctgcgcggtcgacgcgtcggttgtccttccgcagcagtgacgcgacgggttgctttttcgggttggtttacggtatgactgggacgttggggtgttattgatcttttaccatgggtctctgggtttgcttttaacgtattttactttactattacgcgtccactactgggtctgctagtgttcgtgattgaaatttctgtatcatagcggccttcatgctatcggctggtacctctagaaccatcgcgtcatggaaatgcgcggtctggtatgaatacgaacgcttgaaaaaaagatgaaatatttttgtgaaaaaaac

SEQ ID NO: 4573 - DNA, 1117 bp, Aspergillus oryzae
cgaggcgacaattctccctcggacattccacagcccacgcagtcaagatgcggtacattcactccgaggaacggctgcccatccccgagaatggtgagcattggatcgcccctgaatattgttttgtttcggtttttggagaactatgagaggcacacatcgcgcaatgagaggcctgggccaggatacaccagcgccgacagggtatatacgagaggaggaaatatctactcgatcgctgtcgcgggaaattacgactggtcttgttcatcgcttttgaaatgcttaggagactgactcgaattttgtcgtttagtgaagattcacattcgctcccgggttgtgaccgttgagggccctcgaggtatgcaaaaaccccataagttgaaggagatctcctataccaagaagtcgctccacaaagatggtcggcgtcatggaaaacaaccatgagcggtctgattggtttctcggctcgattcggtcactaactggacttcttcgaatctttcaggcaagcttgttaaggacctctcccacatcgctgtcactttcggccgccccgagaaggatgttatctctatcgagctgcaccacggtgcccgcaagggtgtcgctaccctgcgtaccgtccgtaccatcatcaacaacctgatcattggtgtcaccaagggcttcaagtacaagatgcgctacgtctacgctcactttcccatcaacgtcaacattgagaagaacgctgagactggcctctacgacgttgagatcagaaacttcttgggtgagaagtacgttcgtcgtatcactgcccagcccggtgttgagatcatcacttcccccaacgtcaaggatgagcttcagctctctggcaactcccttgagaatgtctcccagagtgctgccgacatccagcagatctgcagagtccgcaacaaggatatccgaaagttccttgacggtctgtacgtgtctgagcggggtaacattgttgaggaatagatgatgacggggcttgtccgccttgatgggtagttaaggatgccaggagaatctaattttcgcctatttgcatatggaagcaaagcggaattaaaagcaaaaatttatggaccatgga

SEQ ID NO: 4574 - DNA, 692 bp, Aspergillus oryzae
  misc_feature (1)...(692): n = A,T,C or G
catttttgccatcgccgcttcatggtatgtatggcaagaaggtgtcgcaaaggaccgcaagagatcgaagttgcttcttgattgcgtccttatcgtcacaagcgtcgttcctcctgagcttcccatggaactcagccttgctgtcaatacaagtcttgctgctctgagcaagtttgctatcttctgcaccgagcctttccggattcccttcgcgggacgtgttgatgtcgcttgcttcgataaaactggtacattgaccggagaagatctcgtcgtcgatggtattgcgggtcttactttgggtcatgaaggcgcgaaggtcgaaaaggatggcgctcataccgggcttgccaagggcggcaacatcgcagttgacacaactcttgtccttgcgagcgctcacgctctcgtcaaactggatgaaggcgaagtcgttggtgatccaatggaaaaagctactttacagtggctcggttggaccttgggcaggaacgatactttgacccccaaaaatgcatcggcagccgatcctttccgttcccccgagtcagttcaggtcaagaagcgatttcagttcttctcngctctgaagcgtcagaatacaattcgcacgggtatcacttatgatccgaaatcatcccagaagaccaaattcacccctctgggccgtcaaggtgcttcnngaaccattn

SEQ ID NO: 4575 - DNA, 1038 bp, Aspergillus oryzae
gaacaatgaggagctacaagcctatgcggcgcacacacttctcaattatctaaagaccgactgccacgaaagcttggtgaagatcggatgctacgtcctgggcgaatttggacatcttattgcggacaaccaaggctccagccccatcgaacagttcctggcattgcaggctaagatgattaccagcaccgacaatacccgcgcgatgattctctcatctttcatcaaatttgttaacctctttcctgagatcaagccccagctgcttcatatattccggctgtatagtcactctcccgactcagaacttcaacaacgagcttttgaatacctgtcgctggcgacacttcctaccgacgatcttctgcggacagtttgcgacgagatgccgcctttctcggagagagcatcaattctcctctctcggcttcaccagaagacggctggcacaaccgataagaagacctgggttgtgggtggcaaggacgccaatcaagatcagaaggaggtccttatggcgcagaataccgggcttaagcgtacattcactacgattgtcaatggcacgagcactggaacaaacggcacagcggcatcgccagcatctagtgcaacaggggacctagcaggactggacctcagcgcttcatctgctccgcctcccccgaatatggccagcgcagcccatcttacgccggactgggatattgggtacaaccgattatatttcaaggagcaaggtgtgctgtttgaggacgctcaaattcaggttggcctgcgatctgagtaccgtggccatatgggcgtggtgaaaatttacatctctaacaagtcgtcctttcctattggatcattaacgacgacgttagacaaccgtgcagcgcccaacctcaagatagactccaaaagcttgcccgagccttcggttccggctgccggtcaaacccagcaaacgtttttctttgaggctaatgggccattcactgatgcacctaccattcgcatctcttatcttgcaggtgcccttcaggcctatac

SEQ ID NO: 4576 - DNA, 667 bp, Aspergillus oryzae
gtgtctcagaataattccaacgctcatcgttgcttatgcccattgcgcatgggaatcgaaccctcattttatcatactgtactatacttttaactgactgagggctcaacgatgacggacaagctcccccctccgctcctcgccctctttcagcctcgtccacccttgcgctatgttactcccattgaccgtgcaccagaggactgtaagaagagtacactcggcggtgtcgcacaatatctcccggacttgaaggagtatgaagaggagtacccgtacaatgctacagagagttggatacagcgcaaattacgacagaagcaggagaagaaggaaaacatcgagaaacacttgacagaaggcattcatacattcgacccttcaaacgacccgcaagctcgtggtgaccccttcaagacactttttgtatctcgtcttagttacgatgtcaaggagtccgatctcgaaagagagttcggccgttttggacctattgagcggatccgtatcgtcaaagacactgtaactccaaagggttcgaagaaaccgcacagaggatacgcttttatcgtttacgagcgcgagaaagacatgaaagccgcttacaaagagacggatggcattcgtatcaaggaccgacgtgtcttggttgacgtaaaacgtggtc

SEQ ID NO: 4577 - DNA, 644 bp, Aspergillus oryzae
ctcaatcctgtctctttaattcaattgtcacctttgacatcataaatctttcaaaatgtccgacgagcagaccttcattgccatcaagcccgacggtgtccagcgcggactcgttggccccatcatctctcgctttgagaaccgtggcttcaagcttgctgccctgaagctctgctccccctccaaggagcacctcgagcagcactatgctgacctcagctccaagcctttcttccccggcctcgtctcctacatgctgagcggccccatcgtcgccatggtctgggagggccgtgaggtcgtcaagaccggccgcaccatcctcggtgccaccaaccctcttgcctccgcccctggcaccatccgtggtgacttcgccattgatgttggccgcaacgtttgccacggctccgacagcgtcgagaacgccaagaaggagattgccctctggttcaagcctgaggagctccagaagtacaagcacagccagtttgactggatctacgagaaggcctaaatttctctgttcgatctgaaaatctgaaaatctgctccctgatacggcttaaaccgtaagggcagcaaatgatataaaccagaaaagacgtcctgagaaatagaaatcatacaatatctacgagccc

SEQ ID NO: 4578 - DNA, 655 bp, Aspergillus oryzae
gacaatctatcttcgacaatggggacgtcacagcctactttgaggtccatcctcggaatattattcctatgtcttatccagatttccgccgcgttgaaattcgacctgcccgctgtgagcggaaagaacgagcgatgcatccgcaacttcgtctttaaggaccagcttgtcgtcgtgacagctatcgtgagcggtcagaagggtgatggacagaaggttaacattcatatcaaagatgccctgggcaatgaccacggtcgcccgagggacgttgtaggcgagactcgccagacattcacttcttcggaggataccgctttcgatgtctgcttcgagaacaagcttgagggacggtctggtgttgccaacccttatcggtccattgaactcgatgttgacattggcgccgatgctcgtgactggtctagcattcaggaccatgagaagctcaagcccctcgagactgacctccgccgcattgaggagatggtgcaagaaatcgtcagcgaaatggaataccttcgtgcgcgtgagcaaaagctgcgtgacaccaacgagagcaccaacgagcgtgtgaaatggtttgcgtttggcacaatgggaatgctgattggcttgggtgtttggcaagtaatctatctgagggccctactcg

SEQ ID NO: 4579 - DNA, 545 bp, Aspergillus oryzae
cggctctgctgcccaggtcaaggccatgaagcaggtcgctggttccctgaagctgttcttggctcagtaccgtgaggttgctgccttcgctcagttcggttccgatcttgatgccgccaccaagcagactctcaaccgtggtgagcgtctcactgagctgctcaagcagaagcagtactcccctatgtccgtttccgacatggtccctctcatcttcgctggtgtcaacggtcacctcgacaacatccccgtcgcaaagatcctccagtgggagtctgacttccttgctcacctcaagagcaacaaccctgagatccaggaggccatcgagaaggagggccaggtcagcaaggagaccgaggctttcctcaaggagatcatccagagcttcaacaagtctttcaacgcataggtgagcaaaaagcaactgggtgattagccaaccgtgtattggttggttcctgactctttgtgatagacaagaatatcttggacaatttgaaacccaattttcaaaaaaaaatagatgtttaataaagtaaccg

SEQ ID NO: 4580 - DNA, 874 bp, Aspergillus oryzae
cataaatcactcgtcacaatgggtttcaccgacttcgtttctgaggctggcctcactgttgccaacaactggttcgccaccagaagctacgttattggcgatgctccttcccaggccgatgtcgtgacctttaaggccttctctggcgcccctgacgctgagaagtaccctcacgttgcccgttggtacaagcacatcgcttcctacgaggctgagttcggctccctccctggtgatgcctctaaggcctacaccacctacggccccgaggccactgagctccccaccaaccctaaggacaagcccgccgacgaggatgacgacatggacctcttcggcagtgacgacgaggaggaggaccctgaggttgccaggaagcatgcagagaatcttgctgcgtacaaggcgaagaaggaggctaagggccctaagcccgctgccaagtccattgtcactctcgatgtcaagccttgggatgacgagaccaaccttgaggagatggaggccaacgtccgtgcaatcgagaaggacggccttgtctggagtgcctctaagtgggttcctattggcttcggtattaagaagctccagatcaaccttgtcgttgaggacgagaaggtctcccttgatgagctccaagaacagatccaggaggacgaggaccacgtccagtccactgatatcgctgctatgcagaagctgtaaatgaaacgtttatgaagggaatggtgtgatgaaagatttttcatgtgattgaacggaaaccaaagtcatgaacttaacaaataactagagctcgatcggcattgttcgattgttttgatgaaaaaaaatgaaaaaataccccaacaaaaaaaaaaaaaaaaaaattcat

SEQ ID NO: 4581 - DNA, 634 bp, Aspergillus oryzae
  misc_feature (1)...(634): n = A,T,C or G
cgcacaactcgctcgtccgaattgaagatcttcgcaaaatcatgccgtgttcccatcagcacagccagtactaccccgccgaggagaatgctgagccaggccgccgtattcgctgctttggctgctcccggtgcgttccgagagcccagcaggttgcccactcgtgccgacgtggcgacgcctactccaaacgggattgtgttgagtacttgatctgcggtcatgataacgctttgcgcggccaatgcgatggtccccagtcggcctgctgccagggccacaatctcgaacgcccaccattccgtgccaacgtgaatgacacccaggaaagctaggcgggcaaaagtacccaggttctggaacgcctctcgcgaccatccgccccagcattcggacccggcaatgaaccgggcatagaggactaacaagataaaagacagccaatacgaaatgccagtggcgaacggcgctccgagtaaacccatcccaaaggtgtaacagaataggtagttgagaagggcataaagggggatgtaacattaacacatacgttccgggacgcatgatgcctggaaaatagcaccgtttaggactgggttcagaggcggaaaatcagtcgggtcttaccttgagn

SEQ ID NO: 4582 - DNA, 668 bp, Aspergillus oryzae
cgaccgatttcaccaacttctgcggtcctgtcatccacgaggcttctttcaacaagctggcgaaggtgatcgacgaggccaagaacgaccctgagctcgagctcctggccggtggtacctacgactcctccaagggctggtacattcagcctaccgtctaccgcacttccaaccctgaccaccctctcctgtcccgtgagcttttcggccctgtcctggtcgtccacgcctacaacgacgccacggaggccgacttcaccaagatctgcgagaagatcgaccagaccggcgagtacggtctgaccggagctgtgttcgcgcaggaccgcgaggctctccgccaggcggatgacgctctccgcaacactgccggcaacttctacatcaactgcaagagcaccggtgccgttgtcggccagcagcctttcggtggtgctcgcgccagtggcaccaacgacaaggcgggcagcggaaacctgctctctcgtttcgtcagcttgcgttccatgaaagaggagttcgtccctacctacaacgttggctaccctagcaacgcataaattgtgtcatgaaagtctttttttgttaatgtattccccgatctgtatctggtttggtaatttggtgggaatggctatttctgcataaaattttggcggtcatatgac

SEQ ID NO: 4583 - DNA, 686 bp, Aspergillus oryzae
  misc_feature (1)...(686): n = A,T,C or G
ccaccttctccgacaagcttctgcttcatcctggtgtattattctccactccaccaatcaaccgtcccttcatatcataccgacaagatgagcgttaccacagccgcgcccgtggaggccaaaaccgagccccagaagctaagcggcttgaacctgtattcgcgattcgcattcgccggagccgtctgctgttccgtcacccacggaggtctcacccccgtcgatgtcgtcaaaacccgtatccagctcgaccctgtcacctacaaccgcggcctcatcggtggcttccgccaggtcatccagaatgaaggcgccggcgcccttctaaccggtgccggtcctacattcgccgggtacttcctacagggtgcgctgaagttcggtggttatgagttcttcaaacagcagtcgatcaacactatcggctatgaaaatgccagaaacaaccgtatcgccgtctactgtgtttcgtcggcttttgcggagttcttcgctgatattgcgctctgtccgcttgaggcgacccgtattcgtttggtgtcngagccgacctttgctagtggcctngtttctgggttcnggaggattgctcgtcaggagggtcttgctgggttttattcttgctttggggctattctgttcaagcaggttccgtataccatgtccaaattcgttggctaagaaaa

SEQ ID NO: 4584 - DNA, 1073 bp, Aspergillus oryzae
  misc_feature (1)...(1073): n = A,T,C or G
cgctggtgtatcgaatcgcttcaacgtccaccatcgtgctctatcacttcaaacacccgtttgacgcgacatttccatctctgcgaccttaaatctcgacgcttttcaaaatgcctggtggaaagggaaagtctatcggcggaaaggctggttcaaaggactctgcggggaaggctcagaagtcccacagcgcaaaggccggtctgcagttcccttgcggtcgtgttaagcgtttcttgaagaacaacacgcaaaataagatgcgcgttggtgctaaagctgccgtctatgttaccgccgtgttggagtacttgactgctgaagttctcgagcttgctggaaatgccgccaaggacctcaaggtcaagcgtatcaccccccgtcacttgcagcttgccatccgtggagacgaagagttggacactctcatccgcgccaccatcgctttcgggggtgtcttgccacgcatcaaccgtgcgctgttgctgaaggtggagcagaagaagaaaaacaagactgaggcttaatttacggcggataccccacgaatatggcgtttgaaatgatgacgattgaaaaggactccgggatatgtctgttacagcgatcgacctttaactggttctaattcaaacccgaccagttgcgaaagaaaaaaaaaaaaaggaaacatccaatgaggaaatggagaactagatgaattggcatctttcaggacagggatttctccaacagacgcatccccaatttttacttttccctaccccacgacgctacagttcgcgacgctttttctctcttggactctgttttcctctatgtgctccgttcataccgatggtctcgaaatactagggcgctgttaatggaaaaaggtgatatcttaacacggggatgattttcgatttttagctttttctggttcctattttttttcccccctatactttttttcccatgaaactttatttttaattgagatgcgggggttaaatggcttcccaaaaaaaaaaaaanaanaaaaaaaaaaaananntttttcttgggggccgtttgaacattccttttaaagt

SEQ ID NO: 4585 - DNA, 979 bp, Aspergillus oryzae
  misc_feature (1)...(979): n = A,T,C or G
tacgaagcttttttccgattccaaactaagccggaacttacccgctatggcgaggtttactatgagggtaaggaatacgagacgaaccttagacatttacggccgggcgagcttagcgctgagctcaaggaagccctcaatatgccacccggtgcgccccctccttggttaatcaaccagcagagatatggcccacccccatcatatccagccttgaagattcccggtctcaacgcgccgccccctcctggtgccatgtggggatatcatcctggtggctacgggaagccaccagtagatgagcacaatcgtcctctctatggtggtgatatttttggtgtattgcaaccgcaacagacaatgcagcaaggcgagcctgtcgagaaggatctctggggtgagctacaagaacccgagccttctgacgaggagagtgaagatgaagatgatgaggaagatgaagaggacatggaaacgggcgtccagactcctagcggacttgagacgccaagtgggttagcatcagctgttccctctgagttagctggcgaagagaatgtttcgggggaatttgacgtgcgcaagcactatcgaggcacacagactgaagagtctgtaagtcacaagagcgcttttcaagttatcccagagcgacaagccaatgtgcggggcttcttcggtggcgaaagggtgtatgatcttgctgcgcatccagaaaacttggcggtgcttggtgctgatgaacaaaatcggaagcgcaagaaacccggcgacgttgatgtctctatggacccagattctctacagtcaaatgagggatttagcaaagaaagcattcgaaagctttacgaatcccaaaggcagcaggaaaacaatcctagttggggattccaggaggatctaagtgatatgattgctcaagaaagccgncaaaagctcaaaagggaagaagagaacggaaccgccattgaaatcactg

SEQ ID NO: 4586 - DNA, 692 bp, Aspergillus oryzae
  misc_feature (1)...(692): n = A,T,C or G
cgacgacaggatttccgtcctgaacgccggcgggatcgctctccagaacccaagaaacaacctaaagttctggtacgaccgaaaccacgtcccaccatccctgaagaattcgctaaatcggactctgtttattaccgaaaacctggaaatgaatctgtcattggagctggcacatatggaaaggtcttcaaagcaatccacgtgtatacccagagaaaggtggcattgaagaagatacgaatggagggcgagaaagatgggttccctgtcacagctgtgcgcgagatcaagttgctgcaacacctccgcaacgataatgttgtgagcttgctggaagtcatggtagagaggaatgagtgctttatggtgtttgaatatctctcccatgaccttaccggtctcatcaatcacccgactttcacacttacggcagcccataaaaaggacctggcaaagcagatgttcgaaggattgagctaccttcaccatcgtggagtgctgcatcgcgacatcaaggccgccaatatccttataagcaaccgtggacagctaanatacgccgacttcggtttggccagattcttttcaaagagtcgacaacttgattacacaaatcgtgttatcaccatatggtaccgaccgccggagcttctnctgggtgaaaccggtacggacagcaagtgacgtttgaa

SEQ ID NO: 4587 - DNA, 723 bp, Aspergillus oryzae
tggaggatctcgagggcccttttgataacctattcgtgaaggatctttctggatgcccgggatacaaggccaccaagcactggcagactcggtctggcttttatgcggacctgactctcgcaggtccggcatgcaacgtcttcggcactgatctcccggacttgaagctcgaagtcgagtatcagaccagcgatcgactccacgtcaagatcttggacaccaacaacactgtctaccaggttccagacagtgtcttcccgcgtccgggatttggcgaatggtgctccccgaaggacagcaagctcaagtttgacttccaggccgaccccttctcgttcacggtgtctcgaactgataccggtgaagtgctcttcgcaccaccggcaacaaactggtgttcaagagccaatatgtctacctgaaaacacaccttccgcagacccccatctgtaccgtctggggagcacagtgatgcatttatgctcaacacgaccaactacacccggaccatcttcacccgtgatgcttacggaacaccccaaggcgagaacctgtacggtgctcatccaaactacttttaccacaggcaataccgggaatcacggagaggttcctgctcaacttttaacggaatgggatatctttaattgacaacaaactccaccccagtttctttgagtaacaacaatcattgggcggtggtgttcagattatttatcattt

SEQ ID NO: 4588 - DNA, 638 bp, Aspergillus oryzae
  misc_feature (1)...(638): n = A,T,C or G
cacaatatgtcgatctcgacgcttcagcctccctaccctctccatccttccgttaaggacctcttggatcccgaatacatttccttctataacgagtatgtcatcaaccagcagcaagtccatcttcaacccgtcgaagcctcccgaacaagcggggttctgatccctggcgggggtccgctcctcgaggtaggaaagacagaggatatcacgatcaagcgacgcgcgacagaaggtccagagatcctgttgcgtgcattcaccccagctggggagacaccagacggagggtggccggtgatgctgtatttccacggnggtggatgggtcctggggaatataaacacggagaatccggtttgcacaaatttgtgcgtgagagggaactgcgtcgtagtcacagttgattacaggcttgccccagagaatccctttcccgcagccgtccatgactgttgggattctcttctctggctgatttctgacggaccctcacgactctctattaatacatctaanatggcgaccggtgggctctcaacgggcggaaactaccctcaatcatcacccacaaagccttaacacttttaccacccgttcactttcttggccaagctctctctgtccagtgacagata

SEQ ID NO: 4589 - DNA, 649 bp, Aspergillus oryzae
  misc_feature (1)...(649): n = A,T,C or G
cggcagccatggtcctgaacagccaggttccaaatttgaaacaataatgccttccattgcaaagccacctgccatttcagagaatcttcgccggggcaatttcactgcaccacttgaacttggtattttacgaaattttgaatttgtctctgaacttcgacgcgcgagcgttattgtaagacaatttggtgacaatggtgctagcattttcgtcaagggtgcaccagaaagcgtcagagccatatgtcttccagatagtctgcctcaagactttgaagatctactgaaccagtacacccacaaaggctatcgtgtcattgcttgcgccgctagatacgaacagaagttgagctggatgaaagtgcaaaaaatgactcgtggagatgcagaaagtgatctggaattcataggcttcattatatttgaaaacaagctgaaaccgacaagtaccgagactattgctgaactgaaccaagcaggaatacggaccgtcatgtgcacaggagacaatatccttactgcaattagtgtcgcccgtgagtgtggcatggtcagcaaaagtgaaccatgctttataccgcacattgtagaaaggtcgtnctcatgaattggtagccttcactttgctgggagaatgtagaatattccn

SEQ ID NO: 4590 - DNA, 547 bp, Aspergillus oryzae
cgaggtctttggagttttttgctgccggcttgtcactggttctgcacccccataatcccatggcaccaacagtccatctcaactaccgttactttgagacgtcagaccctaaggatcctatcaatggagataagaattggtggttcggcggtggtacagacttaacaccctcctacctgttccccgaggatgtcaagcattttcaccagaccatcaaagacgcttgcgataggcatgatgcaacatattaccctcgattcaaggcctggtgcgataagtatttctatcttccacatcgccgagagtctcgtggtgttggtggtatctttttcgacgatcttgatgccagtttcttggagtcatctgccacttcatcacagaatcctcaggaaactctattctcgttcgtctccgatagtctggcttccttcctttcctcttatgttcctatcattgaacgccgaaaggatacgccattcacacctgctcaaaaaaatggcagcagcttcgacgtgggcgctatgtgggattcaacctggtttatgac

SEQ ID NO: 4591 - DNA, 720 bp, Aspergillus oryzae
ccgcatcgaagttgcgactgaacgcagccgcgtcaaaattcactcaatttcccagttatttgaaattcagctcgcacgcatattgtacctctcatttctgaaaacaaatagtcgctaaaatgtcaactaccacggcgacggcgatgcaaagctctcgcccgcctatcatccctaaagatttctccgctcagcaacctcaaacaattcgtctatatccactttccaattacacattcggcaccaaggaaacgcaaccggaggaggacccctcagtcctggcccgtctaaagcgccttgaggagcattacgaccaacatggcatgcgacggacttgcgaaggtgttcttgtttgccacgaacataaccatcctcatgtgttgatgctacaaatcgccaatgcctttttcaagcttcccggcgactatcttcacttcgaagacgatgaggtggagggtttcaagaagcgactaaatgagcgccttgcgcctgtcggttcgcagttctcaggagaaggtgtcaacgaggactgggaaatcggcgacacacttgcgcaatggtggcggccgaattttgagaccttcatgtatcccttcctgcctggtcatgttacccggcccaaaggagtgcaaaaagttgtacttcattcagctgcctaagaaagaaggtctctcagtaccgaagaacatgaaagctcttgctgtgccgctgttcgaactggac

SEQ ID NO: 4592 - DNA, 698 bp, Aspergillus oryzae
  misc_feature (1)...(698): n = A,T,C or G
ccgtgaagcagaaacaacccgtgcggcagcttctgcggaaggccaacatcgtgatgcaatcaacgcaattgcgttcaatcctgctgcagaaaccgttctcgcgacaggctcagccgataaatccattggcctctgggatctgcgtaatctcaagactaaattgcacacactcgagtgccataccgactccgtaacttccttgtcttggcacccatttgaggaatccgtcttggctagtgcaagctatgatcgtaaaattatgttctgggatcttagccggagcggcgaagagcaaacccctgatgatgcacaggatggaccccctgagctcctcttcatgcacggtggccacaccaaccgtattttttgatttcagtgggaaccttaccaaccaatgggtcctgtgtcctgccgctgaaaacaatctgctacaggtgtggaaggttgctgatgccattgttggtaaggacttggaggatgtgccaaccgaggaattagaggcctaattaacttcatgtcaatatcccgattcccttggattccatcacctgatgccggaaatattctaagatcttgctcaagtgctgcaaattggacgaaaatatcaatgagaaaagaaatatgtgagccttgtgttaaaacggaaggtttccctttcncggtttggataggcctcacccaaaagaacaattttaccc

SEQ ID NO: 4593 - DNA, 717 bp, Aspergillus oryzae
tcgcatgtggtgatgcgaacgtgatgttagctggcggtgctgaatcttgcatccatccgctagctgttggaggctttgcccgggcgcggagccttgcaacgagctataataatgctcctgagaaggcgtctagacctttcgatgcggatcgcgaagggttcgtagtcggcgagggcgccgaaatagttattctagaggagctagaacatgcaaaggcaagaggtgcacgtatctacgccgagttgagaggctatggctgttcatgcgatgcacatcatataacagcgcccaaagaaaacggcgaatgggcattcatggcaatgagaaaagctctgaagaacgccgacattttcaccgtctatggttgaataccttaatgcacacgccacttccactgtagtccgggatgccgcaaaaaacacccactaacaaagaacttcttttttggtccctgaacgaaagctaaaatgcccagcgacttaaaatattctccaacaacccaatggcgcctattaggtcacacttatttagtaggcacctgtgctccaaagcaaacactcggtttcaccatctcattgtctattatagaggaacaaaaaagacctctcttcattttaaaactttgaagcgcacttaccaactctgatttacatcacacctagtttcccgatcatctacgcccatcacacgaccaataaacatcacgattcaccaccc

SEQ ID NO: 4594 - DNA, 695 bp, Aspergillus oryzae
  misc_feature (1)...(695): n = A,T,C or G
ggatgattcataattaatcatccccgcatatccagtgtcgttcggcttatatatcacgacaagaacagtcactcccttcagaggcactagcctctcgcatcatggattcattacatgtaaagctgaacttcctgggtcagctgcctgccctcaggatctacacgcaaatctgcctctgctttccgttcgatgcctcatctgatcacgagatagtcaggaccctagagaatggcctcgaaagactgtccaccaatttcccgtgggtagcaggccagatagtcagtgaaggcagcagccacaacaatcctggcacattcatgatcaaagcactggggaagactccaccactggttgtgaaagacttccgtcatgatcccgacgttccgaccatggacgatttgagacgcgccgactttccctttcggatgttagacgagaacatcattgctcctcggaaaaccttgccaagccctgacgaagatattatctcaccggcctttcttgtccaggctaattntattcacggcggcctggtcctcactctttgtggccatcatagcacaatggacatgactggtcanggacaggttatccaccttctctcgaaggcatgtcgtggggatacatatacaagattggagctagagtcagggaacttaatggaaggtcatctcgttccctcctagaaggctcga

SEQ ID NO: 4595 - DNA, 689 bp, Aspergillus oryzae
cgtgcccttctaacggctcctatttcataatccaattgatcgaaccgctttttatcatcggatagatttgcgattgtctggcttcatttgtccgcttcttgaaccgcagaacatctattataataactggagctagactgatactttgagctcgccaacatgtggatcctacccttactaggatatttgggggttattgtggggttctcatttcttactttggccatagcttctgggctctactatatgtcggagcttgtagaagaacacactgttctcacccgtcgccttttgactcggttgatatacagcattatcctcatccagatcctcctattcgtatttgaccggtttcctttctctctatcccttctcggcatcggttcgcacatcgtttatgcaagcaatttaagacggtttcctatcgtcaagctatcggatccctttttcattctgtcatgtgttcttgttggtctaaaccattggctgtggttccgtcatttctcaaaacctctacctgcgtcgcgagctgcatccagctggcgtcaaccataccaaattaatgcggaggacatgccgactttcactgaagttgcatcttatttcggactttgtgtctggctggtcccttttgcgctctttgtcaaccttagtgcgggtgaaaatgtcttgcccagcatagggtccga

SEQ ID NO: 4596 - DNA, 622 bp, Aspergillus oryzae
accctagctcacttccgtgctctccccaactgcatggtctggcgtcccgctgatggcaacgagaccagtgctgcctactactctgctctcacctctaagcacacccccagcattctggcccttacccgtcagaacctgccccagcttgagaattccagcattgaggctgctctgaagggtgcgtacgtcgccattgaggcccccaacgctgccgttaccatcatctccaccggttccgaggtcagcatcgccatcgaggctgccacctacctcaaggagaaccacaacgttgttgcccgtgtcgtctccgttccttgcttcgaggtcttcgatgcccaggacaaggactacaagctcaaggtcctccccgacggtatccccgtcctctccgtcgaggctgcctccaccatgggctgggacccgtacgctcacgagcagttcggtctcaaccgcttcggtgcctccggcccttacaagcaggtctacgagaaattcagttcaccccttgcggtatcaacaagcgcgccctcgctaccatcgacttttacaagggccaccccgtgcgcttccccatcaaccgtgctttccagagaatctggagatgtcctttggtaccgggagg

SEQ ID NO: 4597 - DNA, 701 bp, Aspergillus oryzae
  misc_feature (1)...(701): n = A,T,C or G
ccaaggccctgttgacctgaaccgacctgctgattctactgcaactggcgaaaagaccgcggcaaacaacgaaacggagaaaggagactttgctccactaaaatcagtaaccgagcgtcatcacccctacttggtggagcttattgctgccgaagcaggagttaagccggacgacatcttggactttgagatgatcttgttcgacactcagaagtcttgccttggtggcttgctggaggagttcgttttctcgccccgtctggataacctgaacagctcgttctgtgccactgttggactaatcgactccgttgccgatgcgtcggcgctggacgatgaaccgtccattcgtctcattgcgttattcgatcacgaagagatcggcagccgtaccgcacagggagctgactcaaatgtgcttccggcaattatccgtcgcctgtctgttctaccttcttccacatctggcaatgaagacttggctactgctttcgaggagactttgtcgacttcattcctcctctctgcggacatggctcatgctgtncaacctaactacgctgctaagtacgagaatgatcaccgaccggaaatcaacaanggtcctgtgatcaagatcaacgccatgctcgctacccgacgaaactcccctgcattgtcctactncaagaagttgcacgcaaagcagccaaagaangtgg

SEQ ID NO: 4598 - DNA, 687 bp, Aspergillus oryzae
gttgaagacgacggggttggtaattggggctggcggcatgggccgtgctgccatttatgccatgcttcgtctgggatgccggaagatcttcatatacaaccgcaccttatcccgcgccgagaatgtagcccgtcactttaattcatgggcggcagcgcaggttggctctacaaaagtggtgcatgtgctgaggtcattgcaagatgagtggccgtcagaaacttgtcatccatgtttgattgcgtcctgtgtacctgccgacccggaccaagatgaacctccagcaaacttcgagatgccgatgcaatggcttgaaagccctactggtggggtggtcttagagtttgcttacaagcccctggagaccccgctgatacgtcagatgcgtcgtttccgcagtgaaactggacggccatgggttctggtagatggactcgacaacgtcattgagcaggccatcgctcagtttgagctgctgacgggacggaaagcgccacggcgactgatgacactggaagcacttcgcaattatgtccgggagcacgggcagttcgacgaggaaacacttcagacgagacttgacggggtccagtaacacgcggtcgtgagtcggcagtgaagaagtttgacacgcattgcccatcgaatgtataaatatgtattttgtactacagaaccatagactgg

SEQ ID NO: 4599 - DNA, 653 bp, Aspergillus oryzae
  misc_feature (1)...(653): n = A,T,C or G
gtcattccaaagcaaggacttattgatggctcgatctggttcggttggttgttctacgtgaacccgctttcgtacagttatgaggcggtccttacaaacgaattctcgaacagagttatgtcatgtgctccttcgcagctcgtgcctcaaggcccaggtgtggatccaagataccaaggttgtgctctcactgggtccgagcttggtaaggcagactttgcaggaagtcggtatcttcaagaaagtttccaattcactcggcaccatttgtggcgcaattttggagtggtcatcgctttcacggttctgtacctncttgtcactgtcataactgcggaagttctcttatttgtcggaagtgggcgcgggccattggtctttaagaaggtcaagcgtttcacaaaactcaatagcgcaaacgggaaaaggttcgaatgaaaagcaggttcaaattcaagcggaaatggcggtttgtccacgggaaaaccaaanttttcttaaaggggggagcctttcgatgcttttttgttgtagaacaaattttctctggttaaatttttaaaaaacagggcacgtcgattaggtgaactggnatttgtaaaaagtggataggtgtagggtgccttgggtttagtactctttaacggggatcg

SEQ ID NO: 4600 - DNA, 782 bp, Aspergillus oryzae
  misc_feature (1)...(782): n = A,T,C or G
cgaagatgccgtcaaggcattgaaacgactgaccagcgctaacgcagacttcaacgccgaagaaaccgtcgcaatgatcgtatacaccgacgcactcgagcgacgtgctgaaaccggtacctcctaccttgactgcttcaagaaaagcgacttacgccgaaccgaaatctcctgctgcgcatgggcggcgcagagtctatgtggcgcaggcctcatgggctattcgactgtcttttaccagcgcgcaggtctcgccgtgtcgcagtccttcaccatgtcgctcgtgcaatatgccctaggcgtggtggggacattcgtctcctggacactaatgtcgtacttcggccgtcgcaccctctacgtcggcggtctatttatcctagccatcgtattattcgtcatcgggttcgtctccatcgctccatccacacccgccatctcctgggccaccggctccatgcttctcgtctatacctttatctacgactcctccatcggccccgtctgcttcgccctcgtctccgaaatcccatcctccagactccgtaccaagaccgtcgtgctggcccgaaacgtctacaatatcctcaacctcgtcaccggaatcattatcccgtatatgctgaacgtcgacgcatggaactggcgcggtaaatcaggtttcttctggggtgcactctgcgtttgctgcttgacgtggtcgttcttccggctgccagaaccctaaggacggtcgtatgctgangtggatctgnntgttgagagaagggtgaagacgaagg

SEQ ID NO: 4601 - DNA, 696 bp, Aspergillus oryzae
caagacaactgacccctctcgaataacccccagactccgtgatggcgactcagactacagtgtcctacactactacacgcaccttgtccaccccggctcgttgcctgaaccctgataacatcaacccccacgtcacggaggccaagtatgccgtccgtggtgagcttgctgtcaaggccgaggagtaccgcgtgaaactggccaatggagacaaatcgttacctttcgacagtgtcgtctttgccaacatcggcaatccccaacagctcgaccagaaacccatcaccttcttccgccaagtactcagtctcctcgagaaccctcaactgttgaacaacacggaagcacttcgtacatcctttttttatgaacaagatgtcgttgaccgggccaagaagctcctcgcggatgtccagagcgttggtgcttacagtcacagccagggagcgcctgtgatccgccaaagtatcgccaaattcattgaggagcgtgatggattcccggccaaccctcaggatttgttctgctgcgctggtgcctcgtctggcgtcagcaccattctcaatatcatctgcaacggccccccaaggccggtgtcctcgtccctatttcgcaataccctctttacactgccaccctttctctctgaatgcgcaatgtgtaccctacctccctcaagagcaaagggcttggggg

SEQ ID NO: 4602 - DNA, 672 bp, Aspergillus oryzae
gggatcggtcgcagtccgcgcatgcagtaccatgcgctgagcattgccaaaggcggaggtcaagtggaaatcattggttatcatgagtcagaagttcatcccgatatctcttccgaccccagaatctcgattgtcgcacttcccccgcacccagcctatcttcaaacaagcaacaagcttcttttcctagtatttggtccgctgaaggtcctcttccaggttgcttgtttgtggtggtcactagcctatcgcacgcgacctgtgaagtggctccttgttcagaatcctccatccattccaactctagcagtcgcatccttaacctgctttcttcgtcaaacgagccttattatcgattggcataatttcggctactccatcctagcgctcaagcttggaaatggtcatccattggtcaaactgtcgaaatggtacgagaagacattcggaagatacgccacggcacatttgtgcgtgacaaccgtcatggcgtctgtcctgaagaaagaattcctactggaggcacctattctaccactgcatgatcggccagccaaccatttccggcccatactcgatgataaacgtcgacaagagtttctcttatccttgcccggtactgcttccgtacaatcactgatcaattccggggcacttcgcgttctattcatt

SEQ ID NO: 4603 - DNA, 671 bp, Aspergillus oryzae
  misc_feature (1)...(671): n = A,T,C or G
gaagctctgacaaacaccttccttcagggtgttttccctctcatcgctcgaggcaaggttcgcgacctgtacgatgtcgacgagaagaccctcctcttcgtcgcaacggaccgcatctccgcgtacgatgtgatcatggagaatggaatccccgagaaaggcatcctcctaactctatgcacgaaaacctggttcaagatcctctccgacaaaatcccctctctccgcacccacttcctcaccctcgacctcccgcctcagatccccgagtcgttgcgtcccgtcctccagaacagaagcatgcaggtgcgcaagctgaagatcctccccattgaggccatcgtccgcggttacatcaccggttccgcctggaacgagtacaagaaatccggcaccgtgcacgggatcaaggtcgccgagggtctgagggagagcgaggccttccctgatggtcctatttacactcccagtaccaaggcggagcanggcgagcatgatgagaacattcatccggatcaggctgtcgctattggtggtgaacggtatgcctctaagatcgcctcttttgcgttcaaccttacaagggcgctcacgagtatgcccttactcgtggtgtgtcatttgcggacccaaatttgaagtccggttggattccgagactggccagggtg

SEQ ID NO: 4604 - DNA, 585 bp, Aspergillus oryzae
  misc_feature (1)...(585): n = A,T,C or G
cgagggggataccatcaccgtcgtctcctccccatccattgcaagatgagctctctccgcttcgctcgctctgccctccgggcccgtccctctgccttccgcgctcctctccagcgcagaggttacgctgaggccgtgaacgacaagatcaagctttccctggcccttcctcaccagactatcttcaagtccaccggcgttgtccaggtcaacatccccgccgagtccggagagatgggtgttctcgccaaccacgttccctctattgagcagctcaagcccggtcttgttgaggtcgttgaggagggtggtgctaccaagaagttcttcctctccggtggattcgccgttgtccagcccgactcccagttgagcatcaacgctgttgagggtttccctcttgaggacttcagctccgacgccgtcaagaaccagatcgccgaggcccagaagatcgccagcggcagcggcagtgagcaggatatcgctgaggctaagattgagctcgaggtgctcgagaccctccaggctcacctcanataaattatctgatgtacatatccactcgcgattccagccttgaan

SEQ ID NO: 4605 - DNA, 683 bp, Aspergillus oryzae
gtggcctagcactcagtgcgccacaggccagtccattggtggcctcgaatgtaagaatggcaagctctaccttaccaaccccaccctgtccaagaagctttgcattgagggtgttggtggtgttcatgctcagaacaaccttggcgaggagattgccatctgccgtactgattaccctggtaccgaatctgagaccatccctctggcccttggcgacaatgagcttcagcccttgacttgccctgacggcgaaacctacttcaagtgggagggcaaggtcacctccgctcagtactatgtaaaccccaagggcaccagcaccaagcagggctgccagtggggtgatggttccaagcctattggtaactgggctcccatcaacctcggtgtcggtcagaacaatggcaagtggctttctatcttccagaacagccccaccaccagcgtgaagctcaacttcaacattaagatccagggtgacaacctcagtggatcttgtaaatacgagaacggcaagttcatctctgaaaccggcagcaatgactctggttgcactgtcgaagttctgtctggcgaagctaccttcgtcttctactaaataacctgacgatactgcatcgctgcaaacgggcacatctgctacgtgacttggccaccattaaccggctcgactggcctgggta

SEQ ID NO: 4606 - DNA, 680 bp, Aspergillus oryzae
  misc_feature (1)...(680): n = A,T,C or G
gatctgcgcaagaaagtcggccagctttttgcggtcggctttcacggcctcactcccagccccgagattaaaaccctaatccacgaatatggtttggggggcattgtccttttcaaacgaaacatcagcgatgcagcccagttgcaatctttaactcactctttacaagaagaagcgaggctagctgggcatgattatcccttatttatcggtattgaccaagagaatggattggtcactcggatttcacctcctattgccgctcaactcccggggcctatggctctcggagcgacctatgcctcggagcttgctaaggaagtcggcaccgtcacgggcgagacgctgagactatttgggatcaacatgaactatgctcctgtgtgcgacattaactcagaacccctaaacccagtgatcggagtccgcagttttggagaccatcctggattggtgggaagattggcatgcgccactgcccaaggactccgagaacaaaaggtggtacccagcgtcaagcatttcccagggcacggagacactgctgtggactcccattatggccttcctgtcatctctaagacgagagaacagctagataaatgtgaattgagaccatttcgcagagctatagctgaaggtattgaggcagngatgactgcccacatttcgctaccttt

SEQ ID NO: 4607 - DNA, 701 bp, Aspergillus oryzae
  misc_feature (1)...(701): n = A,T,C or G
ctctgtcaccgttggccttacacagctctcattcacataacaacattaattctccctcttgcagtgcaatttgtacagttacttaatcattatcccccgacacactattttgttctctgtcctagagtgatatcctacgattatcatggagccctacgacgacggatttattgaggagcaggaagagcaggaagaagagcgtactgaggagaaagtcattaatgaagaatacaaaacctggaagaagaatgcgcctttcttatacgacatgattcttagtacggcattagaatggcctactcttacaacacaatggctacctgacaagcaagaggtccctgacaagccgtattcaactcatcgactgctgcttggtacacacacctcaagtgatgcgcaaaactatctacagattgctcatgtgcaacttcccaacccttcggctcctaatccggacgactacgatgaggagcgtggggaaattggtggctatggcggtagctccaaaaaggccccgatggaaatcaagttcaacattgtccagaagattgatcataaaggcgaagtaaacaaggcgcggtatcaacctcaaaaccccaatgtgattgccaccatgtgtacagatggaagggtgatgatttgngatcgctcgaaacaccccagtctacctacgggcacagtgaaccctcaaatggagcttt

SEQ ID NO: 4608 - DNA, 1273 bp, Aspergillus oryzae
  misc_feature (1)...(1273): n = A,T,C or G
cccgttccatttcaagggaaactcaatctacgcacatttccctttggttattccatctgaaaacaagaagatactcacaaagcttgggtttgctgagaaatacagctgggacaaacctggcctcactcccccacccgagtttattaactctcattcggcttgtatgtcaatattgtctgatcaagagacattcaaggtcacatggggatcaaagattgagtttttaatgcatcgtggcaaacagccttttggcagagacttcatgctgtccggggataggcctccaaattccgcatcgcgcaaaatgatgggagctgctttgtaccggaagagatgggagaatgaagtcagatcattctatgaagacataactctaaagcttctgcacaggaactcttacaagattgctgggatcaatcaagttgacattgtacgagacgttgcaaatcctgctcaggttaacttctgcgcaaatgtgttctcattgcccttgaaaactgaatctaacccccggggaatctttacggaatccgaactctaccaaatcatggctgttgttttcacctcaatcttctacgatgcggatcctgcgaactcatttgaaacttaccaagctgcccgggaagtgacgcagcagcttgggcagttggcaatggtcaatgtcgagcttgtcaacaactctgggttcattgcaaacctggtgagtagtttacaccgacatgacgtgctcagcgaatacggtgtccatatgatccaacgcctcctgggcaggggactgccagcggaggagattgtatggactcatattctgtcaactgctgagggcatggtagcaaaccacgcgcagcttttttcacagtgtcttgactattacctttcggaagaaggctcggtccattagcctgatatcaagatgctggcgaaggttgacacgccggaaaccgacaaatagctgttaagatacttcatggaatgccgcccggtacagtcttacgtgggactgcctccgatggtgaccaancccactgtatttgaagacatgggcagacccttaacttcatgcagggcacccatttttttgacttaggtatccgtttttatggcccgcaagttttccaaaacctgaaaaggaaggcttgtttccaattgggactcttccctattttgggttttggcccaataaatgctttgggtttgggcttttgaacttaccccttcccacctgcctaagggatttgggcgttgaaaaatttggccatcgccaagggcccaa

SEQ ID NO: 4609 - DNA, 684 bp, Aspergillus oryzae
gatcagcctgtcgtcaagtggatcgcgagtacctgtggagaatgcgagttttgcctcaatggggtcgatgaggtgcattgtgagaagcagattaacagtgggttttcagcgccagggacgttccaggaatactgtcttgttgatgggaggtatacgtcaaagataccggatggagtttcagatgaggaggccggtccgatcatgtgcgggggcgttactgcttacacggcttgtaagagatcggccgtcaaatccggtcaatggcttgtgctccccggcgctggaggcggtctaggtcatctggctatccagtatgcgcgcgcaatgggcatgagggtcctcgctattgatggcggagacgagaagcgtgacctttgtgagaagctcggggccgaagcatacattgatttccagaaattcaaagcccctgcagacctcaaggatgaggtcatgcgaatcacaaagcacggcgcacatggcgtggtcgtgacggctgccagtaagaccgtctacgaatgggcgcccatgtacctccggcctggaggcacaatggtggtggttggtctacctaatgatccttccattctagcgggtgcaccaccgctcgttttggctttgagacgactaaatatcgttgggaatatcactggacgcttgagagattgacacggaacccctgatttt

SEQ ID NO: 4610 - DNA, 682 bp, Aspergillus oryzae
gcgaggccgccttgccatcattccccaagacccggccatgtttgagggcaccgtacgggacaatctggaccctcgtcatgtgcatgatgacacagagctgtggagtgtgctcgaacatgcacgactgaaagatcacgttgtaagcatggacggccagctggatgcccgaattcaagaaggaggatccaacctgagtcaaggccagcgtcagctggtgtctctagcacgggcattgttgacgcctagcaatatcttggttcttgatgaagcgacagcggccgtggatgtggaaacagatgcattactgcaacgcaccttgcgcagtagtatcttccaggatcgcactatcatcactatcgcccatcgcatcaacacgatcatcgattctgaccggattgttgtgttggacaaaggccgagtggctgaatttgacacacccgccaatctgattaagtccggcggtaaattctacgagctattcaggaagcaggtcttgttgataacaaaggacatgcgctcgtgcataatggcagacttttactcccacagtggcgaaaaccttggagtgggtgggcccaaccgagagaggcttctctataatttcggaccgatctttctaatctggaccctcgatggaaaccccgttgaaaaataggatgaccgcatctttggttgatcttgg

SEQ ID NO: 4611 - DNA, 681 bp, Aspergillus oryzae
gatctgcaagacggcagtgatcctttgcgtgagccactcctccgtgagaagccagtagtctttacgaaaccatgtctggagaacctaatgccgcttggcctctggccgacgagagcctcacccagaacctcctggaccttgtgcagcaggcttctcactaccgtcagctgaagaagggagcaaacgaagcgaccaagacactcaatcgtggtacctctgaaatcgtcatcctcgctgcggacaccaatcctctcgctatccttttgcacatcccccttctttgtgaagacaagaatactccgtatgtcttcgtgcccagcaagcttgctctgggccgggcgaccggtgtctctcgtccggtgatcgctgctagcatcaccaccaacgaggctagcgacctcatgggacagatccggaccatcaaggacaaggttgagaggctcatgatctaaggcatggtttatgttgttgaatggacgagatctaggatatcgcaggtgttgccattccttgctccggtggattcgcatttatatgaaagacacaacacggaaatggaccatactctttaatacctatcttatacgggaaacgctatcttaaataatgatgggttctccgttgaatatttattgggatcatttttctaaaatagacccgcatattccctttaattaagaa

SEQ ID NO: 4612 - DNA, 1725 bp, Aspergillus oryzae
cttcttttctatccatacttatcctctcaacttctctttcccctcctcatcattcctcaaaaccccccttaagcttatcacgcattcctctcatcaggaattcgtctccgcttttatagatctatccatcggatctataatcgcctccttcacctccacttccctttccccacgagaaagactaccccttaaaaagtcttttcttgtctagcctttcgttcgtatctgttcgaaaggcattcgagaaaagacgccaaaggacagccaatctggactttgacgcccgtgtccccatccccttcagtgtcttcccgtcgtcgtaccggagtgacgctgttcctgagcctactcttgcacctgaaagagtagaggaagaagtcaatctcgatcgtccttcgcacgtcgaacgggaagacactcgaccctctgctcctctcccagatccccgtatctacggaaaggaagagatcgatctacgcgcccagcgcgactctcgtcctgttccgccccctgccccccagcctgaccaatactcggtttacaccgaagaccggtaccagcagcaagaccgcttccagcaggaaaagccctatcccgaggtccatctcgcgcgtgaacgctatcaagagcctacctcataccctcgcttccaagagactcccaaggtctacgatcaggagctttccaaccagctagacatcactgagcgtgattatcgtcgtcgtgtcaaccaacagacctacgacgtctataacaccaacgctagctatcagcagtctagtgtagagtcctacgagaaccgtcaacccgtctcgtacgaccgtactcctgcccacccccagctcgacgtctcgtacgacaaggcttatcaagctcccaccctcgagacctaccccggctcttctcgcagccaacgtcaggtctctgtcgagccagtcaacccaccttctcaagtcaaggttcttagcactactactgtagttgattatccccctgctcgcaagatgggatactacgacgacgacgtttcccgtgacggtgcccaccacgccgtccgcgtcgttgagccccgcagcagcggtcgcagaagcgccgacaccgtgcccattccctgcaacttcattcgcatcggcgacatcttgatcctccagggccgtccctgccaggtcatccgtatctccgtgtcgccccagaccggccagcaccgctacctcggtgtcgatctcttcacccgccaactgcaggaggagtccagcttcgtctccaacccctctccctccgttgttgtccagaccatgattggccctgtctacaagacctaccgcatcctcgacatccgtgataaccagatcgtcgccatgaccgagaccggtgatgtcaagcagggcatcccagttgttcctcagggcgaactcttcagcaagatcaaggcagccttcgaggacggacacggcagcgtccgtgctctggtcatcaacgatggtggtcgtgagctcgttgtggactacaaggttatccagtcttcccgtctgtagatcattttcccgctttgatctggtcggttcccagttaagtcatctatccgaacgatcaatcacgactgaatgttctatgtctcatggacgcggtgggtggaagtggcttgtttttttttgcaacgttttcaatttgtatgatggatggcctttgtacctagcaacgtaatttaccggaattggttgatgt

SEQ ID NO: 4613 - DNA, 711 bp, Aspergillus oryzae
  misc_feature (1)...(711): n = A,T,C or G
tttaacttacctatttcggttccctgcgatggcgtccatcacccgcgcgttgcggcctctgtgccggactactccctcgttccgcatggccgcaagacggccattgccttctcatttagctcggagtacccatgcgttctctaccacatcccgccggcgggatgtcgacttgtccactctgacaccgaccccgatcacccttctttccgaaacagagtcaatgatggccgacacagtgtcaaagttcgctcaggagcagattggacctaaggtccgagatatggatgaggcggaagccatggaccccgccattgtcgagcagctgttcgagcaagggttgatgagtattgaggttcccgaggaatacggtggagccggcatgaacttcacatctgccatcgtggcgattgaggaattggcgagaattgaccctagtgtcagtgtcatggtcgacgtccataacacactcgtgaacacggctattatgaaatacggtgatgcccaggcgagacggacgtggttgcccaagttggctaccggcactgtgggctcattctgtctgtctgagcctgcgtctggatcggatgcattcgctctgcaaaccaaggccgagaagctttccgatggatataagttgaatggttcgaagatgtgggataccaacgccatggagtctggtgtattcatcngcttcgctaaccttgaccccaa

SEQ ID NO: 4614 - DNA, 678 bp, Aspergillus oryzae
gcaagtcatctacccagacggacttcgcgaaatgcgtgccaagggcgttaccgacgacgatctttatgatatcctctccatcgtcgaaatcgcttcagtcgttgaccgccccaatggttgggacgcagaggaagaatggcgtgacgtactctccggtggactccaacagcgcatcgccatggcaaggctcttctaccatcgacccaagtttgccattctcgacgaatgcacttcatcggttactatggagatcgaacgggtcatgtacgagactgccaagaggctaggcacaaccctgatgaccgtatcccaccgccgcagcctctggaaatatcacaagaagattttgcagttcgacggccagggaggctacatcttcacaggactagactgggaacggagactgaaactagaagatgagaaagaagagcttgatcttcacctccgggctgttccagaattgcaaaggcgcatggctgaactgagtgcttcctaagcaaaccttcatctctttcatatacttttccatcttgttccaggaccattccgaatcacgcagtccataccctccccttccccatttttcccttctaccccttgagacatgatatatgaagcatgctttttcaatgttgagcatttaagcgaatgttcaagtgtacttttagtggcaattgg

SEQ ID NO: 4615 - DNA, 578 bp, Aspergillus oryzae
ccgtggtatcattgaggagatcgagcgcctgaacctcgtcgagcacaccgccaagaccggtgaatacctgtactctggtctccagcgccttgctgagaagtaccccgagcatctgcagaacctccgtggtaagggccagggaaccttcattgcctgggatacccccaagcgtgacgagttcctcggcaaggccaagggcgtcggtgtcaacattggtggaagcggagtcagcgccgttcgcctccggcccatgctgatcttccagcagcaccatgctgatatcctcctggagagcattgagaagattatcaagcagctgtaaggaacttgggttgcatgattatcattttccattaaatttgcatctctttctgtttccctgaattggcagagtccggcgttcattgttggtttgggtgggtctctccgtgtctgattggcacgctatctacgagttatgtcttttgaagctgttagcacactatatatatatctatagcaaacggcaatctaatgccgtcccaaggtgcatcgattctgcatgttgggtatcgaacaaaatccaactgtttatcttc

SEQ ID NO: 4616 - DNA, 716 bp, Aspergillus oryzae
gatttcagcaaccggcccgcaacgcgtcgcgtctatcgtcctgcaacccaccgtttccatctatatctcatcgatatccatctcttttcatcatatttgaacttcacacaacatgtctggacgtggcaaaggtggtaagggcctcggaaagggtggcgccaagcgtcaccgcaagatcttgcgtgacaacatccagggtatcaccaagcccgccatccgtcgtctcgctcgccgtggtggtgtcaagcgtatctccgccatgatctacgaggagactcgtggtgttctcaagtccttccttgagtccgtcattcgtgatgccgttacctacaccgagcacgccaagcgtaagaccgtcacctcgctggacgtggtctacgccctcaagcgccagggccgtaccctctacggtttcggtggctaaatgcctcgccctcgattccctcttgtttcgttcctcgtccgacgtacaatagcggctgtcgtcacacgaccgattctcgctggctcgaatggaccgaggtgctgagcgcttacggtgtgatacttgttctcaatcaatttttcttacggaatctgcatcatgattaccactgggtacggggttttgggacggacggttttgtttttttatccagaaggatggtatttgtcgggcttcgtacggtttcgtttggagggagcaatgggttgaactttttgtagactcattggaa

SEQ ID NO: 4617 - DNA, 438 bp, Aspergillus oryzae
cactggatctgttgaagaataagtggaagagagacaacaactataactatatatgcgatcagttcaagtcgctgcggcaagatttgactgtgcagcacattaggaatgagtttactgtcagtgtttacgagattcacgcgcgcattgctctggagaaaggagatcttggtgagtataatcagtgtcagactcagctgcgcgcgctgtacgcacagcaacttgggggccaccctacggaattcaaggcgtaccgtattctgtatttcatccacacccgcaattggacggccatgaacgatgccctggccgatctaacagcagcagacaagcgagaccctgctgtcaaacatgccttaaatggtcgctcagctcttgcgcttggaaactacccaccgtttctttcaactttaccttggacacccccgaatatgggaacct

SEQ ID NO: 4618 - DNA, 674 bp, Aspergillus oryzae
  misc_feature (1)...(674): n = A,T,C or G
ctcaatcctatcattcataaacccctccaataaaacaaaacagcccagaatgtcctctacaatcaacaccagcaaaggcgaacagcccatcgacccctacaaggccaaaagcctcgaagacccgcccctggcccaaaaggtcgaagacctggttgacttcatttccgaggccaaattcggcatgctaacaaccaagatcgctggctcggaatacttaacctcgagatgcatggcgttggctgggaaggaacacggcggcatcgaccttctcttccacatcaacctcttctccagcaaaaccctagatatcaacacgaaccccagcgaagtaaacatgtccttcctagacccagttagcggatcctgggcgtctatttcgggaacggcatcgatcgttgccgacaaggctctcattgagaagtattattcgccgacgttgccggcttggttgggtgatcttggtgatggggttcatgatggcagtccgtcggatccgaggattggggtgatcaagttggaggcgaagttggcgacgtatgcggtggccacgaggggtatctttgggaaggcgattgagacgatcaagagtgctactaagggggatgtgccggctattaatagtatcccggagttgagtgaacangagttggctgagtggccccggacgcacaaat

SEQ ID NO: 4619 - DNA, 702 bp, Aspergillus oryzae
  misc_feature (1)...(702): n = A,T,C or G
cccatattcacgccacactggcgtcccccgctatcaagaaagccatcaccgaggccgcagcgcagtatgtcaagccggagggaaaggtcttccagtatggtactgcggggttccgcatgaaggcggacgtcctcaacacagtggtctttgccgtgggcttgctcgctggtcttcgctccaagaagctcagtggacaatggattggtgttatgattactgccagtcacaaccctgcggaggacaatggtgtcaagttggttgaccccatgggtgaaatgcttgaggctgaatgggaaacctatgcgacaaagcttgccaatgctccgctagacaaaatcgcagatgtttacgaagaactcgtcaaggagattgatatcagcatggaaaacccggctcgtgttgtttttgcccgggatactcgtgcctctggttctcgtcttgccggtgttcttaacgctgcgctcaccgctaccgaggttaacttctctgacctgaaattcatgaccaccccccagcttcattatgttgtccgctgcaagaacaccctgngaacgcagtatgagtacggtgaacccacagagcaaggatactatgagaagctcgccaaagctttcaagggagttatgcggggccctcaagttaaagggctctttgaccgttaattgcgcaaatggtgttggcggacctaagctgaaagaactt

SEQ ID NO: 4620 - DNA, 1053 bp, Aspergillus oryzae
cgagatcttgatttcagttccaacattgcgggtgctgtcactttaactaagcttatcggatactgaaccttgaatatactttcaagatgatcgatccacccgccgagatgatcgacttcttcgataccctcaagacgaagccgctgcccgtgcccaccacgaccccgacatcggttgcccccgtgcccaccgtcgtccctggccatgatctcattttccaggagttgtccaagaccagccaacggacactatgggtggtcgtcgtgctaatggctatatccgccatcgtcttctacatcctcgcctcccgagcacctttgaccaagcgagtcatccacaacctgattgccatctccacaacaatctccttcatcacctatctcgcactcgcaaccggcgaaggtataacatacaagcacgacatcctgacgatccacaacaagcacgtccccaacactcatcgtgatatctaccgtcaggtcctctggctgcggtacctcaactggttcctgacaaaccccctggccctcatcaatcttgccctcttgtccggcctcccgggtgcccatctccttgtcgccatcgtcgccgattggatcatgctcggcaccggcatcttgggcacctatgccggccataccccccgcagatgggtctggttcaccatcagcgccatcggctacctcacgactgtgtaccatattggtgtgaacgggggccgctcggcggtgaacaaggacgcccagacaaagcgattcttcggtactgtttcgggtgtgtcgcttttgattaaggctttgttccctgtagccatcgcggccggcgctctagccctcaaaatcggcatcgacgccgagaccatcattttcgctatccatgatatcttcctgcagggtataatcggctactggcttattttcgcacatgatgcggcacctggaattacccttctggttgacgggttctggtcccatggacacggcaacgagggtgcgattcgcatcacggaagaagagggcgcctaaagcaatcatgaaaatacgccttctgata

SEQ ID NO: 4621 - DNA, 680 bp, Aspergillus oryzae
  misc_feature (1)...(680): n = A,T,C or G
gacattttcccttcctctccacacgtcccttctcgctcgtcctttctttacaggcactttctctagttgaaataaacgacaatggctgccactcaaggatacccttttctttgcttggagaaccctctcctcgacatccaagttgttggtgatgctgctcttcttcagaagtatggtctgaaggacaacgatgctatcctcgctgaggacaagcatatggggctctacgaggagcttctgcagaacgatgatgctaagttgattgccggtggtgccgcccagaacactgcccgtggcgctcagtacattctcccggacaactccgttctctacattggatgtgtcggccgtgacaagtacgccgatatcctgaaggacacctgcaccaaggctggtgtgcacaccgagtaccgtgtggacgatgcccagcctaccggcaagtgcggcgtgatcatcactggccacaaccgtagcatgtgcacccaccttgctgcggctaacgagtacaagttggagcaccttaagcagcctcagatctggtctcttgttgagaaagctcangtgtactatgtcngtggctaccaccttaccgtgtgtgtgcccgctatccangctctttgtgaagaagctgcttgcaagaacaagatctttatgctctctcttttcngccccttttatcn

SEQ ID NO: 4622 - DNA, 764 bp, Aspergillus oryzae
ctccgccaacggattttcttgtgccaaatcctcttcacaatggctgctcaggctagcgaggatctgcagaagcttgacctaaacggccagggcggtgccgctaaagcggacgcccctaccgcgggtcaggcagaagccggagaggcagaggacgactcggatgatgacgctgatgaaggaaacgctgctcccgaaggcggggccaacggagccgccaagaaaaagaagaagcgcaagtctaagaagaagaagaagggcggtgctaaggttcagagcgagcccccgcgggtccctctttctcagctcttcgccggcaagcagtaccctgagggcgagatcgtcgagtacaaagatgataatctgtaccgcacgaccaacgaagaaaagcgttatctcgaccgcatgaacaatgattttttgcaggagtatcgtcagggtgctgaggtgcaccgtcaggtccgtcagtatgcgcagaagactatcaagccgggccagaccttgacggagattgctgagggcatcgaggaatcagtgcgtgctttgactggccaccagggtcttgaggaaggtgacaacctcaagggtggtatgggtttcccctgtggtctgagcatcaaccattgggccgctcactacacacctaatgcgggcaacaagatggtgctgcagcaaggagacgtgatgaaagtcgacttcggggcgcacatcaacggccgcatcgtcgacagtgcttttactgggggctttcgaccaagtttatgacc

SEQ ID NO: 4623 - DNA, 656 bp, Aspergillus oryzae
  misc_feature (1)...(656): n = A,T,C or G
ctgtgtacgtgggagactttgatgccattctacgatgcgttcatcacaagccaggaccccacgcaacgccaatgggctctgtgcatcatggatgatgtgctggagttctgtgggcccgagtcgtggaagtataaagatcacattatgcagccgttggcagcagggttgcaagatcagaacgcagccaaccgtcaagcagccgcatacggtgtgggtgttgccgcgcagaagggtggcgctgcctggggcgatttcgttgcggccagcctacccagtttgttccaggtaacacagtttaaccagtcccggacggaagaacatgtgtttgccaccgaaaacgcatccgccagtattgcgaagatcctgcattacaatgcaggcaaggtgcagaacccacaagaggtcgtggccaactggatcaccaccctgcccatcacattcgatgaggaggccgctccatatgcctactcattcctggctcaactcattgaccagcaaaaccccactgtcttgtccaacgtcgacaaggtgttcggatacattgtccaagctctcgaggcagagacattgcaaggacagactggncgcccgggtggccaactcggcgaagcagttggtggctaccactggaactcacgcagaccagatcctggctg

SEQ ID NO: 4624 - DNA, 698 bp, Aspergillus oryzae
  misc_feature (1)...(698): n = A,T,C or G
tcgcgccgtccgcttccaactcgctccgcgggccttcaaccagtctgcgctcgcccgccttctctccaccttggccgtccttgagcagcgtgatggcaagctccaggcctcatcgctctccgcgattgcggctgcacagaagctaggaggtcccgtcactgccttcgtggctggaaacggcgttaagggaacctcggctgcggaggcagctaagattaagggcctggataaggtagtggccgtggacagcgaggcttatgagaagggtctccccgagaactacgcccctctcctcgttgagaacatcaagaaaggcgaatacacccacatcattggcggccactccgctttcggaaagagtcttctgcctcgcgtggcagctttgctggatgttcagcaggtttccgatatcactggaattgagagcgaggatactttcgtccgcccaatctacgcaggaaacgccattcttactgttcagtcgagcgaccccattaaggtcctcaccgttagaggcactgctttccaaggtgttgagaccgaaggcggctccgcagaagtcgttgagggagttgaccccaagtcacccgcccagaccgagtgggtttctgaggaactcgccaagtctgagcgccccgacctgggtactgcatccccgtgtgtgtccgggtgccgtggcttgaagtcnaaggaggagt

SEQ ID NO: 4625 - DNA, 699 bp, Aspergillus oryzae
  misc_feature (1)...(699): n = A,T,C or G
ccgattctcgagacgtgaaggccacggaggaggagaataagaagaaggatacgatggacgactgggatgaagagaagctgcgcaatgtcgtcctcagcaagcacggaaacccgaagacgacgaccgataaggtctgcaagttcttcattgaggcggtcgagaaccagaagtacggttggttctgggtctgtcccaatggaggtgacgcctgcaagtataagcacagtttgccccctggattcgtcctgaagacgaaggagcagcgtgcggctgagaaggccctgatggacaagtctccactcaacaccttgacactagaggactggctcgaaagtgaacgacacaagctcacgggcaacctgacaccggtcacccctcaaacattcgccgagtggaagaagcagcgtctcgacaagaagcaagccgaagaacaagcccgcaaggccaaggaagccactggacgaacattgtttgagagcggtaactggcgtgccgaggatgagagcancgacgaggagggtgacgacgacgatacctttcaacctgcttgcctccgcanggagacngagaggatccggnaacagaangaagaaaagcgacttgcgangctgcattgggcaccngtaccgatttcnaacgacgaaaccattgcacanganggtganggctgancgtggcgataccccccagaaactgcan

SEQ ID NO: 4626 - DNA, 719 bp, Aspergillus oryzae
cgacaaaacttctcacccgacatcgaggaccaccccgctcggcaaccacatcaagatggtccgttacgctgctcaggacattccggccgctaagagcgcccgcgcccggggctcttacctgcgcgtcagcttcaagaacacccgtgagaccgctcaggccatcaacggcatgaagctccagcgtgctcttactttccttgacaacgtcaccaacaagctcgaggctgtccccatgcggaggttcgctggcagcaccggccgttgcgctcagggcaagcagttcggtgttagcaaggctcgctggcccgagaagtccgccaagttcctcatcgacctcctgaagaacgctgaggccaacgccgacaccaagggtcttgacactggcaacctcgttgtcaagcacatccaggtcaaccaggcccccaagggccgcagacgcacctaccgtgctcacggtcgtatcaacccctacatgaccaacccttgccacatcgagcttatccttactgagggtgaggaggttgtccagaagggtcccgttgccaaggaggctcacctctcctcccgtcagcgtggcctccaggtccgccgtgccatccaggcataagcggttcatgggtgtcggggatgaggtagtcggaaaatgaatgggaaagccggagttttctgttgtacggaacaaatacctttttacggaaggaatacaaaagaaaattttt

SEQ ID NO: 4627 - DNA, 676 bp, Aspergillus oryzae
taaaatcccattcaaacaaaatgcatacccccgactacgtcgagcccgctcagggcatctcttacttcactcccgctcagaacccccccgccggaacagccgccaacccccagaccaacggccaaaaggtccctaagctcttccagcccttcaccgttcgcggtgtcaccttccagaaccgcctgggtctggccccattgtgccaatactccgccgaagatggccacatgaccgactggcacgtcgcgcatctgggcggtatcgcccagcgcggcccagggctcatgatgatcgaagccacggccgtacaaccggaaggccgaatcacgccccaggacgtgggtctctggaaagacagccacatcgcgccgatgaagcgcgtcatcgaattcgtgcacagccagggccagaagatcggtgtgcagatcgctcacgcaggtcgcaaggccagtaccattccgccgtggatgtcgggcgctgtcgtcgcctccgagcaagcgggcggatggcccgagaatgtcaagggccctagcgatatccccttcgctgactcgttccccaagcccaaggccatgacgaaggctgatattgagggagttaagaacgcttgggccggcggttgaaagcgggctattgctgcgggcgcggattttattgagattaataaagcccatgg

SEQ ID NO: 4628 - DNA, 716 bp, Aspergillus oryzae
ggaaacttccagcagcaccttcccccattgaaacctgtcttcggagtttccttggaggatttgtatttgagagatggaactgctgttcctatgattgtctaccaatgcttccaagccattgaactttttggcttggatatggagggcatttaccgactttctggaagtgcgaatcatatcaaccagatgaaacaaattttcgacaatgattcgtcgcaggtggacttcacaaatccggaaaacttctatcatgacgtgaacagtgttgctggattactcaagcagttctttagagatttgcctgaccctctgttcacgtcgcagtcttataccgacttcatcaatgcagcccgcattgacgatgatgttcagcgtcgagactcgcttcatgcgcttgtaaataatctcccagatgcgcactacgccacgttgagagccttggttctgcatctcaataaggtgcaagaacattacacccaaaaccgtatgaacgcaggaaacattgccatctgtttcgggcctactcttatgggcgccagttccggcggcaacgtcgccgacgctggttggcaagtccgtgttatagagacggttatttttgacactttccaaatcttcgacgatgattaatttacgcctcgagaacaaaaaggccatgatcacatttttgccttgcattgcaaagcaatttctttttttctaacatatggatatag

SEQ ID NO: 4629 - DNA, 852 bp, Aspergillus oryzae
  misc_feature (1)...(852): n = A,T,C or G
cgaacggtgcctttgttatcgcagctggagccatcctcggtatcggtgcatcattcctctgggtggcccaaggtgcgatcatgacgacgtacgtcccagaatcgcagaaaggccgcgccattgcagccttctggattatcttcaatctgggcggcggcattggttccttggccagtttcggtatgaattaccactcaacgagtggaaccgtttcggacggcacgtacatcgctttgctcattatcatggccatcggatggctcatgggggctctgatttgcccgccgaaatcagtgcgagtgtcaactctgcaaaccacccccgagaccgaaaagaattggctccacgtcgcgaagctcaccgtgaaaacggtttgtgactggagagtgatctccatactcccgctattcttttgcgctaatgtattctactcgtatcagcaaaacaccgtcaacggaatgacattcaacatccggtcccgctccttgaacggtgccttgtactggatcgcacagatgttcggcggactcatcatgggcttcctgctggatgtccctggtctgaatcgtcaatggcgggctcgacttaactgggctattcctattcgtcacggggatggcgatctggggtggaagatacgcgtttcaactctggtacgatcgtcgcgtgggcggagggccagaaagcagatgtcgacttcactggtagcagcatcttcgttggggccatgttctctacattctctatggcatgtacgatgcttnctggcagccgtcttgttactgggtgaaggccgctcagccgacattttccgggtggcccgcatccnttggggggcggtcaaaaaccttc

SEQ ID NO: 4630 - DNA, 696 bp, Aspergillus oryzae
gcacgatgtatttaactcccgtctctctcagccccatagaaagtgtttcttcttttcttttacttcttcaccaattccgcatcctccaccccatcaaacaacacgtcatgtccgtcacaacgcaagcaaccatcgcctcctttggcggaaagctcctcaagctcagccatgccgccacctccacccgctgcgaaatgtccttcaacctctacctgccgccccaggccatccagaacccctcgcagaaagtccccgtcctcatctacctgtccggtctcacctgcaccgccaacaattgctccgagaagggcttcttccagcacggcgccagcaagaagggtattgccgtgttgtaccctgacaccagcccgagaggcttgaacatccagggtgaggacgactcctgggacttcggtaccggtgccggattctacgtcgatgccaccaaggacccctacaagggtggatacaacatgtacacctatgtgacggaggagctgcccaagaccgtctttgccgcgttcccccagctagatgagagccgtgtcagtatcaccggtcacagcatgggtggtcatggtgctttgactctgttcctccgcaaccccggcaagtacaagtccgtctccgcctttgcacccatctccaaccccatcaactgcccatggggccagaaggcctttggcggctactttg

SEQ ID NO: 4631 - DNA, 532 bp, Aspergillus oryzae
  misc_feature (1)...(532): n = A,T,C or G
ggggcttacggctcgtccgattcgcacgaggccagggcagggttctgattgatggaaaggatattggtgagatgaatgctaaatcacttaggagaaagattggcattgtgtctcaggagcccgttcttttctcgcctaatcaaagaccctgatatcttaattcttgatgaagcgacttctgctcttgacgcagaatctgagactttagtgaacagtgctctggctgctttgctccgcgggaacaacacgacaatcagcattgcccatcgactctctaccatcaagcggtccgatactatcatcgtcctcggccccgacggtaaggttgccgaacaaggttcgtacgaagagctcagctctcgtcctgacggtgccttcacgaagttgatggaatggcaaatgagcggtggcgatgtctctcagcctccaaagggacgctctatcagccntttgacccaagaaaaatgtggcagatggaagagagcaggagggtgcgctgaggagcagcctctgacaagcgagcagcgaagaa

SEQ ID NO: 4632 - DNA, 658 bp, Aspergillus oryzae
gaaggacctctgcagctcaatctgcaattgattggatttctttgttatatatctttttccctttccattaaccatgctgtctaccctcagagtcgccagccgtaaggctgcttcgcgtgacgctaacttgcgcaccgtcgtcgttggtgccagacatgcctcggcctggtccaacgtccctcagggtcctccggatgctatcctgggtatcaccgaggctttcaaggccgattctttcaaggagaagatcaacctgggtgttggcgcttaccgtgatgacaagggcaagccgtacgttctgccctccgttcgcgccgcagaggacaaggttgtcgcctcccgctttgacaaggagtacgctggtatcaccggtgtcccttctttcaccaaggccgctgctgagctggcctatggcaaggactcccctgccatcaaggaggaccgcctcgtcatcacccagtccatctctggtaccggtgccctgagaatcggcggtgctttcctgcagcgcttctatccccacgcgaagaagatctacctccctaaccctatctgggccaaccacaacgctgtctttcaaggactctcggcttggaggttgagaagtaccgttactacaacaaggacaccattggtcttgactttcaagggtctgaat

SEQ ID NO: 4633 - DNA, 642 bp, Aspergillus oryzae
gtcatacttcgagaaatacccatgcccaccgttcaagatcattatccttgatgaagcagatagcatgacccaggatgctcaatctgctcttcgacgcacaatggaaacctacagcaagatcacacgtttctgtcttgtttgcaactacgtcactcgaattattgaaccactggccagtcgatgcagcaagttccgtttcaaaccgctggataactcggctgcaggtgacagacttgcacaaattgcgaaattggagaacctggagttggaggatggtgtcgttgacaaactgattcagtgcagtgatggtgacttgcgacgcgcgatcacatacatgcaaagtggagctaggctagtaggagccactgggaacagcggtagacaggatggaggggaagacgctgaaatgacagatgctagctcacaagtgattactgtgaggatggtagaagagattgctggcgtgatcccagagagtgttctagaccagtttggtcaaactatgcaaccaaagaagatcggttcctcctaccatgccgtctcgaaggtaactactgatatttgtgcggatgggtggagtgcgacgcaattgcttgcacagctttaccgtcaagttggttacaatgacgcccatccctgatt

SEQ ID NO: 4634 - DNA, 696 bp, Aspergillus oryzae
cggctacaaaatgcttgcctctctgcttggaccgctcgcattctttgctagtcgtgctgccgccacaatattgtatgctggtgtcgacgagtctggaggcgagtttggtgtctatggagctaaaggtcaaggcctccccggacgcttcaatgtcgactacgcatttttgaacgcttcaactgtgccaatttgggtgaagcagaacgggatcaacgtcttccgcgtcgcattcctccttgaacgtttgtgccccctcgagtacggcctcggatcccgtttcaacgagacttacttctcggaatacgcgactgccattaacgcgatcacctcggctggtgcttacgcactcattgacccacacaactacatgcgctacaacgacccgtcttctcagcctgtttccgggtctattatcggcgacacaacggatcccgcggctgccactactgcccagtttggcaagttctgggctgcattggccgctcgattcctgttcaacgagcgagttattttcggactgatgaacgagccacacgatatgtccacagctcttattcttcagaataaccaggcagcggtgaatggtattcgtggtgtaggtgcccaccagctgattcttgcgcctggaaatggttacaccggcggacatacttggaccgtgagcgccgcggggcgacgagccctcaggcgactact

SEQ ID NO: 4635 - DNA, 589 bp, Aspergillus oryzae
  misc_feature (1)...(589): n = A,T,C or G
gtcacctggatacatgccacacgatctttttgacacgatgatcggcgaacctgaacaatacctaaaccatccgacaatgtggatacactcctagattagccctctacagcggcatactgaaggaagtcatggaatacttttggctgggctctcacagagatcaagacattgcaacttgaaacatgtgtcctccagctgccatctacgaacccactgtggccgctaccggccataaaaggtaatgtcggggatgctgagaccgcccccggtgagggagctgctcagaccaagctgttggaccataccggtggcaactgagacgagtgaaaggtcgcccctatccgcgaaagccaggtctctcgtgccatgaccagacgttactttgaggacctggacaagtacgctgaaagtgacgaagacattgttggtgctggttcctgcggtctgagcactgcgtacgtcttggccaaggctcgtccggacctgaagattgctatcgtcgaggcccacgtcttttcttgtggccgggcctggatgggtggccactcttttgtggtatggcatgcgccgcctgcgaaacgctacttan

SEQ ID NO: 4636 - DNA, 866 bp, Aspergillus oryzae
atgggatgcggatggatatgccgatgaagatgatggtacggttctggattattccgcacctgctgatggcgacgaagcagctgctccggccgtggaagctgttgcacaggattcctggggccacagaactgggaaaggacagttcgttctgaaagacttgggtgatgaagtccattctatcttggagaatgcggacagtgaaaaagcgaagaacagggccaccggaatcgttggctcaggattcaatgctatcggtggccttttccgcaacatcgtgggtgggaaggtcctgaccgaatccgatttggagaagcccctgaaggccatggaggaccatcttctgaagaaaaacgtggcgcgtgaagcagcagtccgcctatgtgacggtgtgcagcgggaacttgtcggaaagaaaacaggaaactttcaaagtgtggatgctgcattgcgccaagccatggagtcgtctttgcggaagatactcacccctacatcttcgctggatctgcttcgtgagattgatacagtcacatctcccacaagtaaacagcagtctccccgcccttatgtcatctccatagttggagttaacggcgttggaaaatcgaccaatttgggcaagatttgctacttcctgttgcaaaacaactatcgtgtcctgattgcagcatgcgatactttccgctttggcgcggtcgagcaacttcgtgtgcacgccccgaacttggaaagaactcaatgcccgtgaaaatgtggggcagtttaactgtattaatagggatatggcaaggatgcaaccaatgtggccaaagatgctgttgaatcggagcttccacaagttctaccttggtttgatcgatactgcg

SEQ ID NO: 4637 - DNA, 665 bp, Aspergillus oryzae
  misc_feature (1)...(665): n = A,T,C or G
gttccttgctgctgaggctctccgtggtgagggtggtcttctccttaactccgatggccagcggttctcggatgagctcggtcaccgtgattatgtctcgggccagatgtggaaggagaaggagaagggcaagtggcccattcgcctcgtcctgaacagcaaggcatccaacgttttggacttccacacccgtcactactctggccgtggtctcatgaagaagatctccggcaaggagttggctaaggagatcggctgcggcgaggcggctcttcagaagaccttccaggaatacaatgccattgctgagggcaagcagaaggatccttggggcaagcgtttcttccacaacctgcccttcgacatcaacgacaccttccacgtggctctgatggagcctgtcctgcacttcaccatgggtggtatcgagatcaacgagcacgccgaggttctgaactcggagaagaaccttttgagggactctatgcttgtggtgagctcgctggtggtgtccacgggtgcaaacgtctcggtggttcttctctcctgggatgtgttgtctacggtcgcgttgctggtgacagcgcaaagcagcaactcttccagaagctggtctctggcggtgcttccagcgctgctcagcgtctgggcaagatctctctgan

SEQ ID NO: 4638 - DNA, 535 bp, Aspergillus oryzae
ctgtgctcttttctcccattcctatcctcgtacattacaattcaaaatggcttccaagacctggtttgatggccttaagaggtccttcgccgatgttcccgttggcgcagacaactccatttctaccaccgagttcctcgaagcctccgaatccctcactactttgttcgatgtgctcggctccgtggctttcactcccgtcaagaacgacctacttggaaatgtcaagaaactcagagaccggcagctggctgcccctgctgagtctgagactgttcagtctctttcagtgaacgaactgaagaccaagaagcacaccgcctctgaaggtctactctggcttgttaggggccttgacttcactgcccaagccctccgccgccacgtcgacaagaccggtgaggagcttgccagctccttccgtgaagcctacggtgttaccctcagcaagcaccacaatttcattgtgaaaaaggtcttcagtgtggccgtaggtgctggtcttaaaaccagaatttttacaagcccttgcctt

SEQ ID NO: 4639 - DNA, 678 bp, Aspergillus oryzae
  misc_feature (1)...(678): n = A,T,C or G
ctctggacgaggctattactacatctcgcattttgaccccgatcctttcccccctccgtactactttggtttcttaaaccagcactgggtccaaggagccctcggggttccggttaatttcaccgaatctgttgatagcgtctacaatggcttttccgcaacaggtgactacccacgctccgatgtacgcgggtacctggaggatatcgcatacgtgcttgactctggcatcaaagttgccctagtgtatggcgatcgggattacgcatgcccctggaacggaggagaagaagtgagcttgaaggtggagtactcggatgccgccaagttccgctctgcgggttacgcccctctgaagaccaatgcctcatatgtaggtggcttggtgcgacagtacggaaacttctcgttcactcgcgttttcgaagcgggtcatgaggtgccggcatatcagcctgaaacggcgtatgagatcttccaccgagcattgttcaacagagacattgcgacgggcaaggtctcaatcgccaagaacaacacctactccactcacgggccctctttaacttggaacgtcaccaacacggtttctgacaggcctgcacccacttgctacattctcgagttgggcagcacttgcacgaaagagcagaatgcgagtgtcgtgaacggaactgn

SEQ ID NO: 4640 - DNA, 649 bp, Aspergillus oryzae
  misc_feature (1)...(649): n = A,T,C or G
ccacaccgaattcatcactacatccgactatatacccttctactataacgatacactttccccctccccccactaaaatgtcgcattctcactcccatgatcaaggcattagccactcccacgatgacttcggtggtcacggtcactcgcatgagatcctcgacggacccggttcctatgtgaaccgtgaaatgccattgatcgagggccgcgactggagagatcgcgccttcaccatcggtatcggcggacccgtcggatccggaaaaacagctctaatgctcgcattatgccaagctctccgagacgagtataacatcgcagcagtgaccaacgacattttcacccgcgaagacgccgaattcctcaaccgccacaaagccctcgcgtccaagcgcattcgcgccatcgaaacgggtggctgcccgcatgccgccgtgcgtgaggacatcagcgccaacctccttgcgctgcaatccctccacaagcagttccagacggatctcctcctaatcgagtctgggggtgataacttggccgncaattactcgcgccaacctggttgatttcaatatctaaggtatttgatggtcgccgtggggaataaagggcccccggaaagggtgggcccggaaaatacggaaacgca

SEQ ID NO: 4641 - DNA, 680 bp, Aspergillus oryzae
tctaaacaataacctgattaccgcgcccgagctctccggactgcgaaaaaggttacggaacctggacaccagagagggccagatgttctttgtggctttattcaggtcttggtgtcacaattctgtctccacattttcactgtgtctgcttgcacaagcatatgagcaagcctacaaccttcttcaagtctttgccgagcttgaaatgactgtcaataatctgatccaaatcgataagctggtccagctgttggagtctcctgtcttcacctatctccgacttcaactgcttgaaccagaaagttatccatatctctacaaatgcctctacggtgtcctcatgcttcttccacagagctctgccttcgcggctctaaagaatcgtttaaacagtgttagcaacattggccttctccatacacctcgactttccacgatggtttcagcctccggctcaggcgcctacgatcgctcgacaggcagccgctccaaacgcgaagagaactccatccgctgggtcgaactacttgaaaaattcaaaaccgtacaggaaagggcccgccgagccctacgtgcaagagagcgtcccttcgacgatggcgtggccggcttccagggtcaatcgttagctgccgccttctctgctgcaaaccaagcgcggaacaaggaacgggcaactt

SEQ ID NO: 4642 - DNA, 695 bp, Aspergillus oryzae
ggatgaggaatcaactatcgttcaatgcctattcccttgcttgctcaggggttccaggagggtatctcctctattccttatgcgtggacagttttgaagatcgtgccatttgtgctcttggttgctgcgttgaagtattatttcggtggtgcccgaaatggatcggagcggttgatgcactctaaggttgtgatggtcacgggtggaacatcaggaataggagccagcgtcgtccacgaacttgcctctcgcggtgcccaggtcatcctcctcacaaagcatgccccctcggacgtcttcctggttgattatatcgaggatatccgaaagtcaacgaaaaaccaactcatctacgccgagcaggtagatctgtcctcgctgcactcaatccgcacattcgcaacaaaatggatcgataacgtccccccgcgccgactagacatggtcatcctgtgtggaaacacagccgcaccttcatccgccagccgaaagctgaccgcagacgggctcgacgaagaatggcaagtgaattatctcgccaactttcacctcttgagtatcctcagtccggcgctaagggcccacccccctatcgtgatgtgcgggtttttttcaccacctgttcgatctacattggagccaaaattgccccttagccaaatcgagggagtttggacacctcaccccccaccgct

SEQ ID NO: 4643 - DNA, 640 bp, Aspergillus oryzae
caagggataccaggttctgtttctagatcaacgtggcactggcctcagctccacgatcagtgcaggtacccttgccttgaaaggcaatgcaatcaagcaggcggagtacctgaagaacttccgagccgataacattgtcagagattgtgaagccgttcgccgttgccttaccgtggactatcccgaagataaacgtaaatggagtattatcggccagagtttcggtggtttctgcgctgtgacgtatctttctatattcccagaggggttagcggaagcgtttatttgcggcggattgcctcctcttgtcaatgatcctgacccagtctatgcacggacataccaaaagctggaggagcgaaacaagggctattactccaagttccctgaagatgttgagagagtcaagagaatcatgcactatctcgaggagaacgatgtttttggtccgtccgggagactgacacccgcgagattccagcaattgggtctgatatttggcatgcaccgtggccttgatagtattcacgaacttggtctgcgcgcctggaaagaactcgagaacttgggcgttctgactaatactaagcgcacttcaatcgatgcccaagtgggttttatagggctggtaattatgccc

SEQ ID NO: 4644 - DNA, 566 bp, Aspergillus oryzae
  misc_feature (1)...(566): n = A,T,C or G
tatgctcgtccgatcggccagggggccatcatncatagccaatactgcacaagggaagtccattggcatgggccgttggtgaaaaccataataaactgcattgctaatttcgctgctttaatcatcaataatcctgactttagccgatacgcagccaagccaaacgatgcggtatggccacaactgatcacgattccggtaggctttgctgtaacctcgtttatcggaatcatggttacttcatcctcgtcggtgatcttcggccaagcggtctggaaccctctcactctgctaggaatgttcttggaggatgccagttcggcggaacggttcggcgtgttcgttattgccgctggctttgcattggctcagctgggaacaaatattgcagccaactccgtatccgctggaaccaatctctcggccttactccctaggttttgcaccatccgccgaggagcctatgtgtgtgcagctattggcctcgcgatgtgcccgtggaacctcggaaccttcttcacaaaatcaccgagtacctggcatccattaaggtttcttttctcaag

SEQ ID NO: 4645 - DNA, 693 bp, Aspergillus oryzae
  misc_feature (1)...(693): n = A,T,C or G
cggcaatgcctttctcacatttcagccactccgggcaattctgcccgggacacgccaaagactcgctggaggaggtcatccagctcgctattgcaaagaaattccaggtcttctgcctgaccgagcatatgccgcggggcaaagaggatttctatcccgaagagatcgaagcaggcaacactgagacgagcctggttgccaacgaagccgcatactttcaagaagcgcaacggctgcgcgagaagtatgcagaccaaatcaagatcctgattgggttcgaaatcgactggatccgtccggaatcccgcacgctcatcgaggcgtctctggcgcgtcaccccttcgagttcttcatgggctccgtccaccacacgctgacgatccccatcgactacgaccgggagatgtacgtacaggcgcgggatctggccggcggcacggacgagcagctcttccaagtgtactttgacgagcagtaccaaatgctgcaacagttgaagcccgctgtcgtgggtcatttcgatctgatcccggtgaagagtgacgaccccgagccgagctttacccagtggcctgccgtttgggagcgtatcctgccgaatcttgactccntcgcgtcataccgcggactgcttgagtttaactccggtgcgctcccgaaaggcatgaaccaaccgtattctaaagcgggan

SEQ ID NO: 4646 - DNA, 670 bp, Aspergillus oryzae
  misc_feature (1)...(670): n = A,T,C or G
cattcaaatcccgaagccttctgggttatccaagtcgataactacaccctacactccacctgtactcactttgaattatcacctaacccttggtcgatattgagatactccttacaagatgatgtctttcatgggtcaccaacctcagagccaggccgtcggctacaccttctctcaaccaacaaacgccccgaacaaagaacactcattttacccgtacactgacaacggtggctccactttgggtatcacaggtgctgacttcgctatccttgctggagacactcggtcggtggcagggtataacatcaactctcgctatgctcctaaggtttttaaaattggcggtgatgatgatactggcgagggtgcccatattattctgtcggtcgtgggcttcgctgcggatggtcaagcactcaaagaaagattagacgcagtggtgaagatgtacaagtatcaacacgggaagcccatgtctgtcagagcatgcgctcagcgattgtcgactattctctaccagaagcgtttcttcccctattatgtgccatgctatctggccgngttggatgaagagggcaaagagcgttgtacagctacgatccggtaggctcatacgaaagagagcagtgcaaagcggccgggatctgccgcagtttgatcatgccgt

SEQ ID NO: 4647 - DNA, 768 bp, Aspergillus oryzae
cccctctcccaccgatatccctccaattcacacttcaaaatggccgcccgcagcgccgctcttaagattgactgggtcaaggtgaccagctctctcggcctccgcggccagaccgctgcctctctccaggctttcaagaagaggaacgacgatgcccgtcgcaaggttcagcttctgtccgaacagccccagaccatcgacttcgcccactaccgcaaggtcctgaagaaccaggccattgtcgacgagatcgagaaccagttcaagaccttcaagcccgccacctacgatgtttcccgtcagctgaaggctatcgaggctttcgaggcccaggctgttcagagcgctgaggagaccaagggcaaggttgaggccgagctccgcagccttgagaagaccctcgagaacatcgagaccgcccggccattcgatgagctcactgtggatgaggttgcctctgcccagcccgagattgatgagaagaccgcctctatggtcagcaagggccgctggatgccggctggttacaaggagcgcttcggcgatatgtctgttgtctaaactatcagcattatctgtcattttacgcctcttttctccttcgaccagtatcatcacacgatgggattttcttttgtcaagcatgtttaccagctaggataccctttgcgcctggcagtgtgaacttggttgtgggacgtgtatagaaacaatgtgcaatttacaagatggtttcctgccttgaaaaaaaaaaaaaaaaaaaattcc

SEQ ID NO: 4648 - DNA, 664 bp, Aspergillus oryzae
  misc_feature (1)...(664): n = A,T,C or G
gccgtaccccaaatgagtgctttttggaagaatatgcgcgggggcaatctccaaaagttgatttatgcccctccttttctttgcggatacttctctcatttctttaacactctttactctcctctcaactgcagtcgctcttctcattaagcgcaatctctacacacaataatcacaatggcttctcccaccgtcaagctgaacagcggacatgacatgcccctcgtgggttttggcctctggaaggtaaacaacgagacatgcgcggaccaggtttacgaggccatcaaggcaggatatcgtctctttgacggcgcatgcgactacggcaacgaagtcgaatgcggccagggtgtcgcccgcgccatcaaggagggcatcgtcaagcgcgaggaactcttcattgtttccaagctgtggaatagtttccacgagggcgaccgcgtcgagcccatctgccgcaagcagctggctgactggggcgtcgattacttcgacctgtacatcgtgcacttccccgttgcgctgaagtacgtcgaccccgctgtccgctaccccccgggatggaactcggagagcggcaagatcgaattcagcaacgccaccatccaggagacctgnacngcgatggagtcgctggtggacaagaagctcgctcgcacat

SEQ ID NO: 4649 - DNA, 644 bp, Aspergillus oryzae
ggtgatgtcatccattctgtcctctcttttgtcgaggagaatattcgtaatgaagactggcgtcgcagagacgctgcagttgcggcattcggtgccatcatggatggaccggatcctaaggttcttgaacccctggtcaagcaggccttaggtgttcttgttggtatgatggaagatagttccattcaagttcgtgattcggcagcctatgcccttggtcgcgtgtgcgacttctgctctgagaccctggaccctgacgtgcatctacaaccccttatttcttgcctgttcaacgggcttgctagcacccctaagattgccagctcctgctgctgggctctgatgaacgttgccgatcgatttgccggtgacgttggtgcgcagactaaccccctatcaaagcactttgaagagagggttaagtcgcttcttactcttactgagaagccagatgcagacaaccaacttcggactgctggatatgaagttcttaattccttcggtacccaatgcggcgaaacgacagtctggctatgggtggctagccctcttcgacggttgggatttaacgcctggagcacaccatccccatgcaacagcaagtcgttaatgtggaagatcggatcaccctggaagaaggtgcc

SEQ ID NO: 4650 - DNA, 596 bp, Aspergillus oryzae
  misc_feature (1)...(596): n = A,T,C or G
gagcatccacccctcgtcgtccggcggctgaagcttccccgcggtctctcctccccacctttttcaacatctcgtttcgcaaacaggttgtatccccgtcacaatgcaagccgtcccggagtcgcgacagcagacctttgaggaaatctacggtcctccggagaatttcctcgagattgaggtccgaaacccccagacccacggcacatcccggaacatgtacacctcgtacgaaatcgtctgtcgcaccaacatccccgcattcaagctcaagcactccgtcgtgcgccgccgctactccgactttgaatacttccgcgatatcctggagcgcgagagcacgagggtgactatcccgccgctgcccgggaaggtgtttacgaatcggttcagtgacgatgtcatcgagcaccgcagggaggggttgcagcggttcttgcaaattgttgccggtcatccgcttttgcaaacagggagtaaggttttggcgagctttatacaggatccgaactgtgaaccgcatgctnggtanaagttggttggtttggggggtggatcgtcattgacatgaagggcttgcttcagctgtgctgttt

SEQ ID NO: 4651 - DNA, 293 bp, Aspergillus oryzae
gagagcgttcggacgaggcatggtcatgcccaatctgtacggcggaattctttctaatgtcggtgcagcccttgttggcggcccaggcgttgtccctggctgcaacatgggtcgcgacgttgctgtatttgaacccggctgccgtcatgtcgggctcgatatcaagggcaaggaccaggcgaaccctagtgctatgattctctccgggtctatgcttctgcgccacctcggcttggatgatcacgcaaacagaatctccaaggctgtgtacgatgtcattggtgaaggtaaaa

SEQ ID NO: 4652 - DNA, 683 bp, Aspergillus oryzae
  misc_feature (1)...(683): n = A,T,C or G
gctcaagaacggcctgtccaagcttcacgaggcctgcaagctacagcccggtatcccgattaagcctatgcttgctaagccaacgaaatccatcaccgaagtgcttgaccgttttgaaggaaaggagtttacgtgcgagtataagtacgacggggagagagcacagattcactacgttgcaccagacgcaacccacaactatccggaagcacaacacacgttacagaaggatggcaaaggcctcgctgcgattttttctcgtaactcagaagacctgtcgaagaaataccctgatgtgctggctaagctcgacagttggatcaaggatggtgttaagagctttgtcttggactgcgagactgttgcttgggatacggtgaacaagaaggttctgcccttccagcagctgatgactcgcaaacgcaaagacgtcaaggctgaagacgtcaaggttaaagtttgtgtattcgcctttgacctcttattcctgaacggagagcctactgtcaagaaatcacttcgcgaacgccgagaacttttacatgaatcatnccaggttacggaaggcgagtttcagttcgctcagttcggtaacaccaacgtactggatgagattcaggagttgctggacgacagtgtcaaggcatcgtgcgaaggtctaatggttaagatgttggacacgn

SEQ ID NO: 4653 - DNA, 684 bp, Aspergillus oryzae
  misc_feature (1)...(684): n = A,T,C or G
ggaattatcatggcattgttctttgcgcccttgaagaacgattacgccgcggtgcaatcacggatgggcttcatccaggagtttggcgctttgtactttgtgggaatgcttcaaaacatcgccatctaccccaacgaacgcgatgtgttctaccgcgaggaggccgaccattgttactcggctgagacattcatactgcagtacaccacgctggaggtgcccttcgagatactgtcgtccctcatcttcggcgtcctggccgcatacgcggataacctcgggcgcagtgccacgatgttccttatcaccgcgtacaactgtttctgcatcgtcagctgcggtgagtcgctgggcatcatgttctgcacgctcttctcgcacgttgggttcgccgtcaacgtgacgtcaatcttgctctccatcgcgaacatcttangcggtgttatgagcttgaacgtcaacgaggttctccaagggcttaaccacctctcgcccgtcaaatatgccgtcgccaacctggcgccctatgctatgcgggaccaggagttcgtgtgtacggcagcgcagcgattggcggatggaagctgtccaatccagaacggacagcaggtgctccgactctacacctcgacaagaacggggcgatcaatgtaatggcncttaggtggttgtacgataaattat

SEQ ID NO: 4654 - DNA, 694 bp, Aspergillus oryzae
  misc_feature (1)...(694): n = A,T,C or G
ctttatttgctccctacattatttctcccctgcatcatgggaaagcgtggaagaaagggacagggcggccgcggtggtggcgggcagcgccaaaactggaccgacattcccaagaccaacgagaagttcgaacgcttctataacgagcaagggtttattcccgaggaagaaagggaggtattctgggagtatctgcggcgagacctccccaacagtttccgctttacaggatcacgaggacatgccctcgcggttcaggagcgcctcaaagaattctatattcccgaaatcacgtcgattaagtatgagggcaacttcgtcgagccaccgcgcctggtgtcctggtaccctgaccagctcgcgtggtcgatgacgaccccgaagcaggtcgttcgacgctttgctccgttcgccaatttccagaagttcctcgtcgccgagacagctgtcggaagtatcagccggcaggaggttgtcagcatgattcctccgctcttgcttgatgtgaaacctggcatgactgtgttggacatgtgcgctgccccgggtagcaaatctgcacagcttatggagatgatccacgctggagaggaagagtcgatgtcccangctttccaacaagtgaaggagggaaccgcttgtccccaagctttgggacctgagggtcttaacaacnatggtagaaccaccggct

SEQ ID NO: 4655 - DNA, 663 bp, Aspergillus oryzae
  misc_feature (1)...(663): n = A,T,C or G
cttgcttcgttattgtctttcgttattcttcttcttcacctattattatcgcggctttacttaactatcatcgaatttcaatcgttatttcccgacaatgaccgtatcaccacgcaacaccgtggagaggctcgatcggccgagcgcctactacctgggaaagaacaagaagcgcaagtacagccaagatgacgcggacaaggttgcagaagatccaaccgacaacttaaaaaatgctaccactctttatgtcggtaatctttctttctacacaacagaggaacagattcatgaacttttctcaaaatgtggagaagttaaacggcttgtgatgggactcgaccgatttacgaagacaccctgtggcttctgcttcgtcgagtattacacacatcaagatgcgttggattgcttganatacgttggtggcaccaagctcgatgagagaantatccggacgggatctgaccctggttncgaggaanggaggacatacggtcgtggtaaatctggtgggcanggtcgcgacgaataccgagaagagtacgaacccggacgtggcggttatggacgggctattcanatgatcanagacaacggggagaaaaanaattaccgtangggttaggtattaatgattgggaccttgtgtgaatgggcccc

SEQ ID NO: 4656 - DNA, 677 bp, Aspergillus oryzae
  misc_feature (1)...(677): n = A,T,C or G
natatagattcggacgaggctcaccttccttccatctccctcctttctcgcgctcttccttacctctatatcttctcgacatactgttaaaacttgaaaatggaggttctactgggtatcaccggcaaggactttgtcctggtggcagcgtccaaagccgccatgaggggcccaactattcttaaagccgaagacgataagacacggcagctcaacaaacacagtctgatggctttctcaggagaggcaggagataccgtacaatttgcggagtatattcaagcgaacattcaactatatacgatgcggaatgataccgaacttggaccgaacgccgttgccaactttgtccggngagaactggcgcgcagtctgcgatctcggagtccatacacggtcaacctgttgctcgctggtgtcgatgggatcacccagaagcctcacctgtactggatagactacctggcttctttgcaccagtaccatatgccgctcatggntatgcccatactatnngctctcacactcgataaacacaccatnctgaaattncctcgaagaaggctaaagcttctnagattggccagaccacttaagcgtgattgccgatgatacaggggggtttggtaaagtcngaacaagatgggcgagagaggtgacttgtaatggcacaaacg

SEQ ID NO: 4657 - DNA, 688 bp, Aspergillus oryzae
  misc_feature (1)...(688): n = A,T,C or G
cttcgttgtcgacaagttcccaattccagcaccaccaacaccgccgacatgggtcactctcacggtttgagatccggcactcggtatgccttcagccgtaacttcaaggagcacggccagatcgccctgtcgacctacctgaagacctaccgggttggcgacatcgtggacatcaaggtcaacggtgccgttcagaagggtatgccctacaaggtctacaacggtaagactggtgttgtctacaacgtcaccaagtcctccgtcggtgtcctcctctacaaggttgtccgcaaccgctacctcgagaagcgcgtcaacatccgcatcgagcacgtcaagcactcccgctcccgtgaggacttcatcaagcgtgtcaaggagaacgccgagaagaagaagcaggccaaggagcagggtgtccacctccaccttaagcgccagcccgtcggtccccgtgaggctcacgtcgtccaggccgccgctcccgagaccatcactcctatcccctacgacacccacatctaaacgaatagaatggtcaggtcgatgcggttgtttggtgtttctgggttttgccatctaagggtggattttgcattgagacgaagcgaaaaagggtactcggatgtactagcacaactcagcctgtgcatagattcccctgaatgaaacanaacanaaaatttcg

SEQ ID NO: 4658 - DNA, 723 bp, Aspergillus oryzae
  misc_feature (1)...(723): n = A,T,C or G
ctacctgaagcggctgtagaaaaattgcggacgaagcttctgccattgacaaccgttctcacccccaatatccccgaagcgaagctgctactgaaagacgccggtctagatgtaccggagccagagggtctcccggacgttcttcagttagtcaagcaagtcaaagccctaggccccaaagctgttcttcttaaaggcgggcatttacctctcaccaaggatcacaaaacggcgcggaaccaggacgaggctaccacagttatagacgtgctttacgatggacaagatatcacacttttcgagacagacttcttattatctaggaacacccacggcaccggatgttctcttgcgtcttcgatcgcagccaatattgccttaggcaaagatttgaagcgagcagtgcatagtgctgttcggttcgtcgaggcgggaattaagaccagctttgatattggaaagggaagtggtccaatcaaccatttgcactcggtgtatacactaccttttgcgcctggtcgtttcttagaatatgccctggaccgacctgatattcgaccggtatggcagaagtttaccgaacatgaatttgttttgggcatgggcagtggcacactttccgtggagatattcaaggagtacctagtgcaggattacctctacctggtggaccaatgcacccttcatttgtccaatggactttgtctaacaatgtgatattcn

SEQ ID NO: 4659 - DNA, 775 bp, Aspergillus oryzae
  misc_feature (1)...(775): n = A,T,C or G
tggtcgagaaatggggtcgtcgtcctcttctcttgttcggtgctgtcggcatgtgtgtctctcaactcatcgttgccattgttggcaccgccaccacttccgacgtcgcaaacaaggtgctgatcgccttcgtctgtgtctacatcttcttcttcgcttgctcatggggttgcaccgcgtgggtggtgaccggtgagctcttccctctcaaggctcgtgccaagtgtctctcaatcacgaccgccaccaactggctcctcaactgggccatcgcatatgctaccccttatatggttaactccggcccgggcaacgccaacctgcagtccaaggtgttcttcatctggggtggattctgcttcattgccggtattttcgtctacacctgcatctacgagaccaagggtcttaccttggagcaggttgatgagctttacgctaagattcctgtggcctggcgctcccatgaatttgttccatccgtcagctatgctgacgttcgtgacgttgccgccggcaaagtgtctggcaacctcgctgatctagaggccgacgcccagatgaagcgtgatatggagcatgttgagaaggcctagaagtataatccggcgttggtcaattggagttttcctgtcttggttaggtgttcaacttcttttttcgtttccatagtccctatactgcctttgtacctagcgagtggctntttgcaactntatcttggtgatgagagacgtggtataatgaccatctcacgaccaatattttctattgt

SEQ ID NO: 4660 - DNA, 695 bp, Aspergillus oryzae
  misc_feature (1)...(695): n = A,T,C or G
cttttgttcagatgatccagcctacaacttgttttgggcagcttatgccgcagactgaaccgccactccttcaagctctgcctgtcactcttaaagatctagttgcaggttgttcatcaatagtcacacctagctgtctccgcaagctttatggaatttctgattccaagcccaagccagaccgtcgtaacaggcttggggtatctggttttctggaccagtatgcacgctatagcgactttcatcagttcttgcgcctctacgcaccgaatataacagacaataactacaccgtggagctcatcaatggtggtctcaatttgcaagattctttggaggacagctccgaggcaagcttggacatccagtacgctgctgctctagctgatacccctttcacgacattctatagcaccgccgggcgtggccctgtcatacgtgacctgnggcataatgacccaggtgaccctcacgagccgtacctggaacaactccgttatctgttggatctcccaaatgacaaactgcctgctgttctaactacatcctacggtgaattagacaaaacgtgccataatatatccaagaccacatgaacatgtttgctcaactggggcgcgcggagtcttgtgatctttacaacggcaaatcgggcgttggggactcgggcctactaaagacgggacctaatcgct

SEQ ID NO: 4661 - DNA, 639 bp, Aspergillus oryzae
cacgatcttaaagttcctatcacctcctattcaatcaccatattttccgtgattatcctaattccttcgcaatcaccataatgagcccaattcagattcccgtcgatgcgatcacctcgcgcttcggtgagcgctttaacagcctccgatcacaatccctaggctctcgtttcgccaacctccggcccatttccgagtttcttgacgtcaaacgggtctccaagccggccaacttcggcgaggttcagagccgtgtgaactacaacctgtcttacttttctagcaactatgccgcggtcttcgcgatgctcagcatctacagcttgctgacgaactttatgttgcttttcgtgatcatcttggttactggtggcttgtacgggatcggaaagcttcagggccgcgaccttgatctgggatttgcccggttcaacactttccagctttacaccggattgctgattgtggcggtccctctcggcttcttggcttctcccatcagcactgtactgtggctgattggggctactggcgtgtgtggctttgggcacgccgcttttctgggaaaacccatccgagatgcttttttcagaggaagcggtctaggggggcggccgcgaacttcttaacggtttggcg

SEQ ID NO: 4662 - DNA, 737 bp, Aspergillus oryzae
cccgataccttcgtctgggcctgaaacgtcttggctttatagtgtacggccacgacgattccccaattatcccagtgctgctgttcaaccctgctaagatgccagccttctcccatgaaatgctcaagcgaaagatttctgttgtcgttgtcggttatcctgctacacccttggtctcctcccgtgctcgtttctgcgtctctgccgcgcatactaaggaagacctcgatcgggtattgaccgcttgtgatgagattggcaatgtcttacaactcaaattctcgactggtgttgccggcggagccctcccctcgaatgaggacgtgacccctcctccagagatggagaaggaatggcaccggaagcgagaccccgttgctcccccgcggtggcgtatcgaggacgttatcaggcgcggtgtccaggacgccaaaggtccgttgtattagttcgtcatgattgcattcggtattgttacatattcgtttaaggggttggcctacagactcggttgatgctggtcatgccgcgtcgcaggctgatcgaaccattactacttcacgcttgttgtgtatcattaagcagccgccccctggttgtctctgcattcttaccacgtttccccctccatatgcatggcgtggaatggcccacaagcctcagaaagtcacggattcctgaccaacccatggatacgctgtttgaaaaattgactaccggccaacgaacttcccaaa

SEQ ID NO: 4663 - DNA, 645 bp, Aspergillus oryzae
  misc_feature (1)...(645): n = A,T,C or G
acagagtggaacgggaggggtttccaagtctaactgtacctttccaccatgtcgctcttcaatgtactggccctgttgatggccttcgtctgttcggtgaccgctcagacatggaccgactgtaaccctctcaatgaaacctgtcctgcagcgccggctctgggtactaatcactcttgggtcttcaatgagaccatggacgacaagatttggtcggttacgaacggccaagtggactggaaagataccggcgcggaattctccatcaaaaagaaattagattcgccaacgatgcagtcgaccttctttatcttcttcggtattgtcgagtcccacgtcaagatggcgaagggcggcggtatcgtcagcagtgtggtgcttcaatcagccgatctagacgagatcgactgggagtggatcggctacaatacctctgaggtccaatctaactacttcggcaaaggcaacgacacctcgtttaaccgtggtggcttccactatgtggagaacgctgatacagaattccacaactacaccacctactggactcaggagaagctcgagtggtggatcgacggcaatctggtccgcacgctgaagcctgaagatgccctggatggcaagaactatncacaaacacctagt

SEQ ID NO: 4664 - DNA, 715 bp, Aspergillus oryzae
  misc_feature (1)...(715): n = A,T,C or G
cttctagtatggggttcccgagggcaaggagtgagaaggcactctacacgactggaaactcggatttcgaagctgcaatgaactggttatttgctcatctggaagatcccgatattgatgaacccttgactatcagcgagatcagggggggaggaaccgacgcctcacatgacccagcaaaagtggcacaattggtcgaaatgggcattgacgagtcccgtgccaaacgagcattgggtgccacaggtggtgatgtcaatagagctatcgactgggtgtttagccacccagaagcagatgctgaaggctatggtcgtgaatcaaacacccattctgatggttgccctagaaacctcggttctagtgatgtaccagctaggtataagcttcgctctattgtctgccataagggttcttcagtccacgctggacattatgttgcctttgtccggaagactctgccaggtcagaatgaaccatgttgggtgatgttcaatgatgagaaggttgtgaaggctggggacatacatgagatgaagaaatacgcatacttgtacttcttttcacgggtctaggcattattttctaatcctgagtgagcacaccttgcacgaggaactcccaccagggattggtnatgtacacctagtaatgctcaccaatagagagagagtcggggttcttactgcggtatggagcactgttagacgccgtt

SEQ ID NO: 4665 - DNA, 649 bp, Aspergillus oryzae
  misc_feature (1)...(649): n = A,T,C or G
gaaatacggccactctcatgatgcttttaagatctccatcacgaacaccgacgtgtggaacgacgttgagttccccagcgaggccgtgaagaaggagttgacgcagtatatcagcaagaggcttacgccccaccccaccaaggttcgcgccgatattgaggttacttgcttcggttatgagggaatcgatgcggttaaggctgctctgcgtactgctgaggaggccaacacccccgatagccaggtcaaggtcaagctggttgctcctcctctgtatgtcttgactagccagtgcttggacaaggctatttgtatcaagcagcttgaggaggctattcagaggatcgaggctaaaatcaaggaggccggaggtggctgcagcgtcaagatggcacccaaggccgtcaccgagcacgatgatgccgcactccaggagctcatggagaagcgtgagcgtgagaacatggaggtcagcggtgacgagagccagtctgagagcgacgatggtgttcccgagtaagcagcgcacaagacgcctacagcgccaatttaggcctatgaacccgattcgaaagaagagaatgtcagaanaattccgatgtgtagttgaacaacactgaatacgaaggctggttatgagtactggttg

SEQ ID NO: 4666 - DNA, 673 bp, Aspergillus oryzae
  misc_feature (1)...(673): n = A,T,C or G
ggagaagctcgactcgtctagttccggttcgggtacacctggcaatgcggggcccatgagagtgatgattggaatgggattatagggttctttcatccattctgcaacgccggaggaggaggagaacgtgttctttgggaagctgtgagggcaacgcagaagcgctggcccagagcgatttgcgctatatatacaggagaccacgaagtgaacaaaactgccatgctggagagagtccagaatcggttcaacattcaacttcatgccccgacagtggtgttactataccttactacccgtaaatatgttgtcagcagcatgtatccttacatgactctgctgggtcagtctttgggatccctggttgtcgcctatgatgcattcaatcttctggttccagacgtgttcgtcgataccatgggctatgctttcacactggccttctgcaagatgcttttcccgtccgtcccaacaggtgcttatgtgcactatcctacgatatccacggacatgctccagtctttagatgacacccaccgcgttgaaggaanttaacgctgtgccngaaagggactgaaaggacagatcaagcgaaagtactggcttgctttcgnccgtctacngcttgggttggtggcaatgtggacgtcgtgatgtgccactncttcttgac

SEQ ID NO: 4667 - DNA, 700 bp, Aspergillus oryzae
gatgtgatctccgtcctgtttcacatgaaggagtcctgcgaacaggtccgcagtggtgagtggaagggttacactgacaagaagattgacaccattatcaacattgatatcggtggttctgatcattggtccggttatggtcaccgaggccctgaaaccatacggagctgaccgcatgaagctgctctttgtcttcaacattgatggaactcacattgccgaggccctcaaggactacaacgctgaaaccaccctcttcctgatcgctttcaagacctgctctaccgcaaagactactaccatcgcgaataaccctaagaagaggttcctcgagactgccaaggatgaatttgatatcgccaagcacttggttgatctgaacaccaacgaggcctacgtcaccacgttgggtcttgaccagaccaatatcttccgtttaaattcttgtgtggatggtctcttctgcgtctggagtgctatcgtgattattcgtcgccctcttcatccgttccaatgaactaccgccaaatgatgtgttggtgccccatccgattgacaaagtactttcgtgaaagctccctatggactaaaacttctccggcaattgccgggcttgcttaatggctgagtacaagtacttttttgagtggcccaaataacactgggttgttccttttcataaacaacctttatcctattg

SEQ ID NO: 4668 - DNA, 693 bp, Aspergillus oryzae
cccattttgagagcaactctttcactcggggatggattcaaaatgtcggtagtgggttctacgccgcggcctcgtctagtggttctttcttcttcgcgctaaacttcggtgatgaaggtggtgcacctgtggaaacatggatcttccgtgcatgtctcattcagggtatccagtccgcctatgttattgctctctggtactggggttcaaccctgtcacaggcacaaagtgagtgtctcttgactcctacaaacaatatctccaattcttggaagattagtgccatctgttaccccattgccgcggcccttttcggaattggtttgctcttgacattcggcctgcccaactattaccgtcaaacccctggcaaggtcgcttccttctacaaatccgtgttccgtcgtaagatcgtcctctggaactttgtcgcggtcatccttcagaacttttttctcagcgccccctacggccgcaactggcagttcctctggacatcccaccacgcacatcactggcaaatcgcatcccttggggtgtttctacgggttcgaaggggccggcttctaattcaggccaggtgcttattaaaaaaaacagatggttcttcccggggtcccctggtacctatgcactccacctcgtcacaatgatggggtgaggtgatcacacacatgacaaccattattgccc

SEQ ID NO: 4669 - DNA, 671 bp, Aspergillus oryzae
  misc_feature (1)...(671): n = A,T,C or G
gcttgctttccgggttcttctttcctttcgcacatcctctaccagggtccccaacctaagattttctgtcccatcaggagccaatcggtatatcgcaaccatggcgacggatacttccacgtataagctcaatcacactatgatccgggtcaaggacccgaagaagtccctggaattctacaagttcctcggacttactcagattcaacaactcgatttccccgaaaacaagttttcgctctacttcctcgcatacaacggccccaagtccctgcagggtgaccgtcactggacggaccgcaacgctgttctggagctcacccacaactatggcacagaaaatgaccccaactacagcgtagccaacggcaacacggaacctcaccggggctttggtcatattgccatttctgttgacaacattgaatcggcctgcaagagaattgaagatgctggctatcctttccagaagaagctcactgatggacgtatgaagcacattgctttcgccaaggatcctgatggatactgggttgagcttattcgtcgtcataacgaggatgtggtacgacgacagataccggcaattaccgactcaacacagcatgctccgtgtgaagtgcgcanaacaagttttgaatttctccaagaggtattggcatgaccctttt

SEQ ID NO: 4670 - DNA, 697 bp, Aspergillus oryzae
  misc_feature (1)...(697): n = A,T,C or G
caaagcgactattttctggggatcaggtatacactttgataatcacatttgcccatcatggccgaaactcccgagcttgagcctcacaatgccttcgatactatcctgaccctagactttgggtctcagtacacacatctgatcacccgtcgcctccgtgagctcaatgtctactcggagatgcttccttgcacccagaaactggccgatctcaagttcaagcccgctggtgttatcttatccggaggaccctactcggtgtacgaggagggtgctcctcacgtcgaccctgcctactttgacctaagcgtgcctatcctcggtatctgctacggcttgcaagagattgcttaccgcctggacagcaccaatgtcattgctggcacgtcgagggagtacgggcttgcgcagctcaaggccaagaaggtcggcggccacgtcgaccacctctttgatggactggaagacgaattcaacgtcttgatgtcccacggtgacaagcttgggcaagcctcccgaaggtttcacacgattgcactactcccactcaaagacgctgtattgccacgagacaggccattatgggctccactgcacccgagtgaccaaaccagacggaccagctctggagactttgccgcacattgggctgcaacgactgacatgctcgttngtgaccagaatgcagaatcgaact

SEQ ID NO: 4671 - DNA, 734 bp, Aspergillus oryzae
  misc_feature (1)...(734): n = A,T,C or G
agcacgcgattcgcacgagggcgcgcagatgtcgcagtatccattgagaagccctccggagaccaagaatgggccaataaggtccggggatacacccctctccagcagcacgtcctattctgggaccgtgacggtgatgggatgattttcccatgggacacctatattggatttcgtgaactgggcttcaatatcctcttttcattcctggccgtgttgatcatcaatattaacttttcgtacccgactcgactggcatatagctggctcccagatccgtggtttcgagtttatgtacggagcgtacacaaggctaagcacggctcggacagtggtacttatgaccctgaaggccgattcatcccgcagcttttcgagaatctgtttgcgaaatgggactcggataatgatggagcgctgacgctacgtgagctgtttcaactgatgcacggccatcgctgcgctgctgatccgtttggttggggtgcggccctcttcgaatggggaactacgtggcttttaatacagaaggatggtaaagtttataaggaggatttgcgtgctgtgtatgatggttccatattctggaaaattcgcgaggcacggaaatctagcccaggatggacgcaaggatttggacttggtggagatgggtttgttggaggagaaaagatatattcgtaaaagaggcggntgatacataattggttgcgaggtcctagaatcgagaaacc

SEQ ID NO: 4672 - DNA, 738 bp, Aspergillus oryzae
  misc_feature (1)...(738): n = A,T,C or G
ctctcgaggtatcaagatgagaacaacggtctacttgaactctcttcaagtgtccgtcctacctatttaatattctctacccttcttcgtcggttctggattccacggccctgtccaattttttgagacatcgcccgtgtcaccccaaacctcattacaacccccactttcacaaaactagttgtggttctcacagcccagttccgcggccatcgacccctcttttaatatcccgttcaacatgcaatcagaacacaatgaaccgtatgctaatcgcattcaactttcagggactcagtcttgtccgcccccagaattacctcaactcgtcgccgagcaacatgttcccattgccgccaacgacaaggaaactcaacgtctaatcgttgtcctctcccatgctagtctggagacctatcgtgcctcccacggtggacgcaatggcgccggtcgtgatgagaagtactcattgctgaacagcgatgagcatatcggtgtgatgcgtaaaatgaacagagacattagtgaagctcgaccagatatcactcatcagtgtcttctcactctgctcgactcccctgtcaacaaggcaggcaaactccaaatttacattcacacggccaaaggtgtcctgatcgaagtgaatccaagtgttcgaattccgcgtacattcaagcgtnntgctggcctcatggtccactttctgcaatcgctctcgatccgctctaccaattctaa

SEQ ID NO: 4673 - DNA, 646 bp, Aspergillus oryzae
  misc_feature (1)...(646): n = A,T,C or G
gtgcggcaatggaattgtcgaggccggcgaggactgcgactgcggtgataattgtgatgataacagctgttgcgatggatcaacatgtcgatttcgcgataatgcggtatgcgacgattccaccgggccgtgctgtacaaactgccaatttgcatcgtccggcaccgtgtgtcgtgagagtactggaacttgcgacattcaggaaacgtgcaccggaaactccagcgcttgtcctaccgaccgatacgcaccagacggacaaacatgcggcaactcatccggcttattttgcgccagcggacaatgcacgaaccgagatatgcaatgtcaacaactcctgaacacaaatagcacgggtgtgtcctcctgcaataatgattcttgcaccctcagttgctcagttgactggtatggatctggggtttgtatgggcatgaaccggcaggtgcaagatggtactccctgttctgacggcctctgtcgcggtgggagatgtcggtctgagagtgagaataacggctcatgggtggaccgtcatcgctcgctgatcattggactgtctgatggaatncgtggagccttggtccttgcggtacttttgggtataatcatttgctgctgctgccgngaaaaaagactcccaaan

SEQ ID NO: 4674 - DNA, 919 bp, Aspergillus oryzae
cggaaataccatgctgtgtgcaatctcgggagaggcaccacaagagcccgtcgtctcgcccaagagcggcagcgtgtgtgagaagcgcctcatcgaggcatatatcgccgaaaatggaaaagatcccgtgaacggagaggagctctctaccgatgaccttatcgaggtcaagtcccagcgcgttgttcgacctcgtccccctacactcacctcgattccttccctactcaatgtgttccaagaggaatgggacgcccttgccctggagacatacacactgcgacagacattggcacaaacgcgccaggagctgagtacggctctctaccagaacgatgcggcagtccgcgtgatcgcgcgcttgaccaaagagcgagatgaagcccgtgatgcgctctctaaagtatccgtcggcgctacacgcgctgctggtggtgaagcaatgcaggttgattcaaatggactgcctgatgcagttttgtcacgtgttgaaagtacacaagcagcgctctcgaagactcgccgtaagcgcgctgttccggaaggctgggcgaccagcgatgctatctccacatataagcccgcccaaagcaccgagcccctctaccctggtggcaaggcactgtctgttaacgcttccggagagcttgcccttgttgggagcgctgacggcgttgttggtgtcttctcgctatctcagaagcaagtcgttcagagcttgcaagcaaatggtccggttacggatgctatctgggcaggtgataaggccgtcgttgcttcgtctaccggctcagtgaaggttttcgagaacggcaatgaagttgctgacttcagctctcatgctggcgcagccactgcgctcgccctgcaccctactggcgacatcgtcgcattcgttggcgctgacaagagtacgtgc

SEQ ID NO: 4675 - DNA, 707 bp, Aspergillus oryzae
gttccttctcttcggccgacgtagcatcctcagttcgacgacgatgtggcagacggtcctctacccgcctatcttcgttcagatcatcgacaagtgtcttgacgggctcttcaattggaaatgccggaatatcagtcgttggcaaaagctagcgggctacctacatctattctccttcaccagcaccaaatccgtggttcactggtttcagatcatccgacataagaactttcaattctacgatgacgaggtccacgctccgttcagcattgtcgctagcgagcgattctataagccggtcaagtaccctaccaggaacatcaagacgcccattgtgctactgtacgggggcaatgacagccttgtagacattaacgtgatgctgaaggagcttcctcgcgggatcacagccaagatcatcccgaagtacgaacacctcgatttcttgtgggcgacggatgtcgagcaacaggtgttcagccatgtcttcgaggctcttgaacagtacagtggcatcacccagcttgagggggcggtaacgggcctgatcaatggagatgcgggacatgcgatcgcggtttaggcgatcgagcgcattagatagcatggcttgtgattcgggcacaagatatataccggcgcatacccgaatggaggttggttgggtttaatggttgatgttaattatacctgacataacgctcagt

SEQ ID NO: 4676 - DNA, 698 bp, Aspergillus oryzae
caggcttctagatgtcggacgtaaggaccagcttcaactcttagccttatcacttgcaatctctctacatgcatgattcgtttgtctagttgataatgcaatccagatcggtacttatctgtgttcttttagccctcgacatactcaattttacagttgcctctttaacccaacgaccgatctacgcgatcgctcaccgagtcctacgaaacgaagccgtcaccgctgcgctttctcatggtgcgaatgcattagaggttgacttaacagcgtggtacttcggctggtgggcagaccacgatggaaagctattcagtgctggttctacagcacgcgacctcttcaagttcatcgcgcagaaacagtggacgaaagattacaacatttccttcgtatggctggatattaagaatcccgatttctgccgaaaaggtcgaccctgctccatcgaagccttgcgcgatctagctcgagagatacttgaaccagcaggtatacgagtactttatggttttttcgaaacagctgagagtcgcgggttcaaggtgatcagagacggtttgactcgaacgaagccgtgttttgatggggagacgagtactatcttgcattgacaacatttccggggctgggcataccattaaacaaattgttatggatttcggggattccttgcttaggaaaggggtcgacatctt

SEQ ID NO: 4677 - DNA, 673 bp, Aspergillus oryzae
  misc_feature (1)...(673): n = A,T,C or G
ggtacatccccccccgcagctggcccaaacttcctcttcaatactccctcaatctacgtattcgcatccgtcataaccggactgaacaaccatggccgctctattgaaacagccgttgaaattagccctggtgcagctcgcctccggcgcggacaaagccgttaatttggcccacgctcgcactaaggtcctggaggcagcacaggcaggagccaagctcatcgtccttccggaatgcttcaactcgccatacggaacccaatattttcccaaatacgccgagactcttctcccttcgccccctaccgaagatcaatccccttcctaccatgccctgtcagccatcgctgccgaagccaaggcctacctcgtaggaggtagcatccccgaactagaacccacaacgaagaaatactataacacctccctcgtgttctctcccactggctcgttaatagggacccaccgcaagacccatttgttcgacatcgatattccaggaaagatcacntttcaggagagcgaggtcctgtcgcccggaaaccagttgacaattgttgatcttcccgactatgggaaagatcggcttgccatttgctacgatatccgttcccggaaggcggcatgattgctgcgccgaaaggcgcttttgcactcatctacccgggcgcgg

SEQ ID NO: 4678 - DNA, 690 bp, Aspergillus oryzae
ccaaccccatcgaccttgttgccgccgggactttcacaatgaagttcatgaaagtgggccgtgtggccatcatcacccgtggccgttacgccggtaagaaggtcgtcattgtccagcctaacgacactggctccaaggcgcaccccttcgcctatgccgtcgttgccggtatcgagcgttaccccctgaaggtcacccgccgcatgggtaagaagaccgtcgagaagcgcagccgcatcaagcccttcatcaaggttgtcaactacaaccacttgatgcccacccgttacaccctcgagctcgagggtctcaagggctccgtcaccaacgacaccttcaaggaggtctcccagcgtgaggacgccaagaagaccgtcaagaaggcccttgaggaccgctacaccagcggcaagaaccgttggttcttcactcctcttcgtttctaaacggggtttttttgggcgttatgtcgtttgagcgcgcaaggtcttagatgaggcaagcaaaaaagggcatcgagcacattcggttcatgacacaagaggacggataccatagctggcggaggcatggggaatgtatcgatgtacaagtccaggacttggccatttttcttttttgataatgaaggaggcccaccgagatctggcgtcctcgcaatgaaatgggaatatgaacaaattcaaaatc

SEQ ID NO: 4679 - DNA, 387 bp, Aspergillus oryzae
gacggtgtgactgagccccaggccactttctcctcttgcttcgcccagcctttcttggctctccaccccatgcgctacgctaccatgctggctgagaagatctcgcagcacaaggccaatgcttggttgctcaacaccggctgggttggcgctggcgccaccactggcggtaagcgttgccctctcaagtacacccgtgccatcttggacgccatccacagcggcgagttggccaacgccgagtacgaggtctacgatgttttcaaccttcacgtgcccaagagctgccccaacgttccctctgagcttctgaaccccaagaacagctggactgcattcaccagcttcaaggacgaagtcaacaaagctaggcaagttgttcaacga

SEQ ID NO: 4680 - DNA, 734 bp, Aspergillus oryzae
  misc_feature (1)...(734): n = A,T,C or G
nnttgactgactctatccaaattcggcacgaggtgcagcaccagctgactcaataccgggtgaacaactgcgtgcgttttgcatggtgggccggtgaagaggaaggtctccttggatcggactactatgtttccgttctcactcccgaggagaacctgaagattcgtttgttcatggactacgatatgcttggctccccgaactttgcgtaccaggtttacaacgccaccaattcggtaaacccggtcggatccgaggagttgcgtgacctgtacgtcgatttctataatgaccacgacctcaattacacctatattccgttcgatggtcgcagtgactatgacgctttcatccgtcacggtattcctggaggcggaattgccactggagccgagggtatcaagaccccggaggagcaggagatgttccgtggtgtagcccgcgcctggtatgatccatgctatcacccagatctgtgatgtcgggggcaatgtgaatttgacggcctgggagttgaacaccatacttgttgcccactctgtggccacctatgccagaacccgttgaaggaattgctaagcggacgaagagttccattactggctttgcctccgggaaataactaggaccgtgggccggagcgtcggactttaatgctaagatattctagagacccgtggattcgatctggagcagtgacacacagattggcagtgtgaaagagaaaaaaaact

SEQ ID NO: 4681 - DNA, 855 bp, Aspergillus oryzae
cgaggggtcttcccatcgttacaatggcttcgcgtcttgctaagagcgccattggtgctgcccggctccggccgaccgtctcgcgcaacgtcgctcccatcgccaacctgaccgtgtctcgttcggcctccaacgtccctaccgaggaccccaagaagaaggctcagtcgattctcgatgccctccccggcaactccctggtctccaagaccgctaccctctccgccgctgccggtctctccattgccgctatcagcaatgagctctatgtcatgaacgaggaaaccgttgctgctttctgtcttctcagcgttttcaccgccgctgctaagtacggtggtcccatgtaccgtgagtgggctgagggccaggtccagaagcacaaggatatcctgaacgctgcccgtgccgaccacaccaacgctgtcaagtcgcgtatggacaacgtccaggagcttgctggtgttgttgaggtcaccaagcagctcttcgctgtttccaaggaaaccgcccagcttgaggctcaggcctatgagctcgagcagcgcactgcccttgcccacgaggccaagcaggctctcgactcgtgggttcgctacgaaggtcaggttaagcagcgccagcagcgtgagcttgccgaatctgtcatcggcaagatccagaaggagcttgagaaccccaaggtcctccagcagatcctccagcagagcgttgctgatgttgagcgcatcatgtcctcctccaaggctcagtaaatggacgttgcatgaatagcctcgctattagcaatatgtataaattaaagatctgtttcctgtgctacattagacataccaatacgagttcctaagcaag

SEQ ID NO: 4682 - DNA, 672 bp, Aspergillus oryzae
cgaaaagagcaagtcgggtggtatgccggaacgcttagcggacggcgatcacaagtatgagctccagtttggtggacggggcttcgacctgtaccagcactcccaccttggatatggtctcatggctgcacgtgaagccattcacaaagctgtcgttgagggtaaaatggcctccagtggaaacgatatggcttggttgaatcagcccatccctaatccttgtattgcacctggaatggagcgcgatgtggaggtgaagtttgacaaggaacacccacttggatcaaaagtgactgtcaagatggttggcccgcaggatggatcttcttcgcctgccctgtgccgcggcttcgcggagaagattctcaagaaggacgctgaatgcaaacttgcaccttgctctttcaatggtgttcatcagccctcgcttgagaagacattttccagagaagacgtttatatcttttcctacttctttgaccgcactaagcccctgggcatgcctgactctttcactctggaggagttgcaccagctcacattcaccgtctgtgccggcgaatcgtcatggaagaattttctaaggcatgggagaagccatggccgaactactcgaccgtcctgaatggtggcttggatttgaacttcatgcttgcactgctgcactctggg

SEQ ID NO: 4683 - DNA, 305 bp, Aspergillus oryzae
ggctgctaacaacgccatcaagcacgtcaacggcatgttgctgaacgacaagaaggtcttcgttggccaccacatctcgaagaaggaccgccagagcaagttcgaggagatgaaggccaacttcaccaacgtctacattaagaacattgaccaggatgtcaccgaggaggagttccgtgagctcttcgaaaaattcggtgagatcacctccgccaccctcagccgtgaccaggagggcaagagccgtggtttcggtttcgtcaacttctctacccacgagagcgcgcaggccgccgttgacgaga

SEQ ID NO: 4684 - DNA, 799 bp, Aspergillus oryzae
tgaatgtcttctcctctacttgtactttcgattactcttgggaggaggtatcaacggcgaactggcgcaagtactgcccgtggaatgacaagtccacacatgttgtggcggtagacacgttatcccggactattgactcagaaactggtatcttgcgcacagagcgtcttattacatgtgatcaatccgtgccgcaatgggttctttctcttttcggaggaagcgctacctcgcatgtttacgaggtctcctacgttgacccaaaatcgaagaaagttacaatgtgctcgaccaacctcacatggtccaatgttttgaatgtccaagagactgtcacctatcaaccatcctcagcgaagccggcttgtaccacgaatttcaaccaggaagccaagatcactgctctctgcggcgggtggcaaaagatcaagaacaaggtagaagaggcaagtgtggagagattcaatcaaaacgctaaaaggggtcgagaaaggtttgaggccgtgcttgagatgaatcgacgggtattcggtgaacaacgcgagcgtgagaacgatagacttcagtcatgacttgtgcaatgttctatatccgtgccagaattgaattcaacaccataaaaatcgggcctttgcatataacggcggcaggtctgggtgttttccaacgcagggtgccaatttgcggttctaaacgggttctgtgccaaaggggtctctcttttttctctgtggggagcaagacctgactttgttcaaaacctatcaaaagtgtgactaacgacgaatgaccgggtggg

SEQ ID NO: 4685 - DNA, 671 bp, Aspergillus oryzae
  misc_feature (1)...(671): n = A,T,C or G
ccacccctcatttgtttgatcaattgaagtcttcagactatcccttcaccatgccgctctcccctgaacaaatccagctcatcaaggccaccgtgccggtcctccagcagcatggcaccaccatcaccaccgtgttctacaataacatgctgacggcccaccccgagttgaacgccgtcttcaacaacgccaacaaggtgaacggccatcagccccgcgccctggccggtgccctctttgcctatgcctcgcatatcgatgacctgggagctcttgggcccgctgtcgagttaatctgcaacaagcacgcgtcgctgtatatccaacccgagcaataccagatcgtgggcaagtttctgttggaggccatgggcgaggtcctcggtgatgcgctgacccccgagatcctggacgcctgggccaccgcatactggcagcttgccgacctcatgatcggtcgtgaggccgaactgtacaaacaggccgacggatggacggacttccgccactttcgtgtcgccaagaaaggtcctgagtcctccgagatcaccttggtctacctcaagcccgtgatggccaaccccttnccaaagttccgcccccgccagtatatctccgtgcagggtttcgtggactcgctcaattcccccaatgtcggcaatacttcttgg

SEQ ID NO: 4686 - DNA, 740 bp, Aspergillus oryzae
  misc_feature (1)...(740): n = A,T,C or G
acaatttcctcagattacatttccaaattcagtttttctttctctcaattctcaactagacgtcgagtagtcaattgactcctatctcccaactatcaagatgtctgccgatctgaagccccttcgcattgtcatggcctgtgatgaggctggccaaccctacaaggagactctcaaggcagcccttgagaagaaccctctggtcgagtccgtcgatgatgttggtgtcaactcgacctccgacaagactgcctaccctcaccccgccgtcgccggtgctaagctcatcaaggagggtaaggcagaccgtggtctcttcatctgcggtacaggtctgggtgttgccatcgccgccaacaaggttcccggtatccgtgccgtcactgcccacgactccttctccgtcgagcgtgctatcctgagcaacgacgcccacgttctctgcttcggtcagcgtgtcattggcattgagctcgcgaagaagcttgccaacgagtgggttacctaccgcttcgaccccaagagcgcatctgccgccaaggtccaggctatctccgactacgaggccgaattcgccaaggctcagtagatcctctaatatcggtgctttaaaccatgcgcgagcgaacggatcgcctgtctacgatgccatcttaacgacggcgctcatggcgcatccttagatcatcgaccacttctcccttacgccgnngtctcatacctcttncgagcgactggac

SEQ ID NO: 4687 - DNA, 659 bp, Aspergillus oryzae
gcgcgagccccatgactctggacgtcctgtctccaaagactacctcgcttatctcggagttttctaccgctactgccctgatatcgagtctgtcaatgctttggccaaggagcgcggatataagaaccgcgatgaggtgtgcgtttctccacagaccatgggcgatgtgtacgagtcgaaggtgaagatgttctttgctgagcaccttcacgaggatgaggaaatccggtacatccgcgatggtgagggttacttcgatgtgcgcggtcaggatgatgaatgggtccgtatccaactcagcaaggacgacctaatcatgcttcctgccggtatctaccaccgattcacaaccgacgagaagaactatgttaaggctatgcgccttttccaggaagaacctaagtggacgcctctgaaccgtagcgaagatgtcgattccaaccctcaccggaagacatatcttggaactctcagcacaagtgctgaggctgcaaagtaaacgggtggcttggttagaccactggccaaagtatggatattgggaaggctcgatatgttccatgatctacctcatttcaaggtgattgccatcgctacatttgatgactgaaggggtatatttcaaagccttgagattcatgatgaaccaaaaaaaatat

SEQ ID NO: 4688 - DNA, 627 bp, Aspergillus oryzae
  misc_feature (1)...(627): n = A,T,C or G
ccaattgcaccattgcggagtcgttggaacgtattcgccccattgtagagttggccaaaacaaaaaacattagggtccgaggatatgtttccgtcgccctgggctgtccgtatgaaggccctgatgttccaccgtcaaaggtggctgacatcacggccacactgcttgagatgggtgccgacgaagtgtcagtagctgacaccacgggtatgggaacagccccacgtacgatggagctcctacaagcgctcaaagcggcaggaatcgcgaacaacgacctcgctctgcatttccatgatacatatggacaggccctggttaataccgtcgtgggactggagcatggtattcggattttcgacagtagtgtgggcagactcggtggctgcccctactccaagggcgccactggcaatatctcgacagaagacctggtccacacgctccatagccttggnatgcacacgggaatcaatcttgaggagatggctaagatccgcggttggatcaccggcgaactggatcggttcaacgaaagtagagccgggaaagccaaccttgcaaggattcaagaatgaagaacggtaatccgcagaaaggacccgaaaatcctcatccactaaacaa

SEQ ID NO: 4689 - DNA, 669 bp, Aspergillus oryzae
ccgcgacaatcatcacgacagcgccggacgacagccatggcacctaaggcggataacaagcaaggcaagacaaagcccagcgaccgcgctggcgctgctgccaaggcagtcctgaagggtgtaggcgcgcacaaggctcgcaaggtccgcacttccaccaccttccaccgccccaagacccttgagctctcccggtcgcccaagtacccccgcaagtcgattcctcatgctcctcgtctcgattctcacaaggtcattctttaccccctcaacaccgagagtgcgatgaagaagattgaggagaacaacactctggttttcattgtggatgtgaaggcgaacaagcgccagatcaaactggctcttaagaagctttacgatgtcgacactgttaaggtcaatactcttgtcaggcccgatggatccaagaaagcctttgctcggctaacccctgatgtggatgctctggacattgcggctaccaagcttgccattgtctagatgaatcaattttttatgggtctggtgaacttgttttgtttaacgcggtagcttataagtcctggtcatacagttagctacccgtgctgcaacgacggctgaatgatcgttataaaaggtgtcatttcaatgcataatctgaacccacttgggtagtgctgtaggaaa

SEQ ID NO: 4690 - DNA, 553 bp, Aspergillus oryzae
gcaatttcaattccctatataatatacttgcatcttcttctcctttcttattcttttcttctctctttccctttcttctccctctctcataacactatccttgtcaccatgtccatccagaccgtctccttccaatcctttactgaccagaagccgggaacctccggtcttcgtaagaaggtcaaggtcttccagcagcccaactactccgaatcctttatcaccagcatcctcctctccatccctgaaggtgccaaggacgccttcctcgtcattggtggcgacggccgttactataaccctgaggccatccagaagatcgctaagatcagtgccgcttatggcgtcaagaagctccttgtcggccagaacggcatcttgagcacccccgctgccagtaatcttatccgtgtacggaaggccaccggtggcattctgttgactgccagccacaaccccggtggtcccaatgccgactttggtatcaagtacaacctgtccaacggtgcccccgcccccgagacagtcaccaacaagatctacgaaacttcca

SEQ ID NO: 4691 - DNA, 676 bp, Aspergillus oryzae
cctcctagacctattcggcgtgttgtcggagatcgattgtccccgatatttgcatttcgcgacagcctacgacgacaccgcccagactcgaccaccgccgcccctctctctctgcctattatcttccctgcttgactccaccactttctaccgatttctagtcccgagcgtcgaggagcatacagacttggatagtggacaactatctgtaataatacattttaagaattgggaccggaggaaagccacataatataacccctaaaaccgcttatcaagatgtggtcatggtttggcggctcggcagcccagaagcggaaggatgcgcctaaggatgcgatcctcaagctgcgggagcagcttgatatgctgcagaagcgcgagaagcacctggagaatctgatggaggagcaggatgccgtggcgaggaagaacgtgacgacgaataagaatgcggccaagtctgccctgcgacgtaagaaggtgcacgagaagaacctcgaacagacgacggcgcaaatcatccagctagaacaacagatatattcgatcgaggcggcgaatatcaaccaggagactttgaacgcgatgaaacaggctggcgcagccatgacgcagatacacggtaacttgactattgataaagttgatgagacaatggaccaactccgcgagc

SEQ ID NO: 4692 - DNA, 625 bp, Aspergillus oryzae
  misc_feature (1)...(625): n = A,T,C or G
ccctccatcatccgctctcttcaaaacttacacatctaatatcataatggaaggactcaatgcctcggaacagcgcgagttcgccgctcgcatggagaggaagcagctgaaggagttcatgaccatgtactccaagctcgtccagcgctgcttcgatgactgtgtcaacgacttcaccaccaagtctttgatctcccgcgaggagggctgcaccctccgctgtgtggacaagttcctgaagggctctcaacgcttgaacgaacgcttccaggagcagaacgccgccatgatgcagagcggccagatgcccggtcggtaatggattgattgaatgatctgcttgttcttctgggttcggcggttcgtgtacaaactagacttttcgaatgatgacccccattgattgcatttggtctaagattcggctatgatctggatgagcagggcttccgctttgttgagtcacgagtactcaatggtcgtatatctatgctgctgtttagcttgtgccctcggaaatatactgtacaatatagtgattatggacatgcaatggacccttgatgggtatgttaaggtatntaattgnnnaanaaannnnnnnnnnnnnnnnnnnaaaattcct

SEQ ID NO: 4693 - DNA, 743 bp, Aspergillus oryzae
  misc_feature (1)...(743): n = A,T,C or G
tattgatgacacttagtatnanacngcggnacctagcgcggacccacacncggcacgaggcccctctcaactatggcggttaacgggctcttaacatctaccgncnggctctccccgtcgggacgggctccctgatcttcaacaactctatttacgacgttcgtggtggttcccgcgctgtcatcttcgaccggttgtctggtgtgcaggagaaggtcgtctacgaaggaacccatttacttatcccctggttgcagaaagcgatcgtctacgatgttcgaactaagccccgtaacatctccactaccaccggaagtaaggacttgcagatgggcagcttgacactgcgtgttcttccaccgtcctgaggttcccgaaactgacggccatctaccagtcttacggaaccgactacgatgagcgtgttcttccctccatcggaaacaaagtcctcaaagctcatagcgaccaattttatcccgccgagcttttcatccacgggaaactgtctcaacccgtactcccctagacttttgaagcgggcggacatttaacatctcctggaagtagttttatttccccccgaccctcgaaaggaattacaccccgcgataacaaaaacagatcccccactggacctcaaacgggccttgtaatactagtagaaccatcccattacttaggccactgtttactttgggggggtgtctcctttacccctatatatattggaggcagcggcc

SEQ ID NO: 4694 - DNA, 635 bp, Aspergillus oryzae
cagccggtcaattccttagttttggaccgaacatggcgcaagccaccgcatcggctaaccgggtgctgagcctacgatcaaattcatctacaaaggttgccgccagcatgggacagaaacaactcgcccattttgcttcacaatctggagctagtatcgaattctgcgacgttgcttttaagtatgcatctcaagatgttcctcttttcacaggactcaatgttagtatcgaaagcggacagttcgttgcctttgttggaccttctggttgcggaaagacaactgtgatatctctcttagaacggttctatgaccctttccaaggcacgatatccctgaatggccaagatatccgttccttggaaaaatcgtcttatcgcagagcgctgtctttagtggctcaagaaccaagactctttgagggaacaattcatgagaatatcactcttggactggataaatctgacttgactgagaatgagataatacaagctttgcaaagacgctgagatacatgactttattacgtcggttgccagagggctattgcaacgagccgggtattatagcacagacagatctcaatggacgccaaaagcaccgggtattgattgagcgtgcactggtacgaaagc

SEQ ID NO: 4695 - DNA, 574 bp, Aspergillus oryzae
cgaggtaaccttaactactagttcactggcggcccgaattatcctgtgcacttgcaggtaactaccttgtctcctaaccacaggtttctttggaatgggctgttgagttgccagttcccttctccaagatgacgtcgcgtcttgttctggtcattggtgacctctttatccctgatagagctccggatcttccagctaagtttcggaaactcttaacgccaaacaagatcggccagatcctctgtctgggcaatctgaccgaccgaagtacatttgaattcctccgtggtatcgctcccgatctgcaattggtcaagggtgatttcgatgtcgactctcccaacctacccctctcaaaagtggtgacccacggaagcctccgtattggtcttacacatggccacaccatcatcccgccgggtgacgccgaagccctgcttattgccgcacgccagatggatgttgatatactactatggggtggtgcgcaccgcttcgatgcctttgagatggagggaagattctttatcacccccggaaagtgcaacgggcgctttgaacactgggtattggg

SEQ ID NO: 4696 - DNA, 702 bp, Aspergillus oryzae
  misc_feature (1)...(702): n = A,T,C or G
agaatgccttggttattaaaaagtttaatgccgccctcaatgccctcataactgcactacagccttcggggcagtggcgggaacaggtgaaagacgcagacctcagaacggagcgagggatacccagatccaaggtagacggtcggttgattgctatcaaagataacatatgcacgcgcgacctgccgacaacatgcgcttccggaaccctcgagaagttcgtaagcccgtttaactccaccgtcgtggggcaattacaagatgcaggcgctgtagttgccggaaagacaaatcttgatgaatttggcatgggttctcattcagtatattcgcgatttggaccggtgaggagtttttggcagggtcgcgatgccgaacccctgtcagccggtggcagttcgggagggagtgcagttgcagtcgccacaggccaatgttatgccgcgttgggtacagacactggagggtctgttcgccttccggctgcatacactgggacagttggtttcaaaccctcttatggattgatctcgcggtggggtgtagtcgcatatgccaactcactggacacggttgggatcttagggagaagcacagccagcgttcgcgatgtcttcaatgttgtgaaccagcacgatccacgcgatcctactaatctctctccatcatctcgttcacgaatactttcaactcttcaatcan

SEQ ID NO: 4697 - DNA, 1682 bp, Aspergillus oryzae
gtgtcaaaacgtgcctacccaatctgtgcacatcctttcgctgaaggaaccatcatcaaaccgcttctctttcgttgaagctctatctttcttccactcgtttatttatctttggatcccacccctctttcaactctttgcgactttgcgctactgttatctggtaagggctaaatatcgccccgtcatacccaagtagtccacaacattatcgaagaaatcacataacaatgttcattaaatacgctcttcccgccctggccgcggctcaggccgtctttgctgctagtgataagtgcggctcgggtgacaccatcaagatcgagaaccagagcgatgccgacggctactccagctgcagcacccttaagggtgatgttgagatctccggaacctactctggcgatctccaactcaatggagttaagcagatctccggtggactgagctgcgatggtgcttccaacatgaccggcctctctgcttcttcgttgaactccatcggcgacaccttcaagctgaccggtcttaccactcttactaccctcagcttcgccgcgctcaccaaggttggttctatcgaatttactgctctgcctcagctccagagcctggatttcaccaagggtgttacggaagctggtagtgttgtcattaccaacactggtttgagcagcctcaacggtatctctcttgagaccgtgggtggcttcgatattaccgagaacaccaacttgaagaccgtcaacgtcaacaacctgaagaacgctactgccctcatcaactttgccggtaacatggacggtcttgagatcgaattccccaaccttggcacaggtcagaacatgaccttccgtaacgtcagctcggtttccgttccctctctggagaagctcaagggtcagctcggcttctggggtaacaagttccagtcgttcagcgctcccaaccttaccgagaccagcgacttgatcttcaacgataacagcaagctcagcaacatcagcatgcctgtgctcaagactgtcaacggtggcttccagattgcccgcagtgacaagcttaacgttatcgacttccccaagctggagaccgtcacaggtgctattgatttcagcggtgaattcaacgaggcccaccttgactctcttaagttggttaggggtgacttcaacatgcagagcactggtaacatcagctgcactacctttgacaacatggcaaagaaccgcgaggtcatcaagggtacggagacctgcaagactacctcgaacccggagacccgtgatggcaagtctggctctaccacttccactggcaaggcttctgccacctctaccggcgctgcttctgctcttgatgtttcctcgatgcctgctatgggcttggccgctgtcttcggtgccctggtccagtatgctctgtaaaggatgtttcgataccaaaccgttgtgcactttgttatttcttatatcggactccacttacagccgtgtagagttgcttaataagcaaagggtatattgattcctgtgctttggttttatgactaataatgaacttgtttgaccaaattcgcagtctgggtttgtcgctctccgcggaaatccgaattccagctgatgggctactttttttttttgtcttactttgtatgaaaatgcaattggtggttaatatgt

SEQ ID NO: 4698 - DNA, 701 bp, Aspergillus oryzae
ggcacagttgcggatccatctcaatgatgtctaatgttacccaatcagccttgagacaggcaactcgcgcctacgctcgtcgactgccatcgacgcagcatggctccttcgcttccgcccttcccagacgggcgctcgccactccgtacagacggttctatgtctccgaaaccaaggctggaaatgctcaggtttcggtagataccgctattaagcaggagcagaaggaattcatgaagcaaactggggtgcagccgcagaaggtggagctccctagttctggtgtttccggcgatgcctcgatgagcccgtctgccggcatcctcaagcaggccactgtcatggaccaaggaacgcgaccgatctatctcgatatgcaggccacaaccccaacggacccccgtgttctagacgcaatgctccccttcttgaccggaatttacggcaaccctcactcgagaacccatgcatacggttgggagtcagaaaaggcagtcgagcaatcccgagagcacatcgccaagctgatcggcgcggacccgaaagagatcatcttcactagcggtgctactgagagtaacaacatgagcattaagggtgtggcgaggttttttggcgctccggcaaaaagaaccacatcattacaacccaaaccgagcacaagtgggttttgacagctgttgggattcttaggatgaggg

SEQ ID NO: 4699 - DNA, 684 bp, Aspergillus oryzae
  misc_feature (1)...(684): n = A,T,C or G
gatattggagataaacgttctcttctgtttatcattctgatcatatttccctattcaaagacttcgaagaattgtcagtcgcaacactcattaattcatgatatccggctttcgcccgattccgggccgctattccggcgcatatagagcatactgtggagtctttcgattccatagaactccatcatgcagcttccatactgatggccgaactcgggtgtctaatttctggattcctacgggaggcatctcaaagaaaaatattcagggtgaaaaagaggacgtgaatgacctcttagttcggggaggcttcctccgacaggcttattcggggatttttcatatgttaccgctaggattgcgagtgcaagacaagcttgagcgcctgatagataagcacatgcgctcagttggagcgtcaaaagtttcactgtcgtccatatcttcccaagaactctgggagaggtcaggacgcttangagagggttcagaggtgttcaaatttcatgacagaaaggaatctcgtttccttcttgctcctactcatgaggaggaaatcaccactctagtgggcagtctcgcccaatcgtacagagatctacctctacgagtataccaaatctcaaggaaataccgtgatgaaccaagaccaagacaaggtctacttcgtgggcgagaattcat

SEQ ID NO: 4700 - DNA, 731 bp, Aspergillus oryzae
  misc_feature (1)...(731): n = A,T,C or G
gaacgcaattcgcacgaggctgtacgcaatcgtgatggatcttggcaccttgtgtaccaggttggctattacagtcccctctatttcttcgggcttcccattcaataattcgcagcaatgtcacgacccggccgttcggcatcaggtcgttgaaccctcccaacacctcccggttcaatgtcgggtccgatctcccagtgctcaagtcgacaccaacagcagccttagaacgcaaagcaaacacgctgccccccagaactggagccattgctatcaagaaagggatgaccgctctctacgatacagagacagggaagcgaatcgcatgcaccgtccttcagctggaccgagtggaagtcatctcgcataagacacggcagcagcatggttactttgctgtccaagttggttctggctggaaacaccctaataatctcaccaaatcactcctcgggcacttctctgttaacggtatctctccgaaacggcacatcttcgagttccgagtgcgggacgaaaatggcctcctgcccgttggtcaggcaatcaatgcagactggttccnagaaggccaatatgtcgatgctcgatcaaacacaaaaggaaagggatttgctggtgttatgaanagacacgggtttggtggtcanggaccgagccatggcgtcagtttaacacatcgctctcttgttctgcgggtccaatcagggtgtgggatcagagtgatnctg

SEQ ID NO: 4701 - DNA, 718 bp, Aspergillus oryzae
  misc_feature (1)...(718): n = A,T,C or G
ggcagttggttggtccgctccaatcccagcttccacctgggaccgtcgcaccgatgctcctgtagagctcaagaagaccaagttagctgagcaacagcctagtaacctcaagttggaccctgctactatcaggaaagtcttgggagctggtctccggcgcatcattgacgccgaaccgacggttactcgctacgatacgattgtcggagacggtgactgtggtgttggcttgaaacgtggtgccgaggctgttcttgcactccttgaggacaacttctcaagcctggatgaagacgtggttaaaaccgtcaaccgcatcgttaccattgtggagaacaccatggatggtacttccggtgccatctacgccatcttcttgaacgcacttgtgcacggtctccgggagcaagacaagggcaaatcgactcctgccacagctgaagtctggggcgaggccttgaaatactcgctcggagccctcggaaaatacacccccgccaagcctggtgaccgtactatgatcgatgctcttgttcccttctgtaccactctgcgcgacactaaggatgtccatgctgctgctaaggctgctcaagagggaactgaagcgacgaagagcatgaaggccagcttgggacggtctgtctatgtgggtggtgaagacgagtgggtgggtaagggtcctgacccangtgcttacggactcagcgaattctta

SEQ ID NO: 4702 - DNA, 1102 bp, Aspergillus oryzae
cgaggcacccacgacgacgacaatctcggccttgatcaccgtccgtcacaatggcgatcaagcacaacaaccagattctcaaccagcacttccgcaaggactggcagcgtcgtgtgcgcgtgcacttcgaccagcctggccgcaagcaccgccgtcgtgaggcccgtcttgcgaaggccgccgctgttgcccctcgtccggttgacaagctgcgtcccgttgtgcgttgccctactgtcaagtacaaccgccgtgtccgtgccggtcgtggattcactctcgctgagctgaaggaagccggaatccccaagaagctcgcttctaccatcggtatcgccgttgaccaccgccgtgtcaactactccaaggagtcgctggtcgccaatgttgatcgtctcaaggactacaaggcccgcttgatcctcttcccccgcaagagtggtcagttcaagaagcttgactcttctgctgaagaggtcagcgctgccaaggctgccttcgccgctgagggcaagactgagggttatgccactcgcgccaatgctacccttcccatcaagaacctcactgctgaggaggctgtcactgagatcaagcgtgatgacctgcccaagggtgaggaggctgcctaccgccgtttgcgcgaggcccgcagtgaagcccgccacaagggtatccgggagaagcgtgctagggctaaggccgaggaggagtccgccgccaagaaataaatgtgattcacagttaatgatgatcgggtctattttcaagtcggggattagtgtactgtggcatggcgtggcgccccttttctcaatttacctttgtccttaaaaaagctccgaaccttccgaaatgcaaatgcccaaattttcacgtttcaataaagaaaaaaagggtctactccgagttatggatgtatggtatgaagctgcgtcttggtccgtcagtgcgtggtcgctggggtcgtatcaagccacatccttagcgattattcgttgcattacaccggtctagtcgtgtggaggcagagagcacgcaaaatactatggaagggtagcctgatgcaggcccccgtaagctaggtcaatgacggagatga

SEQ ID NO: 4703 - DNA, 804 bp, Aspergillus oryzae
  misc_feature (1)...(804): n = A,T,C or G
cactgtacattcctttctgtcgtgatcattcaagtcaagaatgcacggactatctacactcacccaggctctaagcctctgggctcccctcgccgcagccgcatacacactacaagatgactacggcacagacacaactttcttcgacaaatttagcttcttcacaggcagtgatccaacccatggcttcgtcaaatatgttgacagaggaacagctcagaacacaggcctaataaaagccgatggaaccatctacatgggcgtagattacacaaacgctgctccaggcggccgccaaagcgtccgaatcagcagcaacaaagtctacaatcacggtcttttcatcctagacctagcccacatgcccggcagtatctgcggcgcctggccagcatactggctcctaggccctaactggcccaataacggcgaaatagatgtcatagaaggcgtgaacgaccaaactaacaaccaggtagccctccacaccagcgacagctgcacaatcaacaattcaggcttctcggngctccttcttacaagtaactgctacgtcaatgcccncggccaagccaacaaacgcagctgcngnattaaagatnnactcgnccagtctttacggaatggnttcaataagtgccgcngcggtgtgtatgcaaccgaatgactgccgagctatcagngtttggntttcccgcgttcgagtatccctggngtatcagtagccggaacccgatccggagtgttggnggcaccgtcagnaagtttgccgaacctggatattgatccgattttaaggcctgg

SEQ ID NO: 4704 - DNA, 665 bp, Aspergillus oryzae
gtcggttacctccatgaccacgaccagcattacattgttatggttgaccctgctgttagtgtgagcgacaacggggcctttaacaggggactcgagcaggacgtcttcctcaagactcaaaatggcagtttatacaaaggtgccgtgtggcctggtgtgactgcttatccagattggtttcaccctgacattcaagactactggaactctgaattcagtaccttcttcaacgcggagaccggtgtcgacattgacggcctgtggatcgacatgaacgaggcctcgaatttctgtccagatccctgtactgatccagaaagatattcctccgagaacaatcttccacctgcgccaccacccgtccggtcaagcagccctcgtcccttgcctggctttcctgctgattttcagccttcctctgccagccgatctcagaagagaatcgtcaaggcaaaggtcggacttgagggccgcgatctactcaatccaccttacaagatccggaacgaggccgggtcccttagcaacaagaccatcaacactgttttcgttcacgcttgagagggatatgccgaatatgatacgcacaatttttatggaacaatgatgagctccagttctcgtgaagctatgcagaattgtcggccctgaagtgaggccctctg

SEQ ID NO: 4705 - DNA, 685 bp, Aspergillus oryzae
ggtttatcttggtccttacttctcagcattttctttacaatatggcgagccaagctcctgctgacaccccggtcgcttctgacgcggcggtaactcagacccttcctgaccgcaccaaaaaccccgctgataaggatgctccccagggagatgtctcgaagaatgccgcaaagaaggccgcgaaggctgcagagttcgccgctaagaaggctgagaaggccgccaacaaggctgctggaaagcaggagcccaagaagcccgctgctgcgaaggctcccaagaagaagatcgatggtgctgctctgattggtattgatgtctccaaggaggaggatttccctggatggtaccagcaggttcttacaaagggtgatatgctcgactactatgacgtttcgggatgctttattctcaagcccgcttcgtactttatctgggaagagatccatgactggttcaatgcgcgcatcaagaagattggcgttaaagaactgctcgttccctctggttgtctctgaggatgttctgaacagggaaaaggatcacattgaaagctttgctgctgaagttgcttgggtgactcatgctggctctagcccctcttgagaaaaagatcgctattcgttccacatcggagaccggtatgtacccgtactacttcaaatggataaaaaggcaccgcgaa

SEQ ID NO: 4706 - DNA, 697 bp, Aspergillus oryzae
  misc_feature (1)...(697): n = A,T,C or G
gttattcaagatagcttacactttattggaactttataccgttacgccatggatgtgtccaacaaccgtcttttccggttctccaaaccggaatggttaaacaacaatagcgtccgcaacgcaggcgtctacacatcgggagcattgttctccctcggttttttcttcctagttgatgcagctgcattctctcatagctcacgaaatgggtcaaatgtgcatgtcaaatttgtcgactggatccccggcatttgctccgcgctcggaatgcttgttatcaactcgattgagaagtcacggctgcacgcagatagctggagttacagtggaagcggtgtcgcgtggaaagcgcggttcgtacttttccttgggtttgcgctcttggccggcggtttggcaggcagtgtgacggtcatggtccttaaataccttatcaaacaatacccactgcaaacgctatactttggaatcgccaatgtagttgcaaatggactcgtcatgctgagcacgattgttctctggatttcgcagaacatagaagatgattacacctacaacctcgcgttgtgataactgatggagtanggtactcattttgggaatatatcatgattaactggttctctgtctttccctaattgnttttttgaatggctggcgtaatcgcgattcatagccctctaagtctatgtttgag

SEQ ID NO: 4707 - DNA, 676 bp, Aspergillus oryzae
  misc_feature (1)...(676): n = A,T,C or G
ctttccgatgaggttattgacaagacaattacttcatacacccgggaatctggtgtccgtaacctagagcgcgagcttggctcaatctgccgtcataaagcagtccagtatgccgatgcgggagatgcaggccatccagaaacttacaatcccgttgttacaatggatgacctggaggagatacttggtatcgaacgattcgaggaagagatcactgagaagcatggtcgtccgggagttgttaccggtcttgtcgcttactctactggaggacagggcagcatcctgttcatcgaagttgcagatatgccaggaaatggccgcgtgcaacttactggaaaactcggtgacgtcttgaaagagagtgttgaggttgccctaacatgggtcaaagctcattcttacgagctgggactgaccccggatctcagcgaagatattatgaagagtcggagtttgcatgttcattgtccttctggagccattcccaaggacggcccctccgctggacttgcgcatactattggactgatctcactattctcaaacaaggctgtaccccccaagcttgcgatgactggagaggtatctctccgtggaagagtgatgcctgttggtggtatcaaggagaagctcattggggcacntcgtgctggtgtaaagaccgttctcttgc

SEQ ID NO: 4708 - DNA, 667 bp, Aspergillus oryzae
ctaacaggtcaatctcaacaaccaaatcaatatgtcttttcgaggaggaggtcgcggtggctttgccactggtgctaatcgcggaggttccttcggtggccgcggtggccgcggaggcttccagcagccaatgggaccaccagcacaagttctggagatgggatcttttatgcatgcttgtgagggcgagatggtttgcgaatcgatcaacccgaagattccgtatttcaatgctcctatctacctagagaacaaaactcctatcggaaaagtcgacgaggttcttggccccatcaaccaggtctacttcaccatcaagccccaggaaggaattgtcgcaacttctttcaagcctggtgacaaggtctacatcggtggggataagctcctgcctttggagaagttccttcctaagcctaagccgccaccgggtactgctaagcccaagagagccggaggcgctgccaggggtggtgctcgcggtggcagaggaggccctcgtggtggagcaagaggtggacgcggcggatttggcgctcctaaaggaggaggcggcttccgtggtggagctagaggaagcggtggaggcttccgtggtggaagcggtgcttctccaggggaggcggcagaggaggacctcgtggaggttccgacgttagacagtctc

SEQ ID NO: 4709 - DNA, 678 bp, Aspergillus oryzae
gtttttgttctgcccacactttctacttccctctcggggtttgtctcatcgttgtgcgcctttgcgctcgtcattcgttcacttgtcatacataccctctgctttggaacttcctgtggaagcatctccgtccgatcctttgattctttgtactagttttttccagcgagagagatatagaaaatgccttcgatgtacactcgtcttttcgctgcgctttgcgctcttgcgaccactgcaaatgccgtcaccaccatcgaagtgaagggcaaggactttgtcaacagcaagaccggtgatcgtttccagatcctgggtgtcgattaccaacccggcggttcttccggcttcacgaaggacaaggaccctcttagcgacaaggacgcatgcttgcgtgatgccgctctcatgcagcgcttgggtgtgaacaccatccgtgtctacaacttgtcgcccagccttaaccatgacgactgtgcttccattttcaacgctgccggcatctacatgatcctggatgtcaattcccctctgtacggcagctacattgaccgtaccgctcccaagagcagctacaacgccgtctactacgaacaggtcttcggtgttatcgaagccttcaagaactacccgaacaccctcgggttcttcgcccgtaacgaagtgatcaacgagccg

SEQ ID NO: 4710 - DNA, 674 bp, Aspergillus oryzae
  misc_feature (1)...(674): n = A,T,C or G
gttcgaggagatggagtcgatgcccaactacaaacctcgcccagctccctacaattccatgattcagtacttcctgaacaccaagcgcgaccgcagcaaggttctggcgtactataagcgcatgctcagccgtaatatccagcccaccatgcacacgtacaagttgctcatcgacgcacacgcctctcttgagcctgtggatatgaaggctgcggagaaggtactcgaaaccatcaaagccgccggacagcaaccagaggccgtacactatgcatctctcatccatgctcatggctgtgtgatgcatgacatgaaagctgctcaggacgtcttcaactcggtcgtctccaacagcaaagtgcgactccagccatgcctgtaccaggcccttctagaggccatggtggccaaccaccaggtcgcacaaactgaggacattgtgaaggatatggtccagcgtagggtcgatatgactgcctacattgccaacactcttattcaagggtgggccactgagggcaacgtgagcaaagccaaggccatctatgatagcattggtgtggacaagcgggagcccagcacttatgaggctatgacccgtgcattcctcatggcgaacgagcgagagaacgcctctcgcattgtgcaagagatgctgtctcgtggataccccn

SEQ ID NO: 4711 - DNA, 1038 bp, Aspergillus oryzae
  misc_feature (1)...(1038): n = A,T,C or G
caccacttccgccgtcgcctccagcagcgctagcgccagcagcactgccaccgccgttcccaccggtgtcagcggccagcagatgggtatgacctactctccttacaccaacgagggtggctgccagtctaaggaccaggtcctcaaggatgttgccctgatcaagcagaagggcttcacccacgtccgtgtctactccactgactgcaacggtctcgagtacattggtgaggctgcccgtgagaacggcctcaagatgatcattggtgtcttcatctccagcaccggcatcagcggtgcccaggagcaggtgaccgccatcactaagtgggcccagtgggatctggttaccctcgtcgtcgttggtaacgaggccatccagaacggttacaccgatgcttccagcctcgctggcttcatctcctcttgcaagtcctccttccaggcttccggctactcgggccaggtcaccaccaccgagcccatcaacgtctggcagcagtctggcagcgctctgtgcggtgccgttgacatcctcggtgctaacctccaccccttcttcaacgccgatgttacccccgaccaggccggtagcttcgtccgtgctcagatcaaggaccttgaggccgtctgcaacaaggacgtgatcaaccttgagactggctggcctagcgccggtaacgccaacggcaaggccgtccccggtactgcccagcaggctgccgctatcaaggctctcgttgaggaggtcggctctcagtccgtcttcttctcctactccaacgacctctggaaggatgccggcgagtttgacgtcgagcgctactggggttgcattgaccagttcaaataaatgatctcccggatgtcaatagttaaggatctttaaggcttggagttttttcgttctgcttgtctcggaaataccgacagctnttattaactntttttcttctccatatactttgaattgagtagatataacctttctatttcatgtgtcgatctcccggagcattctgtnttcttggtttggat

SEQ ID NO: 4712 - DNA, 670 bp, Aspergillus oryzae
gcccgatccccgtgatgacctgaacggtatggatgtcgcccgtaagctgactattctggcgcgtatcgccggtctggaggtccagtctcctgactcgttccccattgagtcgttgattcctaaggagctcgagtcggtaccctccactgctgatggtatcaaggaattcatgacccgcttgcccgagtttgatggtcagatgtcggctattaaggaggctgctgagaaggaaggtaaggttgtgcgctacgttggcagcgttgatgttggtaagaaggaggtccgtgtcggtctgcaatacttcgataaggatagctccattgctggtctgaaaggcagcgacaacatcatcagcttctacacgaagcgttacggtggtaaccccctcgttgtccaaggcaacggtgctggtggtgacgtgactgccatgggcgtgtccgccgacctgatcaatgtcgtgcagaaactgcagtaagccactttatcaaaagaccaaagaacggtctgacttagatttgatatacaagaaacccgcaaagttattgaagaagaacaccccgaaatataattataaaattttataacataaagataaaattcctgggcgcgtcgacctgcttttaaagggccgataatggtataagtttttacccctaaatttacccccccc

SEQ ID NO: 4713 - DNA, 668 bp, Aspergillus oryzae
cgaggctttgattctatttccctgtcttatcgcatcacctcaattcgtcaaaatggctgacttccagagcatcgctcagcagttcgttgagttctactacaagaccttcgatgaaaaccgcgggcagctgtctggtctctaccgtgaccagtctatgctcactttcgagaccagctccgttcaaggcgttcgcgatatcaccgagaagttgacttctcttcccttccagaaggtcgttcaccaggtcagcaccctcgacgcccagccttctaatgaggctggtggtattcttgtcatggtgactggcgctctgcttgtcgacgatcagcaaaaccccatgaactacacccagactttccagctcttgcctgacggagctggaagctacttcgtcttcaacgacatcttccgtctggtttacggtagctaaatgcaagatcgtggaggccgatgttgtatgttaggttctgggcggggatccagcttatgaagattatgattatgaggggataacagctctgctgctacttcttctgctgtgagaatggcttgcttcgatttcctagctgcggggtagcaatgtgggtgttggacgttactttccctgttatacactggctagacttgaaactgtatcacatcgtctatcaaggcttttgtcctgtctt

SEQ ID NO: 4714 - DNA, 676 bp, Aspergillus oryzae
  misc_feature (1)...(676): n = A,T,C or G
tcacactttgatgtgtgccttagtggatcggaccacagctggaagaccggctgctcgcacataagcaagtcaccgttgaacttaactcaacaacagataacccactgatagatcccgagaccggcgatattctccatggcggtaatttccaagcggtttccgttacttctgcgatggagaagacaagatcatgccttcagatgcttggcaggctcctcttctctcagtctactgaactggtcgacccaagccttaacaacggcctccctaccaatcttgtcgccgatgacccaagcctctccttcactatgaaaggcgtcgatattagcatggcttcatacatggcagangtggcttaccttgccaacccngtaagctcgcacgtacaagcagcggggaatgcgcaccaatcaatcaactctatgggctttggatccagtncgtacaccatgcangcagtcgagatagtgtcgctcatgtgcgctngtagtctatacatggnatgccagncttnggatctncgagtactgcattttgacctacctcgataacatcaagncccaactncatctgcttacttncatcttttcttcctcatacctatcagacaaagagtctgaaactttggacgnatcactcttggaaaacatnttcaaaaagctggtcggccacaacc

SEQ ID NO: 4715 - DNA, 735 bp, Aspergillus oryzae
  misc_feature (1)...(735): n = A,T,C or G
tcaaagagtagacttccctccaatcctctagtgtgactgaagaaatcccaagcttgaggctttggcacgtctaacgagtccccatgcatcctgttgacattaaattggcgctgctatccgcatttcgcatccaagccgagtgtttcaacctttcaaccgtgtcaattggtcgaatccttgaaataccgcaatgcgtcttataaatgtacaaacctttgcgctggaggagttcttcaacgagcaagtccctccttacgccatactttcacatacgtggggaaatgatgaagatgaagtgtcatttcgcgatattaccgagagaaataccggggatgccagctggccagttaaattcaagggctgttgcgaacgtgcagaaaaggatggctttacacatgcatggatcgacacctgttgtattgacaagaccaactcagtcgaactcggtgaagccatcaattctatgttccgatggtatagcaatgcctctgtttgctatgtctatttctccgatgttactaccgacgatcgcaaacagttaccctctcaaatatcctccagccggtggtttcaacggggttggacattgcaagagcttctagcaccgagtcgtcttcttttctttaattcacagtgggtggatattggcagtaaagcccaatgggcangcctgatcgaaacgatcacaggcatcttgcgcgcattcctnnctcgagagaaccgtgtcagaggcaa

SEQ ID NO: 4716 - DNA, 688 bp, Aspergillus oryzae
  misc_feature (1)...(688): n = A,T,C or G
cagaggccctgccggctgaaactagtctcatgactcgcgcggatcgttttgtcagtggcggagatggatcaatgatcatggatcacgagatctgtatcttgaacggagacctgaactatcgtatagactctataccacgcaacgtcatcatcgaggacattcgcaacaaccgattcaccaagttgctcgagcgagaccaattgctggcatcaagacgcaagaacccaggtttccgtctgcgatctttcatcgaggctccgatcacgtttgcaccgacatataagtatgatgtgggcaccgatgactacgacactagcgacaagaaacgctctcccgcatggtgtgatcgtgtcctgtatcggggaataggccgggtgaagcaacttgaataccgacgacacgaagccagagcctctgatcaccgtccagtcagcgcatcgttcaaactccgggtcaagaccgtccaacccaacgaacgcgccgcagtctgggaatcctgccagcaggagttccagaaggaaaagcgccgacttgcctcggaagcaagcattgaatacctcatcagcgtcctcggcaccgaaccccaacaagcccgcgcattgattctggggaatgggaactnaatcagcctatcctcacacccccttcgttcattggttccctacatgcaggtacattggctatngaa

SEQ ID NO: 4717 - DNA, 707 bp, Aspergillus oryzae
  misc_feature (1)...(707): n = A,T,C or G
ggaattgccgctctganccggcacgaggccctatatcctcgaccccgttccccttccgcctctccgcaaaacaacaccagactcttctctctacccagcaccatcgtccggggggtccgagtatgcagagcaataaggagacggcactcgaccccgagcgcaaccccacgggcgagggggaggtgcggacatctaacgaccatgacatgctaatcgacgaggctgccgacgcgagtagtcacatctccggcatgaagttgtatctcattgtgctaagtctattgctcgctgtgttctgcgtggctctcgataacaccatcctgtccgttgccatccctcgcatcacggatgaattccaccggctgaacgatattggatggtatgcgtccgcctatctactgactacgtgtgccttccaattactatatggcaagttatatgccctcttcagcaccaaatgggtctttctcgtcgccctgggtattttcgaagtgggctctctgatctgcggcgtcgcaccgtcgtccgttgttctcatcgtcggccgtgccatcgcgggagtggggagctcggggatctttacaggtgctctggtcaccatcgcgcatattgtgcccttggccaagcgaccagtttacatggggctcttgggggggatgtacgggattgcgtcagtggcaggccctctgttggggggcgccttcaca

SEQ ID NO: 4718 - DNA, 679 bp, Aspergillus oryzae
cgaagttttcgccgctgctccatttacttctggtacaggttagatccttctacctaccaggtaataaaccaattgtattcgccttcattgcccggtctgttttaatttgacttaagtcaattaatcaaccggtttatcggaatcattctcttgtagatccgatctttgaatacttgcacagcaatcatgggtgtttcaatcgttctgggcagccagtggggtgatgaaggaaagggcaagattacggatatgctcgcgcagcaggcgacgctgtgctgccgtgccgctggcggtcacaatgcgggccatactattgtccatggtaacaagacctatgatttccacattcttccctctggcctgatctccccttcatgtatcaaccttatcggtgctggtaccgttgttcacgttcccagcttcttcaaggagttggcttctcttgaagagaagggtctcgagggtgctagcaagcgcattttcattttcgaacgcgcgcatgtttgccttcaattgcactccggtgtaaatggctttggaagaggccaaactgggtgggtcgaaaagttggtactaactggaaaggcattgggtcctgctacagagaaaaagcttcttgcaagggtattccgcgtgggagagatcctggatgaagcgggttttcaacccaaattacccg

SEQ ID NO: 4719 - DNA, 668 bp, Aspergillus oryzae
  misc_feature (1)...(668): n = A,T,C or G
cggcattgtcattgagcgcgttgagatgattcttaagtctggggcaaatgtcattttcactactaagggtatcgatgacatggtcctgaagctgtttgttgagaggggagccatggccgttcgccgctgcaagaaagaggatctccgacgcattgccaaggcttccggtgcgacactggtcagcacgctctctgatctcaacggagatgagaaattcgaggcctcgtacctcggccatgcggaagaaattgtgcangagcggatatccgatgatgaatgtttctttgcaagggtcccaagttcacacctcaacttttattattctttggggggcaaagctttaacttgggacaaaatgaaccgtccggttacgaactcccttggggctggcaagcgaaccctcggaacgggggccttggtttcggaagggggggctgtcaaaaagccctttattattaccccaaaaaattcgcggcccaggtaggctctgggaaccaccttgccttcggaaaatttttcaaccccttttgtttgttccaaaaaccttggtggaaaaccctggttaagaacctgttccaacttggtggcccactttttgtcccccccccctcttatccaccgtgggcaggggtgggtcccccagtagggaggagaaggcccttcttaag

SEQ ID NO: 4720 - DNA, 653 bp, Aspergillus oryzae
aggaattttttttttttttttttttgcgaaagattagaaatcgatggagaaccctttggaggcggaactaccacatcagtgcggattactacccatagacattattatagacggaaatatgaaccccaaatagcacgggcccaaagttgactactcagttatccacgcatgtgattgatggtaattccacccgatccgtgtttaaatgggagactgaattgcccagtcactcgcgagccgtgcatagtagaaggggatctcaaaccttcactagtgcttaccggtgacttgatcgcccgtcaatttttcgactgcttacttggccatgtcaccaagagccaccatgcagactgtctgccagattcctaggcctatacggggagtaactgcacggtgaagacccttaagaccgttggtctcgtagatgtacttgaaggttttgccaacggtcaagttcttaagccggttggggtcgtgcttcttactctggatgtgcacgcgaatgacttcaataggctggttccaagcagagagaccaccaccgaggccggaagctaagaccttgtccattgcactcagtttttggccttcatgcttggtggtcacctttgtgaattggtgaatctgccagaccagaaagaaccggacgagat

SEQ ID NO: 4721 - DNA, 684 bp, Aspergillus oryzae
  misc_feature (1)...(684): n = A,T,C or G
cgttgctctagcattgctcttcatggccttacaaggggtcgagcagacgatccttcgggatccagctttattttattggatcctgttccccatcaccattgttatgatactgacaggtatccttcgtcactatgctacagttttgatgaacacccctcctaagcctgcgtctactctggccgaatcccgtgagcgtctctcgctcctgcgcggagtcaatctccgcaacaatgcttcagcagtcctctctaaagatgcgtttgaaatgcgcaagaactatcttgtctcagcgtaccaaagtggcgagttcctaaaggacccggccagccgcggtcaacccccagcaaatccgatgactgaccctgcgggcatggaggctatgatgggtatgatgaagggaaatatgatgatgatgatcccgcagactcttattatgagctggattaatgccttcttctctggattcgttatccttaagctgccgttccccctcaccatccggttcaagtctatgcttcagtctggtgtcatgactcgggacttggacgttaggtgggtatccagtttgtcatggtacttcctcaatttgtttggtcttcagtctgtgttcgggttcatcctgggtagcgacaacgctgcgaatcacatgtcccaacanatggctactatgaaccctgccatggg

SEQ ID NO: 4722 - DNA, 861 bp, Aspergillus oryzae
  misc_feature (1)...(861): n = A,T,C or G
cacaatgcgtttcgcagctctggtgataggccttctggccactttcgtttcgacggtgacggcaaccgctctcacttataaactcgaagccaacgagaaagcttgtttctacaactatgttgaccagaggaacgcgaaggtcgccttctacttcgctgtccaatctggcggctctttcgatgtggattatcaggtggtcggccctggtgagaaagtggtcttagatggaaccaaagaacgacagggcgacttcgttttcacggcacagagcatcggggaatatagattctgcttcaataatgaaatgtcgactttcgccgagaaattggtggattttgagattgcggtcgaaaacgaagaacgtgcgcaactcccttgccgacagggtgccagtcccgagcaggccttctggatccaagagtccgtatacaagctttgcgaccagctttcgaccatttgtcgaaaccagaaatacttacggacccgagagaaccgttacttcagcactgttcgtagcacagaacgtcagatctttaactttagcgtcattgagggctcgatgatggtatcgatggcttgattgcaagtctttgttgaacaggggttcttacaaagtgctacgtagggttacgtgtgatgagcatgaaatgtgtctatgnacgatgatcgaggggtgacacactgaatctacctctgagtacataggtctacactcattcggtattatgatcanatgtactaatcgggttcacaaggcatcccagtcactaaaattccaaatctcctgcgggcattgtcatcatgcatctaagaggatcccttcattgggttgattttgtcactccaccgtttccgccatgc

SEQ ID NO: 4723 - DNA, 678 bp, Aspergillus oryzae
cggtgtcggcgtttatgacttcacccaggatgacggctcctgtgccctgaatatcatcgttgaagcacgtgtaaatatcacggtaacgctccaaggcagggaaggggttcttgaagtcttcgaactgaatgacaatgccaggccaacgctccgtaagagcagacatcaactcatccatgaactcccgctcctcttccggcgtaatcttgtcacgattgctacccatgtacaacgggtcttcccggagggtcttgttgcttgttcccagatccaaagtcaaaagcagggtggcctcggggcgaatacctgcacatgcagtgtagagcgccaacttgcaatgggaatgcccattccattaatgccaacgtccgccgaggcgaaaattctggaaccatctgtgatgcatgtgaacctcacattgtgcttgggccaattggcaatgaccgcaacaagattgccgggaactttccactttaagaccatcctttccgttgctggataatcttgaacattttttgcaaactttaacgaccaaccggggttataaccaaaggggaagattccttaatataatccctaccaaacgggtaaatataatcccttgttttggcaaaaaggtctaggtaaacaatttcaaaagtgggttgtttaagggccttatgcccaaaattttttgct

SEQ ID NO: 4724 - DNA, 679 bp, Aspergillus oryzae
  misc_feature (1)...(679): n = A,T,C or G
gaacccgaccacgggcacttatatcacagagttttccaagtgtacgatcggaaacatttgctcggccctgggtggcaatagtgtcaagtccagttgcctttctgacaaccggggggtcaccacctatactggccatcaatgtggcaatggcattgttgagtcgggcgaagactgcgactgtggcggggaagaatcctgcggagacaatagctgctgtgatgccaaaacgtgtaagttcaagagcggcgcggtttgcgatgatgccaatgacagctgctgttcgaagtgccaattctcctctgctggaaccgtctgccgagccagccgtggtgaatgtgatgaggaagaaacgtgcagcggtacttcgagtacttgcccttctgattccttcaagaaagatggaacgaaatgtggcgattcctcggccggcctaacttgcgccagcggacagtgtactagtcgagattaccagtgtcggtccgtcgtgggtagcttgctgcacaacaacgagacgtacgcttgttctgcatatggctcgtcctgtgaagtggtctgctccctcaacacatttggtcaatgctacggcgtcaaccaaaacttcttggacggcaccccttggaacggtggtggccattgcaagaacggaaaatgccaccggtctagcgtcaaaggctggatn

SEQ ID NO: 4725 - DNA, 667 bp, Aspergillus oryzae
  misc_feature (1)...(667): n = A,T,C or G
gaacatcaagccccaggttgaccgctacctgatggccaacggccgccacatcatcctccttgctgagggtcgtcttgtcaaccttggctgtgccactggtcactcctctttcgtcatgtcctgctccttctccaaccaggtcctcgcccagatcgccctctacaaggccgaggatgctgagtttggcaagaagtacgtcgagttcggcaccactggcaagaagcccgtcggtgtctacgtcctccccaaggtcctcgacgaacaggttgctctgtgccaccttgagcacgtcaacgccgagctctccaagctcacccctgtccaggccgagtaccttggtctccctgccgagggtccctacaaggccgaccactaccgctactaaactcctcctttccgtttgttgttgattggtataccctaacctagattcttttcaacattatcacgatgttacgaataacatagagtcccatttaacttgggctcaaaagtattttgtcttcaacggcaataaaagtggcatatatgggggttattacngataagtgttatgggtcggcttgcctattttgcattcaacagtgcgtactgatggggcatgtcttaatgttaatgtttggcgattaaatgaaacccagaacggaggcctgctatatagcattta

SEQ ID NO: 4726 - DNA, 681 bp, Aspergillus oryzae
  misc_feature (1)...(681): n = A,T,C or G
gagaggcgaggcacctttgaattccagcctcgtcctatttagttcctaaagatcgacgtcggacatcaacatcaacaaagttcaagaaaagatgtttattaaacttttaaacaaagcgcttctagtgcttggtctgctgtcagctggcacgcaagctgcaactattcgcttggaccctcgcgcaagttcgttcgattacaatggcgaaaaggtccgcggtgtcaacctgggtggatggcttgtgcttgagccttggattacaccttcaattttcgatgccgctggtgccgaggccgtcgacgagtggtcattgactaagattctgggcaaggaagaggctgaagcccgcttgtccgctcactggaagtctttcgtctctgcgggcgatttccagcgaatggctgatgccngactgaaccacgtccgaatccccattggctactgggctcttggacccctcgaaggagacccttacgtcgatggtcagctagaataccctgacaaggcggtanaaatgggctgagcggcgggcctcaaagttctgatcgacctcacngtgcaccgggatctcaaatggattcnacacagcngtcggagaggagccatncatggcacaaggggacactgtgagcagaccctgatgcttcnacctgctgccgaacgtaccttggctcgaaaccn

SEQ ID NO: 4727 - DNA, 653 bp, Aspergillus oryzae
tttctctacaacagtcgcaatcatgtctaacgataaaggattggaagagatccctgagggacagatcgagaccaactacgatgagatcaccgactccttcgacgccatggagctgaagcctgagttgcttcgcggtgtctacgcctatggtttcgagcgtccctctgctatccagcagcgtgccatcaagcccatcatcaaaggtagcgatgttatcgctcatgcccactctggtactggagagactgccactttctccatttgcgctctccagaagctcgaccccaatgttaagggctgccaggccctcattctcgcccctacccgtgagttggctcagcacatccagaaggtcgtcgttactatcggggagttcgtgaacattaccctgcccgcttgtattggtgggacgtggggtccgtgggggatctatggcttcatgacaaggggcccgatggggccccatgacgagatgatatttgtcgtcataatattccgctctgtctagaagtcaccatcctttgtatgcgggacgtgaagatttgatgcggtgctttcatgaaatgacgtcaccagaagatgtcgatatgatgcagactatgagctgagatgatgtcttggactacgatgtcatgacggtgagaattatgatc

SEQ ID NO: 4728 - DNA, 712 bp, Aspergillus oryzae
  misc_feature (1)...(712): n = A,T,C or G
cgaggccccttcgtccaccttcccgtcaacaaggataccaagccccagcaggaggcccgcatcctggagctcatcagcgagcacaacatcgacctcgtcgtcttggctcgctacatgcaggtcttgtcccctaccctgtgcgaggctatgtccggccgcatcatcaacatccaccacagcttcttgccctcgttcaagggcgccaagccctaccaccaggcctacgaccgcggtgtcaaaattatcggtgccaccgcgcacttcgtcaccagcgatctggatgagggtcccatcatcgagcagaacgttgtccgcgttaaccacggcatgagccccaaggagttgacccacgctggcagcaacgtcgagagcaacgtgctggccgccgccgtgaagtacttctccgagcgcagggtgttgctcaacggacacaagactgtggtcttcaactagacgcttnctggatatatatgtatatatgcatcaaaagctggaatagacaaaaaggacgaataaatgaaaacaaccttctacagtcaggtcaggtccactctaaagccgaacaccctcaaaaggatgattatcctnctcttcctcccactgcgcagcatataatgactcccccatctgcgacgcatncattccggcnnatatatccctanaacccattagcctacttccataaaaaccccaagccgaatnngagagaann

SEQ ID NO: 4729 - DNA, 636 bp, Aspergillus oryzae
  misc_feature (1)...(636): n = A,T,C or G
ggaaagaccgttgttgatttcggtcagaacctcgtcggtcggttgcgtgtccgctgcataaacaaacccgaaggagagagagtcacattcacacatgcagaggtcttggagcacggtgagctaggaactcgcccattgcgagccgcaaaatgcagagatgaatttatctctgcgggaaaagaagtcactgattggaccccacaacatacctttcacggattccgatatgtacaagtagagggttggactgatcaagatccacccttacttacaaaccttgtggcattggtaatgcacactgacctaactcgtactggctggttccaatgttcacacccgatggtcaaccagttgcatcagaacgcctggtggagtatgcgcgggaacttcctttccatcccaacggactgtccccagcgagatgagcgcctcggatggacaggagacattcaggttttctggccttcggcgaattttctctacaatacggccggtatgctggggcactggttggaagatgtggctgcanaacaactcaaagaaaggaacggctgcgtttcaccattcatagtacccaatgtgatcagcgaagaagtgtggccgcattatgtaccccaagcaattgggaagatgtag

SEQ ID NO: 4730 - DNA, 735 bp, Aspergillus oryzae
  misc_feature (1)...(735): n = A,T,C or G
cttccacaaggccactggtaacatcgcccgtgacatggtgtttgtccccaagacccgcgaggaatatgcttcccgcatcggcaagaccattcacgacctgaacgaattgatggaggagactcccatcgccactgtcaccaacctcattctccagcagctcttcggatggcccatgtacctcctgaccaacgtgaccggtcacaacaaccacgagcgccagcccgagggccgtggaaagggaaagcgcaacggctacttcggcggtgtcaaccacttcaaccctagcagccctctgtacgaggccaaggatgctaagttgattgtcctgagtgacctgggtctcgccatcaccggatccgtcctctattacatcggttccacctatggatggctcaacctcctggtgtggtatggaattccttacctctgggtgaaccactggctggttgccatcacttacctccagcacaccgaccccactctccctcactaccagcccgaggtgtggaacttcgcccgtggagccgctgccaccattgaccgtgacttcggctttgttggtcgtcacatcttgcacggtatcattgagacccacgtccttcaccactacgtcagcaccatccncttctaccacgccgacgaggccagcgaggccatccagaaggtcatgggctcgcactaccgcacggaggcccacactggctggacggnattcttcaagctctcttcaccagc

SEQ ID NO: 4731 - DNA, 816 bp, Aspergillus oryzae
  misc_feature (1)...(816): n = A,T,C or G
cacttacgatcaagaacgcagccatggttgtcgaccgtcgtcctccaccagcatatactgctcctccagagtcaactgtccatgcttcttctgaaatttacagagccatctcgaacaccgcctcagacgcctctcagagaaccctagaaacatctttcaccatccgtccatgctctggacaagcatggattgtaccagctggacatgtctgtcgtctgactactccaaagggcccccaagtgggtgatctgaacatatggaatgcaaacaacccccgagagcgactgtgggcagcgcgcacccgtcaaattcatgcctctcacgtatccgttggagaccgtctttggtctaaccttccatatctccggccgcttgttaccatcacgggtgattcacttggcggcggacagctccatgaagtgctcgatgcagagggtaagcggacaaagggcttcggaacgacgcaatggggaggacgagttcatgatcttctgggtacccgatgcgatccctatgtgaatctgctgatgggtggcgagtcattcgacttccattgccattcgaatcttacccgctctgtactcccatatggactgacggagcttgatgtgcacgacgttctaaatgtgttccaggtaactggactggatgaagaagggaaatacttcatgggaaacttccccggcgaggccaggagaatatntcgagttctttgccgaggctgatgttctggtgtgcactctcagcttgtcctggtggtgatttgtctaattggggttgggaggaaaggggcgaaaacatggtaaccactacccg

SEQ ID NO: 4732 - DNA, 636 bp, Aspergillus oryzae
  misc_feature (1)...(636): n = A,T,C or G
caagaacgccctggaggtccagcctccaacgaagtctacccgctcctcaagtcgctccccgaggccgaaaaaccgcaagaaggcacccgtggaaacgctgaattatggttcggatggagtgaaggacaacagtattttcagccttcctacttccgactacaaggccttggttctcgtcaccttggtcgctactgctgtccgtctctttagaatctatcagccgacaagcgttgtcttcgacgaagtccattttggtggttttgcgtcaaaatatatcaagggccgctttttcatggatgttcacccgccactcgctaaacttcttattacacttgcgggttggttggctggattcaatggcgatttcgatttcaaggagattggaaaggactatttggcagcaagagtcccatatgtggcaatgcgaatgctcccagctatcatgggtgtgcttacggtgtccttgatgttcttgacattgaaagcatcgggatgtcgcaccacgactgccgtgctatgtgctcgtgtggtgatattcgagaacgccctggtcacccaggctcgtctgatcctcttagactcgccgctggagttctttactgcactcacggncatgtcattcacatctttcacgaa

SEQ ID NO: 4733 - DNA, 706 bp, Aspergillus oryzae
tgccgtcgagaagggcactggaaagaccaacaagatcaccatcaccaacgacaagggccgtctctccaaggaggagattgagcgcatgcttgccgatgccgagaagtacaaggctgaggatgaggctgaggcttcccgtatccaggccaagaacggccttgagtcttatgcctactccctcaagaacaccatcagcgagggcaagcttaccatctctgactccgacaaggagaaggtcaccagcaaggttgatgagatcatcggttggcttgacagcaaccagaccgccaccaaggaggagtacgagtctcagcagaaggagctcgaaggtgttgccaaccctatcatctccgctgcttatggcggtgccgctggtgctgctcctggcggtgctcccggcgctgcccccggtggctccactcgcaccgctgacgaggttgaggagaagcccgaggagcttgactaaatctcttgaccggcaatgtttttcttctacattcttgctgttgcggatgggcgatcggcttttaatggttttggtctttaatactctctgcttgtctctttttaacgaatttatgggattttttttttgtgcatggttggtaaaatccgagtttctttcccacgcctggtgaattgccgaacttgggaggggaaaaagtctccttccaaatggtcaaattcttctttaacaaaaaaaaaa

SEQ ID NO: 4734 - DNA, 667 bp, Aspergillus oryzae
cgtgctggtcaaccgtcaattctccattgcaaccatccctaccttcattccccctcgcagcaatccacacaactctataccatttccggaatcttcctcgcaatcgctccataacaacaaatcgaaaagatggcctccaccaactacaaagaagcgttctccctcttcgataagcgcggctccggcaaggtctccctggagtccctcggtgacctcctgcgcgcatgcggccagaatcccaccctcgctgagatcgccgaactggagaacggccttggcggagacttcgacttcgaatctttcgtgaaggttctcaaccgtccaaacggcttccgcgatcctggtgaggccgaggaatactgccgcggattccaggtgttcgataaggatatgaccgggtttatcggagtcggtcagcttcgatacattctgacgaacttgggcgagaagatgtcggacgaggaggtcgatgagctgctcaaggcggttgataccagctcgggtgagattaactacactgacctcgttcgcaccattctggccaactgatgattgatacacgataccctatgttctatgatattatgagaatcgctcgaggggcggagttgggctaagtttcagttcgtttgtattgtatatcgggttcatatgatatggatagcaa

SEQ ID NO: 4735 - DNA, 672 bp, Aspergillus oryzae
  misc_feature (1)...(672): n = A,T,C or G
cccatctatcgcaagcattatcgagccatcgtcagttccttctctgaaagtgcttgcatgcggtggggagaaactctcacgggaagtagtcatgaagtgggcccatcgtgtgaaactgattaatggctatggaccaacagagacaactattttcgcggtcctgaacaatgtgaccccaagcaccgatcctgcttgtattggctatggcattccgtccacattgacgtgggttgttgaccctgaaaatcacaaccggctctctcccctgggtgcgataggagagctggctttggaaggtgctgctcttgcaagagagtacctcaaaagcccggagaaaacggcggatgcctttgttaatgagccaacatggatcagagacttccccagctccctaccttcacccaggaggatatacaagactggtgatttgtaagatacaattcagacggntctatngaatacatcagccgtaaggacccacaanngtcaaatcacggtctncgtatgggagctcgtgaaattgagcaccgacttgtgcgaagatcggcgggtgcgttaagcccgtgggattctaccatatcagggctcattcaaaaccgcttggncgcggggttgctttaaaatttttgacctaggaaccggctaattctgaggggcattcaacttattacn

SEQ ID NO: 4736 - DNA, 679 bp, Aspergillus oryzae
gagaaccgtgacattctgatgttctgttacgaagtcatcaaggagtcatatcaggagccggtgcagactgcaaagaaggctttatctgcttcagaagaacactttctgattaagcttcatggaccaaagcgtggtgagaaacgaggcaccacttcttcttacgcttacaagttgactcgctttgcccttgatgtccttcgctcggtcttgagcaagtttgactcactactcacgccagccaatgtggctggattccttcctatcattggcgattcgctggtccaggggcaggaggaagttaaaatctcggcccttcgactgctgtctacaatgatcaagcttcctcttgctgagcttgataacaactctcatgtgtatctcactgaggctgtcaagattattaaggaggcgccgagcacaaacactgaggctgcccaagcatcgttgaagttgattgcggccatgcttcgggagagaaagtcgacaaagctcagggatgggcatctctcatatttgttgcagcgcctcacttctgacattgaagagccagatcgtcaaggcatcaccttcaacttcatcagggctgttatgtctaggaagttcgttgtcactgaaatgtacgaagtggtggaccatattgccaccatgatggtcaccaaccagacccgctctgcgcgtg

SEQ ID NO: 4737 - DNA, 680 bp, Aspergillus oryzae
acgtatattttctcatgatttggcccgcccaaatcatacagataaaatcggtagaccggtgtagttcatcgtctgtgtcatcatgtacggcaaatcactcatcttggctaccactctcttgggaacccattctcgagctgctgtgctccctcgcgctagcattgaccatgatgctgtcgtgggatttgaccagacggtccccagcggcaccacgggcgaggtctatctggcctatcaaccagatctgtatgtggtcaacggatgcgtgccattcccagcggtagatgccgagggtaataccaacgccggcctcgagccaaccggggattccagtgggagctgtagtagcagtaccggccaaatctatgttagaggcggcatatcgggagactattatgcccttatgtactcttggtacttccccaaagacgagccatccaccggcctatgccaccgccatgattgggaaggtgttattgttttgctgtccgactccacgtcgacctccgctgataatatcgtggcggtttgtccgtctgcacatgggggctgggactgttcgaccgacagctacacgctcgatggttccaccccctttgattcaatactacagtgtctggccgggcaatcatcaatgtggactgacaaccactgtcgggcgggacacaacccttgattgg

SEQ ID NO: 4738 - DNA, 648 bp, Aspergillus oryzae
ccagctcggtctattgcataccgcacccaagatgactccagagaaggccgctatgtctgaacatattgaaaacgataacccagcgaggcatgatgatatcgacctccccaacagtagcgaggcacataccgccattgcgaaagaacgtgagatgactctatggcaagcgctaagactttatccgaaggcggtggcgtggtctcttctgttctcctgtgccattatcatggaaggctacgatgttgttcttatcggttccttcctcgcatttcctgccttcaacgaaaaatacggaggtctcatgtccgacgggacatatgggctcgaagctaggtggcaagcaggtgttaacaacgcgatggcctgcggccagattatcggactttttctcaatggactggtctcagagcgcttgggataccgaaagaccctgatggcatgccttgccgcgaccgttggtttcgtttcattctgttctttgcgcccaatattcaaactctcgttgtcggcgagctctttatgggcatccctcttggtgtataccaaaccctcgttgtgacatacgcatccgaagtgtgccctgtcgcattgcgcgcatatctcaccacctatgttaaacctttgctgggtggtagggccaattgctcg

SEQ ID NO: 4739 - DNA, 630 bp, Aspergillus oryzae
cccactcccctatcagagtatccagtgaagatgtctcttaagcctattatcctccatgggcattccgccggtcccaacccctggaaggtggccatgctcctcaacgaacttaatgttccttacgaatacaaatatcttcaattcgccgaaatcaagagtgagcccttcttcaagctcaaccccaacggccgtgttcccgccatcgaggatcccaacacaggaatcaccctgtgggagtcgggtgctatccttgaatacttgattgaaacctacgacaaagagaagaagttcagtttcgaagccggcactcctgaatacttccacgccaagcaatggctccacttccagatgtcgggtcagggcccctacttcggccaggcagtatggttcaccaaataccacccggagaaggtcgaaagcgcccgggtgcgctacgtcaacgaaatccgtcgtgtgtcggaaacgatgaacaatgttcttgcagaccgtgagtatctggtcggcgacaagtacagttatgccgacctctccttcgttccctggttcggcatcattccctggatcaccggagatgcatttgatctggaaaaggactttcctcatctcaatgcctggttggaaagaaataag

SEQ ID NO: 4740 - DNA, 689 bp, Aspergillus oryzae
ccggtaagactctccttgccaaagccgtagctcgtgagagtggagccaccgtccttgaggtcagtggttccgaggtctatgacatgtatgtcggtgagggtgagaaaaatgtcaaggctatcttcacattggccaagaagctgagcccgtgtgttgtattcattgacgaagcagatgctatcttctgctcgcggaccggagccagcagtcgcacatcccatcgggagctcattaaccaatttttgcgagaatgggacggtatgaatgacctgtcggctttcattatggttgccaccaaccgaccatttgatctcgatgatgctgttctgcggcgtctccctaggcgactgctcgtggacctgccccttgaacaagatcgactggccatccttaagatccacttgaaggaagagaatctcgatagctctgttgacctcgctgagctagctcgccgcactcagctctattctggatccgatttgaagaacctttccgtcgccgcggctctagcctgcgtccgggaggagaatgacctggcggctcagcaccagggcgacgagccctaccaatacccagaaagacgtacgctgacctggaagcatttcgagcgtggaatggaggagatcagcgcctcaataagcgaggacatgtcgtcactcttcgcgatccgcaagttcgacgagcagtat

SEQ ID NO: 4741 - DNA, 680 bp, Aspergillus oryzae
cgcagccagatcgcccaaatccaactcagaatgcgctttcaaggcgttgtgccgacggctttattggccatctcatgcaccgacaaggcgtgtgcttccaagcatggacgctctgatcagccagtgcacgaaccctcggtcctagacaggagaacatcattgtcttcggaggagcgtcagctccgctcacacgataactttcgatttctcaatgacgagacgaggcgtatgtattcatacttcctggtggatgaatgctgatgtaggcatatggatcaatagcctacctcgtggagagcttgcctgatgtgccattcgacgtcggtgaattgtactcgggatcagtgccaatcgaaaagggtaacagctcgagaactctcttctttgtgttccagccgacagtgggggagcctgtggacgaaattacaatcgaggttaatgggggcccgggtgctagctccctcgaagggttctccaagaaaccggcagatttgtttggccaccaggaacctatgcgccagtcattaatccgtattcctgggtaaatctgactaacatgttgtgggacgtttcgattgtctcctttgggatccttctttaatcttcactatagggttgaacaaccccgtgggaacgggtttttacaagcacacctactgttacacttgagaagaaacgcg

SEQ ID NO: 4742 - DNA, 901 bp, Aspergillus oryzae
  misc_feature (1)...(901): n = A,T,C or G
caggaactcaattcgggcgaggggccccaaaccctcgaaaaagtgtttcaagtatggcaactctttgcccccgggcgcgccgcggaatgctgaaggcccatattgtgaatatactagacattccagggacagggaaagacggacgagtcctcaaagaagatgtccttcggtttgtgacagtgcgggactctgcacctacgtcgcaacctacaacccctacaatccctacaacccctgtgtcacagcagtcagatacagcggtcaacctgacaccaattcagtcacaaatgtttaagaccatgacacggtcgctcaacatccctcacttcctatttgcagatgagctaaacatcaacaatatcactgctctgagaaagaaactggccaatgatccgaaggaccccaggagaattaccttcctctccttcgttattaaagccgtctctctagccctaaatgaatatccaatcttgaacgccaaggttgacacaagcaatcccgacaagccacaactcatcatgcggcccagacacaatattggtgttgcaatggatacaccgcaaggcttgattgtgccaaatgttaaagatgttgccaaccggtctattgaagatgttgcagcagaaatctcccgtctgagcgccttangtaaaagaagggaggctcactccagccgacctgagtggcggaacaatcaccgtctcaaatataggaaatattgngggtacctatgtcgcaccattgatggggtccaatgaaagggctatcctgggtgttggaaaatccaagaccggacccaatcttcgatgaggcgggtcaaggtaaccaagggtgaattggaaaatttcacttggaatggcaaacaccgattctgggccggcgccactattgcttcggatga

SEQ ID NO: 4743 - DNA, 549 bp, Aspergillus oryzae
tgaatgcgactgtcgaatcgccgaggcgattcttatcccccacacccggtggttcttccacagaactgtttgaatcgctcttctacgactccgatcaattgaagatacacgttaagaaatgttcagacgcttggtaactgttgttccccgggttggcaccgtggtgtcgcctcgcattaccccggccctttccggcattcaaagccagcccgttctccgggcccctgcgacaaagagaagctatcacgagaaagtgttagatcactataacaacccccgtaatgttggcagtttcaacaagaacgatgccgatgttgccactggtcttgttggcgcccccgcttgcggtgatgtcatgaagcttcagattcgtgttgacaaggatacgaatgtgatcagcgatgtcaggttcaagacatttggctgtggcagcgccatcgctagttcgagttacctgacagagttggtgcgcggtatgactctcgaggaggccggggaaaataagaatactgaattgcccgtgaactttgcttgccgcccgtgaaagtg

SEQ ID NO: 4744 - DNA, 677 bp, Aspergillus oryzae
tcactcttcacagttcagtcttctccaagacaagcttctctcgcttacaaacttctccgagtctaccctcgttcaaaaccaaagccaccatcacaatgcagttctccgtcgccgctgttcttgctctggctactgccgttgccgctcttcctcctgcctctggcactggcgctggccagcaagtcggacactccaagaacgacttccctctccctaaggagttgaccaccaagcaggccgccgacaagtgtggtgaccaggctcagctcacctgctgcaacaagaccgtcaagaccggtgacttcacccaggttgaggagggtctccttgctggcctcctctccaacctcctcggtgccggacagggctcccagggtcttggtctcttggatgagtgcaccaacatccctgttatccccatcatctccatcgcctctcctcaggagaagtgcaagcagcccatctcttgctgccagaacaccaagtccagcgccgatggcgacctcgtcggtattggtcttccttgcatcgctctcggctctctcctgtaagcgattgcattcgcgaaattggtagctcgaggagcacgggatggaaaatggctatgaaatgtttccatagtgtccttttctgtgtcctgtactggcatctcgtgtcgtggaaccctcggagtgaga

SEQ ID NO: 4745 - DNA, 694 bp, Aspergillus oryzae
  misc_feature (1)...(694): n = A,T,C or G
caatgtgcacttcgccgtttgggcacgcttgtctgatcttcgcactcaacacctggacacgatcgctgttatctctgttctctggagtgtccgcttggcattcaactactggcgcaaaggaggctaccagatcggctccgaagactaccgatgggcaattgtgcgctcaaaggtcaacaaccgattcgttttcttcattttcaacatcgtcttcatctccctgatccaatccctggtgctgttgctcctcgcggcacccacctacaacttcctccttctgtcgcgcctccctggcggaaagacatttgaggtccccgatctagtattctctcgcatcgccttcttcttccttatcatcgaatacttcgccgatcagcagcagtggcacttccactgcgccaagcatgaataccagaagacggcgcgcatccctgatcagtacaagggccaattcacccccgaggacctagaacgcggcttcactgtcagcggcctgtggtctctgtctcgccaccctaacttcctcgccgagcaggctatctggctgacactgtatctgtggaactgctaccgcaccgagtcgtatgcccagtggactggagttggtgtcctggttctcctgctgatcttccanggaagcactcgtctcaccgaatccatcagctctagcaagtaccctgaatacagcgagtcc

SEQ ID NO: 4746 - DNA, 1147 bp, Aspergillus oryzae
  misc_feature (1)...(1147): n = A,T,C or G
tggccgggactcaagcggtaacgtttctttcaagccgcaccttcttacggaccttcgggatgttattttgcctggcatttttgaaaatgtccgctatgtccctatccctcgtattgaggtgtcagaccccatggctgatgtggtcgtggaaaaccttgtcgtcgagagtgataacttggtgccgaatgttgtcgagttcggcagtgacaactacctccgctggggacgcaagaagatcagcagcaagagagacaataagatcatgctttctgtttctggaatccaggctgacttgcgagatgtcagttactacatcaacaagaaacaaggattcccttccataacggatcaaggagttatggatatcttcttgggcggcgatggcttcggcttcaaaatcgcagcttctaatgcccaaagggaagaccgtcagaacttcgtcaagttggacaaagtgtccgtgaagatcgactccttcaacatcaaattgaagaagtccaagcacaaggctctgttcacaatcttcaagccattgcttttccgcactgttcgccccgttctgcagagggtcctcgagcagcagatccgcgatgcattctctaggggagatgcctttgcctatgagatccacagcgaggtcaagcgcgcaaaggaagccgccatcgaggatcccgcaaacgcgcctaacatctactcccgctacctggatgccgcgcgcgccaagatggaagaaaacaagcaaaaggcacaggctgtcgcccagcgcgcatctaacactaaggtccagacggcaacgacgcttcacgattccctcttccccgagatcaagcttcctggtggcatctccagcaaggccactgagtataaggagctcgcggagaggggagaacgctgggaatcacccatcttcagtatcggcgatgcacctgagtcctccaacatcccaaccccggctgatatcacccgcaagccacacaccaccgcccaaggccgtatatccgatggcaacgtgaccaacggtagcgcagcagctagcggcgcacgcacttncaacggttccaccaccatcggggcaacgaacggcnntcgctgccgtacagggaacagtggagtactaacggtgccaccatgtgntcacanggcaacg

SEQ ID NO: 4747 - DNA, 814 bp, Aspergillus oryzae
ggaccatttagacttaattttgcttgtggattcccgttgacgctgcgtatatctcccttctctcctccccggatctacttattgtatacaagtgatctgttctcatcattcaactccctaaagttacactaccatatatactaataccccaccaagcacctgccgacacaatgcctgagcacgaagaagatctcgttgcctccaagaccgagggtttcaaggtcggggagaagaagacaatcaatgagtacactgagcttgataaaaatgacgaatccctaaaccgctggaaggcctctctaggccttgcaaccggtgcaacaattggagaccccagcgatcccaggaagtgcatcatcaagtctctagccctggaggttgagggacgccccgatgtggtcatcgacgtgtccgcacccggtgcagttgatactctcaaggacaagccattcaccatcaaagagggtgcccacttccggatcaaggtcgtcttccaggtgcaccatgaagtcctgagcggtctgaaatacctgcaggtcgttaagaggaagggtgttagagttagcaaggacgaggagatgctgggcagctatgcccccaacaccaccgacaagcccgtttacgagaagaagttccaagagggaagaggccccctcgggatttatagctcgtggccattacaacgcggtctcgaaattcgtggatgacgacgaccacaccccattgcagttcgaatggtcggtttgatatcgccaaagattggtaaatctgacgggtcctggatgaaccacaactcttgtctgacccacatttg

SEQ ID NO: 4748 - DNA, 553 bp, Aspergillus oryzae
gttgggcatacacgtccgggcagcttcgttctcaaggacaaagtattgcggggccgctcaagttgaaactcgattcctgacaagaaacccatatcacaacccaccaaaccgccaaaacagagcacgatggtctccgaatcagacatcaactatttacgccgttgcgtagacctagcccgtgaagctctcgaagcgggcgattccccattcgggtcagttttagtggacgccgccgggaaggttatctacgaggatcgcaaccgcaccgtgaccgaagcagacgtcacctggcacccagagttcacaatcgtcaagtgggcgcagaagaacctgactccgacggagcgcgccgctgccacagtctacacttcgggtgagcactgtccaatgtgcgcggctgctcatgcaaacgcgggcttggggcgaattgtgtacgcgagctctactgctcaatttgtgcagtggaggatggagatgggcataaaaccttgtccgggtgccctcgtgtccatcaatccagtggacccggattaacttgtagatggccccgctt

SEQ ID NO: 4749 - DNA, 658 bp, Aspergillus oryzae
  misc_feature (1)...(658): n = A,T,C or G
ctacgcaagtgtcagagttgaaagaaaagcttgcgacgtcggaatatgcggataccccggcggagcgtcagcgcctaatctactcgggaagagtattaaaagataatgaaaccctggctacgtacaagattaaagatggacacaccatccatctggtaaagagtgctgctagcaatcagcgccaggccggcacttctcagactgcctcggcctccacgccatcaggcacctctgctactccagccgctggtgtccccacaaaccttgcggctggcacaggcaacaacccactggccggtttgactggcgcacgatatgctggttttgcgcaacttccaggggctggaatgtttggcccagatggtggcatgggccctcctcctgatgccgactctatgcttaatatgctcgaaaacctcaattccagtctactatcaatgaagctttacagaacccagcgatgattgatatgatgattcaacaaaatcccatgttgcgcgaaatgggtcncggcgtgcggcaaatgatgcagagcccgaattttcgcgtatgcnttacgatccaattcgcttcgccaggcgatgcaacttcagagagccatgggtggcngtggtgggcttggtggtggtagcgcaatccctgctccgggggtcacaaa

SEQ ID NO: 4750 - DNA, 671 bp, Aspergillus oryzae
  misc_feature (1)...(671): n = A,T,C or G
gtcgctccgaggaaatcatcggaaaggccctgacaaagtacaacatcccgcgcaaccgtgtagtcatcctgaccaagtgctattttggagtcgacgacggaggcaagcaacctcctatctccgccgcaggccggaacgacggcgactgggtcaaccgggttggcctgtcccggaagcacattttcgatgcggtggacgccagcgtgagcagactgggcacttacatcgacgtattgcagatccaccgtctggatcgggacacgccccgtgaggagatcatgagggcgctcaacgatgtgatcgagagcgggaaggtcagatacattggggctagtactatggccgcgtgggagttccaaacgctccaaaatatcgcggaacggaacggatggcacaagtttatctctatgcagaactatcataacctcttgggctcggaggaggagcgcgagatgatcccttactgtgttgactncnggggtgggtctgatcccttggtnctctatggcgcgtggtgtgctggcaccgccgtgggaatcttggtcgacaacccgggagtccacgaggcgggcttaaaactctggcctgaacccaaagtccaggcccaacagggaatcgctaacaatggaggacttgcccagagaagggggtaaactggccagggtccattt

SEQ ID NO: 4751 - DNA, 719 bp, Aspergillus oryzae
  misc_feature (1)...(719): n = A,T,C or G
cgaggacccccaagacccaaggattatgcattcgtccaagtactgtactactttacctgccatgttaaaggacagccgagaggcctacaacattgctgtacttggcagcggtcaaagtgccgcagaaatcttccatgacctccaaaaacgctacccgaactcgaagacgacgctgattatgcgagacactgctatgcgacccagtgatgattcgccatttgttaacgaagtcttcaaccccgaacgggtcgataagttctttagcctttcctctgccgaacgccagcgctccctcactgctgacaaggcaaccaactatagcgtcgtccgacttgagttgattgagcagatcttcaatgacatgtacctacagagggtacaaaaccccgatgagacacaatggcagcatcgcatcctccctggccgcaagattacccgagttgagcattacggaccgcatangcggatgcggcttcatgtccgggctgtgaaagacgaagaaggacagccttgttggcaacggcaaggaaacattggaggtggacgcacctaggtgggtacaggctacaaccgaatggccccaaccttttctggaaaaagtacaagctttgccccccccggccaaaaaactggacccccaacaggaatacgtgttgagctggaccaagcaagttaacccccagcttgaatttggtaacaggtgcaaaaaccaacccgtg

SEQ ID NO: 4752 - DNA, 997 bp, Aspergillus oryzae
ctttctccaccaccgctgagcgtgaaattgtccgtgacatcaaggagaagctttgctacgtcgccctcgacttcgagcaggagattcagaccgcttctcagagctccagcctcgagaagtcctacgagcttcctgatggccaggtcatcaccatcggtaacgagcgtttccgtgctcctgaggctctcttccagcctagcgttctgggtctggaaagcggtggtatccacgttaccaccttcaactccatcatgaagtgtgatgttgatgtccgtaaggatctctctccaagacactgaagccagaaaccttcctaccaccttcctctcaagccgtcttcaaacgaccatctttcagaacatccatcataacaatgaagtccttcactgccatctctctcctcgccctcttctcctcggctttggccgcacctgttgagcagtcaaccgacgcttccaccgccgctactatttccgtgtcctacgaccaaaagtacgatgtcagcggcagctctctgactactgtttcctgctcggacggtgtctacggcctcatttcccagggctacagcaccttcggatccctcccgggcttccctaatatcggaggtgctcctaccgtcgccggctggaacagccccaattgcggaaagtgctaccagctccactatgcggccggcaacgttgacaagtccatttacgtgactgccattgatgcggcacccggtggcttcaacatcggcctgcaggccatgaacaccctgacgaatggattggccgagcagttgggcagagtcaatgtggactacactgaagttccccgctcgaactgcggcttcccttaatggatgaggttatctgatggatggtcacgatgaatcatgagttacatgatcccagtatctaattttatcttctgatgtctctacttcagcatgtgatatagcattaatgcgttacgcgggataatataaaaaaaaaaaaaaaaaaaaattcct

SEQ ID NO: 4753 - DNA, 688 bp, Aspergillus oryzae
tcatcgaatttcaatcgttatttcccgacattgaccgtatcaccacgcaacaccgtggagaggctcgatcggccgagcgcctactacctgggaaaggtctagcttcataagagttcttcaatggcaactggctggatcgcgggaataactaacatgtatcttatatatccagaacaagaagcgcaagtacagccaagatgacgcggacaaggttgcagaagatccaaccgacaacttaaaaaatgctaccactctttatgtcggtaatctgtatgtccattgtcttgtcgacggtttaacatgggtctctcttcatctactaactactttagttctttctacacaacagaggaacagattcatgaacttttctcaaaatgtggagaagttaaacggcttgtgatgggactcgaccgatttacgaagacaccctgtggcttctgcttcgtcgagtattacacacatcaagatgcgttggattgcttgaaatacgttggtggcaccaagctcgatgagagaattatccggacggatcttgacccttggttcgaggaaagaagacaatacggtcggggtaaatctggggggcaggttcgcgacaaataccgaaaagagtcgacccaggacgtggcggttatggaccggcttatgcatatgatcagagacagcgggaaaaaaataatacggg

SEQ ID NO: 4754 - DNA, 692 bp, Aspergillus oryzae
  misc_feature (1)...(692): n = A,T,C or G
ggccgagagctgttcgtatatgtccttccaccccccttctccaatcaacatgggcgagggcttcattaagagcatctacgaggcgttgcgctcttccccgcagtggaacgagacgctgttcatcctgacatttgatgagcacggtggttttgccgaccatgtgtctcctcctgagaatgtgccggctggcgataacctgacgtataccgaaacggccaaggacggccaagaggctaccttccatttcgaccgtttgggtatcagagtacctaccgttctgatgtctccatgggtgggcaaaggcgtggttcagaatagcccggctgaccagcctaacgaattcacccacacctctattctcaaatatgtggctgagctctggaacctggacattctcactcctcgcgtcgactggtctcccagcttccggggtctgatcaccaacactttccgtgagacgccggagaagctacctgagccggctgatttttanagaaatgaatctgtacagtctagactcgatgtctagagccgcatatgaccatgatgacgatataattatgacaataaccgtttcaattaaatgagtctaggcagccacgaaggttttgcctttgtgtgaaaaaataatatatnntaatatttattatatataaattttatttttaatattattcttttattatattttt

SEQ ID NO: 4755 - DNA, 675 bp, Aspergillus oryzae
gatgtccgagatttcctttggttattccaaagataagccccttttaaaggatgtcgatcgcgatgtgcaacttgactctcggataggaattgttggaccgaacggcgctggtaaaaccacagtgttgaagctgctaactggccagcttgagccaacttcgggccttctttcgcaacatgctcgcttacgtattggatactttgcccaacatcatgttgatgctctggatctgacgaccagtgcggtaagcttcaatggcaaaaactaaccaaggaagccggaccaagatacccggagccttttggaaccttccggattaactgaattgcctgaccttcaaaggatgaacctcttgtctgaaggacaaaaatctggtgcgcaattgcttgcttggccgtgacaaaatccacatattgggccctgagcaaactttcaaacacacttgtattgagaggtatgtacacattgtcagggcttgacagaggttcaaaggtggtctcgaaggagttcacacaatgacacaactctgcagaacgtgtgctctactctgtgtgtgccacaaaggagcacatacccaatttcaagggccccgaaaatctttacaaaaagatgatcatttcaaagcccaacaaaccaggtttaacatttgcccactaatgggacctttgaaccccc

SEQ ID NO: 4756 - DNA, 697 bp, Aspergillus oryzae
  misc_feature (1)...(697): n = A,T,C or G
gtcacctgtgacggattacatacatcacttgttcccatacgtgccatcgagtcgcctgggcacctttagctatggtcatgtcattcccccagagaatttgatcgcacaagtcctaggtaaaggggttacaggtacagaatttgactttacctttgagacacgggattcagaacggatgatagttgacctgggacgaacgatggctgctctatgccaggttattccagatggcgtcgttgcctttttcccaagttatgactatctaagtcaagtgttgagcatatggaaaagaacccttgcaggagagaagaatcgtactgtctatgacttgatcgaggggaaaaagactattctgcatgagtcacgagatgtgactataagcactgaggagcttttgcaagaatatgcaagtattgtcggatcagggcgaggggcgttacttctttccgtggtcggtggaaagctgtcagagggtatcaacttttctgacagattgnggagaggtgtgttgattgttggcttgccctttccaaatatacgcagtgcggtttggcaagcaaagatccactatgttgagcaaaaagcatacaaagagagctcgggcttcgatgcaaaccggcagttggtcgcanaagctgcgggaaaggatttctatgagaaactctgcatgcgggcaggtcatcagtgtatagggagg

SEQ ID NO: 4757 - DNA, 687 bp, Aspergillus oryzae
cattaagaagcacaagaccgatcctcgcgagaacgctcgtggtctcgccaagttgaagcttgagggtgaggctgctcgcaagaccttgagcttgggtaccaacgccagcttgagcattgagagtctcgcagatggcattgatttcggctccactgtcaaccgtactcgctacgaacttctctccggcaagaccttcgcccagttcaccggcttgatcgagcaggttatccagaaggctggtttggatgtcttggacattgacgaggttatcttcgctggtggtgcctctcacactcccaagatcgcccagctggcccgcaacatcttctccgagaagactaagatccttgccccttcgaccttcactggcgctatcaacccctctgagctggcccccaggggtgccgccatccaggcctctcttatccaggagttcgagcaggaggacattgagcaatctatccaccccatggtcactgccactcctcatctgaagaacgccattggtgtcgagttcaccaccggtgagaccgtcgagttccagcctctcctgaacactgagaccgccctccccgctcgtcgtgtcgctcagtacaacgccccccaggctggtggcgacgttttcattcgcgtttgcgagggtgtccgcgagatcaaggtcaccaagcctgagcctaagccccagga

SEQ ID NO: 4758 - DNA, 699 bp, Aspergillus oryzae
cgctgcgtgtgaaaaggagtttaagaacgatatacgtctacaagaatcacttgacaggcaagaaacacattcgcgccgccgaggccaaaaaggcttccggtgactctggcgagaagtcagcagcagcaaatggtgtttcggccgttgcttctcgtttgaaggaacgcgctgtggcagagcgtgagcaccgtgttcggtcgttggcgaaggtgttggacgttgagcgtcaagccacgcggaccaacgttgagcggaagcagggtatgactgagagagaacgtcagatggaactcgaagcgctgctcgcagaatccgaaaatgctggcggtgatcgtgcaggcgatcaatctgacgatgatggagatgaccggatttacaacccgcttaagctgccgcttgcttgggatggaaagcccattccttactggctgtacaagctgcacggtttgggtgttgagtacccctgtgagattggcggcaacctcgtgtacatgggtcgtcgcgctttagacaaccacttctcggaaagcttgcatatctgggggctaaagtgtcggggtttaccctcgaatccaaacctttctcggaaaatcacaaggtatcaggacgcctctttattggtgggaaaactttgaccttgaccccaaaaaaaattagggcaacccgcaaaacctggggccaattggggaccgcaagggg

SEQ ID NO: 4759 - DNA, 723 bp, Aspergillus oryzae
  misc_feature (1)...(723): n = A,T,C or G
cgacatcgataaactacactctccgctcctctacctctctccctctctccctcgcctcaactcacacaatggcgtccctccgcctaccccgactaatacgcccatccggtcgtcgactatactcgggcgcggcatcgccatcgtcacgactgaacctgcccatcgactacaaaaccactccgcttcttcatcacacatcctccactctctccgaaagcttagaacttcctggctctaccacctcgaaatccatgaacctctaccaagccatcaattccgccctacgcactgcactcgccaagtcggagaaggtgatgctctttggcgaagatgtcgccttcggaggtgtctttcgctgctcgatggatctacaaacagaatttgggtcggaacgcgttttcaataccccattgacagaacaagggatcgtgggatttgccattggggccgcagcacagggtatgaagccggtcgcggagatccagttcgcggattatgtcttcccagctttcgaccagattgtcaacgaagccgcaaaattcagatatcgtgaaggtgccacgggagtacatgctggtggcatggttgtgcgcatgccatgtggtgcggatggacacggcgctttgtatggtccccgcccaatgagcgctctcgaattggtatactgactntaaccctaactagataccattcacaatcccccgaggcgctntttgcacatgt

SEQ ID NO: 4760 - DNA, 694 bp, Aspergillus oryzae
ttttttattgcaagtttgaaggaagtgggcagagacatcatttaagatgagagttgagacctgccacttctgcagtcgtcctgtataccctagcaagggtatcagttttgtgcggctcgattcgaaaatgttccggttctgcagaagcaaatgtcacaagaactttaagatgaagcgccaaccccgcaagttgaagtggaccaagaccagcagagctgcaaatggaaaggaaatgatcgtcgactcgtctctcgttctgtctcagttcgccaagaagaggaacgcccccgtcaagtacgaccgcaacctcgtggccgctaccgtcaaggctatggagagagtggaggagatccgtcaacgcagagagcgcgctttcaccaagcgcagattggcaggcaagctcgcccgggaccgcaagcgcgaggaggaccggagggttgtggccgagggcgaacaccttatccgcaaggaactgcgcgacagagaagaaggcatgcccttggtgcaggagggcaagcagaacaagatccacagcgaggagaggcccaggcagaagaagagaaccagagttctcgtggatggcacaactcaggaggaaatggacgtcgattaaaggttatgcgctttcttttgttctttcagatacgatgccctgggttttacaacggaggtaggttgttgtgatatctgattg

SEQ ID NO: 4761 - DNA, 753 bp, Aspergillus oryzae
gtacaaatatctatcatgggttccgttgcacactctgtggcagagcttgatgcctctgtggtcaccatcactcggtcgacaaatctccgcccggttcctgaaccgggctcgcccgaggaattgagccattcgtactgtactgaccatatggtcactgcccgatggaccgtggccaatggctgggagacccccgaagtgaagccctttgagaatcttagcatccctcccacggcttcttgcttgcactatgccactgaatgctttgagggtatgaaggtgtacagaggatatgatggcaaactgcgcctgttccgcccggattgcaatggagagagattgctctcgagtgctcaacgagcctctttgcccagcttccggtatgaggagctgaaggttctcatcgctaagttgatgcagatcgatggaccacgctggctccccaaggaccaacccggtcgtttcctctatctccgtcccacaatgattggtagcggccctcatctgggtgttcagactcccaaggaagctctccttttcatcattgccgtgccatggcccgacccatccaagctgaagaagcctgaagaaggcactaaacccggattgaagcttcttgcttctacacctgatactatccgtgcctggcccggtggtttcggctatgcaaagctcggagcgaactacggtccttcgttggttgcgcacggtaaagctcaagccattggctttgatcagattctttggttgtttggt

SEQ ID NO: 4762 - DNA, 1047 bp, Aspergillus oryzae
cgcacacactctcccttcgcactttcccgcctaggccgcgagtagtctcatcaactccaacaaccacccgccgtcgacaaccaccaccaccccctcccttcattcttttcagtctccttcgtcccagcagccaatatgtcggagacgaagcagtttggaaagggccagaggaccgtgccggctcagaaggcccagaaatggtaccccgttgatgacgagtcgcagcctaagaaagtccgcaaggctgttcgtcccaccaagctccgggaaagcctccagcccggtactatcttgatcctcctcgccggtcgcttccgtggcaagcgtgttgtcctcctcaagcaccttgaccagggtgtcctcctcgtcaccggccccttcaagatcaacggtgttccccttcgtcgtgtcaacgcccgctatgtgatcgccaccagcacccgcatcgacatcagcggcgtcgacgctcagaccgtcgagaaggtctccactcccgactacttcaccaaggagaagaaggccgagaagaagaccgaggaggctttcttcaagcagggagagaagcccgagaagaagaaggttgccagcgctcgcgccagcgaccagaaggccattgaccagtccatcctggcatccgtcaagaaggagaacttccttggcagctacctcgccagcactttcagcctccgcaacggtgacaagccccacgagatgaagtggtaaacgtgcgacgcggcggccgcgggttcggtagttattgtggaggaattcatgtgaggggcggcttgaatgcggattggcattcccaatgtgggaagcgcttgcagcgcaggaggaacagctcatgaaatatgtaactcgattcgggctccgtctttgctcattaggattacggtcaattcggaaaaccggttgttatttctgtttcacgatcagtgcctcctgcgtcgccaatttgcaggacctataaatgagccgaaatgaaaagaaaaaaaaacagaataataccttttccagctgtataacaaacgacatacaaaaattcct

SEQ ID NO: 4763 - DNA, 576 bp, Aspergillus oryzae
ccgccgtccaattcggacgaggcgatcaatttcccttctcctccacgtcaaactttccaacctctggggccaatctccccttcctccttttcattttatatcctctactacaggatttcgtcatgcaggccttccgccgtagcactgcctctgcccttaggaatgctgccgctgtgcagcaacggggatatgccaatgccccggcctacgctgagaccattaacaaccttcgcataaatgcggataccaaggttattttccagggcttcactggcaagcagggaactttccacgctgagcaagccattgcctacggcaccaaggtcgttggtggtaccaaccccaagaaggccggctcgacacaccttgacagacccgttttcgcaaatgtgcgcgacgccgtgaaggagaccggagctactgcttctgctatcttcgtcccccctcccctcgctgctaagggtattgaagaagcaattgaagccgaagttcctttggctggttgtatcactgaaagaaattctcaacatgatatgggtcggatacacggaatttggaaaaacccaaacaaaactt

SEQ ID NO: 4764 - DNA, 759 bp, Aspergillus oryzae
  misc_feature (1)...(759): n = A,T,C or G
tggcttcaggagancctatgccttagtaaatccaatcactactatcagggaccatactctagtaccatctcacaacgggatatattcgaggcgcaattttgaatgagttcttttacgactgtctatttctttctcatattctacccatctcatctgttattgcatttgggtgggggctgaaatggttaccctatacatctctacttaattaattgcaaatctatgtcccgtgactagtgcttagccctagataaaatatgcatctaatcaagaacaagacatcaatccttggtccgtcgaacgcgcccgggatgagaacagcgatgtcgcctcgattgactacgaagctatctcccaaaaatggaacacatccattatagaccacagactcctcgagcgctttgaacatgtgactgggcacaagccgcaccgttggctccgacgcgggactgtcttcatccaccgtgacttccaccgagtcctgaacctttacgaacgcggcgagctcttcttcctctacaccagtcgtggcccaaacactggcagtctacacgtgtgacatacgattcctctgcaattcacatagtggcttaaacacgtcttcgacgtacctatagtattcatgctcacggacgacaagaatgccctgttcaaagacaatcttacgttcgaagaaccattggaataccccaaagagattgcccgaaacatcattgctactcgggttggaacacaagtagacctttattttcaggggtt

SEQ ID NO: 4765 - DNA, 698 bp, Aspergillus oryzae
  misc_feature (1)...(698): n = A,T,C or G
tgatgctgtccgatcggacgaggccccgcagaactcttaagatcgaggagagctttattaataatatcttattttctcttcctcatttccttttattataaatctatcttaattccgatagaccgccgccaagatgtcgctcgaagcaaccatgatcatcgtggataatagcgaaagcagtaggaatggggactatacctcgacaagatggcaagcacagatcgacgccgtcagtgtcattcacaccgccaagatgcgcgtacatccccagtcagccgtcggacttatgagcatgggtggaaagggtcctgaggttttatcgactttcacctccgactttggtgctatcctggccggtctgcaccgcactaagattcacggcactgcccaccttagctccagtatacaagtggccggtctcgctttgaaacatcgctccgagaagtcccaacgccaacgcatcatcgtgttctcgtgctctccgatcgaagaagatgagaagtcattggntaagctggcttagaagatgaagaagattcatgtatctatcgancgtatcgcttncgagacctcgaatccgaccaacctagaggcttggaggcgtccgcaagaacgtcaaaggtggcgacgggtcgcactaaccataatctttctggtcagacctgtgggaccaggagcttaaatgacaccattctgcc

SEQ ID NO: 4766 - DNA, 1002 bp, Aspergillus oryzae
tgatgagacgttggatcctgctactcgtcgtcgtagggctttggatcgtgctatggatgaggcgctcaagaagcctactaagaggcgttttcgcaaggcggatggtattgatctggaacaaatggccgatgccgagattgaggatatgcgcaagcgcatgacccatgctgctcagatggacgctattagtcgtcgggagggcaagcccgctatgcataagttgaaaatgctgcctgaggtggtctctctactcaatcgaaaccagtatgtcaacagtctggttgaccccgaaatcaacctgcttgaggcggtgaagttcttcctggagcctttggatgacggctcgctgccggcctacaatatccagcgtgatttgatgacctcgctggctaagcttccgatcaacaaggaggcgcttgttgcgagtggaatcggcaaggtgattgtgttctacacccggagtaaacgtcccgaagccggcatcaagcgtatggctgagcgtctgcttgctgaatggacgcgccctatcctccagcgtagcgatgattactccaagcgagtctaccaggaagcggagttcgatcctcgaaaagttcaacgtactacacaatcggcccaggccactgcggcagaagcgcgcgctcgcgaactgcttcctcctcgtctggcgaaccgtgcccgcgccgagatcacacataccagctacactgtcgtgcctcgtccgacgatggtgcaggagagcaagttcgcgcggccactgggtgccagtggagaggatcgattccgaaagatgcgtgcacgacagattgcggcgtcgaagggatcgcgtcgataggatcgtttcggtttcatgcatattatgttgccacatgtcgaatgcatggttacttccattttcttttctctttattctcttttttcttctcgtcttgccgatcacattttcttatggttttatccgattgtatcgcatagtgttacctacggtttcggtgccggcgt

SEQ ID NO: 4767 - DNA, 736 bp, Aspergillus oryzae
gtgaagctgccggtactggagcggcgaacggagcactcccgggccttgaagtacggcggcccaaggattacattgttcccagtggcaatgagcacgaataccaaaagcgtggcgtattgttgaacgaggttccggactcgcccaataagatttgtgtgtcgaatatccctcattacataccggaggagcctgtcactgatgcttcttaagtccttcggcgagttgaagtcttttgttctggttaaggatggttcaacggaggagtctcggggaattgcattctgcgagtacgctgatccgaacgctacgagcattgccgtggaaggactcaatggcatggaattgggtgacaggcatctcaaggttgtgcgtgctagtattggaataacgcaggctgccggactcgacatgggtgtcaatgcgatgtcgatgttcgccaagaccacttgtcaagatgtggagaccagccgtgtactgcaatcgttgaatatggtgacacccgaggagctcatggataacgatgattacgacgaaatctgcgatgatgtgcgcaaggagtgtgccaagtatggtcaagtatttgaattgaagatctcacgtccttgctgtggcagcagacagtctcctgatgtctgcaagatcttcgtgaagattgactcgggggaatcaatcaccaatgcgctagaggcgctggctgatacgatgtactgtgaccggaccgtaatgacgacctact

SEQ ID NO: 4768 - DNA, 260 bp, Aspergillus oryzae
tactctatctccttctggtcggtgattcacatggttggtatcatcatccagatcgccaccgatgacaactgggtccaagttgctatgggtcgttgggtggccggtttgggtgtcggcgctctgtccaacatcgttcctatgtaccagagtgaatctgctcctcgtcaagtccgtggtggcatggtcaacgccttccagctgttcgttgccttcggtattttcatctcttatctcgtcaacttcgggaccgaatccatcat

SEQ ID NO: 4769 - DNA, 1523 bp, Aspergillus oryzae
gtgggacaacctcgacagtgctgcgctgaacaccaagtatcttggcaacgcgtcggcggccgactgggtctacagcggtttccccaaggttgaggatggcaacctgatcctcaccatgcccaagaacagcgtgggcactttgttcgcaaacaaccactacgtctggtatggcaagatcaagggtaaggtaaagagtagccgtggcaaaggtgtcgtgtctgcttttatcctgctctcggacgttaaggacgaaattgattttgagtttgtcggctacgacttggataacgttcaaaccaactactactggcagggcgtcctggactgtaagtgattcgtttgcccagcggtagaatagctgacgcttttgcttagacaacaatggcggaaaggcccccgcgggcagcagcactttcgacgactggcatgagtatgaaattgactggaagcccgatgccatcacctggtcagtcgacggaaacgtcaagcggacgttgacccgggaatccacctggaatgaaaccgcaaagcgctaccaattccctcagactccctcgagaatgcagttgtctctgtggcccgccggtcaggcaagcaatgctgaaggaaccattgagtgggccggtggtgagatcgactgggacagcgaggacatcaaggacaagggttactactatgcctcattcggagagatcaccgttgaatgctatgaccctccgtcaaactcgggagatggcaagaaatcgtacatccttactaacaaggacggccttgagggttctttcaagctcagtaacaacgacacggtgctcgcctctcttggtgctaccggcctcgaccccgatctcggcgccagctcctcttcgtcctcgtcttcgagcgcgtccaccaacaacagcgttcctgaaaaccgcggtggctccggtaatgagcctggtgcaactagctccaacagtaccagcagcagtagcggtagcagtagcagcggcagcagtgattctggattcagccagggaagcaacaatgacagcaacaacagcaataactcgaatggtgccgcctctgcgaacgagcgggtcatgaagggttccttcttcgccgtcttggtcgctgtcgtcgtgctggtcactctgtgaaccagtcactattagggcccttgccttcattcttgaatattcttttctttcttttctttccttgggtatataacaacacttaccccccattccatgcccacgcggttttggtgtgttctgttaaatctaccttctatccatggcggtccctcactcttcatgtctgtcgccttataccagttaactattctattctgattggatgtctttgatgcttttaatgaccgcgcgtggcaatgccgcaaacggcgcattgcatgccgtttgatactcattctaatacccttgtttgcgttttgatgctagtatatgtattattaattgattggctcggtgtcgatgagtatcggatcaatgaataaaaaaaaaaataaaaaaaaaaatcct

SEQ ID NO: 4770 - DNA, 955 bp, Aspergillus oryzae
cggtcgaaaagatcacagcctatgcacagtcacgagatcttactgttgggtgggatttagctcatgcgtatggtaacgttgagctgaaactacatgactgggacgtcgactttgcagcctggtgcacgtataaatacggaaatgccgggccaggggcgatgggaggtcttttcgttcatgagaggcacggtcgagttgattatagcgaaggagaagacgctccaaagtttaggcatcgtctgaccgggtggtacggtggtgatagaagcgtgaggttcaagatggacaataatttcaagccaatccccggagcaggcggttggcaactttcgaatccttcggctatcgatcttgcatgtctctgcgcctcgttgtccgttttcgacgagacatctatggctgaactgcgcaaaaagtccgttatgctaacggcatacttggagcatctcttgctgaaagataccactgacgaaacacgtcctttccgcattgtcacgccagcagatcccgaggcaagaggggctcaactcagtgtactactgaaacctggcttgttgcagaacgtctcccagaaattgcaagaagggggtatagtttgcgacaagagagagccgggtgtcgtccgcgttgcccctactccactgtacaacactttcaccgacgtatggaagttcgtgagttatttcaaggctgcactggacgaaccagaactgaagaattgaattgtgccttgatataaccacaaaatcagtgacagtgtggtgaaggtcacgtaccccacagcaaaggctagtccgaaatgcgcgccagagtttgctgagatatgacgagcacggagcacgatgtggtgatatcaacatcaacctccgccagtggtatttggtctcttggccgccttctgcttgcctgttcccaagtcaaactgtatataagagaggcaataggctatataacc

SEQ ID NO: 4771 - DNA, 664 bp, Aspergillus oryzae
  misc_feature (1)...(664): n = A,T,C or G
cattgaggttgccaacaatgatggcactaaggcacgctacactgcgcctcacattctgatcgccaccggtggacgtcncaagctcccgaacatcaagggagctgagcacggaattactagcgatggatttttcgagattgaggaactgccccctaagatcgctgttgtcggcgccggatacattgctgtcgagctggcgggtgtcatgggagccgttggcgttgacacccacatgttcatccgtggccagaccttccttcgcaagttcgacccgatgatccagaagaccatgactgagcggtacgaggctgcgggcatcaccgtccataagggccacccgggccttaaggaagtgcaactcgtgcgggacggaaagggcaaggacaagcttctcaagctgatctcaaacgatgggtcggagatgggggtcaacgagattctatgggctatcggccgtgcgcccgaagttgagggacctggcactcgacgtcccaggcgtcaagttgaacgacgccgggtttgtcgacgtcgatgagtaacagaactcgagtgtcgaagggaattatgctctgggtgacgtgactggaaacgctgaactgatcccggtggcatttccggtggccgccaacttggaaccggtctgttcgggccaccggagctgaag

SEQ ID NO: 4772 - DNA, 668 bp, Aspergillus oryzae
ctattgtgcttgcggctggccgcttcttattccgccctcagctggtcgcgtgaagcctcggcgatcatatttctttggccccgcaaaagcaaaggcttccctgaccgccaaagattctaccaacccttaccgactcattcacgtcggccacgtttgagacgtttctaagccagtgaaatattctccgtcttccatcatgtttggtatcatcgccgatttattgtcctcgatcatcacgatgctcttccgtatattcgctgctttcaaagccctccgctcggcgaacccctctcagctcgcaccatggatgatgtattgggtggtcctgtgggccattatgatggctgagtcctggacggactggattacgggatggcttccattctatcgctggatccgactgtacttgtttgcctatctggtcctgccacagactcacggtgccagactcctataccagacttacgtggaccacgtcctggccgagcacgaacgagaaatcgaagagttcatcggtcgctcccatgagcgtgccaaggctctgggcctccaatacttttaccaggggctggattgggtacgcgagaatgttttacacctgcccgaccaacaggctgccgctccgcctgcggcgacaggccctgctgcatacgctcagtcgcttattt

SEQ ID NO: 4773 - DNA, 701 bp, Aspergillus oryzae
ccgacgcatcggtcctcattcactaccctcttctacctcactttctactcccacacggctcttgccctccattggcttgacagagtaaaagagcttcacagtatcattcataatggccagtggtttgcgtatcttagtacccgttaagcgggtgatcgactacgcgatcaaaccccgtatcaacaaggcccagaccggcgtcgaaacctccggcgttaagcactcgctcaacccattcgacgaactctcgatcgaggaggccgtccgtctccgtgagcgcaagggtcccctcaaagtcgagaacattctcgctctctccgcgggcggagccaaatgcgctgataccctccgcacggcgatggccatgggcgccgaccgcgcgttccacgtcgacgtccccgactccaacgatgggggcctggagcctcttaccgtcgcgaagatgctgaaggaggttgtcaacaaggagaacatcaacctggtggctgctcggaagcaggctatcgatggtgaccagggtcagacgggtcaaatgctcgcgggcctgttgggctggcctcaggcgacgcaggctagcaaggtggatatcaaggatgaacagggaaccgtggaagttacccatgaagttgagggcggcgttgagactcttcggcccaagtggcctcatcattactaccgacttgcgacttcacgaacccagg

SEQ ID NO: 4774 - DNA, 531 bp, Aspergillus oryzae
caactcaactcttcaagccgccaaatcgaatttaactaagccctttactctgactcgcctcttcaatatcaccagccggcgtatttgttctatagatcataatatttgacctttcaccattggcatcgtacggatctctcgctcggttcaccgatgtcaaacgcctgcgcgtattcggcgactctgctgtggttggcttcagcggcgatgtgtcagacatgcaatacatcgatcgccttctggaatctcttgacatccgggaaaattattcgacacacggcaatatgatgaacgcaaaaaatctccatacgtacctttctaaggtcctttataaacgtcgctccgaattcaaccctctttggaatcacattctcgttgcgggatttgatgaagacaagaaacccttcctcagctcagccgaccttctcggtactacatattcagctccacatctcgcgactgggtttggtgcgcaccttgctatccccatcctgcgtcggctgttccctgaagagaagccccttgaggaaa

SEQ ID NO: 4775 - DNA, 706 bp, Aspergillus oryzae
gcttccccccttcagcatgacactgacttcgtggattgatattcttggctccgctatgcatggcagaactcccgagtttgctcacacttaccgctccaagcacttgagtggcacgtctttgggattacgggagctgatgggttgcgacgaccgtgtgatgtacctgatctccgagatcgcgtgcctcgatgcgctgaagaaggaaggccgagttgatgcaatggcggtttgctcccacgtttcggccttgggaagacaattggaatttaccgaacccgcggaccagacgctcgagagcccctataccccgaccggagtccttcgccttgacattttgaccaaaaccatgacggcaggcttcccgaatcgcagcgccaaatttacctatgcagtctgggtcctgaattcacccgaagccagccaaccaatataaatttaattccaggcagttgcaaccaccctggcatatatcccggctggtcaggatggatccaaccgttttctattttggcctttccttggaaaccggggctttttcccaaccaacacaccaatttaggacttttttggctgacgggggggttaacctggggaaaccttgcccaacctttgaagctttgggcgtattgtaccgggtattggaggaaatgggggaaaatttcccttttaccctttcgaacccttttgtcaagagggagatacccct

SEQ ID NO: 4776 - DNA, 653 bp, Aspergillus oryzae
  misc_feature (1)...(653): n = A,T,C or G
cgattaccttttcaataaccaacaccatgtctttcctctttggcggtccggccaagatgtcctcggcagagaagattgctgccgcagagaccgaagttgagatgatttcagacatgttcaaccgtctgaccgagtcttgcaccaagaagtgcattcccaacgactaccgtgaaggcgacctgaacaagggcgagtctgtctgcctcgaccgctgcgtctccaagttcttcgaagtcaacatcaaggtcagcgagaagatgcagggcgaagccgccaacaagcagggcggtggtatgggattcggcatgtaaacggatgagaagtctgctgcctcatgggcaaaacctcccttccgaaacataatttatgttctttttacgctcgagtttgcctttatgttgctcgtgtcaggcgcggatcttgccttggtttcagagatcatcttttgccgggaagcgttgcatttgggttttagttctcaagattgtcgattccggggcactctatgccggctggttatgatcgcagtctgctagatgggtgctggggtggtgaaaatgtttgggtcttggtcatggttctgcgcatggccatggtaattgaatctttntatattatgtacaatagaagtgaatatatatggtccagtattn

SEQ ID NO: 4777 - DNA, 652 bp, Aspergillus oryzae
  misc_feature (1)...(652): n = A,T,C or G
gggctgggcagcttggggatgggcgtgccatcagcttgttcgagagcaccaatcccgatacttgcattcgatatgaattgcagctcaaaggagctgggaggacaccatactcacgctttgcagacggaaaatcagttcttcgatctagcatccgagagtatgttgtgtcggaagcgctctctgcgcttggtgtgccaactaccagagccttgtcaattactctattgcccgagtccaaggttttacgcgagcgtgttgaacctggagctatagtggcccggtttgccgaatcctggctgagaataggaacattcgaccttctccgcgcacgcggtgacaggaatctaatcagaagactagctacatatgttgccgaagatgtgtttcacggctgggaagctctaccggctgcggtatctttaggtaaagatcagcccaccgatgccgttaataatccagcaagaggcgtaccgtgggacctggttcanaaacacgaaggagtcgaagaaaatcggtttgcaaggctgtatagagaggtggcacgacgaaatgcgaagactgtggctgcatggcaagcttatggcttcatgaatggcgtcttgaacaacgacaacacatcaatctatgggttgtcgcttgattacggcccatt

SEQ ID NO: 4778 - DNA, 654 bp, Aspergillus oryzae
gagtgctgtgcagatcgatgatgctatccctatccggcaattctccaagaagaacgctcttgaaggtgcggaggagatcgagcttgatttggccaaggccaccggcggggactccacagtggaaactgtctcttccaaactcagccgtgtggtacaactcactggtttctcggatcccgtctatgccgaggcctacgtcacggtccaccagttcgatattgttctggatgttcttctggtcaaccaaactctggaaaccctgcaaaatctgtccgtcgagttcgcgacacttggagacctgaaggttgtcgaacgggcagcaacccacaaccttggaccccgcgattcttgaatgtgcaagctacagtcaaagtatcgtccacggacaccgggggaatctttggtaatattcggtatgatggcgccagctcaaccgagtccacgttggcttttcaacaaattcatgccgccttttggagttatttcagcccgttcctggccccaaaaccagttccggcccttgggacgagttccagtgggaaaacagggaactataactcccggggaaaaacctcccgaatttctttagcaatttttggcacgcccaacaagggtgctttcaccggaaacttttttaaggggacttgttatttg

SEQ ID NO: 4779 - DNA, 719 bp, Aspergillus oryzae
  misc_feature (1)...(719): n = A,T,C or G
ggaaaacaaacaagaggcagaggagccaggtactgtatacgtcggacgtattccgcacggtttctacgaacatcagatgaaggcttacttctcgcaattcggcgaaatctctcgtctgcgtctttctcggaatcgcattaccggccgctcgaagcattacgctttcattgagttcacctccacctctgtggcgaagattgtcgctgggaccatggataactatctgatgtatggtcatatcctgaagtgcaaatacgtgccccaggaacaattgcatccagagctctggaagggcgccaatagacggtttaagcggaccccctggaaccgaattgagaagaagcgactcgacaaggccaaaacaagagagcagtggtcggagcgcatcgatcgcgaacagaagagacgactcgccaaggctgagaaactcaaggctctgggctacgagctcgaattacctcagttgaagagtgtcgacgaggtccctattcaacaggaagagaataagacgattgaggcgtcggagacagtattcgacgaacctgtcaaggctattgaagcgccaaaggaggagaataaggttgctgatgatacccccaagaanagctagatggacgagaagaacggctgtcacatcaccgaccaggagacaccanaggagcaacccaagaaggagatcccntgcagcactgcttcggttgccaccaaggctggagcaa

SEQ ID NO: 4780 - DNA, 764 bp, Aspergillus oryzae
  misc_feature (1)...(764): n = A,T,C or G
actggcgattcggcacgaggctgctgagctaataggagcactgccatgggcgggttatctgactggattctggctctatgtgagagatacatagctttacaaaacttcaaaggggtgtgcaacaggttgtaagaccacaagcatagcatcgcggactactacacttggatatatatctccagcatattcaacaacacttcctcaaaatgaccatctcaacagaaacaagtagagtttcaaacacgtcgatacataccgaaaccaaagactcgacccccgcacaccttgaccggtctacatttccacgcaccgtcaccctacccgacgagaaaatccatatcgaattgacatacgatcccctcagtgcagatacagcattatcctacaccaattcccccgcagccggtgcaaatgtgttcttcttagggacaactcgaaacacatttgacggtcgcccagtcgctcaactcagctatacatcctatccaccattggcattaaggactctgacgcagattgcacgacagagcaaagaaaaacacggacttatcgcagtgagcatttcacatcgactgggtacggtggctgtcggagaggcatcgatcttaattgctgtcagctcggggcataggcgtgcggcttggagaagccgcgaggagattctggacgagtgcanggcanaagcggagatctgggaaccggaagagtttaatggtagcaaaccggaggacggggaatggaaggcaaatagggattggatgggn

SEQ ID NO: 4781 - DNA, 1823 bp, Aspergillus oryzae
  misc_feature (1)...(1823): n = A,T,C or G
ggaccgtcgatgtcgactctagatgatcctgccgtggcactcgcccatcatgaagttcctcattacgacggcggccctcctcttctctttggtgtcagcgcagactggtgtgcctgatgtcaacagtcttgcggtgcaaaagcatctccgctcccgctctgcattgatcgcattcgagaagagacagcgacaagatcactttttccgtcaaaacctctcctctgtagcccagagagcggacgccatcgtggcagctattcgccaggaggaaattgacgattactggagagtccctggaaccccggagaagaatgataccgacgagaggttcgccggtgaggtcttcccgaaagcccggccattgatcaatggaaccaagctctgggacgtggtcaagcacatgccaaagggtgctcttttgcatgcgcatttgcctgccatgctttcctatgacaccattctagagaccattcttcacacggagggtatggtcgtctctgcctcccaggatgtgtccaccccggagaatcgcaggaatgcttccgtttcgtttgcccatgtcaaccataccattgcgaccaatgtatcgtcaattcattctaaggattatgtccctaacacgcaaatccccgtgactgtggctgccaacacattcccgggtggtcaagagggattcatcgacttcgtcaaaaccaaggtgaccatctctcctgagctgtctatacgtcacgaattgggagtcgatgagatctggcgtgtcttccagacagccttcggccccgcaggcaccatgctcacgtacgagcccattgtgcggacgttctacaagaaactcttttcgcgcctggctgaggatcacatcaactgggtggaaatccgttctggaagcggccagctggtccaggagggtcaggaagaccttgatccggatctggacatttggtggaacgtcctactggaggagctgaagaagttccaggagtctcccgagggggcagacttctggggagcgcgagtcatctggtctgacaacagaggcaagaaccgtactgcgctgaccaagagcatgggaaatgctcttgaacggaagcgcagacacccacagctcttttcaggctacgatgtggtcgctcaggaagacctgngccgtccgcttgccgatatggcacccgaattgatctggttccagcaacaggccgaggagtcgaacctcacgattcctttcttcttccacgcgggcgaaactctcggcgatggaaactcgaccgacgaaaacttgttcgatgccgtcctcttcggtacacgccgtatcggacacggtttctccctgtacaagcacccgaggctgattgatgaggtgatcgagaatggtatcatggtggaagtctgccctatctctaacgaagtcctgcgtctggccaccgatatccttcaccatcccctcccggcaatgattgcccatggtatcccgaccgccatcagcaacgacgacccggcgatccttggccaaaacacagctggtttgagctacgacttctatcagacaatccaagctttcgataacattggtcttgctggcctgggagcgctcgcgcacaacagcatccgctggagcaacttcgaagatcagaacgatgttgaatgggttcgtgatatcgactttggagagaatggcgacggcattaaggcccancgtttgcagcantggaacgagaagtgggaggccttctgtgagtgggttgtgaagggagtatggagacccgtaccccccgggagcactctgatgcctcccatagcatgattggggccagtgaatgctgggc

SEQ ID NO: 4782 - DNA, 506 bp, Aspergillus oryzae
gccatctgcaagaagaagaacattgagtcttgccatgtgggcgccgacggctctgtctttacgaaatatccccacttcaaggcccgtggagcacaggctctgcgcgagatcttggactgggcacctaacgagaaggacaaggtggtcatcatggctgctgaagacggttctggtgttggagcggctcttattgctgcattgacattgaagcgggtcaaggcaggcatcagctgcggtatccgagatatggccgatatgcagagtctcatttaatatgtgggcattgtcgactttatctgactccgagtgttaaacattggagatgcatcttcatctcctttcttatttctttttttctctctgaggggatgtcaatatcaacacaaggcacatggctcggtttacaacatagaccgatggggtttttatacgggacaggcgagtaataaaaaagaaaggcgaaagatagctaatttattatacacattaacatatgggaaaaaaac

SEQ ID NO: 4783 - DNA, 736 bp, Aspergillus oryzae
tcgaaccataatcagtattaaactacattctctgaacaatggcaccgcaagtttggttcatcaccggtgcctcctcgggcttgggtctatccctttcgctgtacgcactgtcagccgggcatcatgtcatcgggaccgttcgcaacgcatcaaagtccgcagatgcagtccagacaattcaaaataagggcggaaagatcgtggagctagacgttaccaaggccgatgctattcctgaagcagtgaaaaaggcagaaagcttttacgggaaaatcgatgtattagtgaacaacgcggggtactcattattaggcgccgtggaggacctgaatgacaaagaaagcgcactccagatggaaactaatttctttggtcctctccgagtaatccgagcagtgctccctggtatgcgcggcaacaggagtggaacgatcgtgaacattagtagcgtcgctggtcaagatgctttgccttcttgcgggttgtattctgcaagcaaattcgcactggaaggtctatctgaatcgctgagtcgtgaacttgcaccgtttaatatttcagttcttgtggtggaacccggtgctttccgtacgaatttcctgtcggcagttcagaggaacgagagcgggcttagtgaaccatataaaggtggaccggtggataccatgctaaggcattttgagtcagcacaaggcaaacaaaaaggagacccttgaaaggcgatcgctaggatctt

SEQ ID NO: 4784 - DNA, 653 bp, Aspergillus oryzae
tttttttttttgttttttctctatccgaaaattccatgtatattatgttcgatgcaaccagagcgaaaataataattaacaccatactccacactccctcatagaagcaaatgagcacaagtaactccatcaattaaaagtcgacacctttgggagttaaaaaattctctgaactccaaaaccccgttaaaatgcatggacaacgcttcacgctttaccttcctttgaggaaccagaactccttttcgtagctcggtcgtctttaagacagtgcttgagtatccatgggtgtttttggatttcatctagcgaaatacgcttctcgggatcaagaacaagtaatcttttgattaagtcttttgcctcggggctcacaaaggaaggaactgtcatgtctgctcgtgcaatccgtctttgtgtcatgacaggtgtgtcctcgaatggagcctctccgaccaaaaattcgtaagtcagtacacctaagctccacaaatcgactttttcactgtagtagttatcctgtgagcctggcttgagcatctcgggtggtagataatcaagcgttccgcacattgtctgcctcctgttgtggggcgcatggacactccacccaaaatcactgatcttgattcaccatggatgccgacgaaaaa

SEQ ID NO: 4785 - DNA, 722 bp, Aspergillus oryzae
catcagctgctgctaccttattctttgccttgtagcctttcttctggcacgtgcctaccttaactgacagcgccaagctctggtacttgctagtaattcaccatctgatttacacgactccgtttcacagcccctgctctccccgcgatggagaaccagaagatctccgactttctggcggaccagctgcagcaagctcccgaacaatgccaggcctacttcctcaccttcgaagactactgggagcggaaattatggcaccagcttaccgactccttgattgaattctttcgccttccagagagtgctcctcaacggttaccgatattcaaggccttcgtgctcagcttcgccgacaagatcaaccagctgaagttcgtctcgttggggttgatggcatcgacagaatgtgcagatgacaaagaacgcctctctttcctcacatccctcgccgacaaagtgaacaagcccgacacacaagaagcttacatctatgcccttgcggacgtcgccaatgtcaagcagcggctcaacgacttggatggagcacagaaagatctgggaacgtgtcagaaggtcctggataacttcgactcggtcgagaccgtcgttcacgccttcttctataaagtcaacgctgactattaccataaaaaaacaagaatttgcctctttctataagaacgccctcctctacctcgcctgcatcaacttataagata

SEQ ID NO: 4786 - DNA, 647 bp, Aspergillus oryzae
  misc_feature (1)...(647): n = A,T,C or G
cccatccttcataatgtcagtagaagataagccagtccagcaagaagctcccgtcgagtcgcagttccagaagcctggtgacttggtggagagagatgaggacaccggtgtgatgtccttggaaagtctttgtatgaactgccatgagaacggaacgacaaggctcctcctcctccgagtaccttacttccgcgacatcatcctcgaatccttcgaatgcccccattgccacttcaaggacaactccgtcaaatccgctggtcagatccaagagaagggcgcaaagtacacacttactgtccagggcgaaaatgacctccagcgccaggttgttcgaagcgacacttcaatcttcaaggttgaatctctgggaatcgagatgcccaagggcgagagtcagtttacgactgtcgaaggagtgattcagaaaatctacgagtcgctgtctagcgagcaacccctgcgtaaggctcaggcacctgaacttcacgatgcgcttgtgcctatcatcgagaacctccagaagatcctgaaccgagacggattccccttcaccgtctctctcgatgaccccactgganactcatggatcgcgcctactattnacgacactggaannacactacagcgtcgtgactaccctcgtn

SEQ ID NO: 4787 - DNA, 688 bp, Aspergillus oryzae
  misc_feature (1)...(688): n = A,T,C or G
tcctctctagtctcccctcccgacacctcgaattaatttttttctcctcttcctccttctctaaccgagcgtcatctatcttttttcctatcacatttcttggctgtagcattatcgaggttgatcagaaactctcgaccgtcaattgctctctcattcttccttcaagctccccggatcccatctcaatagctcttatctctccccttccgtacccacacatacacggaccaaaatgtcgagtcaacctctcctccagactgccccaggcaagcgcatcgccctgcccaccagagtcgaacccaaggtcttcttcgccaacgagcggaccttcctctcatggctcaacttcacggtcatcctgggcggcctggccgtcggtctcctgaacttcggtgaccgcatcggccgtatctccgccggtctcttcaccatcatcgccatggcggccatgatctacgccctctgcaccttccactggcgcgcagcaagcatccgcaaacgcggccagagcggcatcgacgaccgtttcggtccccaccgtcctggccctcgccttgttggcggccgtcggtcgtaactttatcctcaggatcacggagaactaaatccatctnctgtggcttcttgagtagtatctttttcgagcttgttttctcaaaccccccttgtttgtggggcacgtgcc

SEQ ID NO: 4788 - DNA, 708 bp, Aspergillus oryzae
  misc_feature (1)...(708): n = A,T,C or G
gaataaactctcacttgcctgcggaaacgcccatttatacgacttcttcgctccatctcacgctcccctaattcattgtattcccaggagctcctcccactattccaaccgaactcaaaacctggaccgtataccccaccatgggcgaatctagacaagagcttctggcatggctcaacaacctgttgcagctaaaccttacgaaggttgagcagtgcggaacgggtgcggctctctgtcaagtcttcgactcgatctttatggatgtccccatgtcccgtgtgaaattcaacgtcaatgccgagtatggctaccttcaaaatttcaaggtccttcaaaacgtgtttgctcgccaccaggtagacaagccaattcccgtgcaacaacttaccaaatgccgcatgcaggacaaccttgaattcctgcagtggacgaagaaatattgggaccagcacttccctggtggtgactacgatgctgttgctcgtcggaaggcttcgggtgctcctcctgctgctgctggttctcgcgcaggcgcagcctcagctggagccacacggcggggagctacgcctaccggtgccgtaactcgtccacgagtcgcggcagcaagcgggcctaacgtgtctgcattgcagcaagagatngcgactcagaaggaagctattggcgggttggagaacggagcggatttctattttgcttagc

SEQ ID NO: 4789 - DNA, 644 bp, Aspergillus oryzae
  misc_feature (1)...(644): n = A,T,C or G
cattttggccggttggagtcaaccattcctgcgattgcgacggatcattaaattactttctccccgcaccgtttccaccctcgatctttctttcccctatgttttcgggctaccggacttccatctctacagcaatcgcaagattcaagactccagcacaacagcccgtgttctcgagacatacgtcaccccgctttctcgatccccgcgccagagcaatgtccgctaccaccgctcgtgcggacccttttcgcccggcgaaacgggtcgctggtcaaagacaggatgtctggtcaattgtcaatgaagccgctgcggcttcccccgttcagcctatcgtgaacatgggccaggggttctttggctataaccctccccagtttgcgattgacgccgcaaaagaggctctcgacaaagttgaatgtaaccagtactccccaaccaagggtcgtcctcgccttaagcaagctattgccgatgcgtattctccgtccgttggccgaaagctcaacccggatactgaggttacaatcaccacaggtgcaaatganagaatgctaaatgcttttatgggttttattgagcctggcgatganggtaatatctntgaacctttctttgatcaatacatcaacaactttgaa

SEQ ID NO: 4790 - DNA, 630 bp, Aspergillus oryzae
  misc_feature (1)...(630): n = A,T,C or G
ggcaactgtaaccatggtgaaagtgctcttgactggcggcagcggattcatcgcagctcatatcatcgatatcttgctgcagcgtggatatgagacagtagtgacagttagatccgaagaaaagggacaaaaaatccttgacgctcaccccagtaccccgaaggagaaactttcgtatgttattgtcaaagatgtcgcagaagaaggcgcattcgacgaagctgtcaaatctaacccacccttcgactacgtcctccatactgcctctcctttccattataacgtttcagacccagtaaaggacttcctggacccggcaatcaaaggaacaacaggtatcttgaaggcaatcaaagcctacgctccgacagtgaaacgtgtcgtggtcacatcctcctttgctgcaattgtcaatgttaaagaacaccctaaggtctacagtgaggaaaactggaaccccgtgacttgtgaggaagcaatggatccttcccaaacctacagggcaagcaagacatttgcagagaaggccgcctgggattttgttgagaaaggaaagccaaactttgacattgcgacgataaaatctnctcttgttttgggcctgttgtgcctattaaattccctaatgcc

SEQ ID NO: 4791 - DNA, 754 bp, Aspergillus oryzae
gctggcggtgtcttgctactgtgtcgatttgcttgcctgttgattcgacactccaaccaccgccctcttcctcaaaacttatcgctaaaagatccaacaattaatatcctacaaatatagtcctatagggcttgctaaggcatcgaattggacaaaatggcggctgctcagattatctccaattccggacacgatgacatgattcacgacgctggcctggactactatggccgcagattagcgacttgctcgtcggataagacaataaagatattcgagatcgaaggtgagacgcatcgcctagtggaaactcttaaaggacacgaaggcgcagtttggtgtatcgcatgggcgcaccctaaatttggtacaattctggcctcttcatcctatgatggaaaggtcctcatctggcgcgaacaacaccagaacacaacatcccctgtcgctgttaacacttggacaaaggtctttgatttctccctccacacagcctcggtgaacatggtctcctgggctccgcacgagagtggatgccttcttgcttgcgcttcttccgacggccatgtcagtgttcttgagttccaggataatagctggactcatcagatctttcacgcccatggaatgggtgtgaactctattagctgggcccctgcggcatctcccggtagcctgatcagtgccaaccctggaccgggtcaacagcgaagggtcgtcacaggcggaagcgataatctgctcaagatttgga

SEQ ID NO: 4792 - DNA, 644 bp, Aspergillus oryzae
  misc_feature (1)...(644): n = A,T,C or G
cattaagttatctatatgcgccatagaacgccgcgatgcactcgtcatctgatatccctattcctctatggctagactgcgatccgggccacgatgatgcatttgccattcttctcgctgcccaccatccctctctgaatttattgggcatcaccacagtccacggcaatgcctctctggagaacacaaccaacaatgctacaaggatattggaggccatagggcgaccagaaattcctgtatatccaggtcataaaaagcctttctgtaggcctgcaattcatgcgccgaatattcacggtgattctggtattgatggaaccgaacttctaccgaaggctacaaagtccccaattacagacaagaacccaattctggcaatgcgagatgccctcctagcacagccaaaagggacaccttgggttatagcaaccgggaccttaaccaacgtagctntgctctttgcgacgttccctgaagtagcagagcacattcaaggtctaagtattatgggtggcggagttggtggaggcttcacagatgcgcctatgagtcgacttgttggtgaagagtcaaggattgggaatatcacccctctggcagaatttaacatctactgcgatccanaagcatcacagtcaaac

SEQ ID NO: 4793 - DNA, 699 bp, Aspergillus oryzae
gtcacgacaacacgagcgccagcggccttacgaaaccgacaagatggtcctcgcaaagaagcacgtccccatcgtcaagaagcgcaccaagaccttcaagcgccaccagtcggaccgcttcaagtgtgtgcctgagtcatggcgcaagcctaagggtatcgactcccgcgtccgtagacgcttcaagtcgaacattcccatgccctccatcggctatggctccaacaagaagaccaagcacatgatgccctccggccacaaggctttcctcgtccagaaccccaaggacgttgagctccttctcatgcacaaccgcacctacgctgctgagatcggccacgccgtctcctcccgcaagcgcgtcgagatcatcgccaaggccaaggctctcggtgtcaaggttaccaaccccaagggccgtgtcaccactgaggcttaaatgctttagcctaattaaatcaacaattaaaatcattataccaaagcattttcaattggagatggggatctctggcaaaagctgcaaggtgtcgcttcggtttcttgtatggtcgtgaattgaaatgaatcacttcgtggcgataacgaatttctctttatgtgcatgattgggtggctggtaccagcactgggatataaaatagaaatgggggcttttctcttgcgaaaaaaaacacagtatgcataaataaaattcct

SEQ ID NO: 4794 - DNA, 638 bp, Aspergillus oryzae
  misc_feature (1)...(638): n = A,T,C or G
cgtactgcattcttgtcggcatataccgcgtcacgctccatccgctcgcaaagtatcccgggccaaaactggcagcagtgacgcgtctctggcattcgtaccatctatgcaccggagacatcgtctcagtcctttcgcgggcacacgaggcatacggaccagtattgcggatcgctccagacgaggtactattcatctctagtcgcgcatgggatgacatttacggtgcgcggccggggaagcccgaaatggacaaagatacccctctctacaagggtcccactgcgcctcattcaattgtgacggtggatggcgagctccatcgcttttaccgccggttgcttgcgaagggattttcagatgctgcgttgagagagcaggagccagtgatccaacgtaacatcaatctactggtagagaagctgcataaggaggtcgcagcagggaagacacccgaaatgacggcttggttcaactatgcgacgttcgacctgatcggngagcttgctttcggcgagacctacggctgcctcgagaactctcactaccacccctgggtggaaatgattctcgaggtgatgaaactccgtgcgatgacgcattgctgtcggtactatccctggatattccacatcctg

SEQ ID NO: 4795 - DNA, 713 bp, Aspergillus oryzae
  misc_feature (1)...(713): n = A,T,C or G
gctcatttcaagctcagtgggtctcagtactgtccaaatagtgaaattgcacgcagaattagagagcagcagctgctggctggcgttcccgataccactgctttgctgccaaatgaagaaccaaagcctttccgttgccctgttattggttgtgagaaggcgtacaaaaaccaaaatggtttgaaatatcacaaagctcacggccataacaaccaacaattacacgataatgcagatggcacattttccattgttaacccagaaacctcgacgccgtatcctggtacactcggcatggagaaagaaaagccgtaccgttgcgaagtctgtggcaaacgttacaagaacttgaatggtctcaaatatcacaaatcgcattctcctccatgcaaccccgactttcaacttgccgcttgccgcaacctggctttcggcggaggagtcatgcaaggacagaatattaatgttgccggagctggtctacctggtattggtgaagaaggtcttctatanaaggtctcgtgaatttacacagcgtgagaagaaattgctttgctcttatacttcatttcacaataattcaatttgacgatttttgaccgttttttcccggtgcgtatcaaatttattaccgggttccgtggtttggagatacctttggtttgaacctcctggtaaatgccggttttttgtggcaacccgcgaactgattt

SEQ ID NO: 4796 - DNA, 675 bp, Aspergillus oryzae
  misc_feature (1)...(675): n = A,T,C or G
taacctcgatggtcaccgcagatctggagacaactggcgccgaatggacatcggtgtcgattntcctttctcccagttgccccctgaagacgtggaacggtttccttatgccgtcctcgaagtcaaacttcagacccaggccggtcaagagccccttcaatggatcagaaacctgaccgcgagtcacctagtaaaagcggttcccaagttcagcaggttcttccacggtacagcgacttttttccccgatcgcattaatctccttccgttttgaaggccccagattggccttgatttttcgaaagcccgcgatcccccggtttggatttgaccagaccggtatccagactttaattgccggccaaccaaaacacccaagaacaattttaattctaacaaggccaacctggttacacaaaaaggcttaacaaatggcaaccgaagggtgccccccattgacctgttcgcaatttcaaacggaaatcttctcaatataaagggaccgttatcgcccaacgcgttttccgaagaaaagaaactcccccttttttgacttcgcccaaaaaaaaactcttttcgaggcccaataaatcttgaaaaaggcgcccacaaatttgaggggaatgccgctttttccggcatgtggggccaaattttttgccccaccaaaatgga

SEQ ID NO: 4797 - DNA, 694 bp, Aspergillus oryzae
aaacattataaccgtcttccaagtccgccttcacagtctctcgtttatcaaaccaccaagatgaagttctccatggtcccctcgttgcttcttcccctgctggcggctgctgccccagccgccccggagaaccctcctttcggtgtcatgtccgctcgctctgcttcccccatccacctcctccccatgaccgcctccggtcagaagttctaccttggaggcaagacccagtcctactgccccctccctgagtcaaaggactgccctcccggcaccgagaccgttttctcccctggtggctatggcttgaacgtcaatgtccccggcggccagcaggtctatgttgaccctaagggcgctctgtccttcacccaggcccactccgcctatatcccggagggctccgccgtgggtcccttcacttacaagcccggcgagcaatggggctactactccttcaatggctggggtgcttccggcttcatggcttgccctactgaggacaaccgctggcaggtgtttgccgctgtccagaacgctactgtccccaagggtaacgtcgctgattgccttggcttcgatgccttggctcccaaggctgccaaaggaggctgctgcttggcagtacatttaaatctgcagttgattatgggatcctgatttgagagataatcagagatgagaaagagtgtgg

SEQ ID NO: 4798 - DNA, 318 bp, Aspergillus oryzae
tcactgtccagcctaactctggcgcccagggtgagtttgcgggtctgcgtgtcatcaagaagtatctggaggctcaaggcgagtccaagcgcaacatctgtctgattcccgtgtctgctcatggcacaaaccccgccagtgccgccatggctggcatgaaggttgttaccattaagtgtgacaccaagaccagcaatttggatcttgaagatctcaaggctaagtgtgagaagcacaaggatgagctggccgctgttatgatcacctatcctagcacttttggtgtgtacgagcctggtgtcaaggaggcctgcgaga

SEQ ID NO: 4799 - DNA, 418 bp, Aspergillus oryzae
ccttctttggggcagtcatattgatacatactacttccttaatactaaaagtcctccccactctctcataatggctgaccaggcagtcgcccgcttggccggcatcaatgtcggcgcaccggcgcgccctcttcctagtgctgacttcggtttgatcggtttggccgtcatgggccagaacctgatcatgaacgtcgccgatcacggtttcactgtttgcgcttacaaccgcacaacctccaaggttgaccgcttccttgaaaatgaggccaagggcaagtccattgtcggtgctcactccattgaggagttctgcgctaagctgaagcgtccccgccgtatcatgctcctggttatggctggaaagcccgtcgaccagttcattgagtctctcctgccccaccttgagaagggcgat

SEQ ID NO: 4800 - DNA, 658 bp, Aspergillus oryzae
  misc_feature (1)...(658): n = A,T,C or G
cggttctcaacggcattttgtcaagatgcctttccacaagcaagtcaagaacagcgcttactacagccgctaccagaccaagtaccgccgtcgcagagagggcaagactgattactatgcccgtaagcgcctgatcacccaggccaagaacaagtacaacgctcccaagtaccgcctcgttgtccgcttcaccaaccgcgacatcatcacccagatcgtctactctgagatctccggtgacaaggttttcgccagcgcctacgcccacgagctcaagcgctatggcatcaccaacggtctgaccaactgggctgatggtgagtactctctcaccgaggccgttgagaccgatgacggtgagcgccgtcccttcaaggccttccttgatgtcggtcttgcccgtacctccaccggtgcccgtgtcttcgctgccatgaagggtgcctccgacggtggtatcctcgtcccccactccgagaaccgctttcccggttacgacattgagaccgaggagctcgatgctgagactctcccgaactacatcttcggtggccacgttgccgagtacatgganggtcttgccgacgacgatgaagagcggttccgcgggcagtttcacaagtaccttgggaacgagggtgaggcggggacattgagg

SEQ ID NO: 4801 - DNA, 649 bp, Aspergillus oryzae
  misc_feature (1)...(649): n = A,T,C or G
ccaacattgtcctcggcgaaggccgtggcttcgagatcatccagggccgtctgggtcccggccgcatccaccacgcgatgcgcacgatcggagccgccgagaaggcgatcgagtggctcatcgcacggatcaacgacgagcgtaagcagaccttcggcaagagtctgtcctcacacggcgtcatcctcgagtggctggccaagtcgcggattgaggtcgacgccgctagactcattgtcctgaatgctgcgatcaagatcgatcagggtgatgccaagtctgccctcaaggagattgcccaggccaaggttctggttccccagaccgcgttgacggtcattgaccgtgccgtgcaggcgtatggtgccgctggtgtgtgccaggatacgccgttggcgaatctgtgggccatgattcggacgttgcggattgccgacggcccggatgaggtgcacttgcagcagctcggcaagagggagaaccgggctcgcaaggatgcggttattgagaagttgaactggcaacaggccgaggcggagcggntgttggctgctaatgggctcaagctgaagagtcattttgtaatgagatgatttaaatacgttagagcccaggtaacaatttgtctacagccgatatttggataagg

SEQ ID NO: 4802 - DNA, 756 bp, Aspergillus oryzae
  misc_feature (1)...(756): n = A,T,C or G
ggggnnggnnaatgatgaccttaacacacaggataaaagcctggacccaccttggtatcgaaatcgggcccaaggcgaaaccatggcccaattggttttaacacggcacttaatatcctttatcacgttggaactgtggcactggcacgcacgcacacactcactcactcacacacactctctcttccccctctttattgagatccgcacaaatgtcccttaccgagtcttctgctattgatatcgctaggactgcttctctagcatctcgacgcttggcaactttatctgaagccgaccgcaatggagctctgacagcacttcatgatgcgttgctgagaaacaagaattctatattggaggcaaatgcgaaggatgtcgatatggcgagtcgggccgctgcaagtggtaatttaagccaaagtattcttaagagacttgacttgtcacgaccgggaaagtacgatgacatgctgaagggcatacttgatgtccgggatttacaagacccaattggacatgtgactctgaggacactgcttgatgacggtctggtgctcgaaagagtgagctgtcctatangcgtnctactgataatctttgaggctcgcccctgagttattgcgaatatagctgccttatctataaagtcnggaaatgcctgcatcctcanaggcggcaaggaatctacngaatcttttgtgctatctcgcaggtatttcggatgccatatcgagtacccangttcctaaatcn

SEQ ID NO: 4803 - DNA, 920 bp, Aspergillus oryzae
  misc_feature (1)...(920): n = A,T,C or G
cgaggcgagcgagttcctatttggcaagaccgtcgactccctcacccatcccgagaatgtgaaggtggccaaggccatggtcgacacaatgcgaggcatccgcgtgcgtctgaccatgtcaaagctgatgttcctccaccgtgacccagtgtggatggaaaatgtgaagatcgtccgggatttcgtggacgagcgcatcgatgccagtctgacgcagctgcaggacgttaagagcggcaagggcacctcatgcacggagaatcagcctgacggtcgtaccgacctgctatgggacatggtacagcagctgcaagataaggaagctttgcggggccaaattatggccgtcttcatcccctccaacgacacgacatcgattctcatcagcaacgctatttacgccctggcaagacatccccatgtgtatcaaacactgcgggaggaggtgctcgccctgggagaccaggagattacgtttgagaaactgcgtggactgcgctacctgcgatatgtcatcaacgagacccatcgtttgtacccgaacggcatccagatggtacggattgctctggaagacactacgctgccggtcggaggaggcccagatcaaagccaacccatcttcatccanaaaggagacatcgtccatgccaaccggtacctcatgcaccgggacccagacaactggggccctgatgccgaggtcttccgcccggagcgttggggagatgtccggcctctgtggaagttcgtcncctttggaggaggccgcgcatctgccctgcgcatgtgctcgtcgatacggaggcatcatacgtgctcctgcgctttgtgcagcggtttcgcactctggaggcccgagatgagcggccatacaaggccatcatgcggnatgggccgagcaatttgcatggggtgaa

SEQ ID NO: 4804 - DNA, 643 bp, Aspergillus oryzae
  misc_feature (1)...(643): n = A,T,C or G
gcaatcctctagtgcgcgctcgcgggacaagaacggtcagtattgttttgggagccattcttaccatggccaccatcgcatacacgacaacacgtgcagccactcagggccttgcgttagggtccaaggggggccataactattcgccgctggggacggatgacaacgaacatggtcttgtgacccaacagccgaccagtcgtcgcgagatgcgtgccgaagttcttcgtgccgacgtggctagtggcagtatacccgccagtgcgctcgacgacgacagcgacgacgaatctgatgactataacaccaaggacgatgaacgaggttcgacacagtataactactccttgtttcacgtgatcttcttcttggctacgacatgggtggccacgcttctcacccagggcttggagaccgaagtcgagaatacagatgactttgccgctgtggggcggacttactgggccagctgggtgaagataatcaacgcttgtgtttgatacgcgatttacctgtggacgctgatcgccccggtggttatgcctgatcgtttcggcgtgtactgagaatgtcgggcacagtcacctagaattgtattgactatacagcggagttgggcgttcacgagcattgagaagtattn

SEQ ID NO: 4805 - DNA, 661 bp, Aspergillus oryzae
  misc_feature (1)...(661): n = A,T,C or G
ggggacattaactcgatcagtgtgaatcaactgaagtacctgagcgcttgcatgaacgaggcactacggatcttcccccccggtcccgccgtctttccgcgccgggtccctcagggtggtgatttcattgatgggcattggatccctggtggtactcaagtgggcattgcgcactactgcatcaatcgcagccgccgaaactttgtcgatccggacaaattcatccctgaacgatggctcggggatcccacgtaccagaccgacgatcgccacgctgtgcagcccttcagctacggtcctcgaaattgcatcgctcataacctcgcccggttggagatgcgtctggtcttggctcggctgatctgggagtttgattgngagctagcccctggatcagagcggtgggaagaagaggcgttggtcttcaatgtctggagtacaaagccattgatgatcaaatttactccagtcgcacgctgaagtcagagagagtggataatgctaaagacagtgttactctttgattaggtagtcttttagtgctagtaacatcgtatcgtgtgcgctgtgannaaaaaaaaaanaatntaaaaaaaaaattttctggggggctccaaaaatgtttctaaaggccccatccgtgaattagtttttcccccct

SEQ ID NO: 4806 - DNA, 737 bp, Aspergillus oryzae
  misc_feature (1)...(737): n = A,T,C or G
cacgcaaaacgaattcccactcaccaaacacccccccagtttcaaaaatgcgttactcaatcttctccaccctcctcgtctctctcgcgaccctctccaccgccgccgaactcggcatcgaaaagacccacgaggtagaatgcacccgcaagaccgtcaagggcgacaccgtccagatgcactacaaaggcacgctccagtccgatggctccgagttcgactctagctacaagcgcaactcgccgttgaagttcaaggtgggctcgggtatggttattaagggatgggatgagggtcttttggatatgtgcattggtgagaagcgcactttgaccattccccctgagtatgggtatgggtctcgtggggttggaccgatccctggtggtgcgactctgatttttgagacggagttggtgggtattgatggtgtttcgaaggatgagttgtaaatttggttctgggtttagatttctttaatttaatctctgatatcgggttctccttttcnnannanannnnnnnnnnnnnnnnnnnnnnnnnnnnnnnnnnnggaannnnnnnnnnnnnnnnnnnnnnggaannnnnnnnnnnnnnnnnnnnnnnnnnnnnnnnnnnnnnnnnnnnnaaaaaattcctggggccctttcaacttttttttaaagggccccatttgttaattagtttttgcccgcttattttccgccctttccccaatttcgttttaccgaaaaggg

SEQ ID NO: 4807 - DNA, 692 bp, Aspergillus oryzae
  misc_feature (1)...(692): n = A,T,C or G
ctcgctccatccctgcgaatttctccactgtttcattttacgcagtataagacttcatatattgcctgcgctgacttgcttcccgtctgcattgcatataatatacaatctacccgctagactccctccacccttctcaatccctccaacaactaccccgcgccgttgatcgtcgctatggatctcgttaaccacctcgaaggcagactccttttcgccgtccctaaaaagggtcggctccaacaggcaaccttggacctgcttgccggcgttgacatccaattccgtcgcgagacccgcctcgatattgcccttgtgaagaacctccctatcgccctcatcttcctccccgccgcagacatccccaccttcgtcggcgaaggtcgcgtcgacctcggtatcactggtcgcgaccaggtcgctgagcatgatgcacagctggcgaatggcgagacctccggtgtggaggagatncatggacctggtttcngaggctgcaagctgcaggtgcaagttccggagaagggtgacatcaccgaggcgatgcaattggtccgcccgaacgtggntaccagcttcacgggccctcaccgaggcctttcttcgctaagctcgaaggcgtcgacgataccagcaagctcttcaccacaatcaagtatgttggtggcagtgttgaacccgcttgcgccatg

SEQ ID NO: 4808 - DNA, 685 bp, Aspergillus oryzae
tacgaggcgacagcgacttcgacaatcccccccaacttcctgtcctcgtcgacgcagacattcgctgctaccgcaaaaatggccgacactcccgttaccctgcggactcgcaagttcatccgcaaccccctgcttgctcgtaagcagatggtcgttgacgtcctccaccccaaccgcgccaacgtctccaaggatgagctccgcggcaagctcgccgacctgtacaaggccaacaaggaccaggtctccgtcttcggcttccgtacgcaatacggtggtggcaagagcactggcttcgccctcgtctacgactcccaggaggccctgaagaagttcgagcctcactaccgtctcgtccgtatcggtgctgccgagaagatcgagaagcccagcagacagcagcgcaagcagcgcaagaaccgctccaagaagttccgtggtaccgccaagaccaagggccccaagaagtccaagaactaagcgcgccctcgacctgtcgaattctgatggatatggatcggatgggaaggattgttggttgcggccaagggctagtgctaaagctattgatgataaccctgtggtggtgattgagcgattcgcattcgcatatgcgatacaccataccataccaaagctatgtatgctatgcttatgcaaatatagttatcatgccatgacgatg

SEQ ID NO: 4809 - DNA, 668 bp, Aspergillus oryzae
gtcattgtcgaccttgcagcagaggctggtggcaactgtgaagcaactgtccccggacaattgaccaagtatcacgatgtcactgtaattggatatactgatctaccatcgcgactacctactcagtcatctactctctattccaacaacatcacatagtaccttctatccatggcaccccaggaaaagtcgttcggtgttgatttatccgacgaggttgtccgcggctcaatcgtcacactcaatggagaaatactccctccggcaccacgaccagctccgccacccacgccgaaagtagaagcagcagctccagcaaaggaacaaacggtactggcactgacgccctggaaaaaggcaacacgttatgtggcgactgtcaccgctggtatgggaactactctggcattaggaaaagcaactggccctatctttatggccaacatgctgactttcgggcttgctggcctttgttggctaccgtggcgtgtggggagtcgcgcctgcccttcattctccgctcatgagtgtcacatacgcaagttcgggtatggatggtattgggggcatcttcatcaatggcggagggttaccggcctagcacaatcccagaatttccttggggccgtctcgggggcttttagcaatttttaaatgtacctggaggg

SEQ ID NO: 4810 - DNA, 665 bp, Aspergillus oryzae
ctgcgacctgcttcctcccggttctcaagagcttctttctcatctgccgcggcccctctccggagctctagaagctctgctttgacatccggtcggaggacaacccgtcaagcagtacccttcacaccaagtcggactctcggccaatttcgatgcttctcgcagtcgctatccaataagctcactgacgagaatggccactttgatccccgccaagtggaaagggaatcggacgaggtcgatgtttgtattgttggtggcggccctgctggtcttgccgcagcgattcgcctaaagcagctggccaatgaagctggcaacgaagagtttcgtgttattgtgttggaaaaggccggcgagataggcgcgcatattctctcgggcaatgttctagagccgaccgctataaatgagcttttaccggattggctgtcgggggagaacccctcaagattcgagggtgctacaccggcaaaaggagacaagatgcgctttttgactaagaactcgggaattcccattcctgcggcatcgcagatgaacaatcacggcaattatatcatcagcttgaacgagttgagcaaatgggtgggttaacgagccgaggaactgggtgtggaaatccaccctgggtttgcttgcagtgaactgggctacaaatccgg

SEQ ID NO: 4811 - DNA, 672 bp, Aspergillus oryzae
  misc_feature (1)...(672): n = A,T,C or G
gcacacatcactattttccatctcttgttaccgacctggttacttccagaaccctttccgttattctttctttctaaccttcctctccacgatacctcatatctaaccttgtccagccaacttccttccgcctttcctctctagcgacttcaagtcgcggcattcggtttccacacgtcttccccgcttccctgtggccggagagctctctcctccggccctactgccgacacaatggctgaaagctctttctccagcgctagcccccagctcaaggtgggcacaaaagatgataaaacttcagcatttcgaaagatctcagaggatgaggagtgggaggtgacgtcaccaactgacccgacctttcaaactgcaaattcggcggcaggtttgtcgtccgctggaaacaacctctttggaggcaacgtatttaatgaacaacaaggcggnggaatacgttttcgcaggagtccttttgccgacccttctggggatggagaagaccatgacgactttgacgaacaccctgaaggacctcgcccgacaagtgccttgaatgagggattcccgaataactacgcattgggtcgtcngacatctgtgtctgctgagtctttgaaccccacctcggcccgttcaaatagctgggtgcccccgcaccaaccaaagacc

SEQ ID NO: 4812 - DNA, 676 bp, Aspergillus oryzae
catttatccccgtttcgctcttaaacaccatcataatgttcaagagcggtcttgcccggaccttcgggagggctgtttttgcccggcctaccccggtcgcccgtcgcgttccttccaagataaatgccttcccttcccttgccaggttggccagcactgaggccggcgctaccggcaaggttcaccaggtcattggtgccgtcgttgacggtatgtttccggctcccgacgaaaaccctgttacccggctacgcgaaaatcttttcctggccgcaattccatcatcaaatcatcaacaacgactccatctgtggctcaaaacacgatatctgactctcgattacagtgaagttcgagggtgagaagctccctgccattctcaacgccattgagaccgagaacaatggccagaagctcgtccttgaggtttctcaacacttgggtgagaacgtcgtccgtactattgctatggagggtaccgagggtttgactcgtggtgccgctgctcgcgacactggtgctcccatcaccatccctgtcggtcctggcacccttggccgtatcctcaacgtcactggtgaccccgtcgacgagcgtggtcccgtcaggccaccaagtacgcccctatccacgccgaagcttccgagtttcgtgagcaatccactgaaggtgagaa

SEQ ID NO: 4813 - DNA, 679 bp, Aspergillus oryzae
  misc_feature (1)...(679): n = A,T,C or G
gctgctcaggacattccggccgctaagagcgcccgcgcccggggctcttacctgcgcgtcagcttcaagaacacccgtgagaccgctcaggccatcaacggcatgaagctccagcgtgctcttactttccttgacaacgtcaccaacaagctcgaggctgtccccatgcggaggttcgctggcagcaccggccgttgcgctcagggcaagcagttcggtgttagcaaggctcgctggcccgagaagtccgccaagttcctcatcgacctcctgaagaacgctgaggccaacgccgacaccaagggtcttgacactggcaacctcgttgtcaagcacatccaggtcaaccaggcccccaagggccgcagacgcacctaccgtgctcacggtcgtgtatgtttcccccatatttccggttgatatcttttgctgactcgaggcttagatcaacccctacatgaccaacccttgccacatcgagcttatccttactgagggtgaggaggttgtccagaagggtcccgttgccaaggaggctcacctctcctcccgtcagcgtggcctccaggtccgccgtgccatccaggcataagcggttcatgggtgtcggggatgaggtagtcggaaaatgaatgggaaagccggagttttctgttgtacggaacaaatacctttttan

SEQ ID NO: 4814 - DNA, 695 bp, Aspergillus oryzae
  misc_feature (1)...(695): n = A,T,C or G
ctttccctgcagccggcccgtttagtcgaggcggttgatggcactcgttcctcgtctccgaacgtgtacgctatcgtcttccgtgagggtgttctcagcttcaatttcggcaacagtccccatggcggtcatgtccgaaatcggatcaaggagcaccggagccatctagcactgaccagtgactggatctcttacgccctcatcgatgacatcgtcgacggcttcgcaccttttatcaatcgcgtccaagccggcgttgaactgatcgaagacgatgtatccataacccgaccggacgatatcggtctagcgctccaacgcatccaccgctatcgcaaagaggtcttgcaaatccgccaactgatgaacgacaagaccgacgtcatccgctgcttcgatcgccactgcggctcgtttggtccctcgacaatggatgtcactctgtatctcggcgacatttgtgaccacgtgctttccatggtggccgatctgtacaatgcggagcagatgttgtcgcgagcacaggagaaatatctgaatcagctggcgttcgattcgacgcgtatgcgaaatgaaatngcngccactcttnaccggatgaccgtcgtttgtgggattcttgtgccaatgcagtttctcatccgtctctttgtatgaatgtcacaantcctggcccgacttcggaggatgtgact

SEQ ID NO: 4815 - DNA, 658 bp, Aspergillus oryzae
  misc_feature (1)...(658): n = A,T,C or G
tttatccttctttaataaataattacatactatctcccgtgacaccatgaggacgtcaactttggtcgctgcttcggctggcacggtccttaccggcctgttggcttatgccatttactttgaccacaagagacagaccgaccccgagttccgcaaatccttgaagagaaacaaccgtcgtctggcgagagctgtgaaggaggaagccgaggctcaaggagcccaggaacgggaatccatcaagaagtctgtccagcaggctcaggatgagggtttcccgaccgatcttgaagagaaggaggcctacttcatgggccaagttgcccggggagaatctctctgcgctgaaggctcagacaaggttgaagctgccctgtgcttctacaaggcccttaaggtttaccctncacctaaggatctgatctcgatatatgacaagactgtccctanggaagtcttggaaattctggctgagatgggtcgcatggacgcggcttnntgagctggcacatttactgggcgaaggtgcagtgcttgatcagccatgtgtcgagtaaaagaacagacgtgacgcatttcatggattccgactcgcgccctcggcattgncaacattccaacccccttcggtataaaataagaactttgcttggcctgg

SEQ ID NO: 4816 - DNA, 642 bp, Aspergillus oryzae
gcctcttccctatgacgacattgaagcacttcgcgaccgtatggaagagattagccctgtgatgcgccggtacgacgtcgctgagccaacttctctgggctctttgagcaagattcaattggtcgaacagaacaagggcacccagccaaccctggcacctttcaagaaggttatcgatgacttctattttaccgactccatttctcggagctcgccaacaatggcccgatgctcagcagctaaggccataggaaacccggagacaatctttatggctgctggtgaaatgtctccccaagctctgtacggctgagaccttgcgacttagagcatgatatgcctagatttgttttccgtgtgtgtctattggctacgcgttgtcgttgtaagacctatgcttctctaggtgtgttttgctcccttatcgttgacactgttaagtcatgttttgcgacctcagtctcaatatgccgcacatatcaccctctggtattaaatgggatgtcagtaacggtgaacttgtacataagattgaggtaaacgtcagcttttacgcatacacgtactcgagaactcactacaatgccaagcctgtggatgaggcgttgagaagatttgaccaaaattcctgagtcgctcgag

SEQ ID NO: 4817 - DNA, 711 bp, Aspergillus oryzae
cgaggccacgacaacccgaacgacatttttgcgggtcatttcctcgacttgtttgcgttgcccgctgttgctcagaaccgccgtcagaatgccttcggaacacggtcacagactctacgtcaagggacgtcacctgagctaccagcgctccaagcgccaggtcaaccccaacaccagtctgatcaagatcgacggtgttgacaacaccgaggctgccaacttctacctcggcaagaaggtcgctttcgtctaccgggccaagcgcgaggttcggggttccaacatccgggtgatctggggcaaggttactcgtcctcacggaaactccggcgttgtccgtgctcagttccgccacaacctcccccccaagtccttcggcgctactgtccgcgtcatgctctacccctccaacatctaaatgactcgcttttattatgtgttagttggcactccggaatcttcgcgcagacagtcgggcaaggagtcgacggtatgagccaatgttgagatggagttggcgggttgataatgttcgtgggagaggcagggccgaccagccctacgaattaaaataaaagaacttttatgtcttctttcacaacatggatatttgtcagttactaggcattagaaaacgcttgacccgttctcaataccggcaagcatcatgtgttttttctgacaccatggctttttcaccacctcgggcct

SEQ ID NO: 4818 - DNA, 1042 bp, Aspergillus oryzae
  misc_feature (1)...(1042): n = A,T,C or G
ccaagctcaatatcaagccaattaccgtttggctgaccccttctggccccaatccatggaaggttgtcctcattcttgaggaactccaggttccctacgtgattgaatccttcaggtttaacgatgtcaagctcaagccctacaccgatatctgtcctaacggtcgagtcccagcgatcgtcgatcccaacactaacctaaccctctgggaatctggtgccattatccagtatctggaagaggtctacgacacggacaagaagctaacctatgagtcgctcaacaaaaggcagctgctgaaccagtaccttcatttccagatgagcgggcaagggccctacttcggccaggctggatggttcaacgtcctccatcacgaaagaatcccctccgccatagagcgctacaacgaccaagtaaagcgcttcctggaggtgttaaacacctgtcttgaaggcaaagcctggctcgtgggcgataaatgcacttttgcagatttgtcctttgtgccctggaactgtcgccttgacatgctgctgcagacacccccgggcgaggacccactggccaaataccccaatgtgcaggcctggcatcaccgtatggtggatcgaccttcatggaaacgctgcatggaggttcgagataagcttatggatgatcagggtttaatgcctaatgggatgcccaaggggataaataatattcaggagtacgaggcggagattgcgcgggaggctgctgagaaagggaaggagtaaattgcaataggagtggtgatatatgtcagtttgtgagatataccctaccagcaagtttcgttaaatccgtacaagatgagaggtcgaatagatatttgttcttaatttgaaaaacaaaganagaaacaaaaaagaacagaacaacggttgtgttgggagaagaaatcaaaagcgatggataccatttgggcctatatttttttgtgccacttggatctttcttttaaagggcccgattttgaaattagtttttgccccctttacttttaccgccctccccc

SEQ ID NO: 4819 - DNA, 692 bp, Aspergillus oryzae
  misc_feature (1)...(692): n = A,T,C or G
gaagtagactggaagccggacgcagtgcagggtaacatagcactaactacctttttgaatgccatttcactctgtaacctttcgactgtacaaaaggaacaacagtcaatgccatcggaaaaggatcctgaacatggcgcgcaagtcaggtggaccgcagtcggggagcctactgaaattgcccttcacgtcctcgcaatgcgatttggcctcggcaaaccaaatatactgcaagacagtaatttacaacttcacaccgagtacccatttgactcttcaatcaagcggatgacggtaatttaccgtagtcttgaaacgagcatgaacgaggtatatacgaaaggggctcccgaggcagttatccctagattgaatagcagcgagatagagaagtcttcgatccaagacactgcagacagaatggctggggaggggcttcgcgttctttgtgttgcttacaaaaaggtccctattaataatgagtctgaggtatcctcgcgtaccacagctgaatcaaatttaagttttggtgggctcgtgggactatatgatcctcctcgggttgagactgcagcagcggtgcggagatgccaaatggcaggcatcgctgtacacatgttgaccggtgaccatatacggacagcgacagctattgcatncgaagtggtatattggaccccgtatgggtgcta

SEQ ID NO: 4820 - DNA, 668 bp, Aspergillus oryzae
ccatggactagccatcttagccgagtcacggcggcatccacaggccccaatggtcagatctcccatcagcaatactcgaccatgttcctgccccctcgcgatgacctgaactcccccgatatgtatattccggtcatggctctcgtcacatatatcctcctatcggcaatgctggcagggttcagaggcaacttccaccccgagcttcttggttcgatcacgacaacagctattgcagtcatcgtattcgagatactttgtctaaagctggctacctatattctcagcatcaacaatgagtcgcagctactagatctcgtggcttactcaggctataaatttgtgggcatcatcattaccttagtgacatccgaggttctaactccgggaagaggaaccggtggttgggtcggctgggttgtgttcatttacacgttcctagctaatgcgttcttcttgcttcgttctttgaaatatgtcctccttccggactcagccactgatgcacgcacgggatcgatgcacaccgtcgcccggtcacaacgcaatcgtcgcacccaatttctggtcatctattcttatgttatccaattcatcttcatgtgggtgctgaaccgagaggcccaacttgttcgaacgtagctggttcagcgccgtaattgaactat

SEQ ID NO: 4821 - DNA, 677 bp, Aspergillus oryzae
  misc_feature (1)...(677): n = A,T,C or G
gattagtggactttattcaggtcttgagtcagcgctttttggcatcagcgtaaccaacttcgtctattattactggtatgaatggacccgctcggccttcgagaaggctgctgcaaaggctggtcgagcctcaacgaagcttacgaccgccgaatccatgattgctggggctatcgctggaagtgcaacggtgctgatcactaaccccatctgggttgtgaatactcggatgacagcgcgaaaatccgagtcatacgaagcggtattgccgggtgctcccaanaagacaaaggcttcgacgattaacactctgctggacctgctccggcaggaggggcctaacgccctttttgccggcgttctgccggctctcgtcttggtgattaaccccatcttacagtacaaccatctttgagcagttgaagaacgtagtggaaacgtcgtatgcgcatgacgccgaaagaagcgttttaccttggggccctgggcaagatcttagccacgtgcatcacatacccttatataacggccataagtccgatgcacgtggctagcaaggacgggtcgaaaggaaacgtttgaacggcagcttgaagacgatcatcaatgacgatggggacgtgggactggtataaaggatttggccccgaaagtgacacagactgcgattactggag

SEQ ID NO: 4822 - DNA, 694 bp, Aspergillus oryzae
  misc_feature (1)...(694): n = A,T,C or G
gttccccggctgatcctaagtctactgaaaagaaactaggatcatggcatcagtgctaccgcctggacgggaaactcatagccgttgcggtcctggacttgatgccgagtggcgtgagctctgtatatatcttctatgatcccgactacgaacaatgggaattcgggaaactcagcgccctaagggaaattgccctctctattgaaggtagttaccagtattactacatgggctattatatccactcgtgccagaaaatgcgttacaagggatccttcaagcctcagtacatcctcgaccccgaaagctacacatgggatccgcttgacggcgaactggcaaagaagctagacgaacgtccatacgtatcgctctcgcgtgaccgccgtcttgcggctgaaggcacaccagagtccgccgggacagaggccgatgccgaaatcaatgatgatgaggtatctctcttcgacctgcgcatgcccggtgtcctgtctctggaggaagtggagcctttggatttggaccactggctactcctcgtccatggtagttntgttcatatgattgacctcgtgggatgggagacgatgcctatggataacccccaatcggttaaagggattattgctgaactttgccgcggtgttgggggccgaaaattgtcaaggaaagtgcccgcggattattcgactac

SEQ ID NO: 4823 - DNA, 670 bp, Aspergillus oryzae
  misc_feature (1)...(670): n = A,T,C or G
tgtcacccgcagccccaaaatacatcctcgtaacaggcgccacaggcttcatcggcgcccatgtagtcgacaacctattagcacgcggcctgaccgtgcgtgcagcaacacgctctaagcaaaagggcgaacaaatgaaagccgcaagaccacaacacgcctcccgacttgaattcgtcgagatacaagatttctcgcaaatcggagtattcgacgatatcatggagggtatagacggcgtcatccacgtcgcgagtccattcacatacgacaccannaacaacgaacaagaactcatcatcccagccatgaacggggtgaaatctatcctctccgcctcagcgaaacaagccagtgtgaagcgcgttgttcttacctcctcgtttgcatccgtggttgatatctcgaganagtatgagggcgattttacctacactggctcacactggaatcccttaacctacgaagaagcgattgatccccgcacagacgcggtagtagcataccgaggatcgangaaattcgccgaactagaagcctggaagttcatcgagcgtgaaaagcctcccttgatctcgttacgctttgtccgcctatgaactttcggtctgttgtgcaaccagtaaatggggtaccggggttgacgagtcgaatgcggtgctctggagtg

SEQ ID NO: 4824 - DNA, 701 bp, Aspergillus oryzae
cccacttaaactggttataacttcaaccatggcatctttgaagggaccaggagctactccaagctttgacggctcggggcttcgaattgcaattgttcatgcaaggtggaatatgggcataattggtcctctcgtagaaggggcaaggaagagccttttggcagctggtgtagttgaggaccatatcacaaccctcactgtcccgggcagctatgagttaccatatgccgctcagcggctctacgcagcttctcagttacaagcagccaagagctcgtcctccggtgagggaatcagtgccacggacctgctctcttcctctaccgcagacattagcaaagcgtccccggaatcgcaaacacccgctacctctaggccgtttgacgccattatggccaacggggggccttaataaagggagagacaatgcattttggagtacatcgcagatggcggcccctcacggaattaatgcgggttcaattaaattccgggcgtgccggcaaattttgggggggccaccgtttttgacggaaaacaagggtttggaaagggttggcgtaggcaaggaagggatgcctaatcatggggaaaattgggggaccgccccccttggaacttgtggccagcagaagagaaatggctgaaagttaaaattgctaagtgcgtttcgaaaactcccagggattgttcggtaggat

SEQ ID NO: 4825 - DNA, 1146 bp, Aspergillus oryzae
cgcgattactctgtgcggtgaatatctctaccatgctcaagatgaattgacactctcaaatcattcacaaaatctcaccacctgagctttacgcttaattacagttgatcctacctttctcgtcagatacatatttccctcaatacgtgccctcaaacagcacaatgtctgtctccattgaaacccacgacattgcccccgccgctcccaccacacaggcggccccctgcctcggatttaagaacagaatgcctgagttcagcttggctggaaaggtcgcctgtgtttctggcgctgcccgtggtcttggtataactcaggctgaagcgcttttggaagccggggccaacgtatatgctttggaccgtctggaggaaccctcccctgaattcttcgaaatccaaaaacgtgccacggaagagctgggaacggagctggaataccgtcgcattgatgttcgtgacaccgaacttctcgacagtactatcgaagccatcgccgattccgagggtcgcttggatggcttgattgctgcggcaggcattcaacaggaaactccagccctcgagtatacggcccaggacgccaacacgatgttcgaagtcaacgtcactggtgtgttcatgacttccaaggccgttgctaagcaaatgattcgcttcggcaatggaggtagcatcgcactaattgcgagcatgagtggtactattgccaatcggggtcttatctgccctgcttacaatgctagcaaggctgcagtgcttcaacttgcccgtaacctcgccatggagtggggcccgtacaacattcgagtcaacaccatctcgcccggctacattgttactgccatggttgagaagctcttcgttgagttccctgagcgtcgcgaggaatggcccaaacataacatgctgggacgtctgtctacccctaacgagtaccgtggcgctgccgtcttccttctcagtgacgccagcagcttcatgactggaagcgatctacgtatggacggaggtcacgccgcttggtagttggcatttacatgactcttttgtttcctttgcatatttctaaatttatatcatcgattctattgcatggcgtcaggaaatcaaacgtgatcggattttggatttgatggccttg

SEQ ID NO: 4826 - DNA, 554 bp, Aspergillus oryzae
  misc_feature (1)...(554): n = A,T,C or G
cgagggaagatcgggggtcaggatggatatgtggatttgtttctgattcatagcgccaacgcgggcgcgtcgggtcggaaggagatgtggcaggccctggagagactcctggaggaagggaagacaaagagcattggtgttagtaactggggcgtgaagcacattgaggagatgaagtcatatgcgaaggtttggccgccgcatgtgaaccagattgagctccatccctggtgtcaacagcgggttgtaaatgcgtattgtaagaagcatggcatcgttgttgaggcctactccccgattgtgcgcaattataaagccagcgatcctacacttgtcgacctggcgaacaaatatggaaagacaacccagcaggtcttggtacgctacgctctgcagaaggaatgggtaccgctgcccaagtctgataaccctgatcggattgtggccaatgccaacgtatttgactttgaaatcagcgaggaggatatggctgtgttgaatgccttggatcanggaagcgctggagctattgtggaggccgtgaaaacgattan

SEQ ID NO: 4827 - DNA, 666 bp, Aspergillus oryzae
tcctggtgtattattctccactccaccaatcaaccgtcccttcatatcataccgacaagatgagcgttaccacagccgcgcccgtggaggccaaaaccgagccccagaagctaagcggcttgaacctgtattcgcgattcgcattcgccggagccgtctgctgttccgtcacccacggaggtctcacccccgtcgatgtgtaagtcgcgccaattctcgcgaacaaccaaaacgacatcggctacaagcaaaaaaagtcgcaacaaagtgactgacagatacctttgcacagcgtcaaaacccgtatccagctcgaccctgtcacctacaaccgcggcctcatcggtggcttccgccaggtcatccagaatgaaggcgccggcgcccttctaaccggtgccggtcctacattcgccgggtacttcctacagggtgcgctgaagttcggtggttatgagttcttcaaacagcagtcgatcaacactatcggctatgaaaatgccagaaacaaccgtatcgccgtctactgtgtttcgtcggcttttgcggagttcttcgctgatattgcgctctgtccgcttgaggcgacccgtattcgtttggtgtcggagccgacctttgctagtggcctttgttctgggttcgggaggattgctcgtcaagagg

SEQ ID NO: 4828 - DNA, 678 bp, Aspergillus oryzae
  misc_feature (1)...(678): n = A,T,C or G
caagcgctctgcccccgccgatgaggagaagcccgcgaagcaggccaacggcgaggaaagcttgagtaagaagcagcagaagaagcttaagaagaacaacggtgatgcagctgctgttgagcagaataaggaggccaatgaaggaaaggaggccaagaaggtccagttcgctaagaaccttgagcagggccctacccactccggccaggacaagaagcctgacgagcagaccaccggcacccttggtgtcaaggaagttaagggcgtcaagattgatgacaagaagcttggaaagggacctgccgtcaaggccggcaacactgttgccatgagatacattggaaagctcgaggacggcaaggtctttgatgccaactagaagggctagcctttcaccttgaagctcggcaagggtgaagtaatcaagggctgggatattggcgttgctggtatggccgttggtggtgagcgccgcatttcgatccctcctgatctggcctactgtaaaaaggctcttccctgcatgcctggcaactctaagttgatctatgatgtcaagctgcttgagatcaaatagacgtttgctacttctatctataatgttgcatattagctcgatgattgggtatcactgtggcagtgttgtacatgatgattgtcctttcctatcttcatgcn

SEQ ID NO: 4829 - DNA, 677 bp, Aspergillus oryzae
gcgccctttggcgtatgcgccgactccctacagctatactcctaacccggccttgtctgcgtccatcaatctcgatgaggaagttaaactagcctccagctcggccgagcgcgatctgtacgagtcgctggctgaaatctacagcatcatagtcacgcttgatggtctcgagaaggcttacattaaggatgtggttacggaagcggagtacacagaaacgtgtgctcggttactgaagcagtataagtctagtttgggtgacgacactgtcgcaaacgagtttgtcgatctggagaccttcaagcgaacctgggggttggaatgtccccgtgctaccgaacgtcttcgtatcggacttcctgcgaccgtcgagcaggccagtcacaacgcaccagcggctaatatggggccggcagcaggccctcctggaggtgcttcaggcagcttgatcctgacggccacggagaacttcatcactttcctcgatgcgttaaagctgaatatggtgtcgaaggatgcgctccacccactgctctccgaggtgatccagtccgtcaataaggtgacagacggggacttcgaaaaccgggcaaaaatcattcagtggctgatcacattgaaccagatgcgtgcgacagaagaactgagtgaggatcaggcaagagagttgtcctttg

SEQ ID NO: 4830 - DNA, 600 bp, Aspergillus oryzae
cgaggccctcccctcccctcttaataactcaacttacacttctgacctgtcgctcattcccactgagataaatgagatacttcaggcgctgttaaacatgtcttcttctaaaccctctcttactacccaggaactccagacccttgcctccaaggcgatcgctgctaaagctacggcctactgcccgtactctaaattccgcgtcggggcatgtattctcacccagtctggtgagtacatcgttggcgccaatgtcgaaaacgcatcctatcctgtcggcacctgcgcagaacgagtggccttcggtactgctgttgtcgctggatatcatgacttcaaagctgttgctgtcgctaccgatagtaaccccccagcctccccgtgcggcatgtgtagacagttcatgaacgaatttacgactccctctttccccatttacatgtatggctctgaaggaacctacactatcaagacaatgcgcgagcttctccccgactcgtttggaccggaggatttctcaaaggaaagggtacagtcttcgtagttacggcgatttatctccctccaagttctttaggttttcccctgaaggctactctg

SEQ ID NO: 4831 - DNA, 675 bp, Aspergillus oryzae
gccggaggattcttgctctcaccgaatctctgtctagatcgaaggattccaacttatctgcatctgtctttatcgtctctctcgcgataacccctccaatcctcctcgcaatgggcaaattgacctccacgatcggtatcccgatcaagcttcttaacgaagcccagggccacgttgtcaccctggaaatcacctccggagtcgtgtatcgaggaaaacttctcgaggccgaggataacatgaacgttcaactgaaggatatcacggtcactgctcgagatggtcgcgtgtcgcatttggatcaggtttatattcgcggaagccatgtgaggttcttcattgttccggatatgttgcggaacgcccccatgttccgctcacgaggccagcgcggccgcggtgtcggtctcgctcgtggtaaggccaccgtgcagcgtgcccggggccaacggaggggttagaaaaacggaaaaatattcatatctcatattaatgggcgttgatttgggcttctttgtttctttcaacgtgccgttttaacactttacattggggcttttcctgaaaaatcatttctgggtctacatgggaatcttattacccgccatgttgggggaccgttctcgtttttgacgctgatgctggttttgagtcgtgggttgttgcttggtggtt

SEQ ID NO: 4832 - DNA, 647 bp, Aspergillus oryzae
  misc_feature (1)...(647): n = A,T,C or G
ggtgaacccaaagatgttctacgcctccacaagcattctatctcccctccgcacggatcccaagttactcttcgcctccttgcagcgcctctaaaccccgccgacgtgaaccagatccagggggtgtatccgagcaaaccgccattccagacaacccttggtacccaggatccatgcgcagtgggtggaaatgaaggtgcctttgaagtaattgcgactggatctaatgtcaagaacctcagcaaaggtgattgggtcgtcatgaagcagacaggacagggcacctggcgcacacacgctcagatggatgagtcgcagctgatcaaaattgagaataaagatggcctatcaccgctccagattagcacagtcagcgtcaatccagtcacagcttaccgcatgatcaaggacttttgtgaatgggactggatgcggagtggggaggaatggctgattcaaaacggagcaaacagtggtgttggtcgcgctgccattcaacttggccgagaatggngtattaagacgatcaatgtcattccgggagaggagaaccccggaagaaacggaaagtctgaaagctgagcttcatgaactaagggcccactggagtagtcaccaaaaccggagttggttttaaggaaatttca

SEQ ID NO: 4833 - DNA, 695 bp, Aspergillus oryzae
gcaggcgttcaccggcaatgtgtttttcatcaactacgccgtccacttcatggaactggctggcctcgactcatccgatgccttctcaatgaacctcggtctgactgccatcgggctcctgggaacttgcatctcttggttcttgctatcatatgtcggtcggcgaactatgtaccttttcggctgttcttcgctagcacttctgttgtttataatcggtgccgttgacctcgccccgcgtcaaacgaacacagtatgggcgcaatgcggtctcatgttggtctgcacatttgtatatgacctcagtctcgggccgttctgctacgtgcttctggccgaagtatcctccgctgctctgcgagggttcacgatcgccttggcgacggtagcctgcttcgtgtggtcggtggtcttcgcggtcgctatcccgtacgctatgaatgaagacgaagccgactggaaggggaagatcggcttcctcttctctggacttagtgttctgggtgttatatatgtttactggtgtatgccagaaaccaagggcaggacctttgaggagttggacatccttttcgaaaggaaggtccctagtcggaagttcaagtattataagattgacattgatattgacgggcggaggcttgaggaatagtcaagtttatgcataatgacttgggaaatgaagttacgaatga

SEQ ID NO: 4834 - DNA, 462 bp, Aspergillus oryzae
cagttgcaaactgtacttaacagccagacaacaagatgctttctctagtcctttcagctgaactcacaggagtcaccgaccttcgccctcaagatactcctgaggatccctactactacactttcaaggtgcaatgcacgtcctgtcgggagacacacccaaactgggtcagcttcaaccgttttgagcaacatgaaatccctggaagccgcggagaggcgaactttgtctggaaatgcaagctttgccaaaaaacccattccgcttctattgtcgcaggtcccaatgtgtacgaagcggacgagaagcgcaagggccggaaagtgatcgacattgactgccgcggtcttgaatttactgattttaaagctgatggcgaatggcaggcgaagggcaccgagtcttccactccctttacggccatcgacctgtctgagggcgagtggtatgactatgatgaga

SEQ ID NO: 4835 - DNA, 914 bp, Aspergillus oryzae
  misc_feature (1)...(914): n = A,T,C or G
gaagctcttcatctacctaacaggctggctcactgtcatcggatggcaagcaacgtttgcaacatcgtgctttctttctggaaccctcatacaaggtcttatcgtcctcacaaactctagttatgagcctaagaattggcatgggactctccttttttgggccgtcgctgttttctccgtgggtattaacagtgtgggaggaaacctgctgccccgtttcgagggcctgattcttatcctccatattctcggctttttcgccattcttatcccgttgacatatatggcggatcactcgagtgcgcaggaggtcttcacccacttcctgaacctgggcgaatggcccacacagggcttgtcatttttcatcggtctagttggttgcgtgtttgcattcgcaggtggtgacgctgctgttcatatgtccgaagaaatcaccaacgccccggttgctgtcccacgctccatcatgcttagtgttctcatcaacggaacattaggtttcagtatgttgatcgccatgttgttctgcctgggagatatcgaggcagccctggtatctcctactggttatccattcatggcgattttcctccaagcaacgcactctgtggctggcacagcaacaatgggcgctatcattacgactatgggaatatgcacatcggtcggcatgttggcctcaacatcacggcaattctggtcttttgcgagagaccgcggaattcctggctggcgcttatggagcanggtgacccccgaatccgccatcccaatctactccgtcggcctcaccacaatcgtcgcctgcctactagccctaatcaacatcggctcctcagtcgcctttaacgacctcgtctccatgtccatctncggtctctacctttcctacatgatcgacgcccgtcttt

SEQ ID NO: 4836 - DNA, 1269 bp, Aspergillus oryzae
ctacgatgaccgcctacgggtattgattgaattcatcctcgttatatgtatatggtcgcttaaccattgcccttcctaccctgattccgcagccgcattactcatttctgccatgtcgaacttaccatctcatgcctcgccgacattcacggcgcaggcctcttcctctcatcgagcggttgatgatatgtctctggactcaacctctgcggctccaccatcattgaacagcagaatagacgagcttcgtggtgatgccgcaagtcaaactgacgccacagagcacacccgaggcgatattacccccgcagtgcccgcctctcttctctccccttccttcacccctccagcgacaccaggtggcacgataaaccaagcgcaactacttcagcagactcaacaacccacgcacactaaaccgcctaagctcctctcctgccttccaaatgtcgagtgtattgttcgcgcacggatcccaaccaccaatggggccgagatgttccttcacctctaccacaatgacctggacaacaaagagcacttagcaatgtgttccgaaacaagatccgatccccgaagtttggacgcaatccgcccgggggaaacggaaatggaccgaatgattcgtggggcctacatcggtaccctccgtcccggccgagtgagcagttggtatgacagctccgcaaatactgagagcgcttctagtggacaagggcggagcaccccagatgcccctgtttcgtcacagacatcagagttagcacagagtagcacaaaccaagcgccgctggttagaatccattcggaatgttacaccggcgaaacggcatggtccgcgcgctgtgattgtggtgaacagctcgatgaggcggcacgtttgatgtctctcccgatggaaactttgaatgaggtggcatcccagcaagatttatctgtgccttcgaatgcatctggaggcgtgatcatttacctccgccaggaaggccgcgggatcggtctaggagaaaagcttaaagcgtataatcttcaagaccttggatcggataccgtcgaagctaatttactccttcgacatcccgcggatgccagaagctacggtcttgccacaacgatgttggtggatcttggtctaggtgttgattccaacccacatggaatccggctggtaccaacaaaccctgacaagatccgggccgtcgagggaccaaacccggagttggtttgaagaaaaattacctatggtccctttggcctgacgaaaagtgg

SEQ ID NO: 4837 - DNA, 579 bp, Aspergillus oryzae
cgaccctctctctcagcgtctctcccctcctcccccctcccagtgtgccattgtagagtgtccggcttggggttacagacacatctatccaaaatgaccatcaatcctacttacctcgcgcagcgcacgcgctcctctgtgaactggaccgatgccagggcccgcgtcctcaagtcctacagagaatggcttagagcgtcccctgagatccagaccatgtactctctgaacatgccggtatccgccatccgcaccaaggtccgccaggagttcgagaagcaccgctatgtgaagcagctcggtgctgtcgatgtcctgttattccagagccacgctgagttccaggaaacccttaactactggaagcagctttctcatgtgatgaagtacttccgtccagaggaagaccccggtgcccggctacctcctaacttcatctcgggctttttggaaggccgcaattgaattgaattgttcttgagtacctttgcattgaaatttctaccttggcttggggattgcaccaatagagtgttatgtaaatattgactgagtaactaacgtcggatatggtacgtt

SEQ ID NO: 4838 - DNA, 512 bp, Aspergillus oryzae
tactcgatcacgacaaataccagggcgacattgcgaacgttagcgtggactcctctaagggattttggcagttcgaattggcgaagtttgctgttgcggatggagatatacaaaccatcaaagataatcctacggctattgcggacactggaacctcgcttatgctgctcatccaataagtggtggacgcttactatgcaaacattgaaggtgcgagttatgctagcagtgccagcggttacatttatacctgcaatgcctcgctgccgagtatttcagttgcaatatgatccaaccatctggcgacagtttcaggcaatctgatcaatatctccgaggttggtatcaacaagaccaccggtggagaggcttgcttcggacgcgttcaatctaacgcaggttcctcaatgcacatccttggagatgggttcctgatggccttctttgtggtattcgacttacggagaccttcgctgggagttgcataccccaaatagtttcggcacgggcgt

SEQ ID NO: 4839 - DNA, 677 bp, Aspergillus oryzae
  misc_feature (1)...(677): n = A,T,C or G
caacaccgcaatcgcaatcgtagccgcctcgcgtttcgtcttcgccgtagcccgcgacggcgtgctccccttctcatcatgggtctctaaagtccacaacggccagccccgcaacgccgtgatcgtcgtctgggccgtagcagccctggtcacctgcacgctcctcccctccgatgtggcattcacatctctcgtctccgcagccggtgtccccagcgcagcagcctacggcctcatctgtctcgcccgtctcatctgcaccccgaagcgctttcccaagccccaatggagcctcgggaagtggagcaagccgttccagttcatcggcgtgttctggaacgggtgggttgttgccgttctcttttcgccgtatgcgtttcccgttaccggggcgaatttgaattatgctcccattataatggctggtgttactatttttgcgcttatttcgtactttgctatgccggaggaggcgtggttgcctcggaaccgcatctcgcatttcatcgatagcaaaggcgcccaagcgactgtggaggaggtggagcggccttccggtgaagatcanggaaccagtactccccggctatgatctgagttattcttgtaagggacaggagtgtccggtacctagtacttcgtgggtggtattaataaattcaaaaaagggccagggg

SEQ ID NO: 4840 - DNA, 764 bp, Aspergillus oryzae
tctctttcctttcctcttgtctagccctgtgccatctccctctcatttcctcctcattttcttctcttcttgttaattaggtttattcctattcatctatcaaaatgatcatttacaaggatatccttaccggcgatgagattatctccgacgccttcaacctcaaggaggtcgacaacatcctctgggaggtcgactgccggaatatcacgataggggacgaaaatatccagcttgagggtgccaacccctccgctgagggtgaagacgacgacgctggtggtgccggcaacgcggagcaggtcctcgacattaagcacaatttccgtctcaatgattacccgaagctcgagaaggacgaatataagaaggccattaagggctacatgaagaaggtcctcgccaagctcgaggagaagaaggcccccgaggagactatcaaggagttcaaggagaatgcccaaaccgccctcaagaggatccttgccaactacaaagactacgatgttttggttggtgaaagctttggagccgatgctatgcacatcctcattaactaccgcgaggacggtgtcactccttatgccactttctggaagcacggtcttgaggagtacaaggtctagatttatctacagtttgctgtgaataatgtcctgaatgaaaaaaagaagtgctggagaatgcgaacatcttaattctgacagagcaggggggatgtgaaaactcttcgaggaaccccctcggctcacatcttaatcatt

SEQ ID NO: 4841 - DNA, 690 bp, Aspergillus oryzae
  misc_feature (1)...(690): n = A,T,C or G
gggcgatgcctgatgatcgtttcgatgagctcttttgccatcgtcgtctcggatatcatccgaacatcgtcaacctcattcactcgttcgagaccgagacccacatgtacctcgtcttggaatactgtgcgaatggcgatctctatgaggcaatcagagtcaaccgtggtcccttggaaaccgagcatgtacgggatttcatgctgcaactagtgagcgctgtcgagttcatgcatgccaagggtttgtatcatcgtgacatcaagcctgagaatatcttcttgatgcaggatggttgcatgaaactgggcgacttaggcttggcgactggcgaggcctggtgctatgaggcctgtgttggaagcgatcgttatatggcacctgagcaatacgacccggctacaacagggtactcccctgccaaggctgatatctgggccgttggcatctgcttgctcaatgtcctcttcgctcgaaaccctttcgcaacgccaaccgaatctgatatcttgttcgccgactatgttcgggatcgccaatctttgttcgatatcttcccgaacatgtctcaagatacttttgagatactgcgatttgcccttgccatcgacccaagcaagcgctcgctctctggcaatccggatgcgatcctncgaactgtcacctttaccattgatgatgagggtctcg

SEQ ID NO: 4842 - DNA, 393 bp, Aspergillus oryzae
  misc_feature (1)...(393): n = A,T,C or G
ccgaacccccgatgccctttcataactccgtttcgcagagaagaccaaggctaagactgagaaggaagcctacatcgacccagcagaggctgagaaggctcgtgagctcggccaaaagaagttccaggaggctgactggcctggcgctgttgatgccttcaccgagatgacgaagcgtgctccccaggatccccgaggtttctccaaccgcgccgcagctctcatcaagctcatggccttccctcaggctgttcaggactgcgacgaagcaatcagccgtgatcccaagttcatccgtgcttatatgcgtaaggcacaggctctgatggctatgaaggaatacaacaaggctttggatgcttgcactgaggctcangaaaatgatgatggaac

SEQ ID NO: 4843 - DNA, 1038 bp, Aspergillus oryzae
ctcacccctcagctcttctacgaacgctcgcgatcgctacaagttacagagtttttaactcttacccctcgctttcatactacaaccgcttttaagggcccgtttcgagaaaaggccgagtttatgtccatcgaaaacctcaagaccttcgaccccttcgccgaagctgacgaagacaccggcgagaccaagcagtctcaaaattatatccatatacggattcagcagcgcaatggtcgaaaaaccttgactaccgttcagggtcttcctaagaagtttgatcagaagaagatcttaaaggtgatcaagaagaagttcgcctgcaatggcaccatcgtcgccgatagtgagatgggcgaggtgattcagctgcaaggtgatcagcgtaaagatgttcaggagttcttgaccgacaagaaggagggtctcgagctggatgccaagaccatcaaggtccacggtttctaaaggagacgccgcgccccgttccgatcccagtctactttgccctcggagtggttggatggaggcatgtatcgcctatccttcgtcttaactctgcattgctctctacgcgattgcaacatctaggtggttcggttaagcttcttgtcttttacatccaaccctctgtggccggcgcactggacgtgggacctctgtcgttattatgcactgtctaatttgatcccaaacaattgcggcacgcgattgatgggagtgggtcctttgttggctcgactgctatactcggaatgggattatgacggaacgaggcgttggtagatacccaaatatatgcatagatgttcttctgtttcttgcctcatccctgtcgttactcggcttggaggaaatgcatgtcgggaggtctgtcgtcagacggatgttatggagggttgcctggtgtgcgaaggtcaatctctcgttgcacttgcgttctacgtcttccacatgttgtttctgaacttgtcctcacaacagtcgttctcagaataagatgtatgcaatgcgatatgcaatttgctgtggatcttc

SEQ ID NO: 4844 - DNA, 672 bp, Aspergillus oryzae
gcggaaaatacaatattgtgtttcgaagtcatcaagacggaagaccgaggatacggtgttcgtagcaaccgcacattcgagcctaaccaggtcattgtggagtacacaggggaaatcataacgcaagcggaatgtgagaaacgaatgaggacgatttataagaataacgagtgctactacctaatgtactttgatcagaacatgatcatcgatgctaccaggggctctatcgctcgtttcgtaaaccattcttgcgagcccaactgtcggatggagaaatggacagtcgcggggaagccgcgtatggcgctttttgctggtgatcgtggaataatgaccggggacgaactgacctatgactataattttgacccatactctcagaaaaacgttcagcaatgccggtgtggatcggacagatgccgcggtatcctgggaccacggccgcgggagaaagagcaacgttcaaaggagaaagaactgagggctggaaacgagaagaaatcttgttcgaaaatatcatgaaaaggccagcattaccaagcagaaggtattgaatggattcaacttccgcgtcaataaacaacagcattttgggtttgaagtccatcaagtcttgagggagaaaagatggttattaagcacacgcttatgtcttttaaagcaactacg

SEQ ID NO: 4845 - DNA, 707 bp, Aspergillus oryzae
ccctgttacgtactttgcggtcaaggtggtattcgacatcgtgcctttgcgcctactgcccccggtgatcatgggagtgatcgtgtatcccatgactgggctgatcccagcatggccagagtttctccggtttatcttagtacttgttctcttcaacctcgcagctgccaacatctgtctcttcatcggtatcgttttccgcgatggaggagtggccaatttgattggcagtttggtgatgctattcagtctattatttgctggtctgttactcaaccacgatgcaattcctaagtccgctttgtggctgcaaaccttgtccatcttccactacggcttcgaggccttgattgtcaacgaagtgacgttccttacgctgatcgaccataagtatgggctggacattgaggtcccaggggcctccatcctgagcgcttttgggttcgatactttggcgttttggaaggatgttattgggctgggtataatcttcggcgcattcatcatgattgcctacggagcaatgcatgttttcttcattgagaagcggtactcgcggtatgaatgcattaacgccatcttcgcctctttgcccctgtctaatttacgtttggcaaaaattaaattattccccgcctcttattgtgtggtcccatactgtcatacctcaccatgactatgcccctagttgatgatgcaccgctccc

SEQ ID NO: 4846 - DNA, 534 bp, Aspergillus oryzae
ctgtacgaccctagccagcctgataacaagggaaaacagtttgataactcctatgaccggggtcagcccttgaaggtggctattggcacaggacgtgttattaaaggttgggatgagggggtccctcagatgagcctgggagagaaggccctgttgaccatcactccagactacggttatggagcacaggggttccccaatttgatccccgccaactctaccctcctcttcgaggtccagctcgtggctatcaacaacaaggagatgccaaagccctaatcgaatgcctaacctcaccaaagacctagacatataaggcaattgaaaatgatatatcattgttttctcgtagtcgagggttgcagggtaggatggaaagacaagcgagatcaaatatcaagctattgtatgaaaatcagctttccagaggagcttcattgaacaaaaacagtagatctccgaatagcaacgctccaccgagatccctccctggctcaggcgaagcaaaatgaaatagttacaagtcagggcatc

SEQ ID NO: 4847 - DNA, 636 bp, Aspergillus oryzae
  misc_feature (1)...(636): n = A,T,C or G
caatcgcaggtcttgaataactaacattccatcatgttgtcgcgatcagtatggaggaacctgggctataatgcccgtcgaagaacggccatacccgaggttccctaccgctgcttttcctgttcgcagcgagctcaagtggactccaacaaggccaaccaagatgaacggatgacccattttggctttagcaatgttcctgaatcgcagaaggagtccatggtcggagcggtcttcagctcagttgcttcttcctacgatgctatgaatgatttcatgtcactcggaatccatcgcttgtggaaagatcattttgttcgctccttgaaccctggatcggcgctaccatctcgcaacaccgacacgacaggaaaagggtggaatatcctggatatcgccggcgggacgggcgatatcgcgtttcgcatgctggaccacgcgaccaacattaactacgatcatgatacccgtgtcacaattgctgatatcaatccggatatgcttgcggagggtaaaaagaggagcatccagaccccttactacaacacggaccgtttatcttttatgcanggcaatgcccaggacatgcccaacattcccgataactcagttgacctctacacgggtgtcttcngc

SEQ ID NO: 4848 - DNA, 674 bp, Aspergillus oryzae
  misc_feature (1)...(674): n = A,T,C or G
gagaacacccacttcggacatattatttttaatgatctctaagaatgacatccaccccatcattaaagcacaacacatctacagctaccaggatgaaacggcctataccgttttggcgtcgtcgcaaccccatcagcctgcggaaacagcgaatgttcagcttcatatcggcgctctcgaatatttcgaaccgctttattgaacgccgcctcaacattaacattatccctagctgaagcctcaacatactcgccgcacaactctttaccgagctccatgccctccgtttccgacacggcccgcttatgttgcaggtcactcttgttcccgaccaagatcaaaggcgcaaaaaacggcgcgcccggatgtgtagcaggtgggtttatcgagtggtcatctacaacctgcttgatctttcggacctgatcgtagtatttccgaacatgggtgaatgattcccgggatgcgacgtcgaaaaccaaaacgaagacttcaccctgtcgaatccattcttcgatcagcgtcgcatattgctctcggncggctgtatctatgatatcgaggatgcattcttgnacgtcgactacggtggacttgcggatactgtcgtccgctgtggcttcatgtgtgccggagaagtgatcgaggcanagctgaacttatcggttactgtt

SEQ ID NO: 4849 - DNA, 1146 bp, Aspergillus oryzae
  misc_feature (1)...(1146): n = A,T,C or G
cattttgctgccatcatgatgtacactttaagcaccttggtgtttctagcggggattctggggctctatgtcctcttgaactcaaaggcaccacgagcccctctccctccgggtcccaaaggtctacccattatcggcagtgttggtagcgatcttccgcgtggtgggagagattgggagcactggctgaagcataaggaattgtatgggcccattagttcgatcacgacagcggggcatactcacattattcttaacgacgccaatgtggcaacggaactgctggaaaagcgatcggcgcgatactcatctcgaccgagattggtgatggccaatgagctgtagctatctctttctttctagactgtatactaactacacaggggccatttaatagtgttgctaatatttacgtaacttcttccctagatctgggtcagacatctttgtcaccacgcaaaatgaacacgctattgtccgtgctctacgaaaacgtatactttcacagctgcgctcggaagaggtgttattatcgttttacccacaggttgatacgttgatccgacgctttctgctgcggacgttgcagaaaccagaggagctgatcggtaatatcaaaacaggaatcgggggagtcatactgaaggtcgtctatggttatactgtcgagtttcatgatcgagatccgctcgttgatctcgttggagagacagccgttgcattcggcaggataaatcagccaacaggttatctggtagacagtattcctgccctgaaatacctgccgagttggttcccgggggctgggttcaagaaagaagcccgggagtatcgacgcggattcgacacattgctcaattggccgttcacctttgctcggcgtcagatggaggagggcaactatgaaccttccttcgtgtccaggctgattgagcagagaggctcgctacttagcctggaggaggaggtgaaaatcaaacacgcggcagctgcagtctaccaagcggggtatgatacgacggcatctaccatcacatncttctttctggcaatgggcgctgtccctgccgcacagcacaaggcccaggaggaaatcgaccgagtcgtaagagcgaggttacctacgcctgaagatcgggtaaataa

SEQ ID NO: 4850 - DNA, 694 bp, Aspergillus oryzae
tttcgccagcataaaatttttaaatggcttctaacccacctggaccttgctgcgccactggcttcaagcatgaaggtaacccagttggtgagatcaagaacgtcaacggcgtcgacacctacattgtctacccccaggataagagcaccgagaaggttgttgtcttcctgagcgatatcttcggtatctatgtcaacgcccagctcctcgctgacgagttcgccgccaatggatacacttgtgtcattcccgatcttttccagggagacgccatcaagctcagcgacatggaatctggaaaagccgacctccccgcctggctccccaaccaccagcctagccacgtcgaccccgtcgtcgagtctactgttaagtacgtccgcgaggaattgggcgctaagcgtgtcgccggtgttggatactgcttcggtgccaagtatgtctgccgccacatgaaggagggcaagatcgacgttggtttcaacgcccacccttgcttcgtcacccacgaggagctcggcgctatcaccggtcctctgtccattgctgcctccgaaatcgatcagatcttcactacccagcttcgccacgagtctgaggagactctgaagaagactggccagcactggcagatcaacctggttagcggtgttttccacggttttgcttgccgcgccgacctgaacaataagat

SEQ ID NO: 4851 - DNA, 675 bp, Aspergillus oryzae
cctgtatcgacttttaggaacggcgatcggaacctctttgtgaacattgtacaacgttatataactagtgtcgtatacattgtgccgacgctatgacagagagcttgaaccctcccctctcatacgaggcatcagccacgacaacccatccgcatgtggcaagcacgctgccccaagaggtcattgcatgcttgaagaattcacgatttcttcatctggcaacatgtgacggcctgacccctcatgtctctctcatgtcctatacctacctgccctcgacgccttacgaccagtatcccacgatcatcatgaccacaaatccttcctctcgcaagacaaaccatcttttgaccaatccgcgagtttccctgcttatccacgattgggtgtcacaccgtccgcccacccgtgcacccaaccccggaggtcagcgcgacggatccccgcctccggctgcgacccgttcatccttggccaaccttctgttgaatctgaacacaagcgcgctatcaagtatctctaccaccatcgccggttcggctcgtgtcctggaacctggctctgaggaggaagcttggtgcaaagagcagcatctggagaacaacactttcgaggaggaaatggggctctttggccagcagcagcagcaacaacccggccaacggaggcccagtt

SEQ ID NO: 4852 - DNA, 795 bp, Aspergillus oryzae
caacaatcaaacacaagaacacaacagcaatcgactacagaccaaatacctctttccactactacttctatcaaaacaaacttgcctctgtttactctcttaaacaacctacctcaacacacagccaaaatgtctctcttcagaaccatgcctaccgctggagacttctcccctctcttccgtcttctggacgactatgacacccaccgccagagccgtggtcaggtgtccagcgtgcgctccttcgctcctcgcttcgacgtccgcgagaccgacgatgcctaccacttcgacggtgaactccctggcatctctcagaaggacatcgacattcaattctccgaccctcagactcttgtgatcaagggccgctccgagcgcgaataccactcccctgaagccggcgaaaccaaggagacagagggtgagagcaaggaagtggtaaagaaggagaacaacaagcctcgcttctgggtcagcgagcgctccgtgggcgaattccaccgcacctttactttcccatctcgcgtcgaccaggagaacgtcaaggccagccttaagaacggcatcctctccttggtcgtgcccaaggctgctgcttacactggcaagaagatcaccatcgagtaaacgagccacgagatgagacgagttacgaccttgcatgggagttgagcagtttgaacgttgccaacagtgatatttcttctttcgactttcgttttaatcgacaaccccccaagaaaaagaaaaagaaaaaaaaaaaaaaaaaattcctgcgggcgtgaattcttc

SEQ ID NO: 4853 - DNA, 709 bp, Aspergillus oryzae
cagatctcagcgcgcaacttccgatacgcctagcgacgacgacaacgacaaccagcccttcagcggaatcgccagttccataattcaagatgacgaagggtacctccagctttggcaagcgccacaacaagactcacactctctgcaggcgttgtggccgccgctctttccacgtccagaagtcgacatgtgccaactgcggttacccctccgctaaggttcgcaagtacaactggagcgagaaggccaagcgccgcaagaccaccggtaccggccgcatgaggcacctcaaggaggttcaccgtcgcttcaagaacggcttccagaccggcacccccaagggcgctcgtggccccgagagccagtaaatcaatcccgacgtcgcgttttcgttctcggaggctggagagggctggtatgataaggcctggcatttgaagtagccgagtttcaatgcaaggcgaaaaaagacgctttcccctggagttggtgttgggatggtctttccttttgccgtcatagcatgtttatcctagaataacgacgacaaatgaaagacggaaaatttcttggggtcttcgaaagggagtatcaaaagggaaagcatgcatgaatttccttgtttatggctggcgaatatcccatgtccgggcagatacaatattgagataaactccaatgtgatctgtctacccgcgttcaaaaaaaa

SEQ ID NO: 4854 - DNA, 693 bp, Aspergillus oryzae
  misc_feature (1)...(693): n = A,T,C or G
ggcaccatctggaatttttccaccgagagaccatattacaagatgatgctcagagaagtaaaacctaagaatccgcgcacggcgcgaattctcaaggcaaaagaaccccagctcattgaaggagccaagcgcacactgttactgcacggttcgaaatgcccgacaccgctccacacggtccttaaaactctccactccctgacccggccaaactcgatcctgttccacaagaagaatgagaatatccacccgttcgagagtgcagagagccttgagttcttggccgacaagaacgactgcggtatggtggtgttcggcagcagtaataagaagaggccgaattgcgtgactatcgctcgggttttcaatgccaagctgctcgatatgtgtgaattaatgttgcttcccagtccggatggagaccagattccttcgatgaacaaccttaccatgaatgttggaatgggattacggccgctgttgcttttctccggaaccccctgggatgatcctacgtcgtcggcgcatgttatgctgaagagcatgtttatggatatgttcaagggcgaaactaccgataagattgatgtggagggcttgcaatatgcgctcatggttgcggctgaggaacctaccgagggcttgtcgcctggtatccatctgcggtggtacaagatcaagacgaagcgcagn

SEQ ID NO: 4855 - DNA, 682 bp, Aspergillus oryzae
  misc_feature (1)...(682): n = A,T,C or G
gagccccgggctttggggcactccactcccgggggagtatatacactacacttcccttctacacaaccctatataatccctcggcgcacactctatacacatgtcgttctggaaagaaactttccttaattggcgtcatgccgtgccgaaaactgtccccggagatcgcgcatgccgcgcccaatcgaaacggcttcttacttattcctcacagagtcctcgagtgactgccccgaaccagtactcgttgtacgctaagagacccgggtatagtgtgagtcaacggcgggtatggaacggattgaaccctcaatgccgaagcttttcggcctccgcgggagttcagcatggccatatcacacctccgaaacccggagaggagctcaacatctctttcattgacaaggatggtgagaagtacgacttccaggtatccgagggggacaatttgttagacattgcgcangccaatgatcttgagatggaaggagctngcggcggttcatgcgcctgctcgacatgccatgtcattgtggaggaccccgacatgtttcgacagatggaagaaccatccgacgacgaanacgacatgcttgattttgcattccggctgacaaanacatctngggtgggttgtcaaagtatcatgagcaaggaactngaccgactanttgtccctctc

SEQ ID NO: 4856 - DNA, 732 bp, Aspergillus oryzae
  misc_feature (1)...(732): n = A,T,C or G
ncccgccgctcgtctgattcgcacgggcatataacccattctttccttatcacccacttcctggcatccaccatgtaccagaaacttctcctcgttcccctcctcctcacctcggctctggccagtcctcacgatgcctcttcgcaccagaagttccaccagctgaacgagcgcgccgcattccccattcccgcctccaagggtagccagacctttaaggaaccttactacgtcaagggtacctatgatggtggcatgaagaccttcggccgtggtgtcaagtgtaccggtcagaaggagggtggtgacaaggacgccgtcttcatcgtcgctgacggtggtattctccgcaacgccatcattggtgctgaccagattgagggtgtgcactgcgagggttcttgcaccattgagaacgtctggtggcaagaggtctgcgaagacgccctcaccttcaagggtaccggcaccggcgtccacaaggtcattggcggtggtgcccagggcgccgatgacaaggtcatccagcacaacagcggcggctctgccatcatccaggacttcactgtccagaacttcggcaagctgtaccgctcctgcggcaactggcaagaagcagcccaagcgtacccggcagatcaagggtggcaaggccagcaacggcaagaccctggtccggattaaccctaaccttggggaattgggcaccattgatggctggccccccccccc

SEQ ID NO: 4857 - DNA, 683 bp, Aspergillus oryzae
  misc_feature (1)...(683): n = A,T,C or G
gcgtccaagattcgccttgtgnaggcgaaaagaaacaaacttaaccatttcgatgttgatatgagcaagttcgaagccactgcgtcttacattgtgtccatcatcaagagagattatgctccggactatgattcgattcctccccatggtcgctggcaacacttcgatgtgggtggccgaccccgcatcaatcagctgctgcagtcctggcctagcacaatcgatgcgcaagaacgaactcggcgattaatcgacctctttgtcgtttccgtccttctggacgctggtgctggaactagatggtcttacaaatcgaaggagtcgggcaagttcttctcgcggagcgaggggctggctggtgctacacttgaaatgttcaagagcggacttttcagtaatgaacccaccgagccttgtcaagggggaaggcgccggcttgaaaaaaaatacggtaaaaccggctgctaagggcatgcaacactcggagaaaaacccattggcagggaatgaaaggcgggcgggaacccctgaatcgacctctggagggattggaacaaacaggaatttcctccgggtgggaagcagagtcacgaaaacatgcccgaacaaacttaccctcgaatccctcgagcaaaaccatcgacgagcaccaaataattcattatacaagaaccatgaccccc

SEQ ID NO: 4858 - DNA, 237 bp, Aspergillus oryzae
aagcgttggaacaacacttccgacgagagcaagaagctctactgtatctacgttgctgtcggtcagaagcgttccaccgttgctcagctcgtcaagacccttgaggagaacgatgccatgaagtactccattgtcgttgctgctactgcttccgaggctgctcctctgcagtaccttgctcccttcactggttgtgccatgggtgagtggttccgtgacaacggccgccacgccgtc

SEQ ID NO: 4859 - DNA, 555 bp, Aspergillus oryzae
  misc_feature (1)...(555): n = A,T,C or G
cgaagactagtcttgactcatctaggcccgctactatcaaggagtctgaaacgatgtccgttaagtccatgaaggaagtgccgaaaactttcatttcactggaggatatagcacaatatgagtctggcttccttgtcttcaaatttcatgaggtacacctttctcgcagcaatgtacaggtagaggtcttgatggacgactatatgttccccgcatacacatcacctaagatccgctccaagtctgccaaggttgaagacattggtgatgccttcgagcgtgagctcgagttctcgaaaattacgcttcggattgtggacaaggaggatcctaaggcgagcagtgacgagcatacagttgcgaaacttacaggcgatacgctttcgactctacaacgcattttgtacaacccaaccgaactaacactgcggtcggacagtggggaagtaagcaaggtcactgttagtgctcggtatatccctgtacatatgaaactngatccgtctgaaagcattaacaacatggggaaccttacgaagtggatgttcttgatgg

SEQ ID NO: 4860 - DNA, 1152 bp, Aspergillus oryzae
  misc_feature (1)...(1152): n = A,T,C or G
tcgaccgcgactggcagcggactggcaccaacaccaacactaacactaacacaggattgacagttctttcccttcggcgcgtctggatcgccgtgtcctcctccccgcctcctgtcttttgactggttggcttccattgtctctctttctcttatcgaatctgccttttgttttgatttcttatttccgatttctcctcaccccctcacctcccaccctttcatcacgcagacttctctgcctatgacaacaatgccagtcaagaagcgcaagtctgaaagcgtgcctgcggccgaagaaaacaattcccctaaaagagctgctgtccctgatccagctactggagagaaaaggaagagaggtcgtcctcgcaagtaccctgaaggaagtggccccaagccttcgccgggtcctaaaaggggccggggccgtccccgcaaggatccgtctgccagtactccctcgaaaccgagtactcctaaggagggcaagcggccagtcggaaggcctaggaagtatcctgctcagaatggagcagacaccccgacagacagatccacgcaaccgaaatcggagtcagcagatgccaaggctgaggatgaggcggatgaagatgattccggccgctcgtattggttgatgaaagctgagcccgagtcgcgcttagagaaaggggttgatgttaagttctccatcgatgacttggcctcgcgtagcaagccagaaccctgggatggtgtgcggaaccctgctgcaaggaatcacatcagagagatgaagaagggcgactacgctttcttttaccactccaactgcaaagtgcctggagttgcgggctttatggagattgtacaagaacatacaccagacgagtctgcctttgaccctgcacacccatactacgacgagaaatcttcccgagaggaccccaaatgggacgtggtccatgtcgagttccgacgcaagttccagaacttcgtctcactaaacgacctcanagctcacgcgaaggcgggnagatcactcgagaaccttcaggttctgaaacaatcccggctcagtgtttnccgcgtaccaagaaagaatggggactcatcctagggttagcccagggaaaggagtcatcgtcatcgggaggagagagcgcanaaa

SEQ ID NO: 4861 - DNA, 732 bp, Aspergillus oryzae
ggatattaccctcgttgctactactgccgaggggtgtgcctcatggtcgcaactacccgtaccttgtcgctggaggatggcgacgcaacgtctcgacgtacctactgcccacgcaccccatcctaactgatcgcgattgtttagcgacggtccaaaaaattatcaccgaaattctacctccttcttccggccagaccttttccaaagatgctcgcgatctccttatggaatgctgcgtcgaattcatcaccttgatctcctccgaagccaatgacatcagcgagaaagaggccaagaaaacaatcgcctgtgagcatgtagagcgggctctgcgtgatcttggttttggcgattatatcccggatgtccttgctgtggcagaggagcataaggagcagttaaagtcgcgagaaaagaaacaaagcaagatggagcagagtggactgtcggaagaggagctgttacgacagcaacaggagctgtttcgctctgctacggagaagtatcacgctgccccggagtaaatgtctgggttggacatgaatatgaaatgtgtttgactcttgctggtcatagagggaatgggttcggagttttgcctttcggatgagaaatcttggagtttaggttgtctgggattgaaaccatggtttctgaacgggttggttggtcttttagttcttctcttccataagtatagttgcattgatttctcgagtttcgccaaaaaaa

SEQ ID NO: 4862 - DNA, 672 bp, Aspergillus oryzae
  misc_feature (1)...(672): n = A,T,C or G
cactgtcctctggttatgtgtattcttcgtctcctttccaccattagtggggtggtctacctttggtaccatatctggctacatctttggggtatggaaaggatggtttctgtatgcatctgcgactgtgctgggatctacgtgttccttcgttgtttcgcggactatcctgtctaagttcgtcaacagaatgatggagcgcgataaaagattcgcagctcttgctttgacattgaagtatgacggactgaagttactgtgtatgattcgtctctgtcctttaccgtactcagtatgtaacggtgctgtttcgaccttcccgaccgttcagccattgatgtatggacttgccacggctatcgttacacctaagcttcttgtcccggcctttgtaggcagccggatccgtttactttccgagaaaggagaggagatgagcgcaggttctaaagccgtgaatatcatcagcatcatcgtaactgttgcgatcgggattttcaccggttggtacatttataaaaggaccatggcacgagctanagagttagaggctcaagaaagagccgatatacgtcgatcacttcaggccgatcatgctgaccgtcgccctcaccattccttctctgaggacccagatgttaacactgccgncacaactcttgctcgtgatgn

SEQ ID NO: 4863 - DNA, 720 bp, Aspergillus oryzae
  misc_feature (1)...(720): n = A,T,C or G
gcgttacggctctagccacatcgggccgaggtcttctctagttttaaatcatccactgcttgtctttcctccctttctcctgttaggatctcatccagagcaatcgcatctactacctcccttcgccccttcgtcggcacgcacttcaatctcactcgacgaactttttcctctacccccaccgttcgattcacaccttcatccaccatgtctgagggcaatgttgtgaagatcgaatccaaaaaggattttcaggagaaggttatcgaatccaaggaccttgtcgttctcgactgcttcgctgagtggtgtggtccttgtaaggcaattgcccctcagcttgctaggctcagcgaggagtatactggcgccaaattctacaagatcgatgtcgacgatctctccgaagtcgctggcgagcttggtgtccgcgccatgcccacttttctcttcttcaaggatggtaagaaggtgaatgaagttgttggcgccaaccctcctgccctcgtggccggcgtccagtctctggtcaagcaataaatgattgatatggggttgagggtagcatttgctttttcatgttagtttcgaagggaatgtgactccacccgttatatccatccctatatgacataaatatgaacttcatcgctatcgngnnnnnnnnnnnnnnnnnnnnnnnnnnnnnnnnnnnnnnnnnnnnnnnnnnnnnnnnnnnnn

SEQ ID NO: 4864 - DNA, 711 bp, Aspergillus oryzae
cacttttctccctccatgttcagtcgtctcagtcagttgacccgccacctcgctcgaccatcactcaattacgcttccacctcgccggtcgctctgccgcccttatcgatatctcaagctcgtgcctccaacatgacatcatccgcggtgcataactacacgaaaacgatacacacggcagcatgtctgatcattggtgacgaggtgcttggcggaaagacaattgataccaattccgcatatttcgccaagtattgcttctcccttgggattcagctaaaaagggtagaagtcattgccgatgacgaaagtgaaattattgaggctgtcaggcgcatgagtaacaactacgattttgtggtgaccagcggaggcattggaccgacccacgatgatattacgtatgaatccatagccaaggcgttcggcctaaagttgaaactacaccaaggcgcttttgaccgtatgaagaagctctccaagcctcacccgatgcaaccgcaatttgactgggataccccgtcgcccggtctaacagccaagctgcgcatggttgaacttccccacgatgatactctgtcggaggagcagcaggctacctttgtggctgatgatatgtgggtgccaaatcgccatcgtcaacggtaatgtgcatatcttacccagcgttcctcgtctgttcgagaagctccttgagcatctgaagcctac

SEQ ID NO: 4865 - DNA, 632 bp, Aspergillus oryzae
  misc_feature (1)...(632): n = A,T,C or G
tatctctgtaactttctactggaattttctccctaccctcatatttctcctagcttttatttcaaaatgggctggttctgggcagactctccatcgcagccaacacctgtggctccgagcccattggcatcctcgggcaccactccccccccagcatgtccaatgcacacgagcaactcgcctccggtgccatcctcagttcctgaaccacctactgcctgccccgtccggtctaaagattctcccttctatgtgccacctaagtcagatacgccattgccttctaaagcagaaaacaagtcaaccctatcaaagctgaaccctttgaactatatgttctcttccatctctcaggaacgagctccgaaccaaaccgtcgatttgtcgctagagcgtgaaccttcctctataccccgcggagatacggatggcaattgggagtatccgtctcctcagcaaatgtacaatgctatgttgcgcanaggtcacacggatacccctcaagatgcagtggaggcaatggttgcagtgcataactttttgaatgaaagcgcttgggaggaaatttgtggatgggaacgtttattctcgaaaggtctaaaaaaaagctgggcaaaatgtcnacgtggcgg

SEQ ID NO: 4866 - DNA, 646 bp, Aspergillus oryzae
  misc_feature (1)...(646): n = A,T,C or G
cccctccgttggctccaattgataccccagctctgtttggatccgtttgatcggggaagcagctcattactcttatttcctatcgccctcaatcctcccaatccggtctcccgtcattcacctttcacaatgtccggcaaatacgttttcaccaagggtctgaaggagctgcgcttccttttctgtcagacttcagagcacagcgctcctacaaggtccttcctgcagcgcgcatatcccaccatgaagaagcacaaccctcacgtccccattctgatgcgcgaggccagcggtactcagcctaaggtgtatgccagatacgcgtttggcaaggaaaaactcgagccattgaatggcttgtcggatgcacagatcgaagaaaaacttaccaagctcgtgaaggagtcgtcatagcgaattttccgcacttccgtatatgtccatgcatcgtgttcaaatcgtcaaccattgtatctatagatgaattggaaaattcaatttacttcgaacaaaanaaaacttaccaagctcgtgaaggagtcgtcatagcgaattttccgcacttccgtatatgtccatgcatcgtgttcanatcgtcaaccattgtatctatagatgatttgganatttcattacttcgaacaaa

SEQ ID NO: 4867 - DNA, 687 bp, Aspergillus oryzae
  misc_feature (1)...(687): n = A,T,C or G
gccatggtgcatctggtgagaccggtcaccgagttgccgagctagtgcaataatctcagcaataaccaactctgcaacgcttcgagagttgctgaatggagagttaaatacagcaatgccgtgttctgcagcatattggaggtctacttggtttgttccaatacaaaaacagccgacgactataagattccgagcctctttcaaaatacgagctgacagctttgtcttcgaacgtataccgatgacgtgtacatctcttgtagaacgcttagtacactataccaaagtaaggaatgtcaatgctggcttcgactcaccgaatcttttctatgagctgatcctcagggagtgatgactttaaaaactctacttgatagccttgctttgtaaggatatctcgccccgttcggattacattatccaaaagaagaaccttgatatcttcagtagcaaatggttacaaatgcttggcattgggcagagggatcgtgcggtttgtgaaaaccgagtttccatgactggatggggcggactgaaacgatgcgtttggagaaaggcctgaggcttgatgactgttgatttcttggggaatggctgacattgtgccaaaatatgcgagacttgaaatgaactatgcagaatgtactcaatggtgaatgaatggcatgtancacaataccgttatgt

SEQ ID NO: 4868 - DNA, 708 bp, Aspergillus oryzae
cggcatggtatcatctcggacaggaccaatgggaacggccaccgccagacggggagggcggtcccaacttttcctcttggacggatgaccaaaccggctggtggcaacaagccagtgtcgaggcaggcgatcaggatggcggatggggtattgttaacaagtacgtggatgccggcgcaggacacggggacatcgcgagaaaagtagcagcggaaggcatcgtcctagtgaagaacaacaataacaccctaccgctgtctcgtagcccgccgagtccttatcgcattgggatctatggtgacgatgctggcccggccttaggaccaaatgcgtgccccgatcgtggatgcagtcaggggacattagcgtcaggctggggcagtgggactgtggaatttcctttccttgtgagtcctctggaggctttgcagggtgcttgggaaaccgaagtcgagataaccccatatctgcagaatatggtgatgcccgtgagtgttcaagataaagacctgtgtcttgtgttcgccaacgcgaattccggcgaggggtatattcatgctgggggaattcacggtgatcgtaatgatctattcttgcagaacggaggcgacacattgattcaagccgtggctaacaactgtgtcgggaccgacagtggtggttgttcaccgctgtcgggcccgtcgtcttggagtcatggattgattg

SEQ ID NO: 4869 - DNA, 681 bp, Aspergillus oryzae
  misc_feature (1)...(681): n = A,T,C or G
gcttgtgctactaccgagtcgggcttcttagtttgagagcccgttatcattcatcatgcgtttcaacgcagctgttgcctccgctctggtttcttcggccactctcatgggctatgctcatgctgaggaggcggagaagaaccccgacgctacctctgtcgtagagaagccaactttcacccctaccaccctcaaagctcctttcctcgagcaattcaccgatgattgggaatctcggtggacgccatcccatgcgaagaaggatgactcccaaacggaagaggactgggcctacgtcggtgaatggtccgttgaggaacccactgtcttcaagggtatcgacggagacaagggtctcngtgtaaagaaccctgccgcccaccatgctatctncgcgaaatttccctaggaagaatgataacaagggcaagacccttgttgttcagtatgaggtcaagccgcaaaactccctcgtttgcggtggcgcctacttcaagctcntncaagagaacaagaagcntcaacgcccaggagttcttttacgcacccctaatgtnatcatgttcgggccccacaagtgccgtgctaccaccaaagtccattttatctttcggcacaaaaacccccaagactgcccagttcgaggagaagcaccttaaggttcctctgtgtgtttgaaca

SEQ ID NO: 4870 - DNA, 672 bp, Aspergillus oryzae
  misc_feature (1)...(672): n = A,T,C or G
gagccgtcatgcgatggccgccatgggcttccgaatcacaagcccgagacaaacaagatgaacaaaaccaaatgaactgggacaaatcactctgtgcgaacgactgggccgcgttcaccgaacctaggaccctaattcccaccctgatcctcacgacaggaattatcggcgcactgcagatccaccgccgatacctgcgccgtttccccgacgctgttagcatctcgccatcgtacttccggaagaggaccatcttaggccaagtgacgagcgtcggcgacggcgacggtttcagactataccacacacctggaggaagattggcaggatggggctggttgccctggaagagagttcccaccgcgaagaaggatctgagagataaaacgatctccgttcgcttggctggtgtggatgcgccggaactcgcgcatttcggtcgtccggagcagccttatgctcgggaagctcatgaatggttgacgtcttacgtccttaatcgccgtgttcgggtccttgtgcatcgtcaggaccagtatcagcgtgtggtggcctctgcgtatgtgcgacgggccatcgatttcccgatccgttttcgtcgtcgtgatgtctcgtatgagatgttgacgcggggattggctactgtgtatgaggcgaaggcgggttctgaan

SEQ ID NO: 4871 - DNA, 665 bp, Aspergillus oryzae
  misc_feature (1)...(665): n = A,T,C or G
gtgaggaggtgggagatgctttagtgagatatgtcaacgaaggtacaactttgggtgccgtcaaccttcctgaagttgcccttcgttccttgaccatggatgaaccggaacatgctcgagtgatctacatccatcaaaacatccccggtgtcttacggaaagtgaacgagatcctcggagaccacaacgtcgacaagcaaatgaccgatagcagaggtgacgtggcctacctgatggctgatatcagcaacgttgataataccactatcaaagatctatacgagaggctcgaaagcctttcatcccggattatgacacggatattatactaaggatatctcggtgtatggaagcctcacactaagatcatctattggtagatttgatttcggtagaacccacccctcaacggctcaagtctaccgtctgctaaacaagaaagttattgattcttatgctactgccgcgctggtttctgattaaatgactgaaagctttaggttantgattttgtcaagtggcgcccggataatggaaacatcagctatgctgttcacattcgacgcatcatactgatgtctacggagaaatgtttgttcaacacttcggccttgttgctttttttattcccttagtactttaagagtcctgctgaattgaaaaaa

SEQ ID NO: 4872 - DNA, 699 bp, Aspergillus oryzae
  misc_feature (1)...(699): n = A,T,C or G
gaagctgaccgaacagcggagccaaggaagacacctcgaaggtgcttatcgcccaaaacgcgcgagaagtagcggaacaatcgacagtgatagtcaccagccttccggaacccgaacacgtcaaaaatgtcttctactgtatgctccgccacggcgaactcccggccctagaaaaggagcgcttgtttatcgacacctccacgatcgatccagcttcgtcccgagaaattgccaatgcaatccacacaacgcgccaagggcgattcgtcgacgccccgatgtcaggcggagttgtgggggcccgcgccggcacgctctcctttatgttcggggcttcatcgcagaccggcgagctcgttgaccgcgtccagtccgttttgatgctaatgggcaagaaggcctggcacatgggtaattcgggaacaggcgtttccgccaaattagccaacaattatctcctggccatcaacaacattgccactgccgaggtcatgaatctggggatccgttgcggactcgaccccaaggtcctggccgatatgatcaatacattgactggtcgctgctgggccatggaaacaaataacccggttccgggcgggtcgagaccgcgccaccatcgggcgaataatcccgggggtttgggattaatttgaagaattaaagaatcttcgctggcgaattcccgttggggaggan

SEQ ID NO: 4873 - DNA, 780 bp, Aspergillus oryzae
gctcatggctcccgtctgcgaagctccccatcttcacaggcggccaatccagcaatactacggcaattgagtgttgccatatccagcacttctgaaaccatggcttctgctaattacgtatgcctcccgacgtgttgtgcgtgcgtggttgcttggttttaacggaagcagatgtctcctactttctcgacaacaacgccaacatggcaccagtttgagcggagggtcgatgaggtcaagccatccaagactgacattaactatctcgttatggactacctcatcaccaatggatatccagctgcagcgaagaaattcgcttcggaggccaacatccaaccaagggcagatgtagaagccattcaagaaagagtagaaattcgcactgccattcactcgggcgatatcaaagctgccatcgagaagatcaacgagctaaatccacagattttggatgaaaatccacccctgcatttttcactgctacgtttgcaacttgtggagttgattcgctcgtgcacatctaaacccgatggagatatcactcctgcccttgagtttgcgacatcgcaactcgcaccccgggcgcctacaaacccccagttcttggaggatcttgagaggacgctggcgctcctcatttttccccactgagaaccttacacccgctctagccccccttttacaccccgacctgcgtaaagatatagccactagcgtgaacgaagccatcctgcagaatcaaggcgctcgtaaagaaacccgattgcgcaacctctt

SEQ ID NO: 4874 - DNA, 672 bp, Aspergillus oryzae
cttgctggtattcagagaatcctgctacactttcaccccctcgtccgcgccacaccatgcctgcctccattcattttgagatctcggccactcaacgggcgatcaagattaagggccccgggcaagcctcggttgagaaaggatgtccggttcccgcttgtcagcctgaggatatcctggtgcgggtagtctgtgtcgctctcaaccctgtcgattggaagtctgccgatctctcgcccagcctcgatgccacctggggcacggacttctccggagaggtagttgtggtaggtgaagcctgtcaatcccgctttgcgctgggtgattcggtctgtggtgcggcctttgggaataaccccgaggatgccacccagggagccttcgccgagtatgtggccattcccggcgagctggtgtacaagatccctccggacatgtccttcgagcaggcagctacggtaggcacgggcttggctacggccggtctgacgctctaccaaacactcggtttgtcatggcccgatcaacctgtccaggacgcacagtatgttctagtctacggcggaggaaccgcgtccgggtgcttcatgatccagcttcttcggctgtccggctacatccccgtcaccacctgctcgggaaaaagctttgaccgtgtcaagcagcttgggg

SEQ ID NO: 4875 - DNA, 684 bp, Aspergillus oryzae
ctctcagctgtatcgtagcgggctccgaccgcatggtacacgccatcatctactccctgttgctaggattcggtatcacaatcggcaccgctgtatatggcctcttggatagcgacgcatcctccgattacacatgccccgccagtccgatcaccaacgaatacctccaacatttccccttcgtcattcctttcaccatctgccttgcccttgtcaaccacgccaagttgaagcaaatcccggtgatgatcgtcattgctttcgcggggtatgtcaccaactatttcggctccaagcgattctattcaagcacacaagtgtccaatgcgttgggcgccttcgtgatcggcgtcatgggaaacctctacagccgactgcgccacggattcgcagcggccgcaatgctacctgctatctttgttctagtcccatccggtcttgcagccagcggatccctgatctccgggatcgcatcggcagagcaaatcaccagcaaaatcacaccctactctgtcgttgccaacggcacacagggattcgtggatgcagcaaagaacatgaccacaacaacaagcaacgatcaattccacggagtcgtcttcgacatcggatacggcatggtccaggtcgcaatcggcttcaccgtcggtcttttcctcgctgcattggtcgtgtatccgcttg

SEQ ID NO: 4876 - DNA, 941 bp, Aspergillus oryzae
ttcacacagatcacaaagcgctattggtataaggatggttctgtgaacccaaaccatccgcttggaattgagaaactagcatcgaaagcagcgggccatatagggctgatgtatctccgtggtgaaggtgtagagcaaaattttgccactgctctcacttggttcaggcgtggagtgacaaatggggattcgctctgtcaacatcagatgggactgatgtatcttcacggatatggcgtgcagcaggacgctttcagggctgcatcgtttttcaagtcggcatctgaacaagatttccccgccgcagaaacaagactgggtgctttgtttttggaccaaggagatgtcccaacggctacccgatattttgagctagctgcccgctggggctggatggaagccttctattacctggcagaattgtccaataatggtattggtagggaacggcattgtggaatggctgcatcatactataaaatggttgcagagcgagccgaggtgatacattcatcattcgatgaggcgaacaccgcatatgagaatggtgacaaagaaagggccctcgttgcagccatgatggccgcggagcaaggttacgagcacgcgcaatctaacgtggcattcttgctcgatgagcagcgctctttgatgtcctttgatcgcatcctaccgggtgctaagaaacctcgaccgtctctacttcggaatgctgcgttggcccttatctattggacacgttccgccaaacagaccaacatcgattcattagttaagatgggtgactattacctgggcggtattggtattgctgcagatgcccagaaagcctccagttgctatcatagtgccgctgaagtccattatagtgcacatgcgtattggaagcttggatggatccatgataatggcatccccgtggaacaagattttcacatggg

SEQ ID NO: 4877 - DNA, 747 bp, Aspergillus oryzae
cgaggcgacaaccgtacctgagccctttcacgatcccttttaggaggctctgtcaagatgactgtccagaaccacagtttggcctcttcccgccggaagtcgcgcaaggcgcacttcaacgctggctccggcgagcgccgtgtcatcatgagcgcccctctgagcaaggaactccgtgagaagtacaatgtccgctctctccccatccgcaaggacgacgaggtcaccattgtccgtggaggccagaagggccgtgagggcaagatcaccagcgtttaccgtcttaagtgggttgtccacgtcgagcgtgtcgtccgcgagaagtccaacggccagagcgttcccctcggtatccacccctccaaggtcgtcatctccaagctccacctcgacaaggaccgtgagcagatcctggagcgcatcggaaagggccgtgaggctgccaaggccaagtctgcttagagggttttgtccggggtttaagttcatgttgcaatggcggtgacggcgctggagttctgaaagactcgccaatgcgagatccaacctcctatgatcaggatatatctgctggaatgaaaaacgaaaaaatctacttcctcggttcatggtctgcgccacggattttcaagccgtagtgttggactacttccccttcaagcgtatttagggataatctaccggcagcgactcaattgtcagagggccgttttccttttttgttcaaaaaaaaaaaaaaaaaattcc

SEQ ID NO: 4878 - DNA, 654 bp, Aspergillus oryzae
ccattcttaccacttactcaataccacagtatttttctaatctcttctgacaaccatgtccggacgtctagaaggtaaagtcgccatcataacaggctccggctcaggcttcggccacggcattgcaaagaaattcgtcgaagagggcgcgaaagtcatagtcgcagagatatccaaagagaacggcgaaaaggtcgcagcagagctcaacagcaaattcgtctttgcagacgtaacaagccgagaatcctggcaaacattactccagacagctctggacacgtacggccagctggacattgtagtcaacaatgcgggggcaacctattccaataagcccacaggccaggtcacagacgccgactttgacctatgcatgaacgtcaatgtgaagtcgatctacctctcggcgaacgtcattgtaccgtatttcgaacagaataaccgtcccggatgttttgtccaggtttcttctaccgctgcgcttcggccgcgccccggcttgacctggtataatgcttccaaagcggcggttagtattgctaccaagacgatggctgttgagtatgggccaaagaagatccgattcaattgcgtttgtcctgttgttgggagtaccggaatgacacatctgtttcttggaaaccagatacg

SEQ ID NO: 4879 - DNA, 662 bp, Aspergillus oryzae
tatttcaaggttgcattaccataaacagaccgctttctttcccgcgagacgtgatcatatccacccgccctttcccctgattcctcgtatagcgccccgagtcccttgagtcctttctagccagcaagcctactttaccaccattcggtggctgcagctctcctgcagaagaatcactgaagtgggcagggaatcagagcatcgatcgataaccttctcttttctctctcgaagggcgaaaaaaggataaaggacaggaggaaagatactgcggtggtgcccgagaaactgagtttcccgacaatattaccggaccttctgtcaagagctactatctcgagacatatattttttttttttggcgtacttgacttattccatcgttcccttgatctgcgtagctcaaactaacgccacttgcgtctacttcatcatggctggtacaagaaactatgatttcctgatcaaacttctgttgattggtgattccggagtgggaaaatcatgttgtttgttacgattcagcgaagattcatttactccatccttcatcacgaccattggaattgacttcaagattcgtacaatcgaacttgacggaaagcgtgtaaagcttcaaatatgggatacggctggacaggagcgctttaaaacgattacaa

SEQ ID NO: 4880 - DNA, 680 bp, Aspergillus oryzae
gaagaatgtgagaaagcatctgccatggcggtgcatacgctcattagtatggcacgtggtggcatccgtgatcatattggacatggcttcgcaagatacagtgtcactgctgactggagcctacctcattttgaaaagatgctttatgaccaagcacaactcctggatgtatatgtggatgcattcaagataacgcacaatcccgaactgctgggcgccgtgtatgatttagctacttacctgactaccgctcctattcagtcacccactggcgcttttcactcttcggaagacgcggatagcctgccatcaccgaaggacacggaaaaacgcgaaggagctttctatgtctggacattgaaagagctgacacaagtgctcggccaacgggatgctggggtttgtgctcgccactggggtgtgcaccctgacggtaatatctcccccgagaatgatccacacgacgaatttatgaatcagaatgtgctttccgtaaaggtgaccccgagcaagctcggccagagaacgaggagcgggaaagaaagacggccagtggccggacattccgggtccagagttaggcgtattgtatattttgtttctaggcaaaagagccggaggtgcaacagcaagcccgcattgtgattttattcaaaatgtatagactgcagcaaaaaaat

SEQ ID NO: 4881 - DNA, 668 bp, Aspergillus oryzae
gagaccactccccctccacccgaacaacaaacaacaagagaacccccttccctcccgacctcacctctcgccaagcgtcccaagcccaacaccaccgaagaccagtccaaaatgaccaacagcacccccgtcacctctatctcgcagcctctgcccccgctgctcatcaagaagctgaacgagggcggtcgcgccccgacccgtggctcggccttcgccgccggatatgatgtctacgctgctaaggagacggttatcccggctagggggaaggctctggttgatacgggtattgccattgctgtgccggagggaacttacggccgcatcgcaccccgcagcggcctcgcagcgaaacacttcatcgataccggagccggagtcattgatgccgattaccgtggtgaggtgaaggttctcctgttcaaccactccgaggtcgattttcccgtgaaggctggggatagggttgctcagcttattattgagaggatttatacccccgaggatatggctgtcgaggactaggatgagactgatcgtggtgcgaggaagctttggaagcactagtactaactaatgatgatatgattggggtttggatgggggtggggttttatcatatacattggcgttggagaaatagaaaaagaacttggatttgatct

SEQ ID NO: 4882 - DNA, 652 bp, Aspergillus oryzae
ctcacacaagccctggaattccttgataatcaccaactgcgggagaatgtaccagatcaggagaagtgctaccgtcagcaccgaaagggcgcatggcccttcagcaacaaaactcagggctatacagttagcgactgcacagccgagggcttacgttcaagcattcagcttcaagagatgcacaactatcctaaactgatatccacacagcgcttaaaagatagtgttgactgcttgctgctcatgcaaaatccttctggcggttttacagagtatgagaccacccgtgcgtcgcccaaggtggagtggttgaatgccgccgaggttttcggcgggattatgattggttacgactatcctgaatgcaccactgcctccgtcactgcgctgtctttagtgaggaagttctatccctattaccgatacgacaccatcggggggcgtagacaaaccgtctgtgtagcatgaacatgtctaaacgctacgagagggcactatgcagcgtgtgtccttgtactagctgcggggatggggactcctaagtgtatcgagattggaaaacctatgaaacgggactgtcccgatcggttgcgatttataattgtacggtaggaaatgaagttggtgcaatctgactaacaaaaaaaaaatt

SEQ ID NO: 4883 - DNA, 675 bp, Aspergillus oryzae
caaaacgcatctttaaaccttgttgaagctgcgacttcggccgccgggcaatagcactgctacaccgtactccggctacgtagctatatccctttcttgagccaatttatcgttgttttcttggtcgcaaacatagtagctcctctagagagagcttcatcatttctcccgttatgtgccgttttctggtatacaagggccgacatgagatacgtctcagcaaactagtaacagagcccagtcattcaattttgactcaatcctatgattcccgtcttagactggataaccgccgtccagtaaacggcgatggctttggagtagggttctatacggaccccaagctcggcccagagccatgtatcttcacattcacactcccagcctggaactgtgagaatctcgagcggttagcatccaaaacctgctccaatctgatcttcgcgcatgtgcgcgcaaccacagaaggagccttatcagaaaacaacttggcaccccgttcaacacaatactttgatggggaagcgccacggtaaccgttgggggctggcaatatatcaagcggcccgctgggcgaatccctcgcggaacgcctgggatttgggcgtgaaaagggggacacaaaaagaggggggttttgcgcgggtccttgacttttggaaaagaagggggtcg

SEQ ID NO: 4884 - DNA, 671 bp, Aspergillus oryzae
  misc_feature (1)...(671): n = A,T,C or G
gaatttccccgaagatgaagaggtgtcgtggctcgcactggcgcaaggagtgtttaacactcaggcggagagagatgggacccggatacttgccatggtggcctgcggtggcagagaaattcgtggaatggagggtacgatcttaagaattccgtctccaacggagggttcttccagctcgctgctcgtcttgcacgatataccaagaatgaaacttatactgagtgggcagagaaggcgttcacctgngccacatctgttcctttgatcatcgagaaagggtggactatcaatgatctggntacngtggaatcgaattgccaggcacctaaccagatgcaatgggtcttacattatggcatctanctttatggggctgcgtacatgtataactttgaccaatggcgatacgaaatgggnaaaatgtcnntggaaggcttattgaatactacatggcgcaatttcttcccacaggagtatgggggtaacatcatggttgaaccatgcaagcctcanaagcaaggatttgtaccatgcaatggcaatcagtccccattcaagagtttggtcaccgcttggctcgccttcacgaccactatatgccccgaaacctgggaccaattttggcccaattacaggggtctggcaagggagccccaaaacatgtttcg

SEQ ID NO: 4885 - DNA, 701 bp, Aspergillus oryzae
  misc_feature (1)...(701): n = A,T,C or G
cgccatttccctccctatcgtttcttcttcgaacgccttctaaactttttcaaaatggatgactggaattctactacccgcattggaagcaagcaccgtgctggcggtgccgctccccgtgagactgtcgtcaagggcaagagcgctttgaacgccgctcagcgccaaggtcttgttatcggaactgaaaagaagtacgccactggcaatgctgcttccaaaactggttctattgaaggtcagcacctgaccaaggtcgaccgcagcgacgacatcatcaagcccaagactgttgggtaccaagtcgcagacgctatcaagaagcgccgtaccgaggagggctacaagatgacacagaaggaacttgccaccaagtgcaacaccactgtcaccgttgtccaggacttcgagaagggtaccgccacccccgaccagaaggtcctcagtgctatggagcgtgttctcaacatcaaactgagaggctcagacatcggaaaggagaagttccctaagaaaaagtaaattgacagggggtgagcccgcggctttttcttgacgggatggaatgctttttatgaaaccattctctttcttccttctctttcatgatgtccccggatgtcctttcngttgttacgttaatgcattttatttgtgcatgagatccccattactttctgcttgtcggaagagcgttgacc

SEQ ID NO: 4886 - DNA, 740 bp, Aspergillus oryzae
ctttgcgaccaagactccctcgtcaccaacccccctcaaatcaatcaccatgtctcccgctactgctcgtggtcgtaaggcccagaaggtcacccacaagttcaccatcaacgcttctcagcccgtgagcgacaagatcttcgacctctccgctttcgagaagttccttcacgaccgtatcaaggttgagggccgtgtcggcaacctcggtgacaaggttgtcatctcccaggtcggcgatggcaagatcgaggttgtttcccacattcccttctctggtcgctacctcaagtacttgaccaagaagtacctcaagaagcagcagctccgtgactggcttcgcgttgtcgccacctccaagggtgtctacgagctccgcttctacaacgtcgccagcgaggaggctgacgaggatgaggagtaaatgtctcccactctcggataaaagtgaaaaaattggccaggctcgagtacgctcacatcagggggtttccataattggacgggagcaatatcttaatgagagtccgtgccttgggtccggtttggagggtacatagatgcggttggtcgggagcgctccaacacggctctgctacgtgatatgtacgccgggttgactcaacctgaaaaaaaggcggcattcccattggctagccctcgtcgcatccccgtgttggtgtaatacttctactcatgacgttacgactggtagattgaattgatccatctatcacccc

SEQ ID NO: 4887 - DNA, 530 bp, Aspergillus oryzae
cttaacaaaaggggcccatgttataatccgtgggaggccctgtaaaattctcgagatcagcaaaattggaaccaatatccatctggtcgcccgagacatttttacggatagaattctgtcggacgatatcgaatctactcagtctgtggagattccgcatgtatacagaaatgaatatatgttggttaatattgatgaggggttcctcaatctcacgaaccaagatgggacgatgaaagacaatgtaaaagtccccggtggtgggttaggacaacagattgagcaagattttgaagcgggaaccgacctgctcattgccgttatctcagcgatgggtgaagaacatgctgtaagtgtgagagaagcccccaagggttcctaaagagggcttcttcaggtgtcgctgtgattgcctgaggcaccaacaatactcctccgttataatgcttttcagagaaaacaggaaattacccaattttatctaggtcttagacatgttatccatctagaaatgaaataggtgatagtcc

SEQ ID NO: 4888 - DNA, 663 bp, Aspergillus oryzae
  misc_feature (1)...(663): n = A,T,C or G
ctcatctcaatcgaaattcatgacctcgataaggagaagccaccagctcttggggagctgggacacgcgagacacttgcctccgccttttgatttcgagcgactgacacgatttatgtcatatggtttcttcatggcaccgatccagttcaagtggttcggatttctatctcgggcattccctcttaccaagaaaaacccgaccattccggccttgaagcgagttgctgtagatcagtttctcttcgcgcctttcgggctggtgtgttttttcacattcatgacactcgctgaaggtggtgggcgtagagccttgacacgcaaattccaggatgtttacctgcccactcttaaggccaattttgttctctggccagctgtgcaggttcttaacttccgagtcgttccaatccagttccaaatcccatttgtgtcctctattggtatcgcttggactgcgtacttgtccttgaccaactcttccgaggaggactgattaaatcacctgtgatgatgatatgaatggtttcnggagggtttcggatcgtcagtcatttcacatttgncgctcctttgtcttttttttggtcaatagaatggtttcctggcgttgtatattgtccttggggttctgctggcctatcttaggctggtggctaagctt

SEQ ID NO: 4889 - DNA, 657 bp, Aspergillus oryzae
  misc_feature (1)...(657): n = A,T,C or G
gtaattatttcgccgccgttatcttcatcggtgtcgtccactaccagcgtctccgtcacatggttaacgacaagttccaagtccgtaccaccggtcccgtgaactcgctgaccggccaacccgtcaagggtcgtgccaagggaggtggtatccgtgtcggtgagatggaacgtgactccctcattgcccacggtgccgccttcatcctccaagaccgtctcatgaactgctccgatactcagcgtgcctggctctgccgcgactgtggctctttcctctcgacacaggtcgccctcgccggtggctctggaaaggcccgcaaccagggcgcaaccgtcgcatccgcaaatgctgcttctagccagcttactcatgccagcggctcctccggcatcgtgcgctgcagacgctgcgcccgtgaagctgtctttgatgactcccgtgccatcacctgggaagacngtgacggccggcgctacgtcggcggtgataacgtcactggtcgtgctgtttcgggtgtgctccggtaccttgatggtgagcttgctggcctgggtattaggatgaagttcaaagtggaccactaatcggcccggttcacatgaaagaaggtattatattccgcttttcagggcgaagttggaaaacccagaacgg

SEQ ID NO: 4890 - DNA, 690 bp, Aspergillus oryzae
  misc_feature (1)...(690): n = A,T,C or G
ggagatcacccatgacttcctttatgaaaactatcgtaccgagaagctcagtaagagcgttgacggtgccactcctacccaagattcgtcgatgaacccagaagacctagcatcccagtccgtccgcctgaaggaggaacaactccgtcgtgaggaggagaaactccgcgagatcgaactccgggtgcagcgtgagattgctgagaagcgccaggaattgttggctcgtgagagccagctgagggagatcgaggctcgtatggcacgcgagtccagcagccaggacgtcgccaatggtgatgcttaattcaaacttgtcaaagactagtcttacgttgcgcgtttggcaccaaccgtgtcgacgtaatggaatttatggcgcggcggttgtactcaatggggttaatattgattttcttattcacgttaataacttcgtttgaaagggagggaagggaaaatgcaacgctccgttaatcgcgatgactggcgccattcttccctttcctacaaagagggattcggacaagagacgacgaanattgctgcagttccccacctacttttccagctctcattgatttcttctctggcttcatccattcggctgggggccttgcctcgtttcgcagcccgtgtttgtgatgctcggggtcaaagatagcattctttaatcgttgacagttgtcc

SEQ ID NO: 4891 - DNA, 695 bp, Aspergillus oryzae
gctcgcggtcctttcaacccctgcgtcaatctttagttacactggttctttgactttgtatcagttctggggtgttctttattcttcgaaccaagcttcccagctttcatcatctgacccagtagagctccgtctatccgagagctcctaccatctttttgaattttccccttctacacttgctctccggtcctttcaaaaacaatctgaaacgatgggtagcaaaaggatagccaaggagctagctgagctcacggagtctcctccagagggtattaccgtcgagctagcgaacgagtcggatatctaccaatggaaggtttacatggacggcccagaagggtcaccgtaccacaatggcagattcctagtcaagctcagtcttcccaccgagtaccccttcaagccgccatccgtttcgttcgggaccaaaatttaccaccccaatgtgaccaacgatgacaagggcagcatgtgtctgggtatgctgcgggccgacgaatggaagcctagctccaagatcgcggcagtgcttgagttcgcgcgtcagctgctcgtagagcccatgcctgatgatgctggcgagggtcgtatcgcagaacagtacaagaatgaccgggccccgtatgaccgaaatcgcacgggagtggaccaggaagtatgcgatggcatagggtggttctctagaagcgcga

SEQ ID NO: 4892 - DNA, 645 bp, Aspergillus oryzae
  misc_feature (1)...(645): n = A,T,C or G
ggtgctgaagaatgtgcgatctgtagatacgaagactaaaattctcggaatcgacagtagcttgccattattcgtgagtcctgcagcaatggcgaagctcattcatcccgatggcgagtgtgctattgctagagcttgtggaaaccacggaattatgcagggaatctccaataactcctcgtacacaatggaagaacttagagacaccgcaccttcggcgagcttctttttccaattatatgtcaaccgagatcgtgaaaaatcagccgcgcttctccgtcaatgctcagcaaatcctaacgtgaaggccatcttcgtgacggttgatgcagcttggccgggtaaaagagaagcagacgaacgtgtcaaggctgatgaaggcttatccgtaccgatggccccatcgaaagcaaagaacgacaacaagggaggtgggctgggacgtgtgatggccggtttcatcgaccctggattgacctgngaggacttggtgtgggtacgacagcatacgcatcttcctggttgtctaaaaagcttgatgtctgcagacgatgccatgttggccatggaagccggccttgacggtattctacttagcaaccatggngggcggaaccctgacactagccctccttcgatcattcn

SEQ ID NO: 4893 - DNA, 577 bp, Aspergillus oryzae
tatggctggtccgaattccgcacgaggctcgtgcatgctacttgtcacctagacctcagaacctgtcgccgtccctttttactcgcatcggaaccgcctccttttccagtactagtatacatcaattcaaaaaagccatgtccccatcaaacgatgcgaccagcgcgggctcggatcctagaccggtgttcttctttgacatagataactgtctttactctagaaaatgtaacatccacgatgaaatgcagaagctgattcatcaatttttcgtgaaacacctctccctcaacggcgaagacgctcatatgctgcacaagaaatactacacagagtacgggctcgcaattgaaggtctcactcgccaccacaaaatcgatccgcttcaattcaacagcgaagtcgacgatgcgctgccgttggacaggatcctgaaacccgatccccagctgcgcaagctgctcgaagacatcgataggagtaaagtgaggttgtggcttctgaccaacgcatatgtcactcattggaaaccgggtcgtgaaattgctggagagggatgaccagttcgaagggctta

SEQ ID NO: 4894 - DNA, 649 bp, Aspergillus oryzae
  misc_feature (1)...(649): n = A,T,C or G
gaagtggaaaggattggaaagcctgtacctgtggttactgcggaggtctccgaagacatcgaaggccttgttaagcgtcggatccttgccagggaatttgatgaagttatccgccgccgccctggtatcactgatagccaagttgcgagaaagagtcgctttgagcttgaggattctaaagctcaacagagccttgcagagctatatgagactgatcacctccgagctactgatcctaactatgtggatcctaagaatcagaagcttctgcgcgaacacaatgagatcagtaatctatggaaagaaataagctcacaattggataccctctcgaactggcactataagcccaaaaccccacacgcacacatcaacgttgttaccgatgcggcaactattatgatggaggatgcgcaaccaacagccggaggtgctgttggtagtgcagcaactcttggcccccaggagatctatacacctggggctgacggcaaggcttctggggaagtagttttgaggaacggattgtcagtttccaaagaggaaatgaccggttaagagaagtcaanatttacgggacaacacaagaagccaaaggaaacttcccccaagcttaaaacccgaaattcggaagggattttagggaaaa

SEQ ID NO: 4895 - DNA, 634 bp, Aspergillus oryzae
  misc_feature (1)...(634): n = A,T,C or G
atcgtccaccaccactacctgctttctttcgaaggctcatactattccctcagtcgaaaactacgattgcaggaaaggaaccctacacccaccatgcgattttccgcaacaactctcctgatcaccgcgctggggtggatgaccgccgtgaccgcacacaccatccagcttaaggctcactcgagagaatgctaccacgaatcactccacaaagatgacaagatgacggtcagcttccaagtcggtgatcgggaattcggaggcagtggcaatctggagatcgacttctgggtcgaggaccccttgaacaaccgccagtactataaacaagctatctcctccgaggactactcgtttgttgctcacgcggatggtaaatatgtctactgcttcagcaacgagggatggacttcgaactctaaagaggtatccttcaatgttcatggaattgtctacgtccccgaatcggaaatgccccaagatcctttggaggtggaagttcgtcgtctttcggaggcattggcccaggttaaggatgagncatcttatattgtggtgagagagcgggtacaccgaaacaccgccgagagcacaaatgctaaagtgaagtggtggagtatcttccagcttgcgg

SEQ ID NO: 4896 - DNA, 969 bp, Aspergillus oryzae
  misc_feature (1)...(969): n = A,T,C or G
cggttctttgcggatcctggccccaaccttgcatcggggtctttgtgttggattctgcatccctcccgggaagcacttgaactcactagctatagctggtgcgcaggaataaagagaacttctgaaaacagaactctaagccccaccttggactacacgcggggacatttatcgtttagttctggtcgttcaaaatggcgttgccgaaaagaatagtgaaggagactgagcgccttatggcggagccggtccctggtatcaatgctgtgcctcatgaagacaacctgcgttatttcgatgtatcgatccatgggccggcccaatctccatatgaaggtggtatcttccgtcttgaactgttcttgcccgaagattatcctatgactcctcccaagattcgattcttgaccaagatctaccaccccaacatcgaccgtctcggacgtatctgcttggatgtcctgaagaacaactggtcccctgcgctccaaatccgagcggctgtcctgctcttctttccttcttctcttgacagttatctaacagtcactctttctgattgtaccttcttcattccttccaccatgaaagccaccatcttagcgactatcgctttggcggcatgcagtgccgccagccccttgggcagcgctccccacgcccgaggcctccttggagattcatccaagccctgcgactgtgaatcggatcatgatggcagctcgcctgaggtaccatctgggcctggttcggagggccctgctcccgttccgatgccggttccagttcctgttcctggtggagagccaaacggtcctggcggagtcccaaccgttcctggccttcctggtattcctggtgttcctggtgttcctggtgttcctggtgttcctggacaccccaaccaccctgaagacccagaggatcccgaagatccctgagatnctgaagacccggaggatcctgaag

SEQ ID NO: 4897 - DNA, 769 bp, Aspergillus oryzae
  misc_feature (1)...(769): n = A,T,C or G
gcaaagagatacttagaaagacaaggtcgcactttggtaccttcctacctgctcacactgaccactttcagattttcggcaccactaattgatccaacaaacacctggccatttcatctcagctccttctcgagcactcacactcaaaaccatggtatcacaacgggataaagagctgctcagagatgatgttcgtgcccggggaacaaaacttagtgctgctgatcgtgagagccttttgaaaccatacctaccagatccctcggagcttccacttcggccaccgcagcggcgcagaaaaacatcgcccaggaagacacctatccggactttcctgaagtcgcaactgcaccagctgacctacactctcattcacattttctttggtattgtcgttcgcctcgtccagagctatcatgccgtcgtagatagggtgtttgccatcgtctattatcaccaccgcacccccgaattgatcagaaaggatgtgaagaatttggatcgtttgccggagcacttgagtgttatattgtcactgcggcaagaggaggattctttaacgattttaatggatgaagtggcagaacttgctgcgtggagcgtcagtgctgggatccctgtgttaagcgtttatgagaagagtggggtcctaaaatcatgcattcccacactgcaccgcatcgttacaaacaagctctctgcgtattacgggtcttcttcccaacaaccaacgttgggtnttttgcccctcaccacctgtgtatcaacc

SEQ ID NO: 4898 - DNA, 656 bp, Aspergillus oryzae
  misc_feature (1)...(656): n = A,T,C or G
cgaatcaattgaagcccgcaatcctcgagacgttcggagacattgctcaggctatcggaacacactttgacacatacctttctgtcgtcgcccaggtcctccagcaggcatcgatcgtaaccgccagctcggacgttaatatcgaaatgctcgactacattgtttcgcttcgcgaaggaattatggatgcttggggtggtattgttttgtcttataagggcaagcctcaagtgacttccctccagccttatgttgaatctatcttccagctcctccacctgatctctcaggatctcaaccggagtgaggggctgatgagggcctcaatgggtgttcttggcgacatcgcggaggcgttcccgaatggagagtttgcggccttcttccgtaacacctgggtcacggacttagtcagagacaccaganacaacagagactttggcgcgaccacagttgagactgctcgctgggctcgtgagcaggtcaagcgtcaggtcactctgtctacggccgcagctatggcataagcatggactctcgcactcgcaaagccttttattgcttttgtcaaaccaccctnctcggagcaaggcgcccttcaagcgcactcaaagaagtacgccgggaaccactggctccaattccatatgggaatn

SEQ ID NO: 4899 - DNA, 645 bp, Aspergillus oryzae
tcgagtgtacccattgtaaactcggaaggtgttgtatacaacgtcttcgaatcagttgatgttatcacattgatcaaaggtggtgtatacgatgacttaagtctaacggttggagaggcattgaaaaaacggtccccagacttccctggtatctatacatgctcgttaaatgatggtctggatactatctttgacacaattcgcaagtctcgtgttcaccgcctggtagtggtggacgaaaacttccgactaaaaggcgttctcacattgagtgatattctgcaatatatccttctagaaggcgaaaacgacgaatcgtcctaatgtaatccagacatcgcgctcaaggtgcctggtgcacaattaaaacttgcatgggaatggcgttaaattctgctttttacggtcagtgaaatggtctattgtgaaggattcaacggagacatggttacgttcaaatcgcccttctcgtctccaactagggcatggactcttgacttgcagtgcacgaggaaacaaggtattgtatgatgggttaaatttctattgggttggcccttcgcttgtcgggtttacgttttggccacgaattcagaattggcgtttggaatgaccataatagaatttttcttttatgcctgggtg

SEQ ID NO: 4900 - DNA, 570 bp, Aspergillus oryzae
  misc_feature (1)...(570): n = A,T,C or G
tcaacgacatcttcgaattcatggaagccatggacccctcggagaacaaggagtacgctacactggtcaaacgccttggtttggacaacaagcaattggcacaagccgcagccttcaccaacgacaagtaccccaacattgatatcgacttccaggtcgaagatccggacgatatcactgctggcgagcctgcgtacctcaaggttaagatcgaacgggaagttgaagaagacgaggaacctgatatgacggtacacgcgcccttctacaccaacaagaagatggagaactggtggttggtggtgggagatgagaagaccaagagcttgcttgctatcaagcgagttaccgttggacggaaattggagttgcgtcttgaatacatcgttcccacccctggcgagcatgaattgacattgtacctgatgagcgacagctatgtcggtgttgaccaagcgccaactttcaatgtcaccgccgccgagggaatggaagaggacgagagcgaggaggaagacgaggagtanaggagagaatccatcagagatattttgatttgtttatttgtta

SEQ ID NO: 4901 - DNA, 673 bp, Aspergillus oryzae
tgctatcgttgccgtgaaaaaggtcattggattcaagcatgcccaaccaacaatgatcccaagttcgatggcaagtaccgagtgaaacgttcaactggtatacctcgttctctgcaaaccaaagttgaaaagccggaatcgctcacgatagatggctccaatgaagatttgaagaatacaggcgttatggttaatgctgatggtgattttgtcattgctaaaccagacaaggcggcttgggaattgtaccaagaaaaagctaaggcttcagccgctgccgccgcggaagctgcagctgcagaatatagcaaggagttgcaagcacgtgggctagagtgcccaattgataaacggatgttcttagaacccgcaaaaaccccgtgctgccaaagaacttactgcaatgactgtattacaaatgcattaatcgagagtgatttcgtctgtcctggatgtggaacagaaggtgtcctactggataatctgtctgcagacgatgacgctgtcacacagattaaggcttatgaggctgagaagatggatttgaaaaaggaaaaagagaaacaatcggcagccccagagaatcagtcaaacaacaaaccatatgcctcaaccgacgatttcaagtgaaaaaactgagttgtcgtcaacaggcctcaactggggaaaattt

SEQ ID NO: 4902 - DNA, 1365 bp, Aspergillus oryzae
  misc_feature (1)...(1365): n = A,T,C or G
gtttagcggggcccggcgattttccagcgccattttccagactctgcagtcctgcggtccacaaaataattgctctcccttatacagtcgtccctgtcccctctcgcattttaatcctaggcgctcacccttcctttctcgacgtttcagtacgaacacccccgtcgcagctatggcatctgctgctgaccttactgtcgccgtggaggggctcaagctccagtccaccaccgagacctcgaagttccccaactcctttccttccctgaaccccgtcgatatctacagagagcatatcgccgagaagctgggtgcggctaccggcatcgattccgagaagatctatactcgtctgcaatggagtagcacattggacaagggtgatttgttgctgccggtccccgccttgggtatcaagggaaagaagccccaagagctgtgcgaagagcttgcccagaagttccccgagtccgacctcgtgctccctcctacttgtgttggcatccacttggtggtcttcttcaagccgcaacccttgacccatactggtgtgagccgcatcttgaaagagaaggcggcctacggtacaaatggcaaccagggtctgcgtgacccctcggacccttccaagggccagaagaagataattgtcgagttctcctcgcccaacatcgctaagcctttccatgccggtcacttgcgtagtaccattatcggaggtttcctggcgaacctctacaccgtcatgggatgggatgtcatcaagatgaactaccttggtgactggggtaagcagtatggtctgcttgccaacggttacaagcagttcggtagcgaagaggcgctgaacaaggacccgatcaaccacctgttcgatgtttacgtcaagatcaacaacgttgttgcccagcaggagggacccatcaaggagctgaaggagcagatcaaggccaagaaggagaagaatgaggatgtctccgaactcgaacaggaattgcaaaagcttgtggacgccagtgaggacgagagcgctcgtcgctacttcaagagtatggaagatggtaatgaagaggcattgggtctctggcgccgtttccgtgacctcagtatccagaagtaccgtcaaacctacgcccgtctgaacattgactttgatgtgtactctggcgagtctcagatcaagaatgagagcatgactgctgcctatgagaccatggagaaggccggcgtctccgagaagtctgagggcgccgntattgttgacttcaccaagcacggtgccaagaagcttggaaaggctatcattatccggaaggacggtactnctctctacctcactcgcgatttggtgctatcacggagcgg

SEQ ID NO: 4903 - DNA, 594 bp, Aspergillus oryzae
  misc_feature (1)...(594): n = A,T,C or G
cgaggccacacaagccgagaaccagtggctgcacctttctctcatcaccgacctcaagaaggcctgcaaggaagtcttccccgtcgccgaatacgcctacaccaccatccccacctacccctccggccagattggcttcatggtctgctgcaaggacgccaaccgcaacgtgcgtgagcccgtccgcagctggactcgcgaggaggaggagcgtctctgccgctactacaaccaggatatccaccgggctagcttcgttcttcccaactttgcccgtaaggctttgaactagattgatattggtcctttgcacccttttgaatgaaatctgtttggggcggacgctgttttccatctagaggcgccatggcggcggataatcgatgatgatttgatgatgatgaatacaacaagggtttttcctctttgttcttctttgtctttattacattcccctcctttctgatgatgtcgcactcgtgttctacagagacgggcagtgttgtccatgacatacagcaataaaggataaaaagtattttcgtatgnnnnnnnnnnnnnnnnnnnnnnnnnnnnnnnnnnnnnnnnnnnnnn

SEQ ID NO: 4904 - DNA, 684 bp, Aspergillus oryzae
  misc_feature (1)...(684): n = A,T,C or G
catacctcaattgtctctgtggtactagaataaccctctgcatatacaatccaacatgcctatccccgtcccctccgccaactccctgaccgacctcctcagcctcaagggcaaggtcgtcgtcgtaacgggcgcctccggcccccgcggcatgggaatcgaagccgcccgcggctgcgccgaaatgggcgccaacatcgccctcacctatgcctcgcgtcctcaaggcggcgaaaagaacgcagaagaactcaagaaaacctacggcgtcgaagccaaggcctacaaatgcgacatcggcaacatggagagcgtccagaagctcgttgacgacgtgatcaaggactttggacagattgacgccttcatcgccaacgctggtcgtaccgctgacggcggcgtcttggagtccattgcaaggcgtggatggaggtcgtgcaaacggatctcaacggaacctaccactgcgctaaggccgtggggccacactttaagaagcgggggaaggggcaatttggtcatcacggccagtatgtcccgtcacattgccaacttcccgcaggagcagacctcctacaatgtggctanggctggtgtatccacatggcacgttcgctggcgaatgagtggagagactttgctcgtgtgaacagtatctcgcctgggtatatcgatactggaatg

SEQ ID NO: 4905 - DNA, 672 bp, Aspergillus oryzae
  misc_feature (1)...(672): n = A,T,C or G
gccgaccgggcaagcttagagcggatggtagtcgacttcatccttgatcgtggcgaaccgaagcccgaagattatgcgcttgatatcaattctatcacaaacaaggttagggagggagatttaacaccagttctgagagcgtacgaaaaagatctacggactccctttgtcggaactgtacgaggtgaccttgtacgagcactcttgatccaaatccagaagacgaaggtagatgttgagatcgcaattggcggtattgacgctctactgaagagccaggaacttgtttttggattcgttggccttacacctggtatcctggtctcgtacgcgtctcttcgatggttcttggatctgtttggcaatagaaagggtctgaggatgggtagacggcaggatgaattaagacatgcactgcgggctgctcatcgaacgttgatatcgcctaaccctgcacctaccggcgtgctcgcatacagggatcatggtcttctgatctgtgacgctgagattttgcttaagaaagcagaaactcttctgagtgggacagagctccgcgcctttcgagaagatgtcgctgaccttatcaancagagaatggttgtccggcagcttganattgttggcagaatgggttgggtctactcgaaatggatgaaatgatggagttct

SEQ ID NO: 4906 - DNA, 692 bp, Aspergillus oryzae
  misc_feature (1)...(692): n = A,T,C or G
gaaggacgttgaaattctgagtattccatttatcaagaaatacattcaatacgccaagtcgagagtcaaacccgtgttgactaagggagctgctgaccacattgttaccacctactcggctctgagaaacgatgaactgtctggtaatcagcgcaggacatcacctatcaccgcgcgtacgctagagacattgattcgtctggctaccgcacacgccaagtcccgtttgtctaacagagttgaagaacgggatgcaaaggttgcggagtcccttctgcgttttgctatgttcaaggaggttctcgaagacgaacgccgtaagaggagaaaggttactacattcgacgaggactcggaaagcgagtcagaggaggactctgatgaggaggatactcccgcgcaaactgcaagtgccaccccgcggtcaagccggagaagcggaacactgcgcactcgtgcagctgcgaaccgttccactactgatgaaatggacgctgatggagacgatgcttcggaagatggcgacggtttatacagcgccagtcctcgtggtcaacggttacggtcgagccagggcacgcgtactcagacacaaagccagtctcagatgtctgtggcatcttctcagccagcctcacagctcatcgactccnagacagacacttctcagccccaggcatcgtctgccagtg

SEQ ID NO: 4907 - DNA, 528 bp, Aspergillus oryzae
  misc_feature (1)...(528): n = A,T,C or G
ctgtacgccgaacccatcattctcaagtggatccgggagaacctgcatgtgagcaactgtatcatcgttagtccagatgccggtggtgcgaaacgtgctaccggtattgctgaccgtctggacttgcaattcgcacttatccacaaagaacggcctcgcccgaacgatgtctcccgatggttcttgtcggcaacgctcaagataagtcgccattatcgtggatgacatggcggacacatgcggaactctggccaanggctgncgatacttgtattgcacacggaacttacgaagcgaatgcgatcggtggtcacggtattcttttccgctaggccttgaaaaccataacaagagctgcctcagcgtctagagttaccacactgtcctcaccaaagaagaagatcagtgcaacagatcgaaacttcgatttagccctattttgccgagcctgaaacttcccataacgggagcccggagtttttgtttccccgctggccttaaatggctcactgggggagggaaaacaan

SEQ ID NO: 4908 - DNA, 685 bp, Aspergillus oryzae
  misc_feature (1)...(685): n = A,T,C or G
ctcaatcaatcatcatatccttatcctcaagacttcccttcctgacctgtctttctccctcttcgatatccttaacgacaatcatccaccatgtctctccctcagaccatgaaggctctcagatatgagcagcctgagaaacatgctgttgttgacgttccccttcccaagctccgtgacaatgatgtcttggtcaaggtcaaggcttgcggtgtttgtggtactgacctgcacatccatgagggtcaattcattgccaagttccccttggttcctggtcacgaaactgttggtgtcgttgcggctgttggccccaaggtcaagggctttgaagtcggcgagcgggtcgtcgccgataactcggagctttgtggtgaatgcttctactgccgccgtggagacgagttgttctgtgaacacttcgaggctcacggtgtcaccatgaacggtggctttgccgagtactgcgcgtatcctgctggcagggtattcaagatcaagaacctctctgatgtcgatgccacccttctcgagcccgcctcgtgcgccgctcacggtttggacaagatcgctcctaagatgggctcttccgttttgctggtcggtgctgggtcccaccggccctatccttgctcagttgcctccgncantgcngtggatgccgtgttgttgtggccgctccgaa

SEQ ID NO: 4909 - DNA, 892 bp, Aspergillus oryzae
  misc_feature (1)...(892): n = A,T,C or G
gactccctacttctactgcttgctcaatgtactgaaatgtctttgctaatcaaccctcgcctgttgaccaggactggcaagcaatcgctgttcgcagtgcccgctcgcagcatcgctttgccaagtagcccagacgttattgataaatcaaacttcaaagtttctcagagcatagctaagatatcaccgctctcaacggaacgggaccaacagcctgcatcatgtaccaaaaattgggccgagcgcctggacggtatcaacgctaaatcccggctgccacgaagcgtgcaagcggtgtatttgcggcctctccgacggaaagccgaatatggattgccggtttgcgaccttcaacttcgatcgtatagcgttcgaaatgtggagttcttcgctgatttcgctgtgcgtgctgcctattacttaaaacttcctgtctccgggcctgtgcctctaccacgcatcgttgaacgttggacattccctcgaagcaatttcgtgcacaagaagagccaggaaaattttgagcggatcactcttcgccgactgattcaaatcaaggatggtagccctcaggttgtgcagacgtggttggcatttttacgaaagcatgctttatatggagtgggtatgaaagctaatgtttgggaacacgagagccttgacgtgttcaagaatatagataacgcagtccctgaggttgaagggtccctcgagcctcatctatcacacttcggtcagcggggaggtgaagggacgcanagtccgatacctgatcttctgggcgacatgcgacttcctaaacacagaagtccactaagcagcgtccgcgaaggctgaaaataagccaatagctccctatatactctgccatttcaaagcttcccacataaat

SEQ ID NO: 4910 - DNA, 620 bp, Aspergillus oryzae
  misc_feature (1)...(620): n = A,T,C or G
ctctcttagcaaccctcaatccgtcccccaactggttcaaggaacatcttctcaacacacaatcatcatcatggatcaggcaaagttggctcgcatgcaggctagcgtgcggattggaggcaagggcactccccgccgcaaggtcaagaaggtccacaagtcctccggcgccgacgacaagaagctccaggctaccctgaagaagatgaacgtccagcccatccaggccatcgaggaggtcaacatgttcaaggaagacggaaacgtcatccacttcggtgctcccaaggtccacgcctctgtcccctccaacaccttcgctctctacggtaacggcgaagagaaagaactcaccgagctcgtccccggtatcctgaaccagcttggccccgacagcctcgcctccctccgcaagctcgccgagagctaccagaacatgcagaagaaccangccngtgccgagggcaagaaggatgatgatgaggatgatatccctgatctggttgagggcgagaacttcgagagcaatgtcgagtaaattcattaaccatatcatatcatatcatggggtttaatggattgatataaaaatgtgaacaaagacattaaaaaagggaaat

SEQ ID NO: 4911 - DNA, 708 bp, Aspergillus oryzae
  misc_feature (1)...(708): n = A,T,C or G
tggaattgactagtgacctatcgacactgtgagcacaatgtccaaactagcaaaccgcgccgactgggccgacgacgaggagttcgatgacccctccgcgctccccgcgcaacaagtcacaacgaacaaagatggcaccaagaccgttgtgtcgtaccgcttcaacgatgagggcaagaaggtgaaggtcacccgccggatcaagaccaccgtcgttcgcgaacatgtcaacccccaggttgcggagcggaggtcctgggccaagttcggtctcgagaagggccacgctcccggaccctcgttcgatactacctccgtcggtgagaacatcgctttcagacccagcatcaactggaaggcacaagccgcggaggcggagaagaacggcggcgagaagggcagcatgaaggatcagctcaaggacaagaaggtcaagtgtcgtatttgcagcggagagcactttacagcccgctgtccgttcaaggataccatggcgcccgtcgacgagcccaccgctggtggcgctggtgaagatgatgaagcagccgccggtgctgtcggcactggatctggcagctacgtgcctcctcatcttcngaaaggtgctgctggcggcggcgagagaatgggtggcangttcgagaacgacgatctggcgactctgagatgtacanacgtttccgagttggcggagaaggagaactccgg

SEQ ID NO: 4912 - DNA, 679 bp, Aspergillus oryzae
  misc_feature (1)...(679): n = A,T,C or G
caatttgccaattttttaggttaggcttgaattgtcgttatctactgacgatccattacaatttgcgttcaccaaggagcccttgattgaagaatactcggttgcggcacaaatctataagtttagcgcggttgatatgtgtgagctggcgaaacactcagtcttacaaagtggtttcgagctcgccttaaagcaaagatggcttggcacaaactgttcagcggcaggagtctcgggaaacaatgttgcaaaaagcaatgttccagacattcgagagagatttaggcatgaaaccttgttaggagagctggcactgattggaagatatgttgacagtctgagtacatattcaaaagcactacccctcagaggccagttgcatcctagcgtgaccacggaaaatgagaacaatccaagccatcctttgcggaaggaggctcangctacagcatttctgcagacttctaatacggtgaatcctcccaaatatttacaaaatcagtctgagaccaacgccgctggagaggcttgcttcccaagttccactcccccgggtcccaaatctagcgaggatactggacccgaaacgttaccagaacaaaagatattcccttgtattgtgcacgaaagggctcancggngtaatatgttgactccggcattggctgaagatgacang

SEQ ID NO: 4913 - DNA, 672 bp, Aspergillus oryzae
cccgactttactttctcgtcaccaccgccctctctttttcttttacctaattcccaggcaattgcgcctttctttcacttcctctttaaccgacataatgttccgttccgctgttgtccgctctttgagggcctccgtgcctcgtgccgtcagggccccggctaccttccagatccgcagcgctcctgccgctcaattcgctcctcgctttgccttccagggcgttcgtctctactccgctcctgccggtcttaacaaggaggaagctgagggacggatagtcaaccttctgaagaactttgacaaggtttccgatgccagcaagatcaacggctcttctcacttcgcaaacgaccttggacttgacagcttggataccgttgaggttgttatggccattgaggaggaattcagcattgagatccccgacaaggatgccgatgccatccacagtgttgacaaggctgttgagtacatccttgctcagcccgatgcccactaaattatgtaatacgaagatctgaatgattttgcgggttagatagaaaagaaggggatggtggcgtgcatctacatggggtctcagcgtggaaacgctacttgtatgctgatacatgccggtgttgtttcaccctattatatcgtgtatatcatcttaaatgcagtttgatg

SEQ ID NO: 4914 - DNA, 637 bp, Aspergillus oryzae
ctattcgatgtctatgatccctttccattgcaattaaccctctaagttgagcttcgaaggcaatccgtcagtcatggcgcgagacgagccccttttggctccgcgcccctcctccgaccactcctcgattcggaatgcagaagaagaggacgccttactaacaggcgagcgcacccaccgtgaacagcaacgcagcaaatgggccttctggaaagacgtcggtctcttttcctgggcgttcattgctaccattgccgtgatcgtcctcgccgtggtttaccaacatgagacgagcaaaaaccatagcgcgaagcaaccttggggccccggaggcaagccgaccggcaagcggaacttgatcttcatggtctccgacggaatgggacccactagtttgactatgaccagaaactatagacaattcacggagggactgcccgtggatcagacactcgtgctggatgaccacatcattggtacttctagaacgaggtccagcaacagccttgtcactgattcggcagccggtgctactgccttctcgtgtgcccataagagctacaatggagctatctccgtgctgcctgaccactcgccttgtggaactgtgcttgaggccgctgccttggctggtttg

SEQ ID NO: 4915 - DNA, 670 bp, Aspergillus oryzae
cagaagcaactgggggtgcgtctgatgcttcgaataaatccaacatgctagccgaaatgtaccgtccgccgtttgaaatcatgtcacgacttccatgggaccaagcccgccaggaaggccgtgagaatgagaggtggttgctggtcaatatacaagacccctccatcttcgactgccagctgctgaacagggacttgtggaaggacgccgggatcagagacactgtcaaagaacactttctcttcttgcagtactctaaggacgacccacgagctgcgccatacctacaatactattttcaagcgagcgacgtctccgacaactacccgcatatcgccattgtcgacccacgtaccggtgagcagatgaaggtgtggtctgggccgcctgtggtgaaagccgcagacttcctgatgcagctgcatgaatttctcgaccggtacagccttaaccacaatgtacggaacccagtggccaagcggaaaccggagaaaaaagagaaaaagctttcgtgctcttgaccgaagaaagaaatgagtgggatctgcgcatgagaaaatttccttgggggagataccctctccaccccccaaaatttggaagaataccgaccatttttaccccgagcgcttaaagaccctataagggaaaaggcccagcaaccccatct

SEQ ID NO: 4916 - DNA, 638 bp, Aspergillus oryzae
cgaaggcaaagacatcccgatctccacatccagtgtcttgttgctctcagacctatcgggctttcgggaaggatcgaccctggtgcgggagcaggaaggtcttcgttctgacattttccgctcattcacgtctgcaaaggatacacgaggggccatccaagctttgaagaaatatggtccagaagaaccccaactatacgtagatgctttgacttattttgcttcaagccccaagattctcgaagaggctggcgaggagctagatgttgttctcaaacgcatcaacgatgaggggctcatgtcgccgctccaagtcattcaggcgctcagcaacaacgcggtggtcactatgggccgggtgaagaagtatctgagtgataacatcgagcgagaacggaaagagatatcgactaatcgtcgtttgatttccagctatagcacagaaacggaaaacaaacggaaggagcttgaacaattaggtagcaaaccagttgttttccaagctcgccggtgtgcacttaagtcttgcggtggagtgctggaccttcctacggttcactttctctgcaaacattctttccaccaacggtgtctgaacaaggtcgacgaagaaaccgaatgcccggtctgtgctcctt

SEQ ID NO: 4917 - DNA, 669 bp, Aspergillus oryzae
  misc_feature (1)...(669): n = A,T,C or G
tggcatcgtccagacttgcattgtcaacatagacaaacgccatgctttcatcaagatgatcagccgccaggatgctgtgcttgcccgtgaaggtatggaatcttataagtctggagacatgcaacttagaactcgatggggtgtcggattcggaccgcgtgactgtagcgactatcagacaggcattagtataattccggttgaacgactcacggaggcggatcggaaatggatgctcactgctgaatatggcgggaccggaggcagacccatcgagagcggcatggttgttgaagagccagatatcgagatcggtgctggagtttcatccaaagctatcagcaggcggattgcaactgatacggggggcaaacggggtccaatttcatcccgcacacagcaggaccgcttcccccgaccagaccgggacggaccttcggctagaatgggccctggcggccatggtggccaacccgatcgagatatctcgaatgcaaacaatgtcggcgtccctcctgctgtgcccggttttggcttttcctttccgggtatgcccatgttccctccaggattcatgatgggaggagcacaagctggaacatctagcgggtcagcacagcccccacccccggttcaagggggcaactaagttcttaatcaagttcgaan

SEQ ID NO: 4918 - DNA, 650 bp, Aspergillus oryzae
taccccatattgaggttctgtaaactgagaatgctcggtcgttccgtgtctcttgctaccgttctgcttaccctgagcggcagcttcgcgaacgctcatgggtctcactcgagtgagcagaatccttcttcggattgggctactcagcacatgcaagaggagcaccacattgattcctttgatcctgcatccttctttactttccacgattatgataactcagggacatggacagccgatgaggtacggaagacatatggcctcgatgatgagtcaaatgcaggtgttagcgaagagcgcaagcaacaggctgtccgggaagtctttgggcttttcgaccctgggaacactggattcgtcactcgagataactggatgcgtctaatttcggaaggcaagcgtctacctgatttcggatttggacctggccaccatggcgacatcgaatatgagtatgaaattcatcatttcgagaagtatcatggagacgatgccaaggaggaagacttcactcatccagaggatattgagcatttccggaggcatgacgaggaagacgacgctgcctatcgacttgaacagcttgagaagatgcagatcgtggtaaagaacataccacagaagtttcctgaaacgagtttagcgcgtgg

SEQ ID NO: 4919 - DNA, 718 bp, Aspergillus oryzae
tgttgtacatactttcatacaccggtaacatacactcgtttacaaaatgcccctcgccaagtcagaatacctgagtgatacgtggaaggacggcctcttcacaaacaaggtcgttttctgcaccggaggcgcaggaaccatctgcagtgctcaggtccgcgccctcgttcacctgggtgcaaatgcctgcatcgtaggcagaaatgtggagaaaaccgagaaagcagctcaggacatcgctacggctcgtccaggtgccaaggtcattggcatcggtgcggttgatgtgcgcaagttcgacagtctgaaagatgcagtagaccgttgtgtcaaggatcttggcggtatagattatgttatcgctggtgccgccgggaacttcctcgcttcgatcaaccagctttccgtcaacgctttcaagtctgtgattgatattgatgttctgggttcttacaacaccttgaaagccaccattccgcacctggttgagtccgcaaataaacacaaggttgactccaagtccctgaagccctctccgctaggcaccggtggacgcatcatttttgttagcgctaccattcactacaggaccattgccctttcagacgcattgtgtgagtagcttatagctggcgtcgatgcctttgtccacaatgtttgccgttgaatttggcccacttaggcgtgactttctacaattattgggccggggtccaac

SEQ ID NO: 4920 - DNA, 675 bp, Aspergillus oryzae
  misc_feature (1)...(675): n = A,T,C or G
tcgagcaagatcggcacaagtggagcaacaacccaatgcaacttagggtctttgagcaggccttaaagaagtacaaggacaagctggatttgggtctcgccttgaagtacagtcttcaaggtgtgttgttcgacgaccagtggcaagcccgttccatgctgttcatgcgctatgttattgttttcctcttgagacttgtgtctggcaagaacttcccccaagagcccattcagttgcctctgcccgcggagcagcaagaagtttggaagtgtcttcctgagtactttgtggacgacattgtgagcaatttcaaattcatcatgtggtgcatgcctcaaatcattaccgccacgcaaggtgacgaattggtaatgctctgcatagcctttttggaaagcactagctatatcaagaacccgtatttgaaggccggtcttgtctctattctcttccgaggaacatggcctcgccctggcggtgcgcggngcgtgctggtggacctcttaaactccatgccctttgccaacgagtatttgctgcatgctcttatgaagttctacattgaagctgagcacactggcacccatacccagttttttgacaagttcaacatccgttttgagatcttccagatcatcaaatgcatctggcccaataccctataccgtgccaagn

SEQ ID NO: 4921 - DNA, 684 bp, Aspergillus oryzae
cctccaagccttgcgaaatcgaggcgttgcggtctggatgctttccggagacaatccgacgactgctcacgcagtgggagagatggtgggcatccctccagacaacattattgctggtgtgctgcccgagcaaaaggccgaaaaagtacaatatctgcaaaaaactctacagaagccacctcgatcgagttggttcagacggggcaaggagccccagtccggccgcgcgatcgtcgctatggttggtgatggaattaatgactcacctgctttgacggtggctgatgtgggcatcgccatcggatctggctcggatatcgccatctcgtccgccgagtttgtcctggtctcctctggtcttacctctctcctcaccctgatcgacctcagccgcctcgtatttcgacggatcaagttcaactttggctgggctttggtgtataactgtgttgccgttccagtcgccgctggtgtgttctatcccattgtgagcaatggcacccatgtacggctggatcccatctgggccagtcttgcaatggcgttgagcagtgttagcgttatctgcagtagtcttctcatgaggacccgacttccattggttggtttcagagctaagaaataatacgtttgaagatatggaataccctcgtgtatcaaggattatatagattgcctttgcat

SEQ ID NO: 4922 - DNA, 1214 bp, Aspergillus oryzae
agttaaaaatgggatgtttgattcaaataaaccatgcgtatggacattagagctctacctgggctgatgatacagatgaagctaagcgatgcgaaacgacagatataaatatacccgcacttgataaagaaagcggtagtatcgagcggatgctccgaaacgccgtacaagacatagcgaatgaagtcgaaaaaatcatgaatcatgcgattgcaaagaaaggaagacacagagctgatttgggtacatgtcgaggttcgtgtttagggaaacggcatgttcaacctaggttgagcatatcgatatctaagtgcagggcgtacatattgccaacctctcagaagggacccttaaattcaatgttaagggccttcaggcaagtgatatgctcaccatcactattgaagacatcggcttgaacagtgtatttgcccggaggaatctgttttggcaaatcgacctgcttggtcaatgtcatgtcacctggtcccagaggacatttaagttctacgttgacgagctgttcacagagatcggctgtctgcctgacaagagtgatctcagcgaactcgacgtttcagtctccgcccaacttgcggttaaatcgattgattctcgtgttcacatattaaacaaatctattcaaaatgaagcaccttgccgcttacctcctcctcgccctcgctggcaactccaccccctccgttgaggacatcaagagcgttctctcttccgtcggtattgatgccgatgaggagcgcctccagaaggtcatctccgagctcgagggcaaggacctccagcagctgatcactgagggtagcgagaagctcgctaccgttccctccggtggtgctggtgccgctgcccctgctgctggcggtgccgctgccggtggtgacgcccccgccgctgaggagaaggaggaagagaaggaggagtccgatgaggacatgggcttcggtctcttcgactaagcgccttcactcgtgcgagcctcaaaaaatatgtgatatctcgtgggggaacagaaatctggcagtcatttgcagtattgggaggaaaatggcccatttcggtcaagtctgtttgtttcagacttctctgatgcagttacgaattatgcatacgtgagctgaaaaagctccttgatagccaatacagattatctgacctccaaaaaaaaaaaaataaaaaaaaaaacaaagataaat

SEQ ID NO: 4923 - DNA, 655 bp, Aspergillus oryzae
  misc_feature (1)...(655): n = A,T,C or G
cttatatagccacacatcctatagccgtatgatatcccagcagaaacttcatcccaaactactacgccactacgatgtcccaggccaacatagccatccccaccgggtccctcattctcgtgactggtgcaaatggcttcatagcctcccatatcgttgatcaatttctcggaagcggttacagagtacgcggaactgttcgatccgaaaaaccatggctagatgactactttgccaccaggcatggtgctggtcattttgaatcagttctgctaccggaactgggagacaaggagacactggataaattattggacggtgttgcaggtgtcgtacatgtggcatcagatgtctccctgaggcctgaccccgaaattatatcaaaatccgtcgccacaaccttgagtgttcttgaagcggcagcgaagcatgataccgtgactcgattcgttctgacttcttcagcttctgccgcttcgttccctcagcctgatcaacctggtattatcatcgactcanatacatggaatgacagtgccgtaagaagcgctagggatcccagtgttcccgtagcccagaaatcatacttcgtgtacgctgcatccaagaccgaatcanaacgagagggcctgaagtgggtaaagcagaacaagcc

SEQ ID NO: 4924 - DNA, 681 bp, Aspergillus oryzae
  misc_feature (1)...(681): n = A,T,C or G
cagactcgatcgggactggcgggtcaagaagccgtgaacagcgtcaatgggcccatggcgtcgacattggaggaaatcacattctactccaagaccgtcatcgaccaagaaccctgggtcaacgacccgaagtgtcttcctatcccgtggcgtccggctgagccaaaacaccgactcaagctggctgtaatgtggaacgacggcatcgtcactcccactccgcccgtaactcgtgcactgaaagaaacagttgaccgactaagaaaggccggccacgaggtaatcgactggaaaccaacaggacacaaggaagcgcgacagcttctacagcgcaagttcgtcgccgacggaggtaagtcagtgcgtgggctactggcgccgacgggggagcctttccgggaggaaatgcgagattacgagaaggcgacggagctgggtgttcatgagatgtggcagattcatcttgagcggaatactctgcagaaagattatcttcatcgatggaacgctagtggaattgatgggattctctgtccaacaaccccatacagctcggtggagcacggtaaatttgcatatgtgggatacaccggtgtattcaacatcctcgactactctgccgntttcttcccttgcggcgtgaaggccaataanggcgtggatgtgtcgtatcacgggcac

SEQ ID NO: 4925 - DNA, 591 bp, Aspergillus oryzae
  misc_feature (1)...(591): n = A,T,C or G
cagtttggaagtgatcaaccgcggtctctctttgtcattcttcttgttcctctcctcttcaggtttctcccattagcattgctttcaactgtatctctgatctcctttgcttcacacttgcgtgttcctccgatcttctatccatacaaccagctttccatccacttctgacaagatgggtgtcactgagatcaagactcctgctgaattccaggaaaaggtcatcgactccaacgagcctgtcgttgtcgatttcttcgctacctggtgcggtccttgcaggatgattaccccagccatcgaaaggctcagtaatgagaaccagggcgtcaagttctacaaggtagacgttgatgggcttaacacggtcgcggccgacttgggtattgccgccatgcctaccttcgtgttctttaaagacggccagcaaatcaaagagttaaccatccgcggtgccaaccctggtggtgttcagaacagtgtgaaagccctgctggcataaattgtcttcttctgaaccttttgtcaacaaggttatccgtttattatagaagaatatgatagagttttnnaaannaaaaanaaaannan

SEQ ID NO: 4926 - DNA, 261 bp, Aspergillus oryzae
gctatcagcgttagcttcggctgcgtgaacagcttgatcagcatgccttgccggatgagccatgctagtatcgatgcgaagacgcgccaggagcgcgccatgccggaagatttgatccgcctgtgcgttggtattgaggatgcagatgatctgattgacgatctgacaagggcgctggtacaagctggtgccgtcaacctaagcttggatgatttccaagcgaacacgactaccaactgatttacgtatacataatgtacc

SEQ ID NO: 4927 - DNA, 699 bp, Aspergillus oryzae
  misc_feature (1)...(699): n = A,T,C or G
gtggcataattcgagtcctcgatttgctcttccagcacctttcctttaacgccccccgcctatttccctgtggtccacgactgcagccatggcgtccgatctgacgaaccccctactggacgccctgtccgcgtccgacgcaccgattctttccagcgaagctttcccctcccacccctcattgaatgtcaagagtgcgcttgatcgtctggcctcacgacagatggtcgaatatgaaacaattgagcgtgaagtcgccgcactgaccaaggaaggtgaagaaatcgccgccaatggtagtcatgaagccaaggttttccaggccgttgtggctgctatggaggggttgaagatcggtgacttgcctggtattgttggaaaggacaacgccaaagttggtcagggaaatgctttcaagaggggctggatcaagaaggatggacaattgctgcgggcaaacactgactcgatcgtggacgagacccgtgagcagttgttgactgtcaagaagactcagaccctggaggaccagaanggccctcgtgatttgaaacgtcgaaagttggtcgccttccanaanggagctaacttcaagatctccaaggggcccaagntcgccaaggagtttgntaaagaggagaacgaccctactgctgagatgctcatgaacggctcgtggaagacggctcaacttaaggn

SEQ ID NO: 4928 - DNA, 731 bp, Aspergillus oryzae
  misc_feature (1)...(731): n = A,T,C or G
cgctcaaccatccctctggaccactatcgctgcaactcgctcgagacggatcactatgaggccgcgcagtcagaatgaccttctgggtcgtttcgctatgggttaatttaaccacacgggtcaaggtatcgtacatagtataacagtcatagctcccgcatgacaggtgttcgtcttggacctgccctggttgcctggccatccccctacttcatgctgtccctgcgtgtctgtctccctttaggggttgtgcccctcgaaggagacgtgagacaaagggcaaaggctgagtggaggggtaccgggtgtacgaggcagagtccggtcgttctgagattatactgtcataacttgatctagataatactagcgaaaggacatgcgtggcattgattgttcccctttatatctcttgtcacagaagagggacttcggtcccctttactaacaagtttcagagctcttgacctcaaattgtgccaagatgtctactgacaagattaccttcctcaccaactggcacgcgacgccgtaccacgctcccctgtacctcgctcagagcaagggttactncaaggaagaaagcctgaaaggtgctctgctggagcccaatgaccactctgatgtcactgagataattggtagcggtaccgttgacatgggcttncaggccatgantcatactctggctgncaaggctcggaacttccttgtcactcgattgccttttt

SEQ ID NO: 4929 - DNA, 632 bp, Aspergillus oryzae
  misc_feature (1)...(632): n = A,T,C or G
agggcgagtttatcattaaccctgggaactccgaaaaactcgctggtgcctaccaggaggctgtcaccatgagcgacgagcaaagggctctgaatttctctaagttggacaaatatgtcaataaatatacgagtgccttctggggccagtcattcgtaacggaattgacgaggatatctagccaatctgcggagaaattccagtctaagagggcttccctgaccggcacgtaccacgaacaagtgaacggtgtagaatccgagggatcggcttgatcacgcaccaaaatgacacctttctatactgtctcctgtggcgtaccagaagaggaaacacaaatatgtgacgaatggcttagagctttttattgacggtctatgagcactggatggcgtgaaatgttttgagtttgctttgcattggttaagattctcggtcactcatatgaaatatcataagagggtaatattgtacttagattcctgggtccgggtcatggatgggtaaaaagttgaagtgttgctggtgtactgtacaataagcgttctgtctaagctctcaactcaacgtgtattaccatccannnananaannannannaaaaanaaaaaaaattcctgcgggccggtcaa

SEQ ID NO: 4930 - DNA, 1134 bp, Aspergillus oryzae
  misc_feature (1)...(1134): n = A,T,C or G
cttttcagtcggattgtcttgacttgcaaaatggacaaggtgcaggcgttcggaaagaaccttagtgcgagcttttcgccttttgctgcgcgcacgcagcagatgatcaaagaacagttgggtcaagccgaagacaagactcaacttcccgatgaataccttgagcttgagaagcgcgtggacgctcttaagttggttcatcagaagctccttcaggtgacttcgcagtactctaacgaggcttacgactacccacccaacatccgcgagtcattcaacgacctaggccggaccatcggtgaaaaggttcagcttctgtctcaagcttcttctcctgcggaggcccaggctgccctgactgcccctccttcggccaagccccagccgaagacgttcaaccatgccattgcccgcgcctctctgtccggatcccagactctggcgcagagctccaccggcgaggaccctctggccactgccctggagaagtatgcgctggcctcggagaaagtgggtgaagcccgtctgtctcaggatggacagatccagtcgcgtttcctcgctgggtggaacacgactctcaacaccaacctgatgtttgcggccaaggcgcgcagaaacgtcgagaacgcccgtcttatgctggactcggtcaaggccagcaagaaggcggctgctaggggtgacctggacaacctgagcgaggaggcccgccaggagatcgaacaggctgaggatgagttcgttagccagaccgaggaggccgtgagcgtcatgaagaatgttctggacactcctgagcctttgagaaatctggcggacttgatcgccgcccagcttgagttccacaagcgggcttatgaaatcctcagcgagctggctcctgtggttgatggtttgcaggttgaacaagaggctagctaccgtaagagccgtgagggagcttagaacacccttttgaatctatttcttctttcactctttcgttacgttcttcttttggccaactgttatgggaaccgtcgggttacgttgtgaactacccctttatgcactgtgaagatgtttatatcccccaatctatggatatgtangggccatttgtgggctctatggatgcgtaaaaaaaaaaaa

SEQ ID NO: 4931 - DNA, 685 bp, Aspergillus oryzae
gcaatgccatcaacttgcttgtaggtgtaggtgacgaaagcggacttcttgacgatctgaaaggtgaggtgagggaagcgaaggaagcaggccatattcacccggcggcccccaacaatctctatagttcactggtggagcgcacctgcgaagcttaccgcgaggcgcatatgcccaagcgagcttctccgtactgctccgaaacccttgacatgaacccttattccctgccagcgctgctctttcagagtcaattggctcttgatgaagagcgttttaatgacgccataaacacgctgaatacagccaaagagcatcaccccgggtccagggacgtccaatcacttttacagaaggcacatgtcttattgaagcgctcaaagcagagggactactacaaagttttaggtgtcagccgagatgctgatgaccggacaatcaaaagagcctaccgtcagcttactaagcaacaccaccctgataaagctaagtcccagggtgtaacgaaagaggaagctgaaaagaagatggctgctatcaatgaagcttatgaaatcctttctgaccccgaactcaaggcgcgttacgacagtggtgatgaccccaaatgacccgaatctcacaggggcaacccgtttcaaggaaaccccattgggccaggaaggcggcaacactttttcttcca

SEQ ID NO: 4932 - DNA, 687 bp, Aspergillus oryzae
  misc_feature (1)...(687): n = A,T,C or G
ctcatgcgatcgttgcatcgggatcggaccttgcaattgtcgatcttaacaaggcggaagctgaggagcaagcccagaagttggtggaacagtttaagaaggagaaccccggtttggaacaaatgcccaacgtcaccgcccactacgctgatgtttccgaccctaactccgtcaacgatgccctctccgatattatctccaagcacggcaagatcgacaacctggtcacctccgccggattcacggaaaacttcgatgccatctcctaccctcacgaccgtctgcaaaagctttggggcgttaatgtcgatggaacataccttttcgccaccggtgtcgccaagcacctcatggagcgcaaggttccgggcagcattgtcatgattggtagcatgtctggtgctatcgacaacgtgccgcagccccaggctccttacaacgccgccaaggccgctgttcgtcaacttgccgcgtacttcgccggcgaatgggccggtcacgacatccgggtgagctgcatgagccctcgatacatgcttactgccctgacccgcaagattttggatgagaacccccgattgcgggacaagtggatctcgctcatccccaccggcaagatgggtactcccgaggacctgatgggtcccgttacctttctgctcagngatgcctnncagtacatgactg

SEQ ID NO: 4933 - DNA, 537 bp, Aspergillus oryzae
  misc_feature (1)...(537): n = A,T,C or G
cgaatgtgctgtcgcaccgcgtncaggcgaggactacgcgattgtatgcgcgcgagaggacctaccatgaagtccgagacaagcttgttgcatttgagaagaacctgaagctaggcgaaggcaccgagcccgatgtcttcttcggtcccctccagaacagcatgcaattcggcaaagcccgcaatctcatcgagcacattgcatccgaagggctgaactccgttttgggaggttctatcccggattcgaagggcttcttcgtcccgcccactatcgtcgacaacccacccgagaactcgcgcgttggccaggaggagcccttcgcgcctattctgcccattctcaagtggtccgaggaggcggacgtgatcgcacgcgcgaacgacaccgagtatggacttggagcatcggtctggactaatgatttcgagcgcggtcagcgaattgcgcgccagcttgaagccggtaacgtgtgggtgaatacacactttatggtgcagcctaatgtaccatttggtggacacaagtcgagtggaa

SEQ ID NO: 4934 - DNA, 631 bp, Aspergillus oryzae
gaacgatcccagtcccgttgggtatctactcgacacaatttatcgccctaccaaattttaggaccatcactgtcccacccgagaatgagccggaagctcgcccccgaagccaatcggattctctttgtcaagaacctcaactacaacgtaactgctgagcaactattcgacctttttggcaagttcggtcctatcagacaaatacgtcagggaattgcgaacaactcgaagggcactgcatttgtagtatacgaagacgtccacgacgccaaacaggcatgcgataagctcaatggattcaacttccagaacagatacctcgtcgtactataccaccagccagagaaaatgctcaaatcgaaagaggacctggcggaaaggcaagagaatttggaacgtcttaaacagcagcacggtatagaatgacgttacgattctttttcttgcttttctctgtgtaccctttgcaggcatctggctgcgtattatcatgggttggttgtggggtttctggcgttttagtcttatgggttgcgtgactcttattcatggatactactacaagggtggccgacgggttgaatgatatactctggctattgaccagagaaacgatacaggatgggatctt

SEQ ID NO: 4935 - DNA, 628 bp, Aspergillus oryzae
gttgagcctcactgttatttctctccccccattattccctgggacttgataccctaccgtttagatcccggttctcggtttagacatttcccggagtctcgaattacacacagtattcgaagatgttgatcaaagttcgcacccttaccggcaaggagattgagctggacatcgagcctgattacaaggtgtcccggataaaggagcgtgtcgaggagaaggagggtatcccacccgttcagcaacgattgatctttggtggaaaacaaatggccgatgataaaactgcatcagaatacaacctcgaaggtggtgcgacgctacacctcgttctcgctctccgtggtggatctctggccttgtaaacacctaccttgagtcctgaatatcgtactccatcgtgattacgattggagcgcaatatttgtatcagctgggtggttctctgcatttgatacctgaagccgcgccgaatattgtggcatgaactcagctcatgtatgttttcgttcactataccctggagatggaagcgggctgttcagtgctggctgcaagcgaatggtgtttaatgtcaagaatgcttcctgaatccgcatagcgtgtctgtgccacatgcatgtcgccc

SEQ ID NO: 4936 - DNA, 681 bp, Aspergillus oryzae
tggctgttgaaggttggtttcagagggatgtgacctagagtagtaactgatgagatgaagatgtgggccagtagaggtggtgatgctgaaagactgcttcatcagaccatcaggcttgtatctgtagccatccggaccctcatctgcgccgtccccccggtcatcatcactccctcgactctccggggttttgcccgctctcgacatggtggattgcgccacgcccgttccccctcgcttgccctccatttcacgatatgtcaaaaagctgcccgacacgctactggcgctccaggacttcccgttcgtccatctgagcatccccgctttccgttcatcccacacgaataccgatccggatcgaattaattggggttctttctcggacaatcgtctctgttcgcggggcaggatgccaatgcgacatgcttcgaagaggataatagcgtccgccggcgtgcggacgtggcctgttaacttcttcatccaccttatgggaactgttttacgaccccgtgacggttgtaggttttacctccatggtatggctattatactgacgtactgtatgctttactgaatttagctgctggtcttctgtgatacaatatctcctttcgggaccacgctgttttcttatattaagggtacccttaactcacttcgcgattcgactcgcgc

SEQ ID NO: 4937 - DNA, 689 bp, Aspergillus oryzae
ctcgaactacgagatcttgatgatgcagggtggaggatcgggccaattcgatgcgacagtgtacaacatcgtttctgcttgggttgagaaacagcgccagaagatcgtgaatgagctcggtgaagccagcgaggatgacgtggtccgagagctccgtaagaaggttgagtcggagctgcgattggattacttggtcacgggatcatggtcatcaaaggctagtcaggaggcgatccgcctgctgggacccgaatacgttaacattgccagtgactcccggaaagtcaacgatggcaagttcggcaagattgccgatgaatcgacatggaagctgagccccaagcccaccatggtctacatgtgtgacaacgaaacggtagatggtgtcgaataccccaacttccccaaggttcttgagccaaccggctcggaggaggaaccattcgtggtgggagatttctcttcaaacatcctctctagacgtatcccaattaagaattattccatcgtgttctttggagcccaaaaaaatctggggtgtgccggagttactggagtcatcatccggaaggacctgctggtctcgtgccctcccacgattcttcgcaagctcggacttgccattgctcccacaatccttgactactgcgtaaccgcaaagaacaacagtctctacaacactcttccgg

SEQ ID NO: 4938 - DNA, 642 bp, Aspergillus oryzae
cggtgcctgcgaaatagattgtcctcatacatagttaagacattttacgatgtcgaaacagtatctatcctgcggttccgcagataatgcacacccaactgatatcttctcattggctgtaaccaataagcagattttatcggcttctggtgtctctgctctcaaggttcactctactgctgaccctgatttcccattagtacaatcgatcgatgaggcccataaacttgggtgccatcatgttgtaaccgatggcaacggatcgagatcagtgagtgttggttttggtggtgagatcagggtttggtcctgtcatgatggaaactggtccgaaaataagacagtctcagctggcaacgcaggatctactggtgtttgggcaattgccttgtcaggcgatggccagtatcttgccggtgtaagccaagatgggcacattcgagtgtgggatttggatgccaatggcgaacaaatacgttactatgagaccaaaggtagctatggtacctgcatagacttgtcagcagatggccgcttcatagctagcgggcatgagaatggcagcggctatatctttagcacggaaacaagtcgtatgcccgttaccttattaaggctaatgaaacccgtgccaactggtct

SEQ ID NO: 4939 - DNA, 672 bp, Aspergillus oryzae
ccaatccttctgaaaccccgtttgatccaattcgttcgtcatgcgtaccctcaccctcttggccaccttactggccgttctggccggcctgtacaactacctcaacgcgcgtctcgagcagttttacatcttcgaacctggccagttgcatgacctctctcagcgtgcaattgctgcccacggaaacgatactcgcgccgttgtaaattacattgtctcggagctagatgagaaggtccccggaagccacctgaacaaggaagaggaatgggtgttcaacaacgccggaggtgccatgggtgccatgtatattattcatgctagcattacagagtactcggatatttttgaaaccgaaatcggtacgatgactgcactagccggtaaatgcagatgatatcttcctaccccttacggtaatcaatgtgtatattctcaaagatgttacaatccgttatcatacttctgcttatcaatactccaccttccccatagttccatcacgataaacttaggtttatattctataacacatcgactaaacctagctaagtcaatgacattattcagacttcaagtaccaccatacgacttaattaggattccgataactatgatctgctcatggtctctaacatcgacgctgactccaataccaaactcctcctaccg

SEQ ID NO: 4940 - DNA, 694 bp, Aspergillus oryzae
  misc_feature (1)...(694): n = A,T,C or G
ctccgtttagctcaacgcttgacctacctcaggaggtagcggcttttccttgaacccgaccatcacagtacccgcccaatgaaccactgaaagatttcccctggagtggcaactgtagacttaaacgcccacaatggcgttcaacaaacgaacgttttccatatattctcttcttcttgcggcaccgtctctcacaacagccttctacttaccgggtgtagcacccacatcgtacgatgaagggcaatcagtgccgctgtatgtcaaccatctcaccccggggcttgcgcaacaggacgagcaacttcactccgtgttttcctacgactactaccaccccgcttttcacttctgcgccccagaaaatggacctaaatatatacgtgaatcgctaggaagcattttattcggggatcgaattcaatcgtcacccttcgagctctttatgggcaagaatgaaacgtgcaaggctgtctgcaaggaagaggccaagttcgattcccgtagtgccaagtttaccaatcggaggatcatacaaggctacaacttcaattggctcgtggatggactccccggcgcccagatcaacgtggaatccgtcaccgaggccaaattctataacccgggctttgcgcctggatcattgaacgacaatggacagggcggntttgattacccactttgatatctttat

SEQ ID NO: 4941 - DNA, 660 bp, Aspergillus oryzae
gtacttcttgttaatcattctttttttgtttttgttttattcctttcttatcaaaatttgcattctacgtcttctgggaagacacatccgccaagatgccgattatgcaacctagtaatcagattaaattcaccaatgtatcagtggtgaggttgaaaaaagggaaaaaacgattcgaactcgcctgctacaagaacaaactcttagaataccgctccggcgccgaaaaagatcttgacaatgtcctacaagtgcctaccatcttcctctccgtttcgaaagcacaaaccggcccgtctgcggagatagccaaagcgttcggtgccaacacttccgcagacgagattcgacaggagatcttaccgaaaggtgaaatgcaagttggtgaacgtgaaccaaaggagaacatcgagcgagttgagaaagaggtggtgggtattgtgattcggcaagcttggtgacccgaccactaagcgaggctacccgcccgggatgaactctaaagcggtggaacaattaactccgcgagaggacaaagcccccagcgccaagtcaaaacaacaatgggaaaccaagggggcctggagataagatttgcccggggcaaactcggaaagccctcttggactggtgttacaccccaaaaaggggggaaaaaac

SEQ ID NO: 4942 - DNA, 715 bp, Aspergillus oryzae
  misc_feature (1)...(715): n = A,T,C or G
gaacaccccctccaatcttattcactccaaaaatgttcgcccgtcagaccttccgctgtgcccagcccttgaggcagagcttccgcaagtactctacggaggcccccaaggccaagtcgttggctcctatctacactgctgtcggccttaccggtctcagtgtgggcttgtaccgctactactacggcgctggcgctaccgccgaggctcccgttgagcgcgccaaggttttcactggtggtgaccagggatgggtggacctgaagctgtcggaaattgaggtcctcagccacaacaccaagagactgcgcttcgaatttgaggacaaggaagccgtctccggtgtcactattgcttctgctctcttgaccaagttcaagcccgttggcgccgagaaggccgtcctccgtccttacacccccaccagcgatgaagaccagcctggctacctcgaccttgtcgtcaaggtctaccccaacggacccatgtctgagcacctgcacagcatgaacgtcgaccagcgtctttccttcaagggccctctccccaagtaccagtgggagactaacaagcatgagcacattgccctgattgccggtggtaccggtatcactcccatgtaccaggctcatccgccagatcttcaagaaccccgacgacaagaccaaggttacccttgtgtacgggtacgtcaccgaggatgacatcctnctgg

SEQ ID NO: 4943 - DNA, 689 bp, Aspergillus oryzae
  misc_feature (1)...(689): n = A,T,C or G
ggctattcgatttccttcaatctatctatgggcttttcggcttcactttcaagctgaagctttccactcgtccagagaagtaccttggagaacttgaaacttggaactatgccgaagagcagcttaaggcggccatgactaagttcaagggcgatgactggaccattgatgagggtgacggtgccttctacggacctaagatcgacatcactatcgctgacgctctcaagcgagagttccagtgtgccaccatccagcttgattaccaggctcccatcaacttcaagcttgagtacatgagcaacgaaaaggccgacaagagccaagcggctgccgagtcggccgagggcgagaacaagtctagcgagcctggccctggccgtgctcgtccagtcgtcatccacagagctatcatcggtagctttgagcggtttctgggaatcttgactgagcactttggcggcaagtggcctttctggatcagccctcgccagatccttattgttcctgtcatgcctgctgtgaacgactacgtggaagagctgcagactatcttgcgcggtgatnagcctgacgtcgacattgacatcaacggaaataccatgcagaagaagattcgtactggacagcttgcccagtaccacttcattttcgtcgtccgtgctcaagagaaaggaagctcgcactgg

SEQ ID NO: 4944 - DNA, 658 bp, Aspergillus oryzae
gtatgatggactgtgtctgaactcgacagaagctccacgtaacgttctgtccaaggcatccgccgttgaggccgcagcatacaagtccttgggccccgagaccaaagagcagtaccgtaccaagatccgcagtttattccagaacctcaagaacaagtcgaatccatctctccgcatccgtgtcctcagcaacgacgtgacccccgatcagttcgtgcgcatgtcacacgacgagctacgctccgacgaacagcgcgagaaggacgcaaagatccagaaggagaacatggacaaggcaatggtcgcccaagcagagcgcagtatcagtaccagtctgcagtgcggcaagtgcggacaacgcaaagtcacatacaccgaggcccagacacgcagtgcagacgaaccgatgactttgttctgtacttgtctaaactgcggaaagtcctggaagcagtaacttctttttttttttcgatccttactcttctatttctctatttttctccaatctcttgtcccattcatctttccaccctatttcacctttaccttctatagttgttttatcgagtctgtccaatttacgctacggcgtggagttggttgcttaaaagaggtcgtcaatctcggggggaagcaggttgagccccccgagttt

SEQ ID NO: 4945 - DNA, 673 bp, Aspergillus oryzae
  misc_feature (1)...(673): n = A,T,C or G
ggtcgatatatgagagatgccgtccccctaatgtatagttcctgacggcgaaatcgcatttatctttacactgagaatcactctcctttcccttcaacctaagcccgcattaatcaacattcaacatgggctcagtaggcaaattctcggactctcaggagtaccagaagatcttccactgggcggaaacacagaaggacggtgaaatcccctcctttgccacacgccggaatgacccttatgagtatcaagctggatttggtaacacatttatctccgaggctgtgcccggaactattccccacggacagaatagccctcgtaatgtgcgctttgggctgtacgcagagcaagtaacagccactgcttttgtggccccgagacatgcgaacaagaaagcgtggctctaccgtgctcgtccggcggttgctcatcanggattcaaaaaccttccagacaaccccgacacagaggccactttcttgcccctgaacccgcgggttcacgtctccccaacccagctggcatggcatccattcgacatcccctccaacgaaccggtagacttcgtcgctggtctgaagaccgtcgctggaatctgagacccgactctccgtgagggacttgcaactcacgtctacactgcaaacacaagcatgacccanaaagcctt

SEQ ID NO: 4946 - DNA, 528 bp, Aspergillus oryzae
ctgagctgctccccgagaacagccttttaatcggcatggaccctttttgggaccaccgttcttaaaagttagccaaattgacaacccatcagcaacgtcatactggcgacaagcgtgactctggcgatatatgtcagaagaggtttgcccagcgcggcaatgtccgtgcccataaaatcacacaccatcatgccaagccattcacctgtctgttggacgactgtgggaaacaatttactcagctgggcaatctcaagtctcaccagaataagtgtcacgcaacaacattgcgggattggacattgaaattctcccaagtaacaataggtgaccccatgagcccgcaagatagaaagttgtgggaatactttgccactctttacaagaatagcgccgagggactgaagggtcgtggaaaggatcgtaggatctgccctacctctaggtcaggacctgggaaacgacaccagaccctaggcaacaatgacgacaagctgcaacgccctatttatgaggaatacggcttac

SEQ ID NO: 4947 - DNA, 680 bp, Aspergillus oryzae
caggaagactaacacaaagttatggcttctacttacggggacttccgtcacttgctacctagcaattacaaacgcctgattacttcctggctcgaagaggactgtcccagttttgactatggcggtttcgtcgtcggggagtcagatggtgaggcaaggttgttggggaaagctaagggagtcgttgcaggtgtccctttcgtcgatgaagttttcgctcagttaggatgcacgtgagtcaattccacatgacgttggacctggcctgtgccatgcgatcgatatctaaatgacaggaaagagtggaatggcacgtccaagaaggcgagcccattgaacctatcaaacattgcgccacagtgcgcgggcctatccgcaagatcctcctcggagaacgtgtcgccctcaatatcctcgcccggtgttccggtatcgcaacaaaaagcgcctcgctagtagctgctctccgtgcccacggatggagtggaacgcttgcttgcacccgtaaaaccacgcctggattccgcgtggtcgagaaatatggaaatcttattggaggcgccgaatcacaccgccatgacctcagttcgataacaatgctgaaagataaccacgtttgggcttgtgcgaataaccgtgtggcttatgatgtgggcgggtcccggtttgaaccgaatcct

SEQ ID NO: 4948 - DNA, 1918 bp, Aspergillus oryzae
cagggcattggacacgtcgtaggtgcactctggcgcgtatctagacgctgccaatagtttcttgagcgcagaccctactttacgtgactcgtacaacgaagtgctcacgtccaacgatgttgccgtttatggtggactttgcgcgcttgcatccatggatcgcaatgaactccagcggcgcgtgctagacaatagttcgttccgcaacttcctcgagctagaaccccatatccgccgggcgatttcttttttctgcaattcaaaatttcggccatgtctagatatcctggagtcttaccaaaccgactacctcctagacgtccatttgcaacgtcacgtcagcactctctacactcgcatccgaacaaagtctatccagcagtatctggttcctttcagccgtgtcaagcttgacactctgtccaagatcttcgctcccggagctaccagcgggcaagctcagcctatccactccaagtctccgtttgtacaagaattgatcggtctcatccaagatggtaccctggactctcgtattgatttggaaaagatggtactggtatcaaatcaaactgataaacggacagaagtgcaggaagccgtgttggagagtttatcgaattatattgatgaggcacatataagagtactgcggactaatattatccgtgcaggactggaagtccgcccattaggcgatgagcagcgcaagcaggggcatgggccgaagcattcacgaccgccaacggggatgttccagtgatcaagaagtgagagaggatattacggagatagccagctatgaactgaattatgactagagacacggtagaaaatcaaacagtttcggaacattgtgttttttcggggcgaacctgccttccgtgcaagtggtaaactgagatccggtttactgtcctgtttatgtcaatctaggaatgtgtggtgtaagtgtactttgaagcagatgcgaaaaggtaaaaagaaaacgggaatgaacattctgtaaataagaatttaagtaacctccaaataatacgctttacctcgagcgcttgacaagataacctacaatgcccgccaggagcaatgcaccattgaatccagccatgatgtagaacggcgcacctgaagacaaaacatcgaagagaagaccacctaacttagtaaggaggaggattcctgcgccgccaaaaaaggagtatacgccagctatcgaccccttcaaatgggacaactgttgctgtctatggttccttggccttgcgagcagtggctgtcggtctgcgccgctatccatttcgctagttcgagaagcactatcctcgttatatacttcagtctcagcgtcgaacgcctgtttcgggatctcctggtttagactgatacccaggatgccgttgctcaataccgccaggctgcagacaatcgccccgatttggctgatcccgattaacctcattatggcgagtacactcgggttcctgctctttctgctgaaaatgggtgtgtggagaaatgtgaacgtgtaatatatgatgtcaccagatatacaagcgcgtaggagagacacatagtgcccgggagagttatctgaccagtgtccgaacgcttgtgcaacgattcaggtatccaagttggagacgcctgttaagaattaagcccacttgtaaggtctaaggccaaaatggttgaatatttcgggccctttggttcggctgttaatgcaagggcccaggaattgattatagtggttggccaaaagggggattaattatggaatccccaatgattaggcgcgtggtacaaatcctccgatgtagcctatgaggatgtcactgtggcagcatcctagaactatagctgcgccaaattggtccagatacgggaggtgtgatttgccgccaacagtacatgg

SEQ ID NO: 4949 - DNA, 657 bp, Aspergillus oryzae
ccttttgactggacttttcgctgctgattacatcgcccaccttgatggctctaccacaatcgatggcggctggatcaaccacaactacatccagctagcttatcagctcgccgactccgtcaccggaatggcatactctttcttcggaagctgcattatcctcttcatcatcaacctgattcctggcctcagcttgcgtgccccggaagaagacgagatcatgggcattgacgacgccgaaattggcgagtttgcttatgactacgtcgagattacccgcgacgtgatcagtgccgccaacagtgagagcggcgagaatgcttccaagcgtagcttgactccaaccggcaacgaaacgaccatagaggccaaggcttagccgattacttgtctatgatttggccttcaaatctctttctgcaacttttatttctttatattaatcatcgtaccatcgtggaaggtcgcatggtagctgtcaccttgatagctcgcgacgatacgtttgtatatacttatgcacctactcaatcttttcaagattccttgttgcaatttcatacaatttcacttggccattggaaaacagatatggtactactgttttgtccgagctttaatcgacaagctcacttctgtggacctcatttttacctt

SEQ ID NO: 4950 - DNA, 709 bp, Aspergillus oryzae
  misc_feature (1)...(709): n = A,T,C or G
cggccaaatgaatgcatcattacactacgcgaatttataaatggtgcccaccatctgtacccaattgcagcacgagggcccaaggggggttttttggaaaccataaattcgaaagctcatacccggagtctacccacttcccaatctacactctatactcttctcaatactaccttgataacgcacacgtaaccacaaatatgcaaaccctctccattctcactaccctcctgttggcgacctcctccctcgtcctcgccaatcccaccaagcccgtttgcggcacctgcaaccctctgtcgggccaaaacaactgcgacatcacgacttcgtgcatcaacacgggcacccggttccattgcgcctgtcacgcgggctacaaggcgtcgaaggacaacaatgatatcaccaagcagttccggttgaacatgcccaattaccagttcctggtctttactccggagtcgactgtgtgtaatacgctctgcgataacccgtacggagcgagcccgaatttgtgtgccgaggtgccgattcagaatangtgcgaggtttangagatgcatcaatagattatggttggtgggaattggtgactatgcaagtagataatgggtggttgaaggtggtgggagcgtacttngtcngtactttgatatgcatggcttgttgcaaggttaatctacattccttttgtgagcttaacgcn

SEQ ID NO: 4951 - DNA, 673 bp, Aspergillus oryzae
ggtattcactggccctgcagagaacactcgtgatggtgtcatcatgagcgctaagttccttgctgcgggtgactggaagaaggctgcagagatgcttaactccatcaagatctgggatctgatgccccagcccgacaagatcaaggagatgctgtctcagcagatccaagaagagggcctgagaacttaccttttcacatatgctcccttctacgacagtctctctatttccaccttgtcaaacatgttcgagctgtccgagaagaagattgccgccatcatcagccgtatgatctctcatgaggagctcgccgctgctcttgaccaggtcaacgatgccattgttttccgcaagggtgtcgagctgtcgcgtctccagtcccaggttgttactctcgccgacaagtcgatgaaccttctggaggccaacgagaagactctcgagcagcgcactcaaggcatggccaacgctttccagcgcgatcagggcgccggcgcccgtggaggccgtggccctggacgtggaggccaagcccgtggtggacccagactgcctggcggccaacaaggtcgtcggccccgcggacagcaattcagcggtggtgcattgggcggagcgatcaggcataaaattgtttgtaatggcatcccttttgttttcatgggtctaaag

SEQ ID NO: 4952 - DNA, 628 bp, Aspergillus oryzae
  misc_feature (1)...(628): n = A,T,C or G
cgtatattggaagggacgggatattacaaccgcctgcgagaaccaatctcgtcaattgagactcttcatcatgagggaatcatcccctcctagcttctcggaggccatgtcagactcccagagtgtcgataccaagagcaaatggacgccgaaatcactcattcgacatgctgagcgctcccatagtcgcataccgggagttcgcaagatcccttttcctgctcttgctatcatattattcattgcatttatcaatgtagcggtatggattgcggttgctgttgttctgcgttactatccgtctctggtctccaatgccgtcctcgcgtataccttanggttgaggcatgcctttgatgctgatcatatctcagctatcgatttgatgacgcgtaggctgctggccacgggccagaagcccgtaaccgtgggaacattcttctcccttggtcactcaaccattgtcatcgtcacatctatcgttgtggctgccactgcagccgccgtgtcatcccgctttgacagcttcagtactgtcggcggtatcattggcacatctgtcagtgccgcttttctcatcttgttaggtctcatgaacttctacatcctgtataagctgtacaagcaa

SEQ ID NO: 4953 - DNA, 714 bp, Aspergillus oryzae
  misc_feature (1)...(714): n = A,T,C or G
gcaaaatagacgatgtaacagcacacggctggccagaggcattcgtctcggactttgaatcgaagatctggatgacgtatcgatctgatttccccccaataccaagactagacaacgacgaagcgaatcatccgatgacgctaactgtcgtgactggcgccgtggcgataaagcggaagaagaggcccgcctactatcactgtttgctgatcatccagatgcacctctctcgatacatcgatttgtcaaatatggtgccgagtcatgcggtaaacaccctggggagtggtttggaccatcggcaaccgctcgatgtatagaggctctctcagcacaatgtggaaatatagcacccagagtatatgtcacaaacgatacttcagacgtctacgaagatagcttcctccgtgtggctcgcagtggctcgggcagtattcaacccacactgatacttctagggactagactgggaattgacaacgtcacgccagtgtactgggacggactgaaggccgttttgcaattgccacagtcggtaggcatcgcaggaggtcgtccttccgcgtctcactacttcatcggcacgcaaggcccgcatttcttctatcttgatccccataccacgcgccccgcagtnccatacagcatcgatggtagactcctctccaaaacgggaatcagtacctatcacactcgccgacttagacgcattca

SEQ ID NO: 4954 - DNA, 1395 bp, Aspergillus oryzae
  misc_feature (1)...(1395): n = A,T,C or G
atatactcgtccgaattcggcacgagggactgctgaagactgtacctatacaccctttcagcatatttcccatcatctactccttctcaataacatacatccagcataatacatcgcctcacatcatggctccacataacgttcggtggggtatcatggccaccggctggattgcaagtgtcttcgtaagggacctcttgaaagaccctaatgtccgaggtgcatctgatgtctcccacacagttgttgcagttgcatcatcttcctctaagtcccgtgcagagggttttatctcggatacgggcattcctgctccctgcgctgcctacgagtcctatgaggacctcgtggccgacccaaacgtagacgtcgtatacgttgcaacgcctcactcgcaccacttccaaaacgtcatgcttgcttttgaggcgggtaaacatgtcctgtgtgaaaaagcttttactgtcaatgcggcccaggcaaagatcctctgtgagacagcgaaaatcaaaaatctctttttgatggaagccgtctggactcggtacttcccacttagcatacagatccgtcggttaattcagaatggcactcttggtgaggtactgcgtgtgctggccgataatagcttcggagatgacatggaggaaaaatggggtatcaagcatcggatggttaataaggatctggctggcggggcgttgcttgatttgggtatttactccttgacctgggtgtttcaggctctatatcacactcttcctcgcgagtcgcgcagggcaccctcacgaatctcatcgcatatgtccctttaccacctcactggtgctgatgaggcaacctccattctccttaccttccccaccagcactccgtccaaccttcctcacctgggtgaatcgcaggcggtggctatgacacatctccgagtgtcgaccaatgccgacgacaaacccgtccagccttcggtccgcattcagggcaccaaaggtgagatccaggtatacggccctgcgttccgaccggagaagtaccgggttgttccgaagggtgagggggaagtcaaagaggtggaatgttcattccctggtgatggaaagggcatgtactgggaggcggacgaggtcgcacggtgcttgcgggatggtaagctngaaagtgatagcatgccatgggaggagagcatcatcattatggaggtcatggatgaggtcaggcgtcagggtggattgggttatcctanaaacattggaatccacagtctaccctacatcgttgtaagaggcggnctgtatcgtgtggtgaacaatcattgctttgtcacaaacgtgtaaatatctttagtaccaacgatcatacaaataacatgtactagaggtaaattagaagagaata

SEQ ID NO: 4955 - DNA, 1045 bp, Aspergillus oryzae
tatcgcccacaatgctgagagtatctcttacccaacagtcttatatgaagatgtcatgtctagtgacgagggcttgcgtgaatggcttcaaaaaatttacctccacggcttctgcttcgtcaagggtgtacccgttgacccggaatcaacccaaaccctcctggagagaattgcttttattagacatactcactatggtggcttttgggattttacggccgatttaacgttcaaggatactgcgtataccactgagtttcttggtgcacatacagataacacgtatttcactgacccggcacggcttcaactgtttcatttattgtcacataccgacggtgatggaggcgcgagcttacttgtcgatggcttttcggctgcagaagtcctgcgagaagagaatccagagaactaccaattgctagcagcaacgccacagccgttccattcaagcggcaatgaaaatacctgcatccagcctgcagagcaaatgcccattttcaggatccacccgcagttcaattacctgtaccaaatccgctggaacaactatgatcgggcggctaaaaaggattggagcttggaacagcagaatagatggtacaatgcagcccggcacttcaacgatatcgtcacacgtgagaaaatgcagatatggacccagctagagccaggaacagcacttatcttcgacaactggaggatgcttcatggtcgctccgaattcaccggaaagcggaggatgtgtggtggatatattaacagcgatgacttcgtttcgcgttatcgcctcttgaggttcggcagagagaagatcctgaacaacataggtaacttttcgagaagtatggacaaccctaacttcttctgtagggggaatcggatataggacgctttgaaactttgatctaagctctgccggaaatgggcattgaaatgggaagttgcctttttttggggctaaggcgatggttctttgaaggtatgttatatccttgtttaaacgaaaaaaaaccggtggggtttttttctaaactgggccctt

SEQ ID NO: 4956 - DNA, 621 bp, Aspergillus oryzae
aagggtgcatttcccttcgccgattctccctgaccaccggaaagcataagctggtggaagcagagaagcagcgcgatggcgaacaaaaccacacatctactaacctggagagtggagataaaagtgctatccttcactcaaaactggacacgaaacctccgacgatagtaagcagcaatgggaactacctcattgccgagggtggacgggagattctcgacgccagcggtggtgctgcagtggcttgtatcggtcacaacaactcccgcgtcaataatgccataatgcgtcagttgcaaagcttcagctatatctacgctccattcttcacgagtaaggcgtcggaaaagttggccacgttgttatccgaatcgacacaaaatcaactatctaaagcttttattgtcagctctggtaccgaagcgattgaggcggcattaaaaatggcacgtcaatactttctcgaactaccaaacccggaaccgtgcagaacccgatttatcgcccgtcagcagagctatcatgggaacactcttggatccctttcattgggaagacatgttgggcgtcgggcaccttatgcaccaatactgactaccaatgtttcccacgggttcgcat

SEQ ID NO: 4957 - DNA, 724 bp, Aspergillus oryzae
  misc_feature (1)...(724): n = A,T,C or G
gtgcaaggaataacgttcaggaagtctgcggtatctttgcccgatcgtcggacaacgagctccgcgccataaaccaggcgttcagcgcccgctacaatgcctcgctagagaaacatatcgacaaggagttttcgggacatatgaaagatgctctgcttcagatgctgcgtggcgcattggatccagccatgcgggatgccgagttattggaggactgcgttaagggtatgggcactaaggacgtcaaattggtgagccgcgttgttaggatacactggaatagagcgcacaaggaccaggtgaagcgtgcttaccgtcatcggtatggaaaggacctgatcgagcgggttcgcggtgagacaagtggtgattaccagaggttgatggtcgctctactggagtaaaccctttcttttgctttatgattgtatgaattaatggtacgttgggtacggtaaaggtcatggccagggctgggtggttttctgtttcctttacatgcgtcaactttctattattgtttaataagtgtaactcttgagtgataccaccagatgcatgttctcaatgttttaagcgggttggttcngtttcactatgctccaactagttaactgatgaattatcttcgcatatttgcttgaggaaaaataaaaaataaaaaaaattcctgcgggcgctctagccttgctttaaagggccgcatttgtaatttgttatgtcg

SEQ ID NO: 4958 - DNA, 709 bp, Aspergillus oryzae
  misc_feature (1)...(709): n = A,T,C or G
caatctgatacttcattagttttcaatttttactgtttggtgctgctatcatggattcccagagccttttcgacgtcaagggcaaagtggtgctggtcaccggtggagccaagggaattggtcgcatgatctctgaaggatacgtagcgaacggtgccactgtttacatctcgtctcgtgatgccaaggcctgtgagaaagccgtaaacgagctcaatgcgctcggcaaaggaaaggctcacgccatccccgccgatttttacaaagaggaggatgttaagaaattagctgaggagcttggaaagcgtgagagcaagctgcatgttcttgtgaacaactccggatcgaactggggtgctccttacgatgaatantcctcctctgcttgaactanggttctcactctgaacctncaccgagtcttcgatctgacgaggctttgtacccccctgctggagaaggcagctacttcgggcgacccagcccgcatcatcaacatcggtagcatcgatggtctttgagtcccagcactttgagacgttngcttatagtgcttgtaagggccggcttgcatcattttgagccgaattctttgcaaaccaaccttggtaagaagaaacataacatcaaaattcacttgcttttgccggcccctttgagaagtaagaatgaatgcctggtacccctggaaacatatatcgggagcaaa

SEQ ID NO: 4959 - DNA, 644 bp, Aspergillus oryzae
gtaaagagaaaaattttgcaaaagaaagacaaaaggggtatgcagtgtacaagaaaaggaaaaaccgaggcaatgaaataagtcaaagtcacttgactagagaacgggtcaggacgtttagtatggcgagttgacaatatcatctcgtcccaaacggctgccccaccgcgtgctccgacggcttggggtgacggggggccctgcaatactttcgcgagtgggcttctggagagctctctttgcgaccatgttgacctcgttcggcaaagcgacaatgacgttcttgtcagaaccaaatcggaagttgtctgccatgacctcttcagagtaccgcttgatcgtgtaaggatccttgcgtccagcaagcaccttcttcatgctccatgtgacgatgaacggacccgttgccgggatgatcgacgtcttttgtgaatcaacccccgtattaaaacgagcttgggtgaaagcgagagggttcttgggttcatgccggaactgggcaacatgtgcttgctggagaacaaatacgacgaagttggggcgctggaatctttggcgaacgaacgcttgaaaccaagcttggcttctgtcttgcctttctttttgagcgaagtcattgaaaaaaaaggagttccacattgttc

SEQ ID NO: 4960 - DNA, 665 bp, Aspergillus oryzae
caccgcaagaccatcacaccgatcgagccctccaagcagcatatgatgctgctgaaaagattggaaacttttccctgtttatatcgtttgactacctttccggtgggccctggccggcagatcgagttatcactatcgtcaattcgtataagaatcgaaaggcgcagttccactacgaggagaagccactggtatcgacatttgaaggtgtcggcaacgctggtgactggccgaatatcaaggccgctacaggttgtttatttatcccctgctggacaagtatgggaccagctggtatacgcaatgttttaaatgatatcgatggtgcttttagctgggatgcttggccagttggtgcagaagacaagaaggtgacaaacgacctggaatggatgaaagctctctcaggtaaaccatatatgatgcccgtcgctccctggttctacacgaacctccctcaatggggaaagaattggctctggcgtggagatgatttatggcactatcgctggaagcaggtcattgaattgcaaccgcctcttgtccagatcttgagttgcgacgactatggagagacgcattacatcggaccagtctaagaggctggagtgcctgaacgggcttcgcgatatatcgcgaatcaacctcacgatgcatggcgaact

SEQ ID NO: 4961 - DNA, 678 bp, Aspergillus oryzae
  misc_feature (1)...(678): n = A,T,C or G
gggatgattacgtttaccccttttgggagaatttcataggtgaaaccagaacacgtgaactgtggtggcgtggaatacctgctcgaagcagaggaacaacctggcagcgcgccatcggcaatgagctgtctttgtccgaggaaacgtacaagaaggcattgcagcgcgccaaagacgtacggtcaagggccgatggcgacgctggagagagtaacaaacgaatgcgagagtggtttgaggcaattgaagccgacgcatccaaagcattcccagatttgaaactgttccaggtaggcggccctttacgggaatccttgattgacgtattggaggcatactctatgtatcggagtgacgtgggctatatcactggtcttcacacaattgctgctctcctcgtccttcaattcccatcaccttcatctgctttcctcgcaatggccaatgctctcaatcgatctttgcctgttgctttcctcaccctcgaccggggggcgatcggtcgtacttacacactaacgactgcgacccttcgttataaattccctcgcctagccactcaccttaccgagacgcttcagctctcggatgaagagatcctggagccaatgttccgctcccttctcacaaacggtctagacctcgagcgtatanccgcgtctgggactgcttggtatt

SEQ ID NO: 4962 - DNA, 664 bp, Aspergillus oryzae
gtctcactacccaccctcgcggctctcccctctgcagctttccatcgctggtcattatatcttgaccttacggtccgacctcataatgttctctcgtgctgttcgcccggccgtcagggccggtagtgctgttgtcacccgcactgctcctcccaatgccgccaacttcgcgactttgcgtgaaatcgagggccgtctcaagtccattaagaacattgaaaagatcaccaacactatgaaggtcatcgcttctacccgtcttacccgcgctcagaaggccatggatgagtctcgcacctacggtcagacctccaacaccgttttcgagaaggccgagaccaagcccctcgaggacaagaagactttgctcgtcgtcgccagctccgacaagggtctttgcggtggtatccactccggtctgagcaaggctactcgccgtatccttcaggaacacgccgacgccgacatcgtggttcttggtgagaaggccaaggctcagctctccagaaccaaccccaacgctatcgtcctgagcttcgccaacgtctgcaaggacattcccaccttcgctgatgcccaggccgttgccgaccagattgctctgcttgccgccgactacgccagcgtcaagatcatctacaacaaagtggtttaacgcccaaag

SEQ ID NO: 4963 - DNA, 522 bp, Aspergillus oryzae
ttcgcggccgcaggaattttttttttttttttttactcatcaatttcggttcaccaatatcctatctcggttcacctaaatatacatatgcaggttttggctggtcaatttttgtccagacgtatgcgggtataaactcatcgcggttgtcgcttttcaaatcagaaaaaaaatcaaaagaaatgtcaaatgccgtacacaggccaaagccatggcatcactctaatcaacccggtccaacttctggacaaccatggcactagcggcgccaccaccattgcaaatcgcggccacaccatattcaccaggctgcagctggtggagaagagtgaccaggatacgggagcctgagcttccgagtgcatgtcccagagagatagctcctcccagagggttgacacgggcgttctgcaatccaagaatcttcttggttggtttgataaccggggcaaatggcttatttaacttccaaaccgcaacctgatccttgtgataccagctcgctcgaggggcatgggaacc

SEQ ID NO: 4964 - DNA, 973 bp, Aspergillus oryzae
  misc_feature (1)...(973): n = A,T,C or G
ttcttcgttcctcacccttcaagcaggccatctccatcagcgcaccattcaacttttatcgctgatcgacttttagtctcgtcaagatggttctcgcggtcgaccttctcaaccctacgcctcaggccgaggcccgcaagcacaagctcaagcaacttgtgcctgctccccgctccttcttcatggacgtcaagtgccccggctgcttcaccatcaccaccgttttctcccacgcccagaccgtcgtcgtctgcgccggttgctcgaccgtcctctgccagcccaccggtggcaaggcccgtctcactgagggctgctctttccgcagaaagtagatgtcacgatacaccaggctggagcgatgatgaaagacatgtggcgtttttcgatggattaatctaatctttttcttgagcaaaactcagatagaagatggagtcctcgcccccttgcgagaaaacccctcaaaaaatacaaaggttcgaagggaaatgagaagtacccaagcaggcgcagccatttctattaccaagtttccaccaaaaagcgtacatggagggagttccggatatctggcaatgatcggtccatactatatcaacctttgcctcttttttgactactatcgaaacggtgtttgcttttatacttgttttatgctgggggatccgtacgacaatatcttctcccgacacctctcccgtcatggaaggatatgacgggtggatcccaccatggggcatatctgcatgagcgttgccggttgattcacgtattcggatgtcatgggaatgagtgtggatcctcccctatgacgaagatgaataactggttgctggcattgctaggacggcggatgtgactacgggtgaaacttggatccagtcaggcagatagcgctggtttttggcaggatgtagaaatacggtcctgttgtaagctagcctatctgaccaggacngtcaagccgtgt

SEQ ID NO: 4965 - DNA, 634 bp, Aspergillus oryzae
  misc_feature (1)...(634): n = A,T,C or G
ccgtcatcagatatatcttctcacgaactacctcccatccctcggtttcggaacacttaatccattccacttgataccctctatcattaactccgaaaccgtcaaactcagtcacaacatccgtcatcatggctgacggagtattgaaggcggagaaggacttctccaaggatgctgacaagctgattcccgaggccgagcagatcgccaagaccgatgcccaacgcgcgattgacagtctgctcggactggagaaacaagcgagacaggcctctgacctcccaactacatcccgccttctcgtcacgattgtaacccttagcaaaaactccggagactggaaccttctcaacgaccaagtcctccttctctccaagaagcatggccagcttaaacaagccattacaaagatggtgcangtggtgatgggattcctggatgagacacccaacttgggagttgaagttgtctgtcatccagacccttcggactgtgactgatggaaagatctttgtcgaagtcgaaagaccccgcgtcacccgcattcctgtcaacatcaagaaaatctcaagggcgatctcaatgcccgccggtgatattctctgcggaactgcaagttgagacattcggaatc

SEQ ID NO: 4966 - DNA, 688 bp, Aspergillus oryzae
ctttgatagaattctccactcctttctttcttaaccgacaaactagacgtttgttttcctttcattattttttatttgtcttttgtccaagatgaagctcaaccttgcctctctttcctttctcgcgagtatcgccccgctggtttcgggtcattatgtgttttcgaagttgattgtcgacggacagacaaccaaggatttcgaatacatccgcgagaatagcaatgggtaccaaccaacactggcttctgaaatcgtgaacaacgacttccgctgcaacaaaggttccatggactctgcggccaagacaaaggtctataccgtcgctcctggtgcagagatcggttttcagctcgcctatggtgcttcgatgaagcaccctgggcctctgcaaatctacatgtccaaggcacccggcgatgtcaagacctacgacggatcgggggattggttcaaggtataccaggagggtgtctgcgaagacattttccgatgggtttgaacgattccgaactggtgcacttggggtaaggacacttggtccttcaagatccccaagggtactccgccccggcatattttggcccggttgacacattgcctttttgggggtttcggggaattccaagtttcttcccttgccctcaatcgaggttccgggtttggatcggccttcccgggccctttt

SEQ ID NO: 4967 - DNA, 695 bp, Aspergillus oryzae
  misc_feature (1)...(695): n = A,T,C or G
caatatctcactaagctcatttacgtttctatcttcttgtcaacctcgaacatatctaccttgtacatctccataagtcatgcccgtaagaagggaactcgccgataatgccacgcgtggccccactgatggaaattacgccgatgaactcgacgttgatgtcctgattgtgggtgccggcttcggcggtatctattctctgtacgaaatgcgaaagctcgggctcaaagctgtcatctatgaagcgggaaatgatattggtggcacctggagatggaactgttatcccggcgcgggtgtggactcggaggtgcccgagtatcagttatcgatcccggaaacctggaaggactggacgtggtcgaccaattatcccaactatgaggatctgcgcaagtacttcgatcatgtggacaaggtcctcgatatcaaaaaggactgtgcattcaacagcgtggtcgtcggcgcgcacttccatacagtggaaggccgctggcacattcggactgcggatggaaggactgcacgcgcgaaatatttcatcatcgctgccgggtttgcggcgaagcgctacatccccgagtggcccggcatcgagaagttcaagggaattgtncaccactcgtccttttggccagatgagaaaatcgacgtttcgtggcaagcgctgggcgatcattggcacttggcgcttn

SEQ ID NO: 4968 - DNA, 682 bp, Aspergillus oryzae
caggtacaccccctacgcggccatcgcgcgatctctgagggttccacccaatcggagtcctagtagaatctcaccgacaagcgtcctattcagcctcgcctcacctttcattcgcgcaatccccgagctcgatagctcgaacccgtcattcacccgagtgccttcctcttattctattccctctccagtgagcttaacgacaggtcgctggcaagatgcccgacgtcaagaggaatgtccggctgatcacagaacagcatgttgtaaacaaagattcgggtgttgaagggttccccctccgggcgtggtctattgagatttaccttgtcaatgaccacggagagcaagtgccggccaacgtcttcgacaaggtgacgtatacacttcatcctagtttcggggatcgggccattcaaaccttcaagaaccccccgttcaggatctcagaagaaggatggggtgaattcgacatgcaaatcacccttcacgccgacaaggatcattacgtgacacacgacctcaactttgcacagacacgctacgagtccaagcacgtcatcacatttaaaaaccccaagcctgccttattggcagcccttcgtgaatcaggccccgttcccggagacgagaatggagtgaaatctaagcgttccgcagctagcgaagaaggatcaaagaagaa

SEQ ID NO: 4969 - DNA, 796 bp, Aspergillus oryzae
ccgagtaaaagtctcccgtcttcttctctctttcctatacccatccctctcgagactccagtccagtcaacgaccccatcgaccaccatgtctactgccgagctcgcttgctcctacgcggcccttatccttgccgatgatggcatcgaggtcaccgccgacaagctccagactctcctgaccgccgccaaggttcaggaagttgagcccatctggacttccatcttcgccaaggctcttgagggcaaggacatcaaggatctcctgaccaacgtcggctccggtggtgccgcccccgccggcgctgctgccgctgctggtggcgctgctgcccccgctgaggccgccgctgaggagaagaaggaagaagagaaggaggagtccgacgaggacatgggcttcggtcttttcgactaagcgtcttcacccgttcggctttcctaatttcctttttcacctcgtttcttccatatctccttttcgccctcgcatttcttgtaccccatactacgcgaccgcacgatgaccaaaaagggaaatttaaaagggatcaacggacaaagacatccggtgggactgggcgctttgcttgtatgatgggttcgatgacaggtactggaacggatgacgctatgattccggccatcagacttcagtcgtggcacacctatgggtcgggggcgagatcgtgttggccgtcctcgtttctatgttatatgttcccagtttagctagtttcgagcttaggtgcccagatctcatgccatgtctgtcatgcgaccatgaaaaaaaaaaa

SEQ ID NO: 4970 - DNA, 725 bp, Aspergillus oryzae
  misc_feature (1)...(725): n = A,T,C or G
cgctgtgatcacaaccaggcagcagacacagccaaagagcgagaaaaagggcctgatcgagactggtaaggaggttgttaacagcgaagatggctggaccggtctgtggagaggtctcaaggccagtttgatcctggttgtcaacccggcaattacctacggtgcctatcaacgtctgaaggatattcttttcaaggggaggaacaatctaaagccctgggaagctttcctcctgggcgctctttcaaaggcaatggccacaattgcaacccagccattgatcgtggccaaggttggtcttcagtcgcggccacccccgggtcgcgaaggcaagccttttaagacctttggtgaggtcatgcgatatatcattcagaacgagggtgcgctgtccctcttcaagggtatcgggccacagatcttgaagggtctgttggtgcagggcttgttgatgatgacaaaagagaggatggaactcattttcatcgttctcttcgcatatctgaagaagctcagagagcagaagttaaagaaggtcgtcgatactgcttgngccagcgctaaaaccagcccttcggcanaccctgaaatagatgtcgctcccacttttctttcatatatacgaactagcttggcttttggtcttggcaatattctctgacggcgtgccggttccgattgccaaattctactcttctatgataccaggcttacttttttgatat

SEQ ID NO: 4971 - DNA, 741 bp, Aspergillus oryzae
caccactgtaatcttttctgtgtctagcccttttaggctcccctaattcacaaaatggccgacccccgtgttgaagaaatcgttgaggaggagactcccaagcagaccgttgaggatgctggcagcgactccgagtctgaggctggcgaggccaacattcccgccggtgctgccgtcaccatccactctcgtaacgagaagaaggctcgcaaggccattggcaagctcggcctgaagcacgttcccggcatcactcgtgtcactctccgcagacccaagaacatcctcttcgtcatcaaccagcccgatgtctaccgttccccctccagcaacacctggatcatcttcggtgaggctaagatcgaggacctgaactcccaggcccaggcttctgctgctcagcagctcgccgctgccgaggctgccgccggtgagcacgctggtcacgaccacgagcacgatctcggcaccaaggtccccgaggccgagaccaagaaggaggaggaagaggatgatggcgagcccgtcgacgagtccggtcttgaggccaaggacatcgagctcgtcatggctcaggccaacgtgtcgcgcaagaaggctgtcaaggctcttcgtgagaacgacaatgatatcgtgaactccatcatggcgctcagcatataagcgctgcccatttaatttcgcgctatcagtggctgatgtctcttagccctgctggcacgatggctttgggtgagaggc

SEQ ID NO: 4972 - DNA, 763 bp, Aspergillus oryzae
  misc_feature (1)...(763): n = A,T,C or G
gcattgcatagcagatacgcacgaggcgtggaagtcggcgaaggcgaggttgcccccatggagggccattctggtcctggtgacgcttactcgtttcctggtgtcattggcccttactggcttgttgatcttgctgtggcgtggtattagcaagtccgcatcggagatgcaaaatttctactgttacggacctcccaagtcgccaatggatatgagtcttaacgaaatggccgaatggaatgcccatatgcaaaccccggtcgtctataaccaccatgacccttatgaagtcaactcttctaccattcacaacattgacctcaaccccatcggctctagtgctcaagctgtcgcaaacgctgaacgagtgctcatcctgacgccgctgagagatgctggcccatatctgcaaaagtacttcgagctcctctacaagctgtcctatcctcatcaccttatcgacttggccttcctcgtcggcgactccaaggatgacaccgaaagcctcctcgtctctgagttgaatcggatccaggaacagggcgacaaggttgcgttccgcagtgcgagcattatcaagaaagacttcggggccgatgtgaacatgaacgttgaggatcgacactcctttgccgctcanggtccgcgccgtaaggctattgggccggcacgtaactatctgctctnactcgccctgaagcctgatcattcttgggtttactggnagagatgtggatattgtcgacagccccagagacccatt

SEQ ID NO: 4973 - DNA, 651 bp, Aspergillus oryzae
ctggcgatgtacctataaatgctctagtaaccggtgataataatcagagaagcatgttcatccagctttaattcgtggaaagtgactcaagatgactacacaggagcagaaagccgatatctggtcagccgatgtttacggcaacaaagtggccccattcgttgcaactttaacagagaagattgtttcttggctcgatcctaagcctacagatgaagtactcgatgtcggctgtggagatggcgtcctaactgccaaattagccccccatgttaaacgtatcgttggcgtcgacgcctcaccgaatatgatagagcacttccagaaaacatatccccatattgaatcctgcgttgtggactgccgacatttggatcaagtgccagtcctcactgaggggaagtttgacaaagtcttctcgaacgctgccttacattggatcttacacgaccccgaaacccggtcgaacacgatcaagggctgcttcaatgcgcttaagccaggtgggattttcgtgagtgaatcgggtgcgctcggtaacggtaccgaggtgcatgcggcaatcgtcagtgctctggtcattccaagcattccttgtgaaaaaagcccggcaggttcgccttggggggttccttcccagaagctttgaaa

SEQ ID NO: 4974 - DNA, 732 bp, Aspergillus oryzae
  misc_feature (1)...(732): n = A,T,C or G
catctatcttacctctccgaccaagcctgagagaccactgattcttatcttctttattctggccctcaatgcatattctggttgtgaacgacgacggccctccgtcaaatcagtcgtctccttatgtccactctcttgtcgttgcgctacagtcggcaggccatgtggtctccgtagtcctcccacatcagcaacgatcatggatcggtaaagcccacctaatcggcgctgccgtgaagcctacctatttccgtcctggaacgctgcatcaagacgatggaacgacgcacgacctgcctcggggaagtgaccctgctgacgatgaagacgacgatggtgatgaatggatcctcgtcgattctaccccagccagctgtgtccagattgggttataccactatttcgaggaccgtggccctgttgacctagtggtgtcgggcccgaactacggccggaattcaacggcactattcgccttgtctagtgggacaattggtggtgcgatggagggagctgtctgtggaaagcgctcaattgcactgtcgtacgcctttagttcaagggaccacgaccccgttgtgattgccgaggcatcgcgccattcggttcggttgatcgagtaccttgcaaagaattgggcggacggtgtagacctttacagcgtcaatgtaccgttggaacctggtgtgagccagagcaagggtctctatactgacatgcttgataaccgan

SEQ ID NO: 4975 - DNA, 710 bp, Aspergillus oryzae
ggtatacgctatcgccactgccgacgacgcatctactatgcactgccagaacacactgcgattagatcctatttgaccatcgcaatggacgagaaagacctttgcagcaatcggaagatacttcaggagacgctgaaaaagaaccccatctccagctcctctacgaaacgcaagacatcgggtcgggaaggtcaaaatggtgtggtaaagaagcgaaacacggaaacagtcgaagggaaaactaaatctgaacaatctcatatatcgaaaaagaggaagagaatggccgacaacgctgctgaggggggcaaggatgacgtacaggaaaccgtcttgaaatccatcacccggaagaattctactgcctcgcttgcgccgcgacctgacgtgaagatttcgaaggccaatgagggccggtcaccgactgcggaactaggtaaatatgttgcgatggactgcgagatggtgggagtcggccctaaccccgataacgactcggctcttgcgcgtgtcagtatcgtcaacttcaacggcgaacaagtgtatgactcctttgtacgaccgaaggaaatggtcacggattggcgaacgcatgtgagcggcatattaccgaagcatatggtggaagcccggtccctcgaacaaagtcaaaaagatgtcgcagagattatggatggacgaatactcgttgggcatgccttgcggaacga

SEQ ID NO: 4976 - DNA, 676 bp, Aspergillus oryzae
cttcgacagctggcgtacatttgaatacctcgacgaggatgtgcccgatgatggcgaaagccgtgaccagaagcgtcaaaccgagaagaagaacgccaacgctcgccgcaagcgtaaggttgaggacactgctcgtctccgtaagctcgtagacgactgtgctgctcaggatgagcgtattaagaagttccgtaaggctgctcgtgccgacaaggacaagaagcgtctcgagaaggaagccgaggctaagcgtctggctgaggagaaggagaaggctcgtctggaagaggagcagcgcaagaaggatgctgaggaggccgccaaggctgaacgtgagaagaacaagaaggccaaggaggccgctaagaacgctaccaagaagaacaagcgtgttgttaagggctccgtcaaggaggtcaactacttcgctgatggcgaggcttctgcttctcaggtcgactccgtcctgaccgacgttgagcttatcatgagcaagattgatgccgaggagcttgccggtctggctgagcgtcttactgctgctggcaaggatgctgctgccgtcaagaacgtttacgctgaggagtccaagaggctggttggtgccggtaagctcaaggagggcgagaccaagaacttctagagtactcatctagaaggtacgactttgttatgg

SEQ ID NO: 4977 - DNA, 735 bp, Aspergillus oryzae
  misc_feature (1)...(735): n = A,T,C or G
tcagcataaccttgacaatgaccgcaattctgaacagagacttgctccggaaatgtgcgcgcccccaatcggtgtgctactgttgtcgtggcttcgccagcagttctccttcgttcgcgggacataatcgatggtcccagatcaaacatgacaaggcaaagaatgacaaggcgaaaagtaaggagcgccaaattatcggcaaggaaatcagtagcgcgacgcaaatgtggggagcggataccaagttcaatcctcggctgacccttgccctctcgaacgcaaaacgagccggaattccaaagaccgtgattgaggcagcaattgcaaggggccagggtataagtgtaactggcgaggctctcgagcaagttaccatcgaggctatactgccccattccgttgcagccgttatcgaatgtcaaactgaccagaaggcgcgcatcttgcaagatctccgctatgctatcaaagatgccggtggaaccgtcactccgactacgtatctctttgaaaagaaggggaggataatattcgaaaagaaagacggtctaaatccagatgactatcttgatcaggctattgaagctggcgctatggacattacggcagatgaagaaggccgtctcatcgtgttcacagagccaacagaaacaaagagtgtgggtgaagcttttgacaagtcatctcagctcacaattgaagaaatagaaataatntggatccgaaccgagacac

SEQ ID NO: 4978 - DNA, 661 bp, Aspergillus oryzae
cgcaaacgggtctttatagccatgtccgcccaggctttagcccaactgaatggcattaacgtcatctcatattacgccccgctcgttttcgaatccgcggggtgggcgggccgcgatgccattttgatgaccggcatcaatgcaatctcatacttggcatctacggttcctccatggtaccttgttgatcgctggggaaggcgaccaatcctcctttcaggagcagtcgctatgattgtctctctctctttaatatcatattttattttcattgatgttgcagcaactcccacgctcactgtgattctcgttatgatttacaatgctgcttttggcgcatcctggggacctatcccgtggctatacccgcccgagatcttgccgttaagcattcgtgcaaaaggtgccagtcttagcacagctacaaactgggcttttaactggcttgttggagagctcacacctatccttcaggccgtgataaaatggcgcctctacctagtacacgcctttttctgtgcgtgtagttttgtgctcgtttacttcctatacccggaaaacagtggcgttcgcctcgaggatatggatactctgtttggggacgcaactaacgccatgccaacacccgcctcccaaggagaacatggctctctaatgagtt

SEQ ID NO: 4979 - DNA, 453 bp, Aspergillus oryzae
catgcggccatcatcaccttaccgaacctcgaagttcaggtcttgattggcaactagccttactttgcgccatctcaatcccggtctccccaccacaaaccagccgtcaagatgtctttccagaagcccgagaaggatttcggcgagggccctaaggtccacaagatccgtatcacccttacctctcgcaaggtcgcctccctcgagaaggtttgctctgagctgatcgagcgtgcccgctccaagtccctccacgtcaagggtcccgtccgtcttcccaccaagacccttcagatctccacccgtaagacccccaacggtgagggttctaagacctgggacaagtacgagatgcgcatccacaagcgtctcatcgacctcctcgcccccactgagactgtcaagcagatcatcatcaacatcgaggctggtgttgaggtcgaggtcaccatt

SEQ ID NO: 4980 - DNA, 515 bp, Aspergillus oryzae
tcccggtctttgccttgatcctgtgttccctgattgcctgcctggcctacatgaacgtctccagcgactcgaagaccgtcttcggctacttcgtcgaccttgtgaccatcttcggtctcctggcctggatctccctgctggtcacacacatccacttcatcaatgcccgcaaggcccagaatgtccccgagcacgagttagcctacaagtctcccttcggtaagacgggcgcttacatcgccctcgcattctgcatcctcatcgccctaacgaagagttacgacgtcttcacccacaacccgaagtggggcaacttcaactacaagaaattcattactgcctacctaggcatccccctctacctgattctgctctttggctacaaattcgtcactggcaccaagggcgtgaagcccgaggaagccgatctctggacgggcagggacgtcatcgatcgtgaggagcaggagtatttggcccgcaaagctgttatggatgaacagcggggcaccggt

SEQ ID NO: 4981 - DNA, 700 bp, Aspergillus oryzae
  misc_feature (1)...(700): n = A,T,C or G
catactcaattctacccaggcaaccacattgcccgaaggtccagtagtaaatggcctcttccgccataacaacactacccctccagcgcaggagagtgttatggctctcttctcgctcaaggggaaaactgccgtcgtcaccggcgcagcatcgggtatcgggttgagcgtcgcacatgcactcgcggaggctggcgccaacgttgccatctggtataacagaaacagtaaagccgttgaggaggctgcaaacatcgagtctaaatatggcgttaagtgccgtgcataccaaataaacatccgcgaaagcgaaaaggttgaagagctgttgaatacatgcgtccgcgaattgaacggtcgcctggacattttcatcgccaactccgggattccgtggactcaaggacccatgatcgatgctccgcttgaccactacagagacgtgacacaaaccgatctagatggaacattctattgtgccagagccgctggcgctcattggagaggcagaagaccgagggtacagatatttttggcaatcctctacaaggcttcacatacggtagtttcgttgcgactgcttccatgagtggacacattgtcaatataccacagctccaagctgcgtataatgcggctaaggcccggagtgatccatttgtgtaaatcaacttgccgtgaatggggtcagtttgcgccn

SEQ ID NO: 4982 - DNA, 687 bp, Aspergillus oryzae
caccctcttcgcgttgttagagcgattccccgaagagcgccaggaactcgcaacaatgcttatccctaaggacgaccgcaagaagatccacgagtacctcttccgcgagggtgtgctcgtggccaagaaggacttcgagtccaagcatgccgacattgacaccaagaacctctacgtgatcaaggccctccagtccctcaactcccgcggctatgtcaagacccagttctcgtggcagtactactactacaccctcacccccgagggtcttgactacctccgtgagtggctccacctccccgctgaggttgtccctgccacccacatcaagcagcagcgttcccacgctcccccccgtggtatgatgggtggtgaggagcgtgagcgccgtggtccccgccctacccgtgagggtggctaccgccgccgcgaccaggagaaggagggtggtgctcccggcgagttcgcccctaacttccgtggtggattcggccgtggccgtggtgctccctcttcttaaagggatgtcgaccggtcttcctagggtttggatggtagcgtgagtggcttgagtagaatttggaataagttcgaaaaggctgctgcgcccatcctaaaaaaattatgcattggtgctgtatcgatattacgacatagctagagtcaatgtcatgattttaatgactc

SEQ ID NO: 4983 - DNA, 642 bp, Aspergillus oryzae
agaggaatcctgtcgcttctcttttctctctctatccccctactatctatttgattgttgatacccatttcattcctcttctgtattttctcaaaatttcactgacgtcataatgtcttctgctcagcagcgtcttacccaggtggcttctcacttcacccctggtggcaagaagggcgtcgccgccatcaccgagaagcaccccgatgacattgtcgtgacttgtgcccttcgttctgccctcaccaagggtggaaagggtggcttcaaggataccgcggctgctgatatcctggctggcgttttcaagggtgttattgagaagagtggcatcgaccccaacgtcgtcgaggatgttgccgtcggctccgtccttgcccctggtggcggtgccaccgagttccgtgctgctgctctggttgctggtttccccgagactactgctgtcaagagcttgaaccgtcagtgctccagtgatctccaagccatcgttgacattgccaatgctttcaagttccggctgaatgaatttggattggtgcttgtgtggaaaacatttcctcttcagaattggcccggggctcttaaccgaattttagaacctcttgagaacccctctaaaattttccaactgtgaaggcg

SEQ ID NO: 4984 - DNA, 711 bp, Aspergillus oryzae
cggacaccgttcttgaatccccgccatgaggtagatgctttgtccgtattcgccacaactttgtccattcattgatcaaagcttccttcaaccttgtgctaatctcaccgatcaataatcgaccctccagacctctctcatcggatatccctggtttctctccactctcgacgcagacattctctcttttgtttatctatcctaccgctttttcaaaacttcatcaacctgaagatcctaccaccatggtccgcaatatcgtggtaattgggggcacttcccacccacaactgactcagaacatctgcggcgtcctgagtatcccgccagcagatgttctactttccaaattctctgtgggcgaaaccagagttgaaatcaaagagtctgttcgtgggaaagacgtgtacattattcaatctggtggcgggaaagtgaacgaccacctactggagctactcattaccatctctggctgcaagaccgccttcgccaagaaggtcaccgatggtctccttcttttccgtactctcgccagaaagatattccttacaataagactggcgcgcctcttgtaaagtcatctgttcctggaaggccgaacctgagaagggtattctttcaagaacacccctacaaccccatttcttggaagcctgagaatgggaatcttcctgaccggggtgtatacccacacaaaaagcttgggcc

SEQ ID NO: 4985 - DNA, 304 bp, Aspergillus oryzae
gcgcgcgcctctgtgtctttgagcagcccaaccagccggtctcgctttacttctatctcgaccgatagacctcttacttcctggtcgagacgggactccacctcgactacttccctcgacggccctcgccaactgacgcctatctacactctccccgctctcaaccgcccagtcgagacgcctttgacctcgcctgcttactcggaggcttctcacactccctcccttgagcctccatccatggtctcggaccacaattcagtttcctccgcctcccctaggaccgtctcatcgccacagctcc

SEQ ID NO: 4986 - DNA, 611 bp, Aspergillus oryzae
  misc_feature (1)...(611): n = A,T,C or G
gggagccggagttagagttagcattgggggtggaaccgccgacaaaggagtaatgattctgcatgtataataatcatcgctcatgagtaagaactagaaaagaaataaaactccactacctaggaatcattatcaggaagcatagtgcttcttatagaaagccgcggcctcattgcccgctatccttccgaagacgacacactccagaagagacgaccctcccaagcgattctgaccgtgtaggccaccagtgacctctcctgcagcccagagacccttgatgggggctccattcttatctagcacctgactgcgcttatcaattgtagctcctcccatcgtaaagtgggtaacaggagtgaccttcccaatatagaccacagaatccggtgtcacatccttcagagtccagtttccgaaagctgcacggccaaactcatcttgttgtttgcctgagacaatgtctgcatatgttttgatagtttcgagcactggtggatcaagttcgtgcaccgttgtcttacgcattagccctttccacagatagaatcccatatgcgagcctaaggcggcagcggtcccttcgtccaagagaaggctaacatcccatn

SEQ ID NO: 4987 - DNA, 653 bp, Aspergillus oryzae
caatcctctcgtcgacaaccgcacgacacgacaataccgcccaccatgtcttccaaggtcaaggctggtcagctctggggaaagaacaaggatgatctcaccaagcagctggaggagctgaagcaggagctcagccagctccgcgtccagaagatcactggcggtgcctcgtcgaagacccagagaatccacgacgtccgcaagtcgattgctcgtgtccacaccgtcatcaacgccaaccagcgcgctcagctccgcttgttctacaagaacaagaagtacctccctctcgaccttcgccccaagcttacccgtgatctccgtcgccgccttaccaagcacgaggcctccctcaagaccgagagacagaagaagcgcgagatccacttcccccagcgcaagttcgctgttaaggcttaaatgaagtcgggtcgtgtctggatttagatggagttccgggaacgtcgttataaagatgacgggttggaccaccttgtgtgggtcggttgcaccaaaaacgtcttttaaaagaaattgattatgtatcttagaaaaagatgcaagtcgatattaaatgaaggctttacttgacttgacaatgatattgcccaactttcgccgtgatgtgacgagttccttaaaatcccgcaatc

SEQ ID NO: 4988 - DNA, 674 bp, Aspergillus oryzae
  misc_feature (1)...(674): n = A,T,C or G
ctcgaatcttcgcagacatggcccatccgacacggcttggcagcttcctgacactcaaggcgtttctctcaatccaatgcctgccctggtgattcttcttttgggtagcatgatgggatcccaccaccaatccagcatggtttccactatggtgcacaagcagtggggtaacctgttggttggcttctcgtttgctagatgtatgacctatgtcatcacgtatctcaagccaccaacctcgtatctgccttctcgtcctccaactgagattgttgccgctttctgcttgatctccggtggcttgattttcatgttgagtacccgaaatgtggttgatgccatggagttttacgagctcgatgcgatgtttattttcactgtcgctatgggagtgaccgctttcataatggcctgtgagattttggctattgccatcaaggcctgngccaccaagaaagaaactcgccctcagctccctcctttccagttcccagcttgagttggagcacgcctcgccgtgtcgctttanggtagaggtgcgtgtccttcacacgggacatggttaagactctacctggatgggtttctcatcgccctattgaaaaccaaaagaattgagaaaaaggagaaatgggaaaaggcataagagacatcgaacattctttgtcttatta

SEQ ID NO: 4989 - DNA, 706 bp, Aspergillus oryzae
tttctctcgagcctcacgttcgagtctctcacgttcttcggtgtccttctgctcacgaaccttggcaagaacgacttcgcggaagatagcaccacgtgcaaccttgctcaaactccgcttcttcgttgtaccagcctcagcctcaccactagccgatgactcggctggggcagatccagatttatcagactcctcagcagaagctgccatgtcagcagggctagggatatcatcctcatcctcttcgtgcatcttgagtgcctcgatgcggttggccagtttgatgatctcaatacctctcttgaggcgagggcgttaggaatcggcgggacaacaaaaaaaaagtaaggggagatatgagcatgggaaagagtcccacgtggagtgtcatttatataccgctgttgggatacttacccgtggccacggtgcgccatgaggaaacttttcatgaactcgggtcaaacaaccttatcacttggtcaatgagctgagaccctattttagtgacgaggtgatcgctatagcccgactttctgttgtttacttatgcccaccgtctgggcgactccgagcctttatatagcacagcatgtcgtacgcatgttgatgacgacgaccatgccgactgtcactgatactactactctgactactgccatctaaaccgtcgccgtcccgatcaccaagatgtactacgacagcc

SEQ ID NO: 4990 - DNA, 703 bp, Aspergillus oryzae
  misc_feature (1)...(703): n = A,T,C or G
ctcgacccgctcggaatgtaccagggagcccctggaaaacggacaaaagatgcctcaactccgcgtcgacgggccctacggagccccagccgaggatgtttttgaaaacgaaatcgccgttctcattggaaccggcatcggcgttacaccatgggcatccatcctaaagaacatctggcatatgcgcgctggacccaacccaccccgtcgtcttcgtcgtgtcgagttcatctgggtctgcagagatacctcttcctttgaatggttccaggctctcttatcctcactcgaatcccagtctgcctacgaggcagcgaatgaaggacgagcggagttcttgcgcattcatacctacctcacacaacgtctagacgacgacaccgccgcaaacatctacctcaactccgtcggccaggaggtcgacccacttacggagctgaagagtcggaccaatttcggccgtccgaacttccagcgtctcttcactgccatgcgtgatggcctccaagacgggacatacatgcctggcttgtatgctgaattctccacgcagatcggagtctacttctgtggacccaatgccgctgctaggcaaatcagggaggcaggcgcgttatcggcgactaaggatatannnagtcagttctggaaagagcacttctaataattttttgtttttggataggaagggcccggcatagtg

SEQ ID NO: 4991 - DNA, 632 bp, Aspergillus oryzae
tcgctcttagcctttttttcatcccctacgttctcctaggccctcggtctatttgggtaccctgattgtcagctggggaataattatgacgttgactggcgtcgttcgaaatttcggcgggttgttgacgatgcgacttttgttaggaatttttgaggctggattctttcctggttcggtctacttgtgttcgcgctggtacatgcccagagacctcgccacccgggttgccgcattcttctgtgcaagtgctctctccggtgccttttccggtctgctcgcggctggtcttaacaagatggatggcgtcggtggatattcaggctggcgttggatatttctgattgagggcttgattacagttgttttgggggttttgaccttctttttactagtagactccccggaaatatccaccaaatggcttgatcaggacgagatccggtacctagtgatacaggaattcatcaaagaaggagggaagttcaaggaggaggataagaagacatcatggaaagacgttggggacatgatgcggaactggaggatttatctactatcctatattatgctgtgccagtcgggctgcaactacggtctgttcgcgatcacctaagcctaagactttttgt

SEQ ID NO: 4992 - DNA, 638 bp, Aspergillus oryzae
cttgaccagtcttaccattcggggtgcttttatcggagctttgatcgcggctctcaccacagatgctatcggacgaaaaatggtcatagggctcggatgcatctggttcaccgtcggctccgtcctcgcatcatccgcatattcagttgccctaatgtccatcgcgcgattcatcatcggggtaggcatgggcctcgaaaccatggtaactccaatctacatctccgaactctccccctcctcgcgccgcggtcgcatgatcaccgtctactcgctagcagtaacaggtggtcaagccctcgcctacgcaatcgggtccatattcaacctcgtctcgcaaggctggcgctacatgttcgccttcggcgccattccaagcctaattcaagtcgcgctgttccccatctaccccgagaccccgcgccacctcatttaccggaaccaaacagcagacgccataatggtgcttcaacagatataccccacggcggcccccttccgacattcaaacccttggtccaaccattcaagaacacgttaaaccggttcgtcttcttttaaccagggaatccgacgcgcatgctggttcctggaaacacttgacaccggccccttcgattttccgttggttaatacaa

SEQ ID NO: 4993 - DNA, 703 bp, Aspergillus oryzae
  misc_feature (1)...(703): n = A,T,C or G
gccccaccatgaccatccgcaagttggaaggcgaaggctccaagctcttccagccgctggacatcagcaatggcaaaatcaagcttagccatcgtgtagttcatgcgccaatgacccgcaatcgaggcgtcccagtgaacgccaccagtacccctgagaatcccaatcggacatggtatccgggggatctcatggttgagtactatcggcagcgggcgacccccggcgggctgatcatttcggaaggtattccgccttcactcgagagtaatggaatgcccggggttcctggtctgttcaccgaagagcagatcgctggctggaaacgagtggttgatgcagtccatgagcaagggggttacatcttcgctcaactgtggcatgcaggccgtgccaccatcccccaaatgactggatccccagccgtctccgcctcggctacggtctgggactcgccgacggagtgttactctcatccccccgtgggatcgacagagcctgtccgctatgcggaccacccgccgatcgaattaaccgtcccacacatcanacagaccattcaggactattgtcaagccgncgaatcagctatgaagaattgggttcgatggcgtcgaacttcacggtgggaatggataccttnctgagcantttttgagctccacattaacaagcgcaccgatgagtacngtgggtctgccgn

SEQ ID NO: 4994 - DNA, 879 bp, Aspergillus oryzae
ctattatcctgctagtaattcttctagcagcttgtctcactgtgttatatcgaaagaagctctcaaactgtatcatgaccgatgaatacagtgacagtcctcagggctcaaccatcttcgagctgaacaatggaatgaaaatacccgcgctcggttttggtgctatgaaaaaaggcttagttttaccagaagaagagaaggactatgtccgaagtctcatagtgcaagccattaaagctggctatcgcctaatcgacacgtctaaaatctacgccacggaggaccttgttggagaagccatcaaggagtcaggagtacctcggtctgagatcactgttttgacaaagctatctagtgatgatcaccatgatgtgcgcgcagcttttgagagatcgcggcgcttgctcgatacctacattgatatttatatcatgcattggccgcagggatttacaaaagatgtgtcacgcccattggcaccggaggagagtccaacctatatagaggtctacaaggagatggagaaactcgtggggccggactgcagaggtattggggtcggcaaccttacacagaagacattggatatgttgctcaaagaaacggaaatcaagcctgtggtcaacgaaatcgagattcatcctgggaaccccaatacgaaattggtccatattgtctggaaagaggcatacgtccggtcgcttggggccccttagcaagcggacccacaagtcattactcggacacttcctcgatctatgagagtcccgtcctcacctctctttcttcacgctacgaactctctgtcgggactatcattctatcatggcttgttcaacgtggaatagtcgtcattcctcattcaagctcatttgccag

SEQ ID NO: 4995 - DNA, 1293 bp, Aspergillus oryzae
ctatacctcaacattgtttcaattgcattccatttctttctcttgttttaaatctctcaaaacaactcataaacaatgtcttacaacaaccgcgacaatgacttcggctccagccagtctggcggttatggtggaaatgatagctatggctctcgccagggcaatgactcttacggatcctccggtgtaggaagtgactcgtacggttccaagaacgacaactacggatcctcaagccgctcaggaaactctggcctcggcggttctgattcctacaactcatccagccgttccggaggaaacgactcctatggctcctccggtaacaacaacagctcctatggctcgtccgaccgggacaactacggttcttccaacgattcttacggttccagtaaccgcaaggacaacgactcctacggctcgagccacaataccagcagctccaagcagcacggcaacgattcctacggttcgaagaaggacagctatggttcttccaccgattcctatggatcgggctcgaagaatgatagctacggctctagccgtgataatgacaatgactcctatggctcaaagaaggataactatggctcctctagtggctcatatggctccaagaatgacaacagctacggatcctctggcgattcctatggttctaagaacgacaacagctacgggtctaagaacgagagtagctatggttccaagagcgatagctacggttctagccgtcgtgacaacgacaacgacaactcttatagctctaataaggatagctacggctcttctaatgactcctatggctccaagaacgactcttacggatctaagaatgacaacagctacggttctaagaacgagagtagctatggctccaataatgacagctacggttccagccgtcgtgacaacgacaactcatatggctcctctggctctcgcggctccaaccgtgataacgacaacagctacggatcctccggagactcctacggttccaagaatgatagctatggttctagccgtcgggacaatgatagcagctcttacggatcttctggtaacaactatggctcgaagaatgataactatggatcttcaggctctaacaaccggagtgactcgtacgagtccagtgggcgctctggatacggtaactctggttactaggtgttgcgggactggggttttctaatatcattattagttgatcgatgtatttaaattatgcctataacattataacataagttgagactcaaatttcgaagactttgtttgatc

SEQ ID NO: 4996 - DNA, 693 bp, Aspergillus oryzae
  misc_feature (1)...(693): n = A,T,C or G
cggcccgcctttctcgcctttatcactgtcagatgtctaactttagtttccctccttctggatggtttcgagtccttcctgggccaccttcttgattgtgaccttgccgctcaggatgtctttagttgtggcgaggattgaggaccagctctcaaagatggtgaagggtgttccttgacgctcgcagtaggtcaccagatctagaaatagtcagctcactggagaggagggaaaaagcaatagagaaaaccccaggaaaaacacgcaccccttcctttcttagcaaacaaaagatcggtctccgaagcagccgacaagtccgagacgccgtctcccgcatacaatagggttgggcgtacgttgtccggcagagcggcatanggcttaatctccagcgatttgtcgtgaccaaaatggctatcatcgtgatacttaatctgccagccgccctcggtgttgatatccttgccatcgcggctttccacatcgttggcgacaataacaaggtggtcatcgggcttatgtcctatcagagtttctaacagggcgctaatgacccgggtcataccggatgacaatactacaattggcacgttgttttccttggaccagtggttgaattcaacaaagtatggatcgagctgcatgtttttcttaaactgcttcatgcactcattgtagggaaccctgacg

SEQ ID NO: 4997 - DNA, 683 bp, Aspergillus oryzae
caacaggcgcatctcactgcgcaggtggcggttgctgttgctcctgctggtgggggttgggcttgtgcagatgcccattagcagttctggggatatttctctccaagaggaggcggccgcccatcatgcttttcctcggtcgctggaagaatggaaggccgccaaattggatcggccaaatctccataaacgttcggcaacgtatgagggcattgaagaggatatgatgaccgcctttccgcgaatgaatgcagttgttggtctcttagcgactctgggtgcgtgcgtcgcatctagccttgccagtgtatatttcgaaaaggtactgaaggatagtgcaaagtcgacctcgctttgggtccgcaacgttcaactggccgtatactctatcttccccgcgcttttcattggtgttgtcttcttggatggcgagaagattgctgccaacgggttcttcggagggtataattgggccgtctggtctaccgtggttactcaagcaatcgggggaattgcaacatctttctgtataggccatgcataccgagatgcgaagaatgttgctactgccaccagcatttttctcactacgttagggagtatctggctatttgagtttgagctcactggtaaatttattctccgaacgtttgcagtgcttgtggcttcttatctttgcgaag

SEQ ID NO: 4998 - DNA, 643 bp, Aspergillus oryzae
cctctttagctaggctaggttttgtccttgtgtcaatacattatcttctaacttaaacataatatcgccggtgtatacaaagagatatccgactttcctacacaatgtctcgtcctggcaccacgctctatgtcaccggtttcgggcacggaactcgagctcgcgaccttgcctacgaattcgaacgttacgggcgccttgtccggtgtgacataccagcaccacgtactccttccagcagactgtttgcttttgtggaatatgagagccgccgtgatgcagatgatgcgtatcatgaaatgcataacaaacgaattggacgggatgatttattgaaaattgaatgggctcgcactccaccatctgcttcttggaggtttgattctggccgagaccgtcggcgcgatcgtacaccgccacgccgtggtcgttcaccgtcgcctcgccgtggccgcggcgattattcttctcgtaaggatgacaggtacgaacgggaatacgaccgacatgatcgggattatgaccgccgcgaccgggattatgaccgacgtgaccgtgactatgatcgccgcgaccgtgaccgtgaacgctcgcgcgaccgttctcgcagccctgatgagagagaacgtgatatcaaagatga

SEQ ID NO: 4999 - DNA, 695 bp, Aspergillus oryzae
  misc_feature (1)...(695): n = A,T,C or G
cttccttctacccttgtttgtgctttttttgcttcaaggggaatttgtgaaattctgtcaagatggtcaagctaggcaaaaactcgaagcggacgcccgtccggttacggcacaagatcgagaaggcctctgcagccaagcaacggaagcagagaaagcttgccaagaagaatcccgaatggcgctcaaagatcaagaaggatccgggtattcctaatttgttcccacacaaggctcagcttctccatgagatggaggagaggaagcgattgaaggccgaggaacaggagcgcatccgtgatgaggcgcgcgctcgcaagaaggcacagaaggagtcgcaacagcaaggagacgacgccgaggacgtgatggaaaatgatattgatctggagggtgactccgacgatgaagatatggatgaggatgttgatgaatcgtcgaaccccatggctgcgctacttgcctctgcgcgcgcgagagcggcagagtatgaagatcaacatgagagcgatgatgacgatgagatggacgaggatgaggatgaggatatggacggcatggatgaagatgaggaagagggcggtgctgcgctgggcgattccgctccccagcttgtttcacagactcacagcaaggagagctctcggcgacaattcgataaggtgttcaagcaggttgttgacgctgcngatgtt

SEQ ID NO: 5000 - DNA, 673 bp, Aspergillus oryzae
  misc_feature (1)...(673): n = A,T,C or G
taaaatatctctttttctcctcaattgcacaaaatggccagccttcagcacaccaagaagacttacaccctgaacacaggggacaagattcccgccattggtctgggaacctggcaatccaagcccaacgaggtccgcgaagctgttaagaatgctctcctgaagggctaccgccacatcgataccgctctcgcttacggcaacgaagccgaagttggccaaggcatcaaggactccggcgtgccccgcgaagagatctggatcaccaccaagctagacaacacctggcatcaccgcgtgtccgagggcattgagtcctccctgaaggacctangcgtgtcctacgtggacctttacctcgtgcactggcccagcagcaccgaccccaacgacaagtccaagcatctccctgactgggacttcatcaagacatggcaagagatgcaaaagctgttcgccaaccgccaagttcgcaacatcagtgtcttaaacttagtatcaagaaaccttgggaacctctttaatgacccctatccccaagatagtgccccgccgtaaccagaaataacttgtgcccttaaaaacccctttcccaaattgggtggcacaaaaaccttccaagggattcccttcccctggacaccttggcctgggttccccaaactcccccctt

SEQ ID NO: 5001 - DNA, 687 bp, Aspergillus oryzae
  misc_feature (1)...(687): n = A,T,C or G
ggaagtctcaatcttgggcactggttccagtgttatgcttttgacgtgattggggagattacattcggaaagcggttcgggtttttggaccagggtgatgacatcgaagggaccatcgctgcactgcagaagaccatggtgtacagtactctgatcggtatctacccggaatggcatccgcggctattcgagcttctgagccatttcagctggtctggcgcgggcggaagaacgtacatcatgcggtacgtgcaggagaaaattcgccgacacagtgagcctgccaagcgtgatccggagcaagggacgctgcagacacaggacttcctcgagaagatgatcctcgctcgagacaaggatccagagaaggtcactgattatcacttattcatgatgggcttgtcgaacgtgattgccggatcagatactactgcaatcagtctttcctcaataatgtaccacctgctgcactatcctgcggttttggagaaacttcgtcgcgaagtggatgactttaccgcgcagggccgctgcagtgctcgtgtgacgttcaaagaaagtcaggaaatgccttatttccaagccgtgatgaaggaggctctccgtatgcacagtgccactggtctcccgctgtggagggtcgttcccgcttgtggtgccgagatcagtggatattactttcccgan

SEQ ID NO: 5002 - DNA, 823 bp, Aspergillus oryzae
ctcttcccccccaccaagctttcttatataacctctgccctcctaccagtggcacatcgacttcccttattctccgatcgttcgtcgcttacatacttctaccctctcagcaaccgatgcctcacgcagagccaaagaagatgggtgaaaacgctgtcaacggcgagaaggtccactcgcacttcctcgatcacctcacatcctaccccctcgtctccgactccatctccgtctttaagagcaacaagtacggcgccaagtccatagagtacgccgaccagagctatgaccgcatcgcgaagcccttcctgccctacttctccaaaccctacggctacatcgccccctacctggcccgcgcagactccctcggcgaccaaggactgtctcagatcgactcgcgattcccgttgatcaaggaggacaccgagaagctccggaacaccatctacgataacgccacttacccggtgcgagtcgtgggcgaagtcaagtcccatgtctttgacacctacggatccgagtacaagaagtgcggtggtgacggggtggtggccagcggcaaggcgctgatcacgaccagcttggtcctgtcgcaggagtcgctgggcttcctcagctccttgctgcaggccaagaaggagcaagtgaaggacgtggtcaacgacaagaccgacaaggccaacaactagagagggatggtgtttcaatttcactggagggttctttgtccagccaacttctatgtttaatttctgtttctaaaaagggggtttgatttttttgcgccgctcttggagttattcatttctcttttcagacg

SEQ ID NO: 5003 - DNA, 876 bp, Aspergillus oryzae
cataagtttcttgttgtgattatcctctcttaatctacctattcattcatacccataccttatcttcactatgtcccagaacaaggctctcgtgttcaagaagatccctcagggatatcctgtccctggacaggacattgttgtcgagcccgtatcggtcgaccctaactctcccgctcctgccaatggtgttgtcctgcagtctctttacactagccttgacccctacatgcgtggccgtatgcgccccgctgaggtgaagtcctactctcctgccttcgccatggacaaacccatcgatagcagctccatcgccaaggtcctccgctccaacaactccaagtacaaggaaggcgatttggtcattggattcgtccccatccaggagtatattgtcctggacgaacagtcgatcgtccgcattcgccctctcgaaaaccccttgggcattgaggatatccgtgtcttcctgggtgcccttggtatgcccggtctgaccgcttattcatccctgtacgaaatcggcaagcccaagaagggcgagaccatcttcgtttctgctgccagcggtgccgtcggtcagctgagcacctggaagctgctttggatgccatgaacaactttggccgtgtcgtcgtttgcggtatgatctcgcagtacaactcggccccttaccccatcaagaacatccaatacgtcttgactaagcgcctgactatgcgtggcttcattgttggtgatgccggcatgggtgacaagtccactaaggagcaccaggagaacgttcagaagtggatcaaggacggttcgttcaaagctctgacccacaagaccgttgcatttgacaattgggccgaagctttacttggaatcttc

SEQ ID NO: 5004 - DNA, 644 bp, Aspergillus oryzae
cgttaaccctaccgaggcaacactttgcgcccaactcgtagaagccttcatctcttgcggtataccagcacgaagcattggtgtcataacgttctaccgcagccaactttcgcttctgaaacagaatttgcgccgtcacctgccggatctcgaaatgcacaccgcagacaaatttcaaggacgtgacaaagaagttgtggtactgagctgtgtgcgcagcaattcagacaaccatgtcggcgatcttctccgtgactggagacgggttaacgttgcttttacccgggcacgaaccaagctccttgttgttgggagcaagagcactcttcgtggcggtaatgagctactaggcaaatatgtgaagcttgtcgaagagcaaggctgggtatataatttaccaaagggcgctgtggaagatcacgtcttcgactctgacaacatccatacacaaccccagccacaagaaggatcaacacccaagtcgaaaaagagtccaccttctcaaaaaaggtccggaaccctttaagtccagcacaagcccgaaatgcttccaaaggtcttaagaaaccccgcaaaaaagggaggtaagctgctgagtggtaaccaagggtcttgggaatagaccaatgctttcagatgtgggg

SEQ ID NO: 5005 - DNA, 684 bp, Aspergillus oryzae
cgcaagtttggaccaacctgtgggcactttacctgatccacaatgacatccagcttgcaaatgaagcctttactcgtgcgcaatctacagatccagacaattcccaagcctggattggacaaggcttccttgcccttctatttggtgacccgcgggaagccaggggtctgtttgagcacgcctttgatatctccaactcgtcagccccattgcctaagaagcagtacacgttaagcttgttcgatcatcttatgtcagactcttcggcttcgaacgaggtttcagcgctgattcaaccgttctttgcacttcaccagctctcttcgcaggacccatccgatttacccttcgtgcatctatcctctcttttggctgagagaattggcgaaatatcagacgcagaagccagtctacggaccctctgtaccgctgtagaggcagaatacgaggtgtccgagtcagcgtccgccctctctcgattcgcccaggcaaacgcggatattgctcgtgtactccttgcacgtcatgaattccaggaagctgctgaaaggcagagacagcgctcatgctatcaggggaagaggatgccgaaaaagtcgaacctgaaacgaacaacaggcttcgcttgtcagcccacttgacagcgggccttgcgcattatttattacggaacatggacagtgg

SEQ ID NO: 5006 - DNA, 669 bp, Aspergillus oryzae
  misc_feature (1)...(669): n = A,T,C or G
ctccccctttaccctcctctcctccctcctcccctctcacccctccacaatgctctccggtatcctaattttcaaccaaaaaggcgaaaacctcatcttccgtgccttccgcaatgactgccgcccccggttggccgacatcttccgcatccaagtcatctccaacccgcaagttcgctcgcccattctcacgctaagatccacgacgttcaaccatgtgaagcacgaaaatatctatctggtagcggtgaccaagaacaacgccaatgccgcgctcgtgttcgagtttttgtatcggttggtgaagctggggaagaactactttgggaaattcgacgaagaggcggttaagaataatttcgctttggtttatgagccgcggatgagatactctactttggatacccccaaaacacggaaacagacactctgtaaatgtgcatctcgacagggggagtgtaatncgccctctgtgacaaaacccacagacttaaagcccattaacatgtaaaacacccgcgcgcttttcttggggcgcttttaaattaaaaaaaccagaaaaaggacctttgtgacgagatcaaaaaatattattttttttggtgcggggaaggggcccctctcccccgccacaaaaaaaaagaggaaaaattctttctcgccctccct

SEQ ID NO: 5007 - DNA, 634 bp, Aspergillus oryzae
gatttccttattcccatcggcattcgcgaataacttcgccacgctggttgtcactcgcttctttggtggcggtgcctcctcggtctccatcaacattgtcggaggaagcatcagtgacgtttggttgggagagaaggctcgcagtctgcctatgtcattgttcggcttcaccagtgttgtaggtattgcactgggccccttcatcggttcggccattgtacagatccacaagtctgacccttggcgttggatcttctacattcagattatctataatgccgccctcatccccgtgttctacctgatcctcagcgaaacccgccctgatgtaatcttaaagaaacgggcccgaaagatccggaaggaaaccggccgacctgtctatgcccaagcagagctcaacaaagtcaacacactcaagcttctgcagatctcctttcaacgtcctacacgcatgctcttaactgagcctgtcgttatcttctttacactctggatcagctttgcttggggtattttgtatttattcttcttcagtgtggtccaaacctacagcaccaattatggctggggcgttatggccactggtcttgttcaacttgctatcttcgtgggtgcggtcattggtacaacc

SEQ ID NO: 5008 - DNA, 668 bp, Aspergillus oryzae
ggcgacctccgcgttgctatcattgccgtgtctgcgacaattgtatcgaaacacttgatcatcattgcgtctggcttaacaactgtgtcggccgtcgcaactatcggtattttttcacttttgtgggctcgtctacactcctcgccttgtttttgatcggcgcaagcctagcgcatatcctcgtatatcgatcacgagaaggcatttctttcaacgatgcgatcgatcagtggagggtgccttgggctatggtcctttacggagccgttgcggctccgtatccagcctccctctgggcctaccacctgtttctggttggccggggagagactactagggaatatctaaactcccacaagtttgcgaaagcggaccgtcatcggccctttactcaaggaaatatcctgaagaattggatatcagtttttgggcgaccacgacccccgacatacatgcaattcaagaagccatatcacgagggtgaccagcgcttgagcatggtgaaacggaaataccttccgcgagacgttgaagctcaagcaagcatagagatgcagcatgtcccttctgatcaaccgcaagattgaggtcagtaacgatcctcgcaattactccatggagtgcccaccaaacactattttaataaaaagggctcttcttctactttt

SEQ ID NO: 5009 - DNA, 662 bp, Aspergillus oryzae
  misc_feature (1)...(662): n = A,T,C or G
caaaaataataccactcgatcacaatgaagttccttgccatttcctccctcgttgcagcagtctctgctcttccctctgtgcctgcccctaaggctcagaatgaccccaacgccttcggtgtcgtcgccgctcgttccgcctctcccatccacttccttaccctgaacgccgccaactcccacttctacctcggcggaaaggccgccacctactgccccgagaacatcgagaagctgggcgcctgccccccgggcaaggagaccgctctcctcggcgacaagtaccttgacgtcgccgtccccggtggccagagcatctacgtcgacccccatggcgccctctccttcaccactcctcactccggctacactccccccggctcctcgactgagggcttcgcctacaagcccggcaagaacggcaccctcggtagctggacctacaagaacggcttcatggcctgccccaccaccaacagcaccatcgtgcccggtaaccccaagtggcaggtgtttgctgcctncaacaatgccaccgtgcccaccggcaacgtcagagactgccttggattctcggctgttgctgccccatacactggacccgctgctgcctgngagtacatctaagtttctcgtctaatctatccaaagacctagatggg

SEQ ID NO: 5010 - DNA, 510 bp, Aspergillus oryzae
cggcacgaggcttgagccgtacctcgtcgccagcaatccgacgtttacttcacaacttctactcgagtggcgttttcctcctgcacctgtgcaaccctacgtacaacatacatcatgcctgcctccgtgcactcccaggatcaggaccagtccatgatggacgccaccgccgcggcacctcaagaacaagaacagcaggttgagcaagaagatgtgttggaggaaaagcggatcattgtccttcccggggctaccgagacagcggcttctttccagtttgagggcgagggtcatacattgggcaatgcgctacgatatgccattatgaagaatcctcaggttgaattctgtggatatactatcccccatccttccgagactaagatgaacctgcgcattcagacttatgacacaacgaacgcagtggaagcactggagaagggcttggattctctgatggatctatgtgatgttgttacggacaagttcaccgccttccgtgatgccttt

SEQ ID NO: 5011 - DNA, 620 bp, Aspergillus oryzae
ctttgaacctgagcatcaattgacaccatagagatgcctcgtagtggcttatccgctgcatcgttttctcacccagcgcaatccggtgtagccggcgctgtcgctcgtttctatcagcgatcgtttccagcggttgactatctggcactaggatgcattgtaggaggttggatcttgatccagctgtttgtgaccccatttcatcgtctgttttcgctcgacaataaggccatccaatatcccttcgctgtagtggaaagagttcccgttgtatggtccataatatacgctggcgtcattccgttcgtaatagtgctcttgtgggctgctacattccgaccgaagccttacaaagtccaagtaactatacttggtttcctggtcgcattaatgttgacttcgctgctcacggatataatcaagaatgctgtgggacgacctcgccctgacttaatttcacgctgcattccgaagaggggtacccccgaaaacaagctcgttgcctggactgtatgtacccagacgagtcaacatgttctccaggaaggatggagaagttttccgagcggccacagcagcttttcatttagcgggctgggatatctgtccttgttagttct

SEQ ID NO: 5012 - DNA, 691 bp, Aspergillus oryzae
  misc_feature (1)...(691): n = A,T,C or G
gtattatatttgtggcatntttttattacatttccatggatgtgcttcttgacatcctcgacacatacgtgttcgacagattctatgcggcgattttaccagcgacgaatcctgttacggcatcggcgggcacatacaataaacatattggtctctactatccgctaccaccgtctccgtatgcagatagcagtacatggaaacgagatgatatcgtgcgacagacgatgtccttattcctaatcggatggatcttcgcaacggcattatacctcatcggcagcacaataatctaccacacactcttcgataagcgcgtaatgcgccacccccatttcctccctaaccaaatccgccaagaaatccgccaaggcatcacctccatccccgtaatcgccgtactcacggccccgttcttcctcgccgaagtacgcggctggaccaagctctacgacttcgccgacgaggcccccttccgcgcctacaattggctgcagtatccgctgttcgtgtgtttcacggattgtgggcatttactggaattcatcgggattgcattacccgccggtgtatcggtggttgcataaaccgcattataaatggattattcccgagtccgttgcgagttatgcttttcatccggtggagggggggcgcagagtattccgattaatggttatcccgtggtggt

SEQ ID NO: 5013 - DNA, 718 bp, Aspergillus oryzae
tgcggtacgagcgcggctctatccttgcacgagggatctttgaaaatctgggcatcaccggtactacgacaggcctcttcgccacgggagtgtacgggatcgtgaaggtggtggcatgtgccgtcttcctagtcttcgtcgccgattctttgggccgtcgacgctctctgctctggacctctgtcgcccagggcctagctatgctctacatcgggttatatatccgcattgcgccaccggtagaaggccagcccgtgatccccgctggctatgtcgctctcgtctgtatcttcctctttgccgcgtgcttccagtttggctgggggcccgtctgctggatctatgtctccgagatcccgactgcccgactgagaagtctgaacgtcgccatggctgccgcgacccagtggctgttcaactttgtcgtttctcgggctgttcccaatatgctggcgaccgtgggggccaacggttacgggacatacatcattttcgcctgtttttgtttctcaatgggcgtgtgggtttggttctttattcccgaaaccaaaggtctctcactggagaaaatggatgagctcttcggtgctactagcagtgatactcatttgaagactgaagatgtagagagaagtgcatcccaagtggaaggtgaccataaaaatgaagttgctacagaaactaaggtagaaagggtgtaatattgtcgaccttgtgt

SEQ ID NO: 5014 - DNA, 642 bp, Aspergillus oryzae
  misc_feature (1)...(642): n = A,T,C or G
gccatcctttatttttctttagaagtctcttgagatagtgttttctcagagacatatttcatgtgtctttcatcttctttttgtgttcagtccagtctcattttcattcgagagtcggggaacctttccgcagccgctcaaatgtctcaagctgaagctgacctctatgaggtcctcggaatcgccagtagcgcaagcaaagatgagatccgcaaggcttatcgcaagtctgcgctcgcaaatcaccccgacaaagtccccgaggccgaacgtgaagaagccgagatcagattcaaggccgtccaggaagcttacgatatcctctacgatgaagacaagcggcatctatatgacacacatggaatgagcgccttcaacgggtctggcgagcccggtatgggcgcaggtcccgatctagatgatatcctggcgcagatgttcggcggcatgggtggcatgggtggtatgcccggaggaccgcgcgcgaataaaccacggaggagcccgaacgaggagcanaagtatgaggttaagttggaagaattgtacaaaggcaagactgtcaagtttgcgagtacgaagaatgtgatttgcagtttgtgtcagggcaagggaggcaaggagaaagcgcatgctaagaaa

SEQ ID NO: 5015 - DNA, 671 bp, Aspergillus oryzae
  misc_feature (1)...(671): n = A,T,C or G
aagctcctccctgaaagcttgggccccggttattttccttactatctccttacctcttttagactttcgaactacgtcgtgtctcagttctatcgaatactcaagacagcacgtccacatctacccgtacaactataatgtccgagtctccgccgcccccaccgtcttggagcatcaccaacatggccaacagtgccgctcagtacctaaggctgccggttttggcatcatctggtttggcagttgttgccagtggtcttttgtatttcaaacaaaatgagttgatctatcctcgcaatgttcctaccgatgcgcgcacctttgtaccgaagccccgacagtttggggtcaacaattacgaagaactccagattcctacgccggatggcgaatcattacatgccctcttccttcgtccctctaagaaaggtcttgccggtgatattactgtcttgatgttccatggaaatgccgggaatattggtcatcggattccgattgcaagggtcttgcttgatatactaggttgcaatgtgcttatgctggagtatcgcggctacgggctctcgaccggcgtcccggacgaagcagggctaanaattgatgcccaaactggactcgactatatccgacaacgagcggagactagcaataacaagggtatagtttac

SEQ ID NO: 5016 - DNA, 717 bp, Aspergillus oryzae
cccatttttccttcttctccttgtgagctcccaacgtccgccagattagtgcctccttgatcgttatcgactcctcgcaccacagcgaggatcatttatactatacacaatggctgacacccaggcccagcagcctgccgaggttgactacaccctcaacaaccccgacaccttgaccaagtacaagactgctgccactatctcacacaaggtcctcgacgccgtcgcagccctgtgtgtggagggagccaagatcgttgagatctgccagaagggtgacgagcttctcgaagaggaaatcgctaaggtctacaagggcaagaagatcaccaagggtgtcggtcaccccacgactgtctctcccagctcccatgtgaccccatacactcccttggtttccgatgcccaggaggccgagactaccttgaaggccggtgaaatcgctaagattcagctcggtgcccagatcgatggcttcggaaccattgtttgcgaccaggttgttgtcggccaggacgaggtgaccggccgcgaggctgacctcattaccgcgactcactatgccaacgagctcttgctccgtctcatggtgccccctggccttctggctaccggtaccgaggaggagaagaagaaggctgccgccgagaggggctcctactcaggcccagatctcccagctgatcgagaaggttgctaaggcctacgactgcaacg

SEQ ID NO: 5017 - DNA, 816 bp, Aspergillus oryzae
  misc_feature (1)...(816): n = A,T,C or G
ggaccttgctcggaccgaatcggccgaggagccgctgcttaactccgcctttcactgttgtttctcgcactgacttactctaccctgacgttagcacgttccgtcggcggtatttcaggtacactgagcacaatgtattggagctcaccccgaaggaaggtcttcttttacgcatgctttctggtctttgctactttcattgggaagtcgacagcctccctgggcgaccatcttcccgatttcaaagaatgtgttaagatctgtcaaactgagaactgtcaggatggaaattccgagatccctttccatctccgcttgatgtggtggacttgtcccgccgaatgcgactatacttgccaacatgttgtaacggaccgtcgagtcgctcgtgatcctccgatgctcaatccagtagtccagttccatgggaagtggcctttccgcaggatcatgggcatgcaggagccgttctcagttctcttctccctccttaacttttatgcccattggcacggcttatctcgaatccgcgaaaccatgtcgacgtggcatacttctctccggacttactatcttgcttttggatattgcggcctggcatgctggaccttcagtagcatcttccacgccagggacttttctttgacagagaagctggattattttggagcgggcgcaaatgtcatgtatggattatacctggcaattatcaagatattccgattagataaggaagacccgnaacgaaaccgacattgcgtcggctctgggaccggggttgtatctttctttataccttgcacgtttcctatctta

SEQ ID NO: 5018 - DNA, 906 bp, Aspergillus oryzae
cttaattcttcttcttctatcaatcaatcaatctccactcctccatttttatttcccagagttgaaattgatcctctggtgcgactttacatcgctaatctaaaactccggttgagagcctacctatctccacttctccgcctttccggcattcgtctctcccttccccatcttcttctctcctcactttcacgatgtcttcccgtgtcggtcttcgtttcttccagaactcccgcgctgcttttcgcaatgcgcagcatcgctttggcgccggacgccgcttccagacctcggatgccgccgccgccgagccacagagcgttttccagcgtttgtggaacagccccgttggtgttaagacggtgcatttctgggcccctgtcatgaagtgggctctggtcatcgccggtatctccgatcttagccgccccgccgagaagctgtctttgactcagaatggtgccctgacggctaccggagctatctggacccgctggtgtttgattatcacccctaagaactatctgcttgccgctgtcaacttcttcctcggatgtgtcggtatcgttcaggtcggtcgtatctacaactaccaccgtagcctggaacagtcgcccgccgaagccgtcaagtcaatggaacacgaagtgattgactcggcgaaggaggccgtcgctaagtccgaggctgctgttgagaagtccgcataaaccggttcagctggttccgctagatgggactctaccacgcaagggggctcgacggggatttaaaaaggaaactgtctatcaggaaaatagaccgtcgattgacgagcttctgagtggatttgggcatctagcactcgatagacaatagctcgggggctctactggttcaccgcaacacgactggcggtctcgtttg

SEQ ID NO: 5019 - DNA, 445 bp, Aspergillus oryzae
ccttctttggggcagtcatattgatacatactacttccttaatactaaaagtcctccccactctctcataatggctgaccaggcagttgctgacttcggtttgatcggtttggccgtcatgggccagaacctgatcatgaacgtcgccgatcacggtttcactgtttgcgcttacaaccgcacaacctccaaggttgaccgcttccttgaaaatgagtcccacttgcccgacagcaaccgccgtaccaagtaccttgccgagaagggcatccgcttcgtcggtagcggtgtctctggtggtgaggagggtgcccgttacggtccctctctcatgcccggtggtaacgaggaggcctggcctttcattaaggatatcttccagagcattgccgccaagagcgaaggtgatgcttgctgcgactgggtcggtgatgagggtgccagc

SEQ ID NO: 5020 - DNA, 545 bp, Aspergillus oryzae
cgtctctttaatcctcatttacgcccggttttctgtcaatatctcaccgcgactgtgtaaatactagcaaaatggcgacccgggctccttttgtcgttcctgcactcaagaaacacaccgcaaccgtgatcatggctcatggtctgggcgacagtggtgctggatggatgggccttgctcagaactggcgccgtagaggcttgttcgaagaagtaacttttatttttcccaatgcgcccatgattcctatcacggtgaattttggtatgtcaatgcctggatggtacgacctttccaagctcggccgtgatctggattttgaagaagctatccgcagccaggatgaaccgggcatcctccgttcccgcgaatacttcaacaccctgatcaaggaacaaattgaccagggcatcaatccttcgcgcatagttctagggggattttcccagggaggcgcgatgtctgtgttcacaggtgttaccaacaaggaaaagctgggaggagaatttggactttcatgcttttgtgttttagaccaaccgtta

SEQ ID NO: 5021 - DNA, 689 bp, Aspergillus oryzae
ccattaacccttcaccttttctcccgtatcttccagacgttaatacacaaatgcgcgtccagctatcccccgagcaagtaccgcggcgaatgcgcatccgcgaacttcttcccgacctcgacctgggagcctaccccccaggtccgctaaattccatcaccgacgtgcctggcgtgcacgttcacacccaagagatattcggtgcccaaggcgccatcaataccggcgtgacctgcatcgttccccgcccgaactggtccaccaatgcttgttacgccggggtcttccgttttaacggctcgggagagctaacgggcgcacatctgatagaagagacggggcttctctgctcccctattgttctcactggaacatttaatattggggccgcccaccaagggatctatcagtatgccgtcaaacacctggggactaacaaggatggtcagttggagtggcttatgttgccggtcgtgggtgagacgttcgatgggtatttgcatgactgtacatcgttcgctgtggctcctgcgcacatcgtgcaccgtctggaaaatgtggtggctggggagccaattccaaagggtaatgtgggcggtggcgtgggcatggtttgccatggactgaaagggggtaccgggagcaacagtccccaggttcttggaacctacaccgtcgcaagcgttggt

SEQ ID NO: 5022 - DNA, 710 bp, Aspergillus oryzae
  misc_feature (1)...(710): n = A,T,C or G
cttctgtgggttacgagaattttctaagatatttcctgttcttccctgtggttcggagggattgttggagtgctgcgagggttacgtttggagagctgctgtgttcatatttgacaaggagatttgaagtttgctgttggttttaggaagactagtataccgacaagatgttgctttctcgccgtgcgtgctacaagtgtggcaatattggccactatgccgaggtgtgctcttcgtctgagcgtctctgctacaactgcaagcaacctggccatgagtccagcagctgcccccgtcctcgtactaccgagaccaagcaatgctacaactgccagggcttaggccacgttcaggccgactgtcccactctgcgtctcaatggcgcgaatggccgttgctacaactgcagccagccaggccaccttgctcgcaactgcccggctcctgcttctggcgctggccgcggtgtcggtgcccctcgtggtggatataacggtggcttccgtggcggatacggtggttatcctcgcgctgccacttgctataagtgcggtggccctaaccacttcgcccgtgactgtcaggctcaggctatgaagtgctacgcttgcggcaagcttggccacatctctcgtgactgcaccgnccccattgtggcccttgagcttttgtggcaggtttgctacagtgtgcccaggttggcacatttc

SEQ ID NO: 5023 - DNA, 737 bp, Aspergillus oryzae
aggatccaaaaagaaatcatgttggcttccgctatacacttgcctctcccgttgccgcacggcccatcgccatgcgatcaccgtttcttacctcccacgtatgatttacaagatctcgtccatgatatcaagtcctacctcggcgattcctcgggaatcgattcatcagacatagaccatgaacacttgattgcgctggcgcagaagtatgtctcaaatccgaatgattggctgcggttcttctacaacgatccgagtaagaactatacccgcaatgccatcgaaaacatcaaccgcaaggcaaacattctgctgctggtatggaatccaggcaaaggctcccccatccacgaccatgccaatgcccattgcatcatgaaggttttggctggcgaattgaccgaaacggtctaccatcctccccatagcgaaggggacgagacaagcccgctccagctcaaacaccagaagcgatatcaaacagatcaagtgacatatatctcggacgatattggcttacatcgggttcataacccaagtccgaatcaagttgcagtttcccttcacatctatacccctcctaacgccgccgattatggctaccatatcttcgatggggccactggaaaggccagttttgtatcgcaagcacatgctcattcgaatactgagaagcctgcttgtcaggcgtgacacacaaacgtcctgaaatagttgtcgtcgaccgaccactatgg

SEQ ID NO: 5024 - DNA, 714 bp, Aspergillus oryzae
tgtatcttttccctcctcatcctctttccggtagatctcgctgttgctggtcttacgtatagacttaaacccctcatcattcttgtgggccaatttgactattacacagctccgttgaagctgtcgcctcatccctccagcgaagcataatccattagacatggttggactcgcttcggctgctggcctcgtcggcttcctctctgaaccagaccctgagctgcgggtttttgctttaaagaccctagattctcagatcgatttgctctggacagaagtggtggatgctgttccacaaatagaggctctctatgaagatgaaaccttcccagaacgcgagctcgctgctcttgtcgccgctaaagtttactatcaccttcaagaatataatgagagtatggtatttgcactgggtgcggggaagctgttcaagttagacaatggaggcgaatttgaggaaacgattattgctaaatgcgttgataccttcatctccctatctgctgcccaacgacctgccgctggcgaccagccggccaacctcaatactgccttccccacttccagtgaagggtgctacagcacctctgctagtttgacgtccccgatcactccattttcgcagtctgccttaccatcgaagtcgctccttttccgacaagaagtaccaggtatcgatgcgacttaccccggtggcgacgatgctagcgttaa

SEQ ID NO: 5025 - DNA, 658 bp, Aspergillus oryzae
ttttcttcctccttatttattcgttcgattttgagttagtgaaaggctgtctatctaaaaacatgggttccaacctgccctatgccgccgatgctgaaagccctctaaagccagcggagctccaggtcttgcgggcgcagtacgaaaaggaaggtgactatgtcggtattcaaaccaagttcaactttgcctggggtctgatcaaatccaacgcccgaccggaccaacaggaaggagtccgtttgctatcagagatcttccgtgctgctccggaacgtcgacgggaatgcctctactatctagccctcggtaactacaagctcggaaactacggcgaagcccgacgatacaacgatctacttctcgaaaaggagcccgccaaccttcaggccgccagcctcggtaccctgattgatgaaagagtgtccaaggaaggattgatggggtttgcgatcgtgggcggactttgctctcgccgcgggtttggtgggtggcatggtgttccggggcgctaagaggcggtaatgtggtgtcttctcctggtgaatagctttgtgcccttgggaaagtcgtgaatctacgctgtgtatatatgggagctctttggtgttgctcttttggtgggggaatgttcgcatgccaaggcgttgtattggcc

SEQ ID NO: 5026 - DNA, 692 bp, Aspergillus oryzae
cagacaatgagcgagcttaattcaacaaatatcgaggcgctcaagcgccggatgcaatccgtgtgcagcgatcccgacaagggccttcccggggtttccgtcgctgtagttggacgggacggcaagcaactgttcagccatgctgcggggaaacggggccatggaagctctgagctcatgtctgtggactcggtattttggattgcgtcgtgcacaaagatgattactggtattgcgtgcatgcagttagttgagcagggaaggctttctttggatgatgctggtcaaattcatcgaatttgccctgagtttgatgatcttcgggtgctccaggaagatggcaccttggtggagaagaataaagggattactttgaggatgctcttgactcatacttctggattcggttatacgttttataatgagaaactgcgtgattacgcccgacccgctggtttcgatgaattctctggatatgctgaggaattcaaccagccgctggttcaccagcccagggaagcttgggagtatggcattggcattgactgggcaagtgttgtgcttgaacgtgtcacaggacaatcgttgaatgactattttcatcaacacatcttcgagcccatcggtcttaagcatatttcaatgctccccactgaagaaatgaaggcgaacctcgcgtacatgcaccaccg

SEQ ID NO: 5027 - DNA, 998 bp, Aspergillus oryzae
tctcagctgacaccgagcagatcggtcccccaaaccctcatttcgacccgcagagtcaagcagaagacaaagcaaagcgtcaagatgtcaaccctaattgaaatttcctccgaggcagaattcgactcccacatcaagtccctgccttcaacaaccttatcgatcctctacttccatgccccctgggccgcgccctgcgcgcaaatgcgcaccgtgctcgccgccctcgcatcccagtaccccgccacacagcccccaacaacctgcttcattagcatcaacgccgaagaactccccgacatttctgaaacttacgaggtcaccgccgtgcccttcgtagtcctcactcgcgacggcaaaatccttgaatccatctccggcagcgacgccgtccgcgtccgtgaagccatcgaacgccacgccggctcgaaagcctcgaccggcgcacctgccacgatccccccgcccttggccgctgtgccccgcgagacgggccccacgacggctacgcagccgccggccggagccgcgaacggggatgcgctgacgccggagcagtcgaaggaggcgctgtttgcgcgactcagagagctggtcaaggcggcgccggtgatgctgtttatgaaggggacgccgagtgcgccgcagtgtgggttcagtcggcagctcgtggcaattctgcgggagaggagcgtcaagtatgggttctttaatatcttggccgatgaggatgtgaggcagggattgaaggagtttgcggattggccgacgttcccgcagttgtgggttggtggggagttggttggggggttggatattgtcaaggacgagattgaaaatgatccggatttcttgcgtgagcactctgtcaacaaggctccccgtgcggcttgaatttatagaatacgggaaataggtttctttatggcctgtttctatctgcctgcaacacgatttgttaaattataggacagggatgccatcaccgtttctatgtt

SEQ ID NO: 5028 - DNA, 641 bp, Aspergillus oryzae
ggctaccaaggccccgtcgtaacagtggacacgttctccgtcctcctcaaacagccccaactctgtgaagcgtccgactattgcgcggccaactgtcacgccttcttcgacgcgaaccaaatacctgacaacgcgggaaaatacgccctcgaacaggccaatcgtatctcggccgcagcgggcgggaaacgcaccgtgatcgctgaatccggctggccgtaccgcggtcaagcaaatggtaaagctgtcccctcggcctgaaatcaggccatcgctctctatgcactggggtactcgttcagggaccgaaaggatgatatggtgcttttctcggccttcgatgatctctggaaacaggatgggcctgggactcacggggccgagaaattttggggaatatgaggcgcttaacgctcctgtccatttcgactggcttctatccccggggcctcgggttctgggcttgagtccgggaaggttgacatgattaccttggcaaggcttgtgcggctttggttagttccttttttcctggaatacctggggggcatgcgctgggaaacgacacgggcataatccgggccatatagggatggttaagccctccattgaaaccggacctagcttttgaaaaaaaaaaa

SEQ ID NO: 5029 - DNA, 632 bp, Aspergillus oryzae
ggatatcagctctgcaccgttgaacgggtccttaaaacacatcatgatttctcagaaggttgctcagcaatcgctgcggcggcttgccgtccagcagccctatgccatgcgctggtctttgatgaactccgcaacccccgctgctgtcgctatgggacgttttatgcagaccagacaagctgccactacctcgaacacctctgaccctaccaagatccttgcgcagcagcgtctgaaccgtcccgtttcccctcacctttccatctaccgcccccagatcacttggatcggcagtagttttcaccgtattaccggattcgccctttctggttctctgtatctttacgcgactgcatacctcgcctcaccgttgcttggctggcatctggagtcggcctccgtggccgctgctttcgctgcccttcccattgttgccaaggtccttctcaagggttttatggctcttcctttcacctaccactgcttcaacggagtccgccacttggtctgggatcttggtaagggaatcaccaaccagcaagtcatcaagtctggttggacttgtgtggggctgagcgttctcagcgcccttgctctcgctttcctgtgattttctgtgtcatacctataaa

SEQ ID NO: 5030 - DNA, 690 bp, Aspergillus oryzae
  misc_feature (1)...(690): n = A,T,C or G
ccattctcccttaaaccaagccccatcctccccaacaacaagaagaagaagaaaaaagaacagaaaaagaaccaaaaatgtccaccctaaccccccaagaaagggtgctcctcgaaaccgccacaaaaacaataaccagcatcaaaccctccgacacgcacagcgtcgctagcgctatcctcgcctccgacggccgggtcttctccgccgtaaatgtccaccactttaccggcggcccttgtgccgaactcgtcgctctggggagtgctgctgcggctggggcggagaatctcacgtatattgtggctgtcgaggatacacggcgtattttgagtccctgtggaaggtgtcggcaggttttgtgggatttgtgccctgggattcgggttattgttttaggggaggaggggcctagggttgttggtattggggagttgttgccttttgcttattcttgggatggtgaggagtagcggnttttcttttcttttcttttcttttcttttcttttttttcttctggtatactccagtttgggggtcgaggggtgtatgtcgggaccctttgttatatgtttctgtggcacttggagttgcgttcaggctacgcttgaaagatggaagagaagaaggtattttgaatgtctggctattattattatcagattaaatatatgatctaaacgcaaaa

SEQ ID NO: 5031 - DNA, 662 bp, Aspergillus oryzae
  misc_feature (1)...(662): n = A,T,C or G
tgaaaatcgccggggccatctccgggattattgtggcaccaataatccaaaagggattgtacccttgcctaacaaggcgaaaggtggcattcggaccgattgcacgcatgacagtcggattcatcgtcctgaccctctccatggtctataccaccgtggttcaaaagctcatttatcagacaggaccctgttacgaggcaccgctcgcgtgcccgggctcgcacgacagcacggtgcccaaccagatatccgtctttctccagatccctatctatcttggaggtgccctggcggaagtgttttgtcttaccacgggaaccgagtatgcctataaccacgcncctaagagtatgaagacactggtgcaggcgatctggctggcgatggctggcatcgggacgtgcctcgccctggcgtttaccccgttgaccaaagatccacatctaattaccatgtatgctattttggcggngcttctgggtggtgcgaccgtcttgttgtgggtgctgttccgccatttggacaaatccaaagatgtcggcgggtgagaaactgcggtaacctctggataggatagggcaatagctgcntaatgggttttaaccgtggtgaacatggagatgtcggtctaggtgtaaatcagggtggttgatggtgcttgg

SEQ ID NO: 5032 - DNA, 717 bp, Aspergillus oryzae
cttcttgccttcccacactttcccttgactcaattcctattcatttcactcaagactcttcaaaatgtctgccatcgccagatccgtccgccccttcgcctctcgcgtgctttcccagaagctccctctggccgccgcatgcagggtttcgcccgcaactgctttcccgcggggaagtgttaggaacttctcccaaagcccattcatggagctgaagaagtacaccgagtctcacgaatggattgagttggccgctgacggcaagactgccaaggtcggaattacagagtacgctgcccattccttgggcgacgttgtgttcgttgagcttcctgaggtcgacgccgaggtcagcgccggggaacccgttggagctgtagagtctgtcaagtcggcttccgacgtcaactctcctgtcagcggtaaggtgatcaacgtcaactcaattctggaggataaggccaagttcatcaacgagagccccgagggtgacgcctggatcgctgagatcgaggtcaaggacgcctcagagcttgacaacctgcttgatgccaaggcctacaaggaaacccttggtgatgagtaggggcgcatgctcggataaggaaaatgcgtagatgcgatggtatgtcaaaatgaagcgctcggtgatcatggtttttttaatgtcggattgttctgttttacccacgaggaacccaattattgtctcttttg

SEQ ID NO: 5033 - DNA, 538 bp, Aspergillus oryzae
ctcaaaatgttcaagaaagatatccccccgagcaaccgctcaaaagtgaaatccagcgtgcagcgcggcctccgccaacgcttcgtagaagcatacccaggcttcgaaccttacattgatgatatcctgccgaagaaagctcagctcgatgctgttaaacttcccgaaaaatgcaccctctacacaatcgactccacacccctcttctaccaaccccaagacggccctcccattccacacctaaaactcatccaccaatatcccaccgccctcccaaccgtacaaatcgaccgcggcgcgatccgcttcgtgctagccggcgccgcgctcatggcgcccggattaacgagtcccgggggccggttaccggagaaggagaatgcgttggaggcgggacaggtggttgctgttttggcggaggggaaggagacggcttgtcttgttgggacgttgaagatggggacggaggatatgaagagtaaggggaagggggttgtgatggaggatggacattatttgggggatgggttgtggagga

SEQ ID NO: 5034 - DNA, 737 bp, Aspergillus oryzae
  misc_feature (1)...(737): n = A,T,C or G
gagtaccgcccgcgcaatatatattcccacaaccgatcgccttttcatcaaatcaattactgtgatacccacctttttttttttgttccatatcaggaactgtcagaaatcatggcctccatcgatccaaatgtaccaacaactacgttgccatatacctgcaacacctgtctcgttgcttttcgcggtagcgatgctcagcgggatcatatgcgcaaggactggcatctctataacatgaagcgccgcatcgcgtctctgcccccagtgtcccaggaggtttttaacgacaaggtccttgctgccaaagccacaactagtgctgccgccgccaaagcttcctttgagaagacatgtgtcgcctgccagaagacattcttcagcgagaactcgtatcagaaccacgtgaagagttccaagcacaaggcccgtgaggcacagatgcttagagacagcgccgatgatgcatcgtctgtcatgagttctactttctctctgggcgagccagtcaacaagcctcgtgagcggtcggaggtgtcgaaagttacggagagtctcaagaacgctaccatcgaatacgatgacgaatatgangaaatggagagcagggcatctcggcctcccgttgttttttttgtatgagaaatcttaaaactttaacaaaacacccaagcccatgttcagacccacggcttgttcatccacaagaaagactatcttgttgatttggaagcact

SEQ ID NO: 5035 - DNA, 679 bp, Aspergillus oryzae
  misc_feature (1)...(679): n = A,T,C or G
gagtatcgtgggaatagtttaaagctctttatgaagcattttcgagtttgttgtaattccattcgacttctacgacacctagcttcttccccctcaagtactacactctccacacttactccattcgcccgaaagaacccattttcctgcacagtccaaccagcaatcacccaacgcacaatggcaacggcaatggcaaagcgcctcgagggcaagacgatcgtcgtcaccggcgcgtcatccggcatcggtcgcagcaccgctaaggagttcgctcgcacggcgcccaagaacctgaagcttatcctgacagccagacgaatcgactctctgaaccagctcgcgcaggagatcaaggaggaagtcggtgacggcgtgaagacattggccgtgaaactagacgtcagcaacccggccgaagtccagaacttcgtaccctctctgccggcggagttccaggaaatcgatgttctagtcaacaatgccgggcttgtcaagggtgttgccaaggcccctgaaatcgccccggaggatatcgatgtcatgttctccactaatgtcactgggctgatcaacatgacccangcgattcttccgatnttcaaaancggggtgatggcggtcgtggagacatcattaacattggaagtatcgctggtccgtgaagnctatccgggtg

SEQ ID NO: 5036 - DNA, 762 bp, Aspergillus oryzae
  misc_feature (1)...(762): n = A,T,C or G
tgatctaatcganaatctctcaactganatttngttacnttctatagnatanacaaanaccttgctgggatccaaagtcgttactagtacattatctctggcgctttttctgaaccattgcacgcactaactaaagcactcttacagaggactaacgggctttgctggtgcatacatttgcctatggggactttgccgttttcaatgatcctgaccaggaagagaatatactgcagaagaccgccagttttttgaagtacggctcttttctagatatctccaacttggccaaggttatgcgaaactggcttggggatattacatttcaggaagcatataatagaacgcgcagaatacttaacatctgcgtttctagtgctggaatatatgagcttcccaagctattgaactacatcacagcacctaacgtgctgatttggtctgcagtagcttgctcgtgctcggattcattagtattttcgccgtttgtccttatggccaaaaatacacagacaggacagcaatcactttaaaaccacttcatacgcagtatatcgatcgtataccagaagcttaattaccacttaaccgttctaaaaacaatgatcaaggataaccattccattacggaaccagttaatactaagtccatttccagaaatcgaatcactattgcatctcccaatggaccatggaaaccctcctgattagttccatttcgaatgatcacagactcataccacgaatcagttaccatggttt

SEQ ID NO: 5037 - DNA, 691 bp, Aspergillus oryzae
  misc_feature (1)...(691): n = A,T,C or G
ccactttgacctcagaacctttcatttcacaccaaaaccccatattgataatacatccaaggaaagaaccgataagcaagatgacagaccatgtcgatgtcccagaaaccaacaaggccttcgtgcccctcgaaaacaacccagaagtgatgtcgcacttagtccaccagctcggtctcccaccaagcctaggcttcacagacgtatactcaatcgacgagccagacctcctagccttcgtcccccgtccctcgcacgcccttctcctcgtcttccccgtctccaaaacctacgaatcgtcccgcatatccgaagacagcaagctcaccgactatactggctcgggaccttcggaacccgtcatgtggttcaaacagacgatccggaatgcttgcggtttgatcggattgttgcacgctgtgtccaatggagaggctcggaaacaggtccttcctggatcggatttggatgggcttttgcgggatgcggagccgcttagtcctatcgacagagcgaatctactatatgagagcaaggcgctagagagtgctcatgctgatgcggcgaagttaggtgatactacggcgccccaggcagaggatttccgtgacttgcactttgntgcgtttgtgaaaggggtttgatggaangggtgtgggacctgatgggaggangaagggtncgttgnaaa

SEQ ID NO: 5038 - DNA, 750 bp, Aspergillus oryzae
  misc_feature (1)...(750): n = A,T,C or G
ctggcgtcgacgaggaaatctaaataaccccaaaatgcccgaaataatcgacgacaaatcccaacactgcatcccattcctcctggagcgcttaaaagcccaccaagagcgattcggcaacgacccggccagaaccccaccattctttctggggttgaacggcgtccagggagccggaaagacggtgctggtgtccactctacaatcgactctgcgttccccgccatactccctccccgttatcactctgtcgctcgacgatctatacctcacccacgaggaacaggtcaatctcgccaagtcgcacccggcaaatccactactgcagcatcgcggacaaccggggacccatgatctgccattagccaaggaggtctttgaatctctccgcgcgggccgagccacggctattccgcagtatgataaatcggcgtatgcggggcaaggggatcgcgtacccgagtcgcaatgggagattgttaacggtgaggggcaggagaagataaaggtcgttatcttcgagggctggtgtgttggtttccgcgctttggatgatcagctcctgcgcgagaagtgggatgctgctgttntgcggaaagagaagggcgactatgatggacggctgggatatgtgccgtttgaggccgccaaggcttgtaatgatgcgctgaaggactatgatctgatcacggatcagttggatgctttgatccatatngatgcccaagacctacacttcgtctatgactg

SEQ ID NO: 5039 - DNA, 1091 bp, Aspergillus oryzae
gccaactacgacgagctattgctgacccctggttcgaccctgggtctcaacatcgtcacacaaagccagcagttccagccaggcgacgagctactgacgaccaatcatgcatacagctcggtgaccatgctcctccgacatgttgcaaaccgggatggcgccaaagtggtcattgcgcaggttccattccccgttgcatctgaggaggagattgtccaaagtatcctggcgtgtgtgacagaacgaacccggttcgccatcattgatcatattgtcagccgttccggcttggtgttccccatcaagcgcattgtccaggaactagcggaccgtggggtagacaccctcgtcgacggtgcccacggcccggggcaggtgccagtggatctccatgacatcggggcagcatactacaccaccagctgccacaaatggatgtgtgctccgcgcggggtgggattcctgtacgcgcgtcgcgaccggatccgccgtctcaagcccctgatcattgctcgctctggccactggcgggactcggacggggccgcctacagttggttggagcatacctttgagtggaacggctgtcacgacccatctggcgtgcatagcatgccaaagattatcgagtttcttgaaaccgcgctgccgggcggtcatgctgccatggtcaagcgaaaccatgagcttgctgttgacgcgcgccggaaagtgctggggatacttggtattgaccttccttgcccagatgatatgattgccaatatggtggtgttcccccttccagactcggtgttaccagagactcagggcattctccctctgtgcaagacgctttgggagaatgatcgtgcagagatccagtgttaccactggccggcctacccgaaacggatcttccgatttagtgttcagctgcacaacagcatggagcagtatgtctggctggcggggaagatcaaggccgcactagatgaggagactagaatagcccaagcacatgctgcagaggtcaatggtcttggaacatagaatcgagtacgctccgatgatagcacagtgactcacctcatgaattgacttgagattaa

SEQ ID NO: 5040 - DNA, 760 bp, Aspergillus oryzae
gcgtcgtagtatcccatcttgcgagcagggggataatcaactacagtagtagtgctattattgcttggttatagtatccatctacaatggaccgttctaacaagccttcggccatcggcgtgggtgcatctgtgcctcagcccactatctccctccgcgataatactgtcgaagccacgctgccctccggcgaatctgttacgatccacctgtacggagctactgtcacttcctggaaattagcaaatggcaaagagcaattatttgtgagcgagaaggctcatcttgacggttcaaagccaatccgcggcggtatccccgttgtgttccctgtcttcggtcctcctcctcagaaccatgccacctcctcccttccacaacacggctttgcgcgtaacagtacttgggaattcttgggcaagtcatcatcggaatccctaggcaaggatcgcagcggagatggctctgtcaagctggacttcggtctctcccgccccatgctcacagaatatttccagaaggcatggccgtacgacttcgggctggtatatagcgttactttgaccaaggagagtctggagacgtctctccaggtgcagaacaagggtagtcagaattttgacttccaggtattgatgcatacgtatctcaagatcgacgacatctccgatatccgcgtcaagaacctcgaatctaagacctacgccgataaaacacagaatgctgccgtcatcaccgaaaccttccctgcccgtgagat

SEQ ID NO: 5041 - DNA, 683 bp, Aspergillus oryzae
  misc_feature (1)...(683): n = A,T,C or G
cgtgcgtgaagggcgtagatgtgacggatgggatggtgacgttgttttcagagctgattatggagaagctggcgatttattgtgggtcgttgtctggggcaaatattgcgccggaggttgcggcggagaagttcagtgagacgactattggatatgatacgccgccgatggatgtcaaagccgaggatggaagtccggaggacaataagattaagattgatgagcagaggcaggtgaaaacgaggccgacgcatacaaagttgacgcgggtgccgcaggagcttgtgacggttgatgcggagctgtggcggacgttgtttggacgaccgtatttccatgtcaatgtggtggatgatgtcgcgggcgttgcgctgagcggtgcgctgaaaaatatcgtggcattggcggcaggtttcgtcgccgggaaaggatggggagaaaatggcaaagcggcagtcattcgggttggggtggtggagatggtgaagtttggacggacttggttcccacagtctgtcaatgagaggacgtttacggaggaaagtgcgggcattgctgatctggtcgcatcttgttctgctggaaggaactttccgtctgcgaagcatgccgtggagaagggggtgaatgtagatgagattgaaaagactgagatgaacggnncagagttgcagggaacgtca

SEQ ID NO: 5042 - DNA, 1049 bp, Aspergillus oryzae
ggggccaccgccgattcggcacgaggcttcagccaacgacagccgacgcctcgtcaaaacacccaaaatgtccaccaccgttcagaccggcaagaagcagcgctcggccatcgccgatgtcgtctcgcgcgagtacaccatcaacatgcacaagagagtacgttgaatcacaacaggctaagacactagtcttcgctatccctacttgcacacatcggtcgtattctcgtcgatcgaaccccgatctgcggaacaagacaaacaagcaagtttcgacatggaggcaatggacggagaacactgcaataatccttctggcaccaaaaccttttctctgtggcttggaatacatctacagaaaagggagggatgaaacatgcctgcttttgcgtgtgtgtgtggaggaacaatcatcaggcgttcccaagaaaccaagaccaaaaaagaagaattagttttatgaagtccacctctatggccgcaaatcttgttcgcagatttttctcaagatcatatttttcccagatggcattcgggcggaagactaattcaacttttttgtgggtatagttgcacggtgtttccttcaagaagcgtgctcctcgcgctatcaaggagatcaaggccttcactgagcgtgctatgggcaccaaggatgtccgcatcgaccctgccctgaacaagaaggtctgggaggccggtgtcaagggcgttcctttccgtctccgtgtccgcatctcccgcaagcgtaacgacgaggagaacgccaaggagaagctctactccatggtctacgccgtcaacgtcaaggagaccaagggtctccacaccgatgtcgtcgacgaggagtaaacggggaaaatctttttcatttccatattagatataccttttgttactctatgaaatgatggggtttctctctgtttttacgataccgtccgggtcgggtcttgctcggttgggttggaacatttaaattaaaaaaatcggaaaagtttctgtccctgtcgtgaaaaaaaaaaaattgaaaaaaaaaaaattcctgg

SEQ ID NO: 5043 - DNA, 668 bp, Aspergillus oryzae
  misc_feature (1)...(668): n = A,T,C or G
cgtctatcaagccgagatatcaccaaaagaaattcgaggacgagttatatcactgcaacaatgggctatcacatggggtatcttgattcaatattttattcaatatggcgcgagcaacatcgacggcggcccaaacaaccccacgcagagtactgctgctttccgcattccttggggtattcaaattgtacccggcgtcattctcttctttggcatgttcctcttccccaagtctccccgttggctcgccagcaaagaccgttgggaggaagctctgcaggtgctatcgaagctacacggtcaaggagacgtcaaccaccccaaggtcctcgccgaatataaggaaatccangaagctctggcgttagagcgggagcaatcagctactgggtttcaagagatcatcaagcctctcatttttaagcgcgtcatcttgtgtatgagcttgcagatatgggcgcaactgtggggaatgaacacgatgagtactacattgttatattatgcagaagacacgacgctggatggcccttctaaccgcctaatttaataatttttaatacgggtgtgaccctcccggccttatttacctggagaaaattgccggcgcccacaattatattgggagattccttcagcaattttcttttacttgaaggagggagggg

SEQ ID NO: 5044 - DNA, 698 bp, Aspergillus oryzae
  misc_feature (1)...(698): n = A,T,C or G
cccgcgcggcggattctgtcgggtttctcgctgagcggaagccccaataacaaagcgcccggacacatgtccctcttctgcgcaaatgccggcctcctaatggcgcgccgacgacggctctcgcatcttcgccaaatactactctccgcctgaccccccggccggtgctgcccccaattgcaccgattaccccggcgcaaacccctatcccacggtcaaagaacagaaggccttcgaacagggtctcctcgagaagacaaacaagcagactagcgatgtgatcctatacgacaaccggatcgtcgtcttcaagatggagagcgatgtcatgctctacgttgacgggagtgctgatgagaacgaagttctgctttataatgacgcgttgtcattgagggatgctttgggtatctagtacaagggtgctactgacaagcgcacgattgtcaagaactatgatcttgttgctttggctatcgatgagatcattgatgacggtattattctggagacggaccctgttcttatctcctcgcgtgtgagccgggcccctcaggccgatgcgccgaatctgaagagtatcgatctgtccgaacaaggtctgctcaatgcctgggaactgtgaaagaggcgctnggccgaaggcttgcggcaaatgtagaggggcttacataccacttgggcgggcttgaatgggc

SEQ ID NO: 5045 - DNA, 626 bp, Aspergillus oryzae
ctcaggttgagatctgggccaccgccacgtcccatgccgttgcttaagtcagtgatcaatgctgccggcctggttggtgccgtcgccggccagtatttccctccaacacccgaaggcttgaaggtcatcaattcgaagcatcaggaaggtgttaagatctcgtacaaagaacctggtatttgcgaaaccaccccaggtgtcaaatcgtactcgggttacgtgcatcttcccccgggtactctcaacgatgtgtcactagaccaaaattatcccatcaacacgttcttttggttctttgaatctcggaatgatcctcgaaatgcccctctttctatttggatgaatggtgggccaggaagctcctcgatgatcggcctgatgcaggagaatggcccctgccgcgtcaacaacgactcaaatactactgaaattaacccctggtcatggaacaactacgtgaatatgctctacattgaccagcccaatcaagtcggcttcagttacgatgtcccaacgaatggtacccatgaactgcttacgggtaattgggacgtttctggctatccggacggtgtcccggagcagaacaacacattttacgtgggcacccttccctagccagaaca

SEQ ID NO: 5046 - DNA, 668 bp, Aspergillus oryzae
ggcacgctgaacacttactctaccaagatctaccaaaaggtgtttcccaacgctggtcagattgctctcatcaatgctctcaatgcgacctttggaattattttcacgctcaacgctgtctggattattgatcgatttgggcgcaaattccttctcattgttggtggcatcggtatgggaatctgcatgatcatcgttgcagcggtcgagaccgaaaccccatcaattggtgatcccggctcagacgtcaagagcacgcccgtcggcatatcgatcgtattcttactctttctattcatcttcttttacaaaccttcttggggagctaccgtgtggatttggacatctgagattttctctatgaatgtcagagcccaagcggtgggaatggcatctcagacgcagaacgtcgccaatgccatcgtccaacagttcttcccaactttcctcaataactgcggcttctacgccttctacatgtttgccggtatcaacttcctcttgtcagtgttcgtgttcttcttcatccccgagaccaagcatgttcctttggaagagatcgatgctctcttcggtggcgctaaccacgtcaaacacggcgaagaacttgtggcgggtgagaagcactggaagtgatgcagtcaaacacacgtactgaaaatgctgaa

SEQ ID NO: 5047 - DNA, 377 bp, Aspergillus oryzae
  misc_feature (1)...(377): n = A,T,C or G
cctcgtgcaggccgtatctcccctttggagcgggacgccaccgctgcatcggggagaaatttgcctatcttaatctggctgtgattgtggccactatggtgcgtcacctgcggttttcaaacctggatggacagacaggtgtacctgacaccgattattcatcgcttttttcggggccgatgaagcctgcacgaatccgctgggaacgtcgggctgcaaaatcgggataatcgattatctcgagaaccaatccagcgctcataggtgtattcgcttttagacgcctcatgcgttatgatgagctatgccggacgtgagagagtaaaatttccttctaaatgggtattttatttttttttatcaaaananaaannnnn

SEQ ID NO: 5048 - DNA, 1289 bp, Aspergillus oryzae
  misc_feature (1)...(1289): n = A,T,C or G
cgaggtgagcttcaagacctcaagatcctcaagggctttgaagagggtaccgagaatccgatcttggtgccagcgaagaataagatcacgttacgacatctcttgacacattcctccggcatcgcgtacgacttcctcgatcctaacataatacgttggcgcatgtcgacgggtcgcactcccgacataggtgaaagcacgccactattgcagcgcaccaatctccccctccttttcgagcccggcgagggcttcgtgtacggctattcgctcgactgggccgggatactcgtcgcccgcctcaacaatatctccctagaggactacatccaaaagaacatttgcgaaccactagcgatcacagacttgactttccacctggagaagaacgacgaggttcgctccaaactagccgactttaatttccggtccggcggtataactcaattcggcaccccggcagacccaaatggttcaatctcctggacaccanggcgcgtatggccggaccccgttgtcgaagagtatggtggatggggtgtgttcacgagcggaccgtcatttttgaaagtccttgcctctatttctgcgcaatgattgaaaagattctgcgcccctgttactgtaaacgaatatgttcaaggatcagctatccgccgcctccaaggagatgttgaatgcatcactgtccattccatagataaacaattttcttggtgggacaccgctagggctgcacaagacttgggggctcggcggtatactcggcttggaagatcatacaaccggtccaaatgcttgaagacttccgtgggctggcttgcccaatctcttatggtggattgatcgctccgttggcttgtgtggtttttatgcgagtcaactgctgcccactggagatcccatgagcgttgagcgagctactgtgtgtatccaatatatgtatgatagggtggaggtgcttcgcgctcacgtgtgagttgatggctagtctgcggatgctacgcatatcagctcacgcctgcctagctaattgaccgatctctgcgttgtctccagatcaacaataccttgagtcagcctcgtatggctacgtaatcacgtgctgtcaatatactacttgcgactgctacatcctatccagaccaagctcttctcctgtacggtatctccaggccattgtcccagagaacccgccccccctttcaatatgtacccgtcagcgacacccccactggtggagcttttcctgcacataagaggacgctagtttcttattctcccagtcc

SEQ ID NO: 5049 - DNA, 710 bp, Aspergillus oryzae
ctacctcctccttttctcttccccgtttatttccacccttctatagaacacaccgtcataatggctgccaaccccgtccaaaatggtctcttcgtccacgaaaacactactccccccgagcaccccagcttgttgagtatgttctctctgaagggcaagaccgccatcgttactggtgctggcgccggtatcggtcttgctgtcgccaacggtcttgcggaagctggtgccaacgttgccctatggtggaacaccaacgacaagtgccctgagcgtgccgctgagatcgcctccaaatacggtgttcagaccaaggcttaccaggtcaacatcaccgatgccgaggccgtgcaaaaggccgttgaccagacggtgaaggatttcaacggccgtctagacgtcttcattgccaacgccggtatcccttggacccaaggtcctatggttgacggccctctatcgcactacaccgacgttgtcagcattgacctcgacggtaccttctactgtgccaaggctgctgccggccactggaggagacagaaggaggagggaaccgaccttaacggcaacaagttgaccaacttcacctaccggagcttcgtggctaccgcttccatgagcggtcacattgtcaacttccctcaaatgcaagcttgctacaacgctgccaagttggctgtatccatctctgcaatctctctcgggcc

SEQ ID NO: 5050 - DNA, 592 bp, Aspergillus oryzae
  misc_feature (1)...(592): n = A,T,C or G
agagtgagctcgatgatcctaatgcaggacgaggcgtacgatccagtagacccaaggcacaggccgcatatcagcagcagatcttggaaatgaacaacgtcaagaattcgtacctcatcagcataaacgtgacaaacaagttgaaggaacggttctaccatgaatacgtcccggagctactagatagcctgcaaaacctcaacgaaatgcgcgtatcgaagttgaattcactatggtcacttgcggcgcaactggaaaaatcttcattatctaagagtatggaacacatggcccatctactcaacgaaatcccacggaatgtcccacacctcgattcgctcatgttcctgcgccacaatgtcagccagtcccaggaaccacctaatatgacctttgagcctagccctgtttggcacgatgacgaagcgcttgtcaccgatgagactgcgaaggtcttcttgcgcaaccttctcagcaagagtaaaacacaggtccgagaactgagagttgaggccgaccagaaacgcagggatgtcgaaacgtccaagcggatccgcgagaacatccaacaaggcanagactacctgagcga

SEQ ID NO: 5051 - DNA, 689 bp, Aspergillus oryzae
  misc_feature (1)...(689): n = A,T,C or G
caactgtaacgcatgttgaagcgagacagtctcgaaaactcacgaatagcaattacaatgctatccagacaactgtgacttcagagaattaattgtcacccttctcagcgaggtctgctgactctggacgaactgccaggtattcccgagcgtccttaacaaaccacaagagtctctgccgccggtgataaatattagtcatatcaaccctcgcgctggcatccgcatcattctggccggtgatcaaaatgagcatgaaaaaggtctcgataatactagggggaatattcgaaatcaattgccccgtcgtactccacctcattgcactcgaaccaatcacacagccaatagtaagcaggaagccagcaaccaccatgagcagatgcgagcagacgttccccatagcaatcgagattcggtgagtgacagaggatgtatcaaaattatctttgggcgggactgccatctgcgtcttagcgaagagcgtcatgtctcttttctccaggctctgaatttgacaaaccgtgtactccttcaccttgccttggatattgcgcagaatgaaactgtcgaatagaccgatcagccccgcgtatgtgccaattaggagcccaccaatgtcattgaagtggaagaaccgtccgactgcggccccaagcacgatcaccgctatgagaatcatgatcccn

SEQ ID NO: 5052 - DNA, 663 bp, Aspergillus oryzae
  misc_feature (1)...(663): n = A,T,C or G
caaggttttccaacttggccaaggaagcaggacagggtctgctgggggtggtgtcggcgtacgcacggggcgatatgggcagcatggtctcgaccgcagtcggttttttcaagaaggcaaccaagggcgacgaggtgtacgagcgcaacaagcagaccaagacgagtggggcagacgttatcatgtggtcaggcagcaaggacgaccagaccagccaggatgctcagattcagggacaagcaaccggtgcgatgtcatgggcgtttatcagcgccctccgcaagaaccctcaacagagctatgtacagctgctaaacagcattcgggacgaactgtcgaccaagtacacgcaaaagccgcagctcagctgcagtcacccactggatgtgaacctcctttatgtgatgtaaggatttgggcttatggatggttcttcaggcacaaactttgcatcgggatagtattgacattntacacggacatgtttttctttttcattctttgttcctgcccgattttcaaaacttgcattgctttctgcccgagtgctttgttagtttcctatgattttcttgataacattcattttcatggagtccgacaagacatggnctacttggcgcatatttacatgcttttaatnattctctacaaacaaacctg

SEQ ID NO: 5053 - DNA, 972 bp, Aspergillus oryzae
gctcgtgtgtactgaggatagtatgcttatggccatggctgtcctgctggccttggaatctgtcgcacatgagaaacctgggatgtactggaaaagcttacggacgctcgtcaacaagactagcgttttgacgttgaaagacggtctgagccagctctcggacgccctggtcgacgctttgaagaaatccaagaaggttgacgtgttggcaaatacggacgttaagtccattactcagaacccgatgactgacgatcttattgttggatctggacaggacaggtctcgaatccacaaccgcgtgattgctacaattccagctcccgaactggcaaacaagctcgcgactacgacagtcaaagaccagaaagtacctcaaagtactattcggaaccttcaagagcacaattatgctgtaacagtcatggttgtcaacttgtatttccctaacccagacctcctcccggtcagcggctttggatatctcataccgcgatcgatcccttatgagcagaatcccgagagggcattaggggttatatttggatctgattctagcgtgggtcaagatactgcacccggcactaagcttacagtgatgatgggtggccattggtgggatgggtggaaagagtccgattatcccgaccatgacacagctgttgcaatgtctcgtgcgttgcttcaccggcatctgggcattacggatgcgcccactctaacgagcagccggctgcagcggaatgccattcctcaatacactgtgggacacttgtctcgcatgcgcgaactgtctcggtccacacggcacgagcttaacaatagacttactctggcaggaagttggtataatggtgttggtgtgacggactgtatccgacaggggtatttagcggcgtcgttcggcgtcggtgctcgaaagctgggccccggtgacggggatcgcccctgggagaggttcgactatgaaaa

SEQ ID NO: 5054 - DNA, 652 bp, Aspergillus oryzae
aacagccggtcatgttctggccacctggggctgttggtgaagagaaataccgcaagagttattttgatattttcggaccatcagtttggcatcatggagacttcgtgcgcttggatcctcagactggaggggtggtcatgctaggtcggagcgatggcgtcctgaaaccggccggagttaggttcggaagtgcagaaatctacaatatactgctcaaacacttcgcagaagaagtggaggattccttgtgcatcggacggaggcgagacggaattgatacagatgagactgttgtcctcttcgtgaagttggcctcgcaggaaaagaccatacctcatgagctggcagcacgtattcaagcaactatccgcaaggagctcagccctcggcatgtcccgggcatagtggacgcttgtccgggagatccggtcacgtccaatgggcaagaaagtcgagaatgccgtgaaacagattttgtgcggcctgaatatcaagatcggcgccagtgttgccaatgcctcttgccttgactgggatagaacatgggctacggggaatttgtaacagactcagtttagataaatctacaattgattgcacaatcatcaaatagcggtagaactagagtttacgtgataaatgtgtgtatggg

SEQ ID NO: 5055 - DNA, 158 bp, Aspergillus oryzae
gtccggtgcggaagaccggatggtcaagatctgggatcccagaaccggtaaatgcgagcgcaccttcaccggccattccggcccagtgacctgtatcggtctcggcgacagtcggtttgcgaccggcagtgaggattgcgaagtgcgcatgtacagtt

SEQ ID NO: 5056 - DNA, 701 bp, Aspergillus oryzae
  misc_feature (1)...(701): n = A,T,C or G
gaagctgtcactcctggggccgcgtcagcctaagaatcatatgcttagacggctgtggcatgctttatattacttgagctggcccgttgtcttttacgcaggcttttcatatggctcgtacttgatatttttcaatgtgttgaacgcgactgcctcaattattcttggctctgccccatacaacttcagtaccgcaatcgtcggcctttcctacattgcatgttgtctcggcgtggctcttggcgctatgttcaccggtagattcagcgactggctcactatccgactcgctcgccggaacaacggcacgatggaagccgaacaccgcctctggccgtttctcatctgtcttgtcatcctcccaggatcgctgatactctggggcgtcggtgcagcgcatgaagtccactggtttggcctcctagtagcgatgtgccttctcgcgatggcgaatacttgcggtgtcaccctgagtgtaaactacctcgttgacagctatcgggagctgagcggcgacgcgatgacaagtatcattttatttcgcaacacaatgtccttcgctatcggttacggcatcaccccctggatcaataatatgggctaccaaaacttgttcatctncggcgcattcattcggttgggctgtgcaacccgttttcttcgcatggtcaatacggcaggacactacgcatacgtagtcg

SEQ ID NO: 5057 - DNA, 801 bp, Aspergillus oryzae
  misc_feature (1)...(801): n = A,T,C or G
ggaaaccggaagagaatatatctcaaaatggttcccaagaagggcggcgagaactccaagaaggcagccggaaacgcccgcaaagcggaagcggctgcagctaaaaaggccgttgaggatcagaagcgtgcagctgaggaggataagcagtgggcgaagggtgctaagggtaatgctaagaaagaagcagaggaagccaagaaagcagacgcagcccgcaagaaagccgagcgcgatgctctactcgccgccgaagaagcctcccaaccctctaagcctaagggcaaatcgaaccaaccggtcaagaagtcccgtggattggatctctcccagctcgacgatcagcctgcgtctcgtaaaggagctgctctcaacgcctccggtatcgataacgcgctagacgccctgtcgttgacaggcaaggagtcgtcgaagatcgatcgccatccggagagacgattcaaggctgcttatgcggcgtatgaggcgcgccgaatgcccgaggtggagcaggagaaccctggtttgcggagacagcagcgtatagagctcatcaagaaggaattcgacaagagcgaggagaatcttttcaccaggctcatgtctcgttcgatgcatcgaggatgagatcgccgcttgtcccgacccgggagaggagaagaccgaggcanattgacgaattaaggccgtttcttttctacttgcttcaatggggtctgcatgtcccttaaaggaaaagggctacctgggcgcttttttcacagggcacttgaaagggtcctgggccttgattaccggatt

SEQ ID NO: 5058 - DNA, 683 bp, Aspergillus oryzae
ggaaactctttccgcggggttagctgcagcgcacaatgcctacggcccatcaaagtccacaccagcccttcccacgtgtattatatttctggtgcaggagaatgagaggaacacatttgatcaattggcgcttttcaggcagctgaccaaggttcacaagatacccgttttccgtctgctcagctccgagattctagaccatacgtcgatccctagctccaacccatcacggccccttgtatactcgcctccccactccccagaaacgcaattcgaagtcacgacagcttatctccggtgcttctatgcgccaagcgatttcaaatcggagcgtgactgggaagcacggactcacgttgagcgttctgcagcgatcaaatgccctacagttttaaaccagctggccggttgtaagattgtacagcaggtattggctgaaactacgggccccgacaaccttacaagcttcttacctgataccgacccagccgttgttgcaaggctccgggaaacctttgcacctcaatatgatctgtcctctggtggacgtggcagggaccttgccttgaatgtcgaaacagccatgaaccacgttcttaagccccagcgcgagggaggtggcaacaatatctacaaggaagccattccagactttttgcgctctatccccgaaagcgaatggg

SEQ ID NO: 5059 - DNA, 693 bp, Aspergillus oryzae
cgaggcaattcaccaggacaatgttcctccaacgcacagccttcgccctcgcgcggcgcactcccgtcagggccgttgctgcccgccctttctcctcctccgtcatccgctccaacaaggcgaagtacgctgttgagaaggatggcaagatcctttctttcgaagagatcaagaccgaggaggacctcgtcccccccggtgctaaggccggtaccgtcccctccgacatcgagcaggccactggtctcgagcgtcttgaactcgtcggaaagatgcagggcattgacatcttcgacatgaggcccctcgatgcctcccggaagggaactctcgagaaccccatcatcgtcaacggtgccggtgacgagcagtacgctggttgcactggtttccccgccgactcccacaccgtcaactggctgaccgtctctcgtgaccgccccatcgagcgctgcggcgagtgcggcaacgttgtcaagctcaactacgtcggacccttggaggatgcccatgaccacgatcacgggcacgggcacgggcaccccgctcccgaggagcccaagactttcgccgactacgtcaagcctgagtactggtacccggtaaatatttgacacaataatagcgcagtcatatttttcttctcaccggggaaataacagaagaattatgaaaaagagagaaaggggttgg

SEQ ID NO: 5060 - DNA, 625 bp, Aspergillus oryzae
  misc_feature (1)...(625): n = A,T,C or G
ggtgcccaaggcgagcacttggcagagaaatgggttcaacgcagttacaaactctggactcaatggaccagttacttggtagaattctctctggagcctgctaaccaactttccacggacgatttcgctggctggctggctcttcagacgaaccttgcccttaagggtattatcggtatcaatgccatgagcaagctagccgaagtggctggacacaaagcgaatgcatcatattataagaatatcgccgatacctacatcgcgaagtgggaagaattcggcatgtctcgagacggcacgcatgctaaacttgcctatgactggtatggatcttggactacgatttataacttgtatgcggatgcccagctttgcttccacctggagggcaccgacattttccctgcacatggcagtcaaaagtcactccactcacactccgggaagagtggattcntnccacatcacatctaccaaaagcagtccatcttggtccactattgtccgcaaaagtacggtcttccctggacaagccgcctttggacacttaaaaaaaactggaagtcttttttttggctgtggcaatgaagaacttcctatgagaaccttaaatccccccgaaaat

SEQ ID NO: 5061 - DNA, 619 bp, Aspergillus oryzae
actgtatccgtgccggatcactcaaccataagagaattagacacaagttgatgattgcagtgtatgagatcacagtgacccattgactcatctcaatgccaccatagatatagacaagaatacatggaaaaagaggtcgggatcagtgacatcaaactagcccacttatagtgtccctgtcaagagatcaacagacatccagactgaactcgggcccaggataaaagacatccacaggcttgtgatgtatcccagatgtgatccactctgcatcggcctacacttgtcctcaggaaaaattcatgaactcgataacagtatatcccacttactatccaaccgtcaacactcatcactcatgcgcagataccacgagaaacactcaaaacatggtacgactcttaaatcagacatgataacactcaccactcatgtgcaacatccaccataatcacgagaacgcatcgtcaccatcatacaccaccaacatcagcactcaccaagaacgtcacaacattcaacatcctcaacgaccgtatcttcatggataacgcaggacaagaaactgttaaaccttgttgcaatcaccacacgaaacccgaaacaatgcgattctcag

SEQ ID NO: 5062 - DNA, 676 bp, Aspergillus oryzae
cgacccgtcttttctcttcttcaacattttcgtcagcctccatccagccccgacagttagcctcaatcgataaataagtccagctctttcaaaaaaagcaataatggctactttccaggatcgtgctcagcacgctattgctcagcttgacaaggagctttccaagtaccctgtcctcaacaaccttgagcgtcaaacctccgtccccaaggtctacgtgatccttggtctggtcggtgtttacaccttcctggttttcttcaacattgccggtgaattccttgttaacctggccggcttcatcatccctggctactactctctcaacgcattgttcaccgctggcaaggccgatgacacacagtggttgacgtactgggttgtttacgccttcttcgccgtcgttgagagtgctgtctatgctccttactggttccccttctactatatcttcaagttcggcctcgttctctggatggctcttccccagaccaacggtgcccaagtcgtcttccactctttcattcagcccgtctttggccgcttcttcgctggcggaaacacctggggcaaccttcgcgcccaggctgatgctgctaccaaggcccagtaaatagactgtacaaggtgagatggcattcgcggtgtgtcctgcgttgccatgagccaggtccgt

SEQ ID NO: 5063 - DNA, 674 bp, Aspergillus oryzae
  misc_feature (1)...(674): n = A,T,C or G
gactggagctctccgtcttagcttgtcggtttttcggggccctgtcaacgcagttcagctacgtggcgatttaattgtctctgcgagcggagacggcgtcgccaaactgtggaacatcacgtctggccactgtgtcaaagaatttcacagtaaagatcgcggactagcatgcgttgagtttagtgaagatgccaggactatcctcaccggtggtaacgatcaagttatatatcagtttgatgcaaacactggtgatatggtcaatgagctgaaaggccacgaagggctagtccggtctctgcacctggacagtgcgggacagcggatcgtcagcggaagttacgatatgagcgttaaggtctttgacgcgcagactggggagttgtcaattgacctacccggctggaccaccagctggatgttgagtgtgaagtcggactatcgacgcatccttgccacaagccaggattctcgagctgtcatcatggactttggctatggactagatggcatttgaatgttagaggaatagacggacagccctagacatatagttgctttttatctgctccatcacaggaaaagttncggtttcaagggagttatacgggtactcattcangggcttctgctcctgtggcaacttgttttgtactgttgcgctttttttttgn

SEQ ID NO: 5064 - DNA, 896 bp, Aspergillus oryzae
gcaacagggatattccctgagatatgtctttgccgcctgtgccaacctcggagttggtggagctaccgatagttggaagacggtgttctgggctgcagctggcatctccattggtgtgggaattatccgcatcttcttccccgagtcgaagcaattcctcgaagccaagaaggccggcaagaagtccatgagcgccggggcattctggaaagaaaccaagcagatgctgggccaggagtggaagatgtgtgtgtatgccattattctcatgacctggttcaactactactcccacacttcacaagactcctacaccacgttcatgttgacgcaaaagggaatggaaaatgccggcgcctcccgcgcatccatcctcatgaaaaccggtgcctgcgtcggtggaacaatcatcggatacctgtcccagttctttggccgccgacgagccatcatcgtttcggccttgatttcgggcattcttatcccagcctggatcctcccagagggtgaacgcgcgttgagcgcaacgggattcttcatgcaattctttgttcagggcgcctggggtgttatcccaattcatctgaatgagctctcgccaccggctttcccggcctcttttcctggaatcacctaccaagtgggaaacatgatctcatcgccctccgcacaaatcggtcaacgccgtcgccgaaaagactttcatcactggttcgactggtaagccggcgcccgcttacgggccaaccatgggcgtggctacggccattatcgcgacaggaatcattgtcaccacggcattccgaccggagaaacgtggacgaagattccagactgcttgtgccggtgttgagcaatctggaccgcaaaaagttcttgacgaggagaagggtgaa

SEQ ID NO: 5065 - DNA, 649 bp, Aspergillus oryzae
tatctcacgaccggctctttttcgcaccacctcaattgaccccagtctacatccattcgggaccattcaccatgtccgctccttctctctccagctacatcgtcaagcgcccttggctcaagcgctggatgatgcccattgccaattggtacaccgacgccgccggctacagaagactcggtttgaaggctgatgacctgatccccgaggagagcgaggttgtccagactgccatcaagcgccttccccctaaggaggcttatgaccgtgtcttccgtatccgcagggctttccagtgctccgtttcccacaccctccttcccgctaatgagcagaccaagcctgcagatgatgtcgaatacctgagccccatcatccgcgagatcgagaaggagcagaaggagcgcgcggatctcgactccctcgttgtcaaacgccggtaaatagcttgtgctcagttctgctgattaggaagattcaaaaccgcgccatggtgatagaaaagcgggatatagatgaagacaggcttatgtttcggttcggttgcagcgcttagttgcgatgagcactggctgaatttaattggttttgatacgtcgttcgatcatgtgtactgatactgtacaaattcatttgtcgccatttgttg

SEQ ID NO: 5066 - DNA, 677 bp, Aspergillus oryzae
ttacaccatgcaatctgtcttgaagccaatcattggccctaaaaaggagattcacgacctctccggtcgagtcgctctgatcaccggaggggcgttgggtatcggctatgaagtcgcccgcgcattcgtgctcaacggagcgcgagtgatcatggtgaaccggaaagaagaacaaggccaagcagccatcgacaagatcaaggaggaagccggtgcggacgcaaagattgaatgggtaccatgcgacatgggaaacttggcacaaatcaaagaagtattcaccggtatccgtgagcgggaggagaggcttgacctgctcattctttctgctggaatcaacgccaaccagtacggcgagacgcatgataagattgatcgtcacttccaggtgaactggctgggccaattctacgtctgcaacttactcttcccactgatccggaagacatccaaattacccgatacgcctgctcctcgcattgtctgggagacatccgagcagcaccgtgccgcgcctaaggtagtccattttcgatctctggacgagatcaataaccctgcgaatgacaacaccgagctatacgggcggtcgaaactacccatcatcctcggtgtcaagtatggatttttggatcgaatgattaaccccatgaagaatacatatatgggctttctgg

SEQ ID NO: 5067 - DNA, 713 bp, Aspergillus oryzae
  misc_feature (1)...(713): n = A,T,C or G
cgtggaggtctagttacagtctgcttccagcgagcattacctcctccttccttcatcgtctgcagcgtcattctctaccagctcacgactgtcggaccctggtgactgggaagataacgcgaatctgtcaatagatgcattttcggagctcccttccaaagattttggtgtcaatcaacacatggtcatcaaccaagagtttaaagaagccttacgtcaaatcctttggcaatttcgggcaccgatccgatacgcattcgcctatggttcgggcgtcttcacacagtccgggagtgctcctggctccggccagtgtcacccgtctgctccggctgcaatcaagaacatgcaacaaggtcagggtaagatgattgattttatctttggagtgtcgtactcccaacattggcactcattaaacctccatcaacatcgngaccactactctggactgggatctttagggtcttacgctgtcgctcaaacacaagataggttcggcgccggtgtgtacttcaacccatatatcaccgttaatggcacgtngatcaaatatggcgtttgtaatctcgacacattatgtcgtgatctcagccaatgggacacgctatatcttgctgggcgggtacagaagccaggtaagattctgcgtgaccattcgaaggtncggctcggaaaccagaagaaactactcttttggcgttcggtggcgg

SEQ ID NO: 5068 - DNA, 1270 bp, Aspergillus oryzae
caatgtaaataatcctcgtctgtgccgacaatctcgctcgcattgcgaaaatcagcgatttcggacagcgaagcgacgatcatcctggagaaccctagatacaccaaacgttgcactttgattactctaacaccacccaaatcaagagcagcgacctgatactcaatccaacagtcccgacagagcagtaccgatcaacgcgatgatgggcgcataactccaatgcccccattccccgtgtccccacgaccagcaaatcgcaccgtcggcaaacgcaaccgcactaaacgccaacaacgtccatccgagtgacttgggggtgccgaatatcgaggccacgtagaccgacagccccatgtaaatgtcccggactccgtagacgtacatcagactgttcacgagctgtctgtccgcggttacggttggtggtgtccattcgaagaaggtaagggcatggtcgggccgtatgagggcgttgatgccgaaaccgaggatgatggtgccgaaggcgttgcccgccagacgcagggctgtgttttcggagaggggcatcttgggaggtatcgcggtccagtctaaatttcgagacgggcaagggaaatgtcgcggttaagcaaacaaaaggatcacgatagctttggttgagaactggaaaaaaaaaaaattcctgcggccgcgaattcttccagtaagaccaagggtacccgcgttgagcgcaagaagaaggaccccaacgcacccaagcgtggtctctccgcgtacatgttcttcgccaacgacaaccgtgagaaggttcgcgaagagaacccgggcatctctttcggtcaggttggcaagatgctcggtgagaagtggaaggccctgagcgaggctgaccgccgtccttatgaggataaggctgctgccgacaagaagcgttacgaagaagagaaggcgcaatacgccgctgccgctgaggaggatgaggatgagtcttcttaaaatgtttcttctcctcgtaggtcttgtgaatcttgaccgactggcgtttcgtgttgtttattcccgctaatggcctcacttgtatttgtcgcctcttatatttccttttactcaatgggttctggtatgggatgacggtggtttctccttgcttttctgttcatgaaggatcttcaatgggacatgtttactgtatggactggcggctttaggacgaatttgacttaactcgagggagcccggcgctgtattccagatcggcgggagaaccttgttttgagtatctatg

SEQ ID NO: 5069 - DNA, 974 bp, Aspergillus oryzae
  misc_feature (1)...(974): n = A,T,C or G
ccaagggcaagatcttgatgggaggtacaatggacgaaaaggagcgcttcattgagccaaccttggtactggtggactcagttgatgattcgatgctgacgcangagagcttcggacctttgattcctatcttgcccgtggacaacctcgagcaggcagtcgacattgccaatggaattcaggccactcctttgggtctttacccgttcggttttaaggttgatacagaaaagattctttcttctactcgctctggtggtgtctccgtcaacgacgctgctttgcacattcccaccctaccattcggtggtgtcggtgaaagtggtcacggcgcctaccgtggcaaggccagcttcgacgtcttcgttcaccgtcgtcccattactagcacacctagttggctcgaatccatcctctcaatccgttacccaccatatgcgggtaagctgaccaagttcaaggcagccaacacccttgcacccgatttcgatcgtaacggaaacaagatccgattcggctggctgcgttacatcctaactctcggcggaggctctgcgaaggctggtgctggcaaagccgtcgttgtcgctgctgtggcctatctcgtgcttcaggttcttgaacgccgcgcttcgaagctttaatatgacctaatattttcgattcggatatataatatttttggttcggtagcgttgctatattgttgaaagtgtattgttgtccaaacgagatatatgaaaaatcttccagctagctggctaggtagagttaacctacgactcaactgctttcgctttcatcacgggtttggttctatgtattctatttgaacgtatgtcaagtatcattattcgtatcatgcgaatgatgaatgcttatcctctccaaaaaaaacacaaaaacaaaaaaannnncgnnttccttcggccgcgaattccgtcgtgcagtattaggatcgagctctaatatct

SEQ ID NO: 5070 - DNA, 1727 bp, Aspergillus oryzae
  misc_feature (1)...(1727): n = A,T,C or G
aatccggcgaggggcacagcttccgcttcaaagccctagtcaacactagttcatcttctaattactttgcttcacaatggcctcagtcgaacccatcaaaacctttgagattagacagaagggaccagttgaaaccaaagcggaacgcaagtcgattcgagacctcaatgaagaagagttagataaactcatcgaggcttggagatggattcaagaccccgcgagaacaggcgaagactcatttttctacctagccgggctgcatggtgagcctttccgaggcgcgggatacaacaattcccactggtgggggggatactgccatcatggaaacatcttgtttccaacctggcatcgtgcgtatctgatggctgtggagaaggctttacgcaaggcgtgtccagatgtctcactcccatattgggatgaaagtgacgatgaaacggcaaagaaggggattccgttaattttcacccagaaagaatacaagggaaagcctaacccactgtattcctatacgtttagcgaaagaattgtcgaccgcttggccaaatttcccgatgcagactacagtaagccacaaggctataaaacctgccgatacccttattcgggcctttgtggccaggacgacattgcgatagctcaacagcacaacaatttccttgatgccaattttaaccaggaacagattactggtctgctgaatagcaatgtcacgtcatggcttaatttggggcaattcaccgatattgagggcaagcaagtcaaggccgacacccgctggaagattcgtcagtgtctcttgacagaagagtacactgtcttctcgaatacaacttcggctcaacgatggaatgatgaacagttccatccactggagtcgggtggtaaagagacagaggccaaagcaacctcactcgctgttcccctggaaagcccccataatgacatgcatctcgctattggtggagtccaaattccgggctttaacgttgatcaatatgctggcgccaacggcgacatgggggagaacgacaccgcctcattcgacccgatcttttactttcatcattgctttattgactatctattctggacctggcagacaatgcacaagaagacagatgctagtcaaataacaatcttgccagaatatcctggaacgaacagcgttgatagccaaggtcctacacccgggatctctggcaacacctggcttaccttggacactccccttgacccattcagagagaatggagataaggtcacttcaaataaactcctgaccttgaaagatcttccctatacatacaaggcgcccacgtccggcacaggttcggttttcaatgatgtgcctcggctcaactaccctctttctccaccaatactacgggtctccggtatcaatcgtgctagtatcgccggttcctttgccttggctatctcgcagacagaccataccggcaaagctcaagtcaaaggtatcgaatctgtgcttagtagatggcatgtacagggctgcgcgaactgccagactcacctaagcacaacagcatttgtacctctttttgagctgaatgaggatgatgcaaaaagaaaacatgctaataatgaattggcagtgcacctgcatactangggtaatccangaggtcaaagagtgcgcaatgttaccgtgggaactatgagatagatggagggtcggctttatagttatttttatg

SEQ ID NO: 5071 - DNA, 711 bp, Aspergillus oryzae
tggaatgtcttttcggtccggatgaggactaggattcgcgacagagaagcccggcccaggcaaggctagtctcttgccacttgcagaggaagaattcactaagggccatgttggcgagctcagcgttctgtcagacttccgtgcgcgaattctaccggttcttggaaccatgcctgcggtttttggatacaccgtggcaaaccatgttatctgtgatattgcaggttacccgagagactacagcattgccagaaaaggcaaggataaaatttatgactcggtccagacggctacccagggtttcatggaacggttggctagagttgaagttggtcaacatgtcattggccttcgtcttccaattaccaagggcgacgtcgttttccttgtggacgacatctggcgaggaaagagtgctatcaccggtcttcctggccgactcatcctcgttccatgggagcggcccgctcgcggcttcgtgcctgaccctgagtgggagaagcaaggacagaaattcctaccgtttgagctgaaggaccttgtgtgtatgaccaaggaggagagcgcccgacacgagaaggaagttctactgtgtggaaagacaccagaagacctatacgacgagaaaacaatccagacggtcatggagcgaatggaggacgcgggattctacgagagatttcggtagatgacttccaatcttgtaacata

SEQ ID NO: 5072 - DNA, 390 bp, Aspergillus oryzae
  misc_feature (1)...(390): n = A,T,C or G
tatcctctgagaagaaccgtggggttgatggagcccgtgttgaacgtgttctagagctctgcggcgttgctagcaacaagaacaccgttccgggagatcggtcggctttgaagcccggtggtctccgcctgggtactcctgccatgactacccgtggcttccagcccgaggacttccgccgcgtggccgatatcgttgatcgcgcggtcattatcacccaaaagctggacaaggctgccaaggagagcgctgcggctaagggcgttaagaacccgaacactgtcaaggccttcctggaatatgttggtgagggtgaggagatttcagagattgtgctcttgcngcangaagttgaagactgggtggggacttttaagcctcctttgaaag

SEQ ID NO: 5073 - DNA, 672 bp, Aspergillus oryzae
tagaccctcagtgggaccactagccttttttttccgtccttcacacccccatccatttattaagaattataccaaagttttcaatgaccatggctgatgaacgattggaagcgatcccttctcctgcccaaggagttggcccaatttacagacccgatggcgagaagccaacagcgacagtgtcgaaagacataccttatgaaaatgtccatgtcttgcctcaaacaccccagttgatcgctcttctaactatgatcagagataagagaactggacgtgccgatttcatattctattccaacagaatcattccgttattgggggaaaagggtttaaaccaccttccatgggttgagcaaccggtgacaattcttgtaggccgaacctatttcggggtcaagttcgaaggtaaaatatgcggcgattccattttgaaaccaggcaaggcaatgaaccaggcctgagaaaatggtgtgcaacaagttgccattgggaaaaacctatttccagagagttgtggacatatcgcaccggaaatctttttatcagaaactctctctgtgagataatttccacgatagggggttacacacctgaggcacaagtgttgcaaatgtgggggttttcgaaactctcttttgtaaaaactttaagcggcaaggtggtctccca

SEQ ID NO: 5074 - DNA, 768 bp, Aspergillus oryzae
  misc_feature (1)...(768): n = A,T,C or G
ggggnnnnnnnnaaggggnttttatggccttctgtacctacgtggaataatacccgggaaccaagacctgggaccagatttgggcccgaggcgagatatggtgtgttccggtttttgggccgtgacacacattgtcacgccttgcatgttgaaaccaagcccatcgaaaatccagattggaacgatattctccgcaaacacggagttatcccggagaagcctcaggaccctgaacctctcattcaagaggcccttgttgaggcggagcgcaaagcctacgagaaccgactagaagataaagatttggacgaactagatgagctcgaggacgaagaggatgaagagttccttgaacaatatcgaaagcaacgtcttgcagagctctctacgctccagaaaaccagtctatacaaccaagtttaccctcttcagaaggtcgactatggaagagaggtgactgaggcatccaataacgcctttgtacttgtgcatctgtcctcgtcttcgagtggcaatgttgagtcgcagcgcttgacggagctatggcggcagttggctactaagtttggcgacatcaagttctgcgagattcgcggcaatatgtgcattgaangggtatccgagagaaacacaccaacaatcctagtgtataaggatggcgagataagaaaacagctcgtaacacttagggaactgaaggccctangaccaatattgaaatctcaaagggatgctcttaaactaagccccctaaggagaatgatgggc

SEQ ID NO: 5075 - DNA, 650 bp, Aspergillus oryzae
ggccgtagcatataatcggcttcctatcgtggagctactggtggccacgaagcacttcgatccagatgtcgaggacggttcaggctggaccccattgatgatcgcagccagtctaaagaacgccgaaggagatcccatcatcgacctactcttgaaaaagggcgcagacgtaaatgccaagagtaactctggacagaatgctctccacttcgcaacctccaaagccaacctttccaccgttcgtaccttaatagccaataaatgcagcgccagagttaaagataagcgcgggcaattagcacttcatcgcgccgcagctatcggatcctcacctataatcaaggttcttcttcaagacgggaagagccccgtcaatgccacggatatggacggtctgactgctctgcaccatgcaatctccgagggccacggtgaagctgcgatcactctgcttaaggctggtgctgaaacggataagaaggacgccgatggcaatttggctattgacatggcgccggatacaagtgttcgaacatatattcggcaaactgcagaaatggagggtatagaaatctaagagacgtgtaacatgattatgaatacccagagccttccatagcttattataatggtctaatattagcaattag

SEQ ID NO: 5076 - DNA, 926 bp, Aspergillus oryzae
  misc_feature (1)...(926): n = A,T,C or G
gctcccctctccgaccgacgttcgcaccgactggcatccactaccctcactgcttcagtccctcgaggatctctcacatatatgtcacaatgatgcccactcagttcgcccgcgccggcctgcgtgccacccagcagttctccgttcctcgcactgccgctgtcaacggcctgaggacctacgctaccccggcccaggaggccaagcctcctgtgtctctgtacggtgttgacggaacctatgctactgctctgttcactgcctccgccaagtccgccaaccttgagcagacctccaaggccctctccgctctcggcgaggtcctcaaggccgaccgcaagttgaccggtctcatctccgctcccaccctgactgcctccgacaagtcccagatcgtccaggagctccagaagctcaccggtgacaagggtgacattgtcaagaacttccttgagaccctcgctgagaacaaccgcctgggtctgttggagggtgtctgtgagaagtttgcgactctgatgggtgctcaccgtggtgagatcgacctgaacatcaccagcgctcatgagcttgacacgaagaccctcaaccgtcttgagaaagccgtctcccaatcccacttcagacacggcaataagctcaaggttgtcaccaagggcaatcctgaccgcctctgtggacctgttgtttagatctgtgaccgcaccttcgacctcaacgtttcctccaagatctccaagctgaataaggacctcaacgatggcctcgtaattatatatagctctgattccgacccacgtaccgtactacatccaccgaccagtagtgaataatgagtccctatcattgtggccctgacgcatttcacactgagccatctgaatgatacacataattgtggtantcccttcaaaattaataccttt

SEQ ID NO: 5077 - DNA, 602 bp, Aspergillus oryzae
  misc_feature (1)...(602): n = A,T,C or G
cgaggaaagccgcaatgctcacattctagcttccctttccgataccccgggtgcctataacaaacggatcaggagaggtcgcggtccggcgtcagggaagggtaagacctccggcagaggtcataagggtcagaagcagcatggaaaggtcccggctaggttcaacggtggtcagacgccggaaattattgttcatggcgagaggggattcaataatgtcttctctcttgaccttgcgccggtcaacctcgaccgcatccaagaatggatcgaccaaggccgcatcgaccctgctcggcccatcaccatccgcgagctggcccaatcgcgctgcatccaccaaacgaaagaaggcgtaaagcttcttggtcggggtgctgaatctaccctcaaacaacccatccacatcgtcgtttctcgcgcctcggcaaccgctattgctgctgttgaggctgcgggtggatccgttactaccagattctacacggnaatcggcaatcgcacgcatcatgcgccgtgagatgcacccatttctgtctcccgcttggacaaaggaaaatggcagcgagggaatgaacaacgcccgagggaacggagaaccc

SEQ ID NO: 5078 - DNA, 659 bp, Aspergillus oryzae
cgccgtgtttctaatgattttcatttacatcgaagcgaatatcgcgtcggagcctgtcattcctgttcgattgcttctcaaccggactgtcttttctgcttgccttacgaactggttagttgtcatggcagtgtatgggctcattttctacttgccactcttgttccaggttcagggctcttcagcgaccggtgctggcataaaactgatcccccaggcagttggaacgtcgctaggctcgttgggggctgggatactcatgcgtgcaagcgggagatatagtctgtacagcatgatatctgtgtcccttctcattgtttccaacaccctcatctgtactttgaccctcagttctccttcttggcagcctttcatctacttcctactcatgggaattgcctatggcgccattctcaccatcacgctcgtggcactagtgtccgccgtggatcatgaacaccatgctgtggtcacatcggcgtcctatgcttttcgcagtacaggaagcacaataggtatcaccgtcgcttctgcggtattccagaacatcctgaagtccggactttggtcacgatttggtgacggggaggaagcgaagagattgaatccacggatcagggacagtcttgatgaacttcggaaactccagcagactggaa

SEQ ID NO: 5079 - DNA, 644 bp, Aspergillus oryzae
cacccttgcccgatgcgttcctggcgaggggctgaccgaccatagtcccttcgactcagtaaacgggggtaattctcgcgactcccgacacaatcgctgggttaccggtgctcatagggccacctaccggcacaagagggcgtgcgacaatggtccgcccgtcctcctacacccgtatcggtaccgctagaatccacctggaccgtacaccgggcgtgtaccggccgttccggaccctccggctcgattacggggacttgatgtgaggatacgcagggatgctccgtaagacgcgggtcatgaatgccgactaacacccctgcatcaacgagctggctcgtaccaacgcgctgaccaagattgccggcttgcatagtgaaacggatcccttgcgtacctggaacgaagcgcactactgccagaccatgaggagtatgcgggcgcaaaacaccccaacctgtggagagaacaagagcaactgcgtgtgcaataagcacgctgagcgctttaccaagaagaggatggcctagctccgccctccagaacaaatccaggccggggagaaatactccctcatttggtgggcggccttccaaaaaatgaaaagcttaccgtgacctcctggaaggtgataagctgacctt

SEQ ID NO: 5080 - DNA, 685 bp, Aspergillus oryzae
  misc_feature (1)...(685): n = A,T,C or G
ttcagcacatctcgacaaccgcccgcgcctcgccttcaacacacgctcctcgactcgatcaatcgcaaccacagcgagagaatcaatcattcgcaatggattccgccaaggcccccgttaagctcgtgaaggtgacccgcgtcctcggccgtaccggctctcgcggtggtgtgacccaggtccgtgtcgagttcatggatgaccagagccgttccatcatccgtaacgtcaagggccccgtccgtgtcgacgacatcctctgcttgctcgaatccgaacgtgaggccagacgtctgcgctaaaaatatgcaaaagcgacaaggggtcggattggttcttcgggaggagtacactggggaattattgcgttggcttatggcggcaaccattcggacattgattttcatgtgttaagagcccagcaatggaattcgcatcacgaatggatccagacttaatacatttccaaggatattgggaactacgaatacggacatgatcgtttgccgcgtgctggattgatgggtcccctggaagcgaatgttttctctcggttttacatctggtttccgaggagtttgtgtggacatttttcctggaaggacctncagcacgtcggttttatgggattgaaatgacaaanaagaattagcngtttatcgagatgcaacaatggacatctcgg

SEQ ID NO: 5081 - DNA, 655 bp, Aspergillus oryzae
  misc_feature (1)...(655): n = A,T,C or G
gcgaccttccccggcagcgcatccaccatcatcgtcaatcggacatcgcattcgctctagcttaagcgtaaatcgacctcaaaaaccacagccaccatgggaaagaagagacgtggtccgaccctggatgagctcttagctcgtccttggtgctactactgcgaacgtgatttcgatgacctcaaaatcctcatatcgcatcaaaaggcaaaacatttcaaatgtgagaggtgtgggagaaggctgaacactgctggaggattgtcggtacatatgagtcaagtacataaggaacagttgtcggctgttgataatgcgcttcccaatcggcaaagtctggatgttgagatcttcggcatggaaggtgtccccgaagatatcatccagtctcacaaccagcgggtcgtaacacagttccaccaagccgaggcggagcgacaagcccagactggtaaccctcctcctggcgcaggtgctggcggacagccagcgaagagaccgaagctcgaaaacgtatcggatctgaanaagcgactggcaaaacataaagccaaaaaagccgaagctatgactggtggaaacaacggtgacgtgacgcctgttggtgcggacaaacacaaaatgcaggtgccttttacccaataaccgtcgacag

SEQ ID NO: 5082 - DNA, 667 bp, Aspergillus oryzae
  misc_feature (1)...(667): n = A,T,C or G
caacagcgaaggccttgtacgatttcactagcgcacagtccaacgagctggacatccgggcgggagatgtcgtgcagattgtatcgaaggaagggaacggttggtggttgtgcatgaacatggcaacttccgtccagggctggaccccccaggcgtatcttgaagaacaagtcgcgcctacgcctaagcctgctcccccaccaccaccaccagccgcacctagggcaagcccggtgccgtctgccaacggagccgccgctactgcggccgcggcgaaggccaaaccagcacctcctgcgccacctgcgaaacgccagcctatcatgaggcctcgcagaggcattgagagcacgacaacacgcgatgcaaggcaagcacgatgatgatgatgagtggtgattgacttgcgttttctattcctactttctatttattccattctcattcccaatatccgattttctctccccgagttctagcttagagttttgctttggatttgctggtctactgataccatgggattcattgtttggcgctgcatgaaccctgnctgtttagatataaaatagaatggttgcttaaaatttcacccttcaagaggcatagcatatatntattcatgcaaaanaaaataaaaaaaattcctgcgagacgctcgagcatg

SEQ ID NO: 5083 - DNA, 509 bp, Aspergillus oryzae
tatatgccggcgactatcttggttcatagcacttgacgaggagcgagagctaaggacgaaaagcggaccaatcttacatctctgactctacttgataccacatcaatcatgccggaaagcctggatccacgtagcggagttatccagtcgggatgcaattaaaggggtcattccggcgttaactagccaaggcctgaaaccggagattctgttaaactgcgccggaatccaaagaaggcacccgagcgagcaattcccagatgaggactgggatgaggtgatccaagtgaatctgacatcggtttttacactatgccgtgaattcggcgcctacctgttggcgcgagatgcatccgagtttccgactggtcgtcgcggatctattatcaatgttgcttctctcctgtcgttccagggtggcatcactgtccctgcctacgcagcttccaagggaggtatttcccaattgaccaaggcactctcgaatgagtgggtcttcaagggcatta

SEQ ID NO: 5084 - DNA, 671 bp, Aspergillus oryzae
cgagggccaatttcaatccgttcgtaccctaaacccttttatccgtatactcttaatctattggaatcgccatgtcacgacacgcacaagtagaggaggtgtacgactccgatccagatgaggttttcccctccgactccacgccctccaacttcaccaatgaatccctcctctccgctgcaggtatctctcctcagggtgcctcgtcgataccaatgaggccagcccctgaacctcgtcgcgaaatcccgaaacactaccagtgcctgtatcccgtgtacttcgacaaatcgcgaacccgcgcagagggccggaaggtcggcgcaaagctggctgtggagaacccattggctcgagacattgtcgatgctgcacagatgctgggactgcaagtcggattcgagcctgagaaactgcacccgaaggattgggcgaacccaggtcgagtacgggtgttgttgaaggacgaggatgggaaactggcaaacccacagattaagaataagcaccacctttatatccttgtggcccagtaccttaaagctcacccaacaaccgagaaatcgccttaccgtctgagaatcagcggacttccaatgccagaaaagctttccccttgcccctcctgctccccgcggattgaagataggcccaatcttcccattcactcc

SEQ ID NO: 5085 - DNA, 692 bp, Aspergillus oryzae
gtgaagctcactctcgcttttattgagcctcacagttgatcacccaagatggcctggtcgatagcacttccccgagaggtcttcacctctccaatcctttccgtcacaacgcctaccacggtcggcatgttggtcggctatctggtcaatcgcgcgggaggaaccaaacaaacctacaaatcactccaaaagccggccttctacccgccggcatggctcttcgccccaatgtggactgtcctctacggggtcatgggatatgccgctcaccacgcgacagtggccggatatagcgccctgacttcctccaccgctgcacagagcttgggtacgaattgggaaacgctgtatacaacacagctagcactcaactacctctggatgcccctcttcttcggcatccgtcgccctgcctgggcgttggcggatatactactcttgggtgggaacgtggcggcgctgatgcagacctggtggaagacagatcggaccgccttctggctcatggtcccctacgccgggtggctcggatttgcgacatatctcaatgccggtgtgggtggtattgaacaagtggactatcggagaaaagccgaaggatcagtaaatagatttatggctctgcatttttactaatttgacgtttgcatctctcctgactacgtttctaactggaatcttcccatcctggg

SEQ ID NO: 5086 - DNA, 677 bp, Aspergillus oryzae
  misc_feature (1)...(677): n = A,T,C or G
cgcagcttcccgaaatcaccctgtgcaactaagcataggcctagatcatcgcgggacgcatatatagagcacaccgcatcgttacgggtctagcaggctcatcttgctggnttgcccaaaccatgcaacatgaacgcatatactgaatcgagcaaaagacatgcccctgtgaacggacgaatgaaaactccattacgaatgcgacgtacggtaaacggacagcagggatgttcggttatagccatttcaccggaggcttcgcgggaggtcaagcagagtacgttcgcgtgccttacggcgatgttaatctactgcagctcccagcggacgttccagatgagaaaggtctctacctttcggatgtcctggcaaccgcctatcattgcgtcgatgatacgggcgtgaagaaaggcgatgttgtagccatttggggcggaggcccaatcggccagatggctgcggaatacagctttagccagggggccactcgtgtcatccttatcgacgggggagagggagcgtggaagttggattttgtcacgagcaagataccaaagcttgagacaatagatttcagcaatctaccaagaggagaatcgatcacctcccagctaaaaaagaatgtacctggagggccagatgtggcgctagaatgtgccgcacgagagtatgctaaa

SEQ ID NO: 5087 - DNA, 658 bp, Aspergillus oryzae
  misc_feature (1)...(658): n = A,T,C or G
cggttatcttttatgattcggactggaaccctaccattgactctcaagctatggatcgtgctcaccgtctcggccagacaagacaggtcacggtgtatcgcctgattactcgcggcaccattgaggagcgtattcgcaagcgagctttgcagaaggaggaagtgcagcgtgtcgtcatctcaggtggcgcagctggtggggttgacttcaatactcgcaaccgcgagagccgaaccaaggacatcgccatgtggctggcagatgatgaacaggcggagcttattgagcaaaaggagaaggaagcgctggaccgaggcgaagtgtttggcgctagtaaaggcgggaagaaggctgctcagaagagaaagagagatatcacgctggatgatatgtatcatgaaggcgaaaggaactttgacgatgccagtgcanagccatcaggagcggccactcctgtgtcgactgcagagaatntaggcaccccatccttcacgccagtttctaaacgaggacgtggaanggggacagggaaagggcacgtctaaaagagccaaaactaccaaggagagattacgtctcattgatggcgacggaggcctagggcctanttgaattaatcgatctgtgcctcataatggacaccgctggtattgtcatg

SEQ ID NO: 5088 - DNA, 630 bp, Aspergillus oryzae
cttccacaacatctctctctgcgacagcttgccaggacaccgcagctgatccctcggactttgttcattatttgagggagatccagaagccggagatgatggaagtgggcaaaatccataaacttcgacttctcttgcggaatgaaacaatcagctgggtcgatacatttattgcggatggcggtatggacgaaattatacaattgctttacaggatcatgaaggttgagtggagggaagaacatgaggataatttgctccacgaagccttgctgtgcttgaaggcgctctgcacgacttccgttgcattacagcgtcttacagctgttgaaggagaaatcttcccagcgctcctgaagatgttgtttgacgaggaaaagaaaggaccaagcgaatacacaacgcggagtattattatcaatctccttttcacacaactttcaacagcatcatcagctgaggatgccagatctcgtgccagccgaatcctgtcgtacttgcgagacccttcaccacctgaagaaaaccaacccctttcatttattgcaaacatataccagtcacgcccgtaccgtgtctggtgtaaagaggttaccaacgtaactaaagaagtcttctggatattcctgc

SEQ ID NO: 5089 - DNA, 599 bp, Aspergillus oryzae
cgaggttaatcaaactaaccacagcactcgtcggacggatccccatggcgcaaaattgactcatttcgatcggacggatagtggttggcccgatttcgttcgcgttcacccagtcattgactggcactatgcggaaatttgggccttcatccgtcaactgggcttagagtactgccctctttacgaccaaggatacacgagtctcggtggccagacggatactcacccgaatcccaagcttcgggtcgacactacggccggtaacgaagccacaaaacactaccgaccagcgtatgagttgactgaagacctgtatgagcggctgggacgcaattagtttcccttgaccgtctgcatggagggttcccggcaccgtcaagctgttcgcgcagaagttctttgtttggtccgatgtttgcatagagagcgatccgagaagattggatgacattgcgtattggaccccatttctatttccggccgctttcacagcttttctccgtccctcttaaatctctatgtatatgggagaatgattgattttatatatctctatggctgcataaaaaaaaaacattctaaataggttttatagagaa

SEQ ID NO: 5090 - DNA, 958 bp, Aspergillus oryzae
  misc_feature (1)...(958): n = A,T,C or G
aacgcatatcattccgtggctcaatcggcggcaccccggtctcagacaccgtcatccagtctggtgccttcccttccgcccctcaaggctctatcgggggattatcccaacaacctctctcaatcatccagcagtacctctcagagccccagtcacgatctcggcgctggcaagaagttcttctgggatacgggcgccagcctgtccaagcggtcgtacgaagattcgtttggccatgatgatcgtccactctacaacggcatgcgccccgatacggaaagttatcctcggaggctgtcagatgccagtcggaacttctacaacgaaacgcgcgatgaaatggcgtacaaacgagccaacgggagaatggccacgaagatatcccctgcactccagtaaaacaagttgattcctgcttttcctcccgctcatataggacggcgtcttggcgaacggtcgtcgattgatttctttcccgtaatctgttccttttcctaatgtactctggtgtgatgggcttcagggactcttttaacgacccagacttttgatgtttataccaccgttctttttcttctttcctcgatctttggcattattgtacatgatgctctgcatgtggttttcaagatattccccggattgttcttgtcttcagtttatatacggccgctctcgtgtttattatccgctgtgtttccaggtcggctggacctgnggcctctcccttcccgcgaatagaagtgagtgagcaatacaaatgtgacattgtccaaaagtttggtgatctgaacgcgcaacctggatgcattgatccgagacaatcacggggtcttagacatgcgacatgtctgattcactccttcgaccatttncttngttatccatgaccatgccccatncactggcatgcgagaatgacgtatgcgacaagatangatcgacgatctggcttatt

SEQ ID NO: 5091 - DNA, 702 bp, Aspergillus oryzae
  misc_feature (1)...(702): n = A,T,C or G
ccaactgacccttcacgatatcattcccttccactgtccaatatacccctcctcccatcttcacttcctacttgcataaaattcctgttgcacacctcactttcataatgcctgagctttccaaggtccaccctgaagtcacatgggcccagcgctcatctgccgacgaagctgagcgcaattacctttatgtgaacatcaaagctcctgatgtagatcgtaaagaagccaccctcaagattacccccaccaatgtcacattcgccggtgattccaagaagggtgttcgctatgaagtctccctggacttgtacgctgagatcgaccccgagaactccaaggttaaccacagtgatcgtgaggtcgagctggtcctgcgtaagaaggagctgaagcaggaatactggccccgtcttctgaaggacagccagaaggtccacttcctcaagaccgacttcgataagtgggtcgatgaggatgagcaggatgaggctcctgaggacgactatgcgaacaacttcggcggcctcgatgccctcggcggcggcgagggtggtctcggaaacattgacttctcgaagctgggtgcanngccttgangggatggngtggtccttggtggcccntggtgggccctgtggtntttggtgctgagggcgaatcggatgaccaggagatgcccgagcttgaggaggctgccag

SEQ ID NO: 5092 - DNA, 1117 bp, Aspergillus oryzae
ttccagctcctttctctgtaaccttgtattatcgaccactcttgttggaacttgtttacgcccgaatatttgaaagaaatctactcttcactgacccgcaaccttctcctgttcttttctccactctctgaactatatccaacatgtctgccgaagactcagtagtaaacggcaaggcgcccgctcagccgggcagccaccatgaccgtggacactccggtcttgtcagtgtccaacccgcgcgcttggccgatctgcagccgaagtatgcgcagaagctcgagcacgatgctgagaacccggaggctcatgggtggtatgcaggcctcatccacagtcttggagaatgcattggattcctcggtgctatcccctgctgcgtttgctgcccgaacccctataagcctgtagcccaaggtgaagttggtctcgtgtcgaagtttggacgcttcgaacgtgcagtcgaccctggccttgttaaagtgaaccccctgagtgagcacttaaccgcagtcgatgtgaagatccagatcgtcgaggtgcctcgtcaggtctgtatgaccaaggacaatgtcactttgaacctgacatctgtcatctattatcaaatcgtctcgccccacaaagccgccttcggtatcagcaatgtacgacaagcgcttgtggagcgcactcagaccactttgcgccatgtcatcggagcgagagtcctgcaggatgtcattgaacgccgcgaggaaatcgcccagtcgacctcggagatcatcgaagacgtagccgccggatggggtgtgcaggtcgaatccatgctcatcaaggatatcattttcagcgatgatttgcaggattcgctttcgatggcggctcagtctaagcgaattggtgagagtaaggtcattgccgtcgcgccgagtcgaatcggccaagtgatgcgtcaggccgctgatatcttttctttggtcctgctatcaaatccgtaccttgaggcgaatcagcgattgccagaacagcaacggcaaagccatatcctggcccgcatgaatcaaacctgcaggacaccttgaaggggccgaaatgccggaaggaaccaaccgttttggactggaagtgtaaccag

SEQ ID NO: 5093 - DNA, 688 bp, Aspergillus oryzae
  misc_feature (1)...(688): n = A,T,C or G
aatatggcacaacagatattacgcgccaactttacacttaaccacagcgtacggcaactgttctctcggcgtatcctgtttccctagcagtctagtcacttcttataagtgaagcacaaccaaagatgattattcctgtccggtgtttttcatgtggcaaggtggttggggatctttgggaacgttatctacaattactggacgagggtgttgcggatggtgatgctatggatcaacttggttgcaagcggtattgctgccgtagaatgatcatgacccatgtggatttgattgagaaacttcttcggtataacccaacagaaagagatcgtgcaaaatctcaaatgtaactcgattgaaccttcactggagctgatttttcacatcaaattattttccgagatggtgatgacggatgctcaacttctgaatttattggctgtgtgagaaataggccaacactgaatatccgtcgtctcgggttttatggggtaattgggcgcattaactgctgctgtaatgctcggttatatcaagcttgcagtatgctattggcattctttgaaagtggccgtccattcccggtatcgacaactttggggctattgaacaggtccccgatttgcgaggcaagatacgcttnntgtaccttttgaggatatggaangtttacggggaaatttgcttn

SEQ ID NO: 5094 - DNA, 1289 bp, Aspergillus oryzae
  misc_feature (1)...(1289): n = A,T,C or G
cttgcgcgaagcgaccaagtcctaaaattgttctcaaaattcagtcctcggatggaatttacagacgcaccaaccggattctacggtgccttgcgtgaaacatttgcacaacttgccctggaggagacaatggcctgccgctgggagaatgtcgcgtgcgtaaagtatcctacatttggaaactgcaatgccgaccccgaagaggtcgtacgtccgttctatgctgcctggggcagttttgccacgaaaaagtccttcgcctggaaaaatgtgtaccgttactccgaggcaccagaccgtcgtgttcgcaggctgatggagaaggaaaacaaacgtcttcgggaagacgccattcgggaattcaacgaggctgttaggtcgcttgtagcttttgtgaagaagcgcgatccccggtacaagtctaacacacagagtgaatcacaacggcaggaatttcttcgtcaatcagcagctgcacaagcaactagatcacgagcagcaaatcaagcgaaactgcgtgatcatgtgatgcaagattgggcaaaagcggagactttaggtgatgaatctagcgatacaagcgaggacgaagttgagtacttcgagtgtgttgtgtgccacattaccttcaaaagtcataatcagttcgaggtccacgaacgcagcaagaagcatataaaagctgtgaagcagctacgctgggagatgagagcacataatgaagagctgggcctgaaaggaaatgtctctgaccccgaagagccccattgggagaattctgcgtatagcattccacaagatggcccaatgcacaatatggagtcatcaattcaacaaccacgggatggcgagacaagaaatggtatcggaacaaacaaatatacctcttctgatactaaaagtgatactaaacctgacgagggttcgttgccgcacacagatggncatanggactctatacctgatctcagcgaggccgattatgtgccctaggagtgtgttgaacggcgattatggttccaacccaccgttatccaacgaacggagaaatggagtaccaaaccatcttgctaaacggtttccacaactgaattaaggaatcgcaacatcttcaccgaagtgggaaaggctaacaaaacctgccaaaaaagccaacgtggaatggaccaacttccacatttttaaaggggcacttgtgttcctcatttttcctttaaggctctaattggtatataatttccccaattggggaaaccctaaacctctaacattggcgggaatggcaaagg

SEQ ID NO: 5095 - DNA, 700 bp, Aspergillus oryzae
tcactaatacgacccccagttggcgtgctaacgctgtcgtgattttgttgagcaaggggattagccggaggcaaaaatgattttttgtctctcatgcgcccttttctccggtaccctctctttgctagacgttcgcccatcatggagcccctcatagccatagtcggtgccacgggcactggcaagtctaagcttgcagtggacctggctactcgtttcaacggtgaaattatcaacggagatgcgatgcaaatgtaccgcggtctccccatcatcacgaatcaaattccaatggatgaacgaaacggtatcccacaccacttaattagctgcattgatttggaggaagaaccatggcgcataggattgttcaagagcgaatgtcttcgaattattaaggatatccactgcagatggaaacttcgaatgatgtcggcggaactcactactatacacaagctgtgtaattaaagggcagctgatcgggaaggatcggacacattcaaggattaagcccacgctccgaccgaaaaaccggagaaatcgtctccaaaagggccattcttagatgccccgacagacctgggggtgggagaaagtaatagaggttggtacctggcatgggccgacctgagggattccaaccgactcgggaaaaattccgccgtctcttgagaaactattttgaaaacgggggcgg

SEQ ID NO: 5096 - DNA, 429 bp, Aspergillus oryzae
cccttcaccaatctgtctaatgattcgttcgaccattgaggaatccatccatcattatgggtgtctctaatctgatggcccggctcaagcctcaggccgaccatgaacaccaggagcactccgatactcctaccccagtcagagccgactcaaacttggagaaggataatgccatgattgacgacagccccgtcaagtatctgacatggcggtccttcatcctgggtttgtgtgtctcgatgggtggttttatcttcggttactccaccggtcaaattgctggctttacgactatgaatgatttcaagatgcgctttgcggaacaacatgcggatggaacatatgctttcagcaacgtgcgcaatggtttgattgtcggtctgttgtccattggtactatgattggcgcccttgtcgccgctcctatcg

SEQ ID NO: 5097 - DNA, 668 bp, Aspergillus oryzae
  misc_feature (1)...(668): n = A,T,C or G
gaaattgccttgcacatttgagctcgaggtgccagggcttggcattttagagggcaatccgggcgacaatatcaaagctggtactcgcatcgacctaccactatggctaggtgaaatgctctctatcggagctcggttgggcacttctcgtttagtcacactagatatcccctcagcattatcagaacgggttatgaatgccttaaaagcagaccctcggaccgtcgatctgcgggcattagcgccgcatttctatagtctgagcgagcgagttttggaacttttcgaggaagaggagatggttgatgttcttattaatacatttaagaagcgcgcttcagaaattgctgaccatgcccacaacccaaaaggtgctcttggcgacggcgttgagtttctgagagggttagatgaaacggaaaggcagttgttccgcgtggcccatgatagtgccaaggagacacggatatgggctggcgaagctaaaaagaaggtataaggattaacatccaaatttaacagactgagctgtgctcgtcatatgagctatgtctattggtttgccaatcatgtgcttaagggttgctgtgttantggaagtatatggaatagcactcgcataaaaaagagcctgcgagctataaaaaaanaannnanannaaaaaact

SEQ ID NO: 5098 - DNA, 583 bp, Aspergillus oryzae
  misc_feature (1)...(583): n = A,T,C or G
ccaagaaggatgtcagatcgctctttggatctctacggccagcttcgctctgtgcgtgttcctaagaaatttgaccggtcggctcgtggtttcggttttgcagacttcgtaagcgctcgcgaagcggaaaatgccatggacgcgctgaagaacacccatttgttgggcaggaaactggtattggaattcgcgaacgaggaggctatcgatgcggagcaagaaatccagcagatcgaaaagaaagtaggggagcagatggaccggatgaaactacagaagctcacgggtgccggacggaaaaaatttactgtaggggcccaggacgaggaagactaaagtcccttgtccttctgcccttctccctgttgctagggttaatgaatagtaatggtgctgctatctttgtgtttgtgagatatacccccttgcttggcggaactcgttgggctttttcacacgttcctgctgtcaggactgtgcctgcagacgcgtcctgcaaagttccgtcgcctcgtgcatctgaatgaagctctatctttttttatcaaannnnnnnnnnnnnnnnnnnnnnnnnnnnatttct

SEQ ID NO: 5099 - DNA, 683 bp, Aspergillus oryzae
  misc_feature (1)...(683): n = A,T,C or G
cgcctttctacgacgagagcattcaagccttatcggagaaagtggcgcgcggccagtacactttcctgtcgccgtggtgggacgacatctcgaagtctgcaaaggatctgatctcccatctcctgacggtggatcctgaacaacgatactcgattaaagaattcttggcccacccatggatacgtggaagcgacgaagaaacccaggcagccacagacgcccccccattgacgactcctctgccctccgcccgtcaacagccgttggacgctttcgcggcagaccaggcaccatatgctccagccagcgctcgactgtcggaccagccctccgctggtctggaacgcccgatggacttccggtcgcccggggcgatcaacttgcgcgaggtcttcgatgtgggctacgccgtccatcgccaagaagaagaaagcaagcggctgaagacgtcccgcggccgcggggccaacccgaccaccgggttccagtcggctctgaaccccctcaacgaggattatgacgaggatggcccgcaagtcacgtatcagcccatttcccanaatgagtatgcggcgcccgaagttcacaagggctctcaacagtctcgagaagtggctgcnatggaggccaaaatgcgatccacanacttgggcgcgccgncgaacgctgtcgnccaaatacaa

SEQ ID NO: 5100 - DNA, 636 bp, Aspergillus oryzae
tgtggctccgcctacttcaagccttttcggacaccttctccacgcctccaaatggtaccacggctcttcagcccttcctagacgggaagatcatctcgccgatgggtatggagggtctccattccatcggaaattcacttgcctatttgcgtcatttctacgcgcaaggtgtatcctatgcaacgctgacccataattgccacaatcgttacgctgatgctgccgtcaccgagctcccagacggcagcgtgaagaaggccgatccccattggcacggtgtcagtgaggctggaaaggccctggtttctgagatgaatcggctcgggatgattgttgatctgtcccatgtaagcgccgagaccatgcgagacgtcttgggcgcaggcaaggatgactgggcgggcagtagtgcgccggtcatcttcagccatagctccgcatatgccgtctgccctcatccacgtaacgttcccgacgatgtgctgcagttggtcaaatcacggaactccctggttatggtcaacattgccccagacttcgtctcgtgcaaggctggtgataacccgaacggtctccctgattttgtccccgaaaatgctaccttagagcacgttgccgatcacatcatgcatatcg

SEQ ID NO: 5101 - DNA, 754 bp, Aspergillus oryzae
cgatactccaaattacctcagccacgatgtctcttcccccgaacgtccatatctcatctcacccgtgcctacaagccaagatatcccagttacggtcccataaaacttctacccgcgaaacaaggagccttgtccatgagatcacgaccattctaggcgtggaggccttctcaacggtattgaaagctacaaagcggggaacggatcaaaccccgttaggtatcgaatatgatacccaagatattgaacccgccaatgtcgcaatggtacccattcttcgatctggattgggcatgactgaggcaatcaacaacctgctcccaggcccggtccctatctaccatttgggtctcttccgcgagaagttcacccttcagcccgtcgaatactacaataacctcccctaccaacgccaggatggctatgactccaacaccgccgccgcagacacagctattattgttgaccccatcgtcgccacaggtgccacggctgaagcggcgattcaccttctgcgtgagtggggagtgaagcgagtggtaatgctcagtgtactgggctccgagacgggtattcgtcgggctgtagactcttggcctgagggagtcgagttctggacaggggcggtggacgagaaatgcaatgaacgaggcatgattgttcctggcttaggtgatatcggcgatagattgttcgttgccattggcaagtagggtcgagtaattcttgatatataaaaaaaaaaaaaaaaaaa

SEQ ID NO: 5102 - DNA, 692 bp, Aspergillus oryzae
  misc_feature (1)...(692): n = A,T,C or G
caacctcacattctgcatccttcaatctctttctcatccactcacatctctcccgtcaaaatgtctctcctccgtaacgtcaagggtcttgctccccttctcgaccgcgtcctggtccagcgcatcaagcccgagaccaagaccgcctccggtatcttcctccccgagagcagcgtcaaggagcagaacgaggccaaggtcctcgccgttggccctggtgccgtcgacaagaacggttctcgccttcccatgagcgttgctcccggtgaccacgtcttgatccctcagttcggtggtagcgccgtcaaggttggcgaggaagagtacacccttttccgggaccatgagctccttgccaagatcaaggagaactagatgattcatcttgttcttccgttttccgactggttggaataatccaatcggagtcttgtattatatcacgcanatcatgagcttctgtcatgcactttaaataatttataaaagagccatctacgaagtgaggacaggtgtatgattctgttcctcgatctcccggctaatgttcccttttccttatcttgcatctgctatctaaagcgtgaaatgtgtcttgggtcctttgcatactatgcgatgtaccttaccaatcggtgctcctgcgctgtctgcggataacaccggtaaatcgatacgaatgtcttctcttg

SEQ ID NO: 5103 - DNA, 695 bp, Aspergillus oryzae
gttccgcagcacccgttcttccttcgggtgatcgaactgttacagtcgtacgaccgtagctggttgcttccatacatcacagtgatgtactccactggacctctgttcctttcggtgatctggaaggaatatatgcaggaagctatgggcgaatcgtcgcgggttcggattctgatgcaggacgagtacaacaggtattcatggagctttttcacccaccacgtcggtaatagctggcacggtaaagatgcacgcttgattttctggatgggacagcattggatgttcctgacggtgtgcggctttatccttgtagggtccgttggtttctgcctctggtgggtttatggtcgactgattttgttgggctcgaagtatcgttatcggtacaccaaggttccaacattcatctctgtttccggcctatcccctactcgcagaccacggcgcccgaccccgacattgctgcgccgtgtctcttttaaagaggacgaagaaacagggcctatcactgagacctcatacgagctctacagtcgtcgtgattgagcgtgtcccgtttatatctgcatttatattgcgttgtccacattgaaacaccttgaaacgacctatactatacattccaagtacctgtcgagcgttactatgtggggtacccgccccactctactggtcttttcatttttcgcggg

SEQ ID NO: 5104 - DNA, 661 bp, Aspergillus oryzae
ggggttgattctaccctccgttctatatgcaacctttacctcggtggacttggaagatcaagttcttagcttttcccggggaacttccgccgtacttctggtgctgtatgtcggatatctctacttccaattaggaacacacaaacatctattccagcaagagccgaacagtccacaagaaggtgaaagtgatcaagatgaaaatgagcagaagccagacttgtcaaaaactgtcctcacccttatcgccgcaggcatctcaatcatcctctgctcccacttcttccttgccagtgtccccgctacatcggccacgactggaatttccaagactttcattgcaacaatcctcatccccatcaccagcaattgccccgaaggcgtggcagtgatcgccgcttcgtttgggggcggtgatgtgaactttgccatcagcgtcattgtcagtagtatcttacagatcggactctttgccattcctttcctggtcatgctcgggggggttattggggtgcccatgacccttttttttgagacgttccatactttgggcccttgtctttggtattttgggtggtaacccgggctttgaaggatgctaagtataccgatttttcttgggaatattgctgggtggccttacctgaaacttggcctttcg

SEQ ID NO: 5105 - DNA, 659 bp, Aspergillus oryzae
  misc_feature (1)...(659): n = A,T,C or G
cacggcacacattgtgtttctggaaatgcgaagggaatcgtcgtcgccaccgctgattcgacggtctttggtggtatcgctaaattaacgaacgagccaaaaaaaggcctgacaactctggagaaagaagtcctgcggtttgtcctactgattgtgcttatcatgttgactatgatcattgtcgtagtcattgtatgggcaacttggctcagagtcgatcatccggactggatcaatgttcctactctgattgttgactgcgtcagtgtcgcgattgcgtttattccagagggcctgccaattgcgctgactgctagcttgactatcactgctaatctcatgcgaaagaataagatcctttgcaagtcgctaaaaacagtggaaaccctaggtgctgtgtcccgtatttgctccgacaaaactggcactttgacaaggaacannatgttcgtcactgattgtgcgatatccagctcaaccctgagcccggagtcngccagagaacccgatggtgatgggacggaaaggcatctggcgtccaccaaactcgtgctgtggccgctttgtgcaatgcnggcgagttngatgcttcctncttcacccttgcctcttgtgagagacatatatatggagatgccacagaccaggctattctcagg

SEQ ID NO: 5106 - DNA, 766 bp, Aspergillus oryzae
  misc_feature (1)...(766): n = A,T,C or G
agtattactcgtccgaattcggcacgaggtgcgactcccgcccaagcgctcggctaccggtgctaagagggccacctaccgcaagaagagggcgttcgagaagggtcgccagccctccaacacccgtatcggtaccaagagaatccacctggtccgcacccgtggtggtaaccgcaagttccgtgccctccgtctcgagtccggtaacttctcctggggttccgagggtatttcccgcaagacccgtgtcatcgttgtcgcccatcggccgcagacgccagcagaagaccgagaccactgaggagaagaagagcaacagcgttgtgaagaagcaggctgagcgcttcgccgagagcggcaaggtcgagtccgccatcgagagacagttcgaggccggtcgtctctacgccgtcattgcttcccgccctggccagagcggtcgtgttgacggttacatcctggagggtgaggagcttgctttctaccagaaggctatcaggaagtaaaaaaggaaaatcgtgttgtaaaagggtggtatcggagtttcagcaattttttccagaatacatttatgatctctggggcactacgggtgcattgtgtgtagagctctgagctgtcagcaatggaatgatcctcgttatgttctgtcgaanaanaannannnangngnnnnnnaaannnnnnntnnnnnnaactnnnnnnnannattnnggaaaaaaannnnnnanaaaattttttgtgggctttagataatatataaaag

SEQ ID NO: 5107 - DNA, 716 bp, Aspergillus oryzae
  misc_feature (1)...(716): n = A,T,C or G
ggacttgattgcatcgaatactcaacgaggtccgttctcccctcataatcataaaccaagatagtcacaatgggatccatcttttccacatccccctccgtggtcaaagctgacagcaccccctacttcacccccgccaacaatgcaggtgccgctgtcaaccccgacgaccctaacactcccaccctcttcaaacccttgcgcatccgcgatgtgacccttaagaaccgcattatcgtgtcccccatgtgcatgtactccgccgaatcggaccccacctcccccttcgtcggcgccctgaccgactaccacatcgcacatctgggccaattcgcgctcaaaggcgccggcttggtcttcgtcgaggcacaggccgtccagcccaatggacgtatctcgccccacgacgtcggtctctggcaagatggaaccgactcggaacagttcaaaggtcttcaacgcgtcgtccaattctcccatagccaaagtgccaaggtggccgttcagctggcccacgccggtcggaaagctagtgtcttacccccctgggtagcaccgcaagccgggaaacatagtcttgggctgaggagagcgtcttcgataggccaaggagtgggcggtccaattggcggggagaaaatatctgggaccccgcggaggggacatattgggctncttcgaaattgagcacagccggaaatcaaggaggtgggcct

SEQ ID NO: 5108 - DNA, 681 bp, Aspergillus oryzae
cgacaaccccgaccacttcgacaacaaattcctccaccgacctcccggagtctgtcgaccgaagccttcgccatggccgatatcgatatcaagatcgctcaatggaagctcgttgagattggccgtgtggtgctgatccgccgcggcccctacaccggcaagctggccaccatcgtggagattgtcgaccacagacgtgttctggttgacggtccttccactgaggagaacaagatcgtcccccgtcacgttcttcctctcgcccacgccaccctcacccacttcgtcattccccagcttccccgtgctgccggtaccggccccgtcaagaagctctggcagaagagcgagatcgacagcaagtgggctcagtccagcttcgcccagaagaccgagcgtgctgagcgtcggaagaacctcaacgacttcgagcgtttcaaggtcctgcgcctccggaagcaggctcgcttcgaggtccagaaggctcacgccaagctcagggcggctgctcctaagtcgtagatggtttacttcatgaggctcggtgcatagtgtgaagggagtgcctttgggacgggtttacattgctgagggtttatttgatttcagcaaaaaagacgctgtacacattatcattggcagcataaaatgattcgagaaccttgatatcctgaccaagag

SEQ ID NO: 5109 - DNA, 801 bp, Aspergillus oryzae
ttcctctcccaccccctcacctaattcatatctccgctagcttctttcacccgcaaatttccgtgggaatctattgagaataagctccctcttatctggttatcaacttcggagtttcttcatttccatatccacatagcaatcatgtcgctcgcatctggagtttccatcaccgatgaatgcatcaacacgttcaacgacttgcgcatgaaaaagggcgacaagcttaagttcatcatcttcaagatcgccgacaataagaaggaggttgtcgttgatgaagcctccaccgatcaggactatgataactttcgcaagaagcttgaagatgccaaggacagcaacggcaagcctgccccccgttacgcagtctacgatgtcgaatacgaacttggtggcaatgaaggcaagaggagcaagatagtcttcatttcctgggtgcctgatggtgccccaactctctggtctatgatctatgctagcactcgggagaatctgaagaacgcactgaacatctccaactccatccacgccgacgacaagtccgaaattgaatggaagactattctgaacgaagccagcggcggtaaggctggtaaataagtaacggtaccggctgggcccgggccaagtgagcttgtgtgtgctggttattacactgcgccgttctgttccagttcgcgaagtgtctcgcaacgaaccaattcaatgacattctcctgcacaaattttagttcaatatgagatcgttacgacttgtctgagggaaaattgaggaatttaaaaaaaacccccaaaaac

SEQ ID NO: 5110 - DNA, 552 bp, Aspergillus oryzae
  misc_feature (1)...(552): n = A,T,C or G
acagctcgtccgattcggccgaggctcatgtatgccctgatgcatcccggattcgtgccccagtcgtggcacatatttgtcagctttatcatctgtacatggctttgctgcgccatcgtccttttcatgaaccggtttctcccgcatatcggcaaccttggaatgttcttcatccttgcgggtgtgttcattacaatcattgtctgtgccgtcatgccccatgtgaacggtactggctacgcatcaaattcggatgtgtggcgtacttggcaaaacggtactggatattctagcgagggatttgtcttcgttgccggtatgctcaatggtgcttacagcgtgggcacgcctgactgttcgacccatcttgcagaggagatccccagaccgagtcggaacatccccaaggccgtcctcgcccagatgacggtcggttttattaccggcgtcctctacatggttgcagtgttctactcgattaccgatctagatgcagntatctcaagcgtctattgcttttcttttaccccgaatctatcatcacgcgacggg

SEQ ID NO: 5111 - DNA, 303 bp, Aspergillus oryzae
cacgtggaaaaaagtcacctcgtctgtcattggcattattacaggtcacccgacagatgacaactatgggttaatggagatcaagaattggacgaccggtgaggcctgctaccttgatttcaagccaagaggctggaaggcctcgtctgcctatcaggtagccggtaggattgtggacaagggcggatctccgaaatggagcattggtggccgttggaacgacaagatttttgctcgccatactcctggatatgaggtggacgtatccagtcaagatccggagtcgtccaagacgttattggt

SEQ ID NO: 5112 - DNA, 705 bp, Aspergillus oryzae
  misc_feature (1)...(705): n = A,T,C or G
catcgaagcacgaggccggcgcctgtgcaatgttgttgtagaatccagaccccagttttctaccaagaatcgatctagctggccatgagctagccttctgacggccattatggttgaaacgacactatttgacttgctcgtcaagcggtcggacctccttaaccctgagaatgaccctaacatagggtcttcccggggaaatgcctcctcaacgacttccgaggctatggaaaatcttggtgtcaaagattcaaacgtctccttccgcacttgtcaccacattagttcctgccttgataatcgcagtcttttggttcggtctgttcctgatctgtcgacgaactcaacttcggtggtacgcgcctaggacacatttacctaattggcataagcatgaacggagtcctcagctaccctcaggtttccttaattggtttgggcactttctcaagatatccgatgcgcacgtgcttcatttctcttacatggacggatatcttttacttcgatgcctgagagtgctgtgtgctacatgcttcacggggtgcttgattacttggcccatcttgctgtctattaatgcaactgggggtgcaggtaatactcagctggatgcattgagtttcagcaacgtgaaaaacccgaagcgctattatgctcataccgngatggcgaatggctttttcacgtncggattctacgtgg

SEQ ID NO: 5113 - DNA, 711 bp, Aspergillus oryzae
  misc_feature (1)...(711): n = A,T,C or G
ggatcagtctacgaatcagtcctcgacagcccaaacctccccgatccgaaaagcccttctacgcctcgaacaagaaggcgcattactgaccctcgcaggaacagagtcccccgcccaaacactcaatataatcttctaccatctcctcgccaacccctctctcctgaccaaacttcgcgaagaactagccaccttgccaacgctatcaacctggacacaactagagcagctcccatacctgtccgccattatcgaagaaggcaaccgactctccttcggcgttaccgcgcgcacagcccgaatccagcacacgcccatcacctacactccatccgcgtatgtaaccaccccagacccaacgcataaatcctacatcctcccggcacaccggtcagtattacgacattgagcgcccacacagccgaatcggtcttcccggatccatatgcgtttcttcccgagcgctggctgggggatgagggtcgcgagcgcaggaagttccagttgacgttttcgaggggcgggaggaagtgtctagggattgagcttgccagggcggagctgtatctggtgactgctgcgctngtgcggaaagtcgatttggttctgtgggagacggatgagaggggatgttcttttgagcatgattatcatngtgcgatgcccgaggattggtcnaggggggtgagggtcctggctaggatacgtggg

SEQ ID NO: 5114 - DNA, 1149 bp, Aspergillus oryzae
cattcttttggcaacgttcttagcttctctgcactcgggcactcgtttggtcttcccaattatacatagatcaccttaatcttaattcaacttaccagtctttcccgtcaagatgagattctccgctatcttcaccctgggtctcgccggcaccgccctggccacccccctcgttgagcgtgctggttcctcccccaccgacatcatctccggcatcagcgacaagaccgatgctctcgactccgccatcaaggcttacaacggtggtgacccctccaaggttgagtccgcctccgctgacttgatctcgaccatcaccaagggcactgatgccatcaagagcggtgatgatatcagcaccaccgatgctcttgctctgcctgagcccgtccaggctttgaccaagaaggtcgagcaggctatcgatgacattatcgccaagaaggacaagttcgtcgaggctggcgctggcggcaaggtcaaggactccctgaaccagcagaagtccgctgccgatggtctcgcctctgccatcacctccaaggtccctgagtctctcaaggagattgcccagagcctctccgctggtatcagcaccgctatccagaagggtgtcgatgcgtacaaggacgtttccgactccgtcccctcttccagcgctggctcctccgcgagcgccactgccaccggcagcgcttctgagaccggcagcgcctctactaccggttctgcctccgccacctccagctccgtgatccccacctcctccggtgctgccagctcctctgctgccccctccggctccagcacccccactggctccggctctgcctccgccacctctcctcccttggccaccggtgctgccaacaaggccaccatcggctactcccttggtgccgtcgccatggccgccattgccgtcgctgtctaagcgatgaacctccatgggatgatcccatcgtcctgctacgacctttgacgatggtgacgaagacaagcgccatgaccgattggaacgattaggaacacaatgggcttgttctgtatattttattctgtcttaccgaattaatgtaacgggcactgcctgtatataccgcgtttgaaatttgctatagtctagtaatggattatatttgccaattg

SEQ ID NO: 5115 - DNA, 676 bp, Aspergillus oryzae
  misc_feature (1)...(676): n = A,T,C or G
cgtccagcccagcggtttattcaagtccagttccatgggcaatcagatcctgtcacacctcatcaagccagagaacgccaaccgacccgtccacttctttgcctcctcaggcgggaacgcaggcctagccgctgtctgcgcagcccgcagtctgggatatccctgcacagtggtcgtaccactatcaacgaagcccctgatggtgcagaagctacggatggcaggtgcagcggacgtaatccagcatggagacacgttccaagcagccggcgagtacatgcgagaagtgatcatgaagaacaaggacgagaacgagtgtgaaaacgtggcgaagattgctctacacccgtttgataacgagcccatctgggaaggaaacagcactctcattgacgaactggccacccagctccttcccccanccggagagaatagaaaggccacccatcgtggccgcccgttaccgcgggatgccatatatggcagggtgggcggnggcgctctcctgaacggtctatttatgggcttagaacgacaccgccagctccagaagatgagccctaattatgctccacaccatatctcccactcccaaggagccccttatccaccttctcgctataaaaactttgggaccggattcctgttgtgccggtggcgaagagaaaacccttcn

SEQ ID NO: 5116 - DNA, 1077 bp, Aspergillus oryzae
gcacatctgttctcttgccgctgacttactgaatcggcccctcctcgaaaatccctcatacacccgtcccccttccaccccatcctttcctgcaatttgacggaccaaccaagtccaaagtgggatccggtctctctcacgcacccacccattgcaattctagacaattcccctcatcggttcccctctcttgtcttactatcttttcccctctctatattataaccgaggaaataaatcaacaaataaaaaccacaaaaaaataaaaaaaaaacaaaaaactttgtcccagccaagcatgtccgaacgaggatctttccgtggaggtcgtggccgcggcggaggccatgacaggtctggcggccgtggcggtcatgccaaaagtggcggtgccagtggcggtgcacagcagcaggagaagcccaaaaaggaaaacatcctcgacctcagcaagtatatggataaggaagttcgggtgaagttcaatggtggcagagaagtcgtcggcacgctgaagggatttgaccaactgatgaacctggttctcgatgatgtcaaggaatctatgcgcgatgacgagggcaacgagaatactcgttctcttggtttgatcgttgctcgtggtactatcattgtactcatctctcctgccgatggcagtgaagagattgccaaccccttcgtgcaagcggaggagtaagcgaactctcatacgacggccagcattggccattcttgactaccagtcttgcatctggtctttgaggatttcaagacgagttccctactctcatgcgataccaatcacagcaattgcggaatttactctattgacatttgcatgtttggactggtgtcagtctacttatttaaccatcccctctatttcccaacttgctagctccccacatggcgagtctttatctatttccgctaaggccgatgctggtgaatccacttgaactatgaggtcgagtagtatctccgcctttggttgttcataatatgaagcgtgtgaaagcgaatggtcggaagcgcagttaaacgcaaaattaaaataatgaatcacgagtcatg

SEQ ID NO: 5117 - DNA, 721 bp, Aspergillus oryzae
  misc_feature (1)...(721): n = A,T,C or G
cgaggccgtcgcacgtctcaaccacacacaccaccccccaattgcctttccctggaccccgggaaccgctcaacactacggttaaccaattgcactcgatcaagtgcattgttctttttttccccgccggtcccgtccgctcaaccgtctcgcgaccaccgttcctgcgaaaagtttcttttaacgtccgactacttcctaaccgtttcctatcacaatgactacccctcaattctggtcgacgcctctccgctaccttcgctgggcctctcatgaaaagcccgctatcttctactcgcttgtcgttggtgccatgggccccgtcatgctggtgactcttcccccgatcagacgggccttcggcgacgttgacccggaacccattcccctcacatatcccattccccagggaccccgggttatcccgcagggctacgatgacgagtaaatccgcctgagactgtgaatggagtccgtgtcgattttcagatttgatttttgcttggtgtatttagctgggaactcgagtcaattcaaaagactacctacctactctgtcggacatctccgattacaccgcctatcgcctgangctgggcaagagattgtgtgttgttccggattgatatccggataaatggcttctggattgctcgaggcgctctcttaacattgccccctcaatcgtctctataccctcagggcctacgggctttggggt

SEQ ID NO: 5118 - DNA, 647 bp, Aspergillus oryzae
tctacctctccaaccgtgctgctgcctattccgcctccggtcaacacgagaaggccgccgaggatgccgagctcgccactgccgtcgaccccaagtattccaaggcatggagccgtctgggtcttgctcgctttgacttggctgatttccacggcgctaaggaggcctatgagaagggcatcgaagctgaaggtaatggcggcagcgaggccatgaagagaggtttggagacctccaagaggaagatcgcggaatctactcgtggtgccgaacctcctgctgatgctgttgatgatgccgctggcgcaagccgtggtgctggcggcatgccagacctctcttccctcgccggcttgatgggtggtggccgcggtggcggtggcggcatgcccgaccttagctccctcatgaataaccctatgttctccagcatggctcagaacctgatgagcaacccggacatgctcaacaacctcatgagcaaccctcagttgagacagatggcagataacttcggccgtggtggtggtatgccggatatgtcgagcctgatgagcgaccctaacatcgctgacatggctcggaatctaatgggtggtggtggccccccgtggtgccggtggtgccggacgttgtcaataaataat

SEQ ID NO: 5119 - DNA, 690 bp, Aspergillus oryzae
gcatgaccgttggcttcacctgagctgccacagcgactcccctttgctccagtcactcactctcacatcttgcactgttcctatcatgactggcaacctcgctaccgtgcgcttacaccgaaatcgcgtcttatccccttgactgtgcccttcatctcctatctccgcgcagacggtattgtcttgccacccgaaaatgcgacccccacagacgacgacaacctagacacgtattccgatgacgaggccgacgaacagccagacccatcgaccgaatgggaagaaattcacacccagatcaagacaacaatctccgagcttggaggtatcataaccccgaagttgaattggagtgcccccaaagatgcaacctgtatggctgcgacaaacgatatgcaatgccgaacaccaaacgacatctacctcctcttgaagagcagtgactttattagccattgccctggaggcttccttcaatgaatgtgccccgaatatcccggattaacaaccccccccgagtttcataccattttggtgcgttggaaataccttaactttaacccctcctttgagtttcggcgtttgtgcgcaaacactttctttttcttttattgtagggggacacaaaccacttttttttcttttcttttggcgaaacccttaatcttgaataaccttttttaaagaaaa

SEQ ID NO: 5120 - DNA, 641 bp, Aspergillus oryzae
gtaatctatcgttgtcattcccattataccaagatgctgaatgtgacatcaccatgggcattaattctttcccttttgactgcgattgttagtatttcctattataataacaacccatctgctcccgagattaggtcgcctcattgcgcaagctggaacgcctggtacaacccactccgatcaggccaagtcggatatcaagccaacgattggaacatcctctaccacctgggtggcaatggaccatggatagagaagattgacgagcttgaaacgccgggccttgaacccccaaagggttgcgtcattgatcaagtacatatgatctctcgtcatggggaacgatatccgaccaaatctgctgggagtcgtcacctcgcacttctaaatcgaataaaggaagcaaatgtacttcttaatggctcactatcattcttgaacaattggacatattttaccgatgaaccacagaaagatttcgaccagctaaccaagactagtccgtatgctggcacactgcaggctttctcaacgggcgtacgcttcttaacgcgatacggacacttattaccacttcatgggacgacaagattatgggcaagctagtgtaaccgcgtgaaagaaacagcccagcattttgc

SEQ ID NO: 5121 - DNA, 696 bp, Aspergillus oryzae
gtctcccccgctaccaccaggtttcgtcttttttatttcccaccaaaaccacaatcaatcaaagtactatccgtactccaacagaaatccttcaccatgtcttctgcgaaagtttacgtcggaaacctttcctggaacaccaatgatgagtctctccgtcagactttctcggagtttggcaacgttttggacgctatcgtcatgaaagaccgcgagaccggccgcagcaggggatttggcttcgtcaccttttccgctcaaacggaagctgatgctgccattggaggactcaacgagcaggagctcgatggtcgccgtattagggtcaacttggccaacgctagacccgccggcggatcccgtaactacggtggtggcaatggctacggcggtggctacggtggtggctacagccagggtggctaccagggtggtggctaccagggtggtaactacggccagggcgactactaaacgcagtctcctatatacgtcgaatacctagttggatgcagtcacgacttgatatgattactgtggcggatgacaatcaccgaccgagcataattgttgaagggaatgaatgatggaaagttgtgtgtcttgacatgaatgggctcagatatccgaagccacattatggctgatgccggaaacccgctatgacaataccaataactagtttcacgtcgcgat

SEQ ID NO: 5122 - DNA, 746 bp, Aspergillus oryzae
  misc_feature (1)...(746): n = A,T,C or G
cggcgatcgacgaggccttgacgagctgtactccagatttcaaccaagatgagccaacccgatatcactttgtacacctgccagactcccaatggaatcaagatctacattgcgctagaagagctgggacttccctatacggtagagaagattgatataagcaagaacacccagaaagagccgaatgtgaccttctagccagaacatggaacaggagcattgataattccgcttagctggatccttgagatcaaccccaatggccgaattcctgctctgaccgacacgtactctgatgggcaaaagattcgtctgtgcgaatctggcggcatcctcacctaccttgccgagcaatatgacaaggactacaagatctgttaccctaagggtactcgcgagtactacgaaatgacaaataggttgtacttccagaacgccggtgtcagccccatgcaaggtcaggcaaaccacttcatgcgctatgcacccgagcgcattgaatacggcatgactcgttacaccaatgagacgaggcggctgtacggtgttctcgataagcaccttgccagctccaagtcaggttacctcgtcggtgaccacatctcgcttgcggatatttcgcactggggatgggttgcggctgctgggtgggcaggtgtcgatatcgaagagttcccgcacttgaaggcatgggaggagcgtatggccgntcgcgatggcgtcgagaaagggtcgcatgttccgtc

SEQ ID NO: 5123 - DNA, 685 bp, Aspergillus oryzae
  misc_feature (1)...(685): n = A,T,C or G
cctaatactccccgcttccttctccagatgtctccctgctctggtgtcttccgcaatcccgccctcccaattcgctcccgtgtagccttctctctcaatcaagccgcaagatcatcatcccgaccccaccacctccggcaagaacaacaccaccgcccctattcctcctcctcttctcccaactcctcgcaatacaaccgctcccaattcaaaatttttccattcttagcaatcattggtattggctctggatcctacgtcttccttgtcaagtcccgtaccggcattcacaaaccgaaacccgactctcaatcttctgattcttaaattacactaccccccctaaagatttgtctactctccgactagagaaacatggccgacactcaacatcccacccctcgtttctcgccctccgaagtcacagttgttttccttcttggtggtcccggaagtggcaagggtactcaatctgccaatctcgtccgcgactacggctttgtccatctgtcggcgggtgatctactgcgcgccgagcagatccgcgagggaagccagtatggtgaactgatcaagacttatatccgggagggcaagatcgttccgatggagattacggtggcactgttgtcgaatgccatggcagatgccttaaagaatgtgctagtgccggngaggggcagaa

SEQ ID NO: 5124 - DNA, 679 bp, Aspergillus oryzae
  misc_feature (1)...(679): n = A,T,C or G
ggtacacgtctgaacacctttggacgccggccactgggacccaaagacacagctgccaggttcattcgagagtttgaggaggaatatggtaccaacacgctgcctttcttggaaaatggatacaatatggccctagaaaaagcgcaccgggacctcaaatttcttctcgtggttctcctggctcctgaacatgatgacacgaacggttgggtccgggataccctcttgttccgggaggtcatagactttgtcaatgacccgcagaacaacatcattgtttggggaggcaatgtgcaggattcggaggcatatcaggttgccaactctcttcgatgcaccaagttccccttcgcagctgccattgttcacactcccaatgtatcatcgacggccatgtccgtcgtctctagaatatccggaactacttcaccatcagaatttattgagaaactncgaaccgccatctcacagcacaaggagcctctagagaggatcggggccactcgggccgagcagcaggccttccgcagtctacgggaacaagcaagactnncgctacgaacgttcattaagcatttgaccgagaacgagcgagaccaagacgggaagccgaagctgctttacaacgggaggaacaaaangcttgttgaccgccaggccgcggaggagaaaccgcttt

SEQ ID NO: 5125 - DNA, 549 bp, Aspergillus oryzae
  misc_feature (1)...(549): n = A,T,C or G
cgagggatagactgagcaagagaagacatggagaatagttccgcatcagaaggcaaggatccatcagtcttcctgagtgagattatcggtgccccagtcactgtgaagttgaactcaggcgttgtctacaaaggtgaactccaatcagtagatggttatatgaacattgctctagaaaagtctgaggaatatgtgaatgggaagttaaggcgaagctatggagatgcctttgtccgaggaaataatgtgctttacatctctgcaaactgaggttccgacaggcgatttcattggttagcccctcatcatgtccgcgaaaccaagctacaaaatgtcccatcaaggcatattaggggtgagggaaggagggagattgctggtacctcattaacagcaagctggctggtgaaaagagaaaaacctgagtaaccaattgtctttcctatactcacgtctagtgcctcccatccacatttgatcatctntcagctccagtcatagggagccctactttagtacccctgtattgattgcccctcaacaacctan

SEQ ID NO: 5126 - DNA, 693 bp, Aspergillus oryzae
gtgaatttcaatatagactgaacgacaatttatacaacagacacaatggtcggaagattagctggtaaaaatgccatcgttaccggtgctgctggaggcatcggtctcgagactacaatcctcatgctccgcgaaggtgcctccgtcctcatgaccgatatcagcgagccgggtctccaaaaggcccttgcgaaagccaacgacgtggttcctcagcgcgacggcaaggtcgagtaccgcgtggtcgacgtatccaaggaatccgaagtcgaggcggcagtggcccatctagacgcctggggcggcctggacgtcatgttcaacaatgccggaatcatgcaccccaaggatggagactcagaggagacacctgaggcgatctgggatatgacgatgaacatcaatgtcaagggcgtgtggtacggaagcaagcatgcagtgaagagcctccggaagcacggcaagaaaaagggtagcatcattaacacggcaagcatggttgcgcttgtgggcgctgccacccctcaattggcgtatactgctaacaagggtgccgtgtttgccatgactagagagttggctattgtgcacgcccgggagggctttcggtttaactccttgtgtcctggctctctcaacacaccacttttgcaagactggcttgggtgatgaataagagaaacgttttccgtt

SEQ ID NO: 5127 - DNA, 687 bp, Aspergillus oryzae
  misc_feature (1)...(687): n = A,T,C or G
cctcttttcgtcctccgcatttatattggcccgatcttcgatagctgcttgatccatagctttgtgaaatctaatcgaaacccaacatatttcaaatctcgtctttagaaccttaggatgccatgcgtcgtgttgtcgagacgggtttaggagctgttactcctttgggagtaggtatccgtccaacatgaaaacgtctgttaaatggccactgcggtattgttaatgtcaaccatcgcgattccaggtttgcggacataccatgtaaaatcgccgccccagtgccaaatggcaaaaggcaagaaggtggctggactgcctcagagtggctaantgaggatgaaaagcgtaagatggcgcgtttcaaacaatatgctttggctgcttcaaaaaacctctagaaaatgctggttggaagcccacttcgtttgagcacagagaatccacgggcatctgtcttggatccggaattggcaatttcgatgaaatatacgacaccgtcgtgcatatgaaaaaggaggttacagaaaggtgtctccttatttgtcccaaaactcttaataatctcggcgctggccatatctccatgaaatatgaatgatgggtccaaacattgcagttaaaaccgtatgcactactggggcacaattcattgtgatgctgctcgctttaaccatgtgagatgca

SEQ ID NO: 5128 - DNA, 746 bp, Aspergillus oryzae
cggactctttcccctctttcttcatcccacacaacaaataaccacttctatatccttcatctactttgacaccctttcgcggatcaccaccttccttgcctcacctacttccgttttctgaccgttctcccgtcgcttctccgtccattattcaccatgagtgggcactctgctgtttggcaaggatatgtcgattccagcttgatgggatctggcctatttgacaaggctgccgttctgagctacaacctttccggcatcgaggctaaatcttccggcttctcgatcagcgctgaagagctccaaggcctcgctgccgccttcgctcaaagtaacgtggcgatggccaatggtatcaaggtcggcggagagaagttcgtcgctatcaaggccgacgaccgcagtctatacggaaagaagggcaaggaggggattatcgttgtgaagaccccgtcctgcgtcctggttgcccaccacggcgagaatgtccagaccaccaacgcctcagccgctgtcgagaaaatcgctgactacatcatcaaccctcaccagtagacggcggtgtggaaatgcaatgaatgtgtcttcttaacttgcggaaaaggaccgtgtctgctttgaatcgatttactggcggggcctcttcatttctactattactccctaccccttttattcctgttatatgttcgccgttcgatattgagcatccgtcgtagatatgtgccataggtcctgatctaata

SEQ ID NO: 5129 - DNA, 605 bp, Aspergillus oryzae
cgaggtcgttaaagacggagagatcatttatgccggcgtgaccaactcggctacccataccgaggcagcccaagataaagatagcgactggcccgagccgaaatctatcaagtgggtttgggatggcaagtcgaaagatgataagactgttcatgcggagctcgatggcgcgcttggcagaagattggaccgtattgacgtcatggcggaggtgccaggcttcatcaagaccatcgccggtagtgtggctggcacacggccgtacatcttccagttcgccccccaagagaagcttacactgaagttgaaggtcggagatgaataagtctccgagcagggtgtcatgttctccgaatcgacgttcatctcgtgaatgacgctaagtacatagatcattgctttccaggacctgtccatggcgttttatgagtgttaatcgtggatttccctattgttgctgctgatatgcagctgaaaacccaactcctaatgtttcgcaaacatcatataagaatcttgaatgatctacataaatctgtatctccctatcaatgtcacatatgcagcgagcacctgaaagtcaaacctccgttccatgtggtccg

SEQ ID NO: 5130 - DNA, 694 bp, Aspergillus oryzae
  misc_feature (1)...(694): n = A,T,C or G
ggcacgggagttgccaagtcatgggtgatacacgcgggtgatacggtgcttgttggccctgattcacttggacaattcactacaaccacgattaagtccatcgaacggaaacggatatctgtcaatgcctgctttgcaggacagtctggatcgttcgcgttgaagcgtgtacgaaggaaagaggttcgaaagggtatggttgttctcaagaagttggaccagccctcccaagttttacccggagttcgttgcggaaggtctcattctctctcatgctactactatcaaacccccggtcccaaccaatgtgcatgttggggcctgaattcaacgtgttctggctttgacattgaccgtcccttcattaaaacggttgatcgtgccctggtggcttttcggttcttgccacgcccaaagttttttgcgcccggagacccaatacttttcctgaaaggaaaaacaaaggactgggtgttgggaaaaaggtttgattccatcctaacaaccctttgaaccaaaacctatggagggaacaccatttaaaaattgctacccgggtggccaaccaataataggttttgttgaaacttagagtttgtttgaatggaagaacaacgtaccacccacaatgggaaaggcttgccctggntttttttaccttttttttcccttttttttatcccccttgcctccc

SEQ ID NO: 5131 - DNA, 697 bp, Aspergillus oryzae
  misc_feature (1)...(697): n = A,T,C or G
ggagtacggctcgtccgattcgcacgaggccatactggctccaatcgcaaggctactgcacctacgcgcaaacctacggcgcatacgacggcttcccgctcctcggcggcctgcgcccgatcagcgaatcctccagcgaaatcgccgcctacatccgcgacgtggccgacaaaaccggtgccaagaaagtcgatctggtgggccattccgagggcgcgttccaatcgctctacgttcccaaattccagggggtctcaggcctcctcgataagattgtggcgatcgcgcccccgacgcacgggactaatttcggtggtctgtataatctggcttatcttttcggaaatgtttcccgggaggttgttggggacgtgttgagtacgtttgggtgtccggcgtgtgatgagttgggtcccgatggggctgccgtgaagcgattgaatgatggtcagcctatcctgcagtcggggaataatctgacggtgattgtctcgaaatacgatgagatggttacgccgcatgagacgtcgtgggtggagggcgccaataatatctacgtgcaggacttctgtccccttgaccccgtcggacatattggggaggcgtatgatttgaatgtctggaacctggtcaagaatgctctcgatggcacgccggacaggaagttcatctgtgtgaatgggtcgncaggaaagat

SEQ ID NO: 5132 - DNA, 973 bp, Aspergillus oryzae
ctcgataacacatctgcttgaccgattacaaggcaaagacaccagctaccacgatgcaaataagcccgactttttagacaggttcatcgacgccaaagacaaataccccgacattgttgatgacagccagattatctcgtacctcatgatcaacatgattgctggtgcagatacaacagccatcacgctaaatgcagccatttatttcgctttgaaggaccgtcgggtgtgggcgcgtttgcaaaaggagattcgtgcctgtcaatcgagcctagacgccgcaccgtcggccgtaccatacaatattgcaagcgcacttccgtacctcaacgcggtggtccgtgaggcaatgcggatgcatcccggtgttgctatgacgttggaacggtatgtgccacccggagggctcaccctaccaaatggccagtacatccctcaggggagtattgtcggtatgaatccgtatgtcattgctcggaatcggtctgtttggggcgaggattcggacgtgtttcgccctgagaggtggctgcgtgatgattcccaggaaagtgaagaggaattccaggcacgcttacggttgatgaataattccgaccttgcgtttggtgctgggagccgcatttgcattggaagaaacttaggtctactcgaggtatacaaggtgatggctacactgatctcacgttacgatatcgagttggctcacccacaccgcgactggaagacgcataacagcttctttgttcggcaagagggtatcaatgttaaactctcccgtcgctcctgagggtgtgttgctctcgttattggtccaagatgtctcctagtccgtgtcatttctcaggtgttggcagagtttccatataacttaattttttgttatttcccatggccatctgggacgattggtggaccacgcgtcgtttattgcttgctacgtctggtgtttactacctactatatccttatt

SEQ ID NO: 5133 - DNA, 687 bp, Aspergillus oryzae
gggctcccttcatcgagctctgcgcccagcgtaacatccccctcatcttcctccagaacatctccggcttcatggtcggcgccgacgccgagaatggcggcatcgccaaaaacggcgcgaagctagtgaccgcaatagcctgcgccgacgtacccaagttcaccgttgtctttggctccagcgccggtgccggcaactaccgtatgtgggggcgggcctacttcccaaggctaatggccatgtggtccaacgccgaaatcacgaggaggggcttctagcaactcttctcgcgaatgggaagcgtcgtgacgctcccagacgcacgcctgaaagcttcgatgtatcacgaagacaagggaagattgtcgacccgccgcgtctgggcgaagaggggcgtcttcgcggcgcgatcaggcgatgttgttacgaggtgatttggcgacatgaaggtgaggacgagacgacgagtagtgctgacactatgtcggtggtgatgatgaggtcttgtcggcgatggagaatgcggcgtgaaccgtgacgattgttatggtcgtggatgtttcggacgacgattagttcgatagtggttgaggaagtcatcgcggggcaggtgatcgcgacgtagaggagatgatcatgatggaggcggatgaggatgtagatcgatgtcgacggcggaggatgacc

SEQ ID NO: 5134 - DNA, 654 bp, Aspergillus oryzae
caactccgtagaaacaacctcagaaatcttgtgtttgaccgtatccccaaactttccccgcaccatctccatcttggaaggcgaagaaacgaccgtacacggaagtcggctttttttgatcttcctcgcatcatatttataatcaggcaggggatattagctcggaccatggacaggcttcttcgtccagtatcacggcaattgctcagatccagaccccgttatccatttacaatcccaccaccagtttacgctaagagactatacagtatgggccatacggtgccgccgctgaaagatcaatctctcttcattgagaaggcatatgtcaatggggaatgggtatgtgcccagtcaggggaaacatttgaagttcacgatcctgcttcaggaaagctcattggaacatgccctgagttcaatgctgccgacaccgaaaaggccattcaggctgccacagaggctttccctaaattccgcacaacattggcccgcgagcgtgctcggatgctgccccggtggtaccagttgatgattgacaatgctgaggactttggaacattgatcacttgggagaacggtaagccgctcgcggacgccaagagttgacgtgaactatgccgccgcctttctttgaatggttcattgaggatg

SEQ ID NO: 5135 - DNA, 676 bp, Aspergillus oryzae
taatgttcggatttatggccttggtataggaacgctggatggcaacggagacacctggtatcaatggataaaagaacagcccaatacctccaactatcccggtcgaccacacgctatcacattcaacggtctcacaaattcagtggttcggggtctcaggttcttacgcagccagatgtggacaatgtctatcatatatagtcatcatgttgaattcgacagcatactcgtgaacaacactggaaatgttgtctcgagctcaaacacggatggagcagataccatacgatcctcccatatcacattcaacaactggactgtgtacaatggcgatgatagtatctcactcaagggcaacagcacggacatcaccatcacaaactccaatctctacaatggtttgggaattgcattgggtagcatcggacagtacaaggatcagttcgaaaccatcgagaggctcaaagtgagcaatgtcaactttcacagtacccttcatgcgatatatgtcaaaacatggacggctgatcagaacggctatccacctaatggtggcggaggtggcctcggatacatctccgatgttacggcccaaagacctaaagctacgtctcttcgtggggcgtgcgtttgctatctcgcagtgtactcgtttcagcggtgcccctggggaagg

SEQ ID NO: 5136 - DNA, 647 bp, Aspergillus oryzae
cgatcatcgttgtttttgctttgaaacgacgtgtcgagccacgtttcggtgaccgatctgctatttcaacagcaaagctccccgagactgacttgattcactttgacaagatgtcagttatactccgaagactcgtccacaatgaggcgatgcgagaggaccccaaggagatttatggatggagggtgtacatgctcgcgtgttcggcctgctttggcggcatgcttttcggaatggagaccggtatcataggaggtgtccttacgatggatcctttccaagtgaaatatgggttaaagaaccttggcgatataggagaggccaatctctccgctaatattgtatccacattacaggcagggtgcttctttggcgccctcatcgcctccccagtagcagacaaatggggtcgaaagaccgggttgatatccgcatcggtaattgctatcgttggcgttatcatgcaagtggcagcaagcgggcacctggaagctatgtacatcggacgtttaatcaacgggttcggtggcggcttcgcttcgatgatcaatcctctctatggctctgaaaacgcccaagagccctccggggtggcttacaggcctttaccaatgttcataaccatgggaattattgctcccttctgg

SEQ ID NO: 5137 - DNA, 673 bp, Aspergillus oryzae
cacattgatcctcttgcattcctctagtggtcgagacgggtctcttcctctatacttcattttcctccttgttgttttccccttcctcggaatcggccctactgatttacctctccactccgcaactggtccgggtttcttcggtattatcttttcgaccttcacaacagtgacgcctcacccaccaccgcgcgccctttcctcttccctttcctcctaaccctttcccctcctctttgcggctccggctgcgtctggagctacaacagctcgatggcggtctccgaacaaatccccgggcaggagttagaatatgactacgaagccctcccgtctaactacggcctcggccgcaatatgctggctggtgcctttgcagggatagcggaacacgctgtcatgtatccggtggacttgttgaagactcgcatgcaaatcctgcatcctgcgaatggcggactctacacaggtctcactaatgcgttttccacaatctaccgaattgagggctggcggacattatggaagggtgtctcgagcgttattgtcggtgcaggccccgcccacgctgtctactttggcacatacgaaattgtaaaggatcttgccggtggcaatgtcgatgacggtcaccatccgctagctgcagctctgagtggtgcctcggcgacca

SEQ ID NO: 5138 - DNA, 676 bp, Aspergillus oryzae
ccattactctgtcatagataatttacaatggccgcccaaagacagaacgtttccagcgacctggtctggcagctcacccgcaaccagaatgcttttctggtcaagcgtaacagcggcggcggctctcagttctcccgtgaccctttgaacctgcagaacaagcactctttcaagtacgctggatacgccaacaccaaggctattggtgtgcagcccactgagaacggtggcgttgttgttcttaccaagaagtccggcaatgcccagcagcccggaaagaacgccgttcgcgtgacttttggccccaaggcctccacccgcaagatttacaagggtgttgcagacaagaccgcaaagaacggctaccgtgctgacctccgtgaggacgctgttgcacgtgtgagcgccattcgccgttctcagaagcctaagaaggatactcctccccagaagcctagaggtgctcaggcccggaaggccgctgagcaggagtcggcataaaggataggactcgatgacgagtagtcgcaagggttgggcgcatcaagcatagtggcgccatgctggtcaagggcggaagcgtccatgtaatttagcaatactgctaccggggcaaatgtgcaccatgccgttcaaaaagagattcaaagaaaaaaaaaaaaaaaaaaaaattcct

SEQ ID NO: 5139 - DNA, 686 bp, Aspergillus oryzae
  misc_feature (1)...(686): n = A,T,C or G
ctctgttcatattaattattatagccaccgtctagtcggccgctatctagaagtacatacgctcaatctcagttgcatacagttagaacaggaacaaaatgggcttcaacactgcactgacaaggaagctgggcatcacagtccctgtcgtccagggtggtatgcaatgggttggatacgctgaactcgccgcagcggtcagcaacgctggaggccttggaatcctcactgccctcacccaacccacccccgaagacctccgcaaagagatccggaaatgtcgctcaatgaccaagaagcccttcggtgtcaacctgactctcctccccgcccttgtgcccccagactacgctgcctacgcccaggttatcatcgatgagggtgtcaagattgtcgagacggccggaaacaaccccggtccggtgattacccagctgaagaaagccaacaccactatcctgcacaagtgcacgacaatccgtcacgctaaatctgccgtcaagctgggtgttgacttcctgtccatcgacggtttcgagtgtgctggccacgtcggcgaacatgacatcaccaacttcattctnctcaaccgcgcccgtcaggatctgggcgtncccttcattgcatcgggcggatttgcagacggatacngnnctgccgcngncctgtaactgggcgccgaaaga

SEQ ID NO: 5140 - DNA, 664 bp, Aspergillus oryzae
ggataaatgctctcgtgggatcagcatcatgcagggttccgtccggacggctacaatatctgggtcttactgacattcagctggtcattgaggcaacatatctttgacgatgcagagccctttacgctacgaatttacccaaatcctgtacaactcatcgacgtgttagccacatgacttctccctgcgagcctcttacaagccactctggggcatttatcgccatgagatcgatctgatgatcacggtccattactagctccaagacgccgtcattactgaccgaatccatgcacgtttgatgcagaccctgtgcaatagcgtcaacttgagtaacactgaagtcaatgacactggaggtcccaccatgaagagaatcgtcgtgtgtctcggcattcgcttggatccagccctgcgactataaggcactgcatctatgggcaccactcgtgatttatccatatgggctgatgaacaagggtcttgacggtctggatactgttgctcatctgttaattccaacagtcattcttagtatccgcaagcaacagttcctcggctttattggagctatgtccctattctctcaagcctcataatggatttctggcactaagcatactaatacatgatgatttgaccccaacgttgggtcttgataaat

SEQ ID NO: 5141 - DNA, 523 bp, Aspergillus oryzae
cgttagcgaaaattgtcgaggagaacgaggtcggtcgtagtgcctgggtcaagaacttcagcagtgtcttggccatctgcgtgattggaatgggtggatggactatcgcatggcaatctggtgtttggcagccggcacctcaggaggatgccgggggtgccgagatagccgttggagcccaggtggttgggtatttcagcgcgatctgctatctgggtgcacgcctgccgcagatctataaaaactggaaggacaaatcttgtgagggactctcacttttgttctttatcctctccctcctgggaaatttgacttatggcgctggtatcctttgtcattcaacggagaagaactacattgttacaaacataccttggctgctgggatcgctgggcacgatggtcgaggatatcacgatttttatacaatttcgactatatgcggttgcggactcgacagccgcagggccatgattggcaagggccagggtacaagtacgcttataattaaccccttgatcgcg

SEQ ID NO: 5142 - DNA, 685 bp, Aspergillus oryzae
  misc_feature (1)...(685): n = A,T,C or G
cgtctacctaatcactatgcttgcttcgcgagctgcagctcgccattgctgcaggagaaccagggtaccagtattggttgctcccgtacgacgccttcatggccttgcgcaaagcaagtttctccaagtctcggaggaagttcgcgacgctgtagccacaggaaagcctgtggtagctctagagtccacaatctacactcacggatttccgtatcccgagagcgttgctcttgcgtcgttgctggaaacagtcgttcgggcaaatggcggagttcctgctacgattggaatcttgaatggagtggccaaggtgggcctcaatgctgaagagcttatcgagctggcctctaccgcagagagcaagagtgcactgaaggtttcccgcanggatttgggttacatatgcggtttgggcctggctgggaaacgactacacggtggtacaacagtttcgggcacgatgattcttgcccatctggctggtattaaggtcttcgggactggaggtcttggtggtgtccatcgcggtggagagagttctatggatatatctgccgacctcaccgaactggggcggacccccgttgctgntgtcaactcttgatgcaaaagcttnctcgacatcccacgaactctggaataccttgaaaccganagtgtttggggtgggacgtttgccgatggn

SEQ ID NO: 5143 - DNA, 683 bp, Aspergillus oryzae
  misc_feature (1)...(683): n = A,T,C or G
catttatccacaatctaccgatctattctgatactgtttgtcctttgtgattctcaagacctaatctacccgtcgcccttgttccgccctctcccattacgccccctgatactccccccccccgaccgcttacccgaacgtcaccccagcagccgaccaccaacaacatcatggaacattcctccgcacccaataatgccgccctgtacgatgcgcggagacgcagaggctcggtcggaacgtcgcaactattagacaacatcgtctccgcttccaacttcgacagagatgaggttgagcgactccgcaagcgattcatgaaactggataaggacagctcgggtacaattgatcgcgatgaattcctttcccttccgcaagtgtcatccaacccgctggcaacgaggtacgcatgggattatttaaatggccaaataaaatgaccggtctgactcacttatttcgaacattaaagaatgatcgcaatcttcgatgaagatggtggcggtgacgtcgacttccaagaattcgtttcaggtctctcggccttctcgtctaagggtaacaaggaagaaaagcttcgcttcgcattcaaggtctacgatatcgatcgcgacggttacatctctaacggagaactgttcatcgtattaaagatgatgggtggcnacaacctgaaagan

SEQ ID NO: 5144 - DNA, 174 bp, Aspergillus oryzae
ggaagaattggccctaagaccaactcggtggagaagatcaacgctctccgcagatccggtctcaatgttgttcgtatgaacttctcccacggttcgtatgagtaccaccagtccgttatcgacaacgcccgtgaggccgccagagtccagaccggacgtcccctcgccattgct

SEQ ID NO: 5145 - DNA, 1338 bp, Aspergillus oryzae
tgccaccatactacgcgatcattccgagttcgatatcgcctggattggctccctattgacgttcatgatatttttctttgcagcgcctgcgggcgtcctggtggaccgggttggtcccacaccgctgctcaccttcggcgccattgcaactatcctggcaaccttcatgatctcactatgtaaggagctgtatcagttcctactagcccaaggtatactgctaggcatcggcaacgccttcctgctttgtccggccatggctaccgtcacccgtctgtttgatcaccaccgcggcgccgccaacggaatcatgatcgccgggtcctccatcggcggtatcatctggcccatcatgctcgatcagctgctcaacaaggacggcgtcagctttggctggaccttccgcatcgtcggcttcgtggtgctgcccctatgtctcttcatggtcgcgaccatccgcccggctcccaagacactgcacgattcggacagggaggggatagagctgtcgcacggcgagtcagagagcgaccacaaggcgcaaggggcagaagggccggcggcgattatcaagaacccgaccttcctcatcctctgtgccggtctctcggtagccaccttcggcctcttcagccctctcttcttcatctccacctacgccaccgaccaaggtttgtccgtcagcttggccttttacctcgtgtccatgctcaacggcgcctccatggtcgggcgtgtctccacgggctttctggccgatcgctacgggaacttcaacctgtgcttcttgacgattgcctcctctgggttgattgccatgtgctggaccaaggccacgaacaccgtgggcatcatcttctttgccctagcctacggatacacgtccggggccatgttcagtctccaaaccccgtgtgccgcccagctctcgacgcccgagtcgaggggggctgccgtcggcattctctttgtcgcgccagcaattcccggattggtcggcacccccatcagcgggcgcctggctcaagcacggctatctggccctttcgatgtattcgggggcggcgttgttagctggggcagggttggtgctgatcgcacggctgcgccaaaacacaaagctaatggcaaaagtgtagttgttcttctgcagctggaagtgggcgttgcgtctacctttgctccgtctgtgggttgttctgcgtttctaatggtctgtcaatccttgcttttggatgcgatggcttgatcaggatctgttacgtgtgttattgtttgatgtgtctacaacaaatccctactttaggaatagagaaataatataatagctgatttgcc

SEQ ID NO: 5146 - DNA, 640 bp, Aspergillus oryzae
gtgtctttcttcatactagagggtgaagtagtcgccgtggaccaggaaacgggggaactccaagcctttcagattttgaccaaccgagccaaaaagaacgttgatataggaactatcaagattaatgtttgtctcttttcatttgacctgatgtacctgaacggaacccctttgttggatcgacctttccgcgaacgtagagaacttctacgaagcttattcgtggaaatcccgaaccggttcacatgggtaaagagttttgatgccacatctgccgattctgaggccgtcctggaatttttcaaaggtgcaactgataccaagtgcgaaggcatcatggtcaaggtgctcgacaatgtgtcgaagtcaaataacccggaaccatcagagaccccaaacaacgacatagacaaaccggatccaaaacccgcgaaaggaggccgccgaaaggccttactttccacatacgaaccagacaaaaggcttgaatcctggctcaaagtcaaaaaggattacagcacctcatccgagaccctcgacctgatccccgtcggaggctggcacggacaaggccggaaagccaaatgtggtcacccatcctgttagctgtacggaatcccgaaacggcaagctcaagccg

SEQ ID NO: 5147 - DNA, 701 bp, Aspergillus oryzae
cattcaaacacgttattgattctgtcgggtttctcgctgagcgaaagcctttataacttgctagtcatacaaattcttcttcttgaacacatatttgtctttctcccgtacaaacaattttaaccttctttcaccgtcgatatggacaagatcaaggagagaatgaacgccctccgcctggaggctgacgaggcccacgagaagaccgaggagttgaagaatagggtcaagacgctggaacaggagaacctggcgaaggaacaggagatcacatccctcaaccaccgcaaccagcttcttgagggtgaggtggaaaagttggaaaccgctctcaaggaggctaaggatgctgccactcagagcgctcagcacgacactcagaacgaaacccttcagagacgcttgcagctcttggaagaggagctcgaggctgccgacaagactaccagggagacagttgagaagctccgccaaaccgacgttaaagccggccattacgagcgcaaagtgcaggcccttgagtcgtctcgtgatgagtgggaaagcaagtatgaggaaatggcgaagaagtacgccgagttgcagaaggatctccacgacttggaagtttctataagcaatgtttaaggctagggttgcctgcagatgcaatattctgggaaaacctcggctcaaccttttttctaacataataacttttt

SEQ ID NO: 5148 - DNA, 304 bp, Aspergillus oryzae
gctcccaagtgcggtgactgtggcatcaagctccccggtgtccccgctcttcgcccccgcgagtactctcagatctctcgccccaagaagaccgtcacccgtgcctacggtggttcccgctgcgctggctgcgtcaaggaccgcatcgtccgtgctttcctgatcgaggagcagaagatcgtcaagaaggttctcaaggagtctcaggagaaggccgctggcaagcgctaaatgggtgcataatatgctcagtatttttctttagtgggagcgaaaatggaaaaataaaattggctgggtgcgg

SEQ ID NO: 5149 - DNA, 682 bp, Aspergillus oryzae
  misc_feature (1)...(682): n = A,T,C or G
caagagtggaatggcaatcagcattgcattcaccagcttagcaaccatcttcgtttttgcccgagtttacacgcgtgccggcatcatgaagcgcatggagtcgaacgattatatggtcatgctcgctctgacattctcctatgtcttcatggccttttatatcatagaagccttgaacggaatgggtatgcatggcgctgatatcccaccacccatcctccttaaacaaatgaaagcgttctggattaccatcccattctacaatgccgcacttctatgcgccaaagcttctatccttttgcagtacttccgcgtcttccctaccagacgcatgcgtctcatcacgtgggtcatgttaggtatactcggcatctatggatcctgggcagttctgagtggctttctcaattgcatccctgtggcaaagttctgggacaagaccctggaagggtactgcttggacgacaaaggactgtggttctcaaatgcctcaatgcatatcaccaccgatctcgtaattctgatcattcctatcccggctctagcgaaactagatcttcctaagagacagaagatcgcgttgatcacagnttttgcattgggcggatttgtatgcatcaccagcatctgtcgtctggtcgccctcaaaaagatctncgattcacagatccaacctttgaca

SEQ ID NO: 5150 - DNA, 756 bp, Aspergillus oryzae
  misc_feature (1)...(756): n = A,T,C or G
tcgacatatgactaagctcgcctctgtaccatatcatttagctagccatctagacttgcatttaccctaaaatggctctgaatattgcacagcggcgcattagcgttgtgcgaatcccattttctcctggccgaacttttcttcgtcgcaatctcattcccgccccgcacgccaactcaggccctttgctggaacgacgggcagaccgcgaactgccttctgtaaacaaggaccgacggtggatgcggaccttacccatatttgccattgctgtcggagctgcgatgctagggatattcaactaccagaagtcttcttcaagcgtggtcagcagtaccctttatgctcttcgcacctcccctcgtgctcgcgaaatcttgggtgatgagatttactttgctcaaaagataccctggattagtggggaaatgaatcagctacatggacgtatcgacatatccttcagggtcaaaggaacaaagtcgcagggtacaatgaggttccgcagcatcaggccagaccgaatgagctattttcgtacggaggaatggagtctggagacggaggatggcacggtcgttcagctccttgacaacgctactgacccgtttcgtcaacatgactaaatactgtcaagttttcctggaagctggatccctgcatatgcgtgcgccnggaccatggcactttttggctccttcattctattccggtacgaagcgacggtacttcaaagtacaaaagaggccgcagaag

SEQ ID NO: 5151 - DNA, 648 bp, Aspergillus oryzae
ggtgttagcgatgaggatgctccgcacgtcaatgaagctatctcagaacgtctaccaggacagtctttctgctgggttcagtgacgagaaagttcagggcttcctccaccagttagaactcgcgctgagacacacaacagcatacttcggtattggtgtcatggataagacgatttcctcatggttcaacagtgtagactcaatgaaggagcttgcttggaatgatgtcatcaacgaattcaagacgagatatcagcaaggatgctatcttgagtcattgatgcacaagtacttgatgaacgaccgttgtctgacgtttaccatggttggtacgcctacatttcaccaagaactatgaccagcacgaaatggtccggtatgaaaagaagctcagtcaacttgttgagcaacatggatcaatggacaaggctatctctagtctccgggagcaagaactgcagttgctcaagacacaacaagacgcacaacatgccgaccttgggtgcttaccttccctgcgtgtcgatgacatttcgcgagagaaagagcgcaagctggtacaggagtcaaatgtctacgacctcgatgttgtctggcgtgaggcccaaccaatggcctgacatatttcaagcaatgaatgccttcgat

SEQ ID NO: 5152 - DNA, 657 bp, Aspergillus oryzae
  misc_feature (1)...(657): n = A,T,C or G
gtcgggcatgaacatggacgactgcaccttggcaacttgcccaattgacttggcctatatcaattaccagcctaacatcccggcaaatgtcctcttcctcgtcatcttcggccttctcctcgccgcacaaatcaccctaggaacatggttccgaacatggacatacatgggggcaatgaccgcggggctcattcttgaaatactgggatacatcggacgactcatgatgcacagcaacccattcgactttaatgcattccttctatacctcatttgtctcacgattgccccggccttcttcaccgccgccatttacatctgcctgggaagaattgtcatcgtctacggggaggatatctccaggattcgcccccgtacatacaccatcctcttcgtcacttgcgatatcatcgctctagtcctacaagcagccggcggtgccattacctccatcgcagactcagaccaaanaaagcctcgcgataccggtgtcaatatcatgattgcaggattggctttcangnntgctcgtaacgctgttcatcgtgctggcttcggaattcgccctgcgagtacgccgcaagctcaaaagtatgaaagntacgtctacagcatctgttcgcagtggtttgaaatggaagaatgtccttctggtct

SEQ ID NO: 5153 - DNA, 664 bp, Aspergillus oryzae
  misc_feature (1)...(664): n = A,T,C or G
ccgtgaaacatcattctccatggccgacatcgacatcaccgaaacccagtttaagctgcccgacggcttgtccgtctaccagaagacatgggcaccgagtagcgctgctcccgtggcccgcctggtccatttccatggttttagcgaccacatcaacaacacgtttgatctgtttccatctctagcccgccgtgggatcttctgtacgggcattgaccagtgcggttggggccagtcggtcaaaaccaaggccgaccgcgggaacacgggcccgaccgctgccatcctggccgattttgcagcgttcatcgaggtccaactcgaagcgaaaccgtctgttcccgttttcgtgatgggccactcaatgggcggcggactagttgcgacgttagcctctacgcccaagtatcagggtcttgtttcccgcttggggggtatcatgctcgaggcaccgtntatcggactcgacgctgagcaagaaccaagtatcatcacggtcgttctcggtcggttggcaagtaaactactgcctcgcttccagattacccagccgatgaaggtcgaaacgattgtgcgggaccccgccgtgcagcaattgctgaagaatgatccgttaaacccttgtgtcggtacgctggagatgtttgcgaacatgctccgacgg

SEQ ID NO: 5154 - DNA, 781 bp, Aspergillus oryzae
gtagtacttcatacgaaagtcagcactatcgacgacacacatcatgagcatattcacttacacataccaccacctgaaggcacagcaagccttaccccgcaggatcataatgtgcacgactgccatggcaagaatgtaccgagcatcagcattctcagctatttgactcgcattcataagtactgtccaactacttatgaggtcttcctaagcctattagtgtactttgatcgcatgactgagctagtgaataaaggccaattggagcgtctccagcggcgctggggacacatccaaccggactccgcctctcggccagggtctcaggagtcggcagtaaaacctgcgcatggctcgcccatggtgactcccccatcttctgctggaatgagagcacaggacccgacaagtccatcatctatatcaccgtctttgcacccccaggaggaagacgactacttttcccaattttttgttgtcgatagttttaacattcaccggctggtcatcgcgggcgtgacctgtgccagtaaattcttttccgatgttttctatactaattctcgatacgcgaaggtgggaggtcttccgctggttgagctgaaccacctcgagcttcaattcttactactaaatgattttcgactctcaataccagttgaagaattggaagcatatggaaccatgcttgtcgaattttatgcacgggagattgttgctcaacaacagcaacagcagcagatagcatctcaaacaggggtgcctcgtgcgttcggctcat

SEQ ID NO: 5155 - DNA, 674 bp, Aspergillus oryzae
ccgattgtggaaccataatcatcaaaggcttcggattctctaccctcgtaactaccctgatgcaggtaccctacggagccctgatcgcactctccattttagcttgtgtatacctcaacgaccgcttcgagaacagacgctgcgtcttcatcctaatattcctcatacccaatatagcaggggcatttggcctgcgcttcgtcccgacagatcaacaagtcggtcgattaatctgctattacttaacaggcccatacaacgcagcctttgtcctgatcctgagtatgcaagatgcaaatacagccggccacacaaagaaagtagtcacaaacgcagtcctcttcctgggctactgtaccggaaacatcgccggtccattcttctacaaagagagccagaaaccaacctactcgctcggcatctggtccatgatcgtttcgcatctgattgaagctgttcttatctctatcctgggtcttctgctgcgctgggagaataaaaagagggataagatacagtctcagatggaaggctgatgtagaggtagagatagggatgcgacggctatactggatctggcggatagggagaattgagacttccggcatatatattagcatgatgatcctctatgaataatgccccatgcattcagtgatcctgtagcgaatata

SEQ ID NO: 5156 - DNA, 377 bp, Aspergillus oryzae
cgagggttcatcctactattgttgactcattgtcagggaaaaatattagtcaagtttgtggtggtgctcatcactcgattgctgttgctgatggcgagcaatgcctcgtatggggtcggttagatggtttccagacaggtttgaaagtcgatacacttcctgaggaagccgttatcaaagatgaacgtgggcgaccccggatcttgatcgaacctacccctgttccaggaattaaagcaagcactgtcgcagctggatcggatcattcgatcgctattgatactgatggccgtccttggtcttggggcttctccgccacctatcagacaggccaaggcacttcggatgatattgaggtggcaacaattgtcgaaaac

SEQ ID NO: 5157 - DNA, 682 bp, Aspergillus oryzae
  misc_feature (1)...(682): n = A,T,C or G
cccgccattcggatctcctttangatggcgtcggcatcctcgacctcatggctatcctccgtcttggccttctgcgccatcttgtgcctctcggtgcctgtcaacgccctctacttctatatcgatggacgtcagcccaaatgcttcttcgaggagcttcccaaggacacattggttgtcggaaccttctccacgcaggtcatcaaccagcaatcgaacacgtactccgttgatcccagcctgaagatgctcattaccgtcgacgagaccttcgacaacgatcaccgcgttgtctccaagcgtgatggccactccggtcgcttcaccttctccgccgctgatgccggccagcacaggatctgtgtgaccgccgatacgagtgccgcgaccggcggctggctgtcgggtgcccccgcgggtgctgtccaagtgactctggacatggccatcggagagaccagcaagatcgagacggaagacaaaggcaagatccacgacatcgtccagaaagtgaaagaactcaacgggcggctgcgagatatcccgagagaacaagtggttccacgggaacgtgaaggcgaatttcgtgatcagtctgaagcctccaactcccgtggtcgccgatggaccctcgatcaagagggtgggcctggtccctgcctgccccgggaaactggccacc

SEQ ID NO: 5158 - DNA, 671 bp, Aspergillus oryzae
  misc_feature (1)...(671): n = A,T,C or G
gcaaacaccatagctctgaaatctgatagcattccgtacgagtgctacatatcaacactcaaccatcatcagtccacaagaactacatccaacatgtccaagcttatcactgtcttcggtgccacgggcaaccaaggcggctccgtgatcaaccacattctggcggatccccagctccacaaagagttcaagatccgaggcatcacccgcgataccaccaagcccgccgcccaggagctgcaaaagcgtggagtggaagttgttacggccgatctgaactctgtcgaatctcttcgcacagctctcaaaggatcccacaccgtcttcctagtaaccaactactgggaatacgtcaacaaggacaccgaggtcacccagggcaagaacgtcgccgatgtagccaaagagctcggcgtccagcacctgatcttctcttctcttgttcacgttaccgacttcactaatggccgtctcagccatgtaccccatttcgatggcaggctgnaatcgaagatacatncgtgcttcaggtgtccctgtactttcgttcttgccggctacttcatgctcatttacctgcagatgctgaaaaagagcgatgatggcacctatcagcttttctatcctgttgatggtgctaaggctaaagttnctttattcgatgctgcaaa

SEQ ID NO: 5159 - DNA, 663 bp, Aspergillus oryzae
  misc_feature (1)...(663): n = A,T,C or G
cagatgctggagaagtacgagatgcagcattttggtgtctgcccccgcgtctactgcaatggttgcaaggttctgcctgttggtcgatctgatactccaggccaagagacggtgaagctcttttgtccgagctgccaggatctgtatacgcccccaaacagtcgtttccactctgttgatggtgccttctttggaactacttttggatgcttatttttcatgacattccctgacttggacattggtcctcggctcgatagctctcttgtatcgccggcacggtcatccacagtaaataaccaggtctctcccgatgttcctcctgctcatcagccggtggagattaacggggtacgaacggccaatttctgccccggacttggattgggcaagatctatgaatcacggatttatggattccgggtttcggagcggtctcggaccggaccacgtatgaaatggctacggatgaagcccacggatgttgaagaactcaatgagatggcccgatatgaggcagctcgtagggaagccgacaacgacggcgatacagaaatgggcgccgctcctgcangangagcgcagaactcggcgatagncaagaggaaaaaggcactatgcngagacggcngtncaaccctgatcaatgagcattaacggngg

SEQ ID NO: 5160 - DNA, 636 bp, Aspergillus oryzae
ttatccgcccatctatcatacaacccctgactaatagagtcgacttcattataatattccggtttaggtataattagagtaaaaagaacatcttgttgattccgcggcacacacttggactatgggtaaccagcagtccaacatcggcggaggccccgggggcgatggaagggatgataaggataagaagaaggacaagcccagatacgaaccacctcctcctcccacgactcgtcttggacgtaagaagcgcaaggctgccggcccaagtacagcttccaaactccccgacatcttcccaacgtcacgatgcaaattacgatacttgcgaatgcaacgggtccacgatcacttgctgctagaagaagaatatgtcgagaatatggaacgtctacgcaaaactaaggcacaggcagcacatgattccgtcagcagaagcgagtttgatattatggaccgaaatgcagacgaaaggggtcgcgtcgatgacatgagaggtacccccatgggagtcggcaacttggaagaattaatcgacgacgaccatgccattgtgtccagtgctaccggaccagagtactacgtttccatcatgtccttcgttgataatgacttgctggagcctggtgccagcat

SEQ ID NO: 5161 - DNA, 670 bp, Aspergillus oryzae
caagacattgcaagtttttcaacccggcggtgatcgagaagaagaagcgaatccgaacatgctcatgcgcacaccgtcgaaattggaaaacgagcgcaaggcccgtgagctacgcatgtccctaaaacgtgaacgcccagtgcctctggacaaagcaaccgcaaaaatgccggaagaaattctcgacgaaagaaaattccatgtcttctattccgacgatgggggatttcgagccactcatgagaatggtcagcctggggaggagatctattacctcggaatcattgattgtttgacacattatggcatggtgaaacgattggagcacttcttcaagggcctgtcccatgaccggaatcagatttcaccagtcccccccgagggttatggtgatcgctttgtgaagttcatcaagggcatcactatgtctaaagaggaagcggtacgttgtcgggagtctcggtaactgggcagaacatctgctgagcgtactccttctgttgaaaggacaatacatgcggcggagaaagaagcggccaatgatgtatcttttacgcaccctcggacgttatccacaattagggaccccacggacaccaattcaacgggtgcaactttaacactaccgatcgtggacgaagctggcgaggccattatcgttgtgggacat

SEQ ID NO: 5162 - DNA, 649 bp, Aspergillus oryzae
  misc_feature (1)...(649): n = A,T,C or G
ctcgacttttctcctcctcctttcctctcaccggtcttcccatcctatcaattcccgaccttcctcgcggtttcccacccagcgcttctgtctgtgttttagtttagatttttgtcttcatacccccccaaacaagatgtctgagaacaaggaattcaccttccaggaggtgtccggccacaacaccaagaaggatctttacatggtcatccacgacaaggtctacgactgcacctctttcgtcgatgagcaccccggtggtgaggaagtcctgctcgatgttggtggtcaggatgccactgaggctttcgaggacgttggtcacagtgacgaggctcgcgagatcctggacggtctcctcgtcggtaacctcaagcgcgtgcccggcgaccctgctccccgttctcacgcccaggctactaccaacgcctcctccaactccggcagctctaccggcctcggtgttggcctctacgccttccttctcatcggtggtgccgtcgcttacggtgcttaccagtacctgaacgccgcttctgaagcccagtagagaaaggtagatgacggggaacaagaaaaataanaaagaaataaaaatatttagaacgaacttttaatacgaccttgcgtttttttaaacgtacgacct

SEQ ID NO: 5163 - DNA, 639 bp, Aspergillus oryzae
  misc_feature (1)...(639): n = A,T,C or G
gcagctttagttcctcaattcacggcgatggtgtctcatcatatgtctcaaccagtcgaccatcttttaacagtcggccaagcagccgcacgagctactcaaggtcggtcaacccccgcacacaccctaatattggacctttgacttgggccggaaggcggccgaagcggaccaaaacccccctgggaccttaatcgaccaaatccacccatggaaggcggggggcgggggcattggttaaccattccgggggaccaaatggacccattaaccggatggcttataatggccaagaagaaggacttttcatgcgcaaggtcctgccggccaagaataatgagaggcgcgaaactctggtttcgcgggtttctaaccccacagggcttcagaagcgcgcccccaccggaaattccttcattcctgtgccttggaatttttcactataaccggaattgagcgaagggggggcacatggggccgcccgattcgaagacaaaaaccaccaccgatctgggcgagactttctaagttccatgtgaattttccactatctattccttccattggctaccattagacacacattggggcaacttcgaaaggcgtgacgaattcaccgctgggacgcgcgcttgatan

SEQ ID NO: 5164 - DNA, 1006 bp, Aspergillus oryzae
ggggagttgcccgtgccttgccaatccgcatgttacaacaaagactactggcgcccctccgggtgctggagagagcaattgtgccatcgctccgctcatcacagccaatctcccgaccaccaccaccatcaatactctcacgaaccaacacctccgcaccgacaccattcttgaaccgcctcctccccttctctcaagtccgtcatgcctcccacgccacccagggtacggcgaatcgacattcccgtgaccccgcgggaaagcgtctcggtgcgaaacgtaccaccggtgaatacgtcgttccaggctgtatcattttccgtcagcgtggaacgaaatggtttccaggcgagaattgcgcgctaggcagggatcataccatctatgccactgaggcaggatatgtgagatactatttggatcccgaacggcaccctgaccggaagtatatcggcgtctgctttgagaaggacggcaagttgcctacgccccggaatgccccgaccaaacggaaactgaacagggtcgccgtccctcgcatcgatgacgcccctacgccgattgctggacagtcggatcttgttgctactattgacaatggcactatggtgtctagagtgtagactctgtacgcccagtcaggctctcagatgcgtccgggttatatgtgccgtgaggcgaactggcagatcggttgagcagcttagaaggccgggattacagcgaaggcttacaaccccaagaaccgttggttggcatggagaaagagacaggctagggccgaacgggccgcccagatgaagagtctcaagaacaagaagaaggcttcaaagaagggcaagggtggccgctaatgatcatagccaacgcttccgcccattatcttatgtctccgcatgtccggagtggtgtcgcacggtatcgggcttaaaggtgcttttgtactatagagaaatgtttacatccattaaattgttattcaaaaaaaaaaaaaaaaaaaattcct

SEQ ID NO: 5165 - DNA, 682 bp, Aspergillus oryzae
cacgatgatgttgtcctcgactgggcacaccatgacaagctttgcgtcatcgatggcaggattgcattcatgggaggtctagatatgtgttttggccgctgggatacaaaccagcacgcactcgccgatgtccacccggaggacgtatacgagagcgtgttcccaggccaagactacaacattgccagagtgctcgatttccatgatgtggcccattgggagaagaatcagcttgaccgaaagacatcctcccgcatgggttggtcggatatctccgtgagcttgcacggccatgtcgtggaggatttacgacgacacttcatcgaacgttggaactttatctacgatacgaagtatgattcacgcaaagatgcgagatactccaggctcgcattgtacggtcgtcccagctcgtcaaaccgctcacagcagccaggtgctcagcaacagcagagtacatctccccggactagcactagcagtcatcgagcacctagctaccagcaacctccggcgtcaccacagtcgaatctatcgactaagccccaggcacaagcaatatgtaaccatgcctaccagcaatcggcaacatcgccgcatcctggcctttcaagctacttcactgcctccatcgcatataatcaagctacctctagcccccatcagcctgcctctggtgctc

SEQ ID NO: 5166 - DNA, 709 bp, Aspergillus oryzae
  misc_feature (1)...(709): n = A,T,C or G
tttttcttcttccttagccttgatttgtgtgaactccaattgtctgcccatactatgtcgtactacggtgctccccctcaacccccatatgggcagcctccatatggacagcctccatacgggcagtctcccggaggctatgagcgccccccatatgaccagcgtcctccctacggtgagcgcccctcttacgacaggcctccatacgaacaggggcctcccggtgaccgtccacaatacgaccgtcccccttacgaacagggacctccctctggcgagcgcccaccatacgaccgtcccccttacgagcaaaggcctccctctggcgagcgctcaccatacgaccgtcccccttacgaacagccacctcccggcgagcgttcgcaatacgagcgccctccatatgggcagccccctcaagaccaacgccctccgtatgacagaccaccatccgagagacccccatacgaatcagaccgttccttcgactcccggccttcctactnctccggaccacctttcggccgtcctcctcaaattcccccaccacctctttcccatgggttgggttcaggaatgggaggcccaacgcccgccgcgccttttgggttgatgtagcccaccggcaaactccagtgggaacaaccttttggcgactcttccgtggaatgggccccgggtggccctccgctatcatgaacccccctcc

SEQ ID NO: 5167 - DNA, 663 bp, Aspergillus oryzae
catcgaacacctcttccccgtgttatttcaacctcgactcagatatcgcctatcccttgaccggacccggtattatcgaaaccgacgataaacgaagatggcttcaactcttgctatgggactcggtgtcgcgaccgcggcatttttgggtcgcgcaggttatgtcgctttgcgtcgtgccaggggaggtgtgaacgccgcgggcaaggcattctacaagggtggatttgaaccccggatgaaccgtcgcgaagccgcattgatcctagaacttccggaacgtactttgaacaaggacaaggtccgcaagaagcaccgtcagctgatgcttcttaaccaccccgatcgcggtggcagcccgtacctggcaaccaagatcaacgaagcgaaggaattcctcgataagcatacttaatggtggaatcggaaggggccgtggcccctggtcaccgttgggggtattggcggatcctctaagaacagaagggtggcccttctgttcgttgtataaggaaagagaatgtctttttttgggtgcatagcatggcgttggtggaatattcgaggacgaggttcatttcttcatgctcctcccggagacttgggtttgcatatatccctgacgagatcggcactcctgattactttacatgtcctctggag

SEQ ID NO: 5168 - DNA, 673 bp, Aspergillus oryzae
  misc_feature (1)...(673): n = A,T,C or G
gcatgtacaattcgatggattcgcattgccaggctctctggcatttgcgtctcttcaactgttggatgatgttcccgctgaacatgatcggagctttgtatgtaactatgacagcagcgctgatcgcaaccattagaggcgtccatgcgtccgtggcagggattgctctcagtttcgctttacaaatgtctgacgtcgtcgcttgggtgctgtctgagtacaccgagatcgagctggacttcaatgccggtgaacgcatcgtcgaatacacgctgatcgtaactgagcatcaggatggcatggatgcctccacccaatggcccacgaaaggcgagattgaggccaatagaactcttcgttggcttaccaccacaattaccaccggttctaacggggtcgagcttctctataaaatctaacgagcacgtcgagatcgcccggacgtaccggctcttgcanatagtcatttgcactcgcgcttctgcgcttccttgaggtacgggcccgatccttacacttaggtggaaagggtttctctagactgggactcacggccctccgctccgagattgcaattatccccccaggagcccgggatttcttcggggaccctacgatcgggcctcaatcgtttggaaaagccaaaattctgagctccttgcgatttatcaag

SEQ ID NO: 5169 - DNA, 650 bp, Aspergillus oryzae
  misc_feature (1)...(650): n = A,T,C or G
ctgctctgcttcgaaaatgcttactccaccctcgatttcgaggagctcgcccgtgacatctcccggcccatacctctcctatccatcagggttaggagttaaccttgacgaggtgatgagaaattgggacgagctgccgccggagcggaaaaaggctggtgaccgatggtctgctgtgatcaaccctgacatagacaagaactgggagatagacctgcttcatagcgtgacgcacgatagcattgtcaactgtgtccagtttagtaacgatggcaaatatattgctgttggatgcgcagatggcgccgtacaaatagtcgaggtttcaaccggaactcaggtggctcgtctacaagatgagggatatagtcacgactgtctctgtgtaagagtgaggtttttgcctgataattatcttctgcttaccgcacatagcgatggcaatatacgcgtttgggactatatgggaagcttcttcgacgaacccttgtggtagtgaaactgggttcttcactctagatctttcggctactgggcatctaatcgcgttttccgagagaaatangactgtcaaggcttgggatctggatgcagcatctggtattcggcagctcgggacgctccacacagctgacgatgtatatatagcn

SEQ ID NO: 5170 - DNA, 663 bp, Aspergillus oryzae
cccagaacgcactttaggagcgagcaattattcaaccatgtcatattcaagcagcgaaaaggatcccggtgcagacaccaggattgaagacgtcaatcaacctgccctgaacgatgttgactacgatgaagaatacacatatgcagagcagcgtaagattatccaccgggtggatagacgtcttgtcaccattacgggtttagcatattgtgtgtccctcatggacaggacaaatctgagcatggctgctgtcgcgggcatgaccaaggacctgggtttgacaattggaacccgatattccgtcatggtcctcatcttcttcgttccttatgtgatcttccagccacccatgacagttataacacggaagataggtcctacctacttcttgggaaccattgttattctttggggggcaattctaattggcatgggatttgcaaagaaatggaagcatatggtcgcgacgcgtgcactgtgggtatacttgaagcaagctactttcccgggtgtgtatatcttttgtcaagctggtacactcgggttgacgtggcaaaacgggtctctggcttttacttaaatcggtgcgtagcatcagcaatggtctggattcttgcttttgggctgaggcaaattggggggctttaagatcctggaaggtgg

SEQ ID NO: 5171 - DNA, 699 bp, Aspergillus oryzae
  misc_feature (1)...(699): n = A,T,C or G
cttggtttgccaaatgggggtcccacaccattagtctcctatgaacgctcgcggcctcagacgcctgcagtgactccctcaagggaaatgggacaacctggattgaacgttcctcaaggctctcctaccggtcctccagcaggcaactctcgaggcaatacgcggccgacaactccatttaatgctcaattttcccttcctgcaacgccacccgacctcttccttgtcacgcgtacttcacccaacctttcgccttcgctgtgggagaacttccagcccgaccagttgttccctgatggcactgccatcttccctgagctgacttccccgcagcagactgccgtcgatccacaattacagatgtcctctcagttacagacacaaggcatggatcagcgacatatgatgccgcatcagatgtcctcccgaggtcttcccggaacacagggaagcccggagatgatttcgaacatccccccgggattgggcatgcaaggtcagcaaccaccacaggtgttcggaatggagaatcagcagccttggcccatggcaggtttagaggcagccctgcataccggggtggaggctgctagcccggatgacacctgnagtaatagctcccgaagtggggaaaccgcaccgaccactttgaacgtggaagactggttccaattctttgcattaatggtagctttggcg

SEQ ID NO: 5172 - DNA, 679 bp, Aspergillus oryzae
ctttgcgaatcaatactcattccttcgttgtattttagtcgggtcgggactgtcaaccacaaagtgatctccgtaagccaggaatacgacataatggctactccaacaggccgtcttcaagacaagaatgctataatcactggtgctgcaggagggatcggtctcgagactagtatcctcttcgcccgcgaaggtgccaatgtcctcatggccgacatctctgctcctgccctcgagaaagccctcgccaaagtgaaggaggttgtccccaatgccccacgggttgaaactttcaagtgcgatgtttccaaggagtccgaggtacaagcgatggtggaatctcaagacagctggggcggaactgacgtgatcttcaataacgctggtattatgcatgctgacgatgccgacgccgtggacacgccagagaagatttgggatttgacacagaacattaatgtgaagggggtgtggtttggatgcaagcacgccgtgctcagtctccgtcgtcataagaagaccaagggtagcattatcaacactgctagtgtaagtgccttaatgggtagtgccacttctcagctggcttacactgccaacaaaggcgcggtgcttgccctgacccgtgaactaaaccttgtgcatgcctcggaaggattccggtttaatgccttgtgcg

SEQ ID NO: 5173 - DNA, 503 bp, Aspergillus oryzae
  misc_feature (1)...(503): n = A,T,C or G
catggatgacactgcctctagaaatgtaggtggctggccagatcatgttaaaggtcctactgatgctccgttcaatgatcggaaccctacgcccaaggagatgacaaagcaggatatcgaagacttgaaggtcgcatgggtgagcgcagtcaaacgagctgttaaggcgggtgcggactttgttgaaattcataacgcccatgggtatctcctcatgtcgttcctgtcccccgccgtgaataagagaacggatgaatatggcggaagctttgaaaatcgcatccgcctcagtatggagattgctaagctgaccagagaggcggttcccgaggataaacccggcttccaggctccttttgctgtcgcccgttaaacgggcggttggggataagctgaaggtanggtcagtgggcatgatcgactcggcccagctggccaactcctttgtagagaaaggaggtctagattttgtcatgggtcggcggggttccaaaagaatccgg

SEQ ID NO: 5174 - DNA, 657 bp, Aspergillus oryzae
ctttcgttgatcgaccctttatgagaacggccggagcccagtcaggctcggtttaaggtctacatcgccgagttccaattcgacttagacacgctctccagaaactggacccttggcgggaggttgaacgatccagagaccctgaagggactggaattgctccaggaactctggacggcattcaatcttccacagggtctcagggagccccctaaaccgggtgactcgcccgttcggctgccgttcctgtacaacttcgagatgcagtcggggaggaagttccccaagtcgaaggtttactttcccctggctgatgtgaatgatcgcgacattgcgaatgtgttgactgcgttctttgagaagcatggatgtgctgaattggcgaagtcttatacggagaacctgttgcaatacttccctggtgttgatcttgcggagagcgttgcgttgcacgcgtggttgtccttttcgtactcggagaaaacgggtccatatatgacggtttattatcagtggccggatagcttcaatcagtgtcatttgactgcagccagctcctgatgtggtctacgtgggtttctgcgctgaaaatgcgggcctgttggcctattttggcctctccgtaatggctaatgaaactcctgggaccatgcctgg

SEQ ID NO: 5175 - DNA, 674 bp, Aspergillus oryzae
  misc_feature (1)...(674): n = A,T,C or G
cctgtgggtccccccagacaagctgaagaagcccttcaagctcatcgccgctatcaatctcctcgtcattctgggactcgcgatcggtctcatcgccggagcccgaggtggctccctgggtaccctccaaacatcccagcgaaccgacaatttgggatggaccttcatccacggtttcgccgtcgtgttctccggcaacgcagtcggaatggcgagtcacagcgatttctcacgtttcgcccgacgaccaggggcccaagtcaaaggacagctcttctcattcctgatctccggaaacgtcgtgcccatcttgggaattttcggcactgcagctgccgcgaaaatgtatggcgacgtgaacgaactgggtctgtggaatccgccgaatatcctgcaaatgtggctggacaaccagtaccataataaggccatgcgagccgcggcgttcttcgtcgccttcggcttaacatccagtatcatggccatgaactccatcgagaacggtgtttcgggcggcatggacatcggcggactctatccccggtacttcaacatccgtcgtggatcgtatctgctggctgcgatctccgtggtgatcaacccgtggcagattatcgcccaatgangcattttctacaaaactctgaacagttcggagtcatcctcctcccctc

SEQ ID NO: 5176 - DNA, 675 bp, Aspergillus oryzae
  misc_feature (1)...(675): n = A,T,C or G
gtcgcacggggaggacaatcaagatgactcgaacataatgcaagcatttaatgatattttgaaaggcgagaaaaccgctctggcgctggagaatcacctaagcagcctagaacacaagattgatgaactgcttaacggcttcgaaggggcacgccaaccacaacccacgacaggaaagactaattgcccggataaaagcggggtttcggttacttctcaggctttgaacagctcttctaagtgaaataatccatcagagtccttttccaccactcccttttcagttatgataccatcaataagtgcccctggggttatatcgaatgctggattccagacattgatcccttccgctgctatgcacacggtttccatcttgacggcttcagaggcaccaccgtcttcgcaggtgcctctgaccgtagtaacctcggatgcgggccgctcctcgatagtgatttcattccctgatttggtgactaagtcgatagtcgtgagcggcgcagccacaagaaatttcacaccatggtactttgcaagcactgcaaaacatatgtaccaatcttatttgcggatcaccgtagctgctaccctgtctgcccctacacaattgcatncacgcctatctcgcttctatccaataatgcaacttgcctttgatctggttttaaagag

SEQ ID NO: 5177 - DNA, 1193 bp, Aspergillus oryzae
ctctttctcagacagctttctgtcgttccttccttcaacaacactctcattctttttgagtgttcattcacttccccaatctgctgtgcagttggttaaattgaaatcattccttcaattgacttcgtcgtcggctcgccgatcacaaccttccttgaaaagtaaaaatatcattttttctgatcaatcaatcatatctgcaatggctcctctggctaagactctcgccctcgccggcgccctttttgccgccctcgcctcggccgctcctgtgcaaaagcgccaggatgttgtcgtgaacacccgcactaccgttgaatggactaccgtgacggtcaccacgaccatcaccaccgaccgacctgtccagactcaagctcagcccactgtctctgttcctgcgtcctccactcccgtcgtaactcctgagccttcccagcccgctgaggttcctggcgagtttcacgagagtgaggcccccgagccccagcaatctgcaaccatccagccggtttggactcccaccccggctgagtctactacctctgctactcccactccggagcctaccgaacagccggaacctaccgagcagccagagcccaccaccaccagcaaccctcctgtcgtggtcccgacttcgtctagcactacctctgctgcccctcaacctaccgccagcagccccagcggtagcagtagcggatacaccggcacctgctccaaagactccccgtgcaagggtcagaccaccttctacgacactgccacttcttccctcgcccccagcagctgtggatacaccaacgatggcagcaccgaggacgtcctggcccttcccgtcggcatgatgaaggacagcgactgcggccgcatggtgaccatgcgctacaatggcaaggtcgcttccggcaaggtcgttgacaagtgcatgggctgcgacagcacctccattgacgtgtcgcgccacatgttcggtttggtggcttccgaagatgcgggccgcctcttcgatgttgagtggttcattgagtaaatgcgttgagtgctagcttcttctgttgactctttgattttttgttacttcgcttcttcgatatccatacccccttttctcttcttaaccttcttcacattcgttttatacataatttacacaggttgctccgcctggagtattggagctatgttca

SEQ ID NO: 5178 - DNA, 745 bp, Aspergillus oryzae
  misc_feature (1)...(745): n = A,T,C or G
tgaccagccgatcaatcggggcgaattcgagctatgcggatccgctatcctttcgcgggcgccttcgtcttcctcttgctcttggctgcctatatcggtctcctcccccacagtgcatcctcaagtgtcccatcgcaactacaacccaatgacaagcttctccatgtcgtgacgttcttcctgctgtctctcatcttctactggattcccgacaccacccgccgacgcacgctacaattgaccttaattgtctgcaccgccgttctgggaattggctccgagattgtccaaggaatcctccccaatggtcgctcgtttgacccgtttgaccttctcgccaatatcgtgggtagtctcggcgcagtcggcttgtgcagttggtaccaccggcggatgctggagaggcggcgcaaagcccgcttcggagctcttggagacgccacagatgatgttgagctcggcgttggccccggtcatagtgagaccgaccatgatcaggaggggctagggccccaggaaacggnggtcacgaatctggagcgtgaggtcgacaattgggatgagaatgccgtcgataactgggattcagacgacgngtgtgatgagccttccggtttgatcgcggaaggctcgaaaccttctngcccctgctgtaatggggaccagggagaggggaagaaaacgaatgactgattcgatctacattaggatcntaaatctaanttgtatgaaatatacctcgtca

SEQ ID NO: 5179 - DNA, 759 bp, Aspergillus oryzae
  misc_feature (1)...(759): n = A,T,C or G
ggggtactgcatcgacgaggatcatccatcgttaaaacaccttcgatttctccaaaaccactcgtttaccatcaaactttcaaaatgcagttcaagaaccttgctctcgctgcctccatcgttgctactgccgccgctgccccggccgctgacagcacctccgctcctgctgcgaccccgtcttccacccctgccactgatgcccctcacttcttcggcgtcatcgccattcactccggtagcggtgtccagaacgctggcttcagcgccgccaagggtagcctgatcgctggccttcagaacaagagcaacagctgccaggagaccagtttctatatcaacgacggtgttctcaacatctacgatgacaccgctcgtccccaggagatctacgttgaccgctccggcatgggccagggcaagattggctacaccgtcggtgtcgagcccgctcccaagaacgccgagcgcaagggctgggccatcaaggatggccacctcgagttcgacggatccagcctcatcgcctgccccggtgccgacggctacagcatctgggcctcctctggtgtcgctaacccgggtggcaacaaggattgcattggcattgctgctcacgtcgttgggaccaaggagcccaagccttgctgggccaactaagtttgtgctttagtggttcgttcttttgcgcanagactttgataaaggctcgatgtctctttgtgcgtcttcattgtattaagcgatttgtgaataact

SEQ ID NO: 5180 - DNA, 659 bp, Aspergillus oryzae
  misc_feature (1)...(659): n = A,T,C or G
cgaaatttcagcctgaagataccaatgactcccaagagctttttctcaccgacacaattaaatcggcaggagatgttttcgcatcttccccggctgaggaacaaaaaaggcgggaatcgcttatttccaccctcactgcttcgtctgctgaggcagtttactggctcacggatgagaaaggtgtcgacttgagcaaggtttgccggttggggggacatagtcgcccgcggacgcatcgtggggctggtcagcgaccgcctgggatttctatcgttagcacgcttttggattctttggagactagttccctgtttcagcttcggtcgggggctagggttacgaaggtgttgcgcgaggcggatgaggtcttangggtccagtatacaggtggtgagaagactgaaacggaggacaatactaccactacgcttaatgggccggttgtgtttgcaagcggtggatatgcaagagatgcgcatggactgcttgccaagtatcggcccgatttggctgggataccttcgacgaaccatgctgttgagggaacacagcctcttctcgagaatataagcgctgggttagtggatatggaacaagttcaaatccatccgacccgatttgtggatgagaaagaaccctccgcgtctgttaagattctg

SEQ ID NO: 5181 - DNA, 654 bp, Aspergillus oryzae
  misc_feature (1)...(654): n = A,T,C or G
aaatggacaggagggtacaccacttgcccatcaaatcaactcgtccaccccttggctgaactctcatcaacttgtcatacgtgattaaatctccgtatggacctggaatccaactcccaaccccttaaaccgcacttggtcgatcaagatgtgcaagatgctcacgatctcgctgcgatgggccatgaccaggccctcacgcgcaaattcgacctgtggagcatgctagccttggcattctgcgtcctaggaacatattcaacttttgctcaggatctcagcagcggtttaaccaacggcggcgctgtcgctattctctggggtctcgttctggtcacagcatgtaacctctgtgtcgccctatctcttggcgagctcgccagtagcatgccgaccgcgctgggtcaggcgtactgggtctttcgactatgggatacccccttgggtcgctttgcttcgtacatgtgcgcgtggatcaacaccttcggctggtggacgttgaccgcgtcacanatcgccttcatgaccgagtttcttcttggcatgaaggtcatgttcgagccgacgtgggaagggagctggaccggggtgcttgaattcctcgtctacatcggctgggtccttctcttgaccgtgatcaatggtggccgggtn

SEQ ID NO: 5182 - DNA, 653 bp, Aspergillus oryzae
ttcagggcgtgcagctcgctaaggcaatgggtatgcgtccagttgtggtggacgcaggcgagtcaaagagagcattggctttggagatgggcgcagaagtcttcgtggatttcatcgaaacgtccgatcctgccgcagctgtgattaaggcaacagatggtgtaggggcgcatggagtattcgtcacagctcctgcggcctatcgaacggcgttatcatacgtcggtaatcgcattggagcggttgtcatgtgtatcggattaggtcccactggcgcaatgactatcgggggagatcccaatgcttttatcttcaagaacctgacggtcaaggggaccttggtgggtagtcggaaggatacagcggcggcattggactttgctcggcgggggaagctccaacaaatttgcgaagtttatccaattgaccgattgcctgaagcagtagagaaactgcgaaaaggacaggccacgggacgaatggcggttgacttcaacaagtaaatcgcattgatggaaacaactcgggaacccccgggaacaaaatgcccaggcgggcacacgaataattgccgtcttcccttgacccagtgcctaagggagaaaatttttgaatgtcatacaacctatttgtgggggaaatttttctccggg

SEQ ID NO: 5183 - DNA, 705 bp, Aspergillus oryzae
  misc_feature (1)...(705): n = A,T,C or G
cggaattagctctgtccgaattcggcacgaggccattggccctcatatccttcacctttttgggtcaattctttcccctcttcttctcatataccccccctattacaatgaggtctacattccggttgctggccaacgtcaagccggcccggtacctggagcctttcgctcccaccggtatcaccggccttgtcactcatcccagtccccgcccgactttgatctatctctacacaactaccctgcagaagttgaaggccttccccgagtcttccgtctaccgccagtctaccgaggctttaacccgccaccgcctgcaaattgtcgaatctacgaaacctcctggctatgaggcttggttggagcgcgtgaagaaggctattggtactgaacctgagcggttcgcctctctccttcgcccagatggcacgtacgcggcagtcatgcgcagcgatggaagcgacaatcctcgtggtgaggagtgggatggagaagccctcgagccgaccagtgaaggccctgcccgtaccccagaggaagaagctcggtggcactcagctatcgaagattcggttaaggcagagaacgagtctgatttccaaactcatgctatgaagtgggagaacgagctcgccttggaagcagagcaggttgccgaattcgagatccagattggaggctggcctattgaggaggtcatncaag

SEQ ID NO: 5184 - DNA, 717 bp, Aspergillus oryzae
cagatttgattgagttttactatcagctcagatcgcctccaacatcaatcagacctttatttgatttcgactgtagactaggctcctactcgcactttgacaccatgacgactcttcactatttacctccggtgaagccctctgctattgctctgggcacgtttttcacacacaccgcgtccttgggaatactggctcctgtcttcggtgacacttaccatcgtgcgcaggcagccaacacgaaagaggaattcatcaagtccaaagaggctgccggggctgccgcagcctggggaagctctttggtcggtagtgccatgcaaacttatggagtggctgctctgattaacgcaaccgggacgctgagttacaagggcgcggcgtatctgggaagtctgattttcatggctagctctgcaccaagtttcatcagccaaatttttaccgagaagcggcctctggatacagttgctgtaggtgcagtgagccgagtcttcgagacagtcgggcttagtttattccttacttggtggggtacgcgtacgaatcctttcgattaagtatacctctgttatgctttgaatatgatatttgcttgagaggctatccaactttgtggacacggttcataggcgtgctcagtacatgttctggtgctcatgctgtaatgtggaagaaaaggtacatggaaccaagtaatttcaaactacaaagggg

SEQ ID NO: 5185 - DNA, 675 bp, Aspergillus oryzae
ccgcgcaaaccaccataatagctctctaccagtcgcttgagtacggcatcaatcgctcatcctatttgaacccgttccttattccacttatcgcgtatcgtcatggctggtcgtggaggcggtggaggtggtcgcaagaccttgctcgcgccgattcattttattttcaagcttcttcaacagcgctccaccgtttcgatctggctctatgagcaactggctttccgtatagagggcaagatcaggggattcgatgagttcatgaatctcgtcgttgatgatgcagtggaggtcaggttggctacaaagaccggagaagagaagcgcaggcctcttggccagatcctgcttaagggagataacgtctctctcatccaagccgttcagtgatcataggggccttaggaagcatacagaaaagaaatttcaaaaatgttttgccaggctacgacaatatctacttctctttaatcatgtctttttacgggttgccgctgggagacactcttgcacatcaattaaatacacggagttctgacacgagagggaattctttttttgggactataaattagtggtgacggacgaagcacctattgtcgccgacgatgagaacatctacttgccagtcatggtttgcaacgggtatatgttcggtccgaggcaaagtttgct

SEQ ID NO: 5186 - DNA, 304 bp, Aspergillus oryzae
  misc_feature (1)...(304): n = A,T,C or G
gtgttgcatttgacaattttcctcattcagcccttcttgagagattagcgaaagccttgcggcctgaggcgcgctattaccttctgagcgcgatggcgaaccagcttcggtatcctaacagtcacacctacttcttcagtttcgcgattctccgtttgttcggttccgactactcggaacaggatgagtccgacattcgccagcagattattcgggtgctacttgagcgacttattgttcatcgtcctcatccttgggggctgattataactctgcaggaactgcttcagaatcgaagctacan

SEQ ID NO: 5187 - DNA, 720 bp, Aspergillus oryzae
  misc_feature (1)...(720): n = A,T,C or G
ngacttgacactcgatccgatgcggacgaggctccgcccgcaacaagctcaccaaatcgccggttcggagctcagattacgcagtgaccgcttgatcctcgattgaagcggacccggtcccaatcccttatttatcgacccttattccgacgttctcctttcccgttccgcgcactccgcaccctccatcatcatggtccacaaagtcctcttctggggcggcttcggcatcgcagtccgtctctggcagctcggtatcgaaatgcgtcccattctcgccaaggaatctctctgggtgtaccctctctttgccggtgtcggtagcagcttcggatactggctccagggcgttgaggacagacagctcaagatccttgcgcagcgccgcgaggctatcatcgaaaagcgtcggagacgtgaccagggcacattgagcaaggttgaggaggccggcactcttgccgcgacgtcgtgaatgtgatattttgagttctggagaaggtggttgaaggacaggattagaagacgatggctgtgttagtcgacttgactggccaacggtccagtcgttcttgtatcaaaattcgaacggttatgctcgggctcctgttatcgaaagaggggaaggcatgacggctttagtgcctatgagcaagacctagattatgtgtttattttcaattggtttattccactgttcgcattgcaatagccgaattn

SEQ ID NO: 5188 - DNA, 955 bp, Aspergillus oryzae
  misc_feature (1)...(955): n = A,T,C or G
cttaaatactgtagtttccttgcagcactctctccttctatgcttagcctcgcccgcagaaccctgaaccgcgtccccagcttccaggatatcctacaaggcaggatgacccacccagacatttccgttgacgttctcgtcattggtgccggccctactggtttaggtgccgcgaagcgtctcaaccagattgatggcccctcctgggtgatcggggacagcaatgagactcctggtggtcttgctttcaccgatgtgacccccgaaaggtttctctacgacggtcgaggtcacgttatttttttccactacaagtactttgacgactgcatcgacgaggctcttcctaaggaagatgactggtacagccaccagcgcatctcttacgtccgttgccagggccaatgggttccctacccattccagaacaacatctccatgcttcccaaggaggagcaggttaagtgcattgacggtatgatcgatgctgctcttgaggctcgtgttgccaacaccaagcccaagaacttcgacgagtggatcgttcgcatgatgggaactggtatcgccgatctcttcatgcgtccctacaactacaaggtctgggccgtgcccaccaccaagatgcaatgtgcctggctcggtgagcgtgtcgccgnccccaacgtcaaggccgtgaccaccaatgttattctcaacaagaccgctggtaactggggtcccaatgctactttccgtttccccgctcgtgggggtactggtggtatctggattgcagttgccgacactcttcctaaagagaacactcgtttcggtgagaagggcaaggttaccaaagtcaacgccaacaacaagaccgtccagctcgccgatggcaccactgtcggctacaagaagctcgtttccaccatgtctgtggatttccttgctgaggctattggtaaccaggagcttg

SEQ ID NO: 5189 - DNA, 1762 bp, Aspergillus oryzae
  misc_feature (1)...(1762): n = A,T,C or G
cggccctaggcaccaccctaatctccaacttatcctccaattttccatccctctaactgagtccttacattggcgacagatatcgttacaagggatcttcgcaagcccataaatgtcgcttgagtacctcttcaggcgacttcgtgaggttggcgttcgtgcagtacacggtgttcctggggactacaacttggtggctttggattacctgccaaaatgcgatcttcattgggtaggaaactgtaatgagcttaatgccggatacgctgctgatggatacgctcgaatcaatggaatgtctgctttagtcaccacctttggtgtgggtgagctatcggcgctcaatgctattgctggtgcatactccgaatttgtgcctatcgttcacattgttggtcaaccgcatacgaaatcacagaaagatggaatgctcctccaccacaccttgngcaacggcgacttcaacgtctttaccagaatgagtgccgacatctcttgcacacttggatgtttgaactcaactcacgaagtggcgaccctcattgataatgctatccgagaatgttggattcgtaatcgaccggtttatatctctctccctaccgatatggtgacaaagaaaatcgagggagaacggctggatacccctctcgatcttagtctaccaccgaacgatcccgaaaaagaagattacgttgtggatgtggttctcaagtatctgcacgctgcaaagaaacccgttattcttgtcgatgcttgtgctatccgccatcgtgtgctcgatgaagttcatgagttcgtggaaaaatctgggctacccacattcgtggctccaatgggtaaaggagcagtggatgagactcacaagaactacggcggtgtttacgctggtactggatcaaacccaggtgttcgtgagcaagtcgaatcttcagacttgattctgagcatcggtgctatcaagtccgatttcaacacgactgggttctcttaccgtattggccaactcaacaccattgacttccatagtacatacgtgcgcgtccggtactccgaataccctgatatcaacatgaaaggcgtccttcaaaagattgttcaaagaatgggcaatctcaatgtcggaccagtctcgccgccgtcgaacctactgccggacaacgagaaggcatcaaccgaacaggcgattacccacgcatggctctggcctactgtcgggcagtggctgaaagaaaaggatgttgttatcacggaaaccggcactgccaatttcggtatctgggacactcggttcccggcaggtgttacagccattagtcaggttctttggggtagtatcggctattcagttggagcttgtcaaggtgctgcgttggccgcaaaagagcagggccgacggactgtacttttcgtgggtgacggaagtttccagctgacgctccaggaagtcagcaccatgataagaaataaccttaaccctatcatctttgtcatttgcaacgaaggatataccatcgaacggtacattcatggatgggaagctgtttacaatgacatccagccctgggacttcttgaacattcctgtggcattcggcgcgaaggacaagtacaaaggatacaaggtcacaacccgagacgagttgagggagcttttcgcaaatgaagaatttgcttcggcaccctgtctccagttggttgagctccacatgcctcgcgacgattgcccagccagtttgaaattgacagccgaatcggccgct

SEQ ID NO: 5190 - DNA, 671 bp, Aspergillus oryzae
  misc_feature (1)...(671): n = A,T,C or G
gagaggctttctgagattactctcaagaattaagacaaaatggcgtctataccagttatcgtgaagcaccagggcaaacgtcatgaggtcgagcttgatctatcctcgaacggtgaaacgcttaagtaccaattatattccctcaccggcgtggaacccgaacgacagaaaattctggtcaaaggaggacaacttaaggatgaaaccccattgtcctcgctcaacgccaaaccgggccagacattcatgatgatgggcacgccatctggaggccaaggatccggggatttgggccgcccaaaagaagcagtgaagttcttggaggacatgacggangctgaggctgcaagagcagagggagctattcctgctggccttcagaaccttggtaacacttgctaccttaactctacactgcagacattgagaagtgttcccgagttccatcaggagcttctgagatatcgcccctcaacaggtgctgctggagcatcgaacctctcggaactcaccagttttggcctgggtggcctcggcgcctaaatggatcttacgtcttcgtggcggaatcaatccaaccaattgtttgaaccccagaagggattccccctctaatgtccctgaaggctttaaggaatgggttccccatttggcccaaaaatatcaacggg

SEQ ID NO: 5191 - DNA, 837 bp, Aspergillus oryzae
cttttatactgtccctatcctttagcacttagggctcctttgagagggcttaaataacgtgagggaggatccagtactctgttgaagtcacgggagtccttaccgctagtaaagcgggctttgttcctgagcccccgcagaattctgcctaccatccgagcgcattcggtacaatgggcttcctcggagaaaagaacgatggcatctcgccagagatgaatagagagttgtcccgcgacatcaccaaagcagaggagggtatcgtcgcggaagagcaccatgtcgacctccaccgggacctcaaggcccgtcatattactatgattgctatcggaggtgctatcgggacaggtcttattattggaacgggagaagctcttgcgaaggcttgccctgcagcaatcctaatttcctattccgttgtcggtcttgtcgtctatactgtcatgtgcggcctgtgagaaatggcccgcttgctgcccttagctttcctggtttaactggttacgctggttcgattctgtggacccgcttctttggattggctctgggattggacataactggttaaaaattataattctcacgccggatcaactaacaagttgccgcgatggtttatccatttttggataaagccggacaaagtttacgcaggctgttggaattacaatatttccttgtgaacatttgtctggaatttactactttggggtgaaggtttttcgggggaattccaggttctgggctggcgtggctcttaaaggtgataagcacatccttcggaattatctctggtccttctttcaatcctggatggctgcaaggtgggccccg

SEQ ID NO: 5192 - DNA, 687 bp, Aspergillus oryzae
ggatctttcatcagacgcagacctaggattcacagatcgccagatccttcatgatagagtcacggacttctttattcaggcagctcaattgtcgccttcgggtgcacaaatggacccagatgtgcaggtcggtttaggtgttcttttctactgcgcggaggaatatgacaaggccgtggattgtttctctgccgccttggcctccactgagtcgggaactgtgaaccagcgggaacagctccatctgctgtggaaccgtctcggagccactcttgccaactcgggtcgttctgaggaggccatcgaagcttacgagcaagccttgaatattaatgccaactttgtccgcgcgagatataacctgggcgtgtcatgcatcaatatcggttgctacccagaagctgctcagcatctgttgggtgcactgtccatgcaccgtgttgtcgagcaggaaggccgtgagcgcgcccgtgagattatcggcggagacggtgtcgacgatgaacagcttgagcggatgattcatatcagccagaaccagagcaccaacttgtatgacaccctgcggcgtgtgttcagccagatgggacgtcgggatctggccgacatggtcgtggctggcatggatgtgaatgtcttcccgaaggaagttggaattttaaatgatgccatttaattttcttttgg

SEQ ID NO: 5193 - DNA, 665 bp, Aspergillus oryzae
  misc_feature (1)...(665): n = A,T,C or G
gtacccgcccaaactccttcgactctccctccgcctccgcagacctctgctgctccaggtcagcagtacgacggagcccagggtaacggccaggccaatccttctcatatgccgccgccccctcgtcctccggttgtgattccgcagaataccaatcctattcccacggcgatcacatctccgatgtctgggaacatgatgtccccaaccagcgccggcgggtacgtgcgccgagctgccccagagccaaacaaaagagctctttatgttggcggtcttgaccaacgggtcactgaggatatcttgaaacaaatctttgagactactggacacgttgtcagcgtgaagatcatccctgatanagacangttcaacagtaaaggatacaactacggcttcgttgagtttgacgatcctggcgctgccgaacgagccatgcaaactctcaacgggcgccgtattcaccaatcggaaatccgtgtcaactgggcttaccagtccaacagcacgaacaaggaagatacttcgaaccacttccacattttcgttggggatctgagcaacgaagtttacgacgaaatcctgcaacagggtttctcagccctcgggtcggtttccgaggccgtgttatgtgggacatgaaaactgggtcgttccgtggctaa

SEQ ID NO: 5194 - DNA, 667 bp, Aspergillus oryzae
cgcccatcgacttcgacaccctcaccaaccacgtcgccaaaccagtccaaccgtcgagatggcccaggaacgctccggaattgtggtcggtctgaacaagggccataaaaccacccccctcaacacccccaagacccgtgtcagccgcaccaagggccagtcctcccgccgtactgcctttgttcgtgacatcgctcgtgaggttgtcggtcttgccccctatgagcgccgtatcatcgaactcctgagaaacactcaggacaagcgtgctcgtaagctcgccaagaagaggctcggtaccttcggccgtggaaagagaaaggttgaggacatgcagcgcgtcatcgctgagtcccgtcgtgtcactggtcactaaattcgtttccattcaatccaataaagctttctcctattagccaaagaaaagaatgagataacgaaacgatgaagtgagtcttggtggccgatcacatggagtgtgggggaggttctgtccatacggggaagggggaaatgacaacccgacctaccttctttgcttctatctctcctgggatataggaatggaggcaagggacataattccataggcgtggacaattggacaaaaaaacataaatggatctctgattctaatgcaataccactgggacttggtttcttttac

SEQ ID NO: 5195 - DNA, 671 bp, Aspergillus oryzae
  misc_feature (1)...(671): n = A,T,C or G
taaaagccacgtatgagctgaaacccaagcttcggaggcacttcaaggggagcatataaagtgaacgcgaccgaagtagccgagtattttgagtaaatcagggggagggcaaaaactggcatgagaacgagctaaaaaaaggaaagaaaggaaaaaaaaaaaagaaaaaggcacatcatgggtcgcttttccggcgcagcgagcagactgcatcgcaccctgcaactcagcggtgatacggatcagtggaggaatcgagatctgatccccttgcctccagatcgcacaacctggtccagctgggacttcctctatctatggagcaccgtcttcttcaccacattcggctggcaaatcacttcctcgctcctgggccttggtttgaatgtctggcaatccattctctgcaacatcattacgaaattcctccagacggccgtggtgttctgtgttgcatggcccggtggagtctggcacattggcttcacggttaactctcgctccgtgtttggaatgtggggatcgtatgtgccagtcattctccgtattatcctctgcattatttggtatggcggncaggcatttacgggcggccagctggtggggattatcctgtcgacaaaatttctccggctattattatatgggagaacacacttgccagaagtcgg

SEQ ID NO: 5196 - DNA, 676 bp, Aspergillus oryzae
  misc_feature (1)...(676): n = A,T,C or G
cgccctaaaataagtcctagcatacaaccattggtccgaggagaatgtatatcaagtgagacatcggccttatatctagcctccaaatcgaactaccagcatattttggatggaacccttctccctggcgtatcctatcctgaagcgttagccgaaaatttgagctccaagcggacgaaccataagcttgcagagcaaggccgacgtaatcgcattaataatgcgctcaaggaaattgaagctctaattcccgctgagtttgtcaacatgaaaaatgcgaaagatgctacgccttgcagtctgaaaggcagtgaaaaggaaaaagagaaacccagcaatcagcagatcagtaaggccagcactgtggaaatggccattgattatattaaagcattgaagaaggaactcgaggaaacgaagggcaagctagaggctgctgaggctcggctaggcgagaaagagacttctcaagcccacgacggcgactcagttagccctgaaaatgagcaattggaaaagcccggcgaggttgtaggtgtgcttacaagccctgcaacgaatggccctgcatagtcttacgatggagacatcgtagtgatttgaaccgaatggggtcttttgctagagcacctgtttaatgtgacatgctntacgacagcagaaatcgggaaactgt

SEQ ID NO: 5197 - DNA, 665 bp, Aspergillus oryzae
  misc_feature (1)...(665): n = A,T,C or G
gaagatttcagtggcatttttgatctcattgaagctgtaatgatacagggcagtggcccgaccgaagcaagtcgcgccctgcgtaagaagcttaaatatggaaacttgcatcgccaactaagagctctcactatcctcgatttcctgattcaaaatgccggagaccgctttttacgggaatttgcagacgagcctctactggaacgtctgcggatcgctgctacggaccccatttctgatcctctagtcaaagaaaaatgcaagcagatcttcggacagtgggcagtatcctacaagaacacacccggcatggaacgtgtgacaggcctctacaggcaattaccgaaacgcaaacagccggccaatcaagctaaagcgaaggttctccgggagtctggcacttcggacgaacctcaaatgggccacaccgtgtccatctctgcgggcaatggcccggctacagttctaagtggccctaagcacaaacatactttcagcaaatctctcnngaaggaaaagaaagagaagaaagtttgcggacaagactcttaacctcgaaaaggagaagcccgaaattttacagacaactcgctctggattcggcgctagcacgaatcttctaaaacgcacctaaacttggtcacccgagaaaaacaacggttggg

SEQ ID NO: 5198 - DNA, 637 bp, Aspergillus oryzae
ggtggaacaatattcttgaatccatttctaaatacaaagataaacgaaatgacgataatgctagtgcgggttggatacactaagagccctatggctgctttagttgaaattcgatagtggatagtggagcgaccaagctttccgtactccgtaaataatgcccgaaacttggagcaaccgttacattcttcccccagagatcggcggactctgttcttcaaaccatgcagtgtacttgcgccccattgacttcggtccatccacaaccttgatgcttgatttccttcggcagagtatttgccgtgcgctggacactccccgaggaccttgcctgtaatcgcaaatcgactggaataggggtgtgcaatgcacttagccaacagggctccatggcataggaatcaaaatccgactctgcatgctttggatcagagggacagtcttgtgcacagtctctgcccatccttcgataccccatgactgctctcggcgaatcttgcgttcttcgagattcgcaaattgccacaggtggtgcacagtgttcaagtcgccaatctgaacaaaccaggcaccgactccctccatgacttcacgacgagccctgaggcccgttcgccagtgcgattcccactccaag

SEQ ID NO: 5199 - DNA, 1262 bp, Aspergillus oryzae
gagaaaacgcgaaagcactgacagcaccggacctgatgctcagcgactgaaccgctcctccaacggaagtaacggcagtattccagcccccgatacccaacctaatttcggccatgcctcgcttggctcttatgatacgcatggcctccctggtgcagcatcggagcttaacattgaccagcaaattctccaacatgtcggtccgcagaacggtatctctgatgagaatgctctgacagctaaagctgctttagccgcgcaccaaccgcagaataaatacccacctcccccagacgcgacatttgacagtagccttccacacggcctgaccttcggagatgaaatgggccaagcgataggtggcgctcatggtcacaattccactgctgctgctgtctatgctgcgcgcgaagcgcaaagcatgaaccaaaagccctccgttgggtcgccggaatggcatcaaatccgcaagaacaaccacaaagaagtggaacgtcgacgccgtgaggcgatcaatgaaggtatcaatcaaattgctcgtcttgttccgaattgcgataagaacaagggtgctattctgcaacgcgcgattgaatacatctgtcaacttcatgacgaaaagaaggcgatgagcgagcgatgggaacagaataacatgactacgagtcatgccatcaacgaaatcagcgcacagaactccaaattaaaagtcgaagttaatcgccgtggggatattgcgctcaagtggctgcaacgctgtcgcgatgcgggcctcgagtttgacgattatgaggaggccaaggagctggaacctctggaggttgatcagggccaggtttgacatccggttcacttctctttgctgcgtatacataagtcgcgagacttcatttctgcgatgatcttcgttccgtactaaacgtgccacgacttatatacttctcttttggaaggctggaaatcctgacatagccactctttctggacatctcctttcctctgcacatctcgatgggcctccctcccttgaacaaacttttccagatctgccgagatgccatctaacaacggcatcgtgtttttatggaatttgcaggtacagtctgagtacatcttccactgagagtgagtacgtgactagtctttacacgctaattgtttaagcctgggtgcggatttgtgagatgttcttttctctataggcgtcacccctccagaaattgcttttgctcactctattatcttcgtgacgctatctttaa

SEQ ID NO: 5200 - DNA, 653 bp, Aspergillus oryzae
  misc_feature (1)...(653): n = A,T,C or G
tttccttcgcccggtgagattgtttttgctgccttaattaattcgcgttctttaaattacacctctcctctctctaaacctccggcaacccggcattttctaaatctctccctttacactcaccttctctccccgcgtccagctttccccgctcccggaccaccccgccacgatgtcctccgcctctgcctctaccccggagacaatccgggacgacgtcaaggtcgccgagaccaaggctgtcaaccagactatcgcgcagaatcgttccctaatttgctggtgctgccggtggtgtgtgcgccgttgtgtcngacaccccttcgactggggaaaggtcgtctacgactgcggagaagggagtgtactncggtgcaaatgatgttgtgaaaagacggtcgccgccagggtcttgttcgcgaatggatgctggtggttctgctcctctggccgaataacccctattgtcgctggcagcttctgggggtatgaatgtggccaaacgcctcgtaacaaagtcttccgaaggggcggtgaagaccaacaccccccatacaccattgggcaaaactcccgcggcggtttttttttccgcattccccagaaccttaatacagcttctttttaaccaaacaaggggcccttgccaaacc

SEQ ID NO: 5201 - DNA, 822 bp, Aspergillus oryzae
ttcacgttccccacgggccctcttcttccattgtcatccttctctttcagccgaaccatcattttatcgcacaaatcttgtctcatcttcttccttcttcttcctctttcctctattgactcccatctcagcctcttgttctactctaccaggacttcagaatgtctaaactgtttatcggcggcctggcatggcacaccaccgacgagagtctccgttctggtttcgagaagtacggtgctgtcgaagaagctatcgtcgttaaggatcgtgacactggtcgcagtcgcggattcggattcgtccgcttcagctctgaggctgacgccgaagctgcggcgcatgaaatgaacaaccaggagtttgacggccgtactatccgcgtcgacaaagccagtgaacgagctcctcgcaacgatggcggcttccaaggccgtggcgggtacaaccagcgcggaggaaacggtggaggatacggaggatatggtggcggatctcgtggaggatatggtgacggcgactggcgcagaagcgatggtaactaggctaaggcccttgcctttaactaaagcgtggattgaagtacggtgcaggtggactgatccttttcgtgcattggttaaacggacttcatcgctcagataagcttctatctcgataaatacttcatgaaacacgggccgcagaagaagaattaaacgcaatattaccgcggaaccatggttttaagaatcacggatgccttatctttgtttttaaaggcataccccattactcgttaattattgaatttccatgacacagagaccaattgcaatttat

SEQ ID NO: 5202 - DNA, 574 bp, Aspergillus oryzae
  misc_feature (1)...(574): n = A,T,C or G
cgagggatacaccgagtaccccccggacgccaaccgtggtttcaacgttgccccggcggtgattaagctcggtggacatgaaaacccgatctacatgcgcacaaccagccttcttttgccgctacccacgccggattttagtatgccgtacaatgtgattatccttaccagcacggttatcgctctancgttcggaagcatcttcaaccttttagtccgtcgcttcgtctccgccgaagaggcagccgctctcacatcacacacattanaggccctcttgcaagcagagtcctaacaattcgggatcggattaaaggaaaaaacccaaagggtaaataaccctgtcacattataaacaaattatgcccattccttttttnttcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 5203 - DNA, 662 bp, Aspergillus oryzae
  misc_feature (1)...(662): n = A,T,C or G
ttcactccatctcctctacgctcgtctgtctcctatccggtcacatcccttcacagccatcatgtcaatttcttcgcaggtcgccgctcgctgctgcaggcagatcgtccgcccatccgccgcttctttgcgcctctcttcctcgacatacctgtctcagcggacacggagatggcagtccaccgaggcggaggctgctgcccctgtcaatcccaagatcagccagattgttgaccagatcagcacattgacgctgctggagaccgccgacctcgtggccaccctcaagacccgcctcaacatccccgacctccccgttggcggtttcgccatggccggcggtgctgctcccgccgctgctcccgccgaggaggaagaggctgctcctgccgcccaggagaagaccctcttcaacctgaaactcgagtccattgacgccgcctccaaggccaaggtcatcaaggagatcaagtcnctcctcgggctctccctggttgacagcaagaagttcgtcgaatctgtgccaaaggtcctcaaggagtccgtgcccaaggaggacgccgagaagatcatcgagacgctcaaggccgtcggtgccaggggcatcatggagtaaacggggaataaaatttcgatgaaatgatttatcctggtggatggcc

SEQ ID NO: 5204 - DNA, 1015 bp, Aspergillus oryzae
  misc_feature (1)...(1015): n = A,T,C or G
caagctcaaagtgaacgtttagtaggagttttcttctactacttcacgcatattctttggttcatatattaagccgcattcgtgcgcatctttcaggaaaaatggctgccaacaagcaaggcaagatgcaaaaccttatcaactatcggatgagagttactcttaacgatggccgacagatgaccggtcaaatgctcgcatttgataagcacatgaacctcgtcctcgccgatacagaagaattccgccgcgtcaagcggaagtccaagccggctgctggaccggctaacgctcctctcgtggaatcggaagagaagcgaacgctcggtcttaccattgtgcgcggtacccacgtcgtctcttgctccgttgatggacctcccccggcagacccctctgcacgacttggaacaagcgtcccaggcgctgctgctgccgcagccactctcgccgccggtcctggaatcagcaaacccgctgggcgtggtctacctgtcggacttggaggccctgctgctggtgttggaggacctccacctcctcctggcggcttccctggtttccctcctggtggtttcccaggagcgccgccaccaggattcgctggccgcggagcgcctcccggaggacctcctggtttcgcccctcccccaggatttgcgccccagggcggacctccggccggntttcaaccccctccagattccagcctccggcccagggacgtgaatttcttccaccagaatttggaggacggtgaacttcccatgtcaaccggaccattcgctaacattattccaaccccaattgaaccagggcggcttactatggttggatataaaataccgcttccatatcatatacgtgtccaaagataagcttaccacaccgagttttaccgccaagggctttgcggcgtgcgcatatccaggaattgccccatttataccaagggacccctgaaaagaaaatgtcgaggcccacaaatatagggcttatggtgttacgctcttag

SEQ ID NO: 5205 - DNA, 431 bp, Aspergillus oryzae
  misc_feature (1)...(431): n = A,T,C or G
cgaggctcagtccacttgctcgtatcaagtcacacaagatgagctacatcactcgccgaggtctttcgaccctgatccctcccaagatcgcttctcctaacgcaattggcgctgccaaagatgctgcccgtatggaccgcgttgtgaacttctatgcccgccttccccgtggctcggctcctgaagttaagcctactggtctcattggccgctaccaggctcgttacttcggcaagaacccctctgctgctccccttgctcacgccatcggtggcattctcctcctcggctacagcatggagtactacttccacctccgtcaccacaagaaccacccncactaaattttctcgctatgatttgaggggcgcggaagattcgtgtatataccgctgacctagaatgaagcaatgtaaaacacattcaagctt

SEQ ID NO: 5206 - DNA, 1033 bp, Aspergillus oryzae
cccatcttaaccatggcgttctttttgcggcgtccattcgccgttccaacggcgcttcgtcaagtccctaaaacggccaacactgctcgattcttccacaactcaccgattaagccatctcaatccaagcctctcggcccggccacctcctctatctttgcgaaatctagacagaccttccagaatgccttccgtcgtacctacatgcaacctacctacgatgccacccagggtggcaatctcactcagcgacttctgtatggcgccgccatcgttggtggaaccatcctggcgaccaacatgatcttcaaccgcgaaactagagaggatggcggcatggctccctacgagcgcagctatctgaacgaaactttcatgcacactggacttggtatcgctattatcggtattgctgctcgggctatgcacatgaacggatggtcttaccgtttgatggccatgaacccttggctcgtcgctggtcttggcctggttggaagcatcggaaccatgtatggtacttactacacttctcccgacaactacttggctaagtacggtctctggactgctttcaacgtcacccaggcagccctcctctcgcctttaatgttcatgcaccccgctctgcttgctcgtgctggtctttacactgttggaatgatgggctctattgctttcgtcggtgctactgctaagcaggacaagtatctgtaccttggtgctcccctgctcgccggtgtgactatcgtcgctctttctggtctcgctcctcttgtcctccccgctaccgccacccgcaccttaatgtggtctgagaagatctggctgtatggaggccttgctgtcttcggtggtttcacactctacgatgtgcagaaggtcctgcaccactcgcgtatggctgagaggggccttatccggagggatgttgtgaacgagagcatcagcctcgagcttgacttcattaacatcttcatccgtatggtccagattttggccatgcagcgcaacaacaggaaataagctactg

SEQ ID NO: 5207 - DNA, 719 bp, Aspergillus oryzae
  misc_feature (1)...(719): n = A,T,C or G
gttacgactcgatcaatcgccgagtactgccaccagaggagctgttgggtgcttctaataatacagataccgtaaccgcagccaagtccattgttattatactggatgagttcgacctctttgtcactcacccacgtcagaccctcctgtataatctgttcgatattgcgcaagcgcggaaggcccctatcgcggtcttgggcctgactacgaaagtggatgtgactgagatgctggaaaagcgagtgaagagtcggttcagccatcgctacgtctatgtaccactcccaagatcattagaaggcttttccgaaatttgtcgagctggtctggacctggaagataaggaggtttcggactacttggaagaggccaatcccgagacgcgctcacttatcacatccgaaaagttcgcaagggtattggaagggtggagagcgtatttgcagggcctgtggagtgatgaggcgtttcaagcgcatttacggaggatattctttcaaactagatcggcaaaggagttctttaccagcgctttgattggcatgacggagctgcattacagcacctacgaccccacaggcggagctgccacgctccagatcccaacgccaaccacctttagcagccaaagcctatcttgtccaaaatccggacctctgccgttctccacctcgacgacgacctctgccagtccctcgncgctgcccctatctttg

SEQ ID NO: 5208 - DNA, 565 bp, Aspergillus oryzae
ccctaataagtaaggaccctcgacgcttgattattgtcgacagggattttctctctctatttttttgttgtttttgtcttctgcttcctttgtcaacatgaaggtttctaccttgttgaccaccctttgcgtactgggtgttgctagttcggcggatccaaccgcacaatgcgataactggacccgatcaatgctgcgcaacggtcggtttaccgactgacagtgtagtctcacctttacttggcttgctcggagtagttgttccagacatgagcactccagttggattgacctgcaatcctattgtccagggtggatcttgcccaggccaccccgtttgctgtacaggaaataatttcaatggtctcctagcccttggctgtacacccgtcacgttatctacatgaaaacagtaaaaagaaagcaaaggcaggcacgtttcagttagtatttcgatctggttgggggagagggaggccaaaatgtctcggacgaaaattgattacaagtgtacgttgagcagaaatgttcaaggtggtgatgaccgtatagaaacatgtcttat

SEQ ID NO: 5209 - DNA, 771 bp, Aspergillus oryzae
taattcactttaatacttcttttctactccactatctaccacttatcccgcttattacgcctgtcagagcaactgtcttgaaatcagacttttacctgccccttgctgttgcgaacctctcttcggtgacgcaacgactgacacgctcgaactcttgggaatcttttcgagaatcgctagtatcgcccatatccatatatctttcacctaacacaatgtctggaaagttggacaagtctcttgacgagatcctcgtcaaccgtcgtcagggcgctcgtcgccgcaatcgtcgttcaacccagtccaaggctgccccggcagctgttggaggagtcaagaagagcacgaaggctgcgaagccctccggcaaggctgctcaagctggacaccctatgtcaactgaaagcaaaatcatggtcagcggcttgccttccgatgtgaatgaggccaatatcaaggaatacttctctaaatccgcaggacccgtcaagcgagtcatgcttacttacaaccaaaatggcactagccgcggcatcgcgtccatcgtctttagcaagcccgacacggctgctaaagccgctaaggatctgaacggactgcttgttgatgggcgtcccatgaagattgaggttgtcgttgatgccaaccatgctcctgaagtccccgctgccaaacctcttggtgagcgtgtcgcacaaaccaagtcccagcccaagccggccactgccagcaatgctaccgacagcactcgtggacgtggccgtcgcggtg

SEQ ID NO: 5210 - DNA, 664 bp, Aspergillus oryzae
ctcaatttcaactccatccaatatcgcaacgccgtcaattcgcctcgcccattcatatactttataaatttccattcaattaataacccatagtcaacatggttcagcttcaagaagtcgaggacgaacactacgcccaggagaagccccaggtcaccaagaacaacgttcttcttgcctcggacgacgaagatgatgactacactgataccgagtctgaaatatccgaggactccgatatcgagctcgacggcgagaccttctacgagcgtctgtccgctctgaaagacatgatccctccctccgcccgccgccaggtcaacaacacagtttcctccatcacctcattcacaaagtccagtctcatgttcagcggtcgggcactctgggttatcagcaccagtgctttccttgtcggtatcccattcgcgctcgcctatgcggaggaggagcagtacgttcagatggagcgtgagcagggcatgatcaagggtgccaacgagatgctcacccccggtgcgatttccgaggagcagaagcaggctcaacctactctgtaaatggacatcgctagtgaaggcaaagaccgcaacaggtgtcaatgatcagccatcaacagctttaacctatagtctacgctcgaaccgcctgttgctgtaaagcc

SEQ ID NO: 5211 - DNA, 939 bp, Aspergillus oryzae
  misc_feature (1)...(939): n = A,T,C or G
cgatgccatcccacatacgtgtctctgacgcatgaaagagccgagatccgggtctcgtgctgcaatttaatcgatcgaagattcaactataaaaccccaatcaaatccctcacatctgcggtatcattgttgctgattatcggcacttatttatagggtactagtcaccagcagcgtgacttgcactatgctctagcttatcatttgcccatttctccaactgctgcactccatcatttacatcaccgttggagagagcggatacttccagcacccccttcaccgtccatcgaatactcctctgatcacatattctctcccatcctgtccctttctctggtgacccagtctttcatcctctaacaatcaatcccccccacttgtttttgacggtccttttgctgagacaatctcttcgtattaactatgaagatccgagcagcccttgcgctgagcgcaacggcatcgggcgttctggccgccgtagttccacagcaggcactgttgaataacccccaaatccatcacgaaaatgaaaaataccttatagaattggcaccttatcagacaagatgggtgacggaagaagaaaaatgggctttgaaattggatggtgtgaatttcattgacatcaccgaggaacgaaaccccgggttttaccccacactgcaccaggctagtaacgtccgatatcccacgaagatggaacatgtcgaggaggttgtcggcttgacccaccgcctaaccaaggccaacatggagcgggatctggaaaagttcacctccttccacacgcgctactacaagtcccagaccggaatcgaaatcgcgacgtggctctacaatcaagtccagacggtgatcgaacaatcgggggcagcggaacatggcgcgaccgtggaccggnttgcccattcgtggggtcagntcagcattatt

SEQ ID NO: 5212 - DNA, 1268 bp, Aspergillus oryzae
ttttctagcaaacctgcttgaggcaggttctcacttattcgttccttacgttcaaacgtcattcagccatcaatctgtgattgatccttacattcctttccgtctgcccagttaaagatgttccgatcagccctgttcctcctcctcgctcccttggcgctcagccacacaaccttcaccactctctacgtagacgaagtcaaccagggtgatggcacctgtgtccgtatgaaccgtgatgccaacaccgtcacataccccatcgagcccttgaccagcaaggatatcgcctgcggcaaggatggtgaaaaagccgtctcccgggtgtgccccgcgaaagccaactccctcctgaccttcgaattccgcgcatgggccgacggcgccaagccgggttccatcgacatcagtcacaagggtccctgcgccgtgtacatgaagaaggttgacgatgcgacagccgataacaacgctgcgggcgacggatggttcaagatctggcacacgggctacgatgagagcaccgtgaagtggtgcacggagaaactgatcgacaataacgggttcctgtctgtgcgggtaccctccgatattgaacagggctattacttagtcaggacggagctcctggcgctgcatgctgcctctgagacgccggctgatccccagttctatgtcaactgtgcccagatctttgtgcagggtggtggtagtgcgaagcctgagactgttagcattggtgagggtttttactcattggagagcccgggcgtgaagtacaatatctatgagaagcccctgcagctaccctatccgatccccgggccggctgtctatgagagcaaaggtgttgaggagcgttcggtctgtccggcccagaagagggctgtcactgctcagaacaagggtctcaagccggccgggtgtatcctgcagcgtgataactggtgtgggtttgaggttcctgactatagtgatgagaacggttgctgggcttcctccaagaagtgctgggatcaaagtcaggtttgctatgacaccgctcttcccacgggtgtctctgcctgcgatatctggatgaccaagtgcaattccattgacgacgcctgcaacagcggcgatttcaacggacccccgaacaaaagcaaggttcttacaccaaaaccaaagacgcttggtggatcgacccaggtctttagagagatgtaaggaagtacaagaagtggaccgcatgattgaagcatggtgcatggagtaacaggcgtatg

SEQ ID NO: 5213 - DNA, 647 bp, Aspergillus oryzae
cgaggggagctgaatcctttccgttctctggcatcttcttgtcgtcgccgaaaagtttatcaaatctatcaataaaccacctacttcaagttcatcgcgaatccttcacatcctcacagtcccaaaatggccgatgcaggactccccactggcgatgcccctgctcccgttgagcatctcaatatcaaagtgaccgacaacaacaatgaagtcttcttcaagatcaagcgttcgacgcagctcaagaagctgatggacgcgttctgtgagcgtcaagggaagcagatctccactgtccgtttcttggtcgacggaactcgtgtacgcccggaagacacgccagacactctggagatggccgacggcgataccttggaagttcaccaggagcagatcggtggttaggaggcccatccgatcgttttgtttcacttcttgtcacttccttttttccttcatccttcgcatttttttgagacacacaggcgcaatggtgttttggcccggtcgggctttagctggaacggggtcgcctacgggcttgacttaagcttagaaaagctttagacacaagcgaactaaaaacatgctgggctgtggataggctatttaagtattacgaattaactacttacgacataaaaaaa

SEQ ID NO: 5214 - DNA, 780 bp, Aspergillus oryzae
cccttcagccctacccatgacaagcgagcgatcatggcaacttcatacgtgcctgtcaattgcggacataccaagttcgaaccatatcttcctcctcatacagaagcagtaacagaccagctgtttcgatcctacgggatgcccaacgggacaacaataaaaggtttccggattgagtccgggttcgcctccaatgacacatcgcctagcgacaaacaataccctgtcataatcttctccccaggcttaggagcgtcccgattgtactactctttaatcctcgagtccgtagccagcacaggcttcgtggtagtctccgtggaccatccctatgacacctcgagtgtggatttccccgacggcagcgttatatacggtgtcaacgtctctgcagccgatcctgtcaccttaaatacccgcgtccaagatgtcatcttcaccctggaccaaatacacgacaacccgcaccttataccatcctctttcacagacaccctcgaactcgacagagtcgctatagtgggccactcattcggtggcgcgacagccgcagccgcgatgctgaacgaaccccgttttgcgggtgggctgaacttcgacggagcgctctggggccccgtagtcgaagagggtctcgaccggccttttatcaattttggacacgcgaacattacacaactggataacaatagctggggaaagatctggcctcatcttcggggattcaggcgagagcttcagctggctggttccctgcatctcaccttcacggacttcccg

SEQ ID NO: 5215 - DNA, 671 bp, Aspergillus oryzae
tgaagtcttacctgatgactgggctcccccacgtcgaaaaagtagagcaactcatttgctcacctagaaccactttttctcgattgaagggcacgcattccaagtgactatgtcattccaacccactccgtcggatgtttctgtcctcattaccgcgcctacagcaagtgccaattctgagccacacttcgtcacggagcgtcgaatcactccaacatggaccgttattcaattaaagtcaaagttggaaacaatgacagggataccacctggcagtcagagcttaaaattgaagacaccagggtttcctgaccaatggcttgacggtgatgagaacattatcggtgattgggagttgagaaagggctgtgagatcgaggttcatgattcccgccctccttcagcacggccgaactttcatgatctatcctctgttgaaaaatacgttcttcctgcagccacctatgagtccctaccaaattcagtattggcgtggaaaaagcaccagaaacttggtcggtttgatccaaatgtactatcgccgtacgaatcggcacgcaagccagctgaacaagacgcctaggatattgggagtcgaggtaagaagcctaaatggaaacgcattccataaagagaaaatgaaaccaaatctttaactatcagaatgctgg

SEQ ID NO: 5216 - DNA, 661 bp, Aspergillus oryzae
  misc_feature (1)...(661): n = A,T,C or G
gcaatctccgtcaatcactttattaccccgtcacagcacaccatccaatcagcaatggctgctattctctcttacttgcctccttttgagggctttctgcccaagtggcttttccttgtctcggtggtctcttncgcaaacagcattcaagcgtaccgatccgattcctacgccgcggagctctacaatggacaatccgctgatggtcgtccgttaaccaaccccttatcctctcgcaccttgggtacctgaactttcctctccgctgtgatccgaatgtacgcagcttacaacatcacgacccctgtggcatatgaccttgctatatggactttcggaatcgccttggtacactttgttggcgagtggctgggtttcggtagtgcccaactcaaggggcgtttcgtcagccctcttattgttgcgtcatcaactttagcttggatgttgacacagagggaaagctatctctctgcctaatttttttacatgcgagacgttaacctatccctcgatgtattacttccctcggtctttctctctactcgagctcccggtcattcgcacgaaccctacctgcagtcccgggtgtaggaaggagaaaattaaagaataatagatacccatgggctacaaaaggtggttctgtgccaaaaaaaaa

SEQ ID NO: 5217 - DNA, 711 bp, Aspergillus oryzae
ccttatgcggacatcaacctatggcgtcggttttacttcctactcgccgaggagctaaagaagaacatctgtaccatgaatgaagccagtgtttcggtacaagtcttcgacttccaccttcgtatcgccggtcaggataccagaaagtacaacttcaaagcttacgatgaggtgcatttggcgcccatgggatacttccagccatccattttcgaccattcactaaaactcaacggacgaaagacattgatatcccgctcagtcgacatctatgacggccaaccaaacgacccaacatctgcagcgcaatcagaactcttgacagccattgctcctcctcttaatggccaggtgaatggcgacactcagtccggtactttagatgtgcaatcgactccgagccggtcccagcaagtaaatgcccttagtcgcctacaagaggccgaagctactcctcgatcctcagttgccggatctcctgcaccagatgtgaccagtactccgcaagctggtggtgctggtacacctgcgggtcggtggcaaaagcagagcacatcgcagcctcgtgcaccgaccgttgaagagcgcgacgatatatttgccgacgttcccacttgatagggcgaaccttaaggctattgctcaggctgctcggcctgatgaccgtaaaaggcaaactttcttggcggtatattggttgttgtaggcggg

SEQ ID NO: 5218 - DNA, 651 bp, Aspergillus oryzae
  misc_feature (1)...(651): n = A,T,C or G
atcctatagtttatttactagctacgggataacaaccattggataatctctcaagatgtcttccaacacgatcaccgtgaccctccaccaactcgcaaaaatgatcgaccactccctcctgcacccgaccatgaccgacgaagacattgttgctggtctgcaaatcgcccgtgcgagcaacgttgcaaccgcctgcgtgaagccatacctcatcccactcgccaagaaagagctcgccggcagcgacgtcctcgtttgtccggtgatcgggttcccccatggcaacagcacaacggaaatcaaagtgatcgaggcgacagcagcagccaaggcaggtggcaacgagattgacatggtcgtcaacgtgggaaaagtccttggcggcgattgggactatgtgaaggaagagatccgtcagatcaacgaagcggttgtggctaaatggtgccatctcaaggttatcttgaaaatgatatctnccatctcagcatatcactagactgtgtgagatctgcacgaaattgaaagtcgcttcgtaagacctnncaccggtatggcttgtcaagcagaaggatgatcatacaactatcgtggagcgacggtcaggatctncagctcatgagggagaaatcggggaggatgtcagattag

SEQ ID NO: 5219 - DNA, 688 bp, Aspergillus oryzae
ctcgacggagcactcttggcttcttcgagtttagtgtatcctatgttacgtacttgaatccgacataaaacaaatccctcccccctcctcacttgtcaacccggccataatcacctcacatccattggtgccctagccttcctgctttctccgctgaaccgaggttgcgcattactttaaacctgtccattgcgccccataaccacttgatctcccctcctgaacaatctgcgcatatcctctctgtgctgaagcatcccaaatcaacatcaatcatcatcatgtctggacacgagaacaacggtgctccccccgtgggacaggagaagatcaacaccgacatcgtcaccctcacaaggtttctgacagaagaacaaaccaaggtgccagaagccactggtgactgcacactcctctgccacgctcttcagttctccttcaagtccatcgcctactatatccgtcgcgcatccttaatcaacctgacaagactggcgggttcctcaaacaccacaggcgatgacccgaaaaagcttgacggaatccggaagatatcttgatctccgccatgcgcgggtcaaggaaatgccggatcctcgcttcggaggagaaaaagaaaccatgatctttaaaaagcaccctactcccgctacgcaggttgttgggacccccttcaagggtcctccaa

SEQ ID NO: 5220 - DNA, 694 bp, Aspergillus oryzae
cgaggccatttcaccaactagggccttccggggcagggataactatggaatcatggttctcgctgataagcgattcttgaataaccggacccaacttcccaagtggatcactcaggccatgcttgaaagtgaaactaaccttagtactgatatggccgtggccacggcgaataacttcctacgcggcatggctcagccttttaaggccaaagatcaggacagtatctcgacatggagcttggcagatttagaacgacgtcgagagaagcatatgttggaggaagatagagcactacgacgagcactggctaatggacatggcgcaaacggtgttgccaatggtgctgccgccgctgcagatgaattcgatgacgacattgacgacgacctcatgatgtttgatgcacagtgaaagccaagctatgcagtactttttctttccatattttgggctttgtcatccacgccagtacacccggaatgtttgttagctaaatatggtttttcgatctctcggtctttcttagaccgcacaaacatcctggctcattcaataccccaatacgcacgatgcattgtttgtgaacgtggacttgagattgatatagatattgtagtttttacgtgctattattcctgacaaaaacagattttccccaatcggcttggattccacgggggacacgttttattt

SEQ ID NO: 5221 - DNA, 658 bp, Aspergillus oryzae
gtaatattgaccgacatcatgggtcgcaagcgccctaacttcctcgtcgttgtcgccgatgacctgcgcttctcagatatatgctgctttggcggcgagatccgcacaccgaatctcgatcgcattgcgacacagggtgtgcggtttactgactttcatgctgcggctgcatgctctcccacccgcgccatgatcatgaccggcacagaccaccacatcgccggcctgtgcaacctcatcgaatggaccaacatctccggccagaacggtcccaaaggctccgcgatgagtaccgctccacagcgcggcatgccaggttacgaggggtatctcaatgagcgcgttgtggcactccccgaggtcctccgcgatgcaggctaccacaccctcatgtccgggaaatggcatctgggcctgacacccgagcgttcgccatttaatcgcggcttcgatcgctctcgatcccatctcgctgcctgctcaaaccactacgcctatgagcaccagctacagggcaccgatgagacacccactttcctggaatctagctacatcgccctgcacatggcagacgacaagtatgtcaacgaagctgcccgaaggctggtactcatccgatggatattgcgacaagatgctccagtacctccgtaaatgg

SEQ ID NO: 5222 - DNA, 512 bp, Aspergillus oryzae
  misc_feature (1)...(512): n = A,T,C or G
cgaggcgttcaggaaggtctcgctcccgtccagtacgttgacaacgccggtctcaagccaaccatgaaatacccattcaacccgaacggcagtcccgagggtatcgccggtatccgcaacgccaacggccgtgtcctggccatcatgcctcaccccgagcgtaccgtcatgggcggtatcgccagctggctgcccgccaaggcccaggaatggggtgacatcggtccctggggccgtgtcttctacagtgccagaagatgggtcggttaaaagtttgaaattttcttcactttagtagctgaaactggattgtatatgcttggccatatcgtctgtatatgtgggataagttatccctaaaagaaaatctattcccgtcgaaattggttgtcattgcgacgtctttctatattttccctggtttgggatgttccaggatgaatttttgatacgatgccatgcttaggtaaattataaatgaattaaagattttntattgttctcaaaaaann

SEQ ID NO: 5223 - DNA, 668 bp, Aspergillus oryzae
gggaataacgacaattcgtgcgtttggctgggagactcactttcaaaaggaaacccttcttcgagtgaacagttctcagaaaccagtgtatatgctgttctgcgtacagcagtggctgacccttgtccttgacctggtagtagggggaattgcggtgctgctggctgccgtcgtaacctcgttgaagggcaacttcagtgctgcgtcgattggtgttgctttgaacttgctcctcaccttcaatcaaactatcactcgcaccatcaagatgtggactatggtggaaatatcaattggtgctgtatctcgtgtacggaactttgtgcaagatacgccatcgaataaacgtgacttcaatcctgagagcggtaggcttccggacgtggcatgtaatggtgcaattgactctgaggatgtatccgctggtcacagcttcaacgaagcgcccatcctgaaagacattacgttatccataaaaccagggcaaaagatcgcagtctgcgggccttccggtagtggaaagacctacttaattatggcccttctgggtatggttgaaatcaagcaaggccgggtgcttctgggatggcacgacctgttaagttaacgggaagcttttcaaggaaacattaatgttataccccagaatcctctttcctttctgggac

SEQ ID NO: 5224 - DNA, 638 bp, Aspergillus oryzae
caatttacgctatctttattttttccggcccagtgctacgacccgaggacggaggctggatcggacagtcgaacctcagcctggcgatggacagaatgggtcacactgatgggcgcatgaatcattattattaccgtcatcttggtccagcccgaatcctatgcgcctatcttgttcaaaagaaaagctatacaccttcctcgtgtgaccggacacgatcgctacccaccacagatcgagctcagacagacatcgttacccgcaagattgctgctacccatgtatcgaccagtggtaatgctcttccaagagcccaccatgttcctgttttgcttatacctaacagtggcatacatcataattttcaccgtgttcaccggctacgagttcatgtacaaaggaatctacggcctaacacaaggcgaaacagctctctgattactgagactagccataagactactactttgcatgcctctaataccgctgaacacagagctacgctcaggcgacatgacacgcaccacataaacagatcccgcagggaaagcaccaccagaaagccgtttatactgggcaacgatcgacgcttcgggtctgcctatctcgactgtttggatagcttggacatcacgggc

SEQ ID NO: 5225 - DNA, 692 bp, Aspergillus oryzae
  misc_feature (1)...(692): n = A,T,C or G
cctctcctccggncgncggtcaactgngattactcncacggngaactccagtcacaatgacatcgtatgaattgaaaaaccacgtacccgccaataacgaggtccgcatctcgggtggttattccacaaaggatcacgataatgctgagctcgcgcgcttgggaaagaaacccgttctgaagcgaaccttcggaatcttgtcgagtctcggtttcagttgtaccattctcgccacgtgggaagggttatttggtaccttcctcatccctttgcaaaatggtggtccagcgggcgcggtctactcgttcatcttcgtctggacgggaacagcatgctccttcgcggtgctntcggagctggtctccatggcaccaacgtccggagggcaatatcacttgtgtgcgatgctttccccgccgaggatgatgaaatgcctgagttacatcaccggctgggtgacaaccattggctggatgtctgcttttaccagtgccagcttcttggcggggacggaaattcagggcgttgtgacccttgcgcacgacaatatgatcccaagccatggcaagcaccttattatgttggccgcaatatactacctctgggataaacatgtcggaggaagtggttccaaaattcaaaactcgtttcaagcgtcaaatcctggggaaattccgaacctgaccccttgc

SEQ ID NO: 5226 - DNA, 645 bp, Aspergillus oryzae
  misc_feature (1)...(645): n = A,T,C or G
gcatggtgtcaacaaagactgtggacaaacatacagggggggctgggcggcatgcaatacgaagtccctctcacttcacgacgatgccgcccatcacctcgacccctcatanggggggcgctgttgtggagctcattcttatcgcaatnatcaaaaggcaggctgttgtcagacttgtgacgaagtccgagaagcttatgctcaggcctcgggggcctttggtcgcggcgagggtgttgagcagtgtgagcgcgatcactatggcgagaagttggatgcgcaacgagaggagggctgccgcatagagggaggtctacgcgtgaacaaggtcattggtaacttccatgtggctcccggacgaagttacagcagcgggaacgtgcacgtgcacaatcttaacacctagtgagatgtgcccaagggtttccgcgacgatcttaataagctggtcacgtacgtcggttgcgcacgtgactcgctcagatagtgctgagaggtcgcgcaaagaacacggttgggaccgcccgcagcaaactttgaggcggactcgtgcgggggagcgcgagacccagagagcactctagagnnctttgaaaagattgccccgactaatatcttcctcttgggggggaaaaacaggggcat

SEQ ID NO: 5227 - DNA, 689 bp, Aspergillus oryzae
cttcatccgaaggccccagtttggtctcgcgtccaaccgtcttgacacccaatcattgccctgtagggaccatttcaaatattcctgcctatcacaatggatgtggcatctaagcagtcgtcgaagctgctacggtcctcttccaacgccatcacgttccgtttactccaaaacccctgtctttctacctccgcactacaagttccaacaacttgaataacgttccaccaacaaatggggttttctaaccccgaacctcatcccccaattaattttgaaacttgggggttgggtcgaaacctgaaggaccccttcttacttttccaatcgctggggctccccatgaccacggttattcaattcttccttaacaagacagcatggatcttgtaacggatgggaaagttccaccggattttgaaccctgttcttgcaaacctgattacgttaattgaccggattgcatttgtaaacagcttgacggaatcggccttcaaaatcccaaccccaaatgcttttacggcggaaaacgtcacactaaagctgaatggtgggctggacacaaaaagttttgaaccctataaaggaaactacggggtggaggaatccggaatattcatttttcaaatttcgccaaaaaaaatatcgctctaaaaattgggcaagtttaaccttcaaccattgccact

SEQ ID NO: 5228 - DNA, 695 bp, Aspergillus oryzae
  misc_feature (1)...(695): n = A,T,C or G
gcgagctgtcctcggtctttctgctcttatatattgacaatagatcatttcaccatggccgcttccatcatggaacccctccagcaaaatatcatcacccctctccagccttacctccgtcagatcgtctcgtcgctgccggaacccgtccacgataccgtcacctcgctgatcggatcatcctgccacaacgctcttttggttgatctcgatgtcaccaaagaccctgcctgcacgtcccttgctatctccaaggcactcggaattgccatcgtgggtgccagcgctatcgtgaaggttccccagattctgaaattgatcggatctcgctcctcggccggcgtgtcctttgtgtcgtacgctctcgaaactgctagcttgctcatcacgctgtcgtacagtgtgcgcaaccagtttcctttcagcacttatggcgaaaccgcgttgattgccgtacaagatgtagtggtgggtgttttggtgttgaccttcgccgatcgatcaactgcggctgcggcgttcattgccgttgttgcggccagtgtgtacgctttgcttttcgatcaaactttggtggacgcgcagactatgtctcttttgcaggctggtgctggtgccctangcgttgcgagcaagcttgcccagatcataaccattaggctgcgaaggaggcactagnatcacgtgagtgcttn

SEQ ID NO: 5229 - DNA, 659 bp, Aspergillus oryzae
  misc_feature (1)...(659): n = A,T,C or G
ccagggacttcatcctcaattgattccaaaaatggattctttcctgtttttggcgctcgactatagcctgagaggctttgccgtgtcactatttggcacgctgtggatagccctggtcttttggtatctagcgacctatctcatttcccctttacgcaagatccctggtccctttctcgccggatggaccaacctctggcggatgtaccatgtcacgcagggacagtctcaggtggttctccatgagctccaccagaaatatggcccagtggtgcggatcgcccctaatgtcgtcgacttggatctgcccgagatgatcaaaaccatctacaacacaaaaggagactatcgcaagaccgaattctaccatggtagtagtgccaaaagcaatggtcgaattatttacaatctattcagcgagtgtgaccccgatatccacgcgcaacaaaagcgacccattgcaaagtattactccttgaccggtgtcctgccacttgagccccatattgatgaggtgatcaactacctctgtcagaggctggaagaggagttcattaatggattgaacgctggnaatacgtgcannatggaccagtggctactgttctatacatgggacgtggtaggacaagccaccttcagcgagcccatcggctatt

SEQ ID NO: 5230 - DNA, 664 bp, Aspergillus oryzae
  misc_feature (1)...(664): n = A,T,C or G
ggttcgctggacggaccatcaagttggtggatggatgttacagcttttgggtcgggggttgttggccactgattcaatccgcaattaacggcacccaaccagctacagctcctaagcagacctcaactggcaacctctatagccgtgaaggcctgacaagatacatccttgcttgctgtcagggaaagcatggagggcttcgtgacaagcccggaaaacatccagattcgtaccacacctgctatactctcactggactgagcacgacccaatatcaccactaccataccgatgctagcgcaagctccaggggggacttctcctctgcattttcctggaaatcccttcctgtcaccagctcagacaatcaaggatcagacttgagtgtattcgatgagaaggatcggctcgcagcgctccacccactatatgtcattccccatcaggctgccgagaatatgcgtatctggtacgaaaatgcaccgcttgaggtttagttgactctgggcaaattaacgagtgtggagtgcactaaagatgagaaatgatctataaagcagattgctattatttgtacagtaaaaatgcaacaccataattgctcttgcaaaaaaaaaaaaannnnttaaataaaaaaaaaaaattgctgcggccgttccaaccn

SEQ ID NO: 5231 - DNA, 654 bp, Aspergillus oryzae
cgttcaccttaccctcatccaacctcccccccacctgttagctctcagtcacttactacttcacctgctacacatcaacttcacagaccagaagatagtatccattcttaccagtttacgcctcgagtttaaaaaactttcgcagaattttcccttgatctcccttcttccaatatgaatccacaccaacagaacaaagtcgatactgcctccttatcccctgaagagcaacgcctattgcgtctctacggaaagatgcccaccaagaaggatctgttgcagaacaaactgaaggagcggaagtacttcgattcaggtgactacgccctgagcaaggccggcaaagcctctgatgtgggtgtcaccaatattggttctcagcaccccgtccccgaaaacatccctcatttgacggctacctctcctggggcgaataacccagcagctgccagcaatggtggcagtaccaactctcaaggacagcagattcctggcagcatcagtgggcacccgggctctattggttttcaaagccgcagtcccgtgaaagaaggcagctatctacaacgcggaactagcgcagatgagtctgagggtaacacccgctgcacttaaagatgcaaagggacccccagcgtgagtcccgccccctgg

SEQ ID NO: 5232 - DNA, 494 bp, Aspergillus oryzae
cgagggctacatggcctttgagatgtacatcgaggttggacaaatacaacgtgtgggctactgcccgcggaggaggagttactggacaagcagaggccattacgttggccttggcacgagccttgttggtccacgagcctggactgaagcctgttttgcgtaaagccggtgttatcacggtggatgcgcgtcgtgtggagagaaagaagcctggtcatgtcaaggcccgcaagatgcccacctgggtcaagaggtgaagcaggcctatcccctgttgtctcgggagcttcttttcttctttctcattcttctccttgctggattattccaccttcccttgtgaccctcgacgatgtatattttgtattgcacgcatcccttcagatgtcatggcggtcgtttcaaaatacgacactgcttggtctcggcgacaagcatgtacccttagctattggggttaattcgtctgattcaatcgaactattgggaaaagt

SEQ ID NO: 5233 - DNA, 683 bp, Aspergillus oryzae
  misc_feature (1)...(683): n = A,T,C or G
aaccgttctataaatgatctgatacattttctgagagctgtttgcatactatttaccttttcttgatattttcaattagcccaaagagagctgtctgcaggtgaacatgattctttcccagcccttccttgtcgcagcatcggcagctctcctatccccgggactggctgctgggttttcgactgagcttcagagtgtattgaagaacacgcatggtggcaatgaatatgattatcccaccgactttaccaggggtatattgcccataccagtccactcccacaatgattactggagagatattcccttttacactggtctttccaagggctgtgtctcaacggaagccgatgtatggctttataacggtacactttacgtcgggcacgatgaatcctccttgactgaggagcgaacttttgagtccctctacgtcaatccaatgttagacgtgctcaagcgccaaaatccccaaactcgatttgtgacttcacccacgaaaaatggcgtctttgacactacttcttcgcaaaccctttactttttcgttgatgtaaaaacatcanggacctgaacatncgaagctgttatctctgcattagagccactccgcanagagggctatctgacctcgttgaaagacaacaagacagtgacaagtggacccataaccgtcatcggan

SEQ ID NO: 5234 - DNA, 687 bp, Aspergillus oryzae
  misc_feature (1)...(687): n = A,T,C or G
ccgctttcccctacaattgttgtcttttcagtaggagattcaaataattattcctttcagacttctacaaaagtattctcaatagagaaaatgagccccccggccgctttggataatgcgaatggctctcccgcggcccctctgaccgtggagggtattcctgccctgagggccaacagcgccccaattcccaagggtgttgcacctgcgacgagtagtgatatgttcaaaagcccggcatgttatacgaagcccaaagctaaacgctgggatcacattctctccaccgaagctaaatctcggaaggtatccacattgaagggtgccgcgaaatacttgaagaacccaggcctcatatctctgggtggtggactgccctctcctgaatactttcctttcgaggagcttgatatcaaggtccccactccaccaggatttacgcccgaagctactcgcgagtctggaaccgttgtacacgccggcaagagtgatattcgggaaggaaagagtctatatgatcttgaggttgctcttaattacggtcaagccacgggtgctccccaactgctgagatacgtcacagagcacacagagctcatccacaaccccccatactcggactggcaatgttgtcttgactgtggtagcaccttcngatgggatgtggcactcagactcttttgcgan

SEQ ID NO: 5235 - DNA, 686 bp, Aspergillus oryzae
ggcgcaagctactgccacaggaccatgaaatgtggatgtggagaatgcactaactccgcttttcgactactttaatgataactttgcgatcatgaacaagaccttgacatctgaagccatgaaaatggtcatggctcgattatggaaagaggttcttagcactattgaatgcttgcttgtacctcccttgtccgacaagccatcccatcagaaacctctcacgatgcaggaggttgatatagtctcacgctggctcgtgctgctcttgaactttttccacgctgttgatgaagaaactggtgaagcaaacggtgtttcgattgatatcttgaagtcgcccaagtatcacgagattcaatctctgaactttttctactttgaacccaccgagaatcttattcgcacctctgagagaatggcctcagcaaccatatctcggcagcaggccaatagaaaccgagcgtccgcgccggcccatcttggttctggaggatcgggcggattcctcggcgttcctggtgctcggcgagctaagagcatcatgctctcgcggaaccttggcacaatgaagacgatgaaggaggaaaaatggcgcgaagctcaggccgaaccaaatgatgacatgatcttgcgaatccttcgtatgaggccagaagctgctggctacctgcgcgatcgaagtcggt

SEQ ID NO: 5236 - DNA, 666 bp, Aspergillus oryzae
  misc_feature (1)...(666): n = A,T,C or G
tctcctttccttcgaacttcaacctcccccctcctctacttcaattctttcgtcacctgcccactccgtttcacgaccacttgtctcttctcgagagctgtggtcccctccgagcagtatagaaaaagggttgcgcaaatacgtactctatatatagttactgctagcgctcgcctcaatcatttcgccggacctcttgtgacatagcttatcccttgatataatggccgctcgtcattcccgcagacttttgcggcctctgctttatacttcggccgcagcggctgcaggagctggtgttctgtatatctcctaccgtccccgcaacatccctggctcggaagctccggctgtaccaccccctggttatcatgaggggaaacttgtgcctccgagctttccctcaatcaagtcgcgtctggaacagattcaggacttgaaacgcagttccagtggtgatgattcagacgtgtatgacctccttattatcggtgcaggcgccactgggtcangaatcgctttagacgcagcgacacgaggtttaaaggtagcggttgtcgaaagagacgacttcagctctgggacaagcagtaagagcacgaaactggtacacggtggcgttcgctacttggaaaaggccgtgtgggagctagattacaccagtcc

SEQ ID NO: 5237 - DNA, 675 bp, Aspergillus oryzae
gctaagcattactctgccatgaaagcctccgatctcgtccttgtcgaccaagatggctatgtgacagaaggaggcaatcaggcacccattaacgaggccggattcatgatccattcagagatccataaagccaggccggatgttgttgctgctgcgcatacgcatggagtttatgggaagacgtggagcgcatttgggaaggggatcgagatgatcactcaagatgcgtgtaacttctatggaaaactaggtgtttatgttgaccacggtgggattgcattggctcaggaagaggggcagcaaatcgcgaaggctttaggggaggacaagatagcatgcatcttgcagaaccatggtttgttaaccgtaggtcgcacagtggatgaagcagcctttctcctttccagcttggatcacgcgtgtcattctcagctgatggccgaagcggccgctgccaatggggtaccgaagaagattatcaatgatgaagtggctcagtacacggccaatgcagtccagactccgcaccatttctataccgaattccaacctgagttcgacctcatcgtggaggagacaaacgggcaggtgcttctgtgatgggaggggaaatgatatagcgatgagcaacatcctccaagatagttacttgaggctacgaacctgttcatagga

SEQ ID NO: 5238 - DNA, 697 bp, Aspergillus oryzae
  misc_feature (1)...(697): n = A,T,C or G
catcatctcacgcaaattggacctggtcatttgtcatcctcttccattcatccatagacatatagacttgctagaatctctactctttgcctttcaatactctttatctctttcattagattcaactctacccaggtcacgttgcgaagatgcctgcaaagatgcctgatacctacccctcccacgctgaggactttgagtccaaggacaatgccacggactctgattatgttagtggtagctcgagtgacgattatctccccgagattgtcttcacgaaaccacatttgcagtttctcaacagacagctgcagttccttgagcctcaagatgtcttgagatggtgtgttacatcactccctcaccttttccagaccaccgcgtttggtcttactggactcgtcactcttgatatgctttccaagctggaggtccctcgccctcagatggtcgacctcatctttctggacacttttcatcacttctcggaaacccttactctggtcgacaagattcgccagaaggaccccttgaacaacaatcctggctacnagcccaagggcctaactcttgagaaagttggcccagaagaacgggcccgtccatgggaaccggaggataactctatcgatgggccgccaaggtaaagccgacccaagggcctacccggaaatctaagatctctacgtgtctcccg

SEQ ID NO: 5239 - DNA, 876 bp, Aspergillus oryzae
gttttgtctactacatctccttaaatctttactgggctgaacagttactggaccctctgacctaccgctactcttattaatagtctcactcactctcacatcccttgttcaggtgtagcactcgatagaagatcgtacctgaaggcccgtctgcaccccaccatgccaccttactcgggtctccagaggcaacaaatagctcagttcacgaactttacacaagcaaaggatgcagtagctgccaagttcttaaaagcatctaggtggaatgtcgaagaagcaattgatgcgtttttccagagtccccagggcgcagggggtgccacctcctccatcaacaagatattcgacagctatcgagactctccggatgacaaccccgatggcatcggcattgaaggagcgatgaaattcctcggcgatatccaagtgcaactagacgaagtgacatgtctcggcattgcagaacttctgaaatcaccgtctatgggcgagtttactagagagggattcttgaatggatggagggctgtcggatgtgactccatcgacaaaatggttgcccacgctgacaatctccgatcgcggatccccacgcagccggatctcttccgtcgcgtgtaccgctataccttccctctctgccggatgcagggccagcggaacctccagtttgagatcgcagccgaacaatggaaactattctttacgccggacaagggcggagtccagtgggagacggagacgactccatggttggactggtggatcgaattcatggaggagcgcggaaagaaacccgtcaacaaggatctgtgggaacaggttgaggtcttcatgcggaagactcttgacgatgagcggtttgggtggtgg

SEQ ID NO: 5240 - DNA, 551 bp, Aspergillus oryzae
ccatatccctaattatggcttccttggggagctccgtgtccctcatgcggagttgtactcctcgactgtccaaggaattcttcacatgtcgtcaatgtctagggcgaagccagaattatgcgacgaaatccactttccgtaagaattgcgctgtctcgccctttactcagaataccagcaagctcaatacgcctgcttcatttccaagaacgaaaagcgcaattccaaacatcttcagaaggtcggcctcaggctccgcggcagcgaatgctgttgaggaaggtgcttccaatgcaaaatccagctttcctaaggtcagcgataagacggcggcatactggttgcttggcagtgcagctagcgtgtttggcatggtggtctttggtggcctcaccaggttgacagaatctggcctgagtatcaccgaatggcagcccgttaccggatctcttccccctatgaacgcagaagactgggagtctgagttcgcaaaagatcgagcatctgccgatttcaactgtgggaaccgcgcaaggacccctttgggatta

SEQ ID NO: 5241 - DNA, 799 bp, Aspergillus oryzae
  misc_feature (1)...(799): n = A,T,C or G
gggatccccgaccccttgttatttgccactcttggggtcactgcgacctatatcgccatgggtggtgtggtatactatttctgtgggtcttacgtcgcttcaccagctttgggctccgctggtccgactgtaaagaaaatcagctatggctttgcgctaccaggtctcttgatgaccactctacttgtcatccatttaccagccaagtatcttttcatccgtatcctgcaaggctcgaggcacctgactgcgaacacaactattcactgggccacctggctcggttgcacttcgggtatcgctattatcgcctatatcattgccagtgctattcccgtgttcaacgacctggtgtccctggtcggtgccctccttggcactctcatgtccttccaacctatgggcttgcatgtggttatatgataactggagtaagggcaagatcagtaaatcgcccaagtggattttcatggtcttctggagcggctttgttattctgtccggcacctttttgatggttgggggcacgtacggatcagttgtttccatcatcgacagttataaaaagtccggtgggctcggcagcttggtcttgtgctgataactccaattcggtctaagctgaattaccgaggaatgcaaagccgatgtctgtccagcgatataagccacagcccgggggccggctgcaacgagggtgtcagatgggaaaaatgtcagtcaatagctacataaacgagtgtgagggcgccatcctgagtggtcagcccacgtgcgnncgcggtaccaaagtgaggcg

SEQ ID NO: 5242 - DNA, 776 bp, Aspergillus oryzae
gggtggactggagtagccgtggcaagaagaatgcaacgagaggccttaatgcaggcgcagaggcacagatcaatcccagattgatctctattgatgcagcgagaaagaccggccagccgaaccaagtcatgtcgtatgaggcgatcatacttttataaacatagactgtccgaacggtgccggcaacattgaccacgattccaaggctaaaaatggacatcacagcaattcgctgccgggccgggagtttaagattccagatcaacggcatcgggatgaccgtggatatgaagtcggtaaagatattgacgacactagcggcgaatacaacggccccgtcatttagacagtgatgagggtatgtaggctgaaagtcccagtaggcatgaatcgggctgcattggaaaatgcatacaaacaaaaagataatacacagcagtgccaccaagaccattgccccgatcaacactatattgtatgtggtatagaggcccttgctaccggctccgagtagtcgtttgcaaaaccataatagcgcgagcttcgtgatgctggatgatagggaaaagaggatttgaaagaggaggttgaatttggaggcagttggaagccattccaaggggacgtcccatatatgtcggttgcatccatgtcgttcagtggctaagcaaatgtccacgcacgtcgcagtcgtaaaagctagcgcgactgctgtcacaaggttgtccgagcctggagctgctctggcctcgtaccgattcggagctagtatatcc

SEQ ID NO: 5243 - DNA, 708 bp, Aspergillus oryzae
  misc_feature (1)...(708): n = A,T,C or G
ggtatgcctccctatncggtcgaggcgccgctatgaagaccgactcagcatatccggaggtgtcctcttacccactcctaccggacatcaccgttggggttcgatttcctcgcaccgacaactttgcgacagagctctggcggatacaaatccacaggaaagacacccttgtggggcaaatcgcatgatgcatatccatcgtctgacacaacccttattgcaccaatatccaaatatgtcctcagtctaaaacaacacgagttcttggatagagctcttctgggtcaaccaagcaggagagcttgcagctactttaatctacaaggcgcatacgccgcaagtcgggcgctcccatcctcacctgcgacctttgatgaagcacatgtatgatcaagaggctgggcacttttcgacgttcaatcaaatggttgcgaaacatcaagttcggccaacggcaatgtatccgatatgggaggtggcggcaacatttctcggctggtcgactgccgcaatgcagcgcgaagatggcatggactagacataaggagccgagaccgagataggctctgactatagtgaacaatatctggagacactgtcatggtttgctgaactggaacgtaaggggcaagaacttnacgatcatttgaaaggtattctggtgacgctctcgaggagacacaatgaagaattagagcctttggatct

SEQ ID NO: 5244 - DNA, 522 bp, Aspergillus oryzae
gatggcgcataacaatattgtggtgctcggggcgggtatcatcggcttgaacgtggccctggagttatcgaaacgtggctatggacagcatatcacaatcatggcggaacatcttccaggagatgaatcgatcgattacacatccccttgggctggagcgaatttctcgggcatatcgggcagcgatgccaatgcgctgcgctgggatcaatccggctactcggccatgatgagcttgattgatgctggtgcggaagaggcgaagtatctgtgcaaaacagagtcaacagagtattgggatcaagccccatcgcaggataagatcaacagcatgactgaatatctgcgcgatataagggccgccaccgcataaatctccatcataacacacgaacacagttaccagtcaattgtgctaaccttgtgggcttaaaatgatagcttgtcataatacctccatccgatctccctaaggggggtgccttcggtataagatcaatacggcacactcaacgcgcccgc

SEQ ID NO: 5245 - DNA, 649 bp, Aspergillus oryzae
gaaggtcttgaagagtgtgaaaaaggctgccgtgaacaagtgcctcaagcgcggtgtgaaggaagttgtcaaggctctccggaaatctcccgtccctgcacctaacgccccggccggcactcccaatggagtcgtgatccttgctgccgacatctcacccatggatgttctttcgcatattcctgtcctctgtgaggaccatggcattccctacgttttcgtcacatcacgagctgagctcggtaactctgccgcaacaaagcgtcccaccagtgtcaccatggttgttcccaagtcggccgcaaagggcaagaagggtgattcagcagatgatgaggactttagcagtgtttacgatgagctggtcaagcttgttcagaaggaggccaagaaggtgaacctttaaaaatctgagcgactttgaccttcgttacgtgtttttgttatttttaattataaggcttctttatatctcttgtcgcttgctatggctgtacagtttcacctttgatgtctggcaaaaacaacgcatgtcttccgggtcctgccttttggacgtgttcattgggttgatcctttatgatgtgtcccgtgccaaatctggcgtcttcaaatccgtgcccaaaaaaagcccgaaatgtgggaattt

SEQ ID NO: 5246 - DNA, 821 bp, Aspergillus oryzae
  misc_feature (1)...(821): n = A,T,C or G
tcgcagtaacagcccgacgggctgaacatgtccaagagctgcaatcccgatatccccaacttctggtcaccgacaacaacctggataaacgcatctggcaagacgccagaagatcacaccgaacttccacccaagacagtacaacatcacccatcctcttcatctgcacacgcccagcagatgtccccaccgtctcaaaacagctagcgcccaccctcgagtcattggatccgagtgtccgtcctaccgttgtgacaatgtgtcctggaatcaccgtcagccagctccaagactggctaccgacagggacagcgattgtccggtccatgcccaacacacccgttgaggtcaggcagggtgccaccggtctcttcgcatcagaagatgccacggttcgcgtcaatcatgtcaaaaccgttctggaggaggtatctcccctcgtcactattgttccggaagagtcgatgctagatgttgtcgcagctgtgtccggatctggtcctgcgcatttcttcttcgtcatcgaatctatggtcgctgcagcagagtctatgggtcttccgagggaggctgctgagccccntcgtatcaatnnctgctggtgctgngtatctggctagtgcgtcgtcgaagtccgtcgctgatttgcggaaagaagtctgtgttcctggnggaagtaccgaaaggcgattcgcatttggatcaaatggngttcagacatttgtttaagtggcgaatcanaagaagttggatgcgaatttgaaaatgcagtttttgtagcctttatggtaaagtngatagggatagcatttgatcctgat

SEQ ID NO: 5247 - DNA, 464 bp, Aspergillus oryzae
tatccactacctttcacccatccactactatatacatcccttcacaatcgtggtatcacaactgtcaccatgtctctcaagaacgacgctttcccctcctccgctgctttcgatgcgatcaacgccgctctccagagcgacgctgctgagcgcaaggaggctgtcgacaaggccaaggcaatcgtcgctttcaacctgaagaatgacaagggccaggaagagagctggtacctcgacctcaaggagaagggtgaggtgggcaagggtgctccttcggggggtaaaaaggctgatgtgactctgtccctctccgactctgacttcgcttccctggtcagcggcaaggccaacgcccagagactcttcatgggaggcaagctcaagatcaagggtaacattatgaaggcgaccaagatggagcccgtcctgaagaaggcccagggcaaggccaagctatagatacc

SEQ ID NO: 5248 - DNA, 741 bp, Aspergillus oryzae
  misc_feature (1)...(741): n = A,T,C or G
tgcacgcgattcggacgaggctcttattgctcgacttgaaaaaagagtggatgcgatgatcgagcaaggcctgatgtctgaagcacagaggatgtcagactatatccgagaaagaaggacacaaggctctagcatcgatccgacacggggtgtttgggtggcgattgggtttaaggaactagcgccttattttgaagcgctgcacaagagttccctaagcgttgacgaactagagtcccttaaaaagtcttgtattgagtctatcaagattgctacccgccagtattcggcctcgcaaatcaaatggattcgaaacaaattatggaattctcttgcagagaccggtatgacgcatcgcctttacctcctagatagcacaaacgtgggagactggaggacttgcatcacggagccgtccgagctcctaacccaggccttactcaaagacgaatctacgccggacccgaaatcattctcagagttagcaagaaccatcctaggcgcaaaagaagctcggtcgcaaaagggtccaggttccgcggcgaaatgtttcacctgccacatttgccgcaaaacaatggtaaacgaagaacagtggcacatccatctcaatggacatagccatanacgagttctcaaggctatggccaaaagagcagaacgtgaggaatctctacaagctcgaaaagaaagtacgagaaggatctcttngtgacatgaatcactagaagagcagaactt

SEQ ID NO: 5249 - DNA, 518 bp, Aspergillus oryzae
  misc_feature (1)...(518): n = A,T,C or G
catgattcggacgccgaaatcgaaagcaattcagagctgtggcaggtccggacggaccgcgcgaagcatcggaaggatcaactacgcaagattgacaaagtcttcggtgacaaggctgagcgcaaacaacgccaggaatgggaggaagagcggcatgaaacgagtcgggtatggggggtcttgcatggtctaccggcccacgcgcagatgaagacaccctggttcatcctgatccttctcatgacagtcctgcagatgttgcgcatgaattactttatcgcgaccgtgcgatcacagtacgagtttatgctacgatcagtacggcaggcggaaatgatcaacgacttctttgatgttgcgttgcccgtagggggtgtgcttttcacgcccgtcatcgggcttttgctcgantaattcagtgtgccggctacattggcaatgatcgtgctcctgaccacgagtactggcgccgtgaatctgttcccaccggtggacggctttttgaccgnattctctgg

SEQ ID NO: 5250 - DNA, 1241 bp, Aspergillus oryzae
caactatgaagggaagagcccgacggtattgatcgttggtgctggccaagctggactgacaatcgccgcccgtctgaaaatgctcgacatcgatgctctgattattgacgaagaagatcgcatcggagataactggcgtaggcggtatcaccagctggttctgcatgaccctgtatggttcgaccatatgccctaccttcagttcccggcaaactggcccatcttcacgcctaaggacaaactcgcggagttctttgaatgctatgccaagcttcttgaactgaatgtgtggactaaaaccaagcttcagtctacctcctggagcgacgcaaacaacgtatggaccatcgagctccaacgacagaaggaagacggcacagtcgagactcgtaccttcaatccacgtcatgttatccaggcgactggtcactcgggtaagaaaaacctgcctgaattcaagggcgttgagactttccaggggaagcgcatctgccacagttctgagttccccggtgcggaccccaacagcaaaggcaagaaggcagttgtggtcggatcctgcaactcgggtcatgacattgcacatgactatttcgagaagggatacgacgtaactatggtccagcgtagttcaacatgtgtcatctcttccaaatccatcaccgatatagggctcaagggcctgtacgaggagagtgccccaccggttgaagatgccgacttgttcctgtggagcattccgtcggacctgttcaaggcgcagcagaagaaggtcaccgcggtccaaaaccagaacgacaaggcgactctggacggattggagaaggcgggcttcaaagtggaccgtggaccggatgatgcgggtctactgatcaagtacctccagcgcggtggcggttactacatcgacgtgggggccagtcagctcatcgtcgacggtaaggtcaaggttaaacagggacaggagattgccgaagttattccacagggattgcgcctctgccgacggctccgagctggaggccgatgagatcattttcgcgacgggctaccaaaacatgagaacgcaggcgcgcattatcttcggcgacgaggtggcggatcgcatccagagtggttggggatataatggaaaaagcgagatgcgtaccatctggcagcgcagcggacaccccggtttttggtttatgggccggaatttgggcgttgtggcccttcctcctcccaactattggcattgg

SEQ ID NO: 5251 - DNA, 596 bp, Aspergillus oryzae
caacgtggctggtacgaccctgaagtgagagagagacgactcagggaatatggagaagattacggccctgcttatgtcgttgcgggcatccacgacgatggtgtaatcaatcattggaagggcttcaattaccctattatgaacatatttgagcgcggactttgtgttcttcaatgccgttatatccatgccgttatattctccgctcctttttcaccaagtgagccctacctaagagccatgcccctaagtgtcccggatgctgtttatcatggacccaccacatttattccacttacatatgatccctacactgcccccaaacgaatgagcattttcagagaaacaggtagccatgatttccagcatgtgaatgctggcgaaatagttgggaggatcctaaaaagccgtgaagcttatgaagagagacagcgggcgaagtttcacaaaggtgtcattgaagatctgacgaatgctaatgaagactcaatagattatgcaagcgactctggtccacactaccggacgatctggatgtaagcattgccaaaacttgttgactgatttgttaaataatcactcataaaattcctgct

SEQ ID NO: 5252 - DNA, 649 bp, Aspergillus oryzae
  misc_feature (1)...(649): n = A,T,C or G
gcaaaatgtttctttttcaattctcgtcacctccatacctcctcacatcttcccctctcctttccccagatctcatcctcctttctcctcagaccacgagattcctccgcagggcgcggggtcggctcacatagttacggtactttacgggacctccgacccaaccccacaggttataaggggttcactgcgacgccgttctctatccgtcgttcatcctacagcaccggaaccaccatggcagccactaagatcgatggcacgcagatcgccaagaatatccgggcgggtctgaagaatgagatccagcagatccaggagtctaatcccagattcaagcctagcttggttattttccaggtgggcagcagatcggattcaagcacttatgtgcgcatgaagttgaaggctgccgaagaggcgggcatcatctgcaagaatgtcaaccttccggagactgctatcgaatctgagctccctcaggatatccccaaggcccacaatgaccccttcgtgcacggnattctcgttcaattgccctttcgcaacacatgtgcgaacataccatnacctctgtcgtggccgatgagaaaaaatgttaaccgttttcgagccgaccatatttgtggacttaaccagaaaaggcgcg

SEQ ID NO: 5253 - DNA, 646 bp, Aspergillus oryzae
gtaattctcactaccattcaatctcattaagatggcgagctctaccctttgtattcttggctgcggcaacttgggcggcgctattctaaagagcttaatcgatggccccaaagataaacacggtagtgccccgttcacacggttcatcgcatgtgtcaggagccaagaatccgagcagcgcctgactacacaattctcccaccagtcgcaaagcttgacggttacccgagacaacatcaaggctgttcaggagtcggatgttgtagtcttgggcgtggaccccgctgtcgtcgagaaggtgctgtcaactcccagccttacggaggccttatcgaacaagctcctcatcagtgtcgctgctggctggacccggcagaagcttgagaccaccctgtatggcagtccaaccacaacgagcaacgccgaatgtcgggcgtgggtagtgcgtacgctgcctaatatcgctgcgtcggtctcacaaggtctcacggccatcgagatatcatagccagaagtttccgaacactaccagaagatcacggatgcggtctttgacaaccttgtgaaagacagtacacatcccccccgactctgaaggatgcaacgaccgcggtggctggatcgacaaccgcgttctatgctgtga

SEQ ID NO: 5254 - DNA, 1558 bp, Aspergillus oryzae
  misc_feature (1)...(1558): n = A,T,C or G
tgcagtctacttgccagctttgaacgcacagacacaagtcgacaagggatgctatagcgattcgacaccgttgaaggatcagggctcttatacgtaccaaagtaacggatactgccagaagctctgcttgaaggataactatgctgtttttgccttggcaaagggcacaaactgtctttgcggtaaccaattaccggccacgtcggctaagacggatgatagcaactgcaatgtcaagtgcgctggatggcctgatgtgatgtgcggtggtaacaatgcgttttccgtgtatctcacgggtatcgaagatgatgtggatagctactcatcctcatcctcatcctcctcgagctcctcctctagcaccgagagtggaacctcgacaaccaccaatggagggactgtcgttactacttctggtggacaaacagtgttcaagacgtcggaaagcgaaatgacaacacaggaagccgacgcaaagaaggagaaaaattctggatcgaatactgctgctattgccgctggcgttgtcgttggagttgttggtttctgtgctttggtgggagctatcttctttctatggcggtttaggaagcgttccaacatgcccgagcagtatcgcaacaacaatatcgacagctttggcgccaagcccatgtctcaaagctccatgtctgattccaggtttgacggtgacttcatggcccagcggcgccagagcaatggcagcatcgatgatgatcaagacttctcccgtcgaattctgcaggtgaccaatcccgatcgccgttactaaactcaacattgaacctcccaaatggaccaagcccctagtgaattatcgaaaacagcctgggccactagtccgactcgttatcctgatatacataaattagtttgcgatttaacgcctgactgccatacattccttcgatttcatttctgatttcccctctaccgcgcttcatttggcgaccctgcgatatcttggaggcatacctgtagataagttatgacgtttcactgtctaccgttgtttgcaacatgttgttcgagtctggaactgcaacgcatccctacttccataatccagcaacgccccgtgacgtgttcggggagtcaaggacgatatcatcatcgcggcctgcagagaatgctgtgtctgcttggaaggaatcggcccggacttggccttacgaatgtgtggacagtcacgagatacccaggagggtccgaagtttagttctgggtttagactgcggtacgtcgaccagagaacttgtattttgaaaaggcgttctgcggtgaagtgttcttgaattttccttatgaacatatctgcgttcctccatacctttctgttcttgcgctggggataatcggccctggtttactttcttttgctcggatgttttctatttatttgcgatttactgaacttcccttggccatcatctccctaatgttgttggtatgcttggggaactgtaagtaagatgatggctgagcctgtagttaatgcgaagaatgaatggataccactcnttgttgaaaaaaa

SEQ ID NO: 5255 - DNA, 680 bp, Aspergillus oryzae
  misc_feature (1)...(680): n = A,T,C or G
ggattctacttcttgactggttctgtccgctggaggttcccactgatgttccaatctttctttactattattgtcatgatcggcttactttatcttcccgattccccaagatggctcaccatgcagggacgccatgctgaggctcgcgatgtcactgctcgacttgtgggcaaggtagaagaccacccagatgtagaggaagaactacgcagcattaacgaagcattggaagtacagagtcgtggcgggagcttcaagtaccgtgaactgctcaccaacgggccgtcacagaaccttcgccgctctactttggccatggtctctcaatttttccaacaaatgtgcggtataaatctcgtgacttactacgcaactgcgatctttgagaactctctcggattcggtccagaaatggcacgtctacttgcggcctgtaatggaactgagtacttcatggcgtcactcatagcgcttgcactcatttgacggnaccngtcggccgaagctgatgataaatcgtgccttttggatgatggtctcgatggcatttctagcttgcactgtattcacggncgaaatantggaanatggagcacctaagctggagacacaatatggtgtcacgggcactggngttctatttgntttcaattccttcttcgccattggcttgctcggaa

SEQ ID NO: 5256 - DNA, 683 bp, Aspergillus oryzae
  misc_feature (1)...(683): n = A,T,C or G
ctcccacctaaatccttgcaggaccatttagacttaattttgcttgtggattcccgttgacgctgccacctgccgacacaatgcctgagcacgaagaagatctcgttgcctccaagaccgagggtttcaaggtcggggagaagaagacaatcaatgagtacactgagcttgccaacctgcctcgtggcatcgccccttaccgttatgcaagaacgggagctatggaactccaaaactccattccagctgccccccgagctagtgtgacggtttgctttcttccaccatgcacgcatatatcccgtacgccggtgctaaactttgaacctcatcagataaaaatgacgaatccctaaaccgctggaaggcctctctaggccttgcaaccggtgcaacaattggagaccccagcgatcccaggaagtgcatcatcaagtctctagccctggaggttgagggacgccccgatgtggtcatcgacgtgtccgcacccggtgcagttgatactctcaaggacaagccattcaccatcaaagagggtgcccacttccggatcaaggtcgtcttccaggtgcaccatgaagtcctgagcgggtctgaatacctgcagggtcgtaagaggaaagggtgtagagttagncaggacgangagatgcttggcagctatgcccccacaccaccgg

SEQ ID NO: 5257 - DNA, 686 bp, Aspergillus oryzae
cacatgacaatccacttctgctgcaactactctttcgcaggactctccaacttcctccccaccattattcaagaaatgggctatacgtctgtcaacgcacagggactctcggcgcctccatacttcgcgtcattcctcctctgcatcgtagctgctcttatatccgatcgatggggacatagaggattagtgatcaccgtatctgcggtagtcggaatggtagggtacctcattctcgccgcggtggaggacgagcacaaaaccggggtgagatattttggagtgtggctggcgacctgcggagtgtttcctgcgttgtcgattaatatcacctggctgttgaataatcagggaggggattccaagaagggcgctgggatggctatattggcggttttcggtcagtgctcaagttttgtgagtagttcggcttttccggattctgaagggcctttttatgtcagagggtgcgccattgggtgcgcattgactggtttgatcgccgtgctggcattagggctgtatctgaaattgaggcatgagaataggcgacgtgatcgaatgtatgggacggtggatccagatgtccgggtagatgttacaagggaggggagacatcacccccagtttcggtacttgacttagaatatgtagtctgacagttataccatacacatatcgatgtg

SEQ ID NO: 5258 - DNA, 705 bp, Aspergillus oryzae
tcccattgcgagtctcattccctcttggtcacttttcttccctcgcttttgatattcgcggcaggaggggatgagatcttgaggcacaccagtcacaccgaattatattgactggaacctcggcttgtctagactgaagtgtacaattgaaactttttttcacctccgctctgggaagaaaaacgttttcttcgatcaaagccatttcaattcaccatggctcctgctaagacagacaccaattggtctgtcaattatgatgtgctcagacgggagcatcttttcaagaaccctcccaaggatcgtacagcttatcctgcactagcagcctccatcaagccgcacgttgattccttcaatgcgctcttcgaggacagcaagattttgcaggcaggattgaaagatatcggtaccaagacattcatagacggcgaagcagaaactcctgagcagaagaaggccagacaggcagagggtcgaaaagcaccaaagcggaacaaactccatgttcgcattaaagaagttttcctcgagaagcctgccatccccccgacgaacaatttcacactcgtaaccgcaatatttacccatctgaatgtagagagaggcatgcgacataccgtggcaagctgcccgctaagatcgaatatcgggtgaacaatggagactggatggaggccgtccaaaaattgggccaggtcccct

SEQ ID NO: 5259 - DNA, 717 bp, Aspergillus oryzae
cagaacctaacgaaaccctttccccgttcatccgccaaatacagtcaatatgggtaaggtccacggatccctcgctcgtgccggtaaggtcaaggccgccactcccaaggtcgacaagcaggagaagcccaagactcctaagggccgtgcccgcaagaggatcgtctacacccgtcgtttcgtcaacgtcaccatgaccggtggcaagcgcaagatgaacgccaaccccagctcgtaaagaacgcactctgcgagggtttgatcgtccggcgaccgggaatcccctaggtcgccgtggcgaagggaggctgagaatgtgatgcatatttgcgttggagccatacgtggcatttgaaacggtctcttttttgcttctgatcttgcgaaacgggttcaaagagtcggtttaggatgaataatgttcagttatcgaacttgacatatgggcgaatacaatcacatattcggcttctcaaagatctactgagacaacacgaacttgttttattgtacacttgttttccggacaacctccacaatttcccacttgggtggaggaccactctggcggttcaactccactatgacacaagaagggggtgagaaagacttgccatcccgggaactccccgttctcgaatataccccacccatcttttccctaaaggggcgaaataattccggtgcaaaggaacaccattgtaaatctacgccgcc

SEQ ID NO: 5260 - DNA, 669 bp, Aspergillus oryzae
  misc_feature (1)...(669): n = A,T,C or G
ctcgtcctacaagaaggccggttacgacatcctgaccgaggacttcaagaacgcctccatccccgtcttcttctcggagtacggctgcaacgaagtcacgcctcgtgtcttcaccgaggtgcaggccatctacggcgaggagatgacccaggccttctccggtggtctggtctacgaatacacccaggaggccaacaactacggtctcgtcaagatcaacgacagcgacaccgccactttgctcgtcgactatgacaacctgcagaagcagtacgccaagctcgacatggaccgcatccaggcctccaactcgacccagacttcctttacggcccctaagtgcagctctgacctgatcaagaacggtaccttcctgagcaagttcgacctgccctcccgtccctccaaggtccaggacatgatcgacaatggtctgtccaaggccaacaccggtaagctggtcgatgtctcgacgaccgctatccctcagaagatctacgaccacactggtaaggaggtcaccggcgtccagctgaaggccctttccagcggtgagtccaacacccccggcaacagcacctccggaagctccagctccggctccagcagtgactccgacaacaccaaggacaacgcagccggcaagatgaccgcttncttcatgggtct

SEQ ID NO: 5261 - DNA, 1184 bp, Aspergillus oryzae
cagagtctcttatcattcacacattctacatcaccctacataaggtggaatacatgcgagcatagtcgccaatcacaacgcacaaaagtgacagttactttcttctccgcctttctatatcccgcatacgtcgttccaggagaaggtgacacggtaggcatttctgtgtttggtccggcccaactcctgatcacattctgcagtttgtaaagtttcaccaacactgtcacttttcttggctattgttgtgccttgtggaatctttctgaaaatggcatcccttaacctttcatccaatgggccttcaatagtaaagagctatcaagctgttgtcaactcttccccacccacaaactcttcttcgcctacatatggacaatgggcagtgttttcagtttcagcaccgcttgttagtgcttttcagcaagacacgggcagcaaggagagcgttctaaaggtccagagcaccggagatggtgaacttgccgatcttattgacgaattctccgaaggaaagatgcaattcgcctttgttaaggtcaccgacccaaatactggacttcccaagagtgtgcttattgcatggtgtggggagggcgttcccgaacggacgaagggttattttactagtcacctatctgcggtctcaaaattgttacatggttaccatgttcaaatcactgcacgtgcggacggggacttgactgcagaaggaattatacggaaagttggggacgcatccggtgctaaatactctgcaggagctggacagccggccgccgctcctacaaagccgccaatctcatccaagccagttttcacaccatcgcggaccgatggtatcagctcgaatgccacaccagctgctccccagaaacctctccagaaagatacggacaatgatggctggggcccagatgcccctccagtcaccaggacagaacttgaaaaggtgcagccggcctaccaaccaaccagggttaacatacaggcccttagatcaggaaagccacatgtagcaaacatgcaggttcaacataccaccgaagatcatagcgacgttgtcaaaggcggctatcaaccagtgggcaaagtagacattgctgccataaggaggcaagcacgtgaggcaggcgaaatgaaggatgaccggccggaaccagtgaagggagcatacgaaccag

SEQ ID NO: 5262 - DNA, 655 bp, Aspergillus oryzae
  misc_feature (1)...(655): n = A,T,C or G
cgtatcagacgccgagtagacaggtaactgataaactcctcagttctatcaacgccaagcatttttcttgtttctaggctcaagataaatcgacctgaagctcctctgcccggtgccaccttatctttcattggtgaagttggacaagtgtctgggcaggcgggattgctgatagcaacccgagttgtcctcctcatggcgatcctgaatagagtttaccagactaaagaagccatggccatgatatactctggctagtcgggggtgttcgtataaagaggcttggggaagcttgctgtgaagtaggtactcgcctgtcgtgcaccaaatcgtacccataggcgatattcaccatgttggccaacatcaaaacctacctgaaaggccaggaatcaaggcctggggaggcgaagctcctgcgaaagctggatttcttcatcctttccttttgttgtttgacatactttttcaattatctagatcgctctaacctatctaacgcgtatgtgtcgggcatgaaagaagagctcaacttccaaagaaaccaattaaatgttatcaatacgggttttactgtcggctatatccttcggcaaataccctgcaacttagcatngacctatatcgcttcccgcatcttctaccctaccatgat

SEQ ID NO: 5263 - DNA, 714 bp, Aspergillus oryzae
  misc_feature (1)...(714): n = A,T,C or G
aattcatcattcattatctcattctcatcatgatacagctgttatccagggttaagccataggcaaacctggtgctttttacaacggttatcgaatcagagcagtgtaaaactggcgtcccttctcaagtccagtcatccatctcgatcttttttggaacgagagaaccctaccttcggttcatccccacgctcaacggacgatcgatcgtcttgcgtcggctggtgcccacgcgcagcatgtggacgaggtaggggtctgggcgactatccaaggtagtcagtggcccttttttttccgcgggctccccatcttctcccttttcatttgaacctttttagttctcaacgccgatcttgaccttcttctctgggggagggatcactttgtcctcggcggcacccttcagggtgggaagctccgatacggcctccgcgatgatctctagggacttcttgatctcatcatcggtgatcacgagcggtggagcgagacgaatgatattctcgtgggttggcttggcctgggggacgagattagcaccatttacatgaatagctgggacattcgaagtacttaccaacagacccttctccttcatcaacatacagaggtcccatgcagagtgtccattggtcttcgactcgtcaatgacaatggcattgagcagacccttgccacggacggtctgaatcatcgggctgntgatggcct

SEQ ID NO: 5264 - DNA, 669 bp, Aspergillus oryzae
  misc_feature (1)...(669): n = A,T,C or G
cggaaggggttcaggagccaccaatacccataaagatacatgctaccctgccctgcctcagtccatttattccgtgtcccagcgcttttttaaaactgcgcaaaaatgaatcctcacatatcggttccgcgccaacatgccagtccgtctaattttggcggcacgacaccagcaagccgtggatctagcatccggatgccgcgtttcttcaaaaggatgttcaagtttccacagatggactttgaaatggctatatgggagatgacatcactgctgatcgctcccaagaaagttttcaaatctatctactaccataaacaaactaagaatacctggcatcggcctgacccctctttcacgtatctactttgcttcttcttgctcctcacagctcttgcgtggggtctagcatatgcgccttctttcggagctattgtccgcttgtctctacttttcatctttgtccatttcatcggatcatcattgctggtgtcgacaatagggtactttgtcatcggccgacttttcggtccagatggagcggcagcctccctctctgggttgcgaggcggacgtggacggagacgtggtgcagcacaaggcttgttcgtgcaaccaggcgaanaggatcaattagaatttggatattgctttgatgtctctaaccgg

SEQ ID NO: 5265 - DNA, 688 bp, Aspergillus oryzae
gtcaacgtcgtttctagatataagcgatcctaaggctgtgcttgagaatgcattccgcaacttttcatgtctgacaaagggcgacgtcttcacatttgcctacaatgatcaagtctatgagatggcggttttggaaactaagccagccaccaattcgaatgccatttccgtcctcgaaacagacctggaagtcgactttgcccctcctgtaggatacgaggagccgcaacgcccaagtggtaccagtactccccgcagtggtgtgagcgcaacgaagcttccggctggcgggttacttcatccccatggaaccatggctcaatcaattaactatgccgccattgcccctgagtctactgacgccgccgcgggggcaaaagcggtgtcgtcaaacttccttatcggtggacagcgtctgaatgcgaaaaagggaagtaaggctccaactccaaaggcctcaacaccaacacccggagccacaaaccctcaacaccctcctcctgtcaggcggaccaacgggccaatgccgctccggctcccgcctaatcagttattctttggatatgcaatcaagcccgtgcagaagcgtgacgaaagcggccaggttgtcgaggacgagaagccccgttttcagggaagtggtcaaacgttaagaaggaaaaagaaggataccggaggctctgcaacg

SEQ ID NO: 5266 - DNA, 689 bp, Aspergillus oryzae
ctgccattgacttagctggttcagaggattttcgtcgaacagacaatgacaaagagcgcatggttgagtcagcgagtattaacaagagcctttttgttctggcacagtgtgtggaagccataagcaagaaacaccatagaatcccgtacagagagtcaaagatgacaagaatcctttccttgggacagaacaatggactgacggtgatgattctcaacctcgcacccatcaaatcttatcacctggacaccttaagctcgttgaactttgccaaccgcacaaagaagattgaggttcgtgaggtggagaacgagccgatgttcaaagggcctccgagaccagcagcgcgtccttcagtgactgccctaaggcagcctctgcgtccactgaccgctactgccaatgtcaaccttccagcacttgccaacaaagacaaagatgcgtcaaaagctggagaaaagccagtcaaggcgttccacgtctactctgacaaaccgcggtctagggattcttaccaattcaaaaaacctgagccaccaaagcgtccttccctagattctaatcaccgcttgttaaagctcagccgaatcacgcagccccttcagtcacaaaagcagtacgaagatatatctgccgccaaaattgaaaaatggtggaaagaaggtaaggagaatttggctgaagaactg

SEQ ID NO: 5267 - DNA, 671 bp, Aspergillus oryzae
cgcagaactattacaacgcctttccgcacctgtcactcttttcccaaaatcaacatagaaagattggattctctcaatgagtccgaatacgcggccggaatgagccatgacgctactcccaccgcagtctccgctgcaccaccagacctccgctacatccgctatgacggcgcacgcgaagacgaatatgtcgctgctatgcggcaactaatctccaaggacctctctgagccgtacagcatctacgtctaccggtatttcctctaccaatggggcgatctctgtttcatggccatggatgacacactgccggacccgatggtcggggttgtagtctcgaagctggaaccacatcgcggcggcccattaagagggtatattgcaatgttggcggtgcgagaaaagcattgaagtcgcgggattgccaccaaattggtccaaaaggcaaatgatgccaaaatttggcctgaagccgaacaaaaccgctccaaaaccaaaattccaaaacggccccctttaattgttttaaccacgtggggtcctcacccgaaaagaaatggctttatcttattgaaagggtaaccggccattcgttgggggctaccccaaagggaggggggggggcctatgcggaggggttaaacacaatagggcccctttaattgtttggg

SEQ ID NO: 5268 - DNA, 695 bp, Aspergillus oryzae
  misc_feature (1)...(695): n = A,T,C or G
gttaacgcaggcgtttggattacaatattccttgtgatcattgtctgcattaactacttcggtgtcaggtttttcggtgaattcnagttttggctgtcgtccttcaaggtgatagtcatcctaggtaatatcttgctatctttcattctgatgctgggaggtggtcaccttctcgaccatataagattctgttactagaagagtcttgaagcattaatattatatattagcgaaggatattttagtagcatttttttgatttgttatattatagattctgatttatgtacatgtcagattacgagtcattatatcattatacttctgctttgctacgtgtcacgattttattataatatcattggttccttaattcaatattatactgtacaataatatattgatatctatttttctatcttttttcaataattttactaagagatcttcattatgttatgtctacttgtttattttgacgatcttatttttattttatgctattgattttttcataatatcctagaatttataaatacttaatttctttgccatcttcttttacttaacatttaaactattattattactattaacgatcattattacatttcatttatctgttatgttgatcatctcatcatcatttagtaggtgtactctatttatatcattaatatagctatataatttcg

SEQ ID NO: 5269 - DNA, 642 bp, Aspergillus oryzae
  misc_feature (1)...(642): n = A,T,C or G
cgagtacagtgattgcctcgggtctggtggcgctgtcgagtccacggcctgcatattaccccctccaactccccctccgcgacattggttggcattggcattgagaccgatgtaacgcatcgcgttgtcgctgcctttgctcttccagcccacccccgcccccaagggaatcagaccatcccattgctggaattcgcaattcaccaccgagatcttcgaccgttcacgagacacgaaattaacgaagtgtaccttttatctacccatccgatccggccggtttgcgtgaattgaatcgtcgcatcatactctttggtggaaatttaggaggtacgatacgacagacagagattgtgttggaagaggtcgattgaacctagcatcgcatcgtcccgatctgctcgaggcgctacatctgatcgaataacttcagtggattgagggggaactacaattgctgtttcaatgcggccacaacgggaatatcatattgtcgtgctcggagctggtggagtgggaaagagttgtcttactgctcaatttgtccaaaatgtgtggattgagagctatgacccgacgatcgaagattcatatcgcaaacagatcgaggtagacgggcgacaatgcattttggaaatnctg

SEQ ID NO: 5270 - DNA, 678 bp, Aspergillus oryzae
  misc_feature (1)...(678): n = A,T,C or G
gcttggctgccctgacggtttctaaccattccatcgagaatgaattgaaactgtacggcagctgtttctgtcccttcgtgcagcgtgtatggatagccttggaggccaagggcattccgtatcagtatatcgaggtagacccctacaaaaagcctcagtccctattggaggtgaacccaaggggccttgtccctgccctgcggcacggagattgggggtcacatgaaagtactgttttgctagaatatcttgaagacttgaacaccgggccgcctctgctccctccaggggatgcgaaattgcgagcctattgccgactctgggcagactttatcaaccgcaacatagtgcccaacttctaccgtgtccttcaggaacaggatgagcagaagcagatttcaaatgcgcaagaacttaaggatgcattcgctacgctagtgaatgccgccgactcacaaggcccattcttcctgggagctaatatatcatttgtggatgtccaggtggctccctggatcatccgattgagccgcgtnctgaagccctaccgcgcttggccggaccccgacgcanggagccgatggggcgcctgggttaacgcgatcgaagctaatgagcacgtcaaagcgacaagtgacgatgaactctatattgacagttttaacgatatgcccaaan

SEQ ID NO: 5271 - DNA, 800 bp, Aspergillus oryzae
gaaaagaaacccggacggaccgcgaaggtatggctcagatgcgatcggggcggacactatcgtccgcgcaacggcctcaccgaggagacgaggaaacggcggcgaacgtcgcggttgatggactgtccattcatgctagtcgcagctggaactcctggcatctggacgctgaccgttctaaacccgacacataatcatggcccagttgtcgaaaaaccccggcaagctcctcatcacaaggttcggaagggccaagtcgcggcggcaccgtatgattggccgcatgacgcgactttaacaccatatacgactgcattagtgcttatcgatatgcaaaaggatttctgctcgccagggggttacatggaatatcaaggctatgatatatcagctgcccatgcacttattcctaagctacaacatctcctgaatgcgttccgagcgtctgggtttccagtctatcatacacgtgaaggtcaccgacccgatctctcaactctctcaagtagagaggcgtaccggtcacgaaataacgcttccgggcttgggattgggtccccgggtccattgggccgtctcttaatccggggtgaggttggccacgacaccgttgatgaactgtatccgattcacggggagccagtcatcgataagcctggtcgtggggcatttgctcacactgacttcgagcttcttctccggaataaaggcatcaagaacctggtgattgcaggagtaactaccgatgtctctgtggtcactactattcctgaaagcaaacgacccaggggtcgactgct

SEQ ID NO: 5272 - DNA, 671 bp, Aspergillus oryzae
gaagttcgttctattttcagtcaaggattcccaggccattgaaatagcattccagaacatagccgctgttgagggtggaaaagacgaaaataaacctaacgagggcattggcgaggcccaggaactcacaaaggtacctgtcaatgaggactatctcttcgatgtggatgtagagcgaagggagctcagtccagcatattggataggccccgtatacgaagttcgtcgtgggacatggtttgtccaggacggctccacgattaaaccatgtgaagagaacctcgccacccaacttgaggagggctatctaaaagttaaaccgtggcgctttgaagaagttgaagagcccagcacgttgcgcgatcgtactgaaaatgccgggcatatgacccacgtacctgcaaattctctctacacctatcgcctgtttggcgcctatatgaatagcttggtgacataccaggattcgtcgacagcattactgacaaatgatgacttcatgtcccgtgtgagcaccacggtataccaaaagctgggtggggtgccaggtacacgaatagtacgcggtttctctgagacaaaaagacagaaggaaagccctgattctagaaaccccaaccgaagaatcaaacagggctcatctctactcccgaagcacgccattcagaata

SEQ ID NO: 5273 - DNA, 616 bp, Aspergillus oryzae
  misc_feature (1)...(616): n = A,T,C or G
tatcaggaccatcagctgatgacctacgcctactactcgagtctcctgcccaacgagacctttgacgctatctactcaggtcgcactaacgtcgacgagcttattcagaagaacgaccccatcataggctggaccgccgccgatgtctactcgaagctccggcccagcgacgaggaggccaaggctcttgggtccgcgtttgagagcgcctggaaccgcgactacaagactaacccaacgaagccgctttctatgatcacgtcgctcaatggcttccccggggactccaccggccagcctgaagtccagtacttctcctgctccaccttcaccccgtacccctactcccgtggccacctccacatcacctccaaggaccttgatgcgtcnctcgactttgccacgggctttttcgccgacgaggatgacatcgacatcaaaaagtccgtgtggtcctacaagaagcagcgcgagatcatccgccgcatggacatctaccgcggcgagtttgccccgctacacccggctttcgccgcggactcggacgccgccaccccctcggagccccttgacgggcctctcnccgacgatgtgcccgacattgtgttcacggctg

SEQ ID NO: 5274 - DNA, 654 bp, Aspergillus oryzae
  misc_feature (1)...(654): n = A,T,C or G
gaatattttggcagccctccgaagtttatgtaaccgacttatattaaagggagagacacagcaggttgatcgagttctagatgccttttccatacgatggtgcgagtgcaatcctaaccatgggtttaaggcttcagatgttgtgcacactatatgctactctcttcttctattaaataccgaccttcaccttgcggatattgaacaaaagatgaccaagggccaatttgttcggaacacaatgcccaccatacatcgtgtggccttcgacgcagccccggatgggtttgaagcactccatgtagctcacgataaatcgaaagtgtcggcccgggaatctctgacgtctcatatggatgagtccgatcgcgggaacatggtcgctgataagcccgcaaatgcgccagcaaagctcgtgaatcgactttctcgaactgatctctccgttaaactgtcaggtgatcctgaaaccaacacaggcccgttggtaaatgtgccattcaatggaaccgataaggcctggggccagcaagttgaaaccgttcttaaggacttctatacttcgattcanaagcagagactcccactttatggtgctcaagcagagaaggaggcgcttcgagcttcatcgaaccatttattgtcccctaatcg

SEQ ID NO: 5275 - DNA, 684 bp, Aspergillus oryzae
  misc_feature (1)...(684): n = A,T,C or G
gaagaaaagaactgcggtttgcctgcaagttcctcgtcgattcatctttatatccttagaatatccctaactcagtttccctcactctcaatatgcccgtcgttgcaggtcctcctcaggcccacggcccctctaccttcgacaagatgaagatgggtgctatgatgggatcaaccgtcggcggtatcatgggcttcatcatcggaactgtcaccatcttccagtacggtgccggacccaacggtgttatgcggaccttgggtaaatacatgcttggctctggcgcgacttttggtctcttcatgtccattggcagcgtcatccgtaccgaaggacctcacaacgatgcctggctccgcgctcggggacccccgatgatgcttcctcgtcaaagccctctgcggcccatgcgtcagtagctgcgcagtcaccgacttgtagcggaatggtgggaatgtgaaacttcccacgggttatctgtacaatagtatttatcctgacgaacaatctgtatggccgacggggcacaggcggtcgacagttaatgcaggagaggggatgaaaggaagcagggatgatctctgcataatgtacatacagtctgggcattgggacggacttgagacattttttgcccggtgacaggatgtcttttgggttacaacaaagctaacccggtaatgn

SEQ ID NO: 5276 - DNA, 684 bp, Aspergillus oryzae
cgcctgcgcaaccccgagatcgcgaagtggattgccgaacagggcgccttccccaacgccatggtcgaccgtatcacccctcagacatccgccaccgataaaacggcactcgcagacaactttgccatcgaggactcgtggcccgtcgtcacagagccctttatgcagtgggtaattgaggatcagttctccgatggccgcccaccattcgagaaggttggtgcccaggtggtcaaatatgtccacgaggtgatggagaacccactgttcagcaagtttgtgtggcaaatgatgcaggacgaggtgaagccgttgttgcccgagatcccgggcgtcaacattgatgagtattgcaagacgctcatcgagcgcttctccaaccccaccatcatggaccaactgccccgcatctgcctcaacgcttcgggcaagatcccacaatttatcatgccttcgattgctgaggcgatctgggttactggcccattccgccgcctgtgtttcgttgcggctgcctggttccattacattaacggcgtcgacgacagcggcaagaagttcgaagtcgacgacccgatgcgcgaggagcctccaggccaagctcgcgcaagaagcaccaaccccggccgagcttctcaacataagaagcctgttcgtgacgacctgggcggcgaccagaggtct

SEQ ID NO: 5277 - DNA, 707 bp, Aspergillus oryzae
  misc_feature (1)...(707): n = A,T,C or G
gagtcgtgcctttgaccccgccgccaccatcccccacggaaaagtcgtcgaggttgacaaccctgtcatcttcaaggccctcacctcttccggccccgtcgtcgttgacttcttcgctacctggtgcggtccctgcaaggccgtcgcgcccgtcgtcggaaagcttagtgaaacctacgagaacgtacgcttcattcaggtggacgtcgataagaaccgtcaggtcgcacaagatatgaaagtgagggctatgccgacgttcattgtgttcaaggatggcaagccccatggagagccgattgtgggcggaaacatgaaggccctggaggatagaatcaaagaagttgcttagatattgcattgagagatgggatcacaacagcgttgacggataagcgcatattgtgccccaggaaatcgcaatgattacgaacagttgatacaccaatgtaccgtatagactccggtgccattgagattngcaaagatacccgttcggtcatgttcggcctgcacgttactccgtcgtaactggcctgtttatgtaccgccatttcctccgcgtctgtactatacggctctttcattaatatttctttggactggtaccataaaaccattaaggttggaaaacagggtttcccgtccgctatgccgtgggcatacggaaaatgtccccccaagggagcccctgattttaaatgaat

SEQ ID NO: 5278 - DNA, 975 bp, Aspergillus oryzae
ccgcttctacactgaccattggctctactcagaagatgcatcccatttcccctcatttgcatctgctgacctccgctgcgtgacatctagattaaggaagaaactggcgccgatgtcacaactcgaggaaactattacccggataagagcatggcaactgccgcgaaccccccgctgtacctacatgtgacgagtacgaacaaagaaggcctggaaaaggccgtggatttgatcaacgagctcatgaagaaggaactccccaacctggtcgatgagcgccgattccgtcgacgtgagccggaacaagtggaacgtgatgaatacggtcgtcgtaaatggcccgaggagcggattccagtggaccttgagccaattcctggctttaaccttcgtgcccaggttgtcggacagggcggtgcatatgtaaagcatattcaacagagaactcgatgcaaggttcaaatcaaaggtcgaggctccggcttcatggaacccagtaccggcagagaaagcgaggagccaatgttcttgcatgttgctggacccgatcccaacgatgttaagagcgccaaagagctgtgcgaggaccttttggccaatgttcgagaacagtatcagcgcttcaaggagaacccgccccagcacaactatggcggatatggccagcgtggagaccgttatcagggagggggctatggtggaggctacggtggaggtaatgggggtggcagtggcaatggcagtggtggttatgggaatcattcgcaccagaactcgccctccacgtctggtagcccagccgcgcaaggcgccacagggtcatcgggaggacagaacctatccgactatagcgcacagtatgcacagtactacggatccgatccctacggctgctacagtggatatcaaaactacgtcggctactaccaatactatcagcaatacgcccagcagcaacaagagcagttacaagcg

SEQ ID NO: 5279 - DNA, 659 bp, Aspergillus oryzae
  misc_feature (1)...(659): n = A,T,C or G
gaacattggctactttttacctcacgttggatgttgaggaagcgtatgagaagaaacgcggcgatgtgaaggaacgtgctgaagagttgaccatcgttcacttcaagaccaagggtatccgtcaacagaactcgaaatttggcaaggacaagttggaaaaggagaataagttttcccctcggcaaaaagatcccgacgtcgttgaaaatcccccccctccttattctgctgcaacaagcggcagctttgttgcggcagctaaatcgaaagcgaagccagctcctccgcccccaaagccgaagccggccagattcgctgcaccagtggaaacggtcacagcactgtatgattatgaggcgcaagcacatggggatctcagtttcttggcgggagatgtcattgaaattgggcaacggacagacaaccagaacgaatggtggactggtcgcgtccatggacgggaaagacaagttcctgcaaactacctncaattaattaattcgattctcctttcgcgctatatggcgaattttatcttggtctttgcaatggtcgtttgatgaaccaagagtcttgcgtggaacacttttctcccaggttggaatttttacctctttctatagcgctggggtttggcccaccttcttgtatattatttt

SEQ ID NO: 5280 - DNA, 685 bp, Aspergillus oryzae
  misc_feature (1)...(685): n = A,T,C or G
gaagacgacatggattccgctgctgactttattgttatcggaggtggtccggctggcagcacagtggcaagccagttagccaattccccgaagcatcccaaagtgcttcttctggaagccggaggcctcaatgctgagcacgacctgcgggtggacggtcagcgatggctgaccttccagaataaacacatgaactggggctacaagaccaccccgcaagagcactgtaacaaccgcgagattgattactcccgtggacggggcatgggaggctccagtgccatcaactttggtgtatacactgtaggcgcccgcgatgactacgaagagtgggcacgagtggtaggtgatgatgccttccgctgggagcaaatccagcccaggttcaaagccctcgagaccttccacggtgatcttcccgcgggcgttgatccgaagtacgcagctccccgagctgaagaccacggaagctctggcagcctgcacgtcggtttcgcctcagaatgggagaaagatttaccgccccttttggatgtctttgagcaggaagggttccccttcaatgcggaccacaactcanggcaatccattgggatggctggtctgattaaactctgctacaaaggggttcgtccacaggccgcggacctattgaaaccggagcccagagaactttgctatggtn

SEQ ID NO: 5281 - DNA, 695 bp, Aspergillus oryzae
ctctttgcgtttcgataatattgatcctaatccttctatgtcccggtccctggacctgaccgtcctgggactgaatagcggtacttcgatggatggaatcgactgtgctctgtgtcatttccaacaagaaacaccagagtcacccatgaggttcgagcttctcaagtatggtgaaatccccctagagcaaacaatcaagcaacgggttatgaatatgatcctccataataaaacctctccctctgagctatcggaggtgaatgtcatcctcggtgaaacatttgcagcggctgtcaaggagttctgtgcacaatacaatgttgatatctcgtctattgacgtcattggttcccacggacagacaatctggcttctgtctatgcctgaagagggagaggtccgcagtgctcttaccatggctgagggctcattcattgcctcccgcacgggaatcactaccgtgaccgatttccgagtcaagtgaccaagcagcgggccgccagggagcaccgctcattgccttcttcgatgccttgatcctgcaccacccacaaagttgcgcgcttgcaaaatattggtggattgcgaatgtctgtttattccgccgaatccttaggggtgttaatgcctgctacaacttcaatcaggcccgggcaatgtttttatcgaccttgtggccgggcataccacaaccg

SEQ ID NO: 5282 - DNA, 663 bp, Aspergillus oryzae
cgaggggcacagtcgcgcaactggaacctttcatccccaacatcatgccgacccttatcaagcagcttgatctggacatgattaaagatgatgatcgtcacacgggcttcagtgtgttgaacaacgcctgctggtcctgtggagaaattgcagtcaacgaaaaggcggccctatcaccctacgccgacaagctgtaccagggcttatatgtcatcatcaacaacgaggagatcattgactccgtaaatgaaaatgctgcaatggccttgggaaggttgggaatgtgctgctcggatcagcttgcccctcgccttggtgagtacgcgggcgcgttcttgaaatctatgaataagattgaattcacacgggagaaggcttccgccttcctgggtttcaaccaagtggtcatgaagaacccgcaggccatggaagccagccttgcggattacttccaggcgatcgctgccttccctaccaagtctctccaccaggatgattaccgtgatattcagagctcattccagcaggttctgcaaggctataaaaatttgatacccaacttcgattcgttcctcacccagcttccggctcacgttactcagaaacttctgtctgtataccaaatctagattttgtcggcactgctagtgttcaacgagggct

SEQ ID NO: 5283 - DNA, 868 bp, Aspergillus oryzae
cggaaatcttatgatttcatttgttcccaacgcatctccacgaaaatgggccatcttccctccaaactaccgttctcaaagcggcggttaaggccgcgcattgttatctcatacattcttgactatgtgattcttgtcgcatgtatcgccggcttttacatcctcgactctatcgagccgtatcatcagcatttctccttgaacaatatttcccttatgtacccttacgctgtccatgagcgcgtgtccatcccactcgccctttgtatctccggggtggctcctttgattataattgcggtctatacactcttgatcgatgggctgttttctcacaacaagcccgtggacccgacttctggtaaaaggaagctgacaggcccataccggttcaaggaccgactgcgggagctcaattgcggtttccttggccttctactgtcccaaggccttgcgtttctcattacccacggtctcaaaaaatgcttgcggtaaacccagaccagacatcatcgatcgatgccaaccccgaccaggaactgaagatccattccgtggcttgtcgaattacacaatctgcacgggtgatccggcgatcatcaaggacggttttcgttcttggccttcaggacacaacagctcctactttgctggattgttttatctgacactgtggctttgtgggaagccgcattatatggacaaccgcggtgaggtatggaaggcgataaatgttatccttccttggattggcgccaccccttatcgatttaatcggaatatggacgctaggcaccacccccttcgatgtgaccaccggctcgcttatggggcattgtctgtgcctacaccgtataccggtcggact

SEQ ID NO: 5284 - DNA, 684 bp, Aspergillus oryzae
  misc_feature (1)...(684): n = A,T,C or G
ctcatcgagagccatgatctcaccctcaatcctgaagatcctgacagtatccgcaacacgtacaagaacacgcgaactatcttgaacgacgagtttgaactggatcatgataatgccttggaaattattgatgaagcggcagagggctatcaattctcgcgttatttggatctccctaaaactctgacaaggtgtctgcaagatacggatacgaagggtatcaaggtcagacataagctgaagttccgcgttcagttgatgaatccagatgggcacattagcgagctgcgagctacgcttcctgtgtcgatatttatctctcccaacctcgcgatcgacgagaacaataacctagtcgaccagactccgcaatccgctcaacgggcaatcaacgatatcgctcaacaggcacccccgttgtacggcgagcatcagtttgaccagttgtatagcgagcttgaccctaatggttaccgtactccgggacctggaagtggccccggcacaccttttggcactctcagccgcaacctctctgctgaaaacctcgcttctatgaatgctttgacgaacaccgacatctccgcttctgcgctacatagccgtctatcaaacctctcaaaccttcatattactcgaccccatcagccatcgcccaacgaccatgagtctcagaacgacagn

SEQ ID NO: 5285 - DNA, 674 bp, Aspergillus oryzae
cctctcctctcaccacgtcaattcgcccgcgtctccattccaacccccctcacaatgtcgcccgtcactgacggccatgtcgagacccgcgccgtcacgacctgccagcctccttcagagcttctcagttgcccaggccccggctgctaacccgggctgctctcgctatcaaccgtcctgccttcagcacctcattacaagcgtctacgcgggcaccagaaggatgagacatacgaggagttctctgccagattcgagaaggaattcgacggtgtccaaactaccataaaaccacccaacagcctgtacaactgctttgcctacgatctcgtcccttccgttgaggtcctctccgccgctctcagggccgctcgccgcgtcaacgactaccccaccgatgtccgcgtatgcaacggtatcgatgccatggacacgaccgatgaccaggactgacaataccttgacgcacttgacggtctactgcaggaactccgcgttgctctccgtgaagagctataccccggcgagcagtagataatcgaccatagttctcgcataccaaatcacttcttggtcccactgtgccacacgattacataggatagctgtgtacatactctataatgcagatgatgaggcgtgctacgagcactgtgaggggatagactatgcac

SEQ ID NO: 5286 - DNA, 655 bp, Aspergillus oryzae
tcgttgcaacgtcactcccgaatatccacccaggcacagctttggcatccacaagatgacatcgctgatctccgaagggtataaacgccctccatggctcttgcgatatcgctcctctacggtgttcattgtcgcaacagtatggacgtcattgttcacggacttctatctatatgccatggtgagcgagggctctggccgaatcgcgcgtaccttcgcgatgcacctactcatagcagctgcagatagtccccgtcatgccaacagcactggttgatcgcgccggcgtcccataccaagaccgcgagtactgggtcagcgtattacttatgtgcgaagccgccgtcgcatgcatttgctgccccatattcggttacatcgttgacaacacgcccacccgccaattcccttatctgctcgggctcatactcctcggcgcatccatggtcatcctatcaattgcgcatacagtgggattattcatcgtcgccagattactgcaaggcggtgcgacggcaatggtcaccgtcgcaagtctcgcgctcttgacagacttcggttcgttcgacaacctcgggcaggtgatcggctacctaagcttccttgttgcgctggggttcccgcttggtcccgtgatagggggaattttctacga

SEQ ID NO: 5287 - DNA, 664 bp, Aspergillus oryzae
  misc_feature (1)...(664): n = A,T,C or G
tgaatagtatagacgaaaacaagttgcgctcgccatatcggaggtcttgaagccattaggtgtcggtgtcgtcatggagtcctcgcacctctgtatggtgatgcgcggtgtgcaaaaaacgagcagcaccaccacaacgagctgcatgttggaatgcatgcgatctagcgcaaagaccagagaggaatttttgactcttttgcaccggagataatgtcttctacgttgtctgtgacacgtacttgttacccccctttttaacagtggatggtattcatgatttcaacggagttcggggcggtttacctctcaacaggttatttgggtccggttgttctgatttttaccgcgccacacggctggcagatcttatattattttcgtctatactcttcttatcctacaaacactacttgtatacatcttgaatttctttatctcgctacagcagatcctgcagatacttgtcatattattcgggtcgcttttgcggaatacatacagaaccaattgaggcgcacgaactgatgaaaggaaaggtggagaacaatcctcatggtanggcttagctcaactcagctattggcatatgatcttattacattatgagatcatactcaatgctaattcaacactatttgtttgatgcctaaaaaaaaaaaaa

SEQ ID NO: 5288 - DNA, 685 bp, Aspergillus oryzae
  misc_feature (1)...(685): n = A,T,C or G
ccggggtgtcgctgaatgctgtctccctagtgaacttggtcatttgtgttggtattggggtcgagttttgtgcgcatatcgctcgcgcgtttatgttcccatctcgggtgatcttagacaaggtgcccactaagttccgcggcaaagacgctcgggcctggactgcgttggtcaatgtgggaggtagtgttttcagtggcatcactgtgactaaattgctcggggtctgtgtgttagcctttacccgcagcaagattttcgagatttactatttccgggtctggttggcgttgatcttgttcgcggctacccatgcgctcatcttcttgcctgtagccctgagctatttcggaggagagggatatgccgaccccggctctgatggtggccttgaggagaaccttgcatcccggggttatcgctctctgctggttgatgatgattacgactcggacggatattagacatacaatactatgatacaatgattgcttgatgcttttacggaccatgggactctcgggagtcccgtcaactcccagctctcgtttggctgttgcgggatgcatatggagttatcaggatggaatggtgttaggaatnggatcattctttacattgatggatgtatacagngcacttggggtatgtgacataaagcggtaataaacgagacgcgtttcat

SEQ ID NO: 5289 - DNA, 688 bp, Aspergillus oryzae
cccgaactcactccggagcaatatggtaatgtgtttaatgcatatgtggcctggaaccaagcagtggagagtgtcgatgcagaaatgcgtgaaggtgcacaatggtttgcaaacatgaagcagctacttaaactctacacgcgccagcgtgacaaggccatgatgctcagcattgtcaaggaacccgttactgttcaactcttccgtgacctatttacaatattctacgagcctctagtgcgcgtttacaagtcggcaaacgtctacaatagtatcactgatttcgctcaatttgccgacgatgccattcaggtggtcgagaaatgtcaacgacaagacgtatctgccgatccaaaccaaactgtccaatacttcatcgacctttgcgaacgtcatcaagcgagcttctataagttcgtccacgaagtgcaccttcatgacaatgggctcttcggctctctgatgggatggattgaagatattcttgatttcctacgccacgggcctgttggtggcaagctcgacatgaacgctgtgcttcacagcgctaatgatgttgggcaaatcgataaagataacgctgttgatgagataaacgcgctcataaaatggcacgaagaccgcaagcgttggcacctgaataagaccaggcagaagaatgcggccagagggactcggaatgacccat

SEQ ID NO: 5290 - DNA, 719 bp, Aspergillus oryzae
  misc_feature (1)...(719): n = A,T,C or G
gacacctggagcgtcgcaaagagctaacaagacaagtcgcaaagccatatttccgagaatggtcgaacctccgccatcacgaaggaaagaccttctactccggtccccggttattcaaacgagataaggcgctctacttccccaacatgcacggtaccacactcgcatcgcccaaggaaccgcaagataccaccacgcagcttcggggcaggatttctgtggtgacccttttctccagtgtttgggcggaaacacaagtcgcgacttttactggtcccgaacagaatccaggcctccatgaggcgctcaagagcggtggcgatatggttcagaaggtggatatcaacttagaagagaatgccctcaaagcatggctggttcgcagatttatgtggcggatgcggaacaagttacctgaacagcaacacaggcgctacttcctagttcgcaaaggtgtcacggagggcgttaaggagtccatcgggatgatgaacagcaaggttggatatgtttatctgttggatgaaaactgtcgcattcggtgggcaggaagcgggcccgcggaggaacatgagctcgaggcacttaacaacggaattcggaaactgattcaagagaagaaggtcagtatgggagtctgagtaccggcctcagagtggggaacgaagagtcnaaatgagttcgcagctcaaaagccccgggttgtcatgagaccttgg

SEQ ID NO: 5291 - DNA, 608 bp, Aspergillus oryzae
  misc_feature (1)...(608): n = A,T,C or G
cgagggtaggttactttacagaaactttgtttcctggtacgggcgataagtcaaatgctggtagcgctggtgacaccgagaggactgagtcagcgacaccacttggcctgattctttacgagcccattcgtccagatgatgctttcggacggaccatggtgtccaaccttgcgacgcgcgggatccacttgcaaacacttcatcagtacgcatcactagcggcgcagcgaaaacggttgcgagaacaaggcttccgcgagggccaagccgcggcagatgtggatttcatctgggaacgctgggtgagtgaagaagaaaaggagagggtgtccggactcgagatgctggacgagatggaagaatggagattgctggcgcaacattattgtatcgcgtggggctggcgtgaggggtctgtangagttgttgacgggtggagagggattgagggacaatcagcggattgaccaaacaggcagacaaactgccatgcctttggagtcgacgataccgacatccgaaatatagatggggatctgcgcaaagagagtgtcncttatttttcccgaggaatatttttttttttcaaccgggaaaactttttgggg

SEQ ID NO: 5292 - DNA, 1042 bp, Aspergillus oryzae
gccaagtctagcaatcagcttctccaatcaaccacccgactcatctgtatactcctccatccgacagcaacagtcaccatgaatcgtcttctgaagcttgccttcttgtctttggtcgcatcctctgcgattgcgaccaccgcccctgagcaggtcgagtccgagaccaacacggtggccgaccagtccgattccctccacaaggctcttcacttgttcgagaagttcagccatggtgtcttccgctccgacgaagatgctgcggacgctctcactgccgaggatagagagctggccgcccatctgaacctcaagagggacaacagctcttccgctgtagagccctcagccactgctgtagtaccatcctctcctactcaagcttcctctccttcctccaacactgaagctccctcttccaccacggaagctccctcctcccacaccactgaagctccctctacttcctctccttccactacagaggcttcttctgcttcctcgtctgactcgtcgacttctcaggcggaaccaaccacctcagcccaacccaccacggccacgcctactcaaaagaccaccgtcgaacccactaccagtgagcagcccacaaccaccgagaagccaacaacctcggagaaaaccaccgaaaagcccaccaccagtgagcagcctaccaccaccgataagccaaccacctccgacaagaccacttctgagaagaccaccgagaagcccaccaccaccgaccaacccacgcccactaccaccgacaagccaaccacctccgaaaagaccacctcggacaagaccaccgagaagcccaacaccagcgcagattccaccaagggcccaaccaccatgcaaaccaccaccaccgccccagagcccacaaccaccgaacaaacaaccaagcacacaaccccctacacctccacctacaagagcaccaccactctccccaacggcgagcatagcaccatcacctccatcaccgtcgtgcaccccaccgaaaccgacgtcgccacgctcaccagcgccg

SEQ ID NO: 5293 - DNA, 720 bp, Aspergillus oryzae
  misc_feature (1)...(720): n = A,T,C or G
gggaatcgtgcttcgaattattccacgaccgtgcgtctcaccactaaaggagacggccattttttgaaccccgcgacgctttccggtccgaattacctgaaaatccgccaatatgtcgcgtttcttctacggtagcggtagcgacagcgattccagctcggatgaggaagagcttctcaccgatcgcgaggaggaggagaagtccgaggaggaatccagcgaagaggaggaggagacttcggaggaggaatcctccgatgacgagggtgaaaccggtgccaatcgtttcttgagggatgcatcggagagcgaggagagcgaggatgaggagaaagtaacggttgtgaagagtgccaaggataagaggctggaggaacttgagggcatcatcaagttgattgaaaatgccgagaagattaacgactgggctgttatctcgtcagagttcgataagcttaaccgccaggtcgtgaaggttacgcaatcgggcccagttcccaggatttatgtcaaagccgttgccgatctcgaggatttcgtgaacgagactattacgaagcagaagtcagcgaagaagatgaacgcaagcaactncaggggtttcaatgcggtccagccacgtattaagaagaaacacaaggagtacgccactcatatcgagaagtatcgcagtgatagggatggctacatggagggcancgagangangctangcccgcc

SEQ ID NO: 5294 - DNA, 710 bp, Aspergillus oryzae
  misc_feature (1)...(710): n = A,T,C or G
caacggtacccttgggtttactatgttgatcgccacccttttctgcatgggagacgtcgacaaggccctcaatacgcctaccgggtatccgttcattgaaatcttctaccaggccaccgattccatttcgggggcgctgggaatgagctcggtcctgctcatcatcgccgtttgttcagtcattgggatgctggcggccacctcgcgacagttttggtcgttcgccagagatcgcgcggtacccggctggcgcttgtggagtaaggtttccccgcgaacatgcattccgacctattccatccttctcaccatgaccgtcgcagctctgctgggactcgttaacattggatccgctgtggctttgaacggtatcatctccatggcggtgtcaggcatctatctttcttatctgattgtcgcaatcctacttctctaccgtcgttgcacgggtgaaatctctctgtatagtgacggagaggacatgctggtcaacgtacctggtgccaagctgatgtggggaccatttcacattcgaggcatcttcggcaccttgatcaatggctacgctgtcatctacatgatcattgtggtgtttttcagtttctggcccagccagatgtccgttgacaaaacgacgatgaacttcagtgtcgtcggcacgatcgggacgattatcctggcgctgatctactatgtcttccgggcccgan

SEQ ID NO: 5295 - DNA, 682 bp, Aspergillus oryzae
gggcggcaaaagcgccaggatgttgtcgtgaacacccgcactaccggtgaatggactaccgtgacggtcaccacgaccatcaccaccgaccgacctgtccagactcaagctcagcccactgtctctgttcctgcgtcctccactcccgtcgtaactcctgagccttcccagcccgctgaggttcctggcgagtttcacgagagtgaggcccccgagccccagcaatctgcaaccatccagccggtttggactcccaccccggctgagtctactacctctgctactcccactccggagcctaccgaacagccggaacctaccgagcagccagagcccaccaccttctacgacactgccacttcttccctcgcccccagcagctgtggatacaccaacgatggcagcaccgaggacgtcctggcccttcccgtcggcatgatgaaggacagcgactgcggccgcatggtgaccatgcgctacaatggcaaggtcgcttccggcaaggtcgttgacaagtgcatgggctgcgacagcacctccattgacgtgtcgcgccacatgttcggtttggtggcttccgaagatgcgggccgcctcttcgatgttgagtggttcattgagtaaatgcgttgagtgctagcttcttctgttgactctttgattttttggtacttcgcttctt

SEQ ID NO: 5296 - DNA, 596 bp, Aspergillus oryzae
cgaggttgagattggtctctcccttggctccggaaaggtcaagactctgcccctccgttctaccctccaccgccgtaccactaccacctacggcctcaagcgtcccagctcgagacagactctctcggagatcgtcaagaagttcggccagttccccttcagcttgcgccagctagatgatgagaaggccgctaaggttggtgtcgtcgagtgtgtccgtggtggtgtcctgagacagtacgagcctgccggtgatgctgacaacgcccctgtctcccgcctcttgactaccattgctatcaccaagaatggtatcactaagctcactgctcccgccgcacctgatttcaccaaggtcaagtctgataagaagatcgaggatgaggaaatcctcaagatccttgagcgtcctctgtccaagtcgactggctccaagaagaacaagaacaacaagaagaaagccgccaagaaagccgactctggcgacaaggagtaaataagtcgtttgactcggtcaactttggcatatctagtgaatcgttggatatgcagatggaattgcttcaggccatggttggaacacctttcggagtgct

SEQ ID NO: 5297 - DNA, 759 bp, Aspergillus oryzae
  misc_feature (1)...(759): n = A,T,C or G
gaatgagcctgtcgattcgcacaggtgcgagccccgttcatagctcctccaaggagcagttcagcaccctgctgacgaagtctcgctttgttgtcgcggacttctacgcagactggtgcggaccatgcaaagccatcgcccctgcctatgagcagctggcagcccagctgtcacgcccgaaccgaatcaccttcaccaagatcaacgtcgatcaccaacaggaccttgctaaggcctacggagtgacagccatgcccaccttcatcgcgttcgagcgcggccgtccaacctccaccgtcaaaggcgccgacccccagaagctgtcggaggtggtccgcaaactcgcatcggaggccagcaaacccgacgacggcggcgagggctcatcaggcagctccgacgcagattggatcgggctggccgcaccgaaaggctacgccgacatcacggaccagtacgatcccaagggcctggagctgctgaaccgggacagcgagttcggaacggcgaagacactcttcgagacttcgaagccgtcggcgctgaacaacggcaagggaaaggctaaggattgggtcgagagcgataccgatgaacagcttatgctctttgttccgttccagtcgacgctcaaggtgcattcgttgcagattacttcgttgcctcccagtgatggtgatgagcttcccatgcgcccgcagacgatccatctctacacgaaccgctcgcatgttctgggctntgacgaggccggaggta

SEQ ID NO: 5298 - DNA, 1347 bp, Aspergillus oryzae
caccacttctgtgtacagcactgtgtccacagtgactcttacgtcgacatctaccatttgcaacaagtgcactgctactcctcctactggcaagcccacgggcactccgagcggaacctctcctaccccgacaggcgtttcccctgaggagcctcctgaggattctaccacgaccgtcgttacttataccaccgtgaccgactgcccagtaactacgactgctaccgccggtggcaccacgaccacttctgtctacacgacccagtcaaccgttacactgacttcgacctccacggtgtgtaccaagtgctcctccactcctgcccctaccggagtcgcgcctatcagtagtactcctgccgagggtgcaacgacggtcgtcacctacgaaaccgtgaccacttgccctgtcactacgactatcacctccggtggctccaccactacgtctgtcttcaccactgtctcgacggtgaccaagacttccagctctgccgtgaagccgactggcgttccctcttctcctgctccctcttcacctccaccagcaaattgccctaactcggtgcccaagtgtatcaacacctggctccctcttgtgcccaagtgtacttccaacgcggagcccggttgtttctgcccgaaccatgagttcacagataaggtcatcagctgtattcaggcatggggtgcatccaaagaagagatccaggccgcgctctcctacttcaccggtatctgtgctccctatatccctggcaatccaggcattgtcactgccattccgagcactattactctgatccccactcctgcccccacaggtgtcgctcctgtgactggcaccagtgcggcaccaaacccaaccgccgctcccgaggttcctcgcacgaccatcacctactccacctacacgttgaccgtgccccaggttaccttcaccaccggcgtctccggccactcgaccaccgtcggcttgatcccgggccctgccccaaccggcgtatccccaggtcactcctcgggcatcccgaacccatgggtctccgcctcgtctacttggatctccagccatcatcctagctcgacagccaagccgtcatctacctatacccctcctcccctggctaacactgcctcctctgtgtccaccagcttctggctggccatgggagtcgccgctctcttcagcatctttttctgatcataacactcctttctcttgtttgatcttgctttcacagaccatgttacttatccatccttctcagattgttaataggttgtgacatataggtcactgagatgaatctggatagtaaatgtatcaagtttctttcctttaag

SEQ ID NO: 5299 - DNA, 679 bp, Aspergillus oryzae
  misc_feature (1)...(679): n = A,T,C or G
ccgatgtacagacccgactccgtgaagagatccttgcaaacctccctcctatctcgacggagaacccccagccgcctgctgctaccgatatcgataatctcccatatctcaacgcggtctgtaatgaagtccttcgctatcacccgtctgtgcctgccactatccgctgtgctagtcgagacacaacgatcattggcgagcccattccgaaaggcacgttatttctgattgcccccgaaattatcggtaagagcaaagaactttggggcccggacgccgacaagttcaacccagaacgttggctaggccctggtcgggccaataacggtggtgctgacagcaattatgctaaccttacgttcctacacggaccacggagctgcatcggccagggattcgctaaagcagagctcgcttgcatggtagcggtcgtcgtgggcaagtaccatatggagctgaaaaatcccaatgctccactcgaaatccgacaacaagcgaccgtctgccctaaagatggggtgcttgctaagtttactaatatagaagggtggtgaagaaatttcacggttgaattcatctttatgtatattaatgtcgatctccttactgtcttggatatctatgaatcagggatctagctgtggcaactcacgatgaaagtgggtggtgttcctttggn

SEQ ID NO: 5300 - DNA, 678 bp, Aspergillus oryzae
ctctccccatcacctttcacatggcatccgaggtctctgcatcgcagggggtaccaaaacccaagattgatctgtccaagaaactttcagaactgcgttcaaaccgaaagtcccaaccggcgctaccttcccgcccgtccagagaacctgctccagtcaccccgccgctttctaaccctccggatctatcctcccaccaatatgcacgcccagttcgccgaatcttatcaaaccatgaccatcagttgttcctttcctcgtcatcatattctctaatcctcgccttcatcttcggtctctccgattcggttcgcgggcgtgcaaccacagactcgaaagatcgtccggtttcgcccaacgtctccaagatcctcgccgttgttgaatccatccggacacttctggatcaacatccttctatcgaccaaggtggctcaagattcggtaaccctgctttccgcgacttgtttgacgatgttgccgcgcagagcgcaaagtggcacagggagatccttggtattcaggattcgaccgccatagaagaagcatcagcatatctcatacactccctgggctcgcgagatcgtctagactacggttcgggccatgaattaaattttatgatgtggctgttatgcctacgccagatgcagctatactcaaccgcagacttcgaga

SEQ ID NO: 5301 - DNA, 821 bp, Aspergillus oryzae
tgtggattgggacgctttgtccaagaagcaggtcatcccgccgttcaaaccgaaacttaaatccgatacggatacttcgaacttcgatcccgagttcacaaatgccaacgccacgttaaacgaccgtgcagcagcagtagcgaatagttatatgccagcatccaccccgctgtccccgggtttgcaagctaacttcaaaggcttcactttcgttaacgagagctcaattgaccatcatctgaagcatgaacccacagatcatatggacgaggaccctgatacttggcaacgaccgcaccgccctgggggttttgacgatcaccgtatgactggtgttcccaaggctcacgaaggcggagagcctggaatcttcaatgttgatgacaatttcgatatgtgattattttgcgatgcatgatgttggagttgtgaatcttctgcatatattcatatgacatgtacatggctttattggaacaggccaaaacttggtttgctctgcatctgcttgctgcaagtgattagcgacctatctgttggtactatcatattcgtggatgtgacgacagaaatgatgtgaacacttctgactaccatgccaatctggtgtatccgggctccaccattcgggtagatcgggcacgatattgctcttgactgagatctcctgacccgtttgttactcttgactgcttacaggtctttggcttataccatctgtgacattgtctttcttgaccctgcgaatatccgacagtcatcggtttggtattgtatagatggacggctcggcgtccctttggttacagttagcacgggct

SEQ ID NO: 5302 - DNA, 669 bp, Aspergillus oryzae
  misc_feature (1)...(669): n = A,T,C or G
tccagagaacgactggcctgcaacataccgcgatctcttgatcaagcataaggatcagtttactgtacgcaacaattgtgtttaccgcaaagtcaaaataggcactgaaacacaagaaatccgctatgtactcttcgcccgccgcgccgaccttgttcagcagttccacgaatcattcggccactccgggaaggcaaatatctatgacttgatgcgcaaacggtggtggtggcctgacatgaggaccgatattgttaattggctcgccacctgcccacaatgccagcttgccgcaaatgccgacaaaaatactcaccacgccccaatgaagcccttggatgtcccacctgcattttcccgttggcatcttgactttatcggcgaactacccaccacagcanatggtaaccgatggatcttggtcgcggtggactctgccacaaattggtctattgctcgttccgtacctgacgccaccggagaggcgatttgcaagttcctatatgaagagatcgtccttcgtttcggtttgccagacgagattgttactgacagaggcgcaaacttcatgtcgaaagtacttgcaanttacanncggcgcatcaaactacgccacgtcttcacatcaggctttcaaccatgcacaancgggaaagcaaagcgtacgan

SEQ ID NO: 5303 - DNA, 659 bp, Aspergillus oryzae
  misc_feature (1)...(659): n = A,T,C or G
gacgagaaacatgacgccagaagcgacaaagctccctccgaggagaacggtgtcgctacctccctcccggacaatgcccacttgacccttgaaagcctgcgcgccgaagtggaaaccgacattgccgcctccggccatgactccgcatatgaccgcaaagcaaaggtcatcaacagagccattcaggatatcggcatgggccgttatcagtgggagctgtttgcactctgtggatgtggttggttggcagacaatctctggttgcagggtgttgccctaacattgactcaaatgtccgcggaattcggggtctctgaaagtcgtgtccgtttcaccacctgcgcgttgttcttgggtctctgcctgggtgcttcgttctggggtgtcgcatcggatgttattggacgtcgtcctgctttcaacctgactcttctcatcaccagtgtgttcggtctggccgccggnggtagtcccaactggatcggtgcctgtgccctattctcctgcttgggtctcggtgttggtggaaatcttccagttgatggcgcatcctcctgggagttcttcaantcgctctggcaactccctgacatgctgagtgtctggtggccaatgggcaactatctcagtctgctcgcatgggcctacattcaacataa

SEQ ID NO: 5304 - DNA, 635 bp, Aspergillus oryzae
  misc_feature (1)...(635): n = A,T,C or G
ctggattatacactatctcatcggctgtcagccatggaaccgatggttcatcctttttttgatgaactcagggatcctagcacccggctacctgattcccggcaccagaatgggccatcgcgagagctccctaatctgtttgattgctctcgacatgaactctctatcgcaccggcaatgaacagtcggcttattccccctcatgcacgccctgccctcgaagcccgcgggatagatattgataactttacacccctaacgaaagatgaaatgatggcacgcctagattgacttgaggtgtgcgatacttacgaaatacaccggtgttcatagtacggtcacatgcacgtgtgcgcgataccntgatgctatgctgtacgagttcactttgatgcaccaggcggttattaactgtgagaggtcatttcaggtgtagacgcttatccattggcgagacctcttggagctggcttctctgcagacgggggtgatgactctcatggcatttgcaacggtcttccggcaaaggatatgacggattgnttcccggaaggaaccgggccaaatgtcgaagagaatgtacatcccttgtcttaactggaaaattcctttgtttttctgtttccttccctaat

SEQ ID NO: 5305 - DNA, 622 bp, Aspergillus oryzae
  misc_feature (1)...(622): n = A,T,C or G
cataacggttcctggaagtgttcttccagactattcacagccattactgtcgaacctacagcatatcagctgtgttcatcaccttgtattataatcacctgactactcagtaaagaaccatggccgacgcagagttggaagagatcaggagagcccgcctggctcagcttcagcagcagcagggaggcgtaccacgaggtggtcccgctccagacggtcaggatgatcagaggaaacaagcagaagccgaacgtcgctctgcgattctgaaccaaatcctcgaacccgaagctgccgaccgcctgggccgcattcgcctcgtgaaagagtcgcgcgctgtcgacattgagaaccgactgatcatgttggcacagacaggccaactgcggcaaaaggtctcggaggatcaactcaagcagctcctgaatgctgtggctgagaaccagcgcaaggatgaggaagagcataaggttgtattcagtcggcgtaaaggaggctgggatgatgacgatgacttgttggatctgtgaaaagttgaattgcaaaacagcgaatgccgtttaagcctgtnnnnnanannnnnnnnnnnnnnnnnnnnnnnnnnnnnnnnnnnnnntttcct

SEQ ID NO: 5306 - DNA, 718 bp, Aspergillus oryzae
gccgtcccaacagcaggctccccttccctgcccgcgcaggtcaccgagctcctcctcacaaacgcagaccaggtccgcctcgccggcctagcagcccgcgactccctccgtctggaagccggcatgtgtctctacggccacgacatctccaccgcccagactccccccggcgcatctctgggctgggtcgtcggcaaggaccgtcgcgaccccgcaaccgccaacttcaatggcgcctccgccatcctcccccagctcgcctcccccgccaagaccctctcccagcgtcgcgtaggcttcaccgtcgagaagggctcccccgcccgtgaaggcgctgtcatcgtcgatatcaacgatgaatcccgtacccccgttggcatcatcacctccggtctccccagtcctaccctcggcggtaccaacatcgccatgggctacgtcaaacaaggtctccacaagaagggtaccgaggttggcatcttggtccgtaacaagctccgtaaggctactgttaccagtatgccctgggtggagagcaagttctatcgggcaaggcctaaatcccataatggggttagctctgtggttctggtttttaagcctttgggggttgcggtggcggtttctagcctcttttccttttaatggaaatgttccatgccgggagtgactgtagatataacgattccccttttcaatgcatttgtgcaaaaatggg

SEQ ID NO: 5307 - DNA, 987 bp, Aspergillus oryzae
tcatacttatccatcactcttcatccattcaaactttcttcatccatcacataccaactctacactacacatcatgtctggctacgatcagtacaaccagcagggcggccactacggccaaggccagcagggctacggtcaacagggctacggtcaacagggctacggtcagcagggctacggtcagcagggctacggtcaacagggctacaatcagcagagctacggacagtcttctggatacgatcagggatacaacagccatagcggtagctccggctctggtgccgccaacgactactacggcggcggcggacagtccgagcaccaccagcagtcttacggtggtcagcagcactatggccagcagcaaggatatggtcagcagggtggatacgaaggttctggtgaacaggctcccggcggtgctcaggagggtgaacgtggcctcatgggtgctcttgccggtggtgcggccggtggcttcgctggccacaaggctgatcacgggttcctcggtacaattggtggagcgatcatgggttccatcgcggaggacgccatgaagaagtacaaggggaagaaggagcatgagcagcagcagcaagagtatggcggctacggtggcagccaatatggtgcccctcactctcagcagggtggttccggtatgatggaccaacttggtggcttcttcaagaagtagtaaacccgttcttgtcacctcacctttccacgatgatccctttccgcgatacgtgaactagctcctttcgacttctatctcgttcggctggccgggttcgcacgttctttatgtttttcagtctgccttgcttacacggacatgctctggggatacacttcttgttttttctcttcgatttgttgctgcatctgggcttattagctcacttacgatgagacgcgttgttcactggcttttttattttttttttttttacaattataactattgctatcttg

SEQ ID NO: 5308 - DNA, 711 bp, Aspergillus oryzae
  misc_feature (1)...(711): n = A,T,C or G
ggaatcactctgtccgaattcggcacgagggttggccgtctcgtcgagcactccaccgctcctgagatcgtcaaggagttccccaccatccttggccgtctcgaggcttgcttgcacatggacgtttctcgtcttcaggacaatgccactggctgtctcagccgcatgatccttaagcaccgtgacagcgttcccctcaaggacgtcctgcctgcccttatcaagctcctccccttgaagaacgactacgaggagaacgaccccttgtaccgcatgatctgtcagctgtacaagtgggaagaccccaccatccgcgagcttacccctcaattcctgcccatcttccagtctgtcctctgcggcgacgaggatcagctcgaggacgagcgccgcgccgagctcgtcgagcttgtcaagtggctgaaccagatgcagcccggtgctgctccttgggctgagcagctgtaaatgctcaccagacatgatggcttgacgactcaacaaatatttaatggatagactggttaacaaaatggttttatggttgacagatagaagatacccctccggagcgcatcanggtcggccctgtttatgcgtgatgatgtgacgaagacggatagaaaagtcatgtattcgtttcgcgatgatttatgaatcaaatgttgtaatattcaatgtttttnnnnannnnnnnnnnnnnnnnnnnnn

SEQ ID NO: 5309 - DNA, 666 bp, Aspergillus oryzae
  misc_feature (1)...(666): n = A,T,C or G
gcggaccggaacaatcatatgcggcgcgaaaggcagcaactcatggacgatatctttccggttgtccctagggctaggtttgtagctctgcactatgttcacgagcccaaggggcaaatgctcccaggcattcgtgaggttacccgacgacgagtgctcgaccgtggcgacaaccaccagactattcgcgcatgaagcaagaactcctaagagattatcggcatcatggaagggttcctcaatcgatttgaaggtgtcgataccgaccgagaaccggacaaaagcttcgatgaggtcattgaactatacgtgtctgctgattcgcggggaaacctgtagacagtattgacaacattgcataaactctacccacaaatcgtgaaacaggtccctacaccagaagagctccatgctggccttgactgggcgatgtccgactaccaagttcagatagacctctaccaccactacggggcgaagaatcggaaggacaagatacagacaggcactcagttaacctcaacacctaacgtaactccccagagcttggcaaagggtatccaatacttctgcatctccctggcgggaaactgaggggtcggaagtcctccaaacgttggtgcctacctccacggaccccgagaaagcttctgtgtaccgccattn

SEQ ID NO: 5310 - DNA, 675 bp, Aspergillus oryzae
  misc_feature (1)...(675): n = A,T,C or G
gtaaactcatgcagtcactcgcccgctcccaagaggaacgccaaaagctcatgatcgggccaaacggcgagcccgtacaacaggcaccattggatccttcgaagcttgacttctgtcgggtcttgtacgactacacccctgagacccaggagaccaatggaattgatctggccgtgaagaagggcgatatcgtcgctgttcttagcaagtcagatcccacaggcaacgcatcggaatggtggcgatgccgcgcccgggacggccgcgtcgggtatctccccgggccatatctagagactatccagcggaagccacaacagcaggcgatcacatcgggtggcgaggcaagcagccgtaccaacagcatgcaagctcgcgtctcggacgaaattccggcaaacgaaaagaagcctgaactcaaaggaaagatgggcgacatctctccagaaaagctccagaanagtgctttctactcgtaatgcctgagcgggattgatatgccatgcttntatttcttacttctatcattagcccacgagcaggaggtcatgtcggnttgactcccttgcagcatggatcttactacntatgggcggnacctcatgactacttcactactggatatttcaagcgttgggtgcttanagtatacggattcttcacatagtcacgttt

SEQ ID NO: 5311 - DNA, 674 bp, Aspergillus oryzae
tcagaccaactcttgtcccactcgttcattcactcacgctattcttcacttcttcttgggctagacttattcctttctttccagttttcctgtcgtttcatcttcatccgtggcctccgcgcaatttagccaaagcagccttctacggccgcgacccttcgagttccaacgctttctatcagaccaaagtcgtatcctgaaaatgagctccgaaggagaaaaggccaggacctccggcgaggtctctcgtccggagcctactctgcctactgttaacccggccgctgagagggcagagcctcccaagcctgccttccaccccgcggtttatgtgaccgtgtggattactttgagttccagtgtcattctgttcaacaagcacatcctcgattatgctcagttccgcttccctattatccttaccacgtggcatttggcattcgcgaccttcatgacccaagtcctcgcccgcaccaccaccttgctcgatggccggaaaactgttaagatgactggccgggtttacctccgcgctatcgtccctatcggtcttttcttcagtttgagtttgatttgtggtaacgtgacctacttgtatctaagtgttgcattcattcagatgctcaaggctactactccggtcgctgtgttgttcgccacttggggaatgggca

SEQ ID NO: 5312 - DNA, 641 bp, Aspergillus oryzae
gtagtcgattaagtgagtatcgattaatggtacaactttttttggcatcttcttaattctggcttggcattaaaaccacctgacccctaacaatcatgggtattaatttcataactgattacccatccatttaagaaaagaaagggaaagttatttgccaaacacccttccgaaccccaaaccaattcccggcgaacgtgcccattccggtggattaaaatttccggtgggccacatggactttgtccgtgaagtcctcttctgggagaccccaatgtgcggggaaagtggtgtgaagctttcacttggcacaagtgcgcggcgcgggctcctccataatattgtgtacctgctctagggggagacccttgtgctctgggattaggaaatatgtgtataggaaagcgcacgcgcacagggatccccacatgaagaacaccctggactttagataccccttgtgctgtgaaccctgttggtgtgatgaccgcgatatgcgctttcaagccctctttacacacggagcacagcccacgcggcgaacaaaaggcaccagggagaatatctcgatgacaacacagagccacgaacccacgtgtggtgaagaaaaaaatgtttatccgcttataaagaacttcccc

SEQ ID NO: 5313 - DNA, 666 bp, Aspergillus oryzae
ccaagaaggaaagtcccacatggtactggtgtccgagtatcccggtgaagaccgtggtgccttgggtgttgttactctggaagatgtgatcgaggagctcattggcgaggaaatcgttgacgaatcggatgtctttattgatgttcacaaggcgataaggcgcatgacgcctgcacccataaaatcccgggttcctaagggcaagattgtggaagaacctccttctttaccccctcagaagacgggcactttggtggatgtagatggcgaaccccaagtctccaaaccccctgcgaacgttcgccgtcgaagctcagtagaaccgccacttccgcgtttccagcttcggatgccacagtcggacagaaattcagattcaacagatggcctagtaaccaaacgaggaaccactgacgaaattcgggagcacttgaagcatctcgggccttctaatttggccagccgacctcgtcaaacccggtaccagaatgtgaagatcaagcgggctagcgtctcgcctactcgttctgcgcaaaccgatatggactctggccatagtatgtctggctcccaggccttgcatcctaactcgaccgccttacccggtgggatcggcgagggactagtccagcccgggttggatgcaagagatggcgcatacgctgt

SEQ ID NO: 5314 - DNA, 654 bp, Aspergillus oryzae
gctttggcttgcactactgcggtcctacatacgtcaactggtatacgtgatcatattcgctgttcccgtgatcttatattccttctctctttatccatttgtttcaagcttcaaaggcgcctggcatggaacaagcatacaggataaggtaatgagatggggatccattgccccattcattatagctagcgtgtggatatacaatgtaatccggggccgtcatgctataggcaaagcgatcagaattctcgagtttgcttgtcggatcctcgccacaaatccagaactcctgatccttggacttggtattctcgccttcatcgtttcatggacatggttgtggatacttatgttcacgcgggtattcctagggggaaccatagcggggccgggtcgcttcatcatcagtttcagtagttggtggctcggggtctatttcattcttgtttatgtctggtcactgggagttatcgctggcattcagcgtgcagtaacagctgctacagtgagccagtggtacttccaccgactcacatcccctgccccgacatcaaggcagatcgtttgggcagcaattaatcactcactcacggctttatttggcaccaattggttatccagatatgtgcacttcttggtcgaattcctcttttt

SEQ ID NO: 5315 - DNA, 682 bp, Aspergillus oryzae
ggtatcaaggttactcctctccatactttaaccagactcatgcagccctccgcgcagaagttcgccaatgggttgagtctgaaattgagccctatgtgaccgaatgggatgaggccaagaatgttcccgatcatatttacaagcagatgggtgaacggggttaccttgccggattattgggtggcaaattccctgtcgaccacacgaagaaccgtgtgcagtctgtcgctcctgaaaactgggacttgtttcacgagatgcttcttaccgacgagctgtcccgcgccggtagtggtggtcttgtctggaatttgatcggtggctacggtatcggctgccccccactagtcaaatatggcaagaagcctctggttgacagaattctccccggtattttgaatggcgataagcgtatctgtcttgctatcaccgagccggatgctggaagcgatgttgccaaccttacctgcgaggctaaactcacccccgatggcaagcactacattgtcaacggtgagaagaagtggattaccaacggtgtctatgccgattacttcaccaccgctgttcgtacgggcgggccccgtatgaattgtcttaatgtccttctcattgagagagagcacggcggagtcagcacgaaacgcattgacttgccagtgtctggaggcaccggccgact

SEQ ID NO: 5316 - DNA, 693 bp, Aspergillus oryzae
  misc_feature (1)...(693): n = A,T,C or G
caaagcttgaaacaagtaccttcataaatatctatgcaccgtttgtacacagaatcaattgtaacttttctcaaaccaggtacatagtcttagccatacacatacttcgccaattatatatttttgcatccacccctaccgcggaaatggccgccacatgcccaaactactgcggcattgaagattatggcatcatcggggatatgcacacctgtgcccttgtgagcaagaatggtggtctggactttatgtgctggccagcgttcgactccccgtctgtcttctgccgcgttttggacaataacaagggtgggcatttcaccatccgcccggcaggagatatcaaaccaatgagcaaacaacgatacagagcgtgtacaaacgtcttagaaacgcggtggatccatgaggatggggtgatcactctatctgactattttcctgtattaagcaaaaagccctcccatccgggggattccgcgtcagcctggtgctcctgtgatacggctgctgatggtgctgaaggggcagaatgtcgctcgggagtggttaggaaggttgaatgcgttcgcggacagatgggcatggttgtcgaagtctttcctgcgtttaattatgcgctngagcagcataccggtcagtgggtaactcgtggtgatcctgggcatcggctgaatgagtatctattcgaaa

SEQ ID NO: 5317 - DNA, 674 bp, Aspergillus oryzae
  misc_feature (1)...(674): n = A,T,C or G
cccaaaaatgattgccgttgatcgcttagcgatcggtgttcggctgtgaccaaagtatctccacatcttccgctggacggactggcgacaatgcgacatccgcttagtcaacctagcatagcataactagcgcgctgaggggttcaccgaattaaatgtgtataacttagtatccagacatgaacgccggtgctagacgatacgtgttaatctgattgaccagggtggctgcttctctccagaaggctgagggcgatcatttatagttgctcccagtgttgtcatttgtgctactatctgagaataaacaccgtgaaacttgccggctgactgtaaaacaacaagttgcatggtgaattaccgatccctcaccttaataatatggagtggcagatatacttgggcattgcatttgcgctgtggatcgttcaggtcctctatacagctttcacgtcccctcttcggcgcgtcccaggcccattatacacagtcctgactaggttacctctgaagctagcaagtctcacaggaaatcgcatttatttcgtccacgagctgcaccgganatatggcccaattgtccgtattgccccggacgaggtcgacatatcttcacttgctgaattcagggaaattcatcgcgccggatcctcatttctgaagtcaaaatggac

SEQ ID NO: 5318 - DNA, 700 bp, Aspergillus oryzae
  misc_feature (1)...(700): n = A,T,C or G
ctcacactatttccgcgcttttcttcaagatttctactgaatagccgccgatacgtataagctgagccgatcgaatacatgaccatatgactgcgaatagcgccgccggaaatgatcttcagtgacaacttagcctcgattcaacatgaataaagccactggggaatcaactctaacgccttcgactgccttggatctgagcggacgaagactgtgcgcatgtgatgctcaaagattgttactctaaaaagtggcagagaaccatagaatagacacatgatggcatctaggaggatgtgaagccctttgactggtgctacaccacagactatacggacaccgttcaagatggtggccggtcatttgaaccngcgaccacatctatatccttaggattgttagagctgccggatcccatactctctttcgatgaagtcatactgtacgactatcatctcgatgataacggcttcaatatgctatcctgcgaaaatacgttttgccatccatactactgttattatcaagattctttctacgactcgataatgctctggatcaggattgaaacacgaaggggtatttctactttgaaaacaaagagtgatcagagagttcctacccaaagaattaaacttgggacagttggcataactgttacccaaccggagatgacgctcttgtcgttttgctcgaacct

SEQ ID NO: 5319 - DNA, 1122 bp, Aspergillus oryzae
  misc_feature (1)...(1122): n = A,T,C or G
ctatctgggtattgtcgcagtcattcgtcagtccggctctacggtcgctttcgaagccctcaagcctcagttgaccgctcagctgcccacctggctgtcctcctgggagttggatgaggaagaggctcagcgcctgcacctcgctgttgcagacgccgctcaggctgccggcgatccggagctggcgcagacccatattctgcaggctctgcagaccattccagccgcgcaggcttcgtccaaggaggcccgcgacctcgccatccgcgctctcacctccgctctcacccaccccgctgtgttcgacttcacccctctgacggcctcggacgctgtccaggcccttcgctctagcgatagcaccttgtttgagcttcttgagatcttcacggccgacactctcgatgcttacgaggctttcgtcaccgccactcccttggcaggcatctccggtggtgtgctggccgacgctggcgaggcgctgcagaacaagatgcgtctgttgactttggcctctctggccgcctcgaccccttcccgttccttgccctatgccacgattgccgcgtctctgcgtgtgccggccgaagatgtcgagaagtgggtcatcgatacaatccgtgctggtctggttgagggcaagctgtctcagctgcgctccgaattcctggtacaccgcgccacctaccgtgttttcggcgagaagcagtgggcggaagtgcagggtcgcttgatggtctggcgccgcagcctcgagaacgttctgggcgtcctccgtaccgagcgggagcgtttcgttcgtgaaagccttcaggccgccgcggcagcagaggaagccgcccagggtaagtcgaacgacaagggtaacaagtctggagatcgtcggcagcgccatggcaacaaccaacaatctcagcagcaacagcagccccaggaggtggctgccgcagagtaattaactctaagaaggaaacaccacgatactccttgaaaagggaaaagaagtatagaanaagttcgtcgtgtaatggctgggaagagggngtatgttgatttcaatttctttctatgggttattctttggntcatgtgttctctccgggcgacattnntatcggttca

SEQ ID NO: 5320 - DNA, 631 bp, Aspergillus oryzae
cgaagagcgcaaaagaaaggcgaaacagctggagatgcagcgaaaggaggcagctcgtaccggtcgtgctatggctccacgcaccccgtcctatcctgtctacactcccccatcgcgacctgccgtacccgatgcctacgattcctatgaagcagagaagaagaagtcatttgctaagccgttgccaaccagagggaagggcatgcagctcggcaagaagtcaaaaaccacggatatatacgagaaagtccgcggcgatctgggccctgaagttgaggagtctagccctctagtcaccccacaagcttcaactcctgtcgtcggggagacatcgtctgctcgcgcctctctctctgctgaccgggatcctattcatgttactattgcagaaacaatctctgccaatcttactcgtgaaggtgctctgaaatccttcgaagtcaagggcgacttacagctccgcatctccgacccgtcattcactaaagtcagacttgaccttgccaccaaccctactcatggggctcagttccgtacacatccaaatgttgataaggctgccttcaccgactcatctgccattcagctaaaggattcgactaagcgatttccggtcaaaaacttaatcggg

SEQ ID NO: 5321 - DNA, 505 bp, Aspergillus oryzae
  misc_feature (1)...(505): n = A,T,C or G
cgaggctttttcgccatggtggaacatttggttgccagtgcgactgccctgggtctttctgaagaacaggctaccagattggctgcacaaacatgtctcggcgccggcaagatgcttgtcgagtcatccgacagtccgagccagctgcgcaagaatgttaccagcccgaatggaaccacatatgccgcccttcaaacattcgagtcactaggcttcaaggagactgttgacaaagctgtgaattccgctacctcccgagcagctgagttgggaaacactcttggcaagcaataaacgtctcggtattgcccgagggaagttaacatacggaaaagagtcgaacgtaccttgatcctgtaatcatttaccaccatcagcgtatacatagaatactaaaaggtctatgaagtctgtactgtacgaaaatcaagccactggttgttcccagttnnnnanannnnnnnnnnnnnnnnnnnnnnnnnnnnnnnnnntnntttccttgcgg

SEQ ID NO: 5322 - DNA, 689 bp, Aspergillus oryzae
  misc_feature (1)...(689): n = A,T,C or G
ggggaaaaacatcgagaaacacacttttgccatttataacacccacagtgaccaccaaacccgcccaagttttccagggcaccctaatccacagcaaagacccccaaaccctggaaatcctgccaaacaccctcctaatcatctccgcaacaggccaaatccaatccctccacccctccaccaacccaaccgacatcccaacccttctcacccaagcaaaccacaaccccgacacaacccccataaccaccctctccgccaccgaattcctcatccctggcttcatagacacgcacacacacgccccacaatggtctcaacgcggcctcggccgcggcatcgacctcctcacctggctggagcaaatcaccttcgcgcacgaagccaagctctccgaccccatctacgcaaaacaactctaccgcgccgctgtccagggaagcctcaaacaaggcataacaacagcctgctactacggctcccgccacaaagacgcctcgatcatcctggccgaaacatgtctcgccattggccagcgcgcactaatcgggaaatggtatatgaatcgccacgcaccggacttgtacgtcgactcttcagtcgacgaatccgtctncgatacggtcgangtcatcgncaaagtanaggaataagatggagacaccggtctcgtgacaccggtcatcacg

SEQ ID NO: 5323 - DNA, 269 bp, Aspergillus oryzae
caaacctccttctacttctcttcctgcctttcaattccttgtggaagtgcttcaatttcatttctggcaggatgtccgcaaacgatgtttaccagacccctctcaactcgcgttatgcgagcgatgagatgaaataccttttctctccgagaaaccgtttctccacctggagaaagctctggctgtggcttgctgagtccgagaaagagctcggcttgtctatctccgatgatgccattgagcagatgaaggcccaccttaccattcag

SEQ ID NO: 5324 - DNA, 693 bp, Aspergillus oryzae
ccatggactggagtttagggattctccatatgttaaacacccccttctacgcgaggtcctggctttccacagggcctgggtctattatgcagccatggttatcgatgtcgttgtgcgattcaactggatattctacgccatattcgctcacgacatccaacattccgccgtgctcagctttgtagtcgcgttctcggagatctcgcgaagaggtatatggacgatatttcgagtggagaacgaacattgcacgaatgtgctgcttttccgcgcgtcaagagacgtgccattaccctacgaggtggcctcgccacatacagaaaccgaccaaccaaccgaagaaatggtggtccaggaaccacagcagcccactcctcaacctcctgcggccgatatagaacacggaactccgcccacaccgggtacatccctccgggcacgcggcttatctcgagtgggaaccattctggcctccgcccatgcacaagaacttccagcgcaaaaagcgaccggaagacctgggcggtgcatctgcatctcatggtaacgcaaacacccctgatgacagttgcgaccacgacgaacattcgcccgcacccgaccctattagataatatcactgtgcaagaactacccctgtcggaaaacacaatcgatttttacactaacgaaattttcttttttttggaaaag

SEQ ID NO: 5325 - DNA, 928 bp, Aspergillus oryzae
  misc_feature (1)...(928): n = A,T,C or G
cggagcctatgcgtgtccacaaccacacgtcggctgatatcgacagatgtattgcgaacgacaccctcaccatcaggttgcatgaagcacaagccatcaacggactagctaccctgaacgaagtcgtcacgggaactgagcgcgtgcttgacacccctctgccgacagcgtacagcatcgccatcgcgcaaatcgcctggatctacgtcatgtctctacccttccaactctacaacaccctcacatgggtgaccatcccaggttcaattatcgccgcatacatcattctcggtctcgccactatcggcagcgaaatcgagaatcccttcggtcaggacgtcaacgatcttcctctggatacctactgtcggcagattgccttggaactggatatcatcaccgctactccggcgccccgtgtcgatgatttcaccgttcgtgacgacaacttggttttgtatccacttagcatggacggctacaatgactggaaggaccgaagcgtcgaggagatcagagctgcacttagaacgaaggtgatagccaactccccttcttctgccttgggatcggatgagtcgaccgttgttggaagcatgagcagtaaacaaacggtttagatggatgactacgcgtcaagagttaaaacttagacttgaaaaagaaaaagaaaaacaagggaatgaaaggaatcgttcaaaagttactatcagcgccggcattgggtttcttttttgagcatgcgcgtttcggtgtttctgttgcttgaggacagggagtactccactcgttactgccatttacattcatgtcattcgttgtgaatatgttggctggngataatcgctacttggtgcgcagatgtacatgatggatntatacattagactggttatattgaaacgactggatnngttgggtttgagca

SEQ ID NO: 5326 - DNA, 660 bp, Aspergillus oryzae
  misc_feature (1)...(660): n = A,T,C or G
cgacttctgggcaggaagcattaaccctctcagtatcctcatttggctacctctgtttgagcgagtaatctacccttcattgcgtcgggttaacataccattccggcccatttcgcgcatcacttttggcttcgtgatcatgtcgggagccattgcagtggccgccggcctgcaatcacttgcctataactcacccccttactcggtaaatttcctatctattctccccatttacgtcttgacagcgctgtctgagattaccgccttcctcagtagcatggaatatgcctatacaaaggctccccggtccatgaagagtctggtcgcttcggtcaatctgctcctctgcgctctgggctcactgctggggttggcgatttcacccacctccaagaaaccacagatcttagtgcagtttgcttgcctcagtggcatgatgtttctagcggctattcttgtctacgtgctcttttccaagtacaacaaggtggacgagaaaatgaatcagatcgaaagggaggcggacagcgaccgggaggaatagaggcatacgcacgctacagaaatgagtcttgtatttagaattagaccagaccatcttctagcttctacttntaagtntacagaatttaacataataaaaatcaacgtggaagtatt

SEQ ID NO: 5327 - DNA, 644 bp, Aspergillus oryzae
  misc_feature (1)...(644): n = A,T,C or G
ctcatccaagtattaaatacacagcaccctcgtcatcagagttctccgccgtgtgtaaggtatggaatatggcccgtccagacaccccgcttgccgttgtccatccccagagcgcagaggatgtgagtgttttggtgcaattcgccaaggccaacggactcaaattcaccatccgcgtcggcggccacaacatggaaggccgggccattgtagatggcaccctcgtaatcgatcttcgggcgcttacgggggtcaggatagctgaagatcgccaatcggctacagtagaaggaggaattcttcaaggagagcttggccaaaaattgtgggccgaaggacttgccacgccccacggggtcaatacccggcgttggctacgtcnggtgggcaatgtatggaggatatggacccttctcgtcacactggggactgggggtttgatcagaatcttggtgcaacgattgtgaatcatgatggggaagattattgaggcngaccanaagcttcttgaaggcattcgtggggccggaagggtggtccggtgttattggtgatcctactatcaaggtgtatccactcagaaattttctggcttgtgcaattctggttgattccagcttttcaccaaaactttggcgatttta

SEQ ID NO: 5328 - DNA, 650 bp, Aspergillus oryzae
  misc_feature (1)...(650): n = A,T,C or G
cgtcgatacgactttcttccgagtttgcatgtacgccactcctgctctcgctggctcactcttccgtatcgccaacttctgcgacccggaggttgtcatggaaaaactggaggaaactggccgttacaatgacttgatcgatttcctatacggaaagaagatgcatcgtcaagccctagagctcctacaacgattcggccaagctgaatccgagaccgaaacggcgccgcagcttcatggtcccaagagaacagttgcctacctgcaaaacttggcaccagatcgaattgacctcatcctcgaatttgctgaatgggccgtgcgggaagaccccaaccttggtatggagatattcctagcagacactgaaaatgcagagacactaccccggcaccaggttctcgaattcctgcggggcatcganccgaatttggctgttcgatatctcgaacatgtaatcgggagttgaacgacatgactccggatttacaccaaaagctcctcactttttacatggatcggttgaagaaaaacggatccgacagctgggcattccctaacggcgaggaacgtattctatggagaaataaatttctggagatgttgagggtcaagctctcaatattcgccagccaagatacttgatagcc

SEQ ID NO: 5329 - DNA, 1060 bp, Aspergillus oryzae
gttaggtcttctctgtggcgagccccaactcttcttttgcggcttgctgtacttcatcatgcttcagcgctcggcagtttttcatcgatttggaacttgccaggggttttcactaccaacatgacacgccgatttgttcgcgcgggtgtacaactcgcaatatttgctctttgtatactggttttcgtcgtaactctagataaccggtttcgcgtcctacctgccgctattcatggccacctcccttcgcactattctggactcgtcgttacggatgtgaccataaaaacgtgctcgcatatcaatcccttctccaaatgcaaacctacctcgcaatcatggacacaagtcgacaaagatctttacttgcgcactggttggacgtccaccgcctttgtccaatttgagcggaaaaaggaggaggatctacttcctacggacaaagttgtgatcgatctgaagattagtcggcttgttccggagaccactgaggatactaaggatggggagaaagacgaagaaacgtgggagccgagaccaggtggcatttggctgagacgaacagccaagcgccacgcgagtgattcgcagactgcgatcaccttagtcgatgtccttttcggtgccgatgcggtggatccacggattggctgggaggtcagagatacgccgctgctgctggatagtcggacggaggaactggaagctcgtctcagtattcagaggggagatcctcagagaatgaaaaaaccagttcccaggatcaatgaacatggtcgctttaagatcatgcagctggccgatttacatttgagtaccggtcttggattgtgccgtgaccctattccagcggaacctgttccgggccagaagtgtgatgccgacccccggacacttgagtttgtggagaggctcctggatgaagagaagcccgatatggtggtccttactggtgatccagtgaatggcgaaacctctaaggatgtacaaagggcgcttttcaaggtcctcaagcctggttgtggatccgacgatcccctacgcggctatttttgggaag

SEQ ID NO: 5330 - DNA, 683 bp, Aspergillus oryzae
ttcggcgatgtttactcgctgccacttcttcccggcaatgagccatatgtagcgccaaagcttcctaatcggccaaaggttcctagcgcaactccccttactgtgcatagtaagcggaatcttgaatctctggaacagcagttgcgctatagtcaaaaaaaaactctaccgaagaaaagaacagcctgaatttccagcatcaattgctacttggccatgtgtcattgctcacggatgtggcttttgtcacggtacctcaggatgataatttcggtaaaaagcgcagttacatcctaactggagaccgcgatgagcatatccgagtctctcgctatccacaggctcatattatcgaaggttattgcctgggccatactgcattcgtcaccaagctctgcattccccaatacgctccaggttatctcatctctggcggaggcgacgattatttgctggtctggaagtggagcgaaggccgtatcctacagaaggttcccttagtgaagcaggaatcagagaccacacaggttacagttcgtggaatttgggcgacatcaatcggtggatcgaatatagtactagttgcgcttgaggggtcctcaaatctgcaatgcttcgtgcttggctcggatggcacattaaaaccacaagacccaatcgagatgtctggcaacgtattagaa

SEQ ID NO: 5331 - DNA, 672 bp, Aspergillus oryzae
ccacttccaagcaggcttccctccttctccaaccagcccatttgtttttcttcgtccttaaatttaatttcgctcaattctttacgacattctttgattttcttcatttgactactatttcttaaaatggcgtctcctcgtgctgcctcccccctgacctctggtgccgagtctgggccagactccaaggcttctggctctggtgctggtgccgctggctctgtctcttccgtggcccgtacctcctctcccactcctcccggtggtcctcgagctgctttgcgtcgtcgcgcggctgccgaccacaaggagtctctgcgcaatgccagacccagctcgactcgcgctgccggtgccggtggctcttccggtaccatgctcaagctttacactgacgagagccctggcctgagggtcgacccggtcgtcgtcttggtcctgagcttgggcttcatcttttccgtcgttggtctgcatgtcatcgccaagatcactcgcaagttttcctcgtgatcaacgacgttgcgtctgctctcgccatcactctcttgcctgcctccagcgacatctgggttgactgaatgaggttctgagtgagcagggatgttttgctatgtatagccggtccctgctcctggaacgaatttggttattctgtgagagtcgcttttg

SEQ ID NO: 5332 - DNA, 688 bp, Aspergillus oryzae
cttctccttcgactagctattacgtatactaaaaaggtaaagaagcaaatcacctgggcagttgtgtttcgcaatggcaaccgaggaagaggctttgtacaagccttatgatcaattcatcctttttggggattcaatcacccagatgtccagcgacccccacatggggttcgggctattcgcagcactgcaggatgcttacagccgtcgcctggacgtgatcaaccgtgggtttggtggctatacctctggccatgccatcaaagtctttcccaagttctttcccacaccggaaaaagccacagtgcggttcatgactattttctttggagccaatgacgcatgtctccccggcagtcctcagcacgtcccattggacgtgtataaagagaatctgactcggatcatacaacatcctgcaacagtggcccaaaatccacatatcctcctgctgactccaccccctgtaaatgaataccaactacaggggttcgacgaatccaatggcaattgcccatcccagcccgaccggcgcttttactaaggaatatgccgaagcagtcccgcgaatcggcggctctctctgtggtccccgtagtgaagtatggaaaggatttattgtttgcttgtggcttggaaggagggccaaccactacccggccttagaaaatttgccaaatttggatct

SEQ ID NO: 5333 - DNA, 1231 bp, Aspergillus oryzae
tggtcaccgatcgattcggacgaggcttggctggcataatgcaaggccttttggggaattcggagagctggtattatttgattttcatagcggcccgcatcttacaactataaagccgcgcttcgagcttcacaagacatgtttgaagggccagattctgcttcagctaccttctttgaacataatatcatcataaaatgccttttgagaagcctattgttgttgttactggtgctacgggcggccagggcggctcagtgattgatgcattgctcgagtccggacgttatcaaattcgtgccgtccttcgcaatctcaccccagcgaaaactcagcctctacgtgaccgaggtgttgagattgtccatggtgatcttaatgatgaagccagcttggtggaggccttcagaggagcacatgctatctttgccgtgaccgatttcttcgagccattcatgaaatacggtccacaggaggccgagaagcgtgagttagcccaggcaaagaacctggccaaggccgctgctgagactagcgggttatctcactacatctggtcaacccttccatcgtctgccacactgtcccagggaaaataccacacgccgcactttgaatcaaaggccagtgttgatgagtatatcctgaagcaattccctgatcttgcagccaagactacttttctctgggttgcttactacgcgtccaacttaacgttcccgcttttcactcccagtctgctcaaaaccagtggcaaatacgcctgggtgcaaccggttggaccatctactccaattaccactattggagaccatcgaaagaatgtgggaatttttgtcgaggcggttcttagacagccagcgcttactcgcggaaggtatgttcatgcagaggtggaaacactcaccaacggagagctactcgagcgctggggaaaggtcaccggcaagccaacctcttatgtcccaagtacactagaggcgtataatcagctgtttccagcctgggggttggagatgggcgtgatgttgcaattttgggaagccgttggagaggcctcgtggaggaaaccgggcgtcatgcttctgcgcaaggacgatttgggcattgatactgcacatctcactgggctggacactgcttttgcgcaaattgattggaaccaggtttagatatgcatcgaagttcgaactgcctggcagcataatcctgagattgattggttccccgc

SEQ ID NO: 5334 - DNA, 653 bp, Aspergillus oryzae
ctgctgggtcctccagggtattctcccattcattgtcatgtcatgcgataccgggagaacattcttaaggctttggccgctctggtgcctttcaaggatgaataccgcaagactatctgtgacaatggggtagtcccctatatcattgattcgctcaaaccgtgcccgaacgatcctcgagacacatctaatccgaaaaacaccgctgctgatggcaaccctacaccaaccctattagcagcttgtggtgctgcacggatgctcactcgctcggttagcgtattaagaaccagcctgattgatgctggagtagccactcctttattcaccttaattcggcaccaggatatagaagttcagattgcggcaacgtcagttatatgtaatcttgcgctggactttagtccaatgaaagaggcaattatatccgcagaggtccttccaacattatgtgagcatgcacattctacgaacacaaggctccgaattgaatcgctttgggcgttgaagcatgtagcctataactcgaccaacgatgtcaagatgaaggtcattaacggcttgggacctacgtggatccagcaaatcataacgcaagacccaattagtgctctagctaaacgaaggctggatgatgagatggaaagcggcac

SEQ ID NO: 5335 - DNA, 606 bp, Aspergillus oryzae
ccatagccaagttcttcccccatgaatacggtggcgacatcatgtcggagatttcgtgtgagcagagcatgatgttcgaccgtaaccaagattgcttcaaaggttttctgtcttcttggttgaccttcaccactaccattgctccgtttacacaagaccagatcctccccaagatccaagcctcagcacaagcagcagcaaagcagtgctctggtggcgactccaagaccgactgtggacgaagctggtacaagcaggacaagtgggatggttcaaaatcgctggagtcggacatgagtgcgctgagtgtcttgtcgtccaccatgatcgctcacaagaaagagcaccaagcaccctttacggcggagaccggtggcaccaacaagagtaatcccagcgcaagctcgggtcacaaagattcacagacccgtaccgcccaacccgatcaccactggtgatcgggcccgggccttgattgtgacgttctttttcgcgtgtggctggatggcctccgtgagcttgatggtttattgaggatagtcaagggactttgtccttttgccattggaattcccgcctgtacagaaccttggatagctttagggt

SEQ ID NO: 5336 - DNA, 693 bp, Aspergillus oryzae
  misc_feature (1)...(693): n = A,T,C or G
gcactgacagttcatccatggggtacccaggagtcaatgcatctttcgcgagtcagttccaaacactgtccaagttagttatcatcgccatgcaagtccgtggtcggcatcgtggtctcccctactcactggaccgtgccatcctgcttccatccgaggctttgaaccaccatgaaattgcggatgcagagcgtcgaatgcgccgccgtgcctccagtctcagccagatgtctgtggatcaccggctgtcccaggctcaggagaacggcacgtctaccgggcttgatccccgagataaaaacacatccgcgtggttcagtgggagcccttttatgcgtcgccaatctaccatgcgatcacaaagatctcagcggtagtgctttggctatgaaattagattgatttcctagaagctctcttgctttatcgtgaccctcactccaatggtcttaatcttatctgattgggtgtaacatttgctttcggtgctgtagaccttctgttactgggttacatctgtctttgagcgtcgngtcttttagtgtatcattgctcgaacgtctacaatgctttcctncctaaggttgaatagtgtggctttgtgcggcaatttaaggggctaggtttctcttcttggatatatcccaattaaaagcccccccgcaggctgtgggtctaatttcccccaaaaaa

SEQ ID NO: 5337 - DNA, 783 bp, Aspergillus oryzae
  misc_feature (1)...(783): n = A,T,C or G
tgggaatacgccttgtcgattcgcacgaggaccgaccccagggacccccgcgtctcacccagggtcttttccgtatctccattgaggctcagtacaaggctctcaccggtgtcgacctggagcgtgtcgtctacggcaagcccgagcgtgccacctacacctacgccgatgaggtcctcaagtcgtggatggagcagatccacaacgagaaccgtctcccccagaacatctacatggttggtgacaacccggcttccgacatctgcggtggtaacatgcacggctggaacacctgcttggtccgcactggtgtcttccagggtggtgacaacgatgagaacaaccccgccaacttcggtgtcttccccaacgtcttggaggccgtcaaggctgccgtccgcaaggagcttggcaaggagttcaagttcaagtggaaccccaaggtgaaccccgttaccggcggtgacagcggctccgctgtcgaataaacgacgatcatgcccaaaacttaaaaggaacaaggaactcacgtttccctggcgtttggttgattcctttgattttcttttatctactctatttcttttctcccactttgatgctacccaacagcgtctttcatcttttttcacgggtttgaacttttgatatccattgtcaccatttcgcctgaaaccacagtgcgatgggtgattcatttcctttacattctttcaattagactgggattctttntatgtgnannaaannnnnnnnnnnnnnnnnnnnnnaaaattctgcggc

SEQ ID NO: 5338 - DNA, 622 bp, Aspergillus oryzae
atactaggaatacggttttcatttcgattcggaggctgatctctcttccaaacatcggccggtctgtctcgatcgtcgcgttccatacgtcgatcaagttcatcgcgacgttcaaatctttcacgacgatccaaatcccggtctctttcgcgatcacggcgatcaatctctcggtcgcggtccattatacgttctctctcacgatcccgatcgcgatctcgatctcgttcgcggtctcgatcacgctcgcggtcgcggtccctatctcggtccataatacgatccctttctcgatcccggtcccaccggccatcgcgtgaacgacttcgacgtcgaaaggaatcacggtcgtccagataaggaatgcggccgcgcccacgtccgatatcccaatctccccgcccacgaccacgcataggtccgccgcgggggtgatgaccgggtcctgaggatgggatgtcggctgtagtcgatgatactgaaatgaggctgtctctggagccgcgtcgcattcgcaccagatctgggtctctgccaataggctccctcatgtcgcgaaattcccaggaggcggctgggaacgggagcgaccgcgaacgaagccgatccgggaatcccttgg

SEQ ID NO: 5339 - DNA, 631 bp, Aspergillus oryzae
cctgggccctgctgcatctttttcacatcatgctgctgttgagttctttgggaagtctgctgaattgttaccttgtgtatcatttacggacgctttcaccgcagtgcaacagggtgaagcagattatgctatcattccttgcgaaaactcaactaacggcccagtcgttcaaactctcgacctcctggcagaccccaacggtttttacgaggacgtcgaggtatgcggcgtgcattatttgacagtgcaccattgcctcttggcccgaagaggtgtattttccagtcaacaggattatggttctgtggctaagctttatacgcacccgcaagcctggggccaatgtgaaagatttcttgggaaatactttagaagcattgaaaggcaggatgtctcatcaacttccaaggctggggagattgtttcaaaagcaaaaacagaacaaagcgctgcaatagctagccgctttgctgctgagctccacggtctggatgttttagaagagaatatcgaagacaaaaccgataatacaacgcgcttcttggtgctgaggaacaaaaactcgggccgcacagcgccgcgccctttcggagacttggataaccgccgcgtgcaaggagcatctgcggca

SEQ ID NO: 5340 - DNA, 650 bp, Aspergillus oryzae
  misc_feature (1)...(650): n = A,T,C or G
cttttggatgaggctactgccgcgttggacaccgagacagaggagcatatccagggagctttgtccactctttctcgcggccgcaccatgcttgtgatcgctcatcgactaagcactattacgactgcagatcgcatcctagtcttgcatgagggcaaggtcgcggagagtggcactcacgatcaactgctagctatgaaaggccgctacgcaagtatgtggcggaagcaaatacgagcgcagagggcagcggcggaggcccaagtactccaagatcgcgcccagcgcttgcgcagtgcatcaacctcgggcgctgtaggagatgatagttctagtcagtctgacgaggaccggaatggtaacactcacgcctctgcggtccgacagacacagggccatcactggcccgcgcacgatcaaaaagcatagagcagaacctggataagtcagcgcggggagttatcccaggcgttgttttcagtcacatataaagagcttatacttagagtgtccgagggatgatataccagtctagggttgtttttggcctttttttctcttncttttcctttttctcctttttcctctttttttttttttgggaagatgcgcttaccaggaacactttttaatattatttcttcccattg

SEQ ID NO: 5341 - DNA, 724 bp, Aspergillus oryzae
cgatatagactcttctaaacgaagtacgagggaggacgcgttgtcacatactgacattgactttgatctatggcactgtacgctgcacatgaggcatgaagccataattctaatgatgatcaaaatttacccgcgtggcgttctgggagctattgaggtcgctgcaggaatcatgcacgttatcttgctgcccgtcacgattgcagtattagctattgtcgctccacgaaacccggactcctttgtgtgggagacttttgtcggaggacttagtggctggaaggattcgggtgttgtattctccattggtcttcttggtgtcattactcccttagctggcctcgacggagtaatccacatggccgaagaagtcaaaaacgccaaagtggtcgtgcaccgggccatgatctctcgcaccatgatcaacggaacccttgccttcgcctacctcatcgcagacctgtactgcatgggcgactacaccgaggccgtgctgagccccacgggctaccgcatcatcacaatcgcctaccaagccacgggctccaaagcagcaacctacgtgctgatggcgatgggcatgctccccggctggatcgccctctttaacggtctcgcctccgtaacccgcctcacctgggcattcgcacgcgataacggcctcccctttctcgacttcttcgcccgcgtcgacccaaccctataaatccccctccgcgctctt

SEQ ID NO: 5342 - DNA, 715 bp, Aspergillus oryzae
  misc_feature (1)...(715): n = A,T,C or G
cgaggcatataaccaattgccctcatccccatcctttaactatagcgaaatggnttgattgnctaccgccaggntacagncattctagcccagagtactggatcaaagctggaacgcttgtccgcgacacccgaaacgatatcgtgaagatggaaggcatctatgccaccggcgggaataaccatactaacattgaggatgtgcgtgcgcccctatggtactagggggtaagtgggacatgccctgatgccgcggaaggttgggtcaaaactacgggaatgagcgacgagtttgtgagtttcggtagaaattaaagtattaggggaatggaaataggggaaggaaggtatggaagtgtagttaaggaaagaggaggaggatgggtgccttatgcatctaacgtatgtaagcgaggtgtgtaagggtagtgttatgagtgaaaggtaggagtggacggattagtaggtagcttaggccatgattagtgatgcgatgttgggtatgggttagatgtgcgtatgacgtaaggtaatggtgatataatatttgataagttaaggtatagggttggtaaataaactatagtcggtcggtgattggaaggtaaatatatgaatatacgctaaggataggatataagtccatgtgtcatgaggaatatatagtaacagtaggtcaaaaggatgggtatggtaaggggttctgttaaggaagg

SEQ ID NO: 5343 - DNA, 575 bp, Aspergillus oryzae
  misc_feature (1)...(575): n = A,T,C or G
caagggcaagggtatgcaaatcaccatctcccatccatcctcccagcgaacgaacctttccccgagcaagatgtcaagcgatttttgtgtgggcagaggggttgtttggacatgaagcgacgactgtcgaagccggctagtggaacaataataactgacgtggtttttttctctgcaaacagtcaaggacaaggcccagcacgccgttgtcctcgagaagaccgtcgctgagcgtctcaacaaggacgtccagtcctaccgtctcattaccgtcgccacccttgtcgaccgtcttaagatcaacggctccctcgcccgtaaggctcttgaggacctcgaggagaagggccagatcaagaaggttgtcggccactccaagttgaacatctacacccgtgccgttaccgctgagtaaacgtttcctcactagtcttttctcgcggacccctcatattttacgaatgatatctctcaaaattcggaagcttggctgggcaaatgatgtatagtggttcaatgaatcattcaatttcggagtgaannnnnnnnnnnnnnnnnnnannnnnnnntttcct

SEQ ID NO: 5344 - DNA, 640 bp, Aspergillus oryzae
cctgtttggggctatggtcgctgaaagagaaactagacgagagtggcgtcagagtttcctccagaatgtggaaatacctctcccgttcgctgatgacgtccgtcaaaaccctgaaaccacactccatgttgcacctgaccattgatcgatcaaatgcggatattgtccagcaattgcaacttccaaaggcgtcttacgacccctttaagtaccctaatccatccctccaatggcattatcgcattctacaagccttggcgttggatgaggacctcccggagaagccagaagacaaaacgttgcccagatatcggcagatcgataaacgcactggcgactatgtattgtcttgggccgacgagttggaaaagcaatacgcgaaaatatcggcacatggcccgaagagcacactcgtcaaacgaagcgccaaagaccgaacatctgaagtcgaggatgcagcccagaagccatacaagaaagtgaaggtggagacagacgagcaaggcgttgaagatgtagtgcgagcccattaccagaagggatcgctatcgaagcttacggtacctgtcctcaaagactttctgaatgcccatggacgctccgctgctgggaaaaagctgatctcgttgagcgtggggag

SEQ ID NO: 5345 - DNA, 979 bp, Aspergillus oryzae
cattaatatttactatcattgacttgacactactaagtgcctccgaatcacttctgatacaccaccaaatcctcaattattacgcgagtcacttcaaaacatggctttcttctccaatttctccggcgactttgctcctttgttccatttacttgatgactatgatgtccatcaagcataccgcccaaagccaaggactacaactgttcgctccttcacacctcgatttgatgtctatgaactaaacaacaattaccatcttaatggagaactacctggcgttaaccaagccagtctcgatattgagttcaccgatcctcatacgttggtcataaagggccgcgtggagcgcaagtacagcgacagcacatccagtaccaacgagcatgctgaagttcccaatgatgcttcttctgtcaagtcactccaaccaacagtcgaagatgaagatgaagaggcaaatgatgcagcatctgttggttcatcagcccaatcttcaaagcaggtggccctccaagagcagaccaaccacaaatattggatcaccgagcgcccggtcggcgaattccatcgagcctttacctttccgacgagagtagaccaagatacagtcaaggctactctgaaagatgggattctttcggtcattgtcccaaaggaacctgcccctacgtttaaaaaaattcgcgtcgagtaaattgccagctgttgggcctttacagtaccgatgatggggctcgtccgatttgacaccggactctctaatataactccattataaaacttggaagatgtctataggagactttgaagacggttgactgagtacgttgagttgccatgctacggttggtttgagcattaacgggtttgcgggtcatttggttttgtatttgggattctatgtatcctcgttgttgtatgacttgtattatagacaaattttatgacagtttaataaagaattgatatacttttg

SEQ ID NO: 5346 - DNA, 1056 bp, Aspergillus oryzae
cttgcatttcaagttcgtctttcaattctaatcattttccaacccatccaagaccatatcaacaaaatgacaacaacaaatatcaactatagcgcccttgaacaaggctacgacctcgaaatcaacaaactcacccccgttctcaccaaacgccaacaaatcacccacgagctcaatcaactacaaaccctccgcgactcgaatctctattccgcacagcaagccctcctcaactccaccaccgtgtcagacgatcaattagcccgccaggaactcgacgatgtccgatccagtatcaataacacactccaacaagtccgcactctggtagatgagcttagatatcttgcggatccgagtgatccgcgcgtgcgggcacaggtcgatgctacgaagaaccaggtgcaacaggcgatccaggattattatcggtcgcagacggagtttgaccgtgcgctccgcgaccaggtgtggcggcgatatgagattgctaaccctgaagcgtcgcccgaagaggtggagcatggggtacagcaggtgttggcggggacgcagatggtttttcaggtgcaaggggcccgaactcgacaagcgaaagatgcgcaagctgctgttatggagcgatcagctgccatccgcaagattgaacaagacttaatgacccttagcgagctttcacagcaagttgccgagcttgttcgctcgcacgaaccgatagttgagaagatcgaggaaaatgcggaggaaacgcgattgaactatgagaagggcaacgaaaaaatcggccatgcgatcgtaagcgctcgtaatgcgaggaaatacaagtggtatattctgcttgtctgcattcttattatcgctatcattgtggctatatgtgtcgggtggtgcaaatctaccgaccactgttgagcaggtcgatgatccaggaatgaccgagagcgtgataaaaacgccctggctatgaaaagatatgtgtctatgctttacttaatttacgactattggctcctacatgggatgaataatgagatgtgtttttatgggaaaaaaaaa

SEQ ID NO: 5347 - DNA, 625 bp, Aspergillus oryzae
gggcaatatggcactgcggtcgctttcatttacccccacctcgcagattctgccccgtattttcatggcctccgaagctatatctttcgtcggaggacgatggtctcgaatctggcagacttccgggcagacttccctcggtttttctcgcacccttttgaaacctgccgcattgtcgttgaatataccggaactcctgtccgatgtctgggactctgtacttcgagccgtaccgaaaaagaaaacatcccacatgaagaaacgtcatagacagatggctggcaaggctttgaaggatgtcaaaagcctcaacacctgccctggatgcggtcaaataaagcgtgcgcatgttttgtgcccacactgtgttgagaacatcaaaaagcaatggaagcaaacccaaaccgcttaagaatgaggactggacagtatcagtgaaggcgaggaaagcgatggcttaggtgtgcttttgaggcttgtacttttactatacatgaagtgttggatatatatgctgcatggcattcggcgtctggttctggcagggaaatttacgtgttggtttacaatattatttgccaaaaaaatatcttcaatcgaatggcaccatctcgtactctatttg

SEQ ID NO: 5348 - DNA, 660 bp, Aspergillus oryzae
cgagatatgccaaaaagcggccgagagctacgcggacggactcgtcctcatgggtccattcttagacatcgaacatccactagtagcatctggagacttcgacctcccagaaaccaacggatacgacccagacacagccaccttaacaaccgtattccggcactgcatcacgacgcccttgcagcgattagtcgcggccgtacccagcatcacgatcgtgatggttccctccgtccgcgacgccgtgagcaagcatgtctcctggccacaagagcagctcccgaagaaggaactcggcttgcccaagcaagtgcgcatggtttccaatccagtcaccctgtctttgaacgagactgtcattggcttgtgctcgcacgacgtcctatatgagctgcgtagagaagaggctctgcacggcaaacccaaagaaggcaatctgctcacccggttgtcgaagttactcgtcgaacaaagacatttcaacccggtcttctcgccatcgtcacgagacgccctccccaaaccagcgatcgagaacggactagccacgggcgccaccttggacgtcagctacatgaagctaggcgagtggtggaacgtccgaccagacgttacaaacgtccgcagcatgctgccaacgtttgtcaaagtagtagacag

SEQ ID NO: 5349 - DNA, 693 bp, Aspergillus oryzae
  misc_feature (1)...(693): n = A,T,C or G
cgcctaccatgcttgtgttgaccggcaaccatcgtactggtgcaagggccgtatctgctgctcgtcacctccgtaatagagggcaccgtgtgactgtctgcatgcttggtattgaacacgaaaatgaattactcgagagctgccgcaagcagattgatgtcttcaagaagatcggtggacgtgtgcacagatgggaagatctatcaacgcggctttcgacctctgaattcagtcctgatctagtcctagatgccctattcggcattcacatagcctttgatgatctccgcaccgacgatcaagctgtggcctttgagatgatcgcctgggccaaccgaagcaacctcgaagttctatccgttgacgttccatcgggcttttcagcttcgagtggtgaggtgactgtaatggagggaggccgtgtgtgcgtcagttccaaatcagtagtctgcctcggggcgcccaagactggaattataaatgcactgctagccggngagggtcttacttggagcctttccgtagcagacattggtattcctcagattgtgtggaggaagtatgggacacgtcgccggcacggaattgactttggcaatcgctgggttgtgcctctacgctaccagccatnctctgcttgaaattgctcgtgtgtggtagcccatgccctttgcttgacgactgaactgcttn

SEQ ID NO: 5350 - DNA, 674 bp, Aspergillus oryzae
cgagatcttgtgcggcatgtcagtatctctgggccggataaagacaagatcaagagtctaaagcatgtcaatcgaatgatcaagcagttcaatcatctagcatttttcgttgctagtgttatcctcttccgagacaagcccaagcaccgagcgaaggcattagaaaagttcatgaatgttgcacaaaaactgcgtcgattaaataactataattccctcggtgcagtaatcgccggaatcaacggaacaccagtgcatcgactgtcgcaaacgcgcgattccgtgcctgttcaaacgcaaaaagatttcatgaggctggttatcctcatgggcacacaaaaaagtcactttgcttatcggctagcatggaacaataccttttcagaaaggatcccattcctaccccttgaccgacaagatttggtctccggtgaaaaggggaacaaaacattttgaggaaacccgaagtctaggatcaactggcggaaattcgaggtgatgggggaggtggtttaggtttttagcgcagcccaaaaaacccttatcccctttgcataagttgaggaaacacccagcctgggccttaattcaaatttcgggtgacataagggatttatatgcccgcctttcccatggggaccccttccttgggggggaaaaggggggccaaaaat

SEQ ID NO: 5351 - DNA, 659 bp, Aspergillus oryzae
  misc_feature (1)...(659): n = A,T,C or G
ccacgtcagccaccacttggttaaaaataggcgccagagttgctgtttctgaaaacttcttttaaccggtttccgcaattgagcctattgccctgcatcatgggcgcacgcgatgaaacaccccagaccacgaacgaggcatcccccacgccaatcgagcccccacctgatgggggactcaacgcctggacacaggcagtgatgggccacatggtgtgcttcaacacatggggatacattgccagctttggggtgttccaagcgtattaccagagcagtctaggtgtatcctcatcggcaatctcatgggtcggatccgtgcagatcttcctgatcttcttcatcgggacgttttcaggccgcgcactagacgccgggttcttccgcccggtctactatacaggggtcctcctgcagctactgggagtcttcatgacctctctcgcgacccgctattggcagctctttctagcccaaggcatctgcaccggcctgggcagtgggctgcaattctgtcccgtaatgggattggtcgcgnactacttcgccaagcgcaaggtctttcgcttgggaattggtctcgtcggaaagtggaccggggcatgctcttccccgggctcgtcaaggccctcaatgcccgcatcggcttttggctggac

SEQ ID NO: 5352 - DNA, 632 bp, Aspergillus oryzae
cctttcgctgcccttttcggcggtaatccagcaatgggcggcgcgaacccgcccagtacatcaactgcgacgggtaccggtcagactgagactgcacagagagcggctggagatgctgcagggggggatactaccacaggagagggtcaaaaccaacaaaatgctcagaatccattcgggctccttttcaaccccgccatgttcggggcacaaggcggtcaggtgaaccctttcaatccccaacaaaatcctttccttcgcgatcccgctttattatcgcagatgatgcaggcaatgggcgcaccaccaggagaagctggcgcaggtggacttggcgccaatcccttggcggcgctccttggaggcagtggatttggaaccccccctccacaggacaaccgaccgcctgaggaaaggtacgcagaacagcttcgccagctcaatgatatgggcttctatgagtttgagaggaatatcgaagcgctgcgacgagcaggtggcagtgtacaaggcgcagtggaatatctgttgagccatccttcttgagttctcacaccgatctgtaatggcgtgttggccaaacggcctttcttcgtggagcgattgttttcattgacggcttctactttatg

SEQ ID NO: 5353 - DNA, 1242 bp, Aspergillus oryzae
  misc_feature (1)...(1242): n = A,T,C or G
tgtcggtgtattgcttcatcttcctagctgttacaacgcttctgggaatcagaatgcatcttaaatcatacttatctgctgccctttatgggctaccgacactggctctagatgcggccgcgtcatctacttcaaatacgtctgctggagatccattcaaagtctaccctatcactggcggaaaatataaccgccaagtggattccttacggaccgcgtctgacttttttgctcgggcctgaccgcaatggcaccaaacaaaatgtagtcgggggctatgatgaccctaaggattacttgaaagacaccgagaccgaccacacatacttcggcactgttgtcggccgctatgccaaccggatcaaaaacggcaccttccaaatagatggagacaagtacgaaatccctaggaacgagcacaacggcaccgacacattgcacggaggagatgtcgggtatgatcagcacaactggactgtcactgctcaatctgagtcttccatcacgtttactctgcttgaccgcgcactggagggcttccctggagatgtcatcactcacgccgggtacagcgttgattcccatgtcacggcccgagaaccccaagggcttgccgaagtggaccaccaaatggatctttttggttctgaccaaaaaaactccctatataatggccaaccttatttacgggaaccttaacgcgttcaaggaaaccaaggtcctgaatgacaccttgcttcaactaccgctgtccaagcggatcatcggcacagacggcatcttgattcccaacggaaccatccttggtgtcgactcgtacgacggagcaccagacttcaccactggaaagcttgtgggccaggacattgagaaagcagaagggctgtgtggaacgggctgcacgggctatgacaactgcttcattgtcgatcgagacaatgcatatggcccagccaactctattgtcccagttgttcgtatgaactccagcacaaccgggatcagtttagaagtggcttcaaaccaacaagctgttcaaatctacacctgcgataacatgaagggcaccattgccgncaagccgtcccaggccaagcggaacaaggaagaaggtatcgagggcgcaaagagcgtcaaccagtatgggtgcgtcgttatcgagaccgaaggttggattgatggaatcaataaccccgagtgggggtaacctggtaaaaccaaatttttcccccaccggagctt

SEQ ID NO: 5354 - DNA, 839 bp, Aspergillus oryzae
cgaaaggtatcatcacacatgaagtaaacttaatatagatacaccatgtgactgatttggtgttgcgagttagtcccagagtgcttgttcggtacagaagcatgtgctatggttccccgcgtcggatgatttcagagcccttctcattattatcaggggtcatgtcagaggtcagtggttttattcctgtgaacctcgacctgtcaggccgcaaccaccatgttccctcaacgcaaccttcttcgtctggctcagcgctctgcgcagcagcagcgttctgctccggttcgctctgccattcagcgccggttcaacagcaccgactccaagcttccctggatggtcgacaacgaattcaaccgtgagagagcggctgtcaagcaccacgctgcctccaccagtgatctctggcgcaagctctctatctacgccgttattccttgccttatccttggctccctcaatgcttacaacctctgggaagagcactgggagcactgggagcacatgcctcctcttgaggagcgtgtggaatacccataccaaaacatccgggtgaagaacttcccctggggagatggtgacaagaccatcttctggaacgacagcgtcaactaccacaacaaggataaggctacctaaacctttccacggacgatgttacagccttcaaccggcggtgctcggaacttgcggcgaagaaagaagtgtatatttactgcagtgagcagaagattgaacggggagcgttgggatctgttgataaatgaagagttttaccaaagtgcaggtgttgacttagtcgttcttgtcagaaatgaagacatgtatcatttggc

SEQ ID NO: 5355 - DNA, 1914 bp, Aspergillus oryzae
catcacatcaagctctcccttctctgaacaataaaccccacagaaggcatttatgatggtcgcgtggtggtctctatttctgtacggccttcaggtcgcggcacctgctttggctgcaacgcctgcggactggcgatcgcaatccatttatttccttctcacggatcgatttgcaaggacggatgggtcgacgactgcgacttgtaatactgcggatcagaaatactgtggtggaacatggcagggcatcatcgacaagttggactatatccagggaatgggcttcacagccatctggatcacccccgttacagcccagctgccccagaccaccgcatatggagatgcctaccatggctactggcagcaggatatatactctctgaacgaaaactacggcactgcagatgacttgaaggcgctctcttcggcccttcatgagagggggatgtatcttatggtcgatgtggttgctaaccatatgggctatgatggagcgggtagctcagtcgattacagtgtgtttaaaccgttcagttcccaagactacttccacccgttctgtttcattcaaaactatgaagatcagactcaggttgaggattgctggctaggagataacactgtctccttgcctgatctcgataccaccaaggatgtggtcaagaatgaatggtacgactgggtgggatcattggtatcgaactactccattgacggcctccgtatcgacacagtaaaacacgtccagaaggacttctggcccgggtacaacaaagccgcaggcgtgtactgtatcggcgaggtgctcgacggtgatccggcctacacttgtccctaccagaacgtcatggacggcgtactgaactatcccatttactatccactcctcaacgccttcaagtcaacctccggcagcatggacgacctctacaacatgatcaacaccgtcaaatccgactgtccagactcaacactcctgggcacattcgtcgagaaccacgacaacccacggttcgcttcttacaccaacgacatagccctcgccaagaacgtcgcagcattcatcatcctcaacgacggaatccccatcatctacgccggccaagaacagcactacgccggcggaaacgaccccgcgaaccgcgaagcaacctggctctcgggctacccgaccgacagcgagctgtacaagttaattgcctccgcgaacgcaatccggaactatgccattagcaaagatacaggattcgtgacctacaagaactggcccatctacaaagacgacacaacgatcgccatgcgcaagggcacagatgggtcgcagatcgtgactatcttgtccaacaagggtgcttcgggtgattcgtataccctctccttgagtggtgcgggttacacagccggccagcaattgacggaggtcattggctgcacgaccgtgacggttggttcggatggaaatgtgcctgttcctatggcaggtgggctacctagggtattgtatccgactgagaagttggcaggtagcaagatctgtagtagctcgtgaagggtggagagtatatgatggtactgctattcaatctggcattggacagtgagtttgagtttgatgtacagttggagtcgttactgctgtcatccccttatactcttcgattgtttttcgaaccctaatgccaagcacgctagtctattataggaaaggatccggattaatgtgttttcataacgcggtactgtatggtacttctgtattatatcaccgaagctcatgtatcttacatgtatatattatacagacacaaccttggttaccccaccatgatgtttcctgcagataatctcctgacgatcaatcttaccacagggatatgatggcacccaacctggcgccttcgcaaaaaaaaa

SEQ ID NO: 5356 - DNA, 638 bp, Aspergillus oryzae
gattcgtgctaaggcccacggtgctgctggtaactgggaagaagcagtgcgcgattacaaggccgtggcggagtccaaccccaccgaaaagggtatccaggaagagattcgcaaggctgaatttgagctcaagaaggcccagcggaaggactactacaagatcttgggtgtgtctaaggatgcttccgagcatgagatcaagaaggcctaccgcaagctggccatccagtaccacccggataagaaccgtgatgatcctcaaggtgatgagaagttcaaggagatcggagaggcttatgagaccctgatcgatcctcagaaacgtgcttcttatgacaatggtgatgacctcattgacccatccgacatgttcggtggccatggtggcttcagcggcttctgcggcatgggatgcatgggaggcatgggtggaaagggccgtatgggtggtatgggtggcatgggcgggacccatatcaacatcgaccccaacaacctctttaacatgattaaaacgcgcagtggcggtggaatcgcccaggcccgcggaaaccccctttgccggcggcagtcccgcctgctgaatccctggcggattcgccttctaatccaaggacggtacgtattcaacgccaaat

SEQ ID NO: 5357 - DNA, 621 bp, Aspergillus oryzae
tgctgatacagagggtatcattctcgttggcgagattggtggaacggcggagatagacgcagcagaatggatcaaggattacaacagaagaaccgcgaatcctaagccaatcatgggcctagttggtggtttgcacgctcctgccggacgaatcatgggccatgcaggcgcatggactgctgttggagaaccgggtgcacacgcaaagtatcaagctctcgagcgcgccggggcagtcatggttaaccacccagagaaattcggagaaggaatgaagaccctactgaatagtcgaccacgggtgcagaacacaacgtctaccaacaccccgaaccagaaaaggggcctacacacaatgagacgtgtaactctacaaaagaaccaacgcccacctgtatcgaagcagagccggtccctcttcatcaagcaattccaggccctggacatgttgaaggaaaagtccattccaatcaacgaaacagaaccctcagaatccgacattttcctaaatctcacagtcgatagaacagcattatcaccctgcgttatagcttcaacatctgctgatttcgcaccgtcgcacactagcaaattttctttcccttactttaacacagactt

SEQ ID NO: 5358 - DNA, 684 bp, Aspergillus oryzae
  misc_feature (1)...(684): n = A,T,C or G
cctcgttttagataagcattctttcttcggtggcaactccaccaaggctacttcgggtatcaatggcgcccttactcgcactcaggtcgacctgggcatccaggacagcgtcaagaccttctacgaagacaccctgaaatccgccagagacaaggctcgccccgagctcattaaggtcctcacatacaagtccgcagccgctgtggaatggctgatggatgttttcaacctcgatctcacccttgtttctcgtctcgggtaagtgatgtaatccggtgaatatgacaactcgatcttctaacggtgtcgcagtggtcactcccagccccgcacacaccgtggtcacgatgccaaattccctggcatggccatcacctacgccctcatgcaacggttagaagagcttaccgagaaggagcccgagcgtgtacagatcgtcaagaaggctcgtgtcacctctgtcaacaagactggcaacaccgtaactggtgttacctatgagtacgatggcgagacacacaccgccgacggtattgtcatcttggccactggtggttatgccgcaaacttcggcgacggctcccttcttgagcaagcaccgcccgacaccttcggcctgtccagcacgaacggcacacacgccacttntgatggtcaaaagatgttgatggagaatggtgccaa

SEQ ID NO: 5359 - DNA, 679 bp, Aspergillus oryzae
  misc_feature (1)...(679): n = A,T,C or G
tngagaatgatcagggctatctacagcaatggtcgatagctaccacagcctccgtcacggggctggcgtgcgtgacggtttgcctccgactgcttgcacgttatgaaaggaagcaaaagctatggtgggacgactacatgatcatattttccatgttatggaacctagtcgttgtcggatttatttacgccatgataaaagaaggaatgggtcttcatgccgacactatcccaacgagtaacgtcgtcatgatcgcgaagttcctagtcgtggccgagattctttacgtattcaacctcgtctggaccaagctcagcattttactcatgtactaccgcatcttccggtttccctacttcaagacatgggcatacatcatcggcaccttcgtcattctctgggtcatctgcatcacattccttttcatcttcatctgcgtaccggtcgagaaactatggtatccncaaatccccggccgatgcatcaaccaagtcgggacatggatcggcaacgccgtcttcacaaatcgcaccgacatcggtatccctacttctctaatcccccaagtcttgaggcttcaacttcggctttncgagaaaatagcggngtcaataagcttcaagcttggcttcttcggnggctccgcttccgctacggtttntaagnctttttaactaac

SEQ ID NO: 5360 - DNA, 683 bp, Aspergillus oryzae
ggcggtatgccagtctttagaaatcgaccacccggaaacaggtctccaaatcaagcgcagtacttgcgatggccacaaaagcaaactttgttgatatcgtcaagcttttggtagatgcaggagttgatatcaactaccaggatgagcaaggcgaaaccgcgttacatgttgcagcccgatttggacatcatatgtgtgccaagatcttgttagagggcagcgatgaccagaaggcggatactgaattggctgagcatacgtactcttggaccccactcttcattgcgagtgttgatggatctttgagcgttgtaaacctgctgattgaagctggtgccaaccttgaaaaagctgactcctccgggtggactgcgaaggagcatgcggcgttgagaggccaccttgacatcgctcgacgtcttgctgagcttacgcctgagcctgaagtcacggaagctgagcctgtgataccgattcctggtagcttctcgtctcctccagccccattctctttgatcgagcgaagatctaataccaacacgcccttcgggagttctatcacgcgggatggtgaacctgtgtaatcttttgacacaagtatcttaccgacgaaggcatgaaccttgtgagcctgggtacattgatatgcacaagccctgttgaaacaatttacccttgattgt

SEQ ID NO: 5361 - DNA, 984 bp, Aspergillus oryzae
aggaatttttttttttttttttttaacagtcaagttattcattctgtatttgcgtggagcctcaggctcatgcacatatgtactcgataaaatataaatcataaaagcatactccggcagtccccaaggccaatggccatctgcgcatcggctaatgtcccaaaaatcgtatcaatccaattgattgatcttcatctttatgtattcgaagatactgagcaagatcatattgtttaccccagtacggatgaaaataatcgaaagtcctttatacatactggacttggcaaccgcagccgacgcctcccagacttcgctggattttccgagcaacacgctctggacacgggtctttcgagtatcaagtggataggtacaaaaccacgggacagtgctgcaaatcgccccggaaatcatggggccgccaaacggggatttgtctgggccaagctctttcgatgcgacttgctttaccgtttcgtagacactaaagtataagccagaccctaaagtatcacgcagagcgtgcagatgaaagccggtgtacaggccacggattccgtaacgttggacgatctgccgaatggcctcgatggtgccgagacggggcttgttacgcaatgaggggtcattgaccgcgtctggcgaggcctgggcacggtttgacaccaagaccgaggtctgaacgacattcttagcaagctcaaaggggcctttactcaagtcagtggctgaagctcaggtaaacagatgcaattattcagtcgtacatgcaagcggggaagtgatgagcccagcaattagtccagcagtggtgaacgtcacaaaggtagagacggtaggcgtgctgcccggttgattgtacataaccagaggagactcgccagtcattctctcgaagaaatctgagatacgatgtttggcagcgttatatgtagagaagtttacaacccgaacagctgtaacactcgctaaaggtggcag

SEQ ID NO: 5362 - DNA, 642 bp, Aspergillus oryzae
agcaaaaattattcttttgctcacattctcttatatagtcaagatatatacgcctgtttcggctgcatacctatgtgatcgcatctgttttacccccttatatctggtccttgcgcataccgtcccaaattcttgaatactatgcttccacgatgggtttgagcgggcgtcacacggatgtccgccgaaagatggtgctgctaggcgacagggcttgctgtatgaatttcgacttgaacgagttgacaacagggctcttccccacactatatgagcccactgtttttgaaaactatgtccaccattatctttaccacaactgtacacaagggattatcgctctgggatatcgctgggcccgacgtatttgaccgattgcgcgcgcctatgtaccacgcacccctgtgaatatgctttgatttaagggggaaagcccagattttttcaaaaccttcccaaccaatgggcctaccaaattccgaaaaccttcctcgggggagaaaagggccccccacccttcaaaggggcttaaaaaaagaaaaatttaataccctttccccatgttttcaatacaaacaagggtttaccaaaggcaaaggaaatcggggttttaaaaacccctgaaacctctgccgaaaaaaa

SEQ ID NO: 5363 - DNA, 777 bp, Aspergillus oryzae
gattcgacttactagaaatggtgaccggatatcacttgtatacgcaaatacgaattttaacatgatagtgccattaaaccctctcccttgactcacatacccaaaaacgaggcataagcggagaaacaccatggcgttcatcaagatcgaaatcatttcagacgcaatctgtccctggtgctacataggatatcgaaaccttcaaaaggcaatctccttataccgcaagacctaccccggcggctcgaaaaacactatagaagtgtggtggaaaccatacttcatcgaccaagaaccgccaaaggaaagcatcttaatacaagaccgtatgctccgccgcatggatcccaaaatggtagcagcggcccagacccgcttgaagcgtgtaggtgcggatgccgggatccgattcaagcttggtgggtatatcgggtcgtctagactagcacatcagctgctgtatctggccgcgcgggaggggagtgagctgcagtgtcgggtttcagagttgctcttccactaccagtttgaggaggagaccgatattagtcaattagataccgtgattgctgttggggtacaggctggacttcgtgaagatgatgtccgagagtggctagctagtagtgctggagtggcggaaatggaagctgaagcgaagaaggcaagggctgatggagttactggtgtgccccatttttgtatcgggggaaagcatcatatggagggtgctatggatatgtccgaactgtttgaaccctttgtgctgttagaaaa

SEQ ID NO: 5364 - DNA, 640 bp, Aspergillus oryzae
  misc_feature (1)...(640): n = A,T,C or G
ctcatttaacatccgttgttcaggaagaccaacacaaagcaatggcttctacttacggggactttcgtcacttgctacctagcaattacaaacgcctgattacttcctggctcgaagaggactgtcccagttttgactatggcggtttcgtcgtcggggagtcagatggtgaggcaaggttgttggggaaagctaagggagtcgttgcaggtgtccctttcgtcgatgaagttttcgctcagttaagatgcacagtggaatggcacgtccaagaaagcgagcccaattgaacctatcaaacattgcgccacaatgcgcgggcctatccgcaagacctncttcgagaacgtgtcgccctcaaaatctcccccgtggtcccgtatcgaaacaaaaaccgcctgctaagaactgctttcctgcccacagattgagtggaacgcttgctggcacccgtaaaacccaccctgaattcccgtggccaaaaatttggaatttttattgaagggcccaaccacaccgccttaacttaattcaaaaacaaagctgaaagataaccccctgttgggcttgtgcgaaataaccggggggttaaagatgggggcgggtcctggttttaaccaaatccgttcgagtttgtttt

SEQ ID NO: 5365 - DNA, 661 bp, Aspergillus oryzae
ctgagcgactgtcaagccgtattgacctcccgaagggctcatataatccgatatactacgctgcatctaccaaccgagttaatctcatccgtgaccaaaccaaaatcacgcgcaacgcgccacttgagcgccgccgagtttaagtttcgcctgcaacgttcagaaagcagtgctcgttcagattctcaagatgccaaaattcttctgtgattattgtgatgtgtacctcacgcacgactcgatgagcgtgcgcaaggcgcacaatgcaggaaggaaccatctaaggaacgtgttgggatactaccaacaaatcggacaagagaaggcccaatccgtcatcgactccatcacctcgtcgtatgccgccgaaggccatgccgtaccgaaccccgcgatggctcccccatggcgcttcccccctccatttccattcccaggacgtccaggccaactgcgaccccctccattcggcttcccaccagcaggaggaccagacggtgccccgggcaagccccctcctcgaggagcaagaggtttcgcgttgccaacagtcgatcccggaagcctcaaggtccgccaaggagtcttccagcgcctccccgacatggcggcatggaaaggtctgcattccgccagggaagagacgggtattgcctcggag

SEQ ID NO: 5366 - DNA, 681 bp, Aspergillus oryzae
gatactttgaagccttgccaacagccatgcggaaagaccaagacgatgtgcggtcatccatgcacggagccttgccacgcgccttatccatgccccgagaaaacgccctgttcttccatgatcacggtaacatgtggttgcggacgccttcgccaggagcgtcgttgcaatgcagcgaaggctgtggcatcaaagggacagttgcagcagccacaaagattgcctgctgtgacccccttgacatgtgatgatgaatgcgcgcggctcgagcggaaccgttcgttggcatctgctttgggagttgacattaacccgtcgactactgttgcgcagaacgctactgcgagtcttccctattcttctgaaactctggacatgtatatccagatgtcgtcctccgctcctttgtctaccctccaatcttatgaatctactcttcactcattagcggctaatccaacacaacgttctgtacggtttcaaccagcaaagtcattcctacgggcgttcgttcattctctcgcaactgactggggctttgcgagcgagagctttgaccccgaacccacccgcatgtgtttgttttgagaactacagtgtggaacactcctcttttttggatgggcatgggacagcgatcggaatctgccgcattaatgtaacccatgcggtaaactacct

SEQ ID NO: 5367 - DNA, 668 bp, Aspergillus oryzae
  misc_feature (1)...(668): n = A,T,C or G
cagaccagaccagaccagaccgggtcaaacacaagaaagcaaggtagtcaagatgtctcacttcggaacggtttatacttatcctaataacccgagggttatgaagatccaagccgccggcaacctcaactccctctcaataaccacctcccccgatttccaaatgggcgtcacaaaccgcagtcccgaatacctctccaaattccccatgggcaaagcccccgcattcgaaggcgcggacggaacccttctcttcgaatccgacgcaatcgcccaatacgtcgccgagagtggtccggccaaggaccagctccttggtgtctctgcggcggagcgcgcgcacatccgccagtggatttgcttcgccgagggggatgctatgggggctgtggtgccgtttgcgatctggcaaatggggttgaggaagtatacggcggaggagttggaggagcatttggccaaggcggaaagggcgttgggggctgttgaggcgcatttgaagacgggtggggggaggaagtggttggcgacngaggaaaaagtgagtttggcggatattagtctggtggcggcgttggaattgggggtttgcgactgttttggatgcggagtttatggccaaagtatccaatgttgtggcctggttttagaggacgaatggaagatga

SEQ ID NO: 5368 - DNA, 654 bp, Aspergillus oryzae
  misc_feature (1)...(654): n = A,T,C or G
ctccttggacatctgggccaacttgctcgtgccttcaagcacattgccaacagttacttgcgcaacgtggccgcgccatttaccgcctcctgcattgcccacctcctgaactgtctcctgggtgctgatgtcaactcgaaccctcaagccgatatcgacgcatctctgcgggagatctatccagaggctgacttctcttttgagaaggttacaccgacaactttgcgggctgagattgagaagcacgtctctacccggtaccgttacacccctgagcctgagtggttcaactctttgaggcacctgcagcttcttcgtgatatctccatcaagctcggtcttcagcttagcgcccgcgagtacgcttttgccaagtcccaacttcccgctaaggttcctgctaccaacggtgccagccaagaggaaggcaaaaagaagaagaagaagggcggcgattctaagtctccggctcgtgctgnctctccagagaagcctgctgtatccatcgttcctgacgacatcgtcaacattgtgcctcttgtcaaagatgcctctccccgaagctncctttgctgagaagccctggaagctggacgtatctccttcatgcagaaccaaaaacaactgggccaagagctcattcttgaatctctt

SEQ ID NO: 5369 - DNA, 658 bp, Aspergillus oryzae
  misc_feature (1)...(658): n = A,T,C or G
cataaacaccgtttggacgacgatttcgaaccaaccggcttggctcgagcttttaaagctaaagagacacaatgttttacgatctcaacgtgccgtgcggcccagacgatcccgagctctatccaactttaagctttcttgcagaactcggttacacaacgatcgccctttcgcaaaccctcaacggaaagcttcctccaaatcctactcccccacctgttcccaccaatgttcccaagggcctgacaatactcacccgcgtgaacctaccactctccgaccccacgcagaatcagcgacttaccaccctcacccaagcgtatgatctagtagcaatccgcccagcgaatgaaaaggccctgttgaatgcatgcaccaatctggaatgcgacgtgatttccttagatctctccgtgcgacagccgtaccacttcaagtttaaaatgctctccgccgctatcgcacgaggaattcgctntgaaatatgctacggcccgggagtcacggggagcggcgccgacgcctgggggcacctcatcggcatagcagtgttgcggattcgcgcaagacgccgcagaggaaacatcatcccgagtgtacggcaagaaaagctctgggttgttccggccaccgtggggatgtgatttaagcttgcgag

SEQ ID NO: 5370 - DNA, 782 bp, Aspergillus oryzae
  misc_feature (1)...(782): n = A,T,C or G
ccaattttccttacccaaataacatgacgacaagacaactcccgatcctcctcctcgacggtggtctgggtaccaccctcggcgaccctccccacaacatcaccttcacggccgaaacacccctctggtccgcccacctactgatttcctcgccctccaccctcgaggaagtccacaaagcctttgcgacagtcggcgccgatatcatcctaactgctacatatcaaacgagctttgagggatttacgctcacggaccctcgttacacggccgacgatgcagcgcactttatgcgctccgcgattccgcttgcgcgacgcgcgggatcgtcctcagggaggacggtaaaggttgcactatcgctgggtccctacggtgcaacgatgtcccctgtcggggcggagtatacgggcctatatccggaagagatgaattcagaagcgaagctgcgcgagtggcatgcgcgacggctgtgcgtgttcgtggacgagacggggtcgtgggacaactttgaatacattgcgtttgagacggtcaggagggcggatgaagtgaaggccatccgtggggctatgtcgatgtgctggcagacatgtatcagggtcaagggcccgattncgagagaaccaattggcatggggaagagccatggtggatctggtgggtctttccgatgaagaggtgatgaggagattgacggcgtggtaccttgcactgttgcacacaggagggagaacgggcgtaatcttcccggcgtggggatcgggggattgccccgatgg

SEQ ID NO: 5371 - DNA, 868 bp, Aspergillus oryzae
aggaattttttttttttttttttcccaagagaaactaaattccggagcgctgcatatctcaaaactagcgagggtcgagacatcgagcagtttcagaaagccttacaaatatcaagtccgcagcgcatctacattctacccaaagaatctccatggtgatatgaccacagccatcgtggccaggagcgcaatcaatgtagcgaagaccttagtaacattgaaggttgaacaaggtgcacggcatttcaactgtttttctcttcattagatagtagaaccagggagctccgaccaagcatcctctggaagttgatttagatatgtaggtcgtctggccggtgacaagtgccgttcctgacttatgatcacagcatccgacagacgcagggacttcagtcctcccgtatatcaaacaggtcagatcgattcatcccagtgccggcccacacaagcatccatgccaatgccaaatcccattcgacagtcgacttatgcttcggcaaccgtcctccgagcccacctctccctacttcaaatcattgaaggtatttacagagccttcttcttctcgcccttggagacatcaacgaccttgagggctgggggcaagctctgcttgagcttgtcggccttgtcggagtccttcagggcaagggtgtagacgaagcgctggcagcggaccttgaacttgacctgctgggtcttgcggttgcgcttgatgcgggcagaggaggcatccttgcggcggcagatctcaatgaactgcttgatgtcggagatttcacgaggcatggtgggcggtgattggggacgtaagtcgggatggtcgagcaaaaagtcgggacgagtgaaggacaatcgcgatctc

SEQ ID NO: 5372 - DNA, 692 bp, Aspergillus oryzae
cgaggctccacggttcagctatttctcttcgcagactcaacaggtcgtttcctcttccaactgggaggagatcttctccgaccagtttatcacgcacttgcaggagagcgagaggactgaagggaatgtttggtggctggacatttgcgatgccaccgagcaggatgtcgacattgtatctcaggcactgtctatccaccctctgacggcggaagatatcaccatgcgtgagccaagagagaaggtcgaggtctttcgaaactactatctaatctcgtttcagactttggtgacctttgcagatgaaagtgaagagaagggaagagccaggtctccggcaagcattttctggtccaccccttcctctgccgggtgttacatcctcgtcttcaagaatggggcagtgaccttctctcctagtggaaatggacacatacgtcgagtcagagatcgaatccgccgtctccctgatccatccatcttgtcaagtgattgggtctgttatgccctgatagacgatatcatcgacagctttgaaccgtacatgccagccggggaacgtgagtctgaatccatcgaagatcaagtcttcatcgctcgtgtagacgacgtcaaatccctcatccctcgtgcccgaaaatctcggaaaaagatcacctattttatttcgcgctcttgaccgggaagggggc

SEQ ID NO: 5373 - DNA, 637 bp, Aspergillus oryzae
  misc_feature (1)...(637): n = A,T,C or G
ccatcacggaaagccggcatccccctcattgatgacaatgtcttcgaaagtctggagcatcaatcctatggaggatgtcaatataaaagaaccatggattccagcaccaggaacatctttttatcatcatcacaacaataacagttactacaataacaaaaacagcaaaacaacaagcttcttccaaatctttcaatccaatctacaatagaatcactatttctattacttcaaccatcaccatgagtgcccaagtcaacaacaaccaatacgacttcatcgtcgttggaggtggcaccgctggcaatgctattgctggtcgcctttccgagaaccccagcgttcgtgttctcgtcgtcgaagctggtatcgccaaccctggccagatcgatgacatcaccactccttccaaggctttcggactccgtggaagccagtatgattgggcctacaagactaccatgatcaagcgtgacgactacgagcgtattgaaaagcctaacactcgtggtaaagctcttggtggtagctcttgtgccaactactttacctggatccccggatctaaggccacttttgatgactggtacgagttcngtggcagtgactggaactgggacaactgtgtggagtacct

SEQ ID NO: 5374 - DNA, 1993 bp, Aspergillus oryzae
  misc_feature (1)...(1993): n = A,T,C or G
ttccttttaacccccccaactcagcatcgttccatcctcccatctttcctttctttttaccttaaatctccatctgtattctttcctcttagaactctcctttcccccttctgtaccttgtgttagacgtcactcttgttgcccatcatgagaggcatcctcggcctttccctgctgccactactagcagcggcctcccccgttgctgttgactccatccacaacggagcggctcccattctttcggcctcaaatgccaaagaggttccagactcttacattgtcgtcttcaagaagcatgtttccgctgaaacggctgctgctcatcacacctgggtgcaggacatccacgattcgatgactggacgcatcgacctgaagaagcgctctctttttggtttcagtgatgacctttacctcggtctcaagaacaccttcgatatcgccgggtccctagcgggctactccggacatttccatgaggatgtgatcgagcaggtccggagacatcctgatgttgaatacatcgagaaagacaccgaagtccacaccatggaggagacaaccgagaagaatgctccctggggcttggctcgtatctctcaccgtgacagcctctcgttcggtacctttaacaagtacctgtatgcttcggaaggcggtgagggtgtcgatgcttatactattgacactggtatcaacattgagcatgtcgatttcgaggatcgagcacactggggaaagaccatccctagcaatgatgaggatgcggatggcaacggacacggaactcactgctccggaaccattgctggtaagaagtacggtgttgccaagaaggccaacatctatgccgtcaaggtcttgaggtccagcggttctggcactatgtccgatgtcgttctgggtgtcgagtgggccgtccagtcccacctcaagaaggctaaggacgccaaagatggcaaggtcaagggtttcaagggcagcgttgccaacatgagtcttggtggtggcaagtccaggacccttgaggctgctgtcaatgctggtgttgaggctggtcttcacttcgccgttgctgctggtaacgacaatgccgatgcctgcaactactcccctgctgccgctgagaatgccatcactgtcggtgcctcgacccttcaggatgagcgtgcttacttctccaactacggaaagtgcactgacatctttgccccgggtctcaacattctttccacctggactggcagcaagcacgctgtcaacaccatctctggaacctctatggcttctcctcacattgctggtctgctggcctacttcgtttctctgcagcctgctcaggactctgctttcgctgtcgatgagcttactcctgccaagctcaagaaggatatcatctccatcgccacccagggtgcccttactgatatcccatctgacacccccaaccttctcgcctggaacggcggtggtgcccacaactacacccatattgtcgtcaacggtggatacaaacgccggcagtgacaaccttaatgaccgctttgaccgactattccacaacgccgagaaattgctcgctgaggagcttggagctatttacagtgagatccagggtgctgttgttgcatagatgcaagacaagacttgatttagagtgacgtaactagtttcgtttatggcagggtatgggaattggctaaccgaacactggcgctggtatttgtttttgctgctgctttttggtaacacggagaagccgatgcattgactgcattgggtacattatcctgacatggtttacctggtctttcattattattatagcatacatgtccacaacaatctttgacatcctatctagagatacatgtgcttgcttttaacagactgccaaatcaattatgcgactgttctgcacagatnannnnnnnnanannannnnnnnannggaaaaaaaaaaaataaaanagaaaaaaaaaaatttcct

SEQ ID NO: 5375 - DNA, 653 bp, Aspergillus oryzae
gtttacttgattcttgacgtgtttctatatcggtcccaagtataggttggccgctacctagtcgttcatttggatataagatattgtgcttttcgcatcagtctttctcaactcgatagtataacttcctgtgatcagctacgcttccattccattggcacccggccaactaaacctcgcataccctggcttccccctaattcgtccttaatatgtcggccgatcaagagtttgaatacaaaaagtggctctccacgagctgccatcctattatagatggcatggatactgcgtacggctatcagccgtcgctggctgcaggcgtcgtcttcctcgttctctttggtctctcgatgatcgttcacacaatccagtttacctggaaaagaacctggtggtgtgctgtcttcagtattggttgtctgacggaggtcctaggctgggccggacgtacctggtcctcagaatgtccctacaacatgacagccttcctgatgcaaatctccaccctaatcattgctcccacattcttcacagcaggcatctacgtcctcctcggccgtttcatcgcaatacttggccggcgactcctccatcctcagtcccaaaatgtacttttggatcttttgcacctgcaaagtatctggcttgtc

SEQ ID NO: 5376 - DNA, 640 bp, Aspergillus oryzae
cggacacgttcaactatataaacacgtccggaacctgatatacaatacgcttcaagaagaacaaggacagggaacacaataaacctaaatgtccgactcaaaagccgctctcctctcgcaatccgaacccatcgaccccccaccagcctacgatgcaacagacaacaagccaccagcacgcacacccctcccccgcccaccaccgctctccctcccggtgctcaacgagctccgcagcaagcgagtcatcctcgcctcccaatccccacgccgcagacaaatcatgtcccacctcggcctgcctaatctagagatcatcccgtccaacgcagaagaggatttccctaagacaatggagccatttgagtacgtgcttgccacggctacgaagaaggcgcaagcggtctacgaacaggagatcatgaatgaggagaagggcgagccggcgctgattctcgcggcggacaccatcgtcgtggattcggctactgggacgattcttgagaagccgcgctccgaggcgcagcatcttgccatgttgaagtcgttacgggataaccgtgaccataaggtgtttacggccatggcggctatggcgccgttggttaatgcgccgcaaccggggtatgcgcttgagacg

SEQ ID NO: 5377 - DNA, 656 bp, Aspergillus oryzae
cccctttcttcttgaccattaatcaaactccacaacgattaaatcttgtacttaggagcagggacgctctatctggaactagactgtgaaacgaaggtgaccttaatccatcccgcacgatcttccttttctcctttccattcagcttcatccaggggagagttatcaacatatcgtcaatatgtcaggtctcgatgtcgaggctctacttgagtccacagccgccgcagcaccaccacaagatgcacgacagtctcaggaacgcgatgaccgctccaaagccgatagtagtgaccgccgggaccgcgaccgctcacgagacaaagatcgtagacgccgggaccgcagccgggaccgacgtcgtgacgccgatggagatgaagacatgaagagtccgagaagcgaacatggcagtgctaacgggaggcatagaagcagaaagaggagcaggagccgcgagagtgatcgccgtcgatctcgacgtgaacgctacggtgatgactaccggtctggcggtgactatttacggcggcggcgggcggggccgcactcgatctcgatctcctaatgatgaccgctattaccggccttcaggtcttgcccttcgagaagagaaggatgatgaccgaagctctcgccgttgaccgagagaaccg

SEQ ID NO: 5378 - DNA, 403 bp, Aspergillus oryzae
  misc_feature (1)...(403): n = A,T,C or G
gttcacacagctgtggaaaagctaggtggtttggatatcatcattgctaatgctggatggacgcgctntactcgccctggggacatttacgacatgtcccacgatgagtggaataagtgttgggcagccaacgtaatgtcccacctgcagcttatgcaaactgcgcagcctatcatgtcgaagaaccccgacggcggcgtctatattgcaacttcttctgttgccggaatcacgacgagcggcagcagcatggcatactctgtcaccaaagcagctggcctgcacctgatgaagcatttcgccttcacatttgggcccgagattcgcgtcaatgcagtcttgccgggtctacttctgacggaatggngcatgaagtttggcgacaacattatcaatgcgctga

SEQ ID NO: 5379 - DNA, 674 bp, Aspergillus oryzae
cgtcaatccaagcagacattttttactgctggttatctgcgggtgtccaagaaagatcgtacttgaccggctgcatatattgggtaaaggtcattggatatccagggctgtaaggagaagctgcgtggatgtcgtcgatttcctcctttgaaagcttgaccttcaaggcatcaggcatagccttgatgtgttcaacagtgttgactccgacgatggggaacacaaatgtggactggtggaacaaatatgccaaggcctgattggcgttgatccctttccgtcagcaatctttcccaataccttacttggcttgagggcaataatagacacagatcctcatcgggcatctgggtcggatttcctctcctttcgcttgctgaactgaaggcaacacgccacggcccaatgaccaataaaaaaaatcctccatgtttgatacctcgcacatggggataacatacccctcatgtcgcggaaggcttgtttccaattgcctgggaaaaaaaaaagaggtcaagccctgattttatggcgttattaaggttagtggtcttgctcctcccaaggggaaaaaagggaaaaaaaccttacggcgttggccttgaaaaaataccaacagggtttttttctttcccggggatattttaacccccctttgataaacaaatgttatt

SEQ ID NO: 5380 - DNA, 651 bp, Aspergillus oryzae
  misc_feature (1)...(651): n = A,T,C or G
ccggttccgttttcccagccttcagagttattcgctttgcgttcctggacggcagcctcgttgagtcgattagctagttcgagaatgcgcttccctccgactagagcttcctcgtggttatctttaatatcgacattgaatacatggacgggtcggttgaggagcgatcctttattcatgagatccgcaacaacggcatcccagcaacggtcctcacaagggataatgacatcgaacaagccggcctcggtccccaaggcgcctttgtcggctttcgcgacgtggtccacgcggggcataccaaggacccaatcttggaagcgctccggcccccaattcaagttccggttgcgttcgagcatgtttaaaagaccgttgttacgatagagcctctcatccttggagtacagttcctcgtacatttgggaatacgaggtggtattgaaattgtacacattaagttgcgtgatggatgggcctggcagacggacaagggatcccgtcccacagggaaataacagggaaaggagacggttgaagtaaatagacggagatgggcttccatcgaacgggtttggttcgaggcgcacaccgtgcaaaatctaagtttgtaagagtctgaatggtgctcctgggtaagggcggatgaan

SEQ ID NO: 5381 - DNA, 662 bp, Aspergillus oryzae
  misc_feature (1)...(662): n = A,T,C or G
catttatcataacttattggcgcttgctaattatttccctcgtattctcccatgggttgaatggttcgtctttggtctgcaatatgggtttagatcggaggcgaaggttacagaagctgtcgaacccgctcgcgctggactcttgttgaactgtctttactcgcaattcgtcaatgagtgggcgctacccctggagaaaggcccagaggctatcatacgcttgtcggcttggttaaatggagacaccgagacggcgcgtattccattccctgttgaaggattgtgggtgcattgccccattgaagtcagggttacggattcaacacataacaagaatcctcggcctttccttgaccctagtcatcacgacggcccaacattatatctcaatgcaactctatatcgnacctatctccggggacccncctgtaaggacaggtactatgaggcgttttgagtggctaatgcgtgaaatgggcgcgaaaccacactggggcaagaacttcaaagtcacanggacgcacgagctgcaagggctatatgggaangacatggatgaatggntaaagtgcgtcaangaggttgacccgatggcatgtcctccggcaatgcaatctcttaacctcgccttacaggtggcanaatgatgaacaatgtcaacn

SEQ ID NO: 5382 - DNA, 118 bp, Aspergillus oryzae
tggttccggaaagtccgacaaggagcgcaatgtcctcatctatgatctcggtggtggtaccttcgatgtgtccctgttgaacatccagggcggtgtgttcactgtgaaggctaccgct

SEQ ID NO: 5383 - DNA, 552 bp, Aspergillus oryzae
  misc_feature (1)...(552): n = A,T,C or G
ggaaaggtaagttttttcatacccacagcgaccacatgccccaaaacagacatcaatctgctaacacaatccatcgcaacaggcccaaacattgtcccgtacgctcatcccatcaatcaatagcctcccccaaaccagcgcttgagctgaggcaaaaacccgaaccgagatcctacatacataattcggggccctatatacgatatcaataactaacacggttgaaatctgatagtctccctctcccccggaaactccctcctccgccgaacacacccccgatcaagacgcaaaagcgcggagcaacaatcctccctaacttcgtgggcttgcggttctcggtgcacaatgggaagaactaccaggatgttttgatcactgaggagatggtcggacggaagcttggtgaatatgttgcgacccggaagaggtttacgtataagcagtcgaagaacaaatagttaattggcttggggctgtgtggntatngtgctctgtggggtgatggaanngggcaataatggcctgacttagagtttgcggggaggattt

SEQ ID NO: 5384 - DNA, 698 bp, Aspergillus oryzae
gaaaacataaaacaaccaaatcccacccaaccaaaaaccaccaaataaaggaaaccaaaatgatccgacccgcacccatctttcgaaagcctccagtctaagatcgacgaagaggctgccgtccgcgatgaactccatgagatagttcagacgcttgctagaaatggacgctccacaacggctattctctctcgagctcattccacaccctcagatcagttgaaacctgtcctcgacgaggcaacaaaggagatcctcgctcagaaagagcaagtcactcggctcaaggccttggctgacaagcacccgttctacaaatataacggcgtgtggactcgtgaactgcagaatctggtgtcgtctattgagctctgtgcctatctgggcgggctggaggagtacaagagtaacagtgctgcatcgttcttgactattgaggaggtcgggaagtttcttgatatccccgtcaatcttaaggaacaagatgcgttccatcttacgattgaagaatatctgctcgctctgatttctatggtcgaggaactgtctcgtcttgctgtcaactcggtcactcttggtgattacgcacggccggtccagattggcagtttcatcaaggatttgtttgccgggttccagctcttgaacctgaagaacgatatctttgcgtagagaagtgatgggaataagtacagtgt

SEQ ID NO: 5385 - DNA, 525 bp, Aspergillus oryzae
  misc_feature (1)...(525): n = A,T,C or G
catactctcatcatgccgacaacgatgtcggagttgcagtgattgaccgctggacgtactatgtgctcgagttccttgaaactcaggtaacaagtgcgaactctaaactgacactgggcgacttgttcgattcgtacgacgaaaccaagatccactcacaacccggtgtgcgatgggatctgttccctggtgccgagcaggagggccgcctacggacggtggtggactttttcggaaatgtccagaacattgaggttgagaataccaccgcgactgacccgggatctctaaaggaagaccttattgagattgcgcgactggttgagaaatggcgtgcacgcgatcgagaatacttggtcagtcaaaacgactcgtcgcttcgcgcaggtaatgacaactccggattgcaagtttctttatcacctcactcggcgaggaagaattttgagcctgccaaaaatgtcccaangaagcttcttggngaaaagcgactaagtcgagctttttgttttggggatctgcgcn

SEQ ID NO: 5386 - DNA, 647 bp, Aspergillus oryzae
caatccctgctctcttattcttagctctcagataaagatctttctctatacacatagccaaaatggcagccacagcgaaacgcccagagatcatcgagctggcacgtgggttaaacggtgtccccatgtgcgaagaatatgaatgcatgatctcaggaatgatgtacaaccccaacatacctaagctcttagaagctcgccaccgctgccgtggcttaacagatgactacaacaatctggacaccaagacagtgccctacgaccagatcgcagacaagcgtatgggacgattacgggcactcgtccgccgagtaggagatggggacctcatcgaacccccttttagacccgactatgggtctaaccttatcaatcggagcgattgcttcgtcaactggggtttaacagtcctcgacacaagtctagtccgtaacggggaccgggtacagatcggcacgaatgtgagcatatcaacggcgggcacagaaacaatgtgcttccccgggaaaaattgtcgaattcggcaatcccaccttcattgggggatgatggccggttggggccaatgttgggaattttgcctggtgtgcgcattgggaaagggaccacgattggggcctgggccaattggtaccaaagggaattcc

SEQ ID NO: 5387 - DNA, 638 bp, Aspergillus oryzae
gaggagactttataacgctggaggcgggccattcgagtcgcacaaactcgggactgtgaaccgggattcatctaagcctgaagataagcgaatccgacgctgcatgcgcgcacgaggaaacatctccgaggccggcggccaccacgcccatctttccgccctcgcttatgtgaccgatagctatttcatcggaactgtatcacgcgtccatgacatccctcggtttgcctcccctgccgaactcaaggcagccctaaacgcactgaagaacccatccgacttggatgacgacgaaatctcgcgagcattcaaggagttgaaggaagaagaagccgcagaattgcgccgtcggctggagggcgccctcagtaaagctgaggacccgaagaacaaacacaagcataaagaggtcggcatgatggtcagtcttgatcattcgatttacttccacaatccttgggcgtttcgcgcagacgagtggatggtcacggagatggagagcccttgggctggcgagggaaggggtttggttctccaaaacatctggtctaaagatggaacattaatcgccacgtgcacacaagaaggtggtggaaggattaaaaccaggaagaaccttccttgggccaaaatataaa

SEQ ID NO: 5388 - DNA, 680 bp, Aspergillus oryzae
cttcatccattcaaactttcttcatccatcacataccaactctacactacacatcatgtctggctacgatcagtacaaccagcagggcggccactacggccaaggccagcagggctacggtcaacagggctacggtcaacagggctacggtcagcagggctacggtcagcagggctacggtcaacagggctacaatcagcagagctacggacagtcttctggatacgatcagggatacaacagccatagcggtagctccggctctggtgccgccaacgactactacggcggcggcggacagtccgagcaccaccagcagtcttacggtggtcagcagcactatggccagcagcaaggatatggtcagcagggtggatacgaaggttctggtgaacaggctcccggcggtgctcaggagggtgaacgtggcctcatgggtgctcttgccggtggtgcggccggtggcttcgctggccacaaggctgatcacgggttcctcggtacaattggtggagcgatcatgggttccatcgcggaggacgccatgaagaagtacaaggggaagtagtaaacccgttcttgtcacctcacctttccacgatgatccctttccgcgatacgtgaactagctcctttcgacttctatctcgttcggctggcccggttcgcacgttctttaa

SEQ ID NO: 5389 - DNA, 655 bp, Aspergillus oryzae
  misc_feature (1)...(655): n = A,T,C or G
tcatattcgtttggcccagtcaattgtcttccttcacactatgttcttcgctaggcgatcggccacttccgcgcggctactgctgcgcaaccaaccccagcggcgattcgactcgcacgcggctcaccaccatgctgagcctgtgaacgagagcttcggtcgtagcttctacgtcaccgtcggctccttcgcctctgcctacgtcctttaccgactgagcaagtccaccgaggagtctggatcgcaatcgtggatttccagcctcatccaaaagtggaccccttcggagaaggtttttgaagagagaaatgccattcgcactgtcgtaatggagaaggctgcccatgaccgccacttgttccagagtcagggccctagagccgttttcgaattgaagcagcccgaggtcagcttcaactccgccccgcctttcaacgtccctgccggctcggctatggatatgagccatgttaccgcacactatgagcgccaaaatagggagctggaagaggcccgtgttgcccggatgcaagatggcaaaggttgtctctatctatgattagacaaaattgatttcgttttcatgttccaagacgcccggagtaagcatgacagggtcaaacattatgtacatataacaggacagttcaatgtn

SEQ ID NO: 5390 - DNA, 1179 bp, Aspergillus oryzae
cattctctccttcccacattcattatctggtattgtcctgtgccgtgcacggtcaatcagtcattcctttgagaaagtaccgcctgaccaccatcaagcgccactgtctttttatttacccgaccttctttatctagagaaccggtcttctcttgtttgcacaaagtttgaggaaatacagaagaaaaaaagtcccatcacaatggtctccttcaccaagctcatcgccgccggcctcctcgcctccgccgccgtggccgtcccccacggccaccagcactcccatgtgcacgtcacgaagcgctcctccagcaagcgtggtgccgcctacaacgacgcctcgaccgtcgagaccctcagcagcaacggcgccatctcctgggcctacgactggaacatgatcgcctccggcagcctgccctccggcgtcgagttcgtgcccatgctctggggccgcaagatgttcggcgactggttcaccaccatccagaccgtgctcagcagcgccagcggctccagctacatcttgggcttcaacgagcccgacgccagctcccaagccgccatgaccccctccgaagccgcctcgtcctactccacctacatcacgccctacagcggcaaggccaagctggtcacgcccgccgtgaccaacggcggcggcgacaacgagggtctcggctggatgcgccagttcctcgacgcctgcaccgactgcggcatgagcgtgctcgccgtgcactggtacggcgcctctgccgacgaattcaagaccttcgtccaggaggcccaggagctcgcgtccaagtacaacctcgaggaaacctgggtgacggagttcgccctcagcagcgccatgaccgccggctcgggcacccaggaatccaccgatttcttgaacgaggttatcccctggctcgactcgcagagcggcatcggtcgctatgcctactacatgtgtgccgatggcttcctgctcgagggcagcgacctgagtgccagtggaaaggcctacacctaccaatcctgatgggcaaattccccttcggtaaatatttcacaatcaaaaaaacaatcaaaaaaatacggattagaaaattaggcaaggaaagggatcggtgttactttttttgggccaggattggcaagggtttattcagttgggttaacttgggtccc

SEQ ID NO: 5391 - DNA, 681 bp, Aspergillus oryzae
  misc_feature (1)...(681): n = A,T,C or G
ggccttctctttcttctcgcattggttggcgtttaactggccctttatggggtgggctggggggcacaaatctgtagacggatttccccttcttttcccctctcgtaactttattccctccgcccaagatttctcaatcatctgttactacaaccccgccgtacttgagttgatgacttgacgagactgacgaattttcttctgtacttctacataaacccatatccacgtctttttcaagctcttctcatatattcctttctttctgttcttggacgggtcccttcgtctccgtgcttggacatcagatcattacataacggccgcacagaattgaattgaattgaatgaaatcactctaataccaagaaattgcaattaggcaaccccaattgaaagctgaaatggcgtcagacctcacaaaagtggtccctttgacctgccacggacactctcgtcctgtgccgcatatcgacttttcttccacagtagaagatgatcagtactacctcatatccgctttgcaggacaacaaccccatgcctccggatggtatcaccggtgattggattggaccttcnctcgccacaaggtgcagtctggcaagccagactcttcacagatgccaccatagcagcaacagctgcggccgatttcttcgcaaaagtcttggacacccac

SEQ ID NO: 5392 - DNA, 661 bp, Aspergillus oryzae
  misc_feature (1)...(661): n = A,T,C or G
cgatcaactcaccgctggttttgaaaccagtgccgtcgccctcacttacctgttctgggagctttctcggcatccagacgtgcaggaagagctgcgagcagagctcttgacactggagccaaagattctgtttccccgatctagtgcgtcgaggggcctgcctcaggcaaaagcagttgattcattacctcttcttgaggccatagttacggaaacgttacgcctccatgccccaattcctggaatacagcctcgtgtcacaccttatccatcctgtaccttagctggttacagcgatatccctgcaaacatcagagttaatgcgcaggcatactcgctccatcgcaaccctgacgtatatccggatcctgagacgtggcaacctaagcggtggcttaagggtgtcaactcggattccgaccttgaagaaagaaggcggtggttctgggctttcggaagtggtggaaggatgtgtgttggaagtaatctggctttgcaggaaatcaaactagtaacggcggccatctacagcaactacaggacgtccatcgtagacgacgacaacattgaaccaatcgacgcctatacggttaagccccgcggagataaactggtgttngaatttgaagccgcgntaatcgtaacccagtggtaactttcc

SEQ ID NO: 5393 - DNA, 650 bp, Aspergillus oryzae
cccatcaacattttctcattttccaactcctaaaaccacatctatactaatcaagatgcctcgtcaacgtcgtggtgccgcccctacccctgcgcgcagcgctcccaccagacctaccgccgctcccgccagacctgctgctgctccctcggcccagcactcccagcctcactcgaccgctgctcacccccagtcgacttcccagcaggcctatcctcaccctcccccccaggctgcccccgtccagcagagcgccggacccggcctgttcggccagatggcctcgaccgctgctggtgtcgcagtcggctcctccatcggccacgccatcggtggtttcttcagcggcggttccagcgcccccgccgaggcccaacaggcagctcccgccgaggcccagcccatggacaccggactgtggcagagcaacaccgtcaacagctcctatggcaaccctgcctgcgagacggacgttcgcaacttccgccagtgcatggacgagaaccagggcaacctcagcatttgcggatggtacctggaccagcttaaagcttgccaggccgctgctaagccctactaaagttaatgtattatgtttcgcgctgggggatatactaaggatgggaattctgggtttggaaccggttcat

SEQ ID NO: 5394 - DNA, 703 bp, Aspergillus oryzae
  misc_feature (1)...(703): n = A,T,C or G
gaattacccatggccctgtgctgcgcttttgttatgcagcagcttcacccctaacgattctagccccagtgtgccctaaatatcgaccgttccaacatatgatcaattgctatcagtcaacatgtggaagccaccggtgaacttcatcaccttgcattatacatacatcattctctgcagtctattggggataatcatactttatccctgtggcaatttgagagcgatcgatgcattctttttcggagtcagctctgccacagtatcagggcttaatgttgtcgatttaaaagacctaaaaacataccagcagttatttttatatttcattcccaccatttgcaacatgtgcttcaccaatatccttgtggtaatcgtgcgactctattggtttgagaagcgtttgagagagacagctcccactgcatttcgcccaagctcacgttcagtaacttccaaggagtatgactatgaccaggaggcacaacccangaaactgaatacaattcgagtccgggacccggaacagaccgccggagagaagatcaatgcggaaaacgagcacttggcagactcgagcaaaagccagacagtgccagaagaactaactgaatcgaagcctncagatggccccgacctagatgctattcaactaactaaccgtcgtatctcctttgcggacaacaacaagctctatacattt

SEQ ID NO: 5395 - DNA, 1186 bp, Aspergillus oryzae
cggcacgaggtatatttgtgtttgctaaattgataagtgagatccactctagttttaaacgagactcgttgcgactttgatataatttgcaagacagggtctgtttgttatacacaactgttcacatataaatttaccgctttccctttttctttttcttgttagcacctccgccttgagacttctgctgctgagccacgggcgcaggcgactcctctgccttttcgttgacaatacctccctgcgtccgttcggcggcccgttgcttgcctttccggcccttgggtcggtaattagagcggtcacggaggggcaaccagcgttcgggatccggcgtcttgcttgcatcataatccttgggaagacgtgactttcgcactcgcttagttgcacgaccttgtttatcgccagatgttctcttccttgcaccggcgatggctgccgcagctgccgcggctgcggaggaaggaggggatatgccagccgattcaagtgcgttcacgtcaacatccgagatcagatcgtcgattggagggagagtgtcaacctgggactcgatcttggcatagtccagtgttgcctgagaagcaacgtaaccggcgatggcaaaagaatcgttcctgtccttctggtaaagagacttgaacaagtcaccggcggtcgtaagatctgcgcggtccgacgagtgtagcaaagactgtgcggccgcgcgcataagttaaggtggcgcctcgacatgttcctgccaataggctgcagctttagcgagttccgacatgatctggaccctccggccttcgagattatagagagtcaagtgaatgcgtaatagtactgggttgaagcggacctccttatcctgttcggagatggagtcttcgagtagctggagggatttctctagggtggtgattgcggaagtagtgttgccttcggtcacgtagagctgcacggctgtgagcgctagtccgatgtcgttcggccgcctttcaagtgcgggtaatatcgccttcagggccggcgtgccagctctgtcttcgcgcaggagccacagctttgtagaccgacagcaggttattctaggtgactatcgaataatactcggggctgcaagagcgcgttcgactctaaccgatctacgcggtcaagctcgcattggccgaatcagggccgtgtcttcaaccgc

SEQ ID NO: 5396 - DNA, 1188 bp, Aspergillus oryzae
cccctcttctccgctttaagcaattcctcatgggttgaaacaaaaatccatcctcagtcccctgaggagttcgagttcattgaaactccccctgcctcctgcactactcccgctgagccctgtggtgtgaggacaacgtcgtacccggccatcaaaaatgcccccgtcccagcggattctccgggcagtgatagcttctccaacatcctcctcttctctttgcttctgctcatcccatggtatctggcccgccaggtcggtggtggtttctacaccaccatcttcttcgcaatcttcaccactatccctattttgatggctttctggtccgtcgcttcatccatctccccccgcaagaccgaaaaggccaagtatgctggccgccccgtcgaacactacctgcacttccacagcgagcatgaccgtgctgcctaccgtggaaagagcaagattcccatggaggttttctacgagaagtacttcaacggtgaggtagacttcaagggtgacgccttggagtgcctcgagttccgccacgattgggccaacttccgcttcaccatgggccttttcaagcacttactcttcggtttcatccccgagatgctgatgcacacccgctcccaagatgaagagcaggtccgtgatcattatgaccgaggtgatgatttctacgcttggttcttgggcccacgcatgatctacaccttcggtgttattagtgatcccgatcgggaagagaccctataggaactgcaggacaacaagctggctgtggtttgtgagaagatttgcctgaagcccggagacaccgtcctctatcttggctgtggctggggtactctggccaaatatgctttcttccactatggggctcaggttcccgtatcactctttgtcttaacccagactgccatgaggtaacaatggcctttgataaggccgtattgatgaatcccaaaagcgaataatgttctttgaactacctgacccttttccacttgaaggtggttctcaaaaataatcttcctgaaatgggtgatcaatttgatgtagattacctatacaataattttattatagagtttaatattgcccgcacaaacaccgttgtttatttcttcaaaaattgtggtcttctaagattcctactgatgaacgagatcttatttgacgactacgaaaaat

SEQ ID NO: 5397 - DNA, 689 bp, Aspergillus oryzae
gtagcccaccatgactacagcacacaggcccacattcgatccagcacaaggaaaagaggccttgcgcggccccgcataccaccagcgactgctcccagcacatacgcacttgaagactcgtcaactcggccagggtggtgaaggcgaagctcaacaacgcgatttgcgcgccgaattgctccaagccgaagccgctcattttgcgaagaagaggggtatccccgtgaatgaaccaactgttgagagcgcagcacccaaacaccaaatagaaggcggtccatctggcagtgattcagttgggacggaggacgaagatccagaagccaaacggcggcgaatactagaggagacgcgggacatagatgcggattcagatgggtcggaggatgacagtaccgaaaaaaaaagtgacgatgaaaaaaaagaggcgccgagttgaagcgagaactggaaagaatcggcaggggataccagtaccgaagatcatgaagagcgccaacgtcctcttaaaaggaaaaaaaacggcgattaatcatgtgacggaaaccgctcgctaagcactatgactcgactataaccctcgcggatgccatatgttcaccatatgacattgtgatgatacgatgttgagtatatcacgattgcgatgatcacattttgacgctatttacgatacgtcacctttaacg

SEQ ID NO: 5398 - DNA, 692 bp, Aspergillus oryzae
  misc_feature (1)...(692): n = A,T,C or G
gcctatgcacgaggccggttgctagtctacccccgcggaacaaatcctagaaccagagacaaggtacacaatcatcgcacctcaccatgtcccaagcaccggacaagaaaaactcattatggaacaaaacgaaagtcataggcaagaaaaacttcgacaaagcctgggatgcactcgacaaactcgggccacccgttaaccgactgactaataaactcggatcagaggccttctggcctatgacaatagacaaagaaagtgagaaggtggcccgaattctccatagcttctgtaaagatggcgtctatgtcgaagaatccaaagaaagtacacctgtacccgaaacgaaaggaggaagacaaccgatcgataagccgcgcggaaagccgaaagtgttgcagaagattccgtccgaagttatcaaacaggcgaagggactggctatctttactgcgatgagaacggggctatggttcantggtgcgggcggtagtggtgttctcattgccaaagtgcctgaaactggcgaatggagtgcgccatcgggtatcctgctgcatacggctggttngggatttcttgtcggtgcagatatctacgaatgtgtgatggtgattaatacgtatgaggcattggaggcgttcacgaaaggtcccgttactctccgaggcgagatcggtgtcactgctgga

SEQ ID NO: 5399 - DNA, 760 bp, Aspergillus oryzae
  misc_feature (1)...(760): n = A,T,C or G
tgattgagtctcgtccgaatccggaccgagggggaggagttctcttgtgcctacatgcctacactccctgtaatagaaacagcgcatctcttcttcaatggctgcaaagaatcagccaaagtcgccgtacccacaagctccagcacctgagtgaaatatcgacccgatgtttcggcaatctgttgagaaatggccccgttatcgatccacacctcgtccactccaaaatcccgtaataacgcctctctttccgtttttctggtcgttgacgccacaaacgcccgatgtgtcttagcaatggccgctgccgccaggcccaccgaggacgttccaccgcgaatcaacaatctatctttgggtctcaaggtgagtgtccttatcaatgaaccccaagctgtctgcagcatctgtggtagcgctcccagcacgtgccagggcagctttgtcttcagtatctgtacctgctttgccggtacacatgtgtactctgcataccccccatcaaacgctcggcccatcccgcccatggctgtggccacggtggctccgagcggaaatttatcttccagtcctggggcggcatcgactatacccacggcttcgatgccgagaatgcggggaaattgaaccgcagagccagagtgaccctgacgggtgaacatctctgagctgttgagtccgaatgctttgactttgatccggacttgtccagaactgggtggggggatgggatatngtatgacctttacgacgtcgggag

SEQ ID NO: 5400 - DNA, 684 bp, Aspergillus oryzae
ttgtcttcctccgactccccgtccttatctgcctccttatctaccgtcccttccccatacctccttctcggcgcttcaatctcccttcaggacgtccacgtcacccattcatagcggccttgccacatcgctctcttgactcctcactcatcactatttccgtataacgccggaaattccgtgagtcgctagcaatcgttcacaacaagccgtaatccgcctgctccaactcggcgcttatcggctcttctccgacgtcacctccttatccggctccctacttgccaccacccgctcaacatggctcctcgcaagccccgctgcaacttcaaggaatgcaaggaagcagctcagcggattgtcggagactgcagcttctgcaatgggcattactgctctaaacaccgcatgctagaagcccactcctgcactggcctggaggactgcaagaaggagtcccacgcccgcaacgccgataagctgaacagcgagcgtacccatgtcatcaagggcgtatagacgacgccctggggtcctcgactttcactctcctttttgaaacttttccttcggttcttgcatcgccatcagcgaaaccggttgatttagcgcggggttcgatttgattacatcatcgcccgtgccgggttcgtccataacccgccggggccattatcttttttt

SEQ ID NO: 5401 - DNA, 546 bp, Aspergillus oryzae
  misc_feature (1)...(546): n = A,T,C or G
tttagacgactcgatcgatctgccaggctttcgccttcactcttcccattgtatacccaaactggccagttgaacatttgggattgaaccatattgatcaacacttgcgtggttatacataatctataaaatcctgagccgggtagaaggccagctgcttcaatcatggctttcagcagagtaatgctgggcttcctaggcctattcttcacggccggagctctgctactgatgttcctgaccctgctcggaggagcacggaactcggtccctttgaacgaaatctacttcctccaagtcgacacaggcaacattccaggtgcaccatctgtatcccgatggacattctggaacatctgcgctgtcggcgacaatgggaagagcgattgtggaacctcataccctgacttcccctttgatcccccgagccaccgcaacttcgacacaacaaccaatattcctggaggcttcaatcggacaaaacactacttnctgacctcccggtcacattccatttcttaatatcgcgctttccttcgcgttgtt

SEQ ID NO: 5402 - DNA, 684 bp, Aspergillus oryzae
  misc_feature (1)...(684): n = A,T,C or G
gtctccccggaactggaggtttaatgctggttcaatccaggtcaaagtcctccctcccatcagtactgagggtttgactgcggctgatgtcgatgccctgactcagtcggctcgggaatccatgctcaagactctactcgagatgtctgagaagaacgaaatcgaggttggcaactcgcatgccaatggtacttctactgccgttgagatctgacctcgttgcaactttgagttatgacaatgacccttttcttcctcggcatccccttcatcgaacgccagatgcacgcaccattccacgaacaagttgaaacgcgacatgagacatgaataccgggcgttgttgtccccgtaccacccgctaataatcattgtcttctgttctccagtacagatcccgcgacagagtacttcaaatagtttctgtctagagacgagggcctaagatttgcattacttgtagacatgagaaacaacatgagacagagcggtcggccctgatgaaacgttcattataatcgggtcctatacctaatggataggaccttttcctccaaagtgtatataatgtcatccgttcaagagtaccgggcccctccctcccgctgtatactctggaccaattctgtatgtaggctaccagatcaatagaacatatncacttgctggntcaaaaaaaaaaaa

SEQ ID NO: 5403 - DNA, 928 bp, Aspergillus oryzae
  misc_feature (1)...(928): n = A,T,C or G
cacagcactatcctaccttttctttaccctttcaaggattttctgcgcacttacagcccttgtgatggctattacactggacggcggcattgctcttgtcacaggcgctgcctcaggaatcggcaaggagacggtctttgccctcgcccaagccggtgtagaaggcgtcatccttgccgatttgaacctcagtggcgctgaattagtcgctcaggagagcacaaaaaaatgggctactaactcctattttcgcacgacagcagtccaggcggacgtttctgacgaggctgccgtaaacaacatggttgatgtagcagtgaaagagtttggcagaattgactactgtgtacatgcagcggggataggtagcatttccggggcgacaactgagcatctcaagatcgacgtctatgatcagataatggcagtcaatgctcgaggcacaatgttagtcttgcgagctgtctcggcggtgatggctaaacaggagcctcgcatgcaccagagtgcccgtcacggtacttcgcgtagtctcggccgtggctctattgttgtggttagttctgtgaatggnaccatggttgcgcccgggatgttgtcatatacagcgtccaagcatgctgtagcaggcatagccaaaacagcagctattgacaacatcaagaaccatatccgagttaatgtcgttgcccccttttacaccgaaaccccaatgttcgaagctagcttgaagcgagtccctgaactgggcgctgctatcaaagcaatcaccccattganaagagctgcagcccccgaagaagttgcagatccgattgtgttcctgtgcagtccagcagcaagttacacgaatggaggcacgcttatcatcgacagcgggacaacgctcaacattccccggacaagtctgtgaagctttctcggagag

SEQ ID NO: 5404 - DNA, 764 bp, Aspergillus oryzae
  misc_feature (1)...(764): n = A,T,C or G
tttaagaaggacccttataacaataccgtaattttaacctttgaatcaaccngaaatattatcctggtaccgaacctggataccgattcggacataaggggggcgggagggtatctgtgtttcctcgcgagatgtctactaggccatcacaaccccaacaggatggccatttattcaagtgtactataatgccaccaatagtcttcccggcacgaacaccatgaccgcgatcttggttcttacgctcaccgcgagtacaatcacggaattggccacggcctctcggcagctttggtcttttgcccgagatggcggtcttccattttccgggttttttggatacgttactccggggtggaacattccgcttaatgcggtgatggtctctcttatggtaacagttctcctgtcgttgatcaacatcggttcgacaacagccctttttgctatcgtcaccttgacgatcgggtcgcttatgtcttcatacgttattacgattgggtgcgtgctgctcaagcggatccgtggcgagccccttccacctcgccggtgggagcctgngtcgattttgaaatggccattaacatcngtgcccttgtgttctttggtcccgtngtngtgtttcctttctttcccttgacttgacagtcgaccgagattcaatgaactgtgcctggtgatgtaccgtgcaatataataattgcattttataataaaattttcgcgggcgggacgtttattttcttcccttgaactggttaacg

SEQ ID NO: 5405 - DNA, 743 bp, Aspergillus oryzae
cgttgagtcgcagagaatatacccaacgtcttgcatttcaacaccctcacaatggcctcaatcgcccgccagtcttccctcctccggcagtcctgcctctctgctttccgctcgccattcgcgaccagaaatggcgccggcgtgtcgcaggttgtggccttccatgcctccgcgaagaagcagatcctgcctcctctgcctcagaccattcagggaacgatgaacgaccctgctcccatccccacccctcacccctcggagggaagctaccactggacctttgaaagagccatctccgccggtcttgtccctctcaccattgcccccttcgctgctggctctcttaatccggtcatggacgcagtcctctgctctttcatcgttctccactcccacattggattccaggctgccatcattgactacttccccactcgccgtgtccccaagactgccacattttgcaactggctcctgcgcgcattcactcttaccactgccgtcggtctgtatgagttcgagacgaacgacgttggtgtaacagaggccttcaagagggtgtggaaggcatagatcgttgcattgatatatccctgtttctcattactttctttttgaactttccttccgttcaggcgttttgcctatgtacatgctgtttctgttaaagtaagccagtccagctggttggcgctctggtattgagctaaaagaatgtaactgttcgaatgggatactgttga

SEQ ID NO: 5406 - DNA, 1590 bp, Aspergillus oryzae
ctcgcttgaacttgggttttttgtcctcaagttcgttctctctttttagtctgactttcctttttttgtttttttgaaaccatcctacagtctttacttcatcgtcaaaatgcaattgacacaccttcttgccttcgccctgtcgctcgctacgtccgaggccgcctacaagggcttcaactacggtgctaccaagtcggatggcagcgtcaagtctcagtccgatttcgaatcggagttctccactgcgaagaatctggttggcacttcgggcttcaccagtgctagattgtacaccatgatccaaggtggcactaccaactcccctatctccgccattcccgctgccattgccgaaaatacatccttgttgctgggtctttgggcctctggtggtggtatggacaacgagttggccgccctcaagtcggccatctcccagtacggtgactccttcgccaaattggtcgtgggtatttccgttggtagtgaagatctctaccgtgcctcgtccgagggtgagaaggtcaatgccggcattggaattggccccgacgacctggtctcgtttatcaaggaggtccggtcgatcatctctggcaccgccctgagcagcgtccccatcggtcacgtcgacacctggaccgcctggactaacggctccaattcggccgtcattgacgccgtcgactggttgggtttcgacggctatccttacttccagagcagcatgtccaattccatctcggacgccaagtcactcttcgacgactctgtggctaagactaaggcggtcgctaagggcaaggaagtttggatcaccgaaaccggctggcccgtcagcggaagcactcagaacctcggcgtcgcttccctcgccaacgcgaagacctactgggacgaggtcggatgccccttgttcgacgagaccaacacctggtggtacatcctccaagacgccaaccccaccactcctaatcccagcttcggtgtggtcggcagcactctgagcaccaccccattgttcgacttgtcttgctctaacagcactcgcccatctgcttccgcttctagctccgctgctggctccgcgactcccgtcggctctgctgttccctctggctccgctgctgtgaacccttcgtcgtccggaatcgtgtctagtgctgttccctctactacccctggcttcaccgtcggcaagggattccgtccgtccaactcctccgctgctgcctactactccagcgcttctgctagcggctcggcctaccctaaattcaccaagaccgctagcggttcctccgctacttccaccaccgctggtagctcttctgactcttcgtcgaccaactctggcaagtcctcttcggaatcttcctcaaccaactctggcgcctctgcttcttcttccatccttgctacgggcggtgccagctccgtctcgggctccgtcttcggtgctctgggtgcagtctttgcattcgtggctactttgtaaagaaactcacctatccatgatcccaatcgatagctagatttagaccatggccattctttcaagtacatacatttataaaataccctcgt

SEQ ID NO: 5407 - DNA, 654 bp, Aspergillus oryzae
  misc_feature (1)...(654): n = A,T,C or G
ccaaggccaaagttgcaaacggcctttacccgtgccatcgactccattcagtctgtccttgattctgcaaacgatgctatcgacaaagaacacctggcttcggcattcacagagctagacgaacgagtagacgattggaagtcgcttaaaatagaatcatttggtgacctgcttcgcttcggcacatttaccgttttgaagggagacaatggcaaggattcagaaagagagtaccacatctaccttttcgaacgtatccttctctgctgcaaagatatcaatccgaacaagcagaaaacgaaactgattgtcggcaaagataaaccagctactactgtgaaaggaaaaccacggttgcagcttaagggtcgcatttacatggcaaacgtaacggatatagcttgctatcanaagccaggttcttatcgtatccaaattttttggaaaggtgacccnggcgtagtggacaaccttatcatacgctatcaaaatgaagatgccatgcgcaaatgtatanggacattggacaccnacgagcaatttagccgaacaacgcaaccaccggataccgttcatcggagacaaatcacgtcatgaagaacatggcaaaattcccaaacggaccctgacatgttgccgtgaacaaccacttag

SEQ ID NO: 5408 - DNA, 711 bp, Aspergillus oryzae
ccacccgactcatctgtatactcctccatccgacttcaacagtcctatgaatcgtcttctgaagcttgccttcttgtctttggtcgcatcctctgcgattgcgaccaccgcccctgagcaggtcgagtccgagaccaacacggtggccgaccagtccgattccctccacaaggctcttcacttgttcgagaagttcagccatggtgtcttccgctccgacgaagatgctgcggacgctctcactgccgaggatagagagctggccgcccatctgaacctcaagagggacaacagctcttccgctgtagagccctcagccactgctgcggaaccaaccacctcagcccaacccaccacggccacgcctactcaaaagaccaccgtcgaacccactaccagtgagcagcccacaaccaccgagaagccaacaacctcggagaaaaccaccgaaaagcccaccaccagtgagcagcctaccaccaccgataagccaaccacctccgacaagaccacttctgagaagacccccgagaagcccaccaccaccggcccaacccacgcccattaccaccgacaagccaaccaccttccgaaaaacccccctgggacagaccaccggagaacccaacaccagcgcgaatccaccacagggcccacccccattgcaaccacccccccggcccataagccacaaccccccgaataaacaac

SEQ ID NO: 5409 - DNA, 667 bp, Aspergillus oryzae
  misc_feature (1)...(667): n = A,T,C or G
ccttgtgtcaatacattatcttctaacttaaacataatatcgccggtgtatacaaagagatatccgactttcctacacaatgtctcgtcctggcaccacgctctatgtcaccggtttcgggcacggaactcgagctcgcgaccttgcctacgaattcgaacggtatgtgccgctcgtcgattgcctacacgctaccatgaccagacgactcgtttccatctcgcaatctacacctcggttgatcctcgcaatgccgacgttggagcaagacctcccctagtgttctgagctttgcttgttgcattactcgtcgtctccttgatatacatacattcccttggaagagtcattatggccccggcacttttgctacctatcataacccgtttatacacttttgtctttggtcattgagcaatattatcttagttgtctgtttacaccccactagtcttggttctaacctagctttagttacgggcgccttgtccggtgtgacataccagcaccacgtactccttccagcagactgtttgcttttgtggaatatgagagccgccgtgatgcagatgatgcgtatcatgaaatgcataacaaacgaattggacgggatgatttattgaanattgaatgggctcgcactccaccatctgcttcttggaggttg

SEQ ID NO: 5410 - DNA, 680 bp, Aspergillus oryzae
cgattccaacgaattcccactcgcacggaccgttttcgggatagaaaagtctttttgttatttaggtttctgctcgtttgccggcaatttgcgataccgttatagttacgaactcggattcacgccaagatgtcttttcagaactttcaattgttccggaaccaccacccagcggctgatgctgccgctgctgtccctggcgcacctgctaccggggataccatggccggccaggccggccctaccagtggccaattacagtgccctgcccctggcgagccaacggccgctcccgttcatcccgctcaagaatgaaagaccactctctggatgggtgagcttgagccctggatcgacgagaacttcattcgcgacctctggttccacatgggcgagcaggtcaacgtgaagatgatccgcgacatgttatctgggtggagcaatgccggctactgctttgtggactttttctttcccgctgctgccgataaggctctgccgtgaaacgcactcccattgcccacaccatccggctttttaactgaactggccactgggggggggctggttgactgatccgaaattaacgttgaccttgatttattctcttcattggtgaattgggggcccacgcgcaattatattttaacgtagttcacgttatgatggccttttttttt

SEQ ID NO: 5411 - DNA, 682 bp, Aspergillus oryzae
  misc_feature (1)...(682): n = A,T,C or G
cttattcttcaccccatcaaagaaccggagcgaccttcgttcattcacagactcctttccccccttcttcttttacagaaacggtaatacaaattcaagggttcgacaagggaacgattccatgcttcagatcagtgttgtcccacagaagttaagctcggaagatgaaagagcaaaaaatacaagtcttattctgagctactcactctttcctcaatatgcaagcgactattcttcggacgcaatcatttcggtccaggattagcatacacaagtacacaccatggaggcgacccttttcatcttctctttgccgcagggaaatcagaaatatagagacgttacctcaacgtctactacctaaatacgaagaatcttgggagggcgatctcctctctcttcaatggccagcaccccctcgaaatgtctttgttgtgaaaaaggactgcgtgccaacagtaacggaatcactaattgaatttgcgaatcatgtaacatctacgtatccatctatcgccctgatcctagagccgaagactgccgaagaagtacattcaaaattttcttttcctatctactcagctccattgagcaggctagcctccgcgctacatagtaaaggcgaccttacggttactcttggcggngatggaactattttgcatgcttcttccttattcgc

SEQ ID NO: 5412 - DNA, 652 bp, Aspergillus oryzae
tttcggatcgacgccgcttgcctcgcatcgtgggttcatcgattcgttcgccctccaaaaggaacaccctggagcatatggaaatggcagacctatgtctacggccttcggaaaccgacctgagactacttccagccaggcacctcaaatgtatacatcggcacagctcaatggttttgagacgtcatcgcccgtatcgggctacccaggcggtgcccccggttcggaaaaccgcagctcatcgcaacctcgatttggcaacccttcaaacgccaacttgactgccaatggcaacgagaacgaggttcctcaaccaaccgaatacccgtatcgggcaaaggcaatctattcgtatgatgccaacccagaagacgccaatgagatcagctttaccaaacatgagatattggaagtgtccgatgttagcggcaggtggtggcaggccaggaaatccaatggagatacaggtattgctccatcgaattatttgatcttgttgtgatctggatggagcttccctgtgtaacgctttctttcttctctttttggttttttcatggtcctcgccgttttgttgcgagaaaaattatctttgatacccttcgagtagtatcactcggcgcgagtctggtttgcgaagtacgttacgtct

SEQ ID NO: 5413 - DNA, 1320 bp, Aspergillus oryzae
  misc_feature (1)...(1320): n = A,T,C or G
gtaaccgcgataatgctcattgatggcgagaagtgggcttgtgaagcttgcgtccggggtcaccgtgtcagcagctgtcaccatagtgaccgccccttgacccacatcaacaaaaaaggccgtccagtctctcaatgcgctcactgtcgcggcctacgcaagtcacggacaacccacacaaagtgcgagtgtggtgacaagaaaaagaacagccacaagcatgatttagatccccaccacgccaatgacaagcgggatcacaagcaggactcccgtccaagatgtggctgcactcatggacagcgctgtacctgtgcgctgaagaaggaaccccacctaaatactgtgccggaaactggtcttcctccgccccaacatactattctgtcggaaccacccaagaagccccagttgacctcaaccaagtcggagagcacgcttacgatattccgagatggtcaccacaaaccggctcataaacacaatgacatggctcacaagtgcggtctgccttacacgataccccggtctcatacgatccattcgacctccgatgtgtctcgtcggtccgtcgatcagatgcccttgactcaagcggccttgatgaacgaaccatntgcgactcaaccattttcggaacagcagcccacccacggtcctcagcgtcgtgtcaagtccgagcatgggtctcccgagagtgcccccgtcgtgtcaacggaagatggaccgacgacagtccccccactcgacctctcgtctttcttccctcagcctcagcccatgaataaacccactgaagccgagccggtgtccctttccatggggaagacgcctttaaatccacttatgactagtgtgccgcctcttgacgtctcgtccttctctactttcccgaccacgaccacttcgcccgtgaacacaatggcgttccaagatccatacaaggagcagtttttcacgtcgccggacaacgatatgaccttgggtcctactggattcaatgcaccccctgtcgactggtcaagcttccctctgtactcctcggatgttcctgccgcgaccagcacacaagctccctcttacgcgagcttcgactacaattccatgagccacggactaccagctccgtcgtcgtccggcgatatttctgaagtggaggatttcgcaccattctccggcttcggaaatgcaggcaatgaccttcaagatctcgccagtgggagtgaaggttcggatctcgaccatttccgcataagttccgcatcatcatttattggccttctcagggcgcactcttatcgtcaaatcagcttgactcaa

SEQ ID NO: 5414 - DNA, 658 bp, Aspergillus oryzae
tcaatcgctaagacgctcacgattatgacaagctacttgattccttcacactactcttttatttccttcctcactcctttccttctcttccaatcaattctccgtcacaatgtctgaaatcctcgaggagctcggcgacatccccaagggggtcctccgtgagggaaccctcttcgtccgcaaatgcaccacgcccgacaaacgcgatttcatcaggatcagccaggttgtcggcatgggcttccttagcacgggtgccattggttacttcattaaattaatacacattcccgtcaacattatccttgtcggtggtgcataagctatgaacaatattaatcagcactcgataacctaataccttaacttgatgtggtgatgggattctgcatggtttaaatgggggagaatccgtccatgcttgtatccgatacccgttactcgtaaagcgtggttacgaaatagagtgatggtacatggaggtgcctaactcatctttgacttgatgacatgccgtcagtgcatgatggaggtggattttgctggatgaaatattgtagccatgtctttgaggctgtatacatagcgtttcctgattctaataagcatccaaagaggataacttgagagaattggctaattccggggttttttcaat

SEQ ID NO: 5415 - DNA, 917 bp, Aspergillus oryzae
  misc_feature (1)...(917): n = A,T,C or G
ccctatggtaccacagacatgttcgcacagcaacagcaacaaccccagcagcaacaacaacaacaacaacaacagccgcaagataacttcctttcgtcgggaagcaataacccatgggcctctagcagcccgcagccgggagatatgttgaaaccaatgcagaccggatccaacaacccattcgctcagcgcacgcagacacagcagttccagaccaggcccgcaacgtctggacatccatccctgaacacgctggcagaagagcgcgcaaccaccgctttcaatccaatcgccaactaccaggctcctgtggcaccggctccacccaagagtaccccgcctcagatgaacgacccgcatcacgctcgtctcaatgcactcctcgccagcggcgacggccaagatacctttggaaacgtcggtgatctccgtatacctgctcaacacaccgcaccaggcaccttcgtcaactctgctggccaaggtctcgaccgcctacgcgccaaccagaccggcagcaacccattcttcgcccaacaacggttcgtcccccagcaaacagggttcgcccagcagcaaaccggcttcgcgcagcctacgaacaacccctggggtgcacagaaatcataccagcagcagcctcaggctggaggcagtctgatagatctgtgaaagacgaaaatgttcatccgtgatgtccgtggtatacaacttgacgggtttgtagtggaagtggaatacgataccaggtcttttatcttgtctttatcgattatatctctacttttctctccttttattccctttgttccgttgcgtcgtctttacaacgaatggttgggtgttatgctcgcattgaattagggttgcggaattgacatacagatttcagtccagttaaaanaaannaaannaaa

SEQ ID NO: 5416 - DNA, 653 bp, Aspergillus oryzae
gaagacgttacttgacgacactatataatcgtcaatacatacgccttcaatcccatcctccctccaacgagtcacaacctacccgggtcattagcaaccgctcgatacattgacacatcgcatctcacggaccgtgtagctagactggacagtagctactcgtgcttacggacataccgcccgcttaatttcatctactggcatctttatctttcttcacattcgctatggatcactcctgagatccctgaccctgggttgccctcaacgacttcggtggagctttctgcatgggagcaattgggggtgcagtgtggaacggacacaagggattcaacaaacagaccatacggatagcgccggacaggagacctcaccgccatacatgcttgtgtacgacatcttgggggcaatcaccgggtacggggcggcaatacatcccatgcgactatgaccacacatggtctcccataatagacgcctcaccataaccaaataagctacccgtcacaagcccaaatacaaccgatgtcgagacagtctaccgaacacctgacacatcgccatgacctcggggtccacacatttatagccattttccgtctcctcatcaactataaactcacgacagagccgcgccgcaccttaacccc

SEQ ID NO: 5417 - DNA, 713 bp, Aspergillus oryzae
  misc_feature (1)...(713): n = A,T,C or G
tggacctaaccatcccgattccatcaccaccatgaacaatgccgctgtgatgctgcagcacctcaagcagtactcggactctcggaagtggttcgaggcttcattgaccgtgtgcgagtctctctttggcaggcaatccattaacactgcaactatcttgttccagctggcacaggctcttgctcttgaccaagactccaagggagctgttggcaagatgcgcgatgcctacaacatcttccttagccagctgggtcctgaagaccgcaacactaaggaagctgagacgtggctggaacagctcacccagaatgctgtctctatcgccaagcatgccaaggacatccaggctcgccgcctgcgccgtatcaatatgaacacccggactcttggtactaaggtccagcctcaagttggccagtccgcaccttcggcatccggagccagttctgccaacccttcattggactcgcgaagcattgatgaattgctgaagttcatcgaaggtggtgacaccagctcctcgcggaccaagcagaagaagcgtgctgcagctagcaaccccaagcttcgtggctcgaagaagtcatcagcttgaacatatccataanttctatcatgtttggtaanaaaaatgcaccggccccttcttgacttttaacttctatgcctttactgggtaagacacactttttttgaaccattttaaaaaa

SEQ ID NO: 5418 - DNA, 664 bp, Aspergillus oryzae
  misc_feature (1)...(664): n = A,T,C or G
cgatgctattggacacactgttcagatagcgtcggtcgtatttggcttggaaaatgacggccgaaacgggatttgtccccactgtgttctctcttccgtcagagagtgcttactcgtgggtatgggctgtgagtgctgggcttgtggcgatatttgtgctctatcttacacaaggtattgctcgtcgcagattcgcctacgctcatggctgtcaagcaccaccacggtatgcccaccgggacccgattctggggctggactccttgcgagactccatgcaggcgaggaaatccgacaggtattttcgcagagagcagcaactacaccaagcctatggcaatacgttcatgtcgctgcttttagggagctggatggtgaatacgattgagccaaagaacctggaggttctcttctctaccaagtttgccgattacgaggttggattccggcgtcggaatgcctttgcccctttgtttggcaagagtatctttcaaagtgatggaactcgttggcaaacattacgatcacagctacaattatgtttctcgcgagtgcaaacctcgcagttagggcttctggagagccactgtcagcatgcctgatctggggctatatagcgccncgaaattccataaggggattatagcgtatttgtaccccaccg

SEQ ID NO: 5419 - DNA, 1178 bp, Aspergillus oryzae
caacattgggtctagacggcgtacctcaagcccaagccgtaacagtgagtctcaaagacctcatcaacggaaccgtctccttcgagaccctcaccgaagctttcggcccctcctctctaggcataatcgtggtaaaagacctagaccccgaattccaacgtctacgcacccaagtcctctccaacgcatcctatctcgcagccctccccaacgacgaactagaatccctaaccagtccctgcgcaaaatacctcgtaggctggtcctgcggcaaagaaaccctgcgatccggccacttcgacaccctcaagggctcctactacgtcaactgcgcattctaccaagaccccaccctacaaggcgcccccgccgacaacttacccgatctatccgagtacacagccccgaatatctggccgccggcggaccgattgcctacgttccggcccgcgctggaagagctctgtaagcttgttattgatactgcggcattggtggcgacggcgtgtgatcggtatgcgacggaaaatattgaggggtataagagtgggtacttggagcatgttgttaggaccgaagttgacgacgaaggcgaggttgttgcattattttcctgccgaggctggggtgggagagagagatggggagggagagggagagggggatgatgattggtgtgcgacgcatttggatcatgggtgtttgacgggtttgacttctgctatgtttgtcgatgaggttgctagtcctcctgggcagggaggcgagcttgttgagttgggggcttcgccggatccgaaggctgggctttatattcagtcgaggactgggaaggtggttaaggttaatattcctcgggattgtttggcttttcagaccggggaggcgttgcagcttattacgagagggaagtttatggctgtgccgcattttgtgaagggcgcgaagccttttgcgggcaagaggattgcgaggaatacgttggccgtgtttacacagccgaatttggaagaggagggggatagtgggaaaagttttgcggattttgcgagggaagtggtggccaagacttattatggggggcgtggagatgaaatgtttattatcatgaatggtatgtatattagctttgagtttcacatattaaaggttgcttttggacccgttgaagttgggtc

SEQ ID NO: 5420 - DNA, 678 bp, Aspergillus oryzae
  misc_feature (1)...(678): n = A,T,C or G
gcagcgcggcccccctgaggatggaatcccttccaagaccaaggtcatggttgccaaccttccttatgatctgagtgaggacaagctcaaggagatcttcgccgcctactcgcccgtttctgctaagatcgctctgcgtcccattccccgctttatgatcaagaagctccaggcccgcaacgagcgccgcaagggccgtggctttggcttcgttactcttggctctgaggagctccaggagaaggccgtgaaggagatgaatggcaaggagatcgagggtcgtgagattgccgtcaaggtcgccatcgacagccccggcaaggaagacgatgctgttgccgctcccgccaccgacgctgagaagactgagccggcaaccgaagctccggcgcaggagaacactgccccggctactgcttaaatgacaagtcgttctcaaccagaacgaatcaatgatctcgacatacccactgtatcgtcgggatttgttggaggaagagaaaagaccttcgtgcggatgataacttcatactctgccgtcgagaagcgttnttacaaaagtcaaaaaaaggtaaaaaagacaacgaggccaactataaaacgcaaaagctatgaaaatattatcccccgtcgaagcggtcataggggacgaatttatcatgaggatgaggcattcat

SEQ ID NO: 5421 - DNA, 682 bp, Aspergillus oryzae
ggagatcgacgatgagttgtttgacttgttgaaacgcctcctcacgaaggatccggtgaagagaatcactgtgaaagagatcaagcatcatccttgggtcttggacggtctacccaatcccagagcgtgggtcgaggagactgatccagggtatctgagtaaaggtaaaaggattgaagtgtctaatgaggaggttacaacggccgtgagcaaagtaccgtttatacaacgtgtgcgatccaatgttgccaagtggtccaactaccttaccgggaggtcgaaagataaagatactcgcaagcgtacttctagtgcggctccctcagtcgagtctttctccactttcagtaccaacagtattggaaagtacctttgggacaagcgtcgtgctagttctaaggattgaagacttcttggggccacccggctaagccaaggaggtgaagcatcccttttacagaagggtaacggaaagcccgggggtccggatgaacaaacttgttatttcaaggaagccttggggaatcaccattatggttggaccggaccccacggcttgaccacccgaaacgtgcggtattttcgttgtgaccgccggaattttgcaaccattaaaggaacgaattacaattcccaacccggacccccaaagaacggtaccccccgtcggttggagaaccga

SEQ ID NO: 5422 - DNA, 769 bp, Aspergillus oryzae
  misc_feature (1)...(769): n = A,T,C or G
gagatggtcgatcgatccgcacgaggggacaaagccagagagactacggcggagacaatgaaggcgaacgcgaaacctgacacttgccggaatggtgccggatgtcgtgtcatagagtgtaagtatagccatcctgatgcggagccctgtcggtatggggctggttgcaccaattccaactgtcgatttcgccatccgaaatcgcgactatgccgcaacggagccggctgtaggaagctgggatgtacattcgcccacccggaggcacccgactgccggtatggagttggctgcacgaatactctctgctcgttcaagcaccccagcgtccctgcttgtcgggatggtgccaattgcatggtggacaaatgtaaattcttccatcccgaagtcaaaccgtgccggtttggaacacggtgcaccaacaagaactgtacttttcgccatccaccacccccttatacaaaggaaccgaccgcgtctgcgaaatcgatggatgacaaagagtccaaggaaccgaaaagctcggaaaaggaagttcgcagaaagctaaaagaaagcccaaagtgaaaaagtcttcggttatcccggaaaaggaaacgtccagttgactgatcactcacagtgcatctctcagcctcgttggtgcggggtttgcagcaaatcactatgtccagcttcctggagtttgtattatgtgagatacgcctaattattctgctagtattntgtccttgaatgggtgggaaatctctgaacagtatccaan

SEQ ID NO: 5423 - DNA, 648 bp, Aspergillus oryzae
  misc_feature (1)...(648): n = A,T,C or G
ctcccccttcctcctcatccttgttttttttctcttggacattctttcgtcctttaccctcggtctttattgtggaagaggctgtctaacatccccttccttcattcaaacccattcttttaagtcttttgttttctgtttttcatctcatacccgccaaaaaaaggaccgcataatgtcttacaacggtggctatcagcgcgaccagcgcgactcctaccgctctagaaacggtggtggtggtggatactcgaatggctactccaacggcaacagcaacggctactctggtggtggtagtggtggtggctatggaggtggctacggcggtggtggctacggcggcggctatggcggtagaggtggtggcgccggtggtggtgaccggatgtccaacctcggcgctggcttgaagaagcaagaatgggatctggattctctacccaaatttgagaagtctttctacaaggagcaccccgatgtcgccaaccggtctcagcgcgatgttgatgagttccgtaagaagtttgagatgtctgtgcaaggaaaaaacattcctcgccccgtcgagaccttcgacgaggctgggcttcccccaatacgtgctgagcgaggttaaggctcaaggtttcgaacgccctaccgctn

SEQ ID NO: 5424 - DNA, 839 bp, Aspergillus oryzae
ggcttattgcggtggtaaacgaccagattgcttgcatcgatgacaacgatgaatcaggacaactgggctacctgtcgaggttcaagcgcgagttcgaggcactcgtcgacccaaaatacatggcagcgcgagctatacccgagctggacgctcttcgcgacggttacgtggatctaagtacctattgtcttactcaattcgtcgaagtggtttttgcggtcgacttccgcgctactatccccgatttcttcactcagaagtggtatggcgactttgcaataaagcgaatcacttctacattcgaagattacatggccgattactcccctgtcatccacccatcccttatcgacatcttagtcgaggaactctccgacgaactcttggtccggtacctgtcatctgtgcgcaatcgcggcgtcaagtttcggcgacacgctgatccatacacggacaagttcaaggacgacgttctcaccgttttcgccttcttccaaaactatccggactcgttcgccagtaccatcaagcaaaagtggcgactcgtcgactggttggttcgtctacttgaatcggagaagggccctgccgttgttgcagtctatgaggacttcaagatggaatactgggatctgcaactgacgtgggttgaggcagtgcttatgacaagggatgactttgagagaagcatgatcagtgctgtcaaggccaaggcagccgagttgtccgtagaaagaggtatggagactcttatgagccggatgaggtagttgaatgatatctagggatgaatgacagtgaaaaataaattgtattataaataaaaattctgcggccgc

SEQ ID NO: 5425 - DNA, 694 bp, Aspergillus oryzae
  misc_feature (1)...(694): n = A,T,C or G
gcggcctgctgctgcaggtcggcgttctcgcccaacttccccaggaattgctatgcaaggaggctctctcggtccaatgggattcacttcgcctcagaacaacgggttcttggcggcgtatgacccgaataaccctctcatgggcaatggactgggcgcgcttggcattggacagtttggcctcggcggccatgaaggctatctctccgatcactcggaggtcactcgcggccgctcgccacgaggccgtcgtggtagctcgaagccaccagaggaccccaccgaccctgctttgttgaaggacattcccagctggctgaggtctctgcgtttgcataagtataccgagaacctgaaggatctgaaatggactgagctagttgagcttgacgacaaagctctggaggagcgtggcgttaatgctctcggcgctaggaacaagatgctcaaggttttcgaacaggtccgggaggccaagactgatggcaagctcgacaacattctgtgacggaggacgtactggtcctctgtctttgtttttccgatcgtttatccttctaacattctctccattgcattaatttgatttgattagatngagattgggcataagtggcacgatccgattatatccatgagcgaatcattggatgacccttggnggangagangtgtgtaataatcgattcgagac

SEQ ID NO: 5426 - DNA, 644 bp, Aspergillus oryzae
ggaaagcgctccaaaacctaatcttgggatgaagaaatgacggatctatgttatcgaggcttgcgcatgttcggtactgactttatgatgatcagcaaactatttccggggaggtccaggcgccagatcaagttgaagttcaacaatgaagagcgccgagccccgggacggattaaggacacactacttggaccgcgggaagctgttgacattacgacctactcggagatgaccaacaccatctatgacgatcccaggatcattcaacaagaactagatgaggagaagaaacggattgaggatcaacatgctaaagaaaagcaggctcaagaggagctgactaacaatccagatggtgccgcaggtgctaatcattctccagagcaaggcactgcacctgtcaagagcaaacgcaatagcaggaagcaagccgctaagaatacgagtgggggaaatgaagaaattttgggcactattgatgactttccttgaaatataatgcttctcttgattgatatgatttagactggtgttggcctctaatgtgatactgatgataggcgtttgcggcgtttccgatatccctaatccggtgttgttatcacggtggttggcgaagaggttcaattctactactgtttgtg

SEQ ID NO: 5427 - DNA, 665 bp, Aspergillus oryzae
ctcttactcgtaccaacctacctgaaacatcagccgcctgagccattgcaactggcagcgtacgcggtaggtgctcttcatgcgtttaatcaggtagctgcccgtgatgcataccgtgccggacatgagaaacttttgaaggaagcttccacgctagcgccccttgagagactgcagacgctacttctactcacaatgtttgcaagttggtcggacgagccaggtttacgggcggagagtatacctctccaagggcaactagcagcggaattgcgcgactgtccaagcgatatttcgtcaagcgagtgtgtctcttgggatgtgtgggtgtggcgagagtcaatgaaaaggacaattctgaacatcatttgcttccttggaataatgaacgtgtctcatttgtcgtccaccatgttcctgcctcccggttttgacattgagcttccgtactcggaagacctctggacctgcaacacccgggaaacgtgggaacggctcttcagtacagcaccgcgaccgcagtcttttacggctgccttccacaatctgacgttattggccggttctatcctgcagaatgaactaagcctggcccaccttggtttgatgattgccctacataaccatgttaaattttgcaaaactttggagccttgcttccggat

SEQ ID NO: 5428 - DNA, 707 bp, Aspergillus oryzae
  misc_feature (1)...(707): n = A,T,C or G
ctacactctgttatcacggacctgattcgtaccaatttgaccaccgatcattgtcgacccttatccatagaacctacaggtttctcgttgacactccgtcaccatgcctttcactgcttctgatatctgcaagatcctcttcgcgatcatcctccctcccttgggtgttttccttgagcggggatgcggtgctgatctcctcatcaatatctgtttgaccatcctgggttggatccctggtatcattcacgctctgtacatcatattcaagtactagacagctctctgcatctctgtcgccatgcccgttttggttcacatcgcccggtcgaaaaactgcatcgtttcgcggtcaatagcgtgagataccaacttttaagatcgaactcgcgaccatgatgctgtcagcaatgttccgcggtgctccggcccaagccaccctaatgcaaccccactacttggcaaccacccgtgtatccatttttcaactgcgacggcgctaagcggtctggaacgctgcttgctcgctgcgatggcgttttggattgttccgaactccctttgttctcatgttactcatgttctgttttttgtttcgcttcggatgataccagctcatttgcgatactgggcttcgactttgctctattgtcagtgagattagttntaatgattaatggcaattgataagacccttgatctgtgaa

SEQ ID NO: 5429 - DNA, 655 bp, Aspergillus oryzae
caacctcacgcccctctgctgtcttacatcccacctccggactcttgtcgccgtcttttatatcacagacttatcaagaccccgccaggaatgtcctactatcccccttactcgggagctcccggctatcccccgcagcaacaatatcaacaatatccgccgtccaactacggcgcccctcctcagcctatgcatcatcaacagtcgtcctacggcggcggttatcccggccaggcctatcgtcagcaacaacctaacaacgcatacggatatggccaaccatctcctcagccatacggctcgcatcacaacggttacaacagcccgcagcagaattacggccctctcagcggaggccatatgtatcaacaacaatctgcctaccagaactcctacaatcaaggcggccatggtattccggcccgtcctcccgatcaaccggtctccttcggtcaaggcgctccccatgaatacgcctaccggtactcagcatgcaccggcacgagaaaggctttgctgattggtatcaactacttcaatcagaatggtcagctgcgcggatgtattaacgatgtcaagaacatgtcgacgtacttgcatgagaactttggctaccctcgtgaaaatatggtgcttctgacggaccaccaactag

SEQ ID NO: 5430 - DNA, 659 bp, Aspergillus oryzae
ggtctttacccatttcataaatgaaggacaatggccgactcaaggcctctcgttcttcatcggattaattggccctgtgtttgcctttgccggtggcgatgccgcagtccatatggcagaagagatttccaacgcacctacttacgtcccctggtcgttaatgctcactgtcttgatcaacggaacccttggttttgccatgcttctcgccctgctcttctgtatcggcgacattgatacagccctcaatgaccccacaggactaccctttgtcggtattttcctacaagcaacagagtccatcccaggcacatgggcaagggtcttattatacatcgaccatacgcttgtgcctaagtgggcatgctggcgtccatatcgcgccaattgtggctctttccccggaaccgggaatccgtgtgggcatctttggactcgggttacagcgcgcacagataacaaacatacaccgttttttcaccacaacatttcacttttctaaaccttataacatggtgtttgattacctttaaaaatgggttcatgtgccatatgccccttttatatacatgggggtggcgggtgttcctttccggggttgcctggggatttttgaaaaacaacgggccccgggtttaaaaaaaaaaaaaccggggggt

SEQ ID NO: 5431 - DNA, 676 bp, Aspergillus oryzae
gttattgtggccactggcgctcacaaggcactggcggtggaaaagggcctcgaaggtggtgtcaatcatatgtggaccctttcagccctccagttgcatcagcatccgctgatcgtatgtgatcgtgatgcgacactggaactcaaagtcaagacagtccgctattttgaggcgattgaacaatccggtactgatgcgcgtactcaagggccgcctcttgtttaccggccgaggacctatgttcctgctcctatgggggcgagcaaaacgaatcagcaacccaccccagcgtcaacaccgccgagggttcccaaggacctgagaatcaatactcagctcaaccagacgttagatgacgaggagttgacgcctgatagcatgtcttcccgaatggtcgactcagccatcagtggactcgactcgaccttgaagggggatctgatgttcgatcgcatgggcactcgagttatctctcactgaccaaacacggcacggacccacggtcttataagacgtgcactgatggctgggcgaaagcgttgcgagctggtacgctgctctcgacaaagcacgtgtgccataagtaaatttgccggtaaagcactatcttgtctcattttgttggagtagggtacagttttttgatttgatagcctggatggacctaccgggaaat

SEQ ID NO: 5432 - DNA, 763 bp, Aspergillus oryzae
  misc_feature (1)...(763): n = A,T,C or G
tttactgaatacactacttaagttaattaaccttnggacccgctctggatctcatttcgggcagggcatatctctccaaacgggcccatttccactttcctttctttggccaatttacatttggaaaatcgtcttttatgggcacactgaccttatctgtcttcgacattggaagaggtaccagcagacttggtcttctcaagcatcggcacgaaatttcgtccgggatcactagctcagttgcacatgaactgataggatacgccgccaacgaactgtccgaggacaccctcgacgtagtcaattattcgtccggcaatgttgcagcgtgggacgatgtgcatgcagcctcggcacagggacgcctagccttcgtctctgacctcccaggatcagttcgttatctaaagtctacgcttcggggcctggtcagctgggctccgcactatgtgttgctgtgtattccggcaaactgtgacgatgagaccttaaaggagtctcaaccggattctgcggagcaaactactgatatcaacttggctttgtcgcacctcgacctctgcaataagttagagatccctacaatagtggtcatcactaagatggaccttgcgtctcgcgctaacctgaaacaaaatcttactaaagtcctatcggctttgaagctttccggcaaaggccggccatactgcctgtacaatcangcagttctgaggcttcactagaacctgcaccacgtcggaccgaaggacaatgtggaaat

SEQ ID NO: 5433 - DNA, 654 bp, Aspergillus oryzae
  misc_feature (1)...(654): n = A,T,C or G
gtcccggtaccaaaggcgtactgtctctgtgtggatagcaatgtgattgggaccccgttctatatcatggagttcttggatggtcggctatttaccgatcctgccatgccgggagtcagtgctgaggagagaaacgcattgtggaaggcagcggtgcagaccctggcaaaattccatcgagtcgatcccaagtcagttggtctggaaactttcggaaagccgtcggggtactatgatcggcagatctccaccttctcaacggtgtccaaagcgcaggctcaggcggtcgacgttgagaccaaggagccagtgggggaacttccgcactttatggagacggtgcgcttcttctcgaacaagtctactcagccgaaggatcgcggcacgctagtccatggcgattacaagatcgacaatatgattttccataagactgaaccccgcgtcatcggtatcctggactgggagatggctacggtggggcatccactatccgacttctgcaacctcacgagtccgtactatctggatggcaccgaccacacgaccgaccagttccaacctggcccgatacctgnattgcccaagcgtgaggactgcgtgcngtggtatcgcgaagtggngggatgggacccaaccccggaccttccctgg

SEQ ID NO: 5434 - DNA, 1040 bp, Aspergillus oryzae
  misc_feature (1)...(1040): n = A,T,C or G
gggaaacaatatcatactaatattattggcgactaatgcgtgcaaaacttctatatctggtgtagacgtcgtggtttgtggctcaccctcgtcgctcccagcgggtacagccgaccatcggatctgagcgcttctatccgactccagcataccattcgagaacgacacgcaaactgatcatcgctaagagatggctgttccatcggttccttataagaggaaggtggcggctctcgtacaatgataagatcaatgaatatcttggtcccctgagggcttcacatccaggtaccgcacgtgatatatgtcgacatatcggtccttcaaatttgcctcttaagattctcatagatgtcatcaccagaagtcttgactatttgaagactccggtgtaggtgatctgcgccatttcacgacaaagaaggcatatccgctggtacagatcgaatcccttcaacgacaacatgggggatcttggccaccccgtcgatatctcctccgtgcctttcgcacaacgccccatcatcattttgggtgccggaattattggttgtgctgccgcaagacaacttctgcttaatgggttctccgtagtcttggtggccgaatatctccccggagaccagagtattttctatgcatctgcttgggccggagcagcatggcatgcggctgggggcattagccctgaataccgatactttcaagcgatcacacatcgccatctgctaaagatggcacaggaagaccctgagtcaggggtctgtattgtggacacacgcgagtatcttgaagaccccccgactgagaactctgcgatctgggggaagactgtcgtatcgaagtttcgtgacctaaaacctggtgaatatccccctaatttcgcttgcgggtgggcatacgataccctcgtcaccgacccaacgcgccatatgccttacctgggaaagcanatcaaggcgctcgggggtcagttcattcggaaacgggtcgaatctcttcaggagctgtacacaatgtttcccgaatcgagcatcttt

SEQ ID NO: 5435 - DNA, 710 bp, Aspergillus oryzae
  misc_feature (1)...(710): n = A,T,C or G
ctgagacaaacttttgcggaccaacatgactgttacaactactactcgccctaccatccttgtcattcacggggcatggcatcaccctgaattttatgccccgttctgcagggcgtttgaagacttgggctacgaagcagtctgtcctcgccttctaacctgcaacaatgatgtacccccgacgaagacattggcggatgacgtggcgctcatccgacagacggcacagtcgctcattgacgatgggaagtctgttgtcgcggtcatgcactcctatggcggaattgttggcactgatgccctagacggactggcgatcaaacgtctgatctacatgactgcttttataccccctagtggcaacagcctcgcgggtatgttcggcggccaattgcctcctttcataacaatcgatgatgaaaaggggatgttgactgtccctgacccagcgaccttttttttcaacgaccttcccgctgaggaagccgctgcatgggccaagaagctagtggtccacccaaaatccgcccagttcgacccgatctcaaacgaggcgtatcgcagcatccccgccacatacattgtgtgcgaacaagatgctgccctcattcccatggttcaggagatgatgatcggaaacgtgcngaacgtgggagtggatatagacgtcgagaggctaccaacgagccacagttcgttcttcacatgcn

SEQ ID NO: 5436 - DNA, 691 bp, Aspergillus oryzae
  misc_feature (1)...(691): n = A,T,C or G
gaattctccttctgtacaacacgagttgaatagggcacgctgagagagagagtcaagtcaacttccctttctttgttgctcttcatacagcatttattatgctctgcaattccccctcatttcctcctcttgtcttatcgcaatccactaccttatgccaattctcttttctgctcctatcttatctctttttccttatcttttgagctaagctgtcgggttgcgctccgaatactttaaacctcacatcttccgtgctcggttggcatcgcaatcgccaagatggggctgaacgaggagaaaaccacaaagcttgaaccttccacctcgggtgagggcggtagtattcatgtcggggagagcatggggaccctgcatcgccggcttggtaaccgtcaaatccagctcatcgccgctggtggctcgatcggcacggccctgttcattagcattggcggtggtctcgctaagggtggccctggcagcctgttcattgcctacacgctntattnctgcattctcggactggttaataactcgatcgctgaaatgaatacgtatatgccggggtcaggaagctttatccgtcttggtggctactgggtggacgacgctccttgattccttcccgggttggaatttcttcttctatgaaactttcctgaatcattttgagaacacggcacttcag

SEQ ID NO: 5437 - DNA, 1101 bp, Aspergillus oryzae
gaatcttgctacaaccgtctctcatccccaggtgctcggtgatctctcaccatggataaaaccgatattgctcatctagaggtcttgagctttgcgaagcttgcgagcaaagaccagaccgagttgaacaagcttctcgatgcttgtcgcaaacaaggcttcttctacctggatcttgctggttccaatgtgtctcatgggctccatcagcgactgaaagccctctctttgatgaaagattggtttgaccgtcccaatgaggagaagatgaagcttcacaaggattcagtgaccaatggatacaagcctcctggtacattgagcggtgttgtcaagcatatgaaggacggatttgagaacatcaagctaccacgggacaacttcttgggaactggcgactctcttcctgaagtattcaagaatgacaaagaggtctttcgcgacgatctggagatatcccacggcgtcacattgactattttgtcgtgtctgtctgatctgctccagccacctgtgcgactcgaggattatcatcaggaaaatatgtcctcgcagtccaccatgatgtacttccgctacgccaagcagtgcgcagacaagtccagtggtgtcggtcacaacatgcacaccgaccttgggactctgactctcctttactgcgagcaatggggtctccaggtctatgcgcaggccaccaacagctggaaatacgtccaaccgcgaccagggctgtatgtcgtgaatgtcggggatgcgttgcggttcttatcaggaaatgatttgttgagtgcactgcaccgcgttgtgccggttccaggccatgagagtgagtatcgctactcgaccgcctacttcctccgtccaggaaacgaaaccgaattccgtacgagcgagaacactgtagtctccgccctgaactggcatgaccagaaatacaacgtgttcaaagcagcgcatgtggagcaggaaaagaacaccattcttaccggtggcatcggtgccttttaaagggagacgtccgttggtgttgtgataggctgcttagctatagatcagtgccattgctgccgtaagacctaaaaggttaacgagaatttccac

SEQ ID NO: 5438 - DNA, 686 bp, Aspergillus oryzae
  misc_feature (1)...(686): n = A,T,C or G
ttttcctccagttctgtttatagtacattctttccatccgaagacgatctctttccctttagagatacatcatattagagaagtttccaagcccaccatggcccttccgtcagcataccgcgagaaccttgaggcggcactagaccctagccgccagaaaggtcaggtcttcaagcttacagcaccagctgacgagcttggttgtgttgacttcggctcaaataacaccctttcccttggtgggagcgcagcaacacgagaggagtttctcagagagcttgcgcgaaatcctaactttgctattgggaccgggggcagccgtctcctaggcggaaccactcgatatattgacgagctcgaacgagacttggcccacttttataatgcagacgagggcttgattttgccttctggatatgagggcaacgttgctattcatgcgacgctcccgcagacgggagatgccattattcacgacgcaaagattcatgccagcacgcgcgatggcatgcgttcctcaaaagcacacatcatacgaccatttgcgcacaacgacccacaatccttgtacgacgttctcgaagaagtcaagctattggagccagcantngccgatgggctcaataccgtcttcgngaccatngaatcgatctacagcatggacggngacnngtgcgctcgtggct

SEQ ID NO: 5439 - DNA, 852 bp, Aspergillus oryzae
cctggaaagggtaagctgtacgtccgtggcgacagcaagatcttccgcttccagaatggaaagtccgagtccctcttcctccagcgcaagaacccccgccgcatctcctggactgtcctctaccgtcgccagcacaagaagggtatctctgaagtcagtaccgccaagttttccccatggttgaagttgtttctttggttttccggaagggtccgacatgtcgggacttgagttgggtccggtgatggaacatggacatgtcaactagcacgatgcggaaacatcggaaaggagccgggatatatctgcaggtgacgaagcgttgggacaggatcagaaatgctgacgggatatctttcaatgcatacaggaagtcgctaagaagcgtacccgccgtgccgtcaagtcccagcgtgctatcgttggtgcttccctcgacgtgatcaaggagcgccgcaaccagcgccctgaggcccgtgctgctgctcgccagcaggccatcaaggacgccaaggagaagaaggccgcttccgagaaggctaagaaggccgagaaggccaagaacgctgccgccggcaagggtaccgcccagcgcatccagagcaagcagggtgctaagggctctgcccccaagggtgccgccaagtctcgttaaacggaatagaagcggtttggcttgggctggggagtatgaaggaattcgggaggcttctggagctggaatttgtgtttccttcacaaaatttatgcaataaatcggcgtatgtgctatggtttcttgcggacgagattcccgcacggctctcagataggctctgtcaatgtgcgccatggtatttacccagaaatggg

SEQ ID NO: 5440 - DNA, 675 bp, Aspergillus oryzae
gggagatcaaggctccaagagacagtggtctggtggggccctcattctatcgtgctccgagccctgctacagagcagatattagataatacctctaggcaatggcatgctcgtccaagctccggctcagagaccacagcgccgaaaccaaacgcagcaaacgagcccgtcgatgtgattgaccgaggccttgtgagcgcggccgtggcatcggaagctttcactagatatgtgaaacatatggcgccccatatcccgatggtagtctttcctcctggcaccacgatggcagacatccggaagaccaaaccggtgcttctccatgccattatcgctacagccgtggggcctattcagcctggattacagatttcacttattgaagacttttacagggtcattgcggaccgagtcgttgtgaaaggcgaaaagtcactagatttaattcagggacttcttgtgacctgcaactggtatatcccgccggaccactttgaagagctaaagttttaccagttgactcatatggctgtgacgttagctatggatatcgggatgtaccgtaggccgatgccaaaaagtcgtccatggaccttggtcaaagaccttatattgaaaaagtcgccctctcaggaccctgattcggcggaggctagacgggcatggttgggtcgta

SEQ ID NO: 5441 - DNA, 629 bp, Aspergillus oryzae
  misc_feature (1)...(629): n = A,T,C or G
cataatggacggattcgatgaagaagctttcaagaagttctttccaggcagcttcgggaaacaagaaagaaagactgatgtcaacactcagatagaccgcaccaagcggacacatgtatctgccaagactaccgcagatgatgacaaggcaggtttgattagcgacgagcaagctaacgttcaaactggagctgaagaccgaaaagacaagagtgaaagcgacagcgataatgagtctgatgattctgactccgatgacgaggacgaggacgagtttcctgtctcacacgaacttgtccttaaaactcatgagcgcgccgtaacaactctcacagtggacccatcaggctcgcgtttaatcacagggtcaacagattgtacgattaaactacatgatttcgcttcaatgaccccttcgacggtgcgcgccttcaagtccgttgatcctaccgcgaagaaacagtccgctttgcangaggcgcacgccgtgcattatgctgcgttcaatcccctgtcgccaggctatgtcatggtcgtttctgnctacacccagccgagaatcctcgatcgcgacggcgagaccattactgaattcatgaaaggagacatgtacttgagagatcttcata

SEQ ID NO: 5442 - DNA, 547 bp, Aspergillus oryzae
gaccgtcgtgtcggaccactccccgtgcaccccggatctgaagctccttccttcccatatcccgggtagctgcacctccaagggcgatgccgccatcgaaaagaaccaaggcagcttctcctccgcctggggcggtatctcttctgtcggtctgggtcttccaatcctgtggacggagctcagccgccggaagggtctcacctctgctccggaggataccaacaccaagcgggccctccaagacattgtacgcctgtgctgtgccaacaccgcggcacaggttggacttgagcgccagaaaggtgatctcgtccccgggtttgacgccgacatctgtgtcttcgacgactctgccgaatgggtcgtggagcctagcaccatgctcttccggaacaagtgctcgccgtaccagggtcgcaccctgcgcggcatggtccgtgagacgtggctgcgcggcgagaaggtctttagccgagacggcggcttcagcaagaagacttcaaccggccaattgtggtagagaaaacgggttggattcttttcattg

SEQ ID NO: 5443 - DNA, 809 bp, Aspergillus oryzae
  misc_feature (1)...(809): n = A,T,C or G
cttacttgactctcacgctaaaacggcactggagacaacgcaagtcttgcctctaccacaatggcgggcgcaaagaaacccgtcaatattttccagctcaaaaacctgggcgatcccaaacaggtctacaactggagactatggcttgctgtcatctctttcgggctcatgggcgctgctcgaggtgtggatgagggcttgatctccggtgccttcaactccaaggacttccagagaaccatccactacgattcgtacagtaaagtcgagcagaccaacatcaaggccaatgtctcggccatggtccagattggctctgtcggcggtgctctctttgccttcttagtttgcgatcgcatcggccgtctctgggctacccgtcagctctgtgtcctgtggatcgttggtattgctatcttcatgggagctaatggtaacctgggtgctatctatgctgggccgtttgttgccggttggngtgtcngtcagacagttgtggttggccctgtgtatcttgcagaaatcgnccncgcatcagtccgtggtctctgtaccctgtgtgtcacaggcttttgctacctcggtatcgtncttgctacttnnacactanntgctgcaagtgaaccttgagacacacacacaagcgtttggaagtgcccacccagttgcacaatattttcgcggccttatttttcctcctttctttacccagaccagtcccctngtttactggccaagaaaggaaagtttgaataggcctttgaggaatatgtcgcgtggtaaaacattttccggggcaccccagatcc

SEQ ID NO: 5444 - DNA, 672 bp, Aspergillus oryzae
  misc_feature (1)...(672): n = A,T,C or G
natactgtatcgcacgagggactaaacagcaattggctctgcgatcaggacaagtgaaaccactcgtcccaattgaccatgcggtcgatcttttcggtcctgcaacgggccgcagcaacctcatggcagccgccaatcgccgcgtcgattcggggtccccggatggcgttcaagctggattcgatttgcgccagatgtcgtcgtcaacagattcggttttatagcaagcagttggcggatgatccacgatggttgtcggttgtggatcatcctgcgcaaattgttcgtactggtcgtaaacatggaccaggtttgattatcttagctctaatccctattatctcattcgcgctcggcacctggcaaattcagcgtctcgactggaagaccaagctgatcgcaaaatatgaagaccgactcgtcaaacctcctcttccgctacctccacagatcgatccggatgccatttncgaatntgattatcgacggnnttacactacggnactgttncgacatgaccaagagatngctcgtggtctcgcatgcccnaggtgaggatggttcatcgttgaaccccnttngnaaangggatgaaaaccattgctgggaccaagctggatctagaaattaggtctcaagcgaacccgggcttcccagggaaggcccgccaac

SEQ ID NO: 5445 - DNA, 685 bp, Aspergillus oryzae
cgtcggagagggcttcctgtcgaggtttaaggcggaagctgctagacggttgaaggaaattgagaaggcagaggaagctgctgacgaggctattatgcggtttggaatgaatattgggcagaagttgcgcgatgcggttagcattgttcctccggagtcggattccagcaagctcctttttgagagtaaggatgcggagggcaagagggttatccatgctactcggttcgaggctcagttgcatgttattcattccaatatggagagcttcactaaggacccggtgagcgatgagtggccttcgttcaaggagaagttcaatgtggacaataagaccactgaaatcgctgccgatcttgagaagtaccctgagttgcggtctgccatggagaagctggtgcctgagcaggttgattatgcaagcttctggtgtcgttactatttcctccgactcgtcattgagactgaagagcagaagcgcaaggagcttcttaagggcgccaatgttagcgacgaggaggaggttggctgggatgatgactccgatgatgatactgattcgccgtctactcctcaagctaaagttgacaccaacaaggccaacggtcgccagggctctgccaccgcttgctccgatatcaaagcattgaaacccaatgaaccctcgcagtcttacgaacaccat

SEQ ID NO: 5446 - DNA, 703 bp, Aspergillus oryzae
  misc_feature (1)...(703): n = A,T,C or G
ccaaggtgaaggtaaattccgtaatttttattacttcggccttcttaatactccaaactcgcactctttcgtcgacccatctcggtcgggggcaaggtttccgttgctattgttgtcatgagctgctgatattctgtcattgacgttcgatcgcaagctttgacaaccatataactgaaacgctgtcgcactcgctacggtttttccttcgcctgcctgcttcagactcttttaacgatttcttgcgaacacctgatctaccttcaggagcacctatcccaccccacccgccaattattgaagttgaacacatcggaacaagcctttggcctagtatcctgatttccttgccagttcttccctttctccgtttctcacgtgggtttaagtttcagcgccatgtttttcctcaaggaagagaccaaggtcatcacgttgcatccgtcctattttgggcctaatgtgcgagaatatcttataaaccggctaaaccaagaggangaangacngtgtacgggagatcacttcgtgatttgtgtgatggacatggtaaatattggagaaagtcgggttctacctaacagcgggcaagccgaatccacaattaaaatcccgagcttattttttggaaacccgtttccgggaaaagaccgtcgattccattggtaccgtctggtaaacccaccggaaattcttacattgg

SEQ ID NO: 5447 - DNA, 732 bp, Aspergillus oryzae
ggcgtctttcatattttccaaatccgctacagtatcactcaagagattaccggccaagtcgagagtattgccgttcacaaggataggcctgatccaaccacgccggaccttctccctttctctaaaacaagccatgttgacgacagagctgtccgaggccgaggtttcggcgcttagagccaacaaggaccgccttgcaaacgacctccatcacagttgtcaatgggggtttggcatacgttggggagatggaccgacggatacaggaatgcagcgcctgacgctgtctgaagaagacaaatccgtgcgagactggtttattaaaacaactaaggcattaaaatgcgacatcacgattgatgaaatgggcaatatcttcgctgtgcgtcccggacggagaaaggatgtgcccccgacattcatcggcagccatttagatacgcaaccaacaggtggtcgttacgatgggatcctgggtgttctctcaggtattgaagctttgaaagttatcgacgagatgggcctggaaacagaaggaggcataggcgttgtaaactggacgaacgaagagggggccgtttccctatcagtatggtcgcttctggggtatgggcagagtctatacctctctcacgggcacatgggctcatcgaggtgccaacggtggcctctctcaccactgcatcttctgctccagaaacgttaaaatcggcacttgagaagatcggttag

SEQ ID NO: 5448 - DNA, 688 bp, Aspergillus oryzae
gaggacgccggattacatacaggaccctgtgtcttatataattgctgccagccgtcaatgccacgatgatcagactagttgaatcaagggggtactcgatctgacctgggacagccatgtattaacaccactgttcaagagcacaatgaatctcgaactaataaaacacccctccttcacaccaaggcattgattggcgcaggcagctccgaaacaggatgatttgtactagggcaagattgatcgtggtggtaactctagcattgatcctactatggctgtcgtcgtcttcactgctcaggctttactacctcctgcgactaccgttcgtatggaaagcatcttcggcggacgcgatcatatcccaagaatacgacgactttgacgtcacattcactgactacgatgcaaactactccacatatgccacaggcatacgaccatacataccaagaaggatacaccatatccacctaggggcgagctcacctccgaaaaattggttggatgccagagccgagtgtctcaaacaccatgaattctgggaggcccatctttggacggacgaaaatgcagatagcttcgttcgagacaactatcctcatctgtatgacatgtggaccagctacccattcaatgtacaacgcgtggatgcattgcgctacatgattctacagaaatatggaag

SEQ ID NO: 5449 - DNA, 668 bp, Aspergillus oryzae
  misc_feature (1)...(668): n = A,T,C or G
tattgacaacaagccgagacgcacaaccagcaaagaagcacccccactcccccccggctcggcgccgccacaaggacaacgtcaggaagttatcaagggcccatggaggcttttgcggctcctgcctcgtgaaagtcgttatatcatcggccggatgctcaaggtgagcgtgaaagagcgagcgattctcgatgatgttttaaccgatgaatggattcggaacatcgatgcctgtcgacaagaggtcactggggagctttacagggctccgggccatacacacattctggagccaccttctccgagccctgcagtggccagtaaggccaaataggcctattactcttaataccaattaatactcttcatggtccaatctccaatccgagacctttgtttctattttgcttcgtcgcccccggttgttctcgagtcggtcgtgatacacttttatgaacttttaccgtcaagttattgttcggggcatatttgcccatggtgatctttgtcgctctttatcccgtttgacggttcgatataggtcacgaagtcaatgttttctatgctaacctaattgttttgattaatccctttcactttccctangctgggaagaaggagcaaattgttccgctccgtcttttgttccccgcgtggtatacaagcgt

SEQ ID NO: 5450 - DNA, 681 bp, Aspergillus oryzae
caggctcagtcaacgattctattattcagatgactatcgtggatctttttttcgtccaccagcgtgcaacaatgaatggtatctataccacaatggtggtcgttggcacatatcttagtctcattccggccggatacatcatcagtagtcagggatggcgatgggtatggtggtggtgtgccattctcaacgcagtggtactactcttgataatcttcgcgtacgaagaaaccagatatggaaggcctgcagggaactgttatatcggtcaagatcccccagccgcactgggatccgaggagaagcagcctacaacttccaaattcgacaaggaaaaggcgataccgctccctcgtgacacaatcccacccaggcctgtggaagagcctatcccaccaccgaagaagtattttggaaggatgacttgcatttgaccccaccgaccgtatcaacttcaaacgtacttgccgatatgtggacaccctttcttcttttcttttgcaattccacaattggcctttgttgcattcaaaaatctcttaatgaggggttggtgggcaattttggttccaaacaaaacttttctattttgggggaccccccgacaaatttttaattggggggggggggcaaatttaaatttgaccatttatttggggcaacctccggggcaattatggg

SEQ ID NO: 5451 - DNA, 635 bp, Aspergillus oryzae
gcctaggacaatatggttcggaaggatccaatctttgaggcacgtactaatgtcaagttacactccaaccggctcaaaaaagaggccgctcgcgctgaatcgactttcaagtccgagaaggcaaaagcagataaggccatgaaaagtcgcgagttccaaatcgcccgcatccacgctgcctctgcagtacgcgagaaacgaagacaggtgaccctcaaagaggaagcagcccgggcagatgttattatcaacgagctcaaggcggcgcaaagtactcgtgatacgtctcgcactttagccctggcatctcggggcttggatgctgcgtctaagagtgtgaaccttgaggcgttggtctcccatgcgaacaactttttagcacgttctgaggatttcaaaatcgctagtagtgcaatcgaggatgttgcacaaggtgtctcaatgcgagaatacggtgctgagggtgaagccgacgttgaccgccttatggagcagcttgcagatgatgcgggtgtggacctacgtatggctctggatgcggacgcagcccccaaagaggacgtcaagaatcagaaagaagccgagacagacctcgaggatggtttgggcgccagactacgagctttaagggctgg

SEQ ID NO: 5452 - DNA, 1132 bp, Aspergillus oryzae
tattttcatcctctaccaattctttctttatttcttgtttaccgacccctcgtggctagctcccgaggttcctattctcggtacatctctcatactcctactggctcgaatttcctcgtcccattaaacaacaactttcgctatggcgcagatccgcggcaccgcgggatacaatctcggccaccaaaatcccttcgggggacctggtcgcgcagatgctacaagtgaccctagccccttggatgccattcgggaacagaccagcaagattgaggattggttggacacgttggcagaccccgttaaaccgtatctcccagccattggccgtttcctgatcgtcgtcactttcattgaggacagtctgcgaatcatcacacaatggagcgaccagcttctctacctgcgggagtaccgcaaaattccgtggggcatcacacacaccttcctcatcctcaatgtgctcgctatgtcgatatgctcattcctggtcattgctcgtaaacatactgaaatcgccgtcgccggactgctggatgacatattaacattaaatatattaaaaaattataatattatatcatattataaaaaaaatttatagattttactttggtatataaatttagaaatacataatataatatatattaaacaaaaaaatattaattataaataaatattaaataaaataaaatatatatatatagataaaaattaataattttaaaaattaaatatataataataaaataaaaaaaattatattaaattaaatattaaaattaacgataaaaattttaaataaataaaatttacataaagtttcaaaagatatatattaaagaattaataaataaaattataatttaaaataaaatatatattaaaatttatattattatgttatattataataaaataaaattaatttcttaaaaattaataattgacataataaaagttatataatttaaaatatttcattagaaatatgaaatgtaatgacattgagtagataacaaattgaaactatgagtataataataaataaaataataagcattgaaaatgaataataataaaattatgaataatactaaaatattaatattaatatataattgcatcg

SEQ ID NO: 5453 - DNA, 621 bp, Aspergillus oryzae
cacgtacaaagcaaggacgttcgtgctgaggttctcgaaggtgtcaatgagattatcgatgaattgggccaagtagatgaccagattgcggcctatgccctcgaccatatccactccaacaaaatcttcctcacccatacctcgtccactaccgtccaaaagttcttgctgaaagctgccgccaagcggaagttcaccgtgattcacgccgaatcctatcccaacaaccacgaagctacacatgccactgtcagcggaaacagtactggcgatgaagagatcctgagcactgaatctttccaaaagcctgtgatcgctctgggcatcaaagtcatcctgatcccggattctgctgtctttgcgctcatgtcccgagtcaacagggttatttttgggcacactttcggtttttgccagtgggggccttgcctcctcagggaccaccgttattgttctcgcacaaaagtgcaccacacacccttgttgttgtgagcgcgtatacaaactatccccctgtatccgccgatttcaaccccttatcaatatgggactcctccaccgtatttgctcctacgatggcgactaggtggatgataacacgttttaaacctcttttcacta

SEQ ID NO: 5454 - DNA, 667 bp, Aspergillus oryzae
ccaactgacttctctcatgttcgcaaaacggccgagacattcctcggtcgtaaccgctcacgaacaggccaataccccccgggcgcaaagcctggaagcaagccgcagtctatcataccggcgccgtctgccggccttcctcaacctcggaaaggcagctccaaaacccaggatccgatcatactactttccccatcggcttcgtctcttatccgcatgtcaaatgtacggtcgttcctccaggatggtgtctttgtacctcccgaccaccccactctctctatgcccagttccaacattctgtatatatctcgcccgctgcgcattctttccgacacatccaacgcaacatcccgtgctgtcggctcccaaaccgcaaccagaaaaccaaccaggttcatccttgtcgacagcacagccaatttcagaccagactactggaatcgactcgtcgccgtcttcacaaccggtcaaacctggcaattcaagtcctacaagtggtcctccccacccgaactcttcaagcacgtgaccggtatccacgtccgttggcgtggtgagggtgtcccgcgcgaagtccgcggctggggccgtggagtccaaaagcttttcgtcgagcgatgggacgaaaagggcgggggtaacggtgcaggacggtggcgagaat

SEQ ID NO: 5455 - DNA, 998 bp, Aspergillus oryzae
ccctgctgatataccgatcttgatatattctctaccgaaaaccacattccatcgtcaccatgtctgaacgcagcacagtccatgtctcgggcatcgcgcccgccacctccgagaaggaagtccgggacttctttagcttctgtggcaagattacctccatctctgtgactccagtttctggtgagtcaggtgcttccaagtccgcaaccgtgactttcgagaaagaagcggctgccaagactgccttgcttctggatcaaactcagctgggaggttctgcagtgcacgtcgaggctgcccagaccctcgacgacatcgccggttcccaggccgccagtgcaggagaggccagggatgagaaccaccatgagatctcgcaggaagacaagcccaagtcccgaatcttcgccgagtaccttgctcacggctatgcactgagcgacaacgcaatccagaaggctattgccctcgaccagaagcacggtttctccaaccgcttcacctcggctctgtccaactttgatcagaagtacaaggccacggaccgcgccagaggaattgatgagagctacaagatcagcgacaaggctgccactggttggcacggactccactcatacttcgaaaaggctcttggtacaccatcaggtcaaaagcttcgtgatttctacgtccagaccgataagcaggtgcgggacatccacgctgaggccaggcgcttggcagacctgaagagtggaaagaccactcatgagggtgaggccccagctgccggtgcagaagcctccggtgccgttcccgcagctgctgctcctgcggctcctgcggctcccgctgccccagccgaacctgcccctgcggcgagccagcccgctggaaccgctgcccctgccgagcctaaggcataatgaattgacgacgtactgaaattaaactggggatgctgctgatttgtgtttcctgtattctgatgtgcgtttttgaacaagctgtctgga

SEQ ID NO: 5456 - DNA, 722 bp, Aspergillus oryzae
  misc_feature (1)...(722): n = A,T,C or G
cgagggaaagagaaggctggctcgtcatccgcgctttggagacgcaaatatactggccggcaggtggagtgcgttgtctgcctcgaagaatacgtggacggacagagcagggtgatgagcttgccctgtgggcatgagttccatgcggagtgcattaccccgtggctgacaactcgtcggcgaacctgtcccatctgcaaaggggatgtcgttcggtcaatgtcccagaataaggccgctgaaacacgcgaacctgcggagtcgatcgaccacacctaccctcatgaactagattcacatcccaacgcgtcgtctgctccagtcccaattacgaacaacggtgaagatgaagtgtcggacctcgaacgccgcggtggctcaaatgctggtctgcttgagcggcactcatcttcggcgcccccgccgaactggagaaacttcgccgcacttatcttctcggccctcagcggcgatactatctggcatcaaggccggactgatcgcgagcgataatcttttcacttttccttctcgaatacccctagcatatagtgacggcaaagcatggacctcgggtccttcagggacccaccgctttgcgatcggaaaatattcccattggcgatcttttaggctgccacattggactttggtggggttattaccgatcgnggggcaggcccatgcaggacaaagcatatattttcttttccagggggttg

SEQ ID NO: 5457 - DNA, 1008 bp, Aspergillus oryzae
aggaattttttttttttttttttgatagacatgtagcttaaagagaaaccctgtcattagcatcacaatacatcgaatatctgtataggtaaatggatatcagaagcagaacgacattcaaaaccagcatttcctcgcaccacactaaatcatccacagcatttcgtcacagcgagggcatcattctccttccccaactgcaacggctcccaagtaaacaaaaacgaacccaaaaacgccccaataaagatacaaataataatatacccattaaagtacatagcaagcagcatgataaaatacgccacagcaaactgcaacatatgcatgagggcgcggatcagctgttcaacgagagtaggtcggacggggacatcagcggccggacaattgggtgcctttcccgcggaaggctgcgcagatgaagaggcttttgtgcctgtggcgacatcttccgcgtctgaggctgcggctggggttgagggttgggattgcacggtgaggtattgggctctgagacgggcgcgacggaggatgaaggcgtcgtattcgcggccaacgcgacggaggaattcgagacagattactaggaggatgacgcctatgcaggagccggcgaacatgccgttggaggttatgtgccattgtttggagaggaagcaggcgtctttgacggtccagttccataacattgagatcttgcagctgtttgagccgccgtgcatacctcccatgctcattgagtgggaggccgtacttgagctcatggctcctgtggatgttgctgtggccatggacatgtccatcatcatgtcaccgtgggctaccatgatggtttatattatttgtggagggtctgagaaggaaaagatctggggatggaagaagtcagtcaactcgcgggtagtactggatacccagtcacggcagtgctgaacaaatctactgaactggacttgggttttagaaatacgaagagagaacaaaagaaagaagagaagaaaaagg

SEQ ID NO: 5458 - DNA, 551 bp, Aspergillus oryzae
  misc_feature (1)...(551): n = A,T,C or G
caggacccaagcttggaaaattggttggctggcctttaaaatttcgagggtcgagcaagacgagatgtctcgcgccgttccccctgtgtatttgacgcgagagctttggtgcgctaaattgatgcttggtgctattgattcctcatatgataccaaggacgagaaggccgctggccgtgctgggcctggagggcctcaaggacctggcggacctggggggttcggaggacctcaagggcctggtggaccgggcggattccggggaccgggcggacctcctccaggacctcaaggacctccaccaggccagtacggtggctataacccggggcctggatacggccagcgaggaaaccctaaccaacccccaccacccggtccatatggcccaggaccgggatatggtcaagcaccttatcctcctagccagggccagggcccaccacctggttatggacagccacagccgtatggtggatacggaacttccccttcttctgctggatatgggacacccgcctggtgtggccccaaaaaggttatcttccacn

SEQ ID NO: 5459 - DNA, 628 bp, Aspergillus oryzae
cgcaagcatcacatctacttcttattgcctattctgtccgagtgctagccacttatcatcatgaagaacatcttcgttgccactttgggcctgttcgccgcagtttcgtctgccttgccctacacaacccctgtcaatgacaatcccatctctgctttacaagcacgcgcgacaacatgctcggccaaggccacggataacctcatcttcaaggtctccatgaagaccttccagaaggcgcgcaaggccaagaacccctccaagtgcaactggtcatcggacaactgctccaagtcacccgataagcccgatggatacaacttcatccccagctgccaaagacacgatttcggctaccggaacacgaagaagcagaagcgcttcacaaaggccatgaagaagcgcattgacgacaacttcaagaaggatctctacaagtactgcagccaattctcgggctggagctcatggaagggagtggagtgccgtcgccttgcggatgtctactatactgctgtccgccactttggcaagcgtgatgaagcgcttgagtttgaccctgaggttgagttcgaaagcgtgatgaggtggccgatgtccacctgacgaatttgataactttgacggt

SEQ ID NO: 5460 - DNA, 1691 bp, Aspergillus oryzae
gcaggatgatgtcaagactgtctacgttgagcacgacttggattctgccgatactgagcaaaccgtcattggctggaccatgaagaagctccgcgaggttggcctggaccccaagcaggaggaggtcgaagccaagctcgaggagttcggtttcctccgtgagcagctcaacggccccattaccgccctttctggtggttggaagatgaagctggcccttgcccgtgctgtcttcgagaagcctgatatccttctcctggatgagcctaccaaccacttggacgtcaagaacgttgcctggttggagaactacctttgcacgtacccttgcacttacatcattgtctctcacgacagcaagttcttggacaacgttatccagcacgtcattcactacgagcgtaacttcaagcttaagcgttaccgtggtaccctgagcgagttcgtgaagaaggttccttccgcccgctcttactacgagctgggtgcttccgacatggaattcaagttccccgagcccggtttcctggagggtgtcaagaccaaggccaaggctatcatccgtgtctccaacatgtccttccagtaccctggcactcctcgtccccagatttccgatatttccttccaggtgtctttgggatcccgtattgctgtcatcggtcccaacggtgccggtaagtctacactggtcaacgttttgaccggtgagttgatccctaccaccggtgatgtctaccagcacgagaacatccgtatcgcctacatcaagcagcacgctttcgcccacattgataaccacctcgacagcactccctccgagtacatccagtggcgtttccagaccggtgaggaccgtgaaaccatggaccgtgccaacaagattgtcaccgatgaggacgagaaggccatggacaagatctacaagatcgacggtaccccccgtagggtcattggtatccactcccgtcgtaagttcaagaacacttacgagtacgagtgttccttcctgctgggtgacaacatcggcatgaagagcgagaagtggactcccatgatgaccagcgacaacgcctggattccccgtaacgagatcatccagtcccacgccaagatggttgccgaggttgaccagaaggaggcccttgccagcggtcagttccgtcctctggtccgcaaggagatcgaagagcactgcgcccagttcggtctcgatgctgagcttgtttcccactcccgtatgcgcggtctctccggtggtcagcgtgtcaaggttgtccttgccgcctgctcttggcagcgtcctcacgtcatcgtcctggacgagcccaccaactacctggaccgtgactccctgggtgccctttccaaggctatcaagaccttcgagggtggtgttgtcatcattactcactcccgtgagttcactgagaacctcactgaggaagtctgggctgttgttgacggaaagatgactccttccggccacaactgggtccagggtcagggttctggtcctcgtctcaccgagaagaccaacgaggaggacactttcgatgctatgggcaacaagattgaagcccctaagaaggcaaagaagcttacttcaagtgagcagcgcaagaagaagaaggagcgtatggctaggaagaagcgtggtgaggaagtcttctctgatgaggatgatttct

SEQ ID NO: 5461 - DNA, 636 bp, Aspergillus oryzae
  misc_feature (1)...(636): n = A,T,C or G
gaggcatggaaggagagagatgccgagaagaacgactctagcaagagccgttctcagcgcgaggagctgatgggtgagaaagagcgggagttggaagccgtccggagagccgaggatgaggcgagaagtggcacccccggtagggacatcggaatcgggggttcctttgctagaagaaatggtggcatcggagcaccatccagcttgcagtacaagatgcctgtggatgacgaggcgaagaatgctttggcaagtctgcagccgggtgacttggtgcagctggccattgatattccaaaggagacattcgtccttgctggggtagagaacgggactgttcctagctccgtcgagtcgcacatctcctcatcttccccacgttatacattttatcattatcccgacactgacgtggtaatcttcgtctatacttgcccgtcaggttcgtcgatcaaggaacgtatgctatatgctagttcccggatgtacgccctccaactggccgaggaccaaggcctgaagatttctaagaagatcgaagcatcttcgccagacgagatcacaagcgacaggctgcangaagaagtgagcccgncacaaaacgacggactcaaccgtggattcgcaagaccgaaa

SEQ ID NO: 5462 - DNA, 1149 bp, Aspergillus oryzae
taagtccaaacttcctgcttgaagcataccaactttttgacttcggtcagccattcttttaccaaaccaactacccacgctctcttttagccaaccgctaaacaacaccaaataaatcaaccttgacggttatattatctcgtgaaaaaaacacatcctacagtcaaaatgcgtttctctgccaccaccattgctctcttcgccggccttgctgccgccatccccaacggcgaggtccacaccgtctaccagaccgaggatgtgaccatcacctcttgcgctcccaccgtcaccgactgccccggccgtcagacctccactcctgagggtgttgagcctgtcaccactggccccgctgtcactgagactcccattgctcagacctcctctgctgaggttcctcctgttgccgagacctcctctgctgaggtcccccccgctgtccctaccagcagctctcctgttatccctggagttcccagcagcggtgttccccctgttccctccagcagcagccccgtcatccctcagcctcctaagcagcctagccagggcaccactgtcatcgctgtgaccacctgcatccccacggtcacctactcgaccatcaccgggcccgttggcacccccaaccggtgtctcccctggcaagagctcttccgtcgctgtgatcggtacccgtgcccctagcggcagcgctaccccttcttcctccggccccacctctctcttcaccggtgctgccaacaccgtcggccagtccttcggccttgccggtgccgccgccgccgccgctttcttcctggcctaaattcccttcttgtcaatagtgtagccccgattcactcgtgagtccggctccgctgcaggcgggggaatctagtaatggacgttctgtgtgaatgataccagagttggacggggtttgtctttagcttttgtgtggttttggggagagttaataccatttgacttcttatgcttcatatttgactacatactctttatacctcttttttttccttgattatacttcttggtttggcttctggattgcttcgaagttgtgaagcagtttggtcgctgtttacgatttaatgtaaaccatgacgctttcacctttatcaaaaaaaaaaaaaaaaaattcct

SEQ ID NO: 5463 - DNA, 656 bp, Aspergillus oryzae
gagggtgtgacagcacctgacgcgtggctcaaacttcactgcgacaaaaagcggaacttctttgcctacccgtctgatgttacgtttctaagcgcagtccaagcgaggttattacacgaaagccctgcgacaccaataggcagccttaccgggctcgaagatcctcactggttcaagttcttcgatggttcacttcccagtcggattctgccatatatgtatctcggcaatctatcgcacgcaaataatccagaaatgctgtgggctcttggcatcagacgtattttaagtgttggcgagtcagttacgtggactaattccgaggtggccaagttcggcgcagaaaacattatgcacgttacccaggtccaagacaatggcatcgacccattgactcaggaactggaacgttgcttggattttgtccggaaagggaagaaggacggaacggctactttagtccattgccgagtggggtttcgcgatcagcgactatttgcatagcagaaagtatggcatcattaggcctttcgttcccagagcatattgtttcgttcgcgcacgaccgctaaatgtattatccagccactttgcgtttggctacggctcctgaatgggaagacttgagttgagaagcagaacagcctcaaaagaga

SEQ ID NO: 5464 - DNA, 719 bp, Aspergillus oryzae
  misc_feature (1)...(719): n = A,T,C or G
tgatattaccagcgtcgaatccagtacgagggatgtgtggtgttggctcgtgattcgttcctattaccgcggtctaagcctctttacactgccgatcttcaatcttgtattgacctgccttttcctattgtcttagctttattgcctgaggctctgggatacactacagcttatgttggcaaatgcgatctgtgtatccaaccggaataccggtgaggagtgtaacctcctggtgtgggcggctacggtagatgagctcggtgactgctgcatggctgtgtttaggtatataacgctgctgacaggttccatggatacctctggatcggtttgaagaatggataaacggcagggcttgccttctgtcccttggacctgtcctctcattacaattggcttttttcctttgtttaatacatatattattcttttttgtataatattcgcgcaatgcaccatctcggcaaagttttgacggctttcgcggcctgtgcaggcctgggcgttgctgccccttcttcggctcanataacccctagagaggtttcgccgcaattcctccaacagctcaccctatacgcacagtatgcggcagcagcatactgctcctccaacaccaactccccgaatacaaagctcacctgctctgttgggaattgcctcttgtcgagggagcgaacaccaagactcttgctgagtttgaagacaacaaagccttt

SEQ ID NO: 5465 - DNA, 669 bp, Aspergillus oryzae
ccattgtattctgacaatctacttatcagtttgtcactaggtggcaatctgaattacctcgctgaaggtactcctgagcctagacaagtcatccaaggccaccagaaaaacattacctccttgacacagtcccaccatggtagcgacaatggcacactgtgggctggcagtttcgacggcagagtctgcagctgggatgtgcccactggaactgcggcggaggtggacggcgaaagtcactcggcgtacatcgcaggccttgcgccgatgcaggaaggcaatggtaaaatctaccgcgtggcctgggacgacaccattaaatctattgacgatgggactaaaacgtataccggaagctctttcaagttatctggacaacctaagggtatcgctgcagctgcagcggtattggtagggacctcggagagtgttgagaactaacaagacggtcagaagatccgcgacttcaaatcttagttttccataactactgtggcagcacatggaaaccacggagctatcggggggcgatgaataaactgttcaaatatgggaaattttcgggcgctactttgatttcttaagacgggtaattaaagctttttcggaatcccgtgttttggattgggttttcttcccggaaaggttcccttgtaaactgttgggcaa

SEQ ID NO: 5466 - DNA, 644 bp, Aspergillus oryzae
cttctgtccaactatctcctttctgtaacataccttgtacaaaggctgaaacgcgacagaacatatcaaaagtggaagtgaggagaatcaccaaagaccgaaagtatcattctcatatgcatggctttagagaacatctataccccgcatacccttctgagagatagtgaagtctctacatcactcagacttgtatataacattgaatccatcacgtctcttcgactctagccctccacgccagcatgccttacatcatggaaatctacaccgacggtggctgtagacgcaacggacgatcagatgccatcggtgctgcagccgtcgttttcaagaacagatttggaaaatgcaccggttggacacgctccttaccgcgatatcccccacccacaaaccagcgggctgaaatcacggctatcatttttgcgctggagaaagccctggacaaattcgagaggctggacacaaatccatatctggaggtcaagatctattcagattccagatatgcgattgggtgtatgacaaagtggatctataagtgggcaaacaacggatggaccaatgctgctggcaacgaaattgcgaatcgggatctgattgaaaaagcttctgctcttgatgatagattgaaagaggaa

SEQ ID NO: 5467 - DNA, 723 bp, Aspergillus oryzae
  misc_feature (1)...(723): n = A,T,C or G
cgctcatgtactggggtcaagaccaaatcgggacagaccttgtcggctacacatgttatcgtcgctgctggtgctttcacgcccaccttgctggagtggtctgctgcggcgagcggcaatcctggcctgcgagctgaagagagaattctggccgcgggaattacaacgggcatggcgcagctcaatgaggagcagtacgagaagttcaaggacatgcccgttggcttccaaggctacacgcccaatgagggcaagcccttcattggtagcattcctcctaccaaggacagagagctcaagtggtggggttctaagattttcaccaacacccgagaggtactacccggtcgttatatctcatcgccccctcccacattcgactacaaccagtggaaggtgcctgggcctcttaagcaggacattgttgaggccaggaatctatggtatgggcccgcgagcgcagattggaagatgacgaaacaccgaatttgctgggacgctttcaccactacctctgattntatcatttctcctcactctgcctccaagggtctctacatcgccacttggtggttcgttccacggcttcaagttctttcccgtgctgggcaagtatgtcgtacagatgcttgagggcgagttagcgccagaattgatcgagagatggggctgggatcggcagcgtcctgattcgtcccaaaacgttgagtatcccaacgctgn

SEQ ID NO: 5468 - DNA, 673 bp, Aspergillus oryzae
cccagaaggatcggaaagggcaattacgttgtgtttacgattgattcagtgtatttgttttatcttacaccacctccactcacccataccgtaaatcccccagctccgctgccttggggaagaacgcgacctcgcgacaactagaatttttttcaacactttctgttccgttactatccaacaagatgtctcacgaggaggatctcattgactactccgatgaggagcttcagaccactgatgccgcagctaccactgctgctcccgccgcaaatggcgacgccgccaaaaagggcgacctaacggtttctggtggccgtcccgacaagaagggaagctatgtcggtattcactcgaccgggttccgcgactttttactgaagggagaacacttacgtgccatcaccgattgcggtattcaaacaatcatcgtggccccgtcaggttacatttcgacccctattttcaatgtaataggcttttgcgagccatcagttgatatatgtacactccgcatcttcagtacgtgcatgcgatgacgacggatattgattactgtatgatcatcatcatcacgatcgtgacgatgttgtactttcactctgaagaaaatgatgatgatgttctggtggagaagctcttgacatctctgttgatagtatcgctcgacacg

SEQ ID NO: 5469 - DNA, 679 bp, Aspergillus oryzae
tccaaacgtaacacctccctctcacactttacttcctacgagcgcgggctcctccgctcgcaatggggcacccaacgcggcgtcatcggccgcgactcattccttccattcgcttcttgtcgcctgtgtctacaccccgctcgagcacccgtcgtcgcctgcgcaaccaacggtgatatattttgtcgcgaatgcgccataaatgacctcctcgcccaacgacaggagattaagcggctctaacgaaaacgagaggaggctaataaacgactcgcataaaaagatgagcggacgttggaaaaagcgcgtgaaccggaactgcgccagtttgagctcgtcagtatgggattggaggtagcgaaaaataaatctttcgggcaagcgcgaaagacaatcttaaaaacggaaagctgaagaagcttccgaggcactggctgtgtttatagcgagggaaatccaaatggaccggcagccaaaaaaagtgtttgaactggattaaaaagaaaatgcaccgggttgctcggaagagcaagaccggtttaaccacaacccgaagaaagaaaaatctgaattcaccagactgcccagccgcaatttttgggggctttggtgcccccaacaacccatccaatgaaaatatggccaccaaggcggccaaatgaatccccgatggccccgg

SEQ ID NO: 5470 - DNA, 702 bp, Aspergillus oryzae
  misc_feature (1)...(702): n = A,T,C or G
accaaggccgcctttttaccgccggaaacagttcctttctgctgcgattaccctacacaatcgacgcggttcaccgtacgcgactgtccgagactaaacgtattcaccaacgtatacaaagcctaagctgtcgaaatggctatgaacgcgattcagctcggccttcggctgtgggagttcctatggaccctgctggtcatggccctcgttggtaacatgatcgccgattcatttagcggaaaccctgcgaccgtcaactatgccatgtttgtgtcggcattttccatgttctcgctgttctacttggtgccagcgtcctttaatctcgactgggcgatccacccgatcatcatgatcgtcttggacactctcaatgcgattttcttccttacggccggtatcgcattggccgctaggctcgaggcccacagctgcagcaacaacgaatacactctcaacaacgagattaccaatggctccgtgcaccgcgagaaacgttgccgtgaggcgcangcatccactgccttcctttggctcgcctgggctggatacacggcttccatcgccctttcatccttgggccgccgccgatccgtcaaccttcgcccccggacgggtcccgcccgtggagcccgtcccagcatggcccangtctaaagagaggaagcctanggagtagggatctacngtgccaacttgctg

SEQ ID NO: 5471 - DNA, 660 bp, Aspergillus oryzae
cctgtatcaagtcaccccacgggctccatccaacagtcccttgattcaaggtgcaagttcaatcgccatgaagtggcttatatgtgtccttgtcgtgctcctgctcagcctccaagtcaaggcacttcctcatgaaagcctagaccaaagtgatccagcaccactttcaggagtcgcaggcaagcatgaaatccccatcaatggcgatcccaataacctcccacccttgctcccaatacctgatccagccacacccgacctggtacccagtctcccaatagaaggcggatacggcatctcatacgccccctacaacgatgacggcacctgccgatccctcgacggaatcaacaaagacctggacaagataagcgaacattatagctacgtccgcatctacggcgtcgactgtgaccagacccaaaacatcgtatccgcagcccgccaacgcaatctccgcgttttcgccggcctctttgacctgcagaacttcccaaacagcctcgaccaaatcatctgggcagcagcaggagactggtccacctttcacacccataatatcggcaacgaactcgtcaacaaaagccaaaatccgcaagacgtagttaccgccgtacacaccgcacgtgccaaaattcgggcaacatgctccaaaggccc

SEQ ID NO: 5472 - DNA, 304 bp, Aspergillus oryzae
  misc_feature (1)...(304): n = A,T,C or G
cagtttgttgcattctgcttcttccaagctgaacccccaatcgttctcagtacccttcctgtcccaattggcttccctgagactccagattgactgcgaacacattcaccaaccacagatggaccgcgaccagtttagagccgctgcgcacgcaacggtagatgacattatcaactattttgacagtgtccccgaccggcgtgtctgccccaccgtcactccaggctaccttcgtcccctcatccccgagcaaccccctacagaaccggaagaatggtcgcaaatccaggccgatgtcgacacn

SEQ ID NO: 5473 - DNA, 1255 bp, Aspergillus oryzae
taaactccccattccatccatttaggacaggccggatacctacgtcgtctaggtttctgccttgctcgtcgcgttctcccgcccttttttcgtatcgaattgctgcgataacggagagccttccccggaaggcccctcataaaaccagacgtcatggcggacgtccggtccaagaacctttacgagcttcttggcaatgatcccgagttagaccccagcagaccccccgctcctcccacaaaagctatcgacaagcccgcaccccgtgtaggcaagcgtgacgcccccaaggaggctcccagccagccccgtgccggccagaactctcgccgtggtaacttctctggcaatgaggccgctttccgtgaccgcaacgctggccgcaaccagaaccgcgagaagcccaccgatgagagggaaggtggtgcccgccgtggcggacgtccccgtggcgaccgtcagtcccgcaccggccagaccgacactggaaagaaggtgaaccaaggctggggtgggccagagcggcgagaaggaattggacgatgagcgcgccggtgagaagatcgcccaggccgacgagaacgagccccagactcccgccgaggaggccgagcctgctgagaaggccaagtcgtataacgactacctcgctgagaaggccgctgccggtgacttcagcgccaagcccgtccgtgccgccaacgagggcaccaaggctgactccaagtgggccaacgccaaggaattcaagcgtgaggaggacgagaactacatcaagggttcctctgaaaaggccaagcgtgagaaggctcgcaaggagaagaacatccttgaggtcgacatgcgctttgttgaggccccccgtggcaacagcggtcctcgtggccgtggcggccgtggcggacgtggtgcccgtggtggccgtggcaacggtccccgtagcgagcgcactgagcgcaccgctcctgtcaccgtggacgagaagaacttccccagccttggcggcaaataaatacagtcagtttcatagcgggggggtattctaccggcacaccttgacaccggtccactgaaaggtcgaaaacgaaaagaatcttgaagaaacccttacgatgcctcttcctggaaagtgacgtgatatggattgcgggaaatgacacgagacgaaacccttcggtcctcgcatttaggtttaaaatggccccgatgtaatttgatttgaatgtcaaaaaataggaaagtgtgaattcaaacc

SEQ ID NO: 5474 - DNA, 569 bp, Aspergillus oryzae
  misc_feature (1)...(569): n = A,T,C or G
gcaggacgatgcgtacgatcatagttgacctaatgtacaagccacatatgagatgccttacttgtaattgaacatatctaaggatgggaatacatatggcctatactattcatgcaccaacaggggcctgcggtcctacaacgaccggagggcctgactcgaacccggcgaagctctccatggtcgaattgatgcaggaaaaggaacgtattgaaaaggaactttcggcgttaagcagtatccttacgtatcacggtgtgaacatgaattcatcgctgacaacattcgacgacttcccacgagccgatattgacgttgcccagatccgcacaatacgcgcgaaaattattcgacttcgctacgaccacaaagaggtcatgaaatatctggaggcaggtattcacgatcattttgcgaatcttcaacgcgcgcaaggtgatacatcttctgtcagtaatacaaatgggtctagtggaacacaatccaanttgactgggcatccttcgtcggatgccgcgatgcttgggccaccattcgcaagagtaacagtgtcgcaaccgcaagtcctg

SEQ ID NO: 5475 - DNA, 675 bp, Aspergillus oryzae
gtccatcctttgccgctcctttgatggttccctatcgctcaatcgaatgattttaggaatccgtaatccagtatgagactcatatgctcgttacctgtggtcctccctctattctcgacagcgctggcagatgtcgagttcatagcgccagcgcgtggcacaataatgaaggccggggatgtagtaacagcacactggaaggactctggcgagtctcctcgcatttccgaacttgtacagtacgacctttatctttgtgctggcggagacacattagggtcccaggagaacctggctatccttatcaaagatggtgtctttgcccgcggcaactctgtttctttcaagattgatccagcagttggcggcaacgaaccaaacgcatacttcctgaaaatggttgcatctggtcccgacgcccatgtaatcaatttctccgatcgtttcacgctcacagacatggctggcgctttctcgtcgaatttggaggatggcattggtttgcttagcgaaggccatgggcaacaggaactgcgtagaaggcaagctgctggagcttatactatcccataccaattgcagaccgggcctacaagatatgcgcctatggctaaaaagcctgggtcgacaattccagcggattagtcgccaacttcccaatttccgactagcgca

SEQ ID NO: 5476 - DNA, 690 bp, Aspergillus oryzae
  misc_feature (1)...(690): n = A,T,C or G
cttgtctcattcgcagcactacgtggatgctgtccccaatacatcttctatctcgccggacttgccttcgttcaattgccactgcgattgatcaacctcggttcccggttttcctccagcaacagtcactctccactccattttcgtcgtctctagtctactcaaaggctttaaagttccccagaccaacctcaactcgactcatttcttgttcattttcacgtctatatacaacatctgtgaacgaccttgccaaaatgagttcccttaccccctaccagcgcaaacacaaggtcacggtgatcggctcaggaaactggggcaccgctattgccaagattgtcgctgaaaataccgctagcaaccctgccatcttcgaaaaggatgttcaaatgtgggtttttgaagagaacgtggaagttccaaagacctcccctcactataacccatcttcgcccttatgccagggtccccagaagttaacagagataatcaataagacacatgagaatgtcaagtatttgccaggaatcaaccttcctacaaatttgcacgccaatccctcattggaggactccgttaaggacagcactatccttgttttcatttgcctcatcaattcattatcaagacttgtgagcagatcaaggcaagattctgccatatgcgcgtggtatttcttgcatcang

SEQ ID NO: 5477 - DNA, 387 bp, Aspergillus oryzae
gggaaagggcacaggtattactgtcatctcgattgtctcaggaaataagatccgaaaaacgaaagcctaccatggaagaggagagcgagatacttgaaaaacttatcctctcccgacgctcaagcgcttctgtccgtgctgacgagcagtcctgggaatctggcgcctccggattgggaccaagcgggccaccgtgtgttatctgccagacaaacccacgttcagtcattacttggccatgccgatgcctctgcgtttgcgaagagtgtagggtgagccttgcaatgaacaattttggtagttgtgtgacttgccgccaggacgttgggggattcgtgcggctgtgggtaccatagaattcctttcttccaattcaattccactact

SEQ ID NO: 5478 - DNA, 647 bp, Aspergillus oryzae
ttcttccataccattctaaagcttgactgaggagctaaccatcacaccatcagagtctgccttcacagcataattcccccaattgcccaaccgttctgacaacaaacggaccaacaagaccctgaaccaggtcgaacaatttgtctaagaagaatgtattctcgacgaaatggtcttccacgcctcactgagcgaaggcgatcagcgatgggccacctacccatgcgttatggaatcccttatgaccaatgccctccagcgaggcctgtggaacatgatactgtccagaaaccacttctaccatggcgcaggattcatcgacctccaatactgtctgatggccgattatctggtaaagagagagttggactctgaggctacgaataatgtttgccgcgaactggaaacattggattgcttgacaagtactgttcaaatcacagaagcagcattgctggcgcccttgcttgaacggaaaatgcgctccgtctttcttatgaccgagcccgatggtgccttcagagattcgaccaacatcctagtgaacatacggcgtgaaagccacccacacgtgctctatggattcaaattgcgcgatatccagcgcaagctaatcccccttgaacttctaacttgaaattggccaa

SEQ ID NO: 5479 - DNA, 677 bp, Aspergillus oryzae
  misc_feature (1)...(677): n = A,T,C or G
cttaccaagagaagatccagactgagctgcagagagctcaagaagttgctgaacagcgtcttcagaatgaattggttgaacaagccattgtactcaatcgcatgtacctccacaacgtgactgatcttgttgagcgagagcgtgagggccgtcttagcaagcttaacgaactgaccgccaacgttagcgagctggaaaagcttactagcagttggaaggacgtgatcgatactaacctgaagacccagcaacttcaagtcgctgtggatgcagtccgctccgtccttgagcgctcttcgacccctcgtccatttgttcgggagcttgttgctgtgaaggaactggctgccgatgaccctgtggttgaggctgcgattgcatctatcaaccctacagcataccagcgtggcattccctcgaagtctcagatcattgaacgtttccgccgcgtcgctgatgaggttcgcaaggcaagccttctgcctgaggatgcgggcattgctagccacgctgccagcctcgtcttgagcaaggtcatgttcaagaaggaccctgtcgcccacagcgatgatgttgagagtgttcttgttcgcactgaaagcctcctggannaagggcgaccttgatgccgctgcacgtgagatgaacagtctgaaggggtgggcaaagattttgag

SEQ ID NO: 5480 - DNA, 1209 bp, Aspergillus oryzae
gtacttcgaaatttataaagctaccagctggtctgtggttatcgctgccgtcatacccctctcttccacagcggaacacatcttccggcttctaacgatactaacgacaccagccgtgcgatcgtactgatatattacactctctgccaatatggtcgctaacgctttggcttatcatcctaccttggcgcactacttgcgctttgttgcaacgactgtgggtcgtgacaagatcctccgtacgctgcaatacttctcacgcttttatgcctggtacctgtatcgcacaaaccgcccgcagtcctctatcgacccctacaatgcagtcaagaagcagtttggaacaacaagaaagatcctgaggatcggaaagtttgccgagcacctcaaggctgcagccgttgcagctgacaacaagagccccgtcgaccctgttctccgctatctagctgtcggtcgccagctcggttacgccggatatctgactctggatactatcaccgttattgacgttatcgggttccggaaacttgctgcagccaagcgcttggcaggataccgcctatcggtcgtggttggctggactaatctgcagcgctattgctagtgtatactccctttggagactgcgggagaaggagaggactctcgaccgcaccgaaggcgaaggcgtcgtgtaggcaaagaagctcgagaaggaacgctccgctgcccgcatccagctcttctcggacctttgtgacttgaccattcctgtgtccggcctgggccttgccaatcttgacgacggaattgttggtattggaggtacaatcagcagtttgctaggcgtggtgtctcaatggcggaagaccgcgtgagcggccaaagctagagaatcctctgattgagatttcacaaggctgacttaaggtgggattggtttatatattgatatctgcgtcgatcgtgcgtcgtgcatttcttacacttcgtcaaacctcagcctcagaacaagagatatggtgtatagatccaaatggatcaaagacgaaatgaggatcgagatataggcgaacttttgtgtggcaggattcgccaaagcagatgcgatatagtagtcttcggttttcatgaacatattatgtaccttaagagtgtattatatttgttttacctatttttctaaaaaaaacaaaaaagaataattcctgcggccgcgaattcttc

SEQ ID NO: 5481 - DNA, 651 bp, Aspergillus oryzae
ccgcccattgcaagacacgtcaggatggtgtacggcctatcggtgaatttacagctcacatgctcacctgcacaagctctgctgcctcttgagtaaacatgggtctggtggcagacatccacctggacggcgctcctggcgagcgcccagatgtcagcccatgtatagaagaccttccagtcccgggtcccgacgccaacggactggatgaagttgatgaattcaaagaccgaaagatgtctttctacgatgatagaggcgccgcgcctgcgacacagttcagcttctttacatcgcagctggattctgtcatccattcgtccaccatccagtccttgcggtcgttctataagccctttgacacgctgctggacaccacagaacattctgggctatggtggctcgatgtaaccgctccctcggatgatgacatcgagacactctcgcggatcttcgacatccatccgctgactaccgaggatataaaaatgcgagagtcgcgaaagagatcgaattgttcgcccgtattactttttttcttgcaccggcccgcaagtcaggcggttgatgcactcgttctcgctccgacgtgtccctatcgtttccggaaggtgtttaacttaatttcggaacagcccaaggggtcttgtc

SEQ ID NO: 5482 - DNA, 669 bp, Aspergillus oryzae
caagatctctggaggcatgatctagctgcaacaccatcggtagaagttatattaccacaagaccttgctcgctaccagaatgccatccaaaagtgagattacagagtttcaaatgccgggcgctgtcgaaatcatctcaacccggccgcaaaagttgattgagatcgtggagccggacccaacatggccggagtcgtttgcgattattgcacgccggattgccgatgcccttggtaatcgacttctctcaatcgagcacgttgggtcaaccagtgtaccagggttaccagccaaagcggtcatcgatgttgacgtactcgtagctgaccccacggcggaagactcctacgtgccagcccttgaggctgcgggttttcagttcttgcttcgcgagcctggctggtatgagcatcgcctcttcggtttcaacgaaccatacgcgaatatccatgtatttggtccgaacagcgcggaacacgttcgtcatcgactgttccgtgactggttgcgcaaccatgaggacgatcgccaaaggtatgtcgataccaaacggcaagccgctgccgctaatcgattggcgggggaaaccgtgaacgaagtattccacccgaagcaatctgtgatccatgaaaatcctccagaaaagcttcaaaggagcacgggtaccct

SEQ ID NO: 5483 - DNA, 646 bp, Aspergillus oryzae
cgttgcagcttgagcacttgatgcaagcgaccaaacttcttcagttaaaaaaggctacactaaatgacattgagattattcaggacatctgttggatgctctccccgaatcagattcagaagctcctgaatcaatacttggtggcggattatgagcaacctattaatggggagatcatgaaagctgtggcctctcgtgtcacggagaagaacgacgtattggttctgacgcctggtgatatggaagataatggtcccgaccaaaatggcgaaccttgtggtatcaccgccctggagacatacacaccggcatgggtgtgaacaccacgaataaaacgcgttggtggaaatgtgttgggttaaggcatgggtcaaccagaaaagcctggaatggccgagaagggaagagatatttcgcacctctctgtaaaccaaggtattggccaattaaaacatgcgcctcttccgagaatatccgcgtaaaaagagagatctttggcccattttctataagatcccgggcaagtgagggagaaatgtgccttctcgtgaaacctgtgaaacaaacaccccatcctattctgtgttttataggggtggggaactatgccccacacctttcttgggaaaaaatttcacatttattg

SEQ ID NO: 5484 - DNA, 663 bp, Aspergillus oryzae
acgtcttgatgaacgccctcaagaaacacggtctagagaggttcgatcccagcgagcctgctgaagacggcaagacccagaagttcgaccccaatatgcacgaggctaccttcatggccaaggctgaaggcaaggagaacggtgatatcatgtacactcagagcaagggcttcaggctgaacggacgtgtcttgagagctgccaaggtcggcgttgtcaagaacgactaaatcaatcacccatacacgcacctcgacttcaatctcccctagacgcaactttgccatctctcttattctacctgtataatataccagaaataccttccatcatgacgaggaataaccgattacggtaatcccaaccgtgataccacgtcttttctctatgaatgcatgtgtatgatacacccgctattttgtttgcatacgatcggaaggcttacggtctgccctcctttcgtggttcttttgttttcgtttttttttttttttttttttcgtgttcatgtcaggcgtttgaaactcacctctcacctttcactatatcacattatacctgtataatacatgcaatgatccggtcttgtcatcctacaaaaaacggtggtctaattggcaatttcttggatatgagctacttgcacggcattggatcctgagt

SEQ ID NO: 5485 - DNA, 654 bp, Aspergillus oryzae
  misc_feature (1)...(654): n = A,T,C or G
ctgattcaacgatcagagtcattacctataacatatcaactggatagattaagcaaatctcccagaatcgggctttatataaatccacagtagttatacacctcttatcttcatcttcaccaacaccacccgcaacagcaatcacaaccatggtcggacaacacgaagctgccattctcccccagaagggcggtcccttgtctcttggaaagcgtcccacccccgagcccggtccaaatgaggttctcattgaagtaaaggccgttgctttgaacccctgcgatcatttccagcgtgactatggcatgcctcctgtgcctatatatcccgctatcatcggatccgatactgctggtgttgtcgtcaagctgggctcggatgtcaccacgatccctggtccaggaagccgagtcatcgcctttgcctcatcattctaccagaacggctcncccgaccacggtgctttccaaaagtacactttggcacaatccgaagctgtcatcccacttccagacaatctttcctttgaggaaggcgcagtcttccccatggccgtcttgactgccttaactgcctgggacacaatcggcattccgctcgacnacaagtatactcccgcggacanacaagcggtcctgatctggggcgcatcgg

SEQ ID NO: 5486 - DNA, 670 bp, Aspergillus oryzae
gaccttgcagatgacacgcaagatgtcgcccgggcaacggcagaggctacagttgggagcaacctccagaccaacggcattcaagccgtggtgcagtacgattatgaaagagcggaagacaatgagattgagctcagggaaggtgaatatgtgacggagattgaaatggttgacaaggactggtggttgggttcaaacgctcgtggtgagaggggtctcttcccgagtaactatgttgagctactggaagacaagccgcagaattttacctcgccggacttgcatgagcacaatttggacacaaacattcaagagccttatgcggaaaatagtgcgccttttagcttgagctcaccttatgaaccactgctacaccgttggatgattattaaacccccgaaaacacgaacctaatttttcggaaggaactgaaaacacttcttttgaaattccccaacaagaactgggggtttgggaaaaatccaaaataaaaagggtcttttccaacacaatattgttaaaactttaaaagggagtcccaaggggggttttttcaaaaaaaaagggttttaaggggctagaaaaattaaacgcgttcgggtttttattatttgggggggccaatttttttgggtaaaccctttggggttttgggtgagacataaacttg

SEQ ID NO: 5487 - DNA, 764 bp, Aspergillus oryzae
  misc_feature (1)...(764): n = A,T,C or G
gggatgatacgcggtccgaattcggcacgaggattcgattcttcatcctcccgtttgccctatcatcctggcagcaaatagcataaatcacccttcactgctcacctctcttgacctgtccatcattcttcgagcaacagatccagttttactcaaaccatcttcaatccaaactacttcgagcaaaacgcctcaagatgtataaccagtggatcggattcaatattgtcaataactctgggagttttatcaagatcagcaatgcttatctgagtgttggtaaattctatcggtgggatgacaaagacaacgaaatatcttccgattctgtcatcaatacccgaaacctacctggcgtgcaggacctgtccttcggctcttgtggcaggtcggacgcgccagttggtaccgagggtgaaatatctttcgaagctgatggcaaggtcgtggcgaaggtagtatgggactgtccagcgccggctgggtcatggaatatagtgaagagcttttctgaggctgatgggtttggtataagtcataatggcgacggttctactggtgcaattggacttgtcactttcgaaatcagcaatacctagtcattctctttgtccattggtagtctggtgatgggggctgggaaaggaagagctaagctgggtgatctctgctatgtatacccttatgagtatctntcaataaaaatcttcagttgttgaggattnnnnnnnnnnnnnnnnnnnnnnnnaaaaattctgcggccc

SEQ ID NO: 5488 - DNA, 647 bp, Aspergillus oryzae
ggatgaagaagaagtcttccaacctgatgacaacgtggaaaccgcgtctctttgtgctgcgtggccgtcgtctgtcgtattattactctgaagacgacaccgaggagcgtggtcttatcgacattacggcccaccgtgtgcttcgcgcggataacgaccctctcattgccctgcatgcgaccctaactggttccacagcctctccaacttcgccgtctgggtctactgccgatggcccttcatctgataaagcctcgggctcggaatcctctctccgtgggtccaagcccgtgggagaaggcccgtttttcttcaaacttgtaccaccgaaatcgggcacttctcggacggtgcagttcacgaagcctgctatccattatttccaggtagacagtattcaagaaggtcgcttgtggatggcagcgttgatgaaggctaccattgaacgggatatggaactccccgtggagactaccaataaacagaagactgttagtcttaaagaagcccgtctaatgaaccagcggcctcccgcgctgctgccgacaacttccgccactcaaggaacagaggagaaagacgaacatttgacgaccaccacagaggagagcggcttgatgattcagggtcttcgggatgagcaagtg

SEQ ID NO: 5489 - DNA, 693 bp, Aspergillus oryzae
  misc_feature (1)...(693): n = A,T,C or G
cccaaccaaaccatggaaggccaaacagttcgcgatgtctgggatggctacatcgcgaccatgggtagcggcagtgacttcaccgctttccaggactttgcgggtgtggccagccttgacctgggcttcggccgtggccccaaggaccccgtgtaccactaccactccaactatgacagcttcgactggatggatcgatttggtgaccctggttggctctatcatgaagcctgcaccaagctctggtctctagctgctgccaagctggtcgaggcccctgtgctgtcatttagtgcgtctgactatagtactggtctcggtcaatatttggagaagatcaagcccggtgcaaagaaattgcgtggcggcgaattcgactttgggtctctggacagagcagtcgccgagttccaggctacggctaagaaatttgacgcctatgccgctgacttgacttctcagttgggtgaagatcttccttggtatctgtggtggaagaggtgagactctactttcagatccgtgtggtcaacgaacagtacaaggcccttgaacggncattcttgtatgagcccggactcgatgggncgcantggntcaaacatgtggtgtttgcgccttgtctgtggacccgaatactcggtgcgacgtacccttgcttggtggaaagttttgatgccgtgaatcaacaat

SEQ ID NO: 5490 - DNA, 681 bp, Aspergillus oryzae
  misc_feature (1)...(681): n = A,T,C or G
ccgtctcccttggtttccatacaaacgagcgtcattttatggcctctcgcttgggtcactggtgaatctgcagagcatcttgcatatcccagccaaacccttcaatcactaatcgatatgtcgaacgtgtcgttatcagcgagcacgctgtccctttatatacaggctattcccaaagtcttggccaatctcatttgtgatggggacgaaacctgggactcgttaaagaacagtgaaatgtcccttcttttagctcgaatcatcgaattccttgatgttttggctgcccacccagacttggacgtgcaagaaagggcaatcgaatttctggaggtcatgcgcttagcagcagatgccgttcagtcagaaactctagaagtaggccaggctccatccttgctgtcgtctatggttcccagctttttccatggactagaactcaatccagtcgctaccaacgcccaaaagaaggttcctttgccagatcaactttgtctaacacaagagttcaacaagcatatatatgggctttttaataacccagccaatgggcttncggagccagccggccaactaccatctnagatgttntatcacgttanggaagtttctgtgctagataagcagcctggtgaattcctacccgtggatttgaattaaaatccacataccanngacctt

SEQ ID NO: 5491 - DNA, 674 bp, Aspergillus oryzae
  misc_feature (1)...(674): n = A,T,C or G
ggtgccatgtcctcaatgctgatgctcgagatgccccacgtaaatattctgactaagatggaccaggtccgggacatggtgactcgcaaagaattaaagagattcaccaatgtggacgtgcaattgctgcaggatgatgacgctgatgcgatgggagacccgtcgtccaaagagacattgctcagcggtggctcatttaaacagctcaaccgggccgtcggtcaacttatcgacgacttcagcatggtctcatttctgaaattagatgtgcaggacgaggacagtgtcgccgctgttctaagccatatcgacgatgccactcaattccatgaagcgcaagaaccgcgcgaacccaacgatgagcaggaggttaattacgaggatgcagacatatgatcgaccataaatatgaagaacttaattgccaaattaaccttgttcgaacatatcatctgggacctaccggcggctacaagacggaaccatctcatccttccaacttgttatcatccgaccgccagaggcaccagaaggtcactgacacgctttgatcccgtggcagggatttgcccgcttatccgggtcagagcccataattagcatcagagcgcgggcgagncatcaatgcaaaccccaacattgggcgcttgctccctcatacaggcgcagaaatg

SEQ ID NO: 5492 - DNA, 691 bp, Aspergillus oryzae
ccaatcctgcggcagctgggctgcttaaggtctatcgcgaagccccagtcattggtgtcgtcccaaatcgctcgccgatctctcacgactgtgtacactccgaaacaagagcccgtacctcttccgagcaaattgcccaagtcgttcctttctcaaatacctcctcgccagcagcctaccaatggccgcaagaagctcaaagtctacccggctccgccttcaagccgcacggtttgcaaagaccccgtggcagcagtgacagaatctcaattgacagcccttgatcccactggtgaacgcaaagcacttttcgactacagaagaaacccacgtagcgtgaaggtcggcgatattttgcgcgtgacctttaagaacggtgacccattctccggcgtttgtcttagcattcgtctgcgcggcattgacactacgttcctgcttcgtaatgagctcactagagtcggtgttgagatgtgggtgaaggttttcagtcccaacgttgaaagcgtggaaatcgtacagaggacagagaagaggaagagaagagccaggttgtactacatgagacaacccagacacgatatgcgcagcgttgagaacatcgtctcgaactacctccgacagaagtctgctctttctggccagagaggacagggaggacgcggtcgtggacagaaacggcgtcgttaaa

SEQ ID NO: 5493 - DNA, 1509 bp, Aspergillus oryzae
aagtacgactctatccgaattcggcacgaggctcattctcctgttgttaacatgcaccgggatcggtctcctttccgacagaactcgcccctggctgctgagtacaacaatgggttccagcagccccagatggcgaccagtgtgcctatgactcaaaatgtaggccaaagtcaaggagaaggagaaccgaagactatgtctcctaaggatgccctgttggacttcaacgagggagatgacgccgggattcctttgttcccaacaagtcaacctgacttcaaccttggtgaagcactcggcctccgacgtgaaagctcatcatccttcccgcagtcgcagaactttacttccatggagtcattccccacgcaatacactacaccgaatggacttccccagcagtatcccttcgcgcagcagcaacaagaccatcagcagcaacaacagaacaacctcctgcaccagacccccgaattccctgcatcccttcctcactttgagtctacgaacagtgatgccggggtcaacaacggtgtggcttctccaccggcacagcccacaatggcgatgcgcccagtgaaggaagagatcacccgccctgagcgcacttctgcggacagtggcacttacacttgcacttaccacggctgcacgcttcggtttgaaacgcctacgaagctgcagaagcacaagcgcgaggcccaccgtcagactacgcctggcggccacttggttgggcgcgatacttccgcacgcaactctcaggccggtccccacaaatgtgagcggatcaatccgtctacgggaaagccatgcaattctgttttctcccggccttacgatcttacccggcacgaggacacgatccacaacgcacgcaagcagaaggtccggtgtcatctgtgcacggaagaaaagaccttttcgcgtaatgatgcgctgacccggcacatgcgagtggtgcaccctgaggtcgattggcccggcaagcaaagaaggagaggcagggagtaagcctgaatggggttgtggtgtcaggcgggcatacctcccattcgacttctacatccaacatggctacgaatacgcaattggaacacgacaaatgggaagatccattttggggaggtccctttcggagctccctctgggttccaccgtttccatgcccccattgagtcaagatgacgccggaaagcctctgacgtcattattatacctgaaagggaaaggactcgctaccggggccggatcgtcggtctgacttccgtttcgggagtattggccttgtggccttgcagcctggtgcagcactcatgacatcatcttcgatgtccattcctcaatgacgtcactgttcaacagatcggattctgttgatgttatcggtcactttctttttctttttcttttctttcgcgaatagatggcctcttgtgatgacgcatgtgaattctttttcttttcgtttctctttcctacggtaccatacaggtgtggtgtttctaa

SEQ ID NO: 5494 - DNA, 661 bp, Aspergillus oryzae
  misc_feature (1)...(661): n = A,T,C or G
ccggccagatgaccggcgcccttgttatctactcgggtaccttcatgcgctatgccctcgccgtctcccccaagaactacctcctcttcgcttgtcacgccattaacttctccgcccaatgtactcaaggataccgctaccttaactactggaactggggaggccgtgaagctaagctcgccgctgaagccgctgggaagggctcgcaggcccccgaggccggcgcataaacgatccgaaccttgtcctacctgccgcgtggccgacaaacaaggatgcccgttttcaatcagtagtagatttagacctcacaagagacaagacgcctatggatggcgatttgtggaatacagatcggttcggatgcaagaggctggcctcatttaactctggttttcttgggtagaagaacggattgcgtgcggcttgggccgactagtggatagttggccttcacctgattatttttatggactggcattggcaaaggggccttgaggctactggttttggttctagcatgttttcgtggcattgggttgtgggatagtgcaacttgcatggcgangaatcaggtctccttttggctctgctgtctttactgttttgtataatacaaattcggtgaaatctaaatggattgaaaggggaaaaaaaaaaa

SEQ ID NO: 5495 - DNA, 552 bp, Aspergillus oryzae
  misc_feature (1)...(552): n = A,T,C or G
cgagggcttctcagccgcctcaatgctagggatgtcttggccccccaggcctatgttgagatgtgtgctctgcgtaagcaagctcacttgaagaagaacttcaagccctccggtaacacggagacgcttttccccaacacctactacctcactgaggtggacgacatgttccgccgcaagtacgaggtcaaggcatgaataatggctagcgcttgatgttaatttggacatgatgagtttctttttcttccttgtttagacgattcattagattcccctcaggaccgcattgtcgtgtttggttgccttgatagagctcgcaaactgggttatgtctgcaaattgtctcggtcgattttatttactttgtctgcctgccctangttctcaggaggagcccagaaggaaaatattttcttgtttttaggagctggcatgatgctgatgttcctttccgcccaagatggcgctgaaatgcttccggatttatgagaagatcttatttattaattaaacatattaatcaatttatttcacatatggttcactact

SEQ ID NO: 5496 - DNA, 783 bp, Aspergillus oryzae
gtggattaccttcttccatctcagaagatatcaatcacttccatacttctacctccacactcctcaaaaaaccatctacattctatacacaactccttcaaaatgcagttgactcttctcaccaccctgctcgtcgccacctccgccctggctgctccccagatcgacaacctcgtctcccaggcggaaggtatcgcccagaccgctgtgaacggcggccagagcatcgcctccgacattgccagcgctgccacctccatcgcttccgccgctgagaccggtgtccccggcgctgcctcatccatcacctctgccgcgggcgccgccgcctccagcgcagagagctggggctcctccgtcgcttccgacgcccagagcagggcctcctccatcgcatccgaggccagctccaagctgagcgacagcctgaccaccctgaccggcaccaacggccagcccacttccaccggcctcgtctctaccacctccgccagcggaaccgagaccaccactgccacaagcacctccaccaccggtacttcttcttcctcttcctcttcctcctcagctggcagtgcctcctccaccagcagcgacggtgcaggtgccatgcccactcctttcagcttcggtgccggtgtgcgccggtgtcgccggtgtcctgggtgtcatggctgctctgtaaacgaaccacgaataacatgctagaaccgtcgctatttttggtacgaaatactatgttacactataccatgattgaagcgggaaaatatatgcattggg

SEQ ID NO: 5497 - DNA, 1545 bp, Aspergillus oryzae
  misc_feature (1)...(1545): n = A,T,C or G
cgcgatcatgccgacctaatccgtcgcatcggcgcgcagagcactgttctgctgaagaacaagggtgccttgcccttgagccgcaaggaaaagctggtcgcccttctgggagaggatgcgggttccaactcgtggggcgctaacggctgtgatgaccgtggttgcgataacggtacccttgccatggcctgnggtagcggtactgcgaatttcccatacctcgtgacaccagagcaggcgattcagaacgaagttcttcagggccgtggtaatgtcttcgccgtgaccgacagttgggcgctcgacaagatcgctgcggctgcccgccaggccagcgtatctctcgtgttcgtcaactccgactcaggagaaggctatcttantgtggatggaaatgagggcgatcgtaacaacatcactctgtggaagaacggcgacaatgtggtcaagaccgcagcgaataactgtaacaacaccgttgtcatcatccactccgtcggaccagttttgatcgatgattggtatgaccaccccaatgtcactggtattctctgggctggtctgccaggccaggagtctggtaactccattgccgatgtgctgtacggtcgtgtcaaccctggcgccaagtctcctttcacttggggcaagacccgggagtcgtatggttctcccttggtcaaggatgccaacaatggcaacggagcgccccagtctgatttcacccagggtgttttcatcgattaccgccatttcgataagttcaatgagacccctatctacgagtttggctacggcttgagctacaccaccttcgagctctccgacctccatgttcagcccctgaacgcgtcccgatacactcccaccagtggcatgactgaagctgcaaagaactttggtgaaattggcgatgcgtcggagtacgtgtatccggaggggctggaaaggatccatgagtttatctatccctggatcaactctaccgacctgaaggcatcgtctgacgattctaactacggctgggaagactccaagtatattcccgaaggcgccacggatgggtctgcccagccccgtttgcccgctagtggtggtgccggaggaaaccccggtctgtacgaggatcttttccgcgtctctgtgaaggtcaagaacacgggcaatgtcgccggtgatgaagttcctcagctgtacgtttccctacgcggcccgaatgagcccaaggtggtactgcgcaagtttgagcgtattcacttggccccttcgcaggaggccgtgtggacaacgacccttacccgtcgtgaccttgcaaactgggacgtttcggctcacgactggaccgtcactccttaccccaagacgatctacgttggaaactcctcacggaaactgccgctccaggcctagctgcctaaagcccagtaaggagcaagtctgattgtacagagcatttcgagatttatgatgtacatgtttatgaatgacctanggtagggtaatacttagtanggttagttctaattcttggagtcaagtattgac

SEQ ID NO: 5498 - DNA, 726 bp, Aspergillus oryzae
ccggttcggcctaccagccccgggactatcaaccatgcccgggacctcggatcagacctcggtacgaggaggattcaccgcggcccccggccatggatcacagtcgtttttatcacataccttttcccacactcagttgagttcaccatcgacaacaccataatttatacatctgctgtgtaaccatgggcaaacacaacccccaagctacgcaaagagctccgactctcaacgaagccctagacttcatcgaacaaacctataaagaatcgaagttgatcatcgtcggctgtctagcatcctggacactctgtcgactgaacttccgtttcgtttggctactcatcatcctagccttctgccgcacgcactaccaagtatccgttcgacggatcgagcgcgccatccgagacgaactccgtcgataccactcacaataggtcctacagcgtggtgaaagcgtaaaatgggtaaacgaagtcctcgggcgagcatggcacctctaccaacgccagatctgtaaaacgatcgttcaatacgtcaacgccgggatgggccaacgcagcgaagattcatcccctcagaaactggtcaatcaatccctggctgttgtggcacaaccgctccgattttaaaaaatgaagggccattcaaacctcaatcgggcaatttgaacctctcaggagaattctggtttccaactcccggccaacgggcgaaccaatg

SEQ ID NO: 5499 - DNA, 813 bp, Aspergillus oryzae
  misc_feature (1)...(813): n = A,T,C or G
cttctcatttgtcatacaggattgataatattctacgtttttcatatacaattaatattctttacacatttatatacatccggcagtaactatggcgagtgttcagcaagacaagcctgcagttgtctgtgtattctgcggctcagtctccggtaacaactccgttcacctggaaacagctagagctcttgcacatgagtttcacaggaacaatatccaacttgtttatggcggtggcacagcgggcctcatgggcgaattggctcgcaccctcgtttccctttctggaccccaagcagtgcacgggattatccctcgcgccctggtcaaagtcgagcccggctatgacaacgcacaagaggagaggaacccttctacagttgtaagcgggaaagaagccgagcgggtcgtcaaggagcccatgggtaagatcgggacgcttaaagagtcagagtacgggtataccaccatcgtcccagatatgcacacgcgcaagcgtatgatggccgagaaggtccgagagggcggcccgngtcgggctttgttggcgctgcngncggtttcgaacgatcgnagaggtcatggaaatgactacctggaatcagtttggaatccataagcttggcatggngttgctaantgccaattggtactggngattgtgtgtaacgttgttgaagaactcagtccaagaaggctttgcagtcctgagaacgtgagatcttggtgangccaagatgcaganaggttggcccaactgntntgttcaagattaacatggaggatgcattgacctgtgaaaagagtaccttt

SEQ ID NO: 5500 - DNA, 649 bp, Aspergillus oryzae
cacacatcctgacaaaatggctcccaaggttctcgttgtcctgacctcccaggctcaaattcctgaccgcgaccacgccacaggatggtacctgcccgagttcgcccacccgtgggaggtcctccatgagaaggtcgagctcaccatcgcctctccgaagggtggtgaggctcccctcgacccctcttctgtcgaggcgttcaagagcgatcccgtgtcctcgaaatttctgaaggagcaggagtcgctttggaagaacacccacaagctggctgatttcctgcctcgcgtttcggagttcgatgccattttctacgttggtggccatggacctatgtttgacctccactacgacgagacctccctctcactgatccaggctttcgctgccgccggaaagcccgtctccgccgtctgccacggcccgaccgtgttcatcaaggcgaccaccaagtccggacagcccttgctcgccaactccaccgttaccgccttcaccaacgtcgaggaagaccaggcacaattgaccgcgctcatgccatacttggtcgaggatgagttgaacaagatccccggatgtaaatttgtcaaagccgaatcaccctggggcgagaaagttgttgtgtctaatacctccgacggcggctct

SEQ ID NO: 5501 - DNA, 1081 bp, Aspergillus oryzae
gataagggggtgtatatacatatatataagcagttgttccccgctctatctttcagatccagtgacggttgcacaactacagaaatctcctcaagatatactgccttggatataaatatacaccccagagactctggtactttttcgctgtattcaatctcctagctggcctctttctccgaccgctcacatcatggcgcctcgtggccgtgggaagttttccaagccttcgcgaggaggtgggaaacactttagtcgcgatgttcaaccagtcgacaagcacggtaatcccgccgggctatggagagaaccagacgatgatgcccgagcttcctcacaggaggaggggcaggagaagtgagaggaggaagtgtccgaatcagaagaggatcttcaaagtagacgctaacctggatctagctttcccgcagcgcagagatgactcgtgaggagcgcgggcagcagccaagccaagaagcaagttgctatagcgaaacggattcaagttcagcctggcgatctaccaccgtctgattcggagtcagaagttagcggggttagtgagggagatgaagagctgccctcaaatccgaatcacacggccaagtctcgctcgcaactgaaggattcaaacccggacaaagacatgtcacagttgtcgaggagagagcgcgaagccattgaggctcagcaggagcgtgaacgttatctgaagctgcacgcggagggtaaaacagaggaggcccgtgcagatctggctcgtctggctatcattcgggagcgacgagaggcagaaaggttacggaaggaggccgagaaagaagagaaggcagagctagccaagcaacgggctgcagagatagaggcaaagctgaacgcgaagaagaaaggtggttcaaagaaaaagtaaatgaaacagaccgcctgccttagcttggacactgagactttgatgggaggtatgggatggttttattcaaagctagttaagaacttggtttgggtataacactaaccggtcagtaacgataatatatggactgtacacagaatacccaaatagattgttcattttagaacg

SEQ ID NO: 5502 - DNA, 629 bp, Aspergillus oryzae
  misc_feature (1)...(629): n = A,T,C or G
ggcccttctattcccctatattcgaatgaatttctccatctctatgaccaagacaaccatcatgtcgacacagatagtaatctgtttgttaatcttgaacttgccacgcatttagcgacatgggtaaacgagccgggcgcacttgctcgcgcttctaatgggcgctctgcgcaggatgttttcacctggtcgggcggggcgctggacaggtcccattggccatctctcgcaacagagaccatcagagatgcgaacgttgacattgacgggattcacccaacctggaagatcctcaagacacgggatcccgtcagaaaggacgaaattgtaggagagatcactggcaaaattggaccgctctggaaatactgcgttgaagccagtaaccgctggcaagagcttcgtcatccagaacctttcgttttcttccaccctcaactgcctctgtatatcgatagtcgccatgagggaaacatactccgctatgcgcgacggtcctgtcgtcccaatgtcaccatcagaaccttcatcaccaatgaagtggagtaccacttttgctttgntgctaaagaagacatancggccgattcagagattaccgccatgtggtatctagacccacaactgtt

SEQ ID NO: 5503 - DNA, 675 bp, Aspergillus oryzae
  misc_feature (1)...(675): n = A,T,C or G
gtcgcaatacccagactactacatgatcatccagagtccgattgctatggaaaagatccgaaagaagattaaccgtgacgaataccaaaacttgaaggacttcaggaatgatatccatctcctctgtcaaaatgctcgaacctataatgaagatggcagcatcctgttccaagatgcgaatgatattgaggcaaaatgcctgagtgaactgaagagagagaccgagggctacccgcaatttgccaactatgacgaccagggagcgcctgttggtcaagatcagtctctcgcggcaacccccagcgtcgagactcctagcactgtcaccacccccggccaaccgaaactaaagcttacattcaacagtggtaatcgggacagtacaggagccgccaacggaaccccacagactggaataactgaggagtaatctttgcataaaccttcgtcctggcttgcttgactctgttcattaagtacaggggagagacatttccccctcacaacgcattttgctattttgatcttttcttgacatgtacccatccggctntggaccggcgtatgtgactnggtgatggatgatggttgatggcgcatgctctgctctactgaagacgagcgattgatttcatttatgggtntcttttcggttattcttcacatttaaccccc

SEQ ID NO: 5504 - DNA, 752 bp, Aspergillus oryzae
  misc_feature (1)...(752): n = A,T,C or G
agcgccattcgacgagnncntcatggngnnggacccactgagatagtctctacctgtccggatctaatttcgatcaatatatccatcaatctcacaccaacaagctctagactacagcaatcctatatacaccaaatctcatgctacaaatcctctaaaacctcacatacaatcaacaagttcacaatcctccatcgacaaaacaagctgccccttcaacagatcaaccggcgtcatctcatcatccccattcaaccgatcatccagcctcaaaacacactcacatcttgcttgcatcaacccctgaaggacctcatcctcattatacccaacctccctcgcaatcctaacagccaaccgcatcccaacagtcaacaccaaccccgcaatatcagtcgccgggtatccaacgccggcatccgcccaatccaatatgccagtaattcccccatcagaatccacaagaatatgttcccccttgatatcattatgaatgagcaccttccgagagaccccttcatcgggacgcttaacccgatctatgaacgccgtcttcctctcacccaatccttcgaactcatccccatctgtaaccccaaaatcaccagctaaaatctgcccccgactaaccagtagacgttgtcccaannnnnnnnnnnnnnnnnnnnnnnnnnnnnnnnnnnnnnnnaaaattcctgcggcccgttgagcatgcatttaaaagggccgaatattgtaattaagtttgcccc

SEQ ID NO: 5505 - DNA, 691 bp, Aspergillus oryzae
ttgactacgaatagcctaaaataaggacacagcttcaggcattcttacgtgggatggctctgctttagccccaacagtccgcagcttactgggaaattgccgaggaactcaccggagctattgtccatcacagggcttggcctcggatgctcctggtcagctgtttaccactgtcttggtaatcgcaactccatcagttgctccttaatcaatctccattattgaaaacccaatagaggattattacacgagacgtactcatcgtgtgctttacgaaacgtcataatggatcttctgtccaacgcgcaatgccagcatctggtgtctccagactatataaacttcatcctatcaatcttgatcctattcggtatactgttgtcctatcttcctcagcactaccgaatcatctccctaaggagctcctacggcatctcaccgtattttgtcctattgggaacaatctctggttcatcgtctttagcaaacgtggtatcccaacaacaaagtctgcaggatgtgtcttgttgcagtgatgtcaacggcctggcctgtttcgcaggactgctacgtatcctccagattggaacacagtgcctctgcttctttatcattctattcctatacatcctatatttccctcgcgatgtacagtcgtcgccttcaacctccaagcaaagggggcaaggcc

SEQ ID NO: 5506 - DNA, 667 bp, Aspergillus oryzae
tgcttaatgtttaggatatccttaacgtcccttgggatggccctcctgaggccgagattgacgcatttgtcactgaggaactctacgttcactcgaaggtcatgattgccgacgaccgcgtggttgtgtgcggttctgccaacttgaacgaccgatctcagcttggtgatcacgattctgaaattgctattattatggagacctatacttcttttgaattcaaccttaaccggaagcccttgaccacttacccgtttgcatttaccttactcgctatcttgtcccaaacaactttgttttttaacgccaagaattaaaccccccatacttattttaacccggcgggtgccttaaaaaataaattttacactctttaaaacccgttttgtgcccaccctttgggggattctttatataccttggaaaacaccgggcccacacaaacattgggttttccaaggggtttcctttcatccaaataaagtgttccccacggtgcccattaaaaaaatttttgttttttttaaaagggggaaaaaaacgtttgggaaaaaaagtattccccccctccctttttgtttggacactttggccatatatattcccggggctctctgggtctttaaagagaaagggatcttttaaaagggtaaagccccctctttat

SEQ ID NO: 5507 - DNA, 554 bp, Aspergillus oryzae
ccaaacccaccatctatcaaaattaatctccacgaaagtaaagaaaagaaggacaggaagaaagaacgaaagataaaacccgcaaaatggcccaccgccccgcccaaatctcctcccacctcaattacccccaaggcctcctcgccaatcaagtcgccatcatcactggcgccggccagggcatcggtgccgagactgcgaagttgttcgccaatgaaggcgctaaggtcgtcattgctgatattgatgctgagaaagccacaaacacagcaaacgccatcaatgccgcgagtccgaaccgggccattgctgttacgggagatattctcgatgatgcctatatcgagtcgttggtgaagaaggcggctgagttcgggaatgggaagattcatgttattgttaataatgccgggtttacgtgggatggggtgattcataagattacggataaacaatgggatactatgttggctgttcacaatacggcgccgtttaagctggttcgtgctgcggccaagtacttccgggtgaaagatggggagcctcgcgtgatc

SEQ ID NO: 5508 - DNA, 458 bp, Aspergillus oryzae
  misc_feature (1)...(458): n = A,T,C or G
caaatttcgcatgcggacgtgatcatcctgaataaggctgatctcgtcactccggaggaactcaataaagtccgagaacgagtgcaagccatcaacagtgtcgctaagatccatgtaaccgatcacagtaagacacctcagattgaaggcgttgtgttggatctgcatgcctacgatcatttggctagtctggattttggcgaaaaagggcatagccatattgatccggctatctctacgatcgcaataacaacccctcccatcccatctgaaaagattccgctcgtagatgcctggctccgctccgtcctttgggactcttctcttccacctgcggaatctcaatctgaacctcagtctcatccagctgatttcgatattcaccgcctcaaaggcatattgatcacaaaggatgattccagcagggttattcaggctgtccggnacgtgtttgagat

SEQ ID NO: 5509 - DNA, 693 bp, Aspergillus oryzae
  misc_feature (1)...(693): n = A,T,C or G
cttttttttggtctccgaatctggtatgtggctcgtaaatataaagcatctcaaggtgatgcctctggcttgtacgaggatacagagacctggcggaagtacagtcttttctacgacaactacaaaaaggattactggtggctcttcgtccctgcgatcgtgtacatgtttgtcaagggtgtaatcatcgctgcgggcaatggtcatggcctcgttcagtccgcgggtcaactcattgttgaagctcttatgctagcacttctgctatggtaccggccatatgttgcaaagtcgagccagtggatcaatatcagcatccaggtggtccgtgtattgtccgttgcttgtgtgttgatctttgttgaggagcttggtctttcgcagactaccaagactgtgacgggtattgtccttatcgttgtgcaatccgccctcacaggcatcttggccatcctcattgccgctaacgctatcattctttgtgtccgagaaaacccccatgcgaaacggagatgagaagccaaaaaaatgaaccgtgatatcgatgatttgactcctttggatgcgcgggagtcgcttcttatggagaattcacccccgaaagagtacccagagatgaagcaggttaaattcaccggcccttacgaaccctatcgggaccactacgaattcaaagtacgatcaaagccctcn

SEQ ID NO: 5510 - DNA, 688 bp, Aspergillus oryzae
  misc_feature (1)...(688): n = A,T,C or G
gatcgttatattacgtaaatatgccgaaacaacctgattattacaaggttctaggcgtgtctcctaacgcaacccaaagagaaattcgcaatgcatataaaagagaatccttgaaatcacatcctgaccgtgtacctgccgattctcctgagcggcctacccgaacgcgcaaatttcaggaaatcaatgatgcctattataccctgtcagacgagtcacgtcggagagagtacgacgcaacaaggccagtggaagaagaaaccgaggatgaagtacccctaggtggcaccgggggattttcatggtcttcatttgggtttggcacgagcgaccgtgaacaacgtgcctctgaacagtttggctcggtgtttgaggagatgctacgcgaagagggcctcgctagtgatgatactgacgctgatggccgtcggcggaccaggcctacatctcgcttctggtctattgttggtggaataagtggtggtgcactcggattcattgtcgccaatgctgccggtgctttcgctggtgccagtgcaagaaatcggctcggcgctgttcgtgatgcgaagggcaaaagtgtctacgaggtcttcctagatcttccacaaggtgaccgtgccangttattaagcgaagtggcagccaaagttttccagtccacaggtggacgaatactgcatagtgg

SEQ ID NO: 5511 - DNA, 694 bp, Aspergillus oryzae
ctgccgcttgcaccccccacagtttggaaccccggccctccaatcccctcaattgatacttccacatagtccaagatgggtatctccgactttttctccgacattatctcctccttcagcctccccgaggcccaggctgaggctcccgctgagaacgttgagcagcccagcagccaggagaccgagaccgaggagaagcccgctgtgaccgaagagtcgaatagtgaagagaccgccgaaaagactgaggagtccgctgaggagactcctgaggagcctgccgaggaggagcccgagcaggaggaggaagaagaggaggaagaggaggaggaagaggaggaggagcctgaggacatcaagccccagctcgaggaggaatgtgccaactccgctcagtgcgccccatacaagcaccacttcgatgagtgcgtcgagcgtgtcactcagcagcaggaggacgccgactacaagggccccaaggaggactgcgttgaggagttcttccaccttgcccactgcgcttccgagtgcgccgcccccaagctctggaagtccctcaaataagcgtctcgctccgaaacaattcctgccacgtttctcttatggttcaatggcaacgagtttaacgatggcacatcatgtatggaccatccgaatgagatacgaagggggaactgtggagggaactcacaga

SEQ ID NO: 5512 - DNA, 672 bp, Aspergillus oryzae
ctgtcccctagaccctttttcactacgggtcctaacaagtacgatatccgtttttccaaaaatgagaccgaacttaggaggaaagcctggtataatatgacttctggtaatcggcaatccgtcggcgagctgcttcgtggctttttcgcttactatggaagccgatgcaaaactacacccccaggcgctttcaattggatccaagacgttgtttcgattcgcacgcagggtggcatcctttccaagctggagaaaggttggaacaccgcgaggactgacgaacatggacgtcgactccggttcctcatagcaattgaagaccccctcgaacacaaccataatgtaggcgaaactgtcacagacaaaggcctgtaagctatcagagcagagttctcccgcgctcagatcattatacgtagagtccaggaaatcccaagagtcgggtgggaatggcgaacaaacaatggccatgtaggtcagaatctacttgctgaagcggaagataacttaaaccgacaacaaccctgtggaacccccgaattcccaagattcaagaatgaccaggtgtccaatactcgcggtgtgattctctcaagtgaaaatcatggttaccacaaaacttatttgccccttggcagatgcccaaaaacaaaggacacacgcccagaaatt

SEQ ID NO: 5513 - DNA, 652 bp, Aspergillus oryzae
  misc_feature (1)...(652): n = A,T,C or G
ctgccttgctcaccatggagtctttacaggtagataaccctcagccagaaccacaaaccccaagactcctcctgaaactcatcagcgctggattcgcgtttttcgtagctggcgttaatgatgggagcttgggatcgctgattccgtatattcgagaagcctaccacatagacaccaatatggtggctattgtgtacggcacgaccttttgtggttggttctttgccgctctctctaatagtcatctaagccagtacctggaccttggcgtgttcttggtcatgggtgcgacattacaagtcctagctcatgccctgagaacctggctgcctccattccccctatttgccgtgacatttttctttgccagtcttggccaagcgtaccaggacacgtacgcgaacacgtttgtggcgtcggtaaaagcagcgcatcgatggctcgggtttattcatgcgatgtatatggcangatgtctcgccggacccttcatctccacaggagtagcatcggcaggagcacggtcacgttgggagttattctacacagcgcctttatgactangagtcatcaactttgccctggtggtgttcgcattccgtgagtcgtttgccttcaagcgtcctacacaaggtgaagatgagtccccccc

SEQ ID NO: 5514 - DNA, 739 bp, Aspergillus oryzae
  misc_feature (1)...(739): n = A,T,C or G
gtggtccacccttccgaatcacgccagagttggagctcggcgtatcgggctgggacgctgttctcggcgatggagcttttacgcatgatgaaacagatactcgcatcacccatcagattgtcgatcgtcctgcactgccagagtcttcacttccggctgcgcctgccgcctcagagaatggtgctggcgctgttcaaaaggtcaagcctggcactcgtatcccgggtagaacgtatattcagccccaatggatctgggactgcatcaacgaaggaaagcttcttcgccctgacctgtatgcacctggtgctactcttcccccccatctgagcccatgggtcaagcccacgaggggtgcatatgatcctcgcgctagcctggctgagcaagaagaggagggtgaggctgaaattgcagccgaagaagaggaagaagattctgatgaagagatggaggaggccaccgatggaaagaaggtggacgccaaggctgaagactcggctgaggaggaaaatgaggacgaggatgattctgttgatggaggtatggatgttgctggtacagatgacgatgaggacgagagcgaagaagaaatggaagatgaggttggtggattcgaggaagaagctgcatncgaatcggaggatgaagagaatctgctcgactcaccacaaaaggagcttgaagcgaagctgctggnctccattctnctnctctatgctggcggtgtttcaacaaa

SEQ ID NO: 5515 - DNA, 685 bp, Aspergillus oryzae
cacaatcagcccgaagaaaccttacttgcattcaatttgacctgaacacaatgcttgccaaacacgtccttgctgtccttctgtctgttggcgcttccgccattcctttcgacaagcgagatgcatccgctgtcctcgctgattttaacacactctcaaccgacctgtcggctctcggctctgctatttcgagcttcgatggaacgctcaatggtgccttgggcgtccagcagaaggaaggccaagtagagacggcgttgaagcaaaccgtcagcgatgtgaaagcgtctactgcgttcagtgctgctgacagcacaagcgtgaccaatgctgtgactggtctggagcctagcattgtgaacgttctcaacgatctcgtttccaagaaatccggttttgactctgttggcgttaccagcattgtcgtatcggatctcaactccctccatgatcttactggccagctgtcaactgagctccagtcgaaggtcacttcgggtgacgcatccactatttctgatgaggctgcgcgacttgatgcggaatacaagaaggccatcgctgcctattcctagattagcgtgccatgtaaaccccctatcaaccgatcgacgaaggatgcggagtagggtgatcagagctagaaaaaggacatccaagcaggattaagcctttcttttagcat

SEQ ID NO: 5516 - DNA, 675 bp, Aspergillus oryzae
  misc_feature (1)...(675): n = A,T,C or G
ctaggtggtagagcatctcacggaacgatttggcgggccggcagcgtctgcctatgctactcgcagtggcgggcctgctggagctgtgcccggtggtatgcaggttgtcccttatgttcctcagcccgctggcggtcaatatggtcaccctgataccttcaagcgccaccacccacaccccaaccgggctgctgcgggtgcatatggcgttccttatcttcacggacagcccgctcccgcccctgtagctcagcctgccatgcactatggtggtgcacctcagccgtatgctggcgcgggccctcaccagcctgccccttatggcgccccccaggctgctcccgcacgcggtggtccgactccggtcgcccctgttggcggagctatgcccggtcaaccactgactcagcagatctatatccccaacgacatggtgggtgctattatcggcaagggtggtgctaagatcaacgagatccgtcaccttagtggcagtgtgatcaagatcaacgagccacaggagaacagcaacgagcgtctggtgactatcacaggtacccaagagtgtaaccagatggctttgtatatgctttactcccgacttgaaagcgaanagcaccgtatctaagcggaggaatgagtctacgagcttggcttaatctgtttctttcttcc

SEQ ID NO: 5517 - DNA, 528 bp, Aspergillus oryzae
  misc_feature (1)...(528): n = A,T,C or G
gagttaacgacatacagtccatagatatatacaagacgttggaagtatataaaccagaagaataaaggtttgaatcgtggctagcaatactttctttgaagtatgagtaacaaccatgaggacgcggacggcattccgcggaaagccgaccacctttgtgtcttgatccatggattctggggcaacccctctcatatggaccacctcgcagtgtcactgcgacagcgatacagtgaggaccgcctccaccttttagtcacagagcgcaacatcgggaacctcacatacgatgggaccgaagttggcggcgagcgagtggctcacgagatcgaggaaacactgaacacattagccgacaaaggatgtcccatccgaaaactgagtatcgtcgggtactcattcggaggcctgttggccagatatgcaataggattgctcgacgcacgaggatggttcgacaagctaaaaccggccaacttcacaactttcgcgtggcacattgtggcggacggattccccgaaagtttn

SEQ ID NO: 5518 - DNA, 1264 bp, Aspergillus oryzae
  misc_feature (1)...(1264): n = A,T,C or G
tgtatttcatcattcctatcgtcccatattaatagagtattgctagttttcttttgatttcgtctgttgaggtgctgcttttttgtcgccgttgtcgcccaccatgaagtcgaccttggttacggcctctgtgctgttgggctgtgcttccgccgaggttcacaagctgaagctcaacaaggtgcccgtgtccgagcaatttaacttgcacaacatcgacacccatgtgcaggctctcggccagaagtacatgggaatccgtcccaacatcaagcaagatcttctcaatgagaacccgattaacgatatgggacgtcatgatgtccttgttgacaacttcctgaatgcacaatacttctccgaaatcgagatcggtactcctccacagaagttcaaggtggtccttgacactggcagctcaaacctatgggtgccctcttcggagtgtggttctatcgcctgctatttgcataacaagtacgactcatcctcgtcctccacgtaccagaagaatggcagcgaatttgccatcaagtacggctctggtagcctgagtggttttgtttctcaggatactctcaagatcggtgacctgaaggtgaaggatcagctgttcgccgaggctactagtgagcccggccttgcttttgcctttggccgctttgatggtatccttgggttgggatttgacacaatttccgtcaacaagattcctccacccttctatagcatgctcgaccagggcctcctcgacgagccagtctttgctttctaccttggagacactaacaaggaaggtgatgactccgtagcgacattcggcggtgttgacaaggatcactacaccggcgagttggtcaagattccccttcgccgcaaggcctactgggaggttgaccttgatgctatcgcccttggcgatagcgttgctgaactcgataacaccggtgtcattctggataccggcacttcccttatcgccttgcccaccacccttgccgagcttattaacaaggaaatcggtgccaagaaaggcttcaccggccaatactcggttgactgtgacaagcgcgattccttgcctgacctcaccttcaccctgagcggatacaacttcaccattggtccctacgactacactcttgaagtccagggatcttgcatcagcgccttcatgggcatggacttnccttgacccgttggccctttgccatcctgggtgacgcgtttcttaagaagtgggacagtgtggacgacccccgca

SEQ ID NO: 5519 - DNA, 2022 bp, Aspergillus oryzae
gagtttacctgctatgatgccgaatgcggcgcgaggatttgttaatattttgccgaggccaatgaactggtttatctgacaagacgatctgagatcgccaggagtcagaacaaaaagggaaattgaaaagatgccatttcgtcgaagccgacgtgcgaccgagttctcatccaacatggcattgactcgtcgactccagtcttggcacaccggccaaaataaagacaacaaaaagggaattagaagagaaattaaaattatcagaagacgcctttcaaccccctgccaagtgcccaataacacgaaaaataaacaattaatgccttgtttcctgcccctctccttcctagtgataccccatttctcgtttattttgtatcctctctcaccatggctgaccttttcaccaccatcgagaccccctcggccaaatacgagcagcccttgggcctgttcatcaacaatgagttcgtcaaggctaagagtggccgcacttttgagaccatcaaccccaccaacgagaagccgattgtagccgtccaggaggcggacgagaatgatgtcgaagatgccgtcaaggcagcacgcgccgccttcgagggtgagtggagcaaggtcactccctccgaacgtggccgcctcctcgtcaagctggccgacctcttcgagcgtgatagcgacatcctggctgctattgaagcccttgacaacggcaaggccttcaccatggctaagggcgatgttgccgccgccgccggctgccttcgctactacggtggctgggccgataagattcacggccagaccattgacaccaaccctgagtctcttacctacacccgccacgagcccattggtgtctgtggtcagatcatcccctggaacttccctcttctgatgtggtcctggaagattggacctgccatcgctgccggtaacgtcgttgtcctcaagactgctgagcagacccccctgtctggtctctatgccgccaagctcatcaaggaagctggcttccccgctggtgtggttaacatcctctctggcttcggccgtgtcgccggtgctgctatctctagccacatggatatcgacaagattgccttcaccggttcgaccctggttggtcgtatgattctccaggccgccgccaagagcaacctgaagaaggtcactctggagctgggtggcaagtcccctaacattgtcttcgacgacgccgacatcgataacgctatctcttggtccaacttcggtatcttcttcaaccacggccagtgctgctgcgccggttcccgtatcctggtccaggagggcatccacgacaagttcgttgcccgcttcaaggagcgcgccgctgccaacaagctcggcaaccccttcactgccgacaccttccagggccctcaggtctcgcagctgcagtttgaccgcatcatggagtacatcaaccacggtaagcagaagggtgctaccgttgccaccggtggtgagcgtcacggaaccgagggttacttcatccagcctaccgtcttcaccgatgtccacagcgacatgaagatcgccaaggaggagatcttcggccccgtcgtcaccatccagaagttcaaggatgaggaggaggccatcaagattggtaacagctcttcgtacggtcttgccgccgccgtccacaccaagaacgttaacactgccatccgcgtctccaactctctccgggctggaaccgtctggatcaactgctacaacatgatcaactaccaggctcccttcggtggcttcaaggagtcgggtcttggccgtgaactgggctcctacgcccttgagaactacacccaggtcaagactgtgcactaccgcctgggcgacgctctctttgcttaaatgaaagttatgaaataatgaaatattcttacaagttccattttggcgatgcctttgatctttgtcatttcatgtaaacataggatatgaattcacgatgaaattgtgactacctaaaaaaaaaaaaaaaaaattcct

SEQ ID NO: 5520 - DNA, 1710 bp, Aspergillus oryzae
  misc_feature (1)...(1710): n = A,T,C or G
ctcttcttccattcattcaactcttctccttactgacatctgttttgctcagtacctctacgcgatcagccgtagtatctgagcaagcttctctacagaatctttctagtatcttacaaagaactacaaagttcgcaccaccttcaaaatgggtaaggaagacaagcagcacatcaacatcgtcgttatcggccacgtcgattccggcaagtccaccaccactggtcacttgatctacaagtgtggtggtatcgaccagcgtaccatcgagaagttcgagaaggaagccgctgagctcggtaagggttccttcaagtacgcctgggttcttgacaagctcaagtccgagcgtgagcgtggtatcaccatcgatatcgccctctggaagttccagacctccaagtatgaggtcaccgacattgatgcccccggtcaccgtgacttcatcaagaacatgatcactggtacttcccaggctgactgcgctatcctcatcattgcctccggtactggtgaattcgaggctggtatctccaaggatggtcagacccgtgagcacgctctgctcgctttcaccctcggtgtccgtcagctcatcgttgccctcaacaagatggacacctgcaagtggtctcaggatcgttacaacgaaatcgttaaggagacttccaacttcatcaagaaggtcggatacaaccccaagagcgttcctttcgtccccatctccggtttcaacggtgacaacatgattgaggcctccaccaactgcccctggtacaagggctgggagaaggagaccaaggctggcaagtccaccggtaagacccttctcgaggccatcgatgccatcgagccccccgtccgtcccaccgacaagcctctccgtcttcccctccaggatgtctacaagatctctggtatcggtactgtgcccgtcggtcgtgtcgagactggtgtcatcaagcctggtatggtcgttactttcgctcctgccaacgtgaccactgaagtcaagtccgttgaaatgcaccaccagcagctccaggccggtaaccccggtgacaacgttggtttcaacgtcaagaacgtctccgtcaaggaagtccgccgtggtaacgttgccggtgactccaagaacgacccccctgctggctgcgattccttcaacgcccaggtcatcgtccttaaccaccccggtcaggtcggcaacggttacgctcccgtcctggactgccacaccgctcacattgcttgcaagttcgctgagctccttgagaagattgaccgccgtaccggtaaatctgttgaggacaagcccaagttcatcaagtctggtgatgctgccatcgtcaagatgattccctccaagcccatgtgtgtggagtctttcactgacttcccccctcttggtcgtttcgctgtccgtgacatgcgtcaaactgttgccgtcggagttatcaagtcggttgagaagaacactggcggttctggcaaggtcaccaaggccgcccagaaggctggcaagaaataagctggttaatatgtgcggggatgcaattatgaaccttttatgagcacaaaaatatggaattctcatgaaattagacttcaattatgtagttgattctacagaacttgaatcatgattttattcgttaaaaagagacggctttntcgctggataataagagaacaatctgggattgatct

SEQ ID NO: 5521 - DNA, 696 bp, Aspergillus oryzae
  misc_feature (1)...(696): n = A,T,C or G
cggagtagcggtcacaattacattcccaccattccaccaccagctcctccgtaaaacaccaagtacgaggggcatgagccgtcatgcgatggccgccatgggcttccgaatcacaagcccgagacaaacaagatgaacaaaaccaaaagaactgggacaaatcactcaatgcgatcgactgggccgcgttcaccgaacctaggaccctaattcccaccctgatcctcacgacaggaattatcggcgcactgcagatccaccgccgatacctgcgccgtttccccgacgctgttagcatctcgccatcgtacttccggaagaggaccatcttaggccaagtgacgagcgtcggcgacggcgacggtttcagactataccacacacctggaggaagattggcaggatggggctggttgccctggaagagagttcccaccgcgaagaaggatctgagagataaaacggtgcgtngatgngcctttactcttttttgcctaggacaagaggtctaatgggttatgtttagatctccgttcgcttggctgtgtggatgcgccggaactcgcgcatttcngtcgttcggagcaacctatgctcgggaagctcatgaatgggtgacgtcttacgtcctaaacgccgggttcgggtcctgtgcatcgtcaagaccaaaatcaacgtggtgtgggcctttgctat

SEQ ID NO: 5522 - DNA, 638 bp, Aspergillus oryzae
  misc_feature (1)...(638): n = A,T,C or G
caactccctcatcctcttccattcctttggaccctatactgcccaactcgagctcctccttctccatcaaccgaacctcatcagcaacgatgcctacctcaacatccaaaccacctcccctcgacccctccaactaccccaatggcaaaaagtctctcgccggaatttcactacgtgcattcctaatcggcacgaccctcggcctctccatctccctcaccattgtcctccgcttccttgaaacgcccctttggcgtatcccattcttcctcgcctccctctccctcttccacttcctcgaatactatgtaacagccgcctacaacacccgctacgccagcatttccgccttcctcctctcttccaatggctgggcatacaatgtcgcgcacatatctgccgccctggaatgtctcctagcccatcgcttctggccgaccgccgcctacctgaactggggaattctcgcaccaggcctaaagattcaggttgtgctaagcctcgtcttcatgattgttggccaggtcgttcgcacgttagcgatggtgcaggcgggaagtaactttaaccatacggtgcangtcgagcggaaggaggatcatagtctccgtacgcatggtatctacgccatgctgcgt

SEQ ID NO: 5523 - DNA, 1604 bp, Aspergillus oryzae
gaagaagaagaaaagaaggagaagaagaccaagactgtcaaggagagcaagatcgaggaggaggagctcaacaagactaagcccatctggacccgtaaccctgctgatatcactcaggaggaatacgctgccttctacaagtctctctccaatgactgggaggatcaccttgccgtcaagcacttctccgttgagggtcagctcgagttccgtgccatcctctatattcctaagcgtgctcctttcgacctcttcgagaccaagaagactaagaacaacatcaagctctatgttcgccgtgtcttcatcaccgacgacgccaccgacctcatccctgagtggctcagcttcatcaagggtgttgttgattcagaggaccttcctctcaacttgtcccgtgagaccctgcagcagaacaagatcatgaaggttatcaaaaagaacattgtcaagaagacccttgagctcttcaccgagattgctgaagaccgtgagcagtttgacaagttctactccgccttcagcaagaacatcaaacttggtgtccacgaggatgctcagaaccgccagactctcgctaagctgctccgttaccagtccaccaagtcgggtgatgaggtcacctccctctctgactatgtcacccgcatgcctgagcaccagaagcaaatctactacatcactggcgagtctatcaaggctgtcgccaagtctcctttccttgacagcctcaagcagaagaactttgaggttctcttcctggttgaccctattgatgagtacgctttcactcagcttaaggagtttgatggcaagaagcttgtcgacatcactaaggacttcgaactcgaggagtccgaggaggagaaggctgagcgtgagaaggaggagaaggagttcgagggcctcgccaagagccttaagaacatcctcggtgacaaggttgagaaggttgttgtctctcacaaacttgttggctctccttgcgccatccgtactggccagtttggttggtctgccaatatggagcgtatcatgaaggcccaggccctccgtgacacctccatgagctcctacatgtcttccaagaagaccttcgagatctctcccaagtctgctatcatcaaggagctcaagaagaaggtcgaggctgatggtgaaagcgaccgtaccgtcaagtccatcactcagcttctgttcgagacctctcttttggtttccggcttcaccatcgacgagcctgccagctttgccgagcgcatccacaagcttgtgtctcttggtctgaacgtcgacgaggaggctgagacctctgaggaaaaggccgctgaggaggctcctgccgctgccaccggtgagagctccatggaggaggttgactaaatgcttcggcagcagcggaaatgaaatccaactgcttttacgacctattattcaaaactgttccagcggtatttgcatcagggttaatctacatcactgactcgcattgctgtttcatttgggacgggagaaaggtggttcctagtcacgatgtgatttttaatcttccggcgtttcgagcgtttggtttccatatcatactactttaaattggtacgtct

SEQ ID NO: 5524 - DNA, 433 bp, Aspergillus oryzae
gattattgccgccattgaggagtttgtgaaagaacgcgcagatcaggtgacggcgaacgtcgaagttccttctactcaacatcgactgctcattggacgcggtggagaaacacgacgtggtattgagtcgaagttcaacattacgctcgatatccctaagcaaggctctggacgttccgatatcaaactcaagggtcctagcaatgctgttgcagaggccaaggagcacatcctttccatgcttaaggaccaacaaggggagaccgtggaggtccctcggcatttgcatcatgctatttccgacaatggctctttcttccgtcggcttcgtaacgactaccaagtgaccgtggatcatgctggccagcaagtgccatccaagccctcctcggaagacacccgcggcgcagccaacggcggttcatctctccca

SEQ ID NO: 5525 - DNA, 714 bp, Aspergillus oryzae
cattgaattatattgatcagcacccaagacaacttcagcataccacttatctagaaaacaaccattaagatacaactcaatagccatgtccgagtttaccgaaaagaacaaagaggtctggggcaacttggccaagacttacaaaacccggttcgaaaagggcacaaagttgatctaccgcctgactcaggaaaagcgcctttggggtagtgacgtttggactgacaccgaagccgggcaaggcaaagagatcaaggtgttggaatatgcatgtggccctggcgttgtatctacggcattggcgccattcgccaccaaagtcgttggcatagacgtcgcggacggcatggttgacgagtacaatgctagcgctcgtgaggccggttttgaagacaaaatgattggctttaaaggtgaccttctggccgaaccaatgccagaggaattctcaaggccagagtattccgatttcgatgttgcatttgtgagcatggcccttcatcatttcgaaaagccggacctggccatgaagcgtctcggggaacgactgaagaagggtggtgtatgtctgataatcgacgtacttccacatggcaagcatgaccacaatgcccatgaaatgcacaaccccgaccatgaaaccacgcacacaatcaagactcatggttttaccttggaggatatgcgcaagctgtatgaaactgcagggcttgg

SEQ ID NO: 5526 - DNA, 670 bp, Aspergillus oryzae
gaggcaattcaccgtcccgttcacggcttaccctcttctttcacagctagttctgccggaacatcgcttttcattgggaatgtgggatttagtgttcacgaagcaatgattcgtgatgttttcgcttccaagggatttttagtcgaggtacatttgccgctagatgcagagacgggaagacatgctggctttggctacctgcgctttccttccatccacgcagcaaaagcggcgttggacgctttgcaaggtgctcacatagatggacactcaattaatttggagatcagtgatcactctccgatcaccgcgctagacacatcacaggtccgcgaagtaaactctaatcagccgccagcgccatctgaactttaatcttcctctgttgcgccaactagagcgaggcaggcgtccgaaccacaaactagtggagaacggggcttcatccacgagcagagatcggcgcccttaaccgtggccgacctctgctcgagcgataccccccacttgtcttagctgtcttcttgcgatacccttttaattagcttctcacttttttgactcggaacgaccttaattctctatattctctcttctggccttgagggtgttttaaacaagcctgtggggggaacaaaccattttcgccacttccgtatcttggtcgggg

SEQ ID NO: 5527 - DNA, 714 bp, Aspergillus oryzae
  misc_feature (1)...(714): n = A,T,C or G
ccaaacctcagcaccacaatcgcaaccaccaacccaacccagcccaacaaacaaacaacgggaccaattcaattcaactcaatcaaacacccaaaatgtcccaagatccctacacgccaccccccctccccaaacccttcacaaacacaaccccaccaccaaccctcctcacccaaggcgccgaagcccacctctacaaaacaatccacctaaataccaacacgcccgcagcactgaaaatccgaccctcgaaaccctaccgccaccccatcctcgaccgccgattgacccgccagcgcatcctccaggaagcgcggtgtctggtgaagctcgttcgggagggcgttaatgtgcccgcggtgctggcgttggattgggaaggacaaggtggggagaatgggaatgggggcgcgtggttgcttatggagtggatcgaggggttggttgtgagggttggttttgagaggtgggaggcgtttatcaaggcttctgggggttcgttgggcgagaaggagctacgganggaggaggagaaggttagggggttgatgaggcggatttgggtgnnngnngngggnnnnntnngggggggtnnttnttgggggtgtgngnngngttntttntttttgggggggggggtggtggtttgggntttgggggttgtgggtgttggggggggtgggggtttggggggttttggggttgggggttgtg

SEQ ID NO: 5528 - DNA, 677 bp, Aspergillus oryzae
ctgggttcttaaccttgatcttggggccttcagttgccatggtgcgggcctgtgtccactgcaaagggtagattccggtctggcggggggagacaatacgagggagctgagacgaagcgaggggtctctgagcgcgaggggtagcagcagtcgagaaagaagaagaagacgaagaggaaatgtaagaagaagaagagcaggagatcgagcgataagcggaggaagagagaggggcagacagaggggaggcgacagcgcggcgaaccgacgcggaatggagccgaagggaattcatcattttgatcggacctgatgccttggatacccaagcggattaaccatcggtaatcgcaactcccaggaaaactcccctgcttacctattcaggtctggggtacaccaaaaggcgaataatgtatacccgagggaagcactttgaagcttttcggttggaaggagagagcgggcggtggagtcggaagctcccgtcacgccggagaaagctgctgatagatggatataccacgggggagatcggagctccggaaaatatgttagttcccaggtggaacggtgattagtcgtcgagatctggggggaagtaaaggaaaagagtacaggagagaagagagtttcgaaggataaaaaaagtgaccaagtcacgactttatctggcc

SEQ ID NO: 5529 - DNA, 648 bp, Aspergillus oryzae
  misc_feature (1)...(648): n = A,T,C or G
caagcaagagacctacttccgtaaccgtggcttggacttgacactcattcagtcccctctcgatttcactgctcgttatttcggcctggttgaggcgttcgccaatcacatccgtaccaagcgcccccagacccaatgggttagcttcattgacgatgacactttctggttgtcccttcccactgtcgccgaggagctgaagcttttcgatgtgaccaagaagcactatatcggctccctgtcggaagcccactggcaggttgacacctttggtcacattgcctttggcggtgctggtgttttcgtgtctaagcctctccttgacgttctcgaagaatattacgacgaatgtcagtcctggggtgagcagcctggagaccagaagctcggacagtgcatccagagatacggagatactccccttaccctttggccctctctttaccagatggacatgaanggtgaggttgacggcgtgtacaantcgggccggaagaatgagtccctccaccactggaacagttggtacactaaggacgttgtcaagatgacgaccgtggcancggccgccggtcgccggtcantgcttcgtcgctgggtgtttgaccaggaaaagaatgccataaactcaccggcnagagcacccgt

SEQ ID NO: 5530 - DNA, 699 bp, Aspergillus oryzae
tttcgtcatcccaagtacggttcaaaatgctgttcggggtagctttgctctttctaggagctgtcgctgccaacccggtcatacccagggaagatggtagctctactcccactcccactccgactatttcaagtagtacacccatctctgcgccatccgatgcatgcgccacctcatcaacaagtagccagtggctaagcgtatgcgataccactattttctggccaacatcgaccaactactactacggcccgaccaccggccccgaggcatccgcagtctcctgcaatgccgaatgggtcgaattcgacggacgcgccaccggcctagaatccctcggcgcaacgtccacttccaccatctacagtacctacaccaccagcacgggagcctgcaacacccaaatctggggcgaaggctgggacgacccccacacaggcccagtgaccacgctatgtgacgggatcccccgagccctgggtccccgagaatactcgaccacatactggccaggcacaggaccctgcagctcattcatatcgttcgagaccaccacaaccctagtctatcgatccccatcaccaacgcccagctgctcgcttaacaccgaagaatgcattccctatctggcaaacctacacaagctccgcgacgcctactacgcctccatcacaaccgcaacccccaggcgattacaac

SEQ ID NO: 5531 - DNA, 1140 bp, Aspergillus oryzae
  misc_feature (1)...(1140): n = A,T,C or G
gtggaaaagctgatacacgcggctgtctttccccaaattgatttctacctgcatagttatataattatataccgatagaagtatagagacccaccgtcgtgaagctcgagtcatcagccaagcaaagacgaattgtccaagttcggctgcacgtcttgtggatataaattgacattccacccagctttctccttccaagcgatcgtttagagagcatccatagactatagtctatagacgcagcaaaaatgcctcccgttattcattgcgtgcgccatgctcagggtttccacaatctctgcacagaaaatcatgtcattcgcgaccccctgctcaccgacctgggcaatgaacaatgccgcaaactctccgagaacttccccttccatgacaagatcgatctcgtaactgcttctccccttcgccgtaccatctacaccgcattgcagagtttcgggcccgtcttcgaagcgcacaaggacacgaaattgcttctcctcccggacgtgcaagaaaccagcgatgttccttgcgacacgggtagcgaccccgttgatttgcgaaaggaaatcgaggagaatggattgcccgttgacccatcattggtgcatgagggatggaacaacaagactggtcggtatgccccaactcatgatgcgattagaaagcgagctcgcgaggctagacggtggttgaaggcgagacctgagaaggagattgttgtcgtgactcatggtggattcttgcattatttcactgaggattgggaggatggcaaccaataccaaggaacggcctgngctaacaccgaataccgtacttacgaattctcctctgaggcccacaagactgatgtggaaggtcatgagctcgagggcgaggacgcaaccttggttgagactatctcttcgcgcgaacgtcgtggcaaagaaggcccggcacctgaccgggaggctcagaaggctctgtacaagaaaggaatccaggggtgggatgacctaggtttgcaactgagcacggctgaactgtaagcggccaatgttccagagggcaaagaagttgatggtgtccgtgtatgagttgtgggaaaatatcctctccttgtcgatatctttttgtagatagtggtagatgctttgg

SEQ ID NO: 5532 - DNA, 712 bp, Aspergillus oryzae
  misc_feature (1)...(712): n = A,T,C or G
ctctatctatactttccgacttcctcgtctactgagtttatatgcagagtgcccagtaacggagttgcctgtggaaaatgaactctctttttaattcggccctgaagcagtcctctgctatccgtcgagatctggacacattcgcgcagtcacctgccacatcctcgcccgcattacaaggccagatcgcagcttcacttgcttccttatcgcgcaccgtcgatgactactcagctctatcgaagaaagagttgatacccgaaaaacaacaaaaggcgtttgagagagtaaataattttcggtcggagctagcagattaccgactgcatttcgataggctacgcaaagaacgagaggatgcccaatccgtgacaaaccgtaatgaactacttggtcgacgtccacatcacacagcgacacccgagaacccatacgcccaatcttcccttcctcagtcgtcggccttcgctccatcttcgtcccgcggggggctcagtttcggcgcttcacccgcagattacaaccgtgagactcatgcgcttcgcgagcaatctttcttggccaacacgagcatacagcttgatgaattcctcgaccggggacgtgctgtactagcggatcttgggcancancgagaggtgtngaagggaacgcancgtcngctggatagtgtcgctattaccctgggagtcagcggtggaacccattcgaa

SEQ ID NO: 5533 - DNA, 679 bp, Aspergillus oryzae
cggaatcagcttcgatgttcttcaaacgattgaaaattgcattcctaagggctctgcattcgaagcggtagcccacgtgtttggcaaagagcttctcggcattgtgaaggtggcagaaacgtgggtggacgagcagagtttgacagctgtcttgaaaatctcatttcaggttcctgatgaatatgtgggctctggctctgtagttgattcactgacgtctgttcttcatggcctacgtgctctttcgtcagaagtcagtcaggttacagcagttcttctgcctacaatcaaccaaggtaaaggtttgaaacgtaaggtggatcctcgagaagccgtgaaagaggaagcttctgtcagatccagcagcgcagcagttatgacgacgcttcagaggcaaacacatcctgtttgtttcacctcgaattcctcgtgcaatttggcaactgatagctgctctggacatgggttttgctataaaaagtccggttcagccaacgatgaggccgctagcgactgctacgcatgcaaatgcaagtcgaccatcgtcaccaaggaagatggcactgttcaaaaaattcggtggggagggcctgcgtgcgaaaaaagagatatcagctcccctttcttcttgattgcaggtatcagtgtactggtggtcatggcggcaggtactgccgtt

SEQ ID NO: 5534 - DNA, 1543 bp, Aspergillus oryzae
  misc_feature (1)...(1543): n = A,T,C or G
cgctgagttcgcccgccgtggtttccgttcccttggtgttgccgtccagagagagggtgagccctggcagcttctgggcatgtaccccatgttcgacccccctcgtgaggatactgcccacaccatcgctgaggctcagcaccttggtctctccgttaagatgttgactggtgatgctcttgccatcgctaaggaaacttgcaagatgcttgccctgagcaccaaggtttacgactccgagcgtcttattcacggtggtcttgctggctctgctcagtacgaccttgttgagaaggctgatggtttcgctgaggtcttccctgagcacaagtaccaggtcgttgagatgcttcagcagcgtggtcacttgactgccatgactggtgacggtgtcaacgatgctccttccctcaagaaggctgactgtggtatcgctgtcgagggttccactgaagccgcccaggccgccgctgatattgtcttccttgcccccggtctttccaccatcgttgatgctatcaagctcgctcgtcagattttccagcgtatgaaggcttacattcagtaccgtattgctctgtgtctncaccttgagatctaccttgttacctccatgatcatcattgaggagaccatccgtgctgatcttattgtcttcattgccctcttcgctgatttggctaccattgctattgcctacgataatgcccacttcgagcagcgtcctgtcgagtggcagcttcctaagatctgggtcatctccgtcgttcttggtgtcttgcttgctggtgccacctggatcatgcgtgcctctctcttcatggccaacggtggtatgatccagaactttggttctccccaggagatgctcttcctcgaggttgcccttactgagaactggctgatcttcgttacccgtggtggtaagacctggccctcttggcagctggtcggtgctatcttcgttgtcgatgtcctctctaccctgttctgtgtgttcggctggctttccggcgagtacgagcagaccagccctcccagcaaggctgagttctccatcaacggtgacgtcgacattgtcactgtcgttgtcatctgggcttactccattggtgtcaccgtcatcattgccgtcgtctactacctcctcagcatcatccctgctcttgacaaccttggccgcaagaaccgctccaaggctgacactaagattgagaacatgcttagccacctctccaagctggctatcgagcatgaggttgatgcccacggcaagtcccgctacatgctgggtgcccgtgctgaggtcgaagaggaggagtaaacgcttgattacgctcatttcatttaatattatccgatctggatatcacttgagcatacatgcatgagctggtgcaccggctttattattttaccccgtattatagactttttatgcctttattactttgctctacgtatatagagcgaattttcctttctttatcatgtatgtatgtcattaatagtggtaaattagtcaaatcaagggtttccaaag

SEQ ID NO: 5535 - DNA, 616 bp, Aspergillus oryzae
cattctcccacgctttcttacatcgcgctgctacaaccacagattaagctatagtgctcttcagaagcctttcctagtctatcctagagctcaattctctgcgtcagcatctaattgttttactactacaacattccgaaacgtgtctgaagcgatcaagatggaggccaaggcaagcaatgagaacttcaagctggagaacctctttaatgttaagggcaaagttgcccttattacaggaggaggctcgggtatcgggttgatggccactcaagctctggccgtcaacggagccaaggtctacatcacaggtcgaactggcgagaagctcgaccgcgttgcagaattatacaacaagaacatccagggcgagatcatccccatcacatccgacatcacagataagagctcagtcgacaagctggtgcaagagatctcctcgcgcgaaaagtacctctccatcctgattaacaacgccggcatcagcagttcgacccagacgacggagaaggaggatcctaaggagctgcgcaaggagttgttcgagagtagtgcgcttgaccccaaggagtgggatgatgtgtaccgcacaaacgttacgcaactcttgatgact

SEQ ID NO: 5536 - DNA, 1148 bp, Aspergillus oryzae
gtctgcctacacgcactattctacactcagtgtactagaaaaatgttcgaggaaacctcgcctgacgcattctggggggtgcaaacagccaaatccaacttttgcgaggaggattatgcggtgacaagatacatcgccgagttcatcaacagtttgaccaacctcgtttacatattctacgcgatctatggaatccgcaagctgcgacaaaaatcgagtcgcgatatctttcgcgtcatcccgtactggggtttgatggccgttggaatatgctccgctgcttttcacattagcctcaagtaccacacccaaatgttggatgacctctccatgctcttcacgaccaccccagttctacaccaggtcttgactgtcaatgccagtcgtagatattccgttatgatggcaattttactatggtcatttcttatgattctagtggtttatcacgtcaggacagatgagcttcttttgcactcgttatccgttgcttgcatggttatcggcattgggattcgcacgatgcatttgatcaacgctcggacactcaccaggctcaccggctcgcaagcagatttggggaatggtacggttcggagcagtgatctttaacttgggattctacctctgggtgattgatgggtggatatgtgggtttttgagaagcgcaagggagaggataggtcttcccttggcttttctgttagagcttcacgggtggtggcatatcttcacaggaattggggcctatatcttcattgcagtggtagatcatctcgtgtctggtgagagtcacgatggtattgaagagcattttgcctggcctgcttcatgggcttctaagtccgtcttcgcgggaagcaatcctgaggagattcataagaaaacaaagttgagggcgccaagtaggtcgtgctctaaaattggagggtgaaatccttccaggaatacattcgccatgttatctctatgctatggtaaaattcttttcccgcgatggggatagtccaccttgtttctttgccaaggacgtactttttaacataatgctatttattgtggggcgggaaaaccctatttatacagaccctataaataaattcccttatcgccactctaattggaaaaaatacctccactctcccccg

SEQ ID NO: 5537 - DNA, 115 bp, Aspergillus oryzae
gcacatctccgaggatcagggcagcttcgtcatctctaactcctctctgagtgaatttggagcccttggattcgaatacggttactccttgacctcccctaacgccctcgttatg

SEQ ID NO: 5538 - DNA, 655 bp, Aspergillus oryzae
gtttgcgcagggatgcttcgagcgagatacgcattgacttggttccgttcccaccatagttggcttggatcttgtccttgtgatggccttgccagccggtggtgtatttggtcgcaataaccatctggtccctgttttgcctggaggcaagccattcacccagccagatctcggattgctcttctcgtcgaggatctcaaaggcggcatccttgctacattctccgtatcgctctttgctcgcagtgccgaaggtcatggcacctaggcatagaggggagactctgacggatgccgaaggggcgagctgtcggtagcgagcgagaagtggttgggaagacatgacgaggtgttatactttcttggatatacggctgtgcacagacacggtgatatcatactgtctaactaagaccgggaaatcaacgggtaattgtttgatgatattcaaacactggatttccatctattatctactattctaggggtttgttaaagttccagactgggtaatatgcaagctgctgacgattctccacttacgcaccgccggacataccgggattaacaccgtcaaccacatataaaaatccgggcccttgattaacagttccagccttaaaagaagaggcaagaaacggtggctagcccctcgc

SEQ ID NO: 5539 - DNA, 639 bp, Aspergillus oryzae
  misc_feature (1)...(639): n = A,T,C or G
cagattcatttgatcgcttcagaatactacatttcgtcgcagatcgccatcggtttcgctagcagagctaaaataaatacatttatatttgagaaacgacacccgaaatcctaaacaaccggcatgcgacacttctttcggcgaatctttggattccgtcaacattcttctcctcacaactcaccccagagacgcagcatgagctcctctaccgtggcagttctttacgccctcacactttcagtaccttcaatttccacaggtcccgaggatgcgaaagagaagaaacaccatgtctcagggggattcacgaatccatgggattcatacaagacccctgctgttcagcgcttttttctgcgacaaataaatggtacagcaaaccgtcctgacactacacccccaaccgtgcctgtccgaaaaccagagttcctgcccagtagagaaactcctaagttgcgtgcgacgtggctaggtcatgcctgttactatgtcgagtaccccagcggtctgcgagtactgtttgaccccgtcttcgaggaccgttgctcaccgatttcttggctggggccccagcgttacactgaaatgccgtggtcaatcaaggatatacccattatcgacgcagtggtgatatcn

SEQ ID NO: 5540 - DNA, 1266 bp, Aspergillus oryzae
  misc_feature (1)...(1266): n = A,T,C or G
gttatatctctcgctcagatatctcagccatcattcatacacccctacgatcgaattctcaacgttaccgcttcttacctgtgttagatttccaccatgggagacgtcgccgtggagaatccggcgaacaacgtcacgcctcataccaagccggcaccattggacaccatccccaacatagactcaatcgaaggcacagggactgatggaggcgacgaatatgctactttgaagaaactccagagacatttagaatacatccagctccaggaggagtacatcaaggatgagcaaaggagcctgaaaagagaacttgttcgtgcacaggaagaaattaagcggatacaaagtgttcccttggttataggccagttcatggaggcgattgaccagaataccggaatcgtgcaatcgtcaaccggctcgaattatgtcgtccggattctatccacgctcgaccgcgagaagctcaaaccatcgtcctcggtcgctctccatcgccactccaacgcccttgtcgatatcctacctccagaggccgactcctccatcgctatgttaggcgaaaatgagaaaccagacgtcacgtatgccgatgttggtggacttgatatgcagaagcaggaaatccgcgaggcagtggaattgccattgacgcacttcgacctgtacaggcaaatcggtatcgatcctcctcgtggtgtcctgctatacggccctcccggaacaggtaagactatgctggtcaaggcggtggcgaatagcacaactgccagcttcatccgagtaaacggctccgagtttgtccagaagtacttgggtgaaggtcctcgcatggtccgtgatgtgttcaggatggcccgggagaatgcccccgctattatcttcatcgacgaaatcgacgccattgccacaaagcgtttcgacgcccaaactggtgccgatcgtgaggttcaacgtattcttctggaactcctcaaccagatggatggttttgagcaatcgagcaatgttaaggtcattatggctactaaccgggccgatactttggatcctgctctgctgcgtccaggtcgtctggaccgaaagatcgagttcccctctcttcgtgatcggcgagagcgtcggttgattttcaccaccatcgcatctaagatgtccttgtcccctgaggtcgaccttgactcgctgattgtgcgtaatgaacccttgtctggtgctgtcattgccgccatcatgcangaggctggtctacgagccgtgcgg

SEQ ID NO: 5541 - DNA, 620 bp, Aspergillus oryzae
cgagtcagttacggagctcaggtctcgagtccgggccgaggggcgcactcgctttccgggcactttctacctcagccaggagatgatctcagtagtgtagaggagaaaatggagtcggtatctaccggccaagctttgcagcggcgagatcgcatctccagtcgagaaccagcaatccatgagagtatctcggcctttgatatcgcgactatggcagctataagtactggggcgactgctaatttcttggaaacaatccaaacgactggaaatacggtttgtggccgtcatccaattggcgttatcatggctgctattgaggaaatcacgagccaggaggaaggaaagaagggtaaattccatttcgtgagatatgaaagaagctcggatgcagttgatgtcgacgatagctccgtgagttacgtctctgcatttgctgtactataacctgcttggctctctgggttcttcccgtttgccccccctgttgggggttcattaccatctcgtataagttagcatctctgttgtactgcttttgaagaacgcaactttacttttgttaccctgtgactaggcgaccaaaggtgcttgtagcaattaattacgatttagttgac

SEQ ID NO: 5542 - DNA, 1486 bp, Aspergillus oryzae
gggaatgtgatctggtgcactatagaacagcgctagggtgtgcaagtcagcgctcccgaatatttctactcattcgccttctcttcttgacgcctcttaccggagcttccccaccctaatgcatgtccatgacacagtctccctcggaactcttgcctccgtttaaatagtcttcctcttctctccacctcaccaccgtaactctttcacctatcaagagggtatccgtcaccgtcgacagtctcctcgtcttggttcgggcatatccgaggtcttcgagaagacgaaaaacaccgacatcatgtctgcaaagacggcagacgctacccagcctcgtgctggcgacatcaagaaggctcacattgtcgacactgccatcacacggagcaactggcataagcatgtcaactggctgaacgtgtaccttattatcggcattcctatgtatggatgtgtccaggctctctgggagcctctgcagctcaagactgctatctgggccgtcatctactacttcttcaccggactgggtatcaccgcaggataccatcgtctgtgggctcactgctcctattccgctcgccttcccctccgtatctggctcgctgctgttggcggtggtgccgtggaaggttctatccgctggtgggctcgtgaccaccgtgctcaccaccgttataccgataccgagaaggatccctactcagtccgcaagggtctgctctactcccaccttggctggatggtgatgaagcagaaccccaagcgtattggccgtactgatatctccgatcttaacgaagaccccgtcgttgtgtggcaacaccggaactacctcaaggtcgtcttcaccatgggtctgtttgtgcctatgctcgtggccggtctgggctggggtgactggtggggcggtttcgtctatgctggtatcctccgtatcttcttcgtccagcaggcaactttctgcgtcaactccttggctcactggcttggtgaccagccatttgatgaccgcaactctcctcgtgaccacgtcattactgccctcgtcaccctcggtgaaggataccacaacttccaccacgaattcccctccgactaccgtaatgctatcgaatggcaccagtatgatcccaccaagtggagcatctggatctggaagcagcttggcctcgcctatgatctcaagcaattccgtgccaacgagatcgagaagggccgtgttcagcagctccagaagaagatcgaccagaagcgtgccaagttagactggggtgtccctctcgaccagcttcccgttatggagtgggacgactacgtcgagcaggccaagaatggccgtggtcttattgccattggccggtgttgtccacgatgtgactgacttcatcaaggaccaccccggtggcaaggctatgatcaactctggtatccgccaggatgcaaccgtaatgtccaccggaggtgctactaatactccaccctt

SEQ ID NO: 5543 - DNA, 1176 bp, Aspergillus oryzae
  misc_feature (1)...(1176): n = A,T,C or G
cagaggtacctccaacttcactgggtatcttatttattgtcgcaccaccttgactcccgtgttgtgcttccacaccttactcacattttctacatctaagaacttgtcctccagcttacctaccatcatcttgtcctgctcaaatctgttgtgcggggtaaacagcgatggcggaccgacaggcagtccaacaaaacctcaatggactgctctcgaaactggatgatccagatcctgacatgaggtacatgtcgctgaacgatctcctgggaatcctcaacagcccgacctctgcatatctggctcacgatcagttttcctcgtcacggcttgccgacggcttgctcaatgccttagatgatcaacacggcgatgttcaaaatcaagcactgaaatgtctcggtccacttgtgaatcgactgccttctgaaagcctcactaccatcctcgaaaagctctcgaacctgacagcatcccaaactatcgatacctcagttcctaataccgctctacgcgtcattgtcacggcccttccccgttctcaagctgggcaaccacctaccccagatgtttccgtagcttactcatctgtctccaaaattctcatccctcgcttgaccggtcccacaccatctcaatctggcagaagaggctccgtcatcaagggtatgctggagaaagatccttctaagggatttagcagcgatgcgattgatgttctgattcaagtcgtcacctgcttcggaccacttctcaaggaggccgagttaacggctctccaaaagtcagtgatgtctattattgacaacgacacagctggtactgtagtcacgaaaagagcgctggccgctatctccgccttggtacctcatttctcagaagctcaattcgcctcgttcgtcgacgaactcgttaagaagttcaataatccacggattagcgtcgtgcaccgaaggcaccttattgccacagtcggtagtgtcgcaaggagcagcccaaccaagttcggccctcatcttcccacactcgctccgtttgtttttgctacccttggtgaagttatcgcgacttagaatactagaaacaaaaagattaatgaaactagctgaatgatttcttcggaaaaaaaaannnnnnnnnnnnnnnnnnnnnnnnnnnnnnnnnnnanaaattcct

SEQ ID NO: 5544 - DNA, 677 bp, Aspergillus oryzae
  misc_feature (1)...(677): n = A,T,C or G
ctttcccttgcattatctcttccctctgcacctttgcctcgtgccctgtagctgacttcttataataccccatatcaccgtcgttcagtcagcgtcagggttcttcatctctccgcccaccagctgtccgtggtcatcatgaacagcttggtggctacaccacctgtgcctccacacttctacgaatattcccgtctttcctcctctcgtccaatgtctacaccaacctacacccctaatagccgcaagcggaaagccgacgacgatggtaacgatcatgatggacgaatgtctgcctctccgacgagctcgccagccttcacaccgaggtctcttccaagccggaatatgaaacgggcccgtccaaatgtcagcggccgacccctgtcacttcctcgtttgttagagaccttagatacagatgctctccggggggtccttcggtcgatgtgtgaacgccatccggggctagttgatgaagttgttcatactgctcctcgcccgagtgtgtcttctgcgcttcaggtgcttcgaaactaccaatctactctccaatcctncttccccttgggcggcaacccaacatccgactacgcttataatcgagttcgacaacctctatccaatcctctggatgccttgagcgacttnacaacgcacttnctaccanctaacga

SEQ ID NO: 5545 - DNA, 547 bp, Aspergillus oryzae
gcctgcaagacccttgttcataaccgctgtgccttacagatctgcctggtgtgtcccgctgcgttccatccagaacagattcgcgccgcatttgttaggtgttttgccagcttgctctatacctacaagaagttcttacagcctgcttccggtgataagaagaaagcgggcctaacttatagcttcaacatggaggcgttcctgaagagcttgccaggcgagcacgctgaatatgctgcggtactacagcaaacacaaagcttcaatgaattcatcagtgaaagagaaagagtcaatcccaagtccaaggacccaagaatggcactttttgatgagattgtcttgtctaaacgtaatcgtgggcggacttctttcttctccagccgaatgcagacagatttcctttcggatacgtcgaatcatctctgggtaactgccagtgctagttccttcggtccaggtagcagggggcaacaaggcctttctggggattatacccgtgtcggcccttaacaccacgccaacttgataattgcttgataaaagg

SEQ ID NO: 5546 - DNA, 659 bp, Aspergillus oryzae
ctccccagcgtgggagccccgtcaacggcaccaaccgctacatacttcaaacttaccgcgagacatcaaatattcctcattgttgcttaatatccagttccagtatttcaaactgtatagttagtcggagagcggcaacccttcaaaaatcgggcttgagccagaaatctcgaagcttgtcctaggtcatggatctgatcaccatccaagattacacaaggtctacacaaaaatggatgaactcacaaggtggcagcggaatgacttggaaaagtttaacattgaaagcgctgttgaattgagtgcatacataccagaggcagttctgcgggcggaactacaccgaagaagtgggatcagagactctgacaatgataagccatcgtgtggctcgaaggatcgaggtgtttacaacactccagtacatgtaatggcactgttcctcattctactgctgagtactttagcttgttcattccctgtacttgcccgtcggttcccacgtctcccaataccacggcgttttcttttcctttccaggcattttgggacaggtgtattgatagctacggccttcgtccatttactccctacggcgtttgtgtccctgacagatccatgtctttctcgattttggagtgaatcataccgcgccatgg

SEQ ID NO: 5547 - DNA, 666 bp, Aspergillus oryzae
  misc_feature (1)...(666): n = A,T,C or G
ctgttctagtgaaaagcttcacgtcagaaagccaaaaactcttttattatcagactatctctcttatttacgatggctctactcgaacttcccaacgaattactacttcagattatcgagaacctggagagcgagaaagatattctttctattttgttgacaagccctcgaatatatgctatccagcaagcgggccctctatacaaacacaacatccaattctccgcgagctcagcgctgggatggtattcggcgagagggcgtatatcagctgtggaggcactgctcgaaaagggcgctgacctagagagcagatgcgatgttggtggcacacctatagtatatgctgctaagtacggacatgagagtgcggtcaggctgctgcctgaaaagggctctatagtaaatcgacccactttgtgctggccccgctggacgccactaagttgggctgttcataatgagcataaggatgtggtcaggctgttacttgagaaaggttctgatccgaagttcaagggtacggaatatgacgagattcagttattaggagctgcacaatttggagatgcgaaatttgttaatctactgctcgagaggggcactgacctanaatgcaaccactatctcggtcgcacaccattgagcaatggtgcttgccatgga

SEQ ID NO: 5548 - DNA, 537 bp, Aspergillus oryzae
  misc_feature (1)...(537): n = A,T,C or G
cgaggctaagttgaacgcacttggaaactacctaagctcagatgagagcccattgcaccgcttccgccagaaggatgccgacatagacagcgtgatcgagcctatcctagtgggctatggaaagcgacacggtatcgaattggaagaaattccagaggctttccacccaatcgccggaaagaatcaaatcaaagatctgcacaaaatctactttgacgacgaaagttacaataaaggtcacggccatgtatacgaatacctcggtatcagccccgagaaaggtgcagttgtgattgtcaaaccagatcaatatgtctcggccgtgattggactggacgattaccggcagataggccgcttctttgaaggattcttgattcctcaaggtgaatccgcctctccggagagcaaattataaggggttgccctcattggatgtgcatactatgtgataaaacacattcagatatgacgatcatgaacatgaacaatnnnnnnnnnnnnnnnnnnnnnnnnnnnnnnnnnnnnnnnnttcct

SEQ ID NO: 5549 - DNA, 616 bp, Aspergillus oryzae
  misc_feature (1)...(616): n = A,T,C or G
gcgtgcttgtagacgatatcttgactatcttcgattacgttatagtctaattctccagattcgggcatttctgccatggctgaagaagacaaatccaataccaacaagattacctcgggcccatatagtcctaagccggagtctcctacgacggcacgccctctagattttgatgatgaacctcaagaatctggcattacctcggtgtctgcagctgtagctcagcagcatgcgacagacgttgccccgcagaagccgccgcgtccactgagcccgcaacaacagtccgaaacaaccctcaaagaagcgtttccaactattgaagtgtcagtaatcaaggcagtcttggtagcgagcaattgggacgttgaacgcgctttccatgctctccttggtatgactgaccccagcgctgccgagcaagatgttcctcctccaaagccacctcgcccctctgcaacacagagacagttggaagcagatgaattgtatgctcgccagcttgcggagcattacaatcgccgtggaccccaatcccgcttggagggtggtcatccatatgatcggncanaaaggacagtgagctgttggaggacagagagtatagtttttttgn

SEQ ID NO: 5550 - DNA, 671 bp, Aspergillus oryzae
ctctgaactgtcttcttgacatccatccacccatacatcatacacaatgccttccaaccgccagttcgaccccaacttcactccctatgtgatcaactccatgggacccaagacccccgagcgcactcgtgtgctcctgggcgctctcatcaagcacatccacgatttcgcccgcgaggtcgagctcacccccgccgaatggatgcttggtgtcgagttcatcaactccatcggcaagatcagcactcccatccggaacgagtgccaccgtatctgcgacgtgatcggtctggaatcccttgtcgatgagatcgccaacaagatcgtcacccgaagacggtgtctcccccacctccaacgtcatcctcggtcccttctggtcccccaacgctcccttccgcgagctcggcgacagcatcatccaggaccccaaccctaacggcaaggtcacctacatgcacggagtcctcagggacatggagaccggcaagcccatcgagggcgccggtctcgacatctggcaaagcttcgccaacggccagtccactttcaggaccccaaccagaccgaaaacaaactgcgccgcaagttccgctccaacaagaaaggcgagttctgggggacttgttccaacccaccccttatttcttgtccacctacaggcccacagg

SEQ ID NO: 5551 - DNA, 651 bp, Aspergillus oryzae
  misc_feature (1)...(651): n = A,T,C or G
ccacaatggctactcatctcaacttcgtcacccttgacgtctttaccaccacgcccttcaagggcaaccccctgggtgtcgtccacctccctcctggggccccgctctctcaggcccagaaacaggccattgctcgagaattcaacctttcagaatcagttttcatacatgatgtcgacccaagcaacgaccccgacccgcacacccgccgcatcgacattttcacgacgaccgaggagctcccctttgccggccatcccaccatcggcacggccagctacctccaggcgcaagggatcaacaagctcatcaccaaggcaggtcccattcccatccgctccgatgcgggagaagggctcgttagcgctgctattccgcacgacacccatctcaactccaaggttctcggccacatcgagtcaactcttcgtgcggaccgcctgcattccacccccgagattcgctcagcagagcttcaagctcctattttcagcatcgtgaaggggatgacttttgctcttattcccctcccgagtctggatctggtatctcaggttttaccaggcgctntcccttgtgcaatgcgcgacctttgtgatgtagaatggagtgagacgttcatcgggcggtactattatgttattttcgggg

SEQ ID NO: 5552 - DNA, 1294 bp, Aspergillus oryzae
cacactttgaccggaaatactcgcctcagcctctgctttcacagggttcgtcaatcttacgtgcttacgtttacgtatctacattgaagcgattcccattttacgtcacgcgactataattcgttcgactgtttcacacgatcactgccccacagagagtctgacacaatggccacaccaccatcgtacaccaagactacccacaccgccacatatgctggcatcaacccaactcagccgggcctgtccacggcgggcaaggttgtgctgatcactggcgcatcaggcggcatcggccgagccacagcctcatccttcgctgcatcgggtccccgagccctcatcctcctcggtcgacgcgccgacgcgctggcagaaacagccacgattgttcgcaccagtcacgcagaggtgacgattcaaactcacgaggctgagctgtgcgatgctgcgagcgtacgcaatgccatgaacaaggtggctgcggagtttggcggcatcgacatcctcgtccattgtgccggcgtcctggcccccgtcgtgcctcttctggaagcggatccggctacctttctggacggctacaagaccaccgttgtcggtacactggtaacggcgcaggctgtcgtcctggcaaacaggaccgtcagtgccagcgaggacaagccagtcacctttatcaatctcaccacggccggcatcctgttccccccattccccggcatgggagcctacgtgagcagcaagatggccgccgtcaagctcttacagtcctttgccaccgagaatccgcaagtgcgtcttcacaatgtgcatcctggactcctcagaacggccatgtcggccaagctggcagagacgatccaattgccatatgcctatgatgacatcactcttcccgccgatttccttgtctggattgcctctcccgaagcggagtttctcaaagacaaaatcgtcttcgccgcttgggacgttgatgagctcaaggctcgccagagggagattgtcggcggcccgccaggaactggtgagctctggcttggctaccaaggattcccgcgattcatcgctggccagcctttgtcaggaacccagtaggcgaccggtacatgtatgggaagtcgcccatcccagatcaaggggactattgcacgcgagcgttgatcatacaagtagatgaacgataaattcacacattagagcgctagcgcaaagatttgcaatgaaatgaatgctagaaagtatattgctccgacgaaaaagacaaaaaaccacgctatccaaaattcct

SEQ ID NO: 5553 - DNA, 638 bp, Aspergillus oryzae
tcgggtcaggaaactcgtatttagcgcagtgagctgaactttgagactggcacctgtcattgaacgtctgtcatgatggcgcttcctcccatcgcgaaggccactctacaagctgcgctgattaatgccgggtcaaatatactggcacagagcatccagtcatatagagatgagaaaccgttcgaactggatctgcaaacactgtttcaattcacaacatgtgcctttgtgatgtcccccatgaccttcctgtggttggaaggtctggaatcagcacttccaggtcatactagcgaggagcccgccgccaccaagtcaacgaccgaaaaggcggataagttcaaacaaaagaagttaaatgtgaaaaacacggtggcaaaggttgtgatcgaccaagtcgtcggtggcgcctgggctaccgtcctttttagtttgaccatgggactgctgcgtgggcaagagtatgatgttcttatggaccagattcgcaaagatttctggcccctcctgatcgcgggatttaagctatggccattggtttcaatcctgaattttactgtcgtcccagcagataagagactcttggttggtagtatattcggtgtcgtctgggctggttacttgagcttgatgtctgg

SEQ ID NO: 5554 - DNA, 637 bp, Aspergillus oryzae
  misc_feature (1)...(637): n = A,T,C or G
ctctgggaagcactggtagcccgctattcacagccgagcctattgtagaggtcgcaaagaaaaagggagtcacccccgccacggttcttctcagctggcacattgcccgtggatcctccgttctcgccaagtccgtcacaccttctcgtattgaggacaaccgcaagttggttcaactcgacgagtcggacatggctaccattgccaaatacaccgacgacctcgctgccaggaaagccttccagcgcttcgtctaccctcccttcggcgtcgacttcggattccccgacaagtcataaactgtttggagtctacctaccaagcatctcctggcacatatgaccaccggatgcgaaaagcagggctttccatccaccttgccatacctctactatcgtgaatagacagggcaaaatctcagtgaaccattaggcttattatttccttatagagaggcgttatgtgcccgttagtggtgagtgtggacgatttgagtgagcattgtataacagcctggggagcctggataaatagttntgattctttggatttgtttatagatagacgacatatatccctcatgaatgatgttccaggaagcttctcccctgcttgggtcaattgtctatgcttagga

SEQ ID NO: 5555 - DNA, 1495 bp, Aspergillus oryzae
ctcgtcagcgcctactctgctgctggcctgttggcaatcatcgtcctaaatctgttgcgccagctcctcttccgtaataagactgatccaccccttgttttccactggatccctttcctgggtagtaccgttacctatgggatggacccttatgcgtttttcttttcttgcagacaaaagtatggcgacatctttaccttcatattgcttggtcgaaagatcacagtgtatctgggcattcaaggcaacgaattcattctcaatggcaagctgaaggatgtcaatgccgaggagatctatagcccgctcaccacgccagtctttggctccgacattgtgtatgattgtccaaattcaaagcttatggagcagaaaaaattcataaagtttggccttactcaggcggcactggagtcgcatgtaccattgattgaaaaagaagtgcttgactacctcaagacatcccccaacttcaaagggacatctggcagggtcgaaatcacggatgccatggctgaaataactattttcactgccggtcgagcattgcaaggcgaggaggttcgcaaaaagctcactacagaattcgcagacttgtatcatgaccttgatcgggggttcactccgatcaacttcatgcttccgtgggcaccgctgccgcgtaaccggaagcgggatgcagcccatgcgcgcatgagggagatctatatggatatcattaacgagcgccgcaagaacccagaccgagagacctcggacatgatctggaacctcatgcattgtacctacaagaatggacagcctctgccggacaaggagatcgcccatatgatgatcactttactaatggcaggtcagcactcatcgtcatctatcagctcttggatcatgttacgactagcctctgagcctgcagtcatggaagaactctatcaggagcaaatcacaaagctcagcccggatggaagaacccttccgccactgcagtaccgcgatctggatcttttgccccttcatcaaaatctcatcaaggaaactctgcgcttacatctttccattcactctctcatgcgcaaggtcaagaacccgatgccggttcctggcacaccttacgtcgtccccgcagaccacgttctactagcatctcccggtgtgaccgctctcagtgacgagtacttccccaacgcatcccgctgggatccccatcgctgggagaaccgggttgaaaaggaggatgaagaggacattgtcgactacggctatggcactgtgtccaaaggaacatccagtccttatttgccctttggcgctggccgccatcgctgcattggagagaagtttgcctacgttaatctaagagtgattgtggcgaccatggcgcggcacatgaagctattcaatgtagacggcaaaaaaggggtacctgccacagactacttgtccatgttctttcgtcccctcgaaaccaaccaatatatgttgggaacgacgcctc

SEQ ID NO: 5556 - DNA, 413 bp, Aspergillus oryzae
gtcgcctgcgtttcatggagatgatgtgtgtcattgtcacaattggaactgcgatccagactgcttcggtaaatattgggatgttccttgcaggccgcgtattggccgggtatgctgttgggggattggtggcaactgtgcccatttacttgagtgagatttctgacccccggtatcgcggtctcattggtgggatctcgggatgcgggatttcccttggtactatggctttccattgggttggatacgcccgcagctttgcaccggatgggccagtccaatggcgaatttcacttggaatttcaaattccggcggattaattatgttcttcgggttgaaacaccttatgcctaaattctccggggaactttgcttccaactgggaacgtcttgccgaccactctaaataact

SEQ ID NO: 5557 - DNA, 684 bp, Aspergillus oryzae
  misc_feature (1)...(684): n = A,T,C or G
cgccctcaagacgaggtttaatttcttgcagaagccgaaggtctgaagatattcgtccatgcgacaaaccagtcaaggaagatcaataacaaccgttatctggctctccgatcctggacggaactcattacgacaatgctcacttgctccgaaattgaaggtggacggaaatcgacattcatactgcataccattcaattgattcttcccaagcttgaagccgctgttgaagaggatcttcctgaggcgaccgaactagcacgcttagctgaagttntagttacaaaactggaatcaagtgcaacaaaagcaaattcggcccggagaagtggggatgtcatcgatgagaagctccatcaactcttccagatctgtgttagaggtatcgctctggcgacaggaaatgttaatctccgagaaactttctacaacatatgcttatcctacatcgcccgtatcatccagcccgatacaggacacgagagtatcaaacagcatagccatcagattgtcaagatggctggcaccacactgattgaaccgatatgcgatgatgcatatgctggtcaggagacatgtcccgtgtctgctcttatggtcctcaatttcctggcgaccttcgtaaaccaggggagaatcaatttggcttgagtcaatttcccagtcaaataactaaaatttctt

SEQ ID NO: 5558 - DNA, 721 bp, Aspergillus oryzae
aatataacgccaactccacggccgcggtctagacgtcctcatcaacaacgcaggaatccaacccgtgaccaagggaggggcagaatacatggataatctcaccgaaacattcaacacaaacgtaaatgcaccccacgaagtaatccgtacattcctaccccttctccgcaaaggagaccgaaaggttattaccaatatatccacgacgttaggctctataggcacggcgtcacctttcatggcgaaattgactccggcgtataatataaccaaggctgcgttgaatatgcttactgtgcagtatgcgcttagtcttggggatgaggggttactgtcttttgtctaaacctgggtggttaaaaaccgactagggggaccaaaaacataactccccgtttcaccggtgcaaagcaatggcaaaaataatccttaaggccaatcccaaaaaacaaatgggaaattcctatatagtaatatccccaggttgataaacataaaaggggttatatatattcaaagggtcgcaaaatccccttgtgatgattacggatgacataaataaagtttttttaccacggacgaccggtgggatataaatcaattattaactatatccctgtctcagtatactaacaattaataatgtatgaagacatatcatagaatagatatagaatgatatatactaatagcttggcggatgcatcattggatctaacca

SEQ ID NO: 5559 - DNA, 664 bp, Aspergillus oryzae
gaaccaaccttgttgtgtgcgtgtctttccttcacctacctctccttttagaccatttccccccgtatatcatcccatatcgagtaaaggattgatccacggttccatccgatctagaagatccaaggaatcgaacactctggttctggatcctctccgttgcgtcccctttccaggatttggttctcagcctcgttgtgtacgatcatcaagaactgactgtacaccggatcattcgctttaagcgccgttcgctatctctgttagtccaaagttttcaaatctcgcattcggggccgtttcagtcattgtcatatctgtaccgaaattcctacaatcctcgacgaatcgtttgacagcagacacaacgccatacctaccccgcattcaaccagaacgaatcgcggaaactgtttctctatcagaatctccatggcgtacgaacttgcttaaagcgttccaaaagtatttataaaatgggagcgtatcgtttgaacgaattccacgaatatggtgcagcaacttcctctccaaggaagttcacgaaagatccccttcaacgtttccgaccaatatgaaattcaagatgtcaattggtgaaagtgcctacagtgttggtgtgctctgccatccacaaaccaatctggtcaaaaaagtcgccatc

SEQ ID NO: 5560 - DNA, 698 bp, Aspergillus oryzae
gcatggctatatcacaattcggcacgaggcattatcaacgtctactcggtctgttataccaaccatagaatacactacgtacgtctttatatcggtttctgcatgagagcaagttcattcagatagtaccgagtataccacggcaataatgtgcggatcggacatcttcctcgcgatcctcgcgatattcttcccaccggtttcagtatggatcaaagtaggcatttgtacagcagattcgatcatcaaccttgccctttgttgtctcggctatgtgccgggcctactacatgcctggtatatcattctcaaatatccagagcaggaccctgatgatccatattacgaaccggttcccggtaacgcccatcgaagggacgtcgaaaacggccatgtgacatactactacgtttctcatcaacagatccagcacccgtctcagagaggctacggcactgtggcaccaactacggcgacaccccccctgcaacaacaatcacagtccactcctaagccccagaatgagcccgcagccggtagcagcggcgatcaaacacagggtgattcgcgaccaccacccacgtatgccgaagccgtgaagggtgaccataaggtacaggactgattcaggcatgcgtggaagtccttcctaccactatctagccatcgcttatctgaaacgctgctatgcgtaaggg

SEQ ID NO: 5561 - DNA, 672 bp, Aspergillus oryzae
cattttcgactgactctctgcctttgcgtcagtgttagatcggcattagtagtattttccacctttactgcctccctcctttcgccatgacgatgcgagaatatgctggtggggaccagcaaaaccccaccggctatggctatgggggaaacaacaactactatcctccccagccgaaccgacaaggcaacccatctccccagtcctataaccacccgaaccccagcggctacaatccgtaccctccatctggttcaaacccttccgagacaaattacaactacaattctgggaatcagtactaccccacgcagactgaatatcctcagccgcagccatggggtggaccctcccctccgcccgggaactactaccagcagccggagaaccgatcataccataaccctccatatgggggacagccaccatatccccattctgaatccccgcggcccaaccagacggacgcctaccctcctaaaccctatcctcctccctccccgcaacagggcggttacggccaatacccgccggcgccaccaccatattcccctcagcccaccggtagcaccgataccccgaatgctgaaacggaagaaaggacagaggattcctcggtgcggtcgcgggcggggcagctggtgccctacggtggtcataaagtcaatcacg

SEQ ID NO: 5562 - DNA, 702 bp, Aspergillus oryzae
  misc_feature (1)...(702): n = A,T,C or G
gattaccttcttccatctcagaagatatcaatcacttccatacttctacctccacactcctcaaaaaaccatctacattctatacacaactccttcaaaatgcagttgactcttctcaccaccctgctcgtcgccacctccgccctggctgctccccagatcgacaacctcgtctcccaggcggaaggtatcgcccagaccgctgagaccggtgtccccggcgctgcctcatccatcacctctgccgcgggcgccgccgcctccagcgcagagagctggggctcctccgtcgcttccgacgcccagagcagggcctcctccatcgcatccgaggccagctccaagctgagcgacagcctgaccaccctgaccggcaccaacggccagcccacttccaccggcctcgtctctaccacctccgccagcggaaccgagaccaccactgccacaagcacctccaccaccggtacttcttcttcctcttcctcttcctcctcagctggcagtgcctcctccaccagcagcgacggtgcaggtgccatgcccactcctttcagcttcngtgccgggtgtcccggtgtcgccggtgtcctgggtgtcatggctgctctgtaaacgaaccacgaataacatgctagaaccgtcgctatttttggtacgaaatactatgttacactataccatgaatgaaggcgggaatan

SEQ ID NO: 5563 - DNA, 1291 bp, Aspergillus oryzae
cactcaactaaaatcatcacaatggttggaatgggccacaaacgtccctcatcctgcaagggatcgatgcatgagctgccccagaacctgttggagcagatcaagcaattcgaggacatctttaccgtggacggcgccaaactcaagcagattgcggaccatttcgtgaaggagctcgaaaagggtctaagcgtcgaggggggtaacattcccatgaatgtgacctgggtcatgggattccccgatggcgacgagcagggaaccttcctcgctttggacatgggcggtactaatctgcgtgtctgtgagatcactttgacggaagagaagggcgctttcgacatcacccagtccaagtatcgtatgccggaggagttgaagacgggtacagcggaggagctttgggaatacatcgccgactgtttgcagcagtttattgaatcccaccacgagaatgagaaactgtctaaactgccattgggctttaccttctcctatcctgctacacaggaatacattgatcatggtgttctccagcgttggacaaagggtttcgacattgacggagtagagggccaggatgttgtgcccccattggaggcaatcctcaagaaaagaggccttcctatcaaagttgctgcgttgatcaacgacactacgggcaccctgatcgcctcttcttacaccgactcagatatgaaaattggctgcattttcggcactggtgtcaacgccgcctacatggaacattgtggctcggttcccaagcttgcacacaagaatctacccccagacatgcccgtggccatcaactgcgagtacggtgcctttgacaatgagcacgttgttctgcccctcacgaagtatgatatcatcatcgaccgcgactcccctcgcccaggacaacaagctttcgagaagatgactgcaggtctttacttgggagaaatattccgtctagccctcttggatctgttggagacgaggcctggtctgattttccagggccaagacacattccaactccggaaaccttacttgctggacgcgtgcttccttcgcactatttgagatgatccgtacaagaacttgtaggaaactcaagagctcatggagcgcaagctgaacattagggcacccatcaggaactggaaaagatccctcccttgggggaattgatatggactcttgcaccacggtttaaacgttggttggggaggcaccctcgagatcacaaaggggcatctttttgtgtaagctcccctcgtatagggactcgtggtttactccc

SEQ ID NO: 5564 - DNA, 660 bp, Aspergillus oryzae
ctaaagctgatgaggaggagctgctacagaaccttagggctttggaggcgaagaaaggcattcgcagtcaggatgacgacgatgaaatggaactcaatactcccccagttgaagaggagtctgataagcccgagaagccttcgattgttcgcttcgaaatgcctcatatgcggttcaacgcacagctcactgtgcaagatgatactctgttcatcttcggaggtacctatgagaaaggtgatcgtgaatttacgtttaatgacatgtactctatcgatctcgtcaaacttgacggtgtcaaggagatcttctataacgaaccagagaactggaatctccttaacgaggaggaagagagcgacgatgaaatggacgacgacgaagatgatgaggaagaggaggagggagatgaagaggaagatgcgatgtcactggatactggctcccccgctcctacagagacaacggttccgtctgtgacgcaagaaatgggacaactcgaggtagaggagccagagggagagcaatctgtacagggtagtaggcctcttcccggactttcgaaagcttgcgtgagtcttcaaacgtacgtctgaagagtggcagaagattttgcttgaaaggtttaaggaaagggtttggagccgggatgaatattac

SEQ ID NO: 5565 - DNA, 715 bp, Aspergillus oryzae
gaagcctccctatggacaacgctttggtggacctggtttccctcctggtccagggttccctaatatgccctatggagctcccccaggatggttccctccccccggacaagggttccccccgccaggccaatttcctccccagatgccaatgggtcctggaggccagcatcagaccccccctccaccgcggccgatgcccggtgcgggtcccatgaacatgcctaagaacacatccgaactaccctctgataagccctccagtaagcctggtagccgtaatggcacgcctgcacctagtaatgcggcccaaaatgcccccacgccgcccgttgagtctaagccgccagtttcggaggctcttcaagcggcgactggtcctactcaagttacggctggcactgctaaggcgccacccactggacctagaagcggacgtgtgcagcctgccatacctattgccgcccctggtaagccgccagttcctcaggttcctggccccgctggggtcccacaaggccaggcttaggcagcgatcactgaagctactcgtgctgctactggccgttgtagcagctgtcatgggtaagtttgcccaaacccggtgcgcaaaaaaagacccgccgatgtttccgtgaaggggggtactaatcaaattgctgaaatatgttcctctatcaccctcggtggacacctgagcgggtttctcctcctcacc

SEQ ID NO: 5566 - DNA, 695 bp, Aspergillus oryzae
  misc_feature (1)...(695): n = A,T,C or G
cttcctgggcacttgtatctctctcgtaaagcgacctgttcagggtacaaggtctctatgatatctgagattctcttgttagtaggctcagacttcaccgtcgacgccatgttcagtttacggcgacaggcagggcataggtcggagtggtccagtgccattgcaacacatctgcgacagaaggtatggccacaggatgttgttaatggatccagtataagcgaatagcagacctggcagtccagctcattctgaacagcgtccttaagtctttcgaaacgctggttttcctggtctataggctcgtgcatttcaaatttgagatctgacgcatcatagtcgaaacgaccgtacttgactaggtcgtacataccctctaataatcctccggcagcatctgcacttttcgccactgtcccgggctgatcacctctcaatcctgtcatgtcactctaaagccacactcgtttcccagaggcgcctccgaaccagcactagaattgcaaagcacccgattaaaaacatccaccagcctactcaacagcacatcggccccccagtcacctaaacaatgttttccaacccaaccataattccgtaccccaatggcttgtgaatcccattttttaatcgtccctcgacgggatatgtgattcccgttccctcataaattgggggcaagcaaaaaccaatan

SEQ ID NO: 5567 - DNA, 663 bp, Aspergillus oryzae
gccactacatccgattgctggaagactccgtgggtcgtcgtcttgatagtgcttggcgccatcgctctggcctgtttatatccgtacgagaaatactttgcccgccacccggtcgtccccacccactacttccgtaccttgtccgttgtggtctcaatggcgttggcatgcgttgacaacatcggatttggaaccacccagacctacctgtacgtctggtccatggtgtcccaccggactgctcatgtatcgattacggtcgtacaaatggatcggggtggtgggcgccgccatccgaatggtcgggtacggagtgatggtccgtctgcgcaaaaacgagagctccgtcgcggaactgttcatcgtgcagctgatccagggcgctggcagcggcatgatagaaacgatcgtcatcgtcgcggcacagatttctgtgtctcatgccgaactggcgcaggttacgtcgctcatcctgctgggatcgttcttgggcaatgggatcggctccgcgatcgctggtgccatttactccaatcaactgcgtgaccggctgcgtttgcatctcggacacagtgttgatgaggccaccgtcgtccggttgtacaactccattacggatacgttgccgaactggggaacggtggagccaaatgccggaaaccc

SEQ ID NO: 5568 - DNA, 721 bp, Aspergillus oryzae
  misc_feature (1)...(721): n = A,T,C or G
cttgattctagcatccaacaatgtctcttcgttgaatttccttccagttcccgtcactctcttatttctctttaccgaccatggcgtcccagagtaacttcatggccgccatgaccaaccggtcgctgcgcactgtccgattggaacttgagttccttgcggatgcgtcggtcattactccgcaacaactgtcctcgatagtatcccaactaccccaggagaacactgaacgttccgcctctgtacctcaatcggtacctcaatcgcagccacctgtccagcgtcaccaaccccctgttgcagccccaactcccattcaaccttctccagccccatactctcctcccacccaacagtttgccaatacctcgttgaacgagaaggccgcctatcaaccgcccccgcagcattatactcccccaccgcctgcttatccccaagctcccgcggtgctctcggtcgctaatgcgctctacgcttacactccaacggatcccggtgatctggctctccagccccatgatcgggttcaagttctggagcacatgaatgccgattggtggcgtggtcgtaatgagcggaccaacttggagggtatcttccctcgtaactatgtgagcgtgatagaaaacanggcgcgccaagctctacgagttacggaaatatgcccctcgaagtcaggcagagtgctccgcttgaaaccccgacgaataaaaaaccg

SEQ ID NO: 5569 - DNA, 1071 bp, Aspergillus oryzae
  misc_feature (1)...(1071): n = A,T,C or G
gagaggtccactactacatatataaatcacatcctcatcctttcgtccaccagagttgtagtcaaagcacatccaagtgaccatcccaaccctaacagacacaagaatggatcaaccagtccaactcctctcctaccaacgcctcaaatcaaagagtaccttcattatctccctgcaacacggaaacggcaccgcaactcccatctacgaagtcgcatgtttatcctcgaaaccgaacctctccatctcccgcctgcagcctgcataccagcagcaaccaccaccaccgcctcaatatggctatccaccagcaccaaacccatactaccagcaaccataccctcctccaaacccatttccaccccagcaatacccgatgcacccccaatatccaataaacaacccaccacccaccaaaacaaccataggaaccgtttccctctcctccatgtcctccaaaatcaccatctcaattcacaacatccccgaactcaaaatgaagcgtccggacttcctcgcctccgggcaccaattcacccatccccgctacggcaccctcgaatggaaagaaagcgatctccttgagaaacgctttaagcttgtcgactcgaacaagaccgtgctggcccggttcgataagtggaagttaccggaccaccagcggcaggaatcgaaatcgtccatgtggggtggttcctcgtcatcgacgaagaagaagaagaaggcgtgggcattccaaatctttgtaaatgcggatccggagctgttggattggattgtggttagtggattgggggttgttgagtatcggatcacttcggataaggagtgggaggaggagcttttgggaaatgaggatggttggtcggctttgttggggtagtttttgtctcttgtctaccttgcttatacattttgtacctggaatcatttgtgctggcatactttttcttggatggtgacagacttattgtaaggatgaacttttgtatgtacgggattactggctgttcgctatgagaacttgttctctgnnnaaaaaannnnnnnnnnaaaaaaaaaaaatttcct

SEQ ID NO: 5570 - DNA, 450 bp, Aspergillus oryzae
tgacctccctctcctacatcattgagagttagtgccctctcttcacctccttacgatcctatcatgtctgcttcgtgtttggcgttgagacggctgacccaccggtctccccgcactttccagtcccgcatctcctccgtctccagaatctcatctgccgcatcctccttctcctccctcaacgctcttcgcgcagttaactcgaccgctcctcgagtctctcgtttctcaaccatggcacctcttcagtctggctctcaggatggcgccctccagaagccctacgatcccgaaattcaggacatggccaactatattcacaactacgaggttaactccgacttggcttatgacactgcccgtcttgtgttcctcgataccctaggctgtggattggaagccttgaaattcaaagagtgcaccaagcttttgggtcccgttgtggaagga

SEQ ID NO: 5571 - DNA, 656 bp, Aspergillus oryzae
  misc_feature (1)...(656): n = A,T,C or G
gcgcgagaaacatacacaccaccaacgccgccatgcctgtgaaacgcaccaccgccgccacggcgactcccaccgggaccaaatccctctcctccggccccaagaccctcacggccaactcctccgtctccgacatcatccacaccgtctggcagcagtacctggcgaccacgccgcaacgaacaatgctcctggatgtcttcatggcattcctggttcttgtcggtggtatccaattcgtctactgtgttgttgcgggcaaccatcccttcaatgccttcctaagcggcttctgtgctgctgtcggtcagttcgtcctcacggctagcttgcgtatgcagacgagttcctctccttcccagggttccggtaagacgccttcgaagggaaaggatgggaagagtgttgataagggtggggtttcgcatgagagggcgtttgcggattatatctttggaagtttgatcttgcatttcttctgtattaattttattaactgattgattgaatgggcttttggtatggggttgtggtggttggtggttgtgaagggatttagttagttccctgggtggatccttgtgtttantaggggttgttanggttagattanatggggaatcattgatgtggttggtcccttttctttcttcctt

SEQ ID NO: 5572 - DNA, 636 bp, Aspergillus oryzae
  misc_feature (1)...(636): n = A,T,C or G
ggattttaaattgtcatctgttcctccatcatctgtatactaaaacgtgctggctggccacctcatcggcggacttatttccccctccacataactacctaaccaatcaattactcatctgtttctaccttcctccacctccatcatgagttctggatctcctcaaggcccgaagcctaagtccgctgttccacctcgtctgttgaacgggagctcttcgctcaattccaacatgaactctcgtggtgctcgcgaaagggagagtctcaactcatctattcgctcctcattcgccccccgtatcccggcagagttcaatttgccagagacggtcgcacactctgtcgacgagtctacccatgtcactaacgaatcgaatactgactcaggcgcggtaaagccatctttgaatgacccgccccgtgatccaagagatgacgcccgggctttgaccccaccgtcgacagctagccgcccggcaagtccatacacgctatatcctcctatcgattttgacggactgagctggccctgccccggcacaagggcgcggttggagtcttcgcccgaggaaacggangaacgagttcaaaaattggcaggtgcagtgagaaccattctggagtgcattggagn

SEQ ID NO: 5573 - DNA, 672 bp, Aspergillus oryzae
  misc_feature (1)...(672): n = A,T,C or G
ggctctacctgagtcaatcgacataaggagttcctgcttctaagtacaagagattgtatatctccaatccatgttgacattggtgcagcactcacgtggttgtacgtccttcatggccgcaagattgtctatttcccttccacgatcaatcttaatgcggttcgcttactggcacaacttgggtcggaacagttcaacggatatgacggtggctggattcgagtggagctacgaccaggtgatctatttatcatgcccccatcatgtccacacgctgtcttcacaccagatgattctttagttgtcggtggccacttttatacctcggcccacttaccctcaacactggaagggttcaatcttcttgagcagaagcaaggcatctctaatgaatcgttagaggatagtcactacgagacgctcgcagagatctttagttcatacgacaaagttgcgacaccggaggaggtcaagcgtgtctgggtaacttgcgatctgttccttggttcgcggacaaaaccccggccaaccacatcccgcgccaaatttataaattctctaggggattgttataacagggcggctgaaagcttctcacaagaaccagaataattagatacaggtgacagagagagagggagaaatgcattatacccgaatgcagcccctttn

SEQ ID NO: 5574 - DNA, 797 bp, Aspergillus oryzae
tggaattgactagtgcactatggaacgaggcttagcattctctctacttacccccactttggaagttctaatatctctcttcaaacctcacattacatctacactttacttctatacatagaatacaatacaatacactacagccatcatgcctaagattaccgaaatcttctttgattgtgacaacaccttagtcctctctgaggagctggcctttgaggcatgcgccgaccttacaaatgagatcctggagagccgcggtatccctgatcgctacacaggggagcagctgattcaagacttcgtcggccagaacttccgtggaatgatggtctccctccaagccaagtacggattcgagatgccccaagaggaacttgaagcgttcgttaagaaggaggaggacaaagtcatcgctaagctggaagccaaagctcagccttgtgtcggtgccaacgaggaacttgagaagctgtacaaggccaagaagtaccacttggcagttgtctcctcgtctgccttgcgccgcgtccaggcctccatcaagaaagtcggacaggacaaattttttgacgaggatatggtcttcagtgctgccacctctctcccgaaacccacctctaagcccgatccagctatctatctccacgcccttgaaaagtgcaataagaagccggaagagactgttactatcgaggacagcaagtctggcgctcttagtgctatccgcgccggcattcacgtcatcggttacgttggcagctaccctggtgatgagaagaaggtcgaaatggcca

SEQ ID NO: 5575 - DNA, 637 bp, Aspergillus oryzae
ctttgacaaccttgtgattgtccctgatagatatctataaaccattatggcttccaagactttcaacgttggtgtggtcggatacggcttcagcgctaaaacatttcacattccttttgtttccgatgttcctcagttgaaactgtacgctgttgttcagcgtacaccaaagcccgacgatgatgccgagaaggatcaccccggcatcaagtcctatcggactgccgaggacatggtcaaggatgacggagttgatgtcgcattgtcactaccgcccagactctatttaccagtgaccaagtaacccttgaaccacggaaacatggtggtttgcaaaaacccttcccccccaacacttcagagacccaataacctggtggcctttgccaaaaaacaaaccaagtggtgggttgggcacaaaacccggctgtgaatgccaactcacgaaccgctctcaagttgggaaaaaggggtgcctttgcccgttccccaattaaaaactcttttaaccgttttccccaaaaaaccccttccatgttttaaaagggaaaaaaaagggcctccccggggggagggctttccaaaatcccgaaggtttttttttaaaacaggccgcgcttttgttggacacgccccc

SEQ ID NO: 5576 - DNA, 703 bp, Aspergillus oryzae
gagctccgactaagaagattttcgccccacgatgggcttccgcgggttcgctagggcatcgtcacgctcagagtcgcctccgtcgcacggtggcttaggaagtgctcgtcgcaatccctggagtaacaacacgcagtcagccaatcccagaggcggcgccagcaatgccggcaaagggatgaagggaggaaactccttcgccgcacgcatgatggccaagatgggttatgttgaaggtcagggtctcggctcgactggtcaaggtatcgtcaacccaattgaagcccaggcccggccacagggtgctgggttgggcgctgttcgagaaaagacgaagcaagcacgggaggaggaaaaacgagcggcagccttacgaggtgaagtggtagaggatagctcagatgaagaacgaaagaggaggcagaaaaagaaggaggcgcgcaaacagggtagtcgaagcggtactggtacgccagtaccacgcgcgaagcctcaattccgcacagctcgagagatggaggaagatatggctggtctcgaagtaccaaatgtcttgaagtccttggtcgatgccacaggaaaaggaacagcgagtgttaccctttactgtcggcttgatgaccccgtcccaattcgtcaaacccggtgaaggggaagctctcaagattgacaacgggcccgccatgacctataaccctttgag

SEQ ID NO: 5577 - DNA, 706 bp, Aspergillus oryzae
  misc_feature (1)...(706): n = A,T,C or G
cgattaactcgtttgaatgcagcacgaggctggcgcatcgagatccgtgcagtttcgggagcataatgaacagctcgacagtcgnggaaccacaggtctcactacacgggttctctgagaaattgcagcagcgcttgagaactcaccgacctgtgctagtaggacacaatcttttcacggacgtggtatatctttaccgctgcttttttgggccacttccggataagctggaagaattccaagcaattgttcatcatatgtttccaattttgatggatacaaaatacatggctacgcacgattgcggttctatcacccccaaatcgtctttgagtgagatcaacgataaccttctccatataaagaccccgaaaataagtgtacatgaacagcattcgaagtataacagccagagaatcgaccacgaggcaggatatgacagcttgcttactgctcagatatttatcaagctctctgctcaacttcgtgacggaggtatctccaagctcccggatccggtagaactgaaaggtcaatcggatactatgggcctgaacaatacgaccttggctgttccggaaagcctaaagggcagtgtagagaaggaatcggcagcgagaaaaaagccgctcaagacaccgacgagcaccaagcttggcacgagatttgatgcacttgatgttgaagagattaacgaccgagttga

SEQ ID NO: 5578 - DNA, 625 bp, Aspergillus oryzae
tatgaaatttaataccacacacaatatactttatacactccatcccaccctaaattaaaaagagaagaaaagagaaatggccccaagatgcttcataatccgccacggcgaaaccgaatggtccctcaatggccgacacacgggcatcacggatctggcgcttacacctaacggggagaaacgggttaaggcgactgggaaggcattggttgggaatgatcggttgattgcgccgaggaaattggttcatgtgtatgtctcgccaagggcccgggcgcagcggacgctggaattacttgagattgggtgtagggagagattaccctggaatgaagagcggaagagcgaggatgaggagccgattcggacggaggccaaggttgagattacggaggcagtgagggagtgggattatggggattatgaggggttgacgagtaagcagattaaggagatgaggaaggagaatggggaggagccgtgggatatttggagggatgggtgtcctggtggagaatcccccgaagacgtcgtccgtcgtctcgatgccctaatcaccgatatcagggagaagttccatggtccctgtttcgacggtgaagggtggtcaaggagacgtcctgat

SEQ ID NO: 5579 - DNA, 639 bp, Aspergillus oryzae
ttgttaaggtgttctttgataaggctatggaccgcagtatctacgctaagggattcggtgaggagggtcccaccacccagctggagattgaggagttcttcgccccccacggccccgtcaacgccatccgtctccgccgtgccaacgacaagaccttcaagggcagcgtcttcgttgagttcgagtccgaggagaagcagaaggcgttcctcgccctggcgcccaagccccagtggaagggccaggatctgatcatcaagagcaagagagagtactgcgacgagaaggtgcgcgacatcgaggccggccgcatcaagcccagcggtcaccgcccccgtggccgtggtggtttccggggccgtggccgtggtcgccagaacgacaaccgtgactggagggagcgtcgcgctgaggaccagaagcgcggtttcaacggcgacaagaaggaggagtccaaggagcctcgcgagatccaaaaggacgctcgcggtgtccccgtcgtacagagcaccgccgacgctggccagaagcgcgctcgcgagaacgaagccaacggcgaccacccggccaagaaggtcgacgcgaaggagtaatggtatgcgactgatcttgtgtttttttttttcgatagagaatcgt

SEQ ID NO: 5580 - DNA, 653 bp, Aspergillus oryzae
  misc_feature (1)...(653): n = A,T,C or G
cgacttgtacaacgnccatgacgatacactagagatgtgcgttcagtacgggtatctagcactcttcggcgcgtcatggccgctggtaccgctcggttttctactcaataactggctggagctgcggggagacttcttcaagttgagtctcgaatgccagcggccgccccccatccgagccgattccattgggccgtcgctccaaagattggagattctcacttggctcggaactttgtccactgcagccatcgtttacctgtaccgcggcaacatggccgacgtgcgtttatccactctcctcttgatcctccttgcggcggagtgggcatatctagggctccggttcgttgtacggacggctgtggagagaatcgcaccggctcgcttcgcaaagaggccgccaaacgatatgcgcttcgcaagaactatttggactcccttacacgaagtacatctcctaagggtcgacaacgcgtccgcttcgaagaccgtgtcatgtttataccacgggaacagatgtcagaacgaactctcaggagtncctgcaccccgtcatcatgagacataagtgagcagcgcttctggtctttgccgcccagaacacccggacgccgngcgtcggttgataaaaccctctgattggagacggn

SEQ ID NO: 5581 - DNA, 685 bp, Aspergillus oryzae
tactcgggatacgtgatatgctcgtcgatcgcgatcatcttctcatacatattcatctgtacgcctatctcgcactggtggacacaagcgaatgcggctgtagggaagcccgtaccgaaaggagaatgtccaaacttagtcccaaggggccttgcatgtacagctttgaatattgtgtcggacattcttacgttctctctgggagtgtctgggctatggacattacagatggaccggcaacgcaagttcatggttggaggcattcttgctatgggctcagcatgttgcatagtaagcattgtccgattgccgattcttcttgatgctacattcagcaacgatcctacatggtcaaatgcaaactccttactgattggagtactggaaggagcgactggtgttattagcgcttcgttacccggtctggcaccattggtgcggcggtggcagcgcagtgtccaggctcgaaaaggaacgagcagtgatagcgagcgggaataccaaaatagaacgaacacatactcacacaagatgcctgcaagtattggtatccaaggcttgcctggaagatacgttcccatggacgatttgaattccgaccagtctgcacagcttgatacaacaccactatcgccaacccaacaggataggaactctagataactttcaactggtgttgtgctta

SEQ ID NO: 5582 - DNA, 1447 bp, Aspergillus oryzae
  misc_feature (1)...(1447): n = A,T,C or G
cttctctgcaacaccaccactactactaggcctcctcgctcccaaccaccagatgtgtggccaggtaccgcggtgatcgttcttaccatgcccctttcataataataataataatctcacctttcgtctctctttttctgtttcctaccgacactcctttacatgcccttttgcggcaagccattcgtttacaacttctgccatcgcaatgaaattccgattaaatgccattgtccgagcgtcggaaagccgaactatgcagatcagcaatatgtgtcctcgccgacggacgcaattgcccagtcttcgccaattacttctgactgtcattgcagtcccatccgttgttgcatccgtgatcccatccgccgtccggacagatttagattctaccaacgctctcgatctcccgcttagcggcgagatcgtcagcgacgatcttcaagatgtatctgattctccactcaaggaacgtgcggcatgggaccccgtccagctagacagcagtcctgaagaagcagacgcaactcactcgcccatcctcatcgcactggaggagaactcgcagaccagcgagaacaacgacaacaactcccaaccagcactatcccaaagatcgacaagcagcagcagcagtagcagcagtgagacgccaacgccattcgacaccaacctctcgacaaacttcacgtccgacagctgtccgaaattcttcaaaaactttctctcggacaccaaattcaccaactgctacgccatctgcatgctcctccgggattccagctccttcttccaaacgctcaaatccgccccagcaacctcgcacctcctggacctctcctgcgccgccgacgtagaccaatgctcgtccttcatgaccgacctcgcatcacgcatcaccaaatccgacgcctgcggcaaggactacgacctcggcaacccggtcgtgacagacgcctacacggacatgatcatctacgaacccatgtaccgcgcctcgtgtctcaagaaccccagcacaggcgactactgcttcgtcgacgccgccacgaacagctcaaacccctccgactacgacgtctacttcatcccctacgggagcgcaatcaccaacgccccttatgccacctgcaacaaatgcgttcaggcctccatggatgtctttggcgaatgggcgcaaaaaagcggncagccgcttgctcactcgtatctgccttccgcgaagtctattaattcgaagtgtggggttagctttgcgaatgctaatatcactggtgcgggtgatggggagtcttttgccgcgacatggtccgggcgtcngcccgatgggtttttatcgtgtgggtggtccttttaatgttggggcgagctatgggggtgggttatttgtccccccgcctctttcttcatcttttctgtacgccccttcctccaacccgtgagctgg

SEQ ID NO: 5583 - DNA, 687 bp, Aspergillus oryzae
  misc_feature (1)...(687): n = A,T,C or G
ctccatgagggtgacatagcaatatattctagcaagttctgaatcacatttgccaagctgctttctcgaattctcgcactcacgtcttcttttcgccgaacaatgccgccgcccgtagaaaacctttccgacgacgagtcgaccggagaatctatcccttataatgacgcgaaagaagaccgtgactcaggcgccgaaaaccaggaagacaatgatgaggaggtggaggaggaagatgaggagggcgtctatgtcgttgaaaagattctcggtcatgacttcgccaagaatggaactctcctcctgcaagtgaaatggaaaggctacgatgaccctgcagatgagaccatggagccggaggagaacctgctggagggcgcaaaagatctggtagaagaatactaccgtgcccaaggtggtcggcctgagaaaccccaacggggcaagcgcaagtccatgactgggccaaagcagacaacagagaaaagtgaacctaaaaggcgaagatagtcccgagcggaaagctgccaccgaaacttcagatgaagatgatgatctgcctaantggggtncccggntccaagaactgggagaacgagggtgcaagtgttgcaacattctgcccgatgccgaaacttcgacgtaatggattattccttggagaccgtaagaaggtctagttctctn

SEQ ID NO: 5584 - DNA, 709 bp, Aspergillus oryzae
ctccatactctccacatttcattgttcctgatcatcttcactacatctatcttttgattctcgattactttctcttctcacgtcccaccctcaaccatggcttctcctcagaaaatccgtactacccttacggatctgctcaagatccaacaccccatcctgctggcaggtatgaacgtggccgccggtcctaagttggccgcagcggtcaccaacgccggtggcctcggtgtcatcggtggtgtcggctatacccccgaaatgcttcgtgaacagattgcagaacttaagagctacttgaatgacaagaatgcgggtttcggtgtcgaccttttgcttccgcaggtcggaggaaacgcacgcaagaccaactacgactacaccaagggaaagcttaacgagcttgtcgacatcatcattgagagcggcgcacgcttattcgtttcggccgtcggtgtccctcccaagcacgtcgtggagaagctccacggtgctggcatcctgtgcatgaacatgatcggccaccccaagcacgttcagaaagcccttgatgttggtgttgatatcatctgcgctcaggggcggtgaaggtggtggtcacactggtgatgttccgactaccgttctcatccctactgttggcaagctgtgccaaagcataagaactccttgaaccggcaaaccgtgcaggtcgtctcttgaagggggt

SEQ ID NO: 5585 - DNA, 1082 bp, Aspergillus oryzae
cgtctccagcgttaacctactgacgtgtccatgacagaaacctgacataaccacacttgatctttcctcatcgtacaactagtttctccccatctgggacctatattgctggtggggtataaaaacaacaaaagcccaggtcgagcagcagacgccccaacatgtcgactgttgcacctttcaccctcgacgttgcgacatgtctttgcatcgcgtttgccctttccttcatgccagccgcctacatcctaggccggtcgttaatcccctccactcacatgcgaaaccgtgtccttttcttctggcacgcctatgacgccctcacccacatcttcatcgaaggctcattcctctacgaatgcttcttcagctacacaaacctccccgctggattcaatcgcccgccctacttcctcgatcagaaggaccgcgtatacggagctgcatacggaactcgtccaagctcgcgactgtggcaggaatacgcgaaggccgatttccgctgggcggccgccgacgccaacgtgatctctctcgaactattgaccgttttcctcggaggtcccgcagctctctatgtgtgttatcttctgtggaaggcctccagcagccggacaagtgccgcggcaaaaggttccgcgaaagcgaagctgtggttggtggcgcccgctctggcgaccgctgagctgtacggcgggttcatgacctttgcgcctgaatggcttacgggtagctcgcagttggagacgagtaaccctgtatacctatggttctacctgttctttttcaataccctctgggtgtgggttcctctgtgggtgttgtgggaggctaccaaggagctgcgcaccgcctttaccaaggctgaaagtgcaactgaagctcgcaagagcaaataaacaatatcatatcatagattggctcagcaaatgcttgtgaagaagactgtggtgattagcgttatagaatttgcaatttgacgcataagcaatggcgcttatgggttctattttttcccacatataatcatgatgatattcctatatattaataacttccgatatgatgctttgacgtgtggg

SEQ ID NO: 5586 - DNA, 678 bp, Aspergillus oryzae
  misc_feature (1)...(678): n = A,T,C or G
gcccctaataagttacttttttagttgaaatgaattgacactctgcgttgtatattgtcttccgctcgttgatgtccctgtatggggcatactataagcataccagtataatatttcactggcatccctttctgcactcaattctgaagaaggttgatcgtcccgcgccgccatgttcgcggccattaggaatcttgggatattgcaagatggctaacacgagtttgttaaccttcggcttgacaccagatccaagcttcaatgtgttcttcttccttgaactcgtcgtctcctgcatattagtactattcttcttgctttactttaatcgcctttttgcaacccttctctcgtatgggattcgcgcctacacatggcattattatcgcgcatatgtcgacatcaatgcactccaaatctctttgcttggaggacggatcttttttaaaggtgtccgataccacggtgtgaatgagaccatatttgttcacgggggctntataacatggcgttactggaggcgatcggtgaggaggacatttctatacgacctgaaacccaatggatacgaaccgaggaatggtgtgcgatcggtcccggacggggataatgattgcgccggagacagtggaatgaaggagcaaagaggaatgaaggtgcanatttactccctggtcc

SEQ ID NO: 5587 - DNA, 622 bp, Aspergillus oryzae
ggaagggccaaaaagaaaaaaaattgggtaaaattccaaaagttaaaggggggaacccccaaggggatttgaaaaccaaaaattttatttgggggaccccgggggggccccaaaaaccccgggcaaaatctaaccccaagggataccgggcaaagggccgttgccgggggaaaccttcgggcccccggaaaccgggttcttaagggctccggacttaaacccccaagggggaaacccccaaaaaggtttgagcccaacggggaatccgggtggaaaaaggggaaccccacgggaaaggaaaaatttctgggaaaaacaacccccctaagggacctaaaaaaaacgggttttgaccggccaataaggggaaacttgtttgggaaaaaaaccaatctcccgggacccggggggaatttttcccgggaaaaccccgggggccttaaaaaaacccgggtaaggaagggcacagaaaacttttccctggggttaaagggcccaagggaacccccggccccggaaaagaccgcaaagaaaagggaacggcccgggggaaaaaccaccaaaggggaaaagccaaccttcaaaggttgggaaaaaaaaagggtagggaccccgggaaaag

SEQ ID NO: 5588 - DNA, 684 bp, Aspergillus oryzae
cttgtcgtagccttcctccagtgcgttcaagatgctggccggccaaggggtcaaggcaatcgtggtgatgtgggtgatggttattatatcctttattcttgtccctttacggctgtacaccagggtttatatcgtcaaagctctggggctggatgatcatgtgttcaatctgggctgggtattcctcctcttatatacggtcttcaccaccatcgccggaaagcacgggttcggacagcccattactagcctgtccatggatgaagccgtccaagccgtgtacatggaaatggtcggtcagacgttcgccgttctggggatggccattgcgaagctttcattgggtatatttcttttgcggatcgtggtaaaagcatggcatcgaagatcgatttggatctcaatggtcagtctatcagttgtctctgtgatgacggcgattatcttctggacccagcgccttccctccaaggcaatctacgatcctcgtgtacctggtcgaactattgtcagcgttaccccgttctcagtactactcggctcatggtgtgcagcggtcgacttttactttgccattctcccgtggatattcatttgggagctcaacatgcggttcaaagagaagatgacgatcgctatcagtctgagcctaggattcattgccgtatctgggggtcattcgta

SEQ ID NO: 5589 - DNA, 1115 bp, Aspergillus oryzae
  misc_feature (1)...(1115): n = A,T,C or G
ctcgtgacttatcaataatcatcgatcgtccctcccgccacccataaactctctccatttccatctcttcctctctcctccaatcttacctcgcaagacatacccttccgtctctcaaaaacctcaaaccaaacgtcgaagccaataatgtctggactcaccacatctcctccggggtcaattcctgcctctccctccagcgtcaaccaggtctctcggtcatctcgaccagccctcacgcttgatctctccaatcttccaacaatgtctcaaccaaccaagccaacaaataccctcatcatcaccgaactgagcaacattcttatcttccaacccgcctccctcgccactctccgcgcacaacttgagtccatcgcgcccctgaactcaatctctccactcccctctcttcggcggcttatttgttctttttacacagaagaagacgcccttagtgtccggaaactgcttgacggccaactcctcgagcacaacgtccgcccgagagtttacttcggcgaacccaccccaatcctagacgaggaatcccgccgcccaaagctcctggaagccccccatgccgacaagctcttcttcatcagcccgccacccagccccccgcacggatgggtcatgcgcaacgaggaacccccgaacaaggaggtgcacgccagtgatctcgccaccgccttggccaagttgaagaccgagcaatccggtgtctacgagggtatcagccagacctgtgaacccggtactccgatgtctatgacctccgataagcgcacggggagctggcccgcctctatgtccggacagcgcagcagaagcagcacccttatctaccaccctgaagaccacggcggaagccctaacctgcctgctgttatggtcgaagatacgagtatcatggtggacgatttggaaatggatatgagtcccattgagatgccgatccggaaggccccgcccaagacctctcggcctcctgttgaattgatgtgttgaatgcacatgatttgatacgtgatcgttttggcaatttgtgaatacngttgggatatgctttagcgtgtgcatttgacttattttaccatctttgcatacttgcatgg

SEQ ID NO: 5590 - DNA, 692 bp, Aspergillus oryzae
  misc_feature (1)...(692): n = A,T,C or G
catccgtaaaaaagcaactgtatgacgatatcctcccaataattaatgctattgaagagcaagctagggcgatgggagttgaagaccctatgctaccttcaacagatgcgttcgtcacggcaatttgcttcgttgggtcaaaatcactttctcacgtactgtcttgcattgagcgaaacaaagaacggcttctggctattggccccaagtccactcgtgcacgtcgccagattataacctctgtcatggaatattggaccgatcagccaggaatcggtatcaacatcatcgacaagttactgaattacacaatcctaacgccactatccgtcattgagtgggcactggtagacaagctcgaggccgggacgattttggcaagaacacatgtttttgagatgatatcagccactgtgggaaaggtcaccaaccgtctgcgccaaatcgttgcggcacgaactcagccaggtctgtatgagccacagttgagtgttctagatgaaaaccttaaccgtgagaaggcagatatgcaagcgctcttcaaggtaattgaagattcgaatatgtcagtcgccggaagtcacaacgattaattgatggaaaagggtgacngaagttgtgagctcccaaaggattaaatcatcaaacattgtggatgttcattgctgaaagcgtttangcgaaaagccggg

SEQ ID NO: 5591 - DNA, 674 bp, Aspergillus oryzae
  misc_feature (1)...(674): n = A,T,C or G
aacccccgttgggtcttcctcgattctccttctactctcttctctccagtccggagatttactagattcccccatcagaagatatgtctgaagctcaaacgaggtcgtctgcctctcgtggcagggtatccgctcgcggcggtcgcggtggctatagctccagaggtggtcgaggtggcagcagatctgcaaaggcagacaactcagacagcacacccgctacattcgaagacgagggagaaattggtcaaatgaagaagaaatatgcaaacactctacccatgctaaaggaattgttccctgactggacggacgaggatctcgtctttgcgttggaggatgcagacggcgacctcgaggaggcaattgatcgcataactgaaggtaacgtctctcagtggggagaggtaaagaagatgaccacagaccggagccgccctcagccanaggaggcacagagcaccccgaccgagtcgactactgctcccattcgggaggcccgtgactgtgtggatttgagagccgtggtggacctgctccgagagatcgtggccgtggctgtctcggccgtcgtgcttgtacccacaccaatggcagctgtcagagnagccagctgctcttgcacagtggagacagctactcccgagtcaccaagactgaaancccggccgatn

SEQ ID NO: 5592 - DNA, 670 bp, Aspergillus oryzae
  misc_feature (1)...(670): n = A,T,C or G
cttactcaacggcgtattgtccagccacccctgcatcggcttccagaggtcctccccagtagcaaaatacatatctccaataaccggccccggattcaccgaattaacggtcgcccgatccgccaactccctagcccaagtgcgcgtcatcgcctccaacgccgccttcgtccccccatacaccgtctgccccgtgaacccaatactactcgacacactggatatattaacaatacgcccactgcgatcggttggcaagaaaggcgcaacagcctgcgtcagcaacaacggcgcaagcacgttaatagtataatgccaattgaagtactcgcggtccatggggcccttttcctcgtcattgaggaaacgatccttgcttacgccagcgttgttgattaggatgtcgacttggagggttccggtcgtctcagaggtgaagttctccttagccgcgttgaggatcgtggntactgctttcttcggtgtgaggaggtcggcttgcacagagaccacatttatggagtgtngntttgcgagttccgagcagagggtttcggttcgcgatttggagctccgcgaggtgtagtttaggagtaggggagcagcttttgaagcgaagttgcgggctaacgcttcgccgattcctggggatttggtagttgggttgctt

SEQ ID NO: 5593 - DNA, 721 bp, Aspergillus oryzae
  misc_feature (1)...(721): n = A,T,C or G
cgagggctaagacccggggcaagaccctgctggatgaggactacgtcatgagacgtaacgccgtcgacttcggtgttcctctgttcatggagaccaagactgctctcctctttgcccaggccatgagcgagaagctgccccgtgccgagggtatgccttctgaggtccgcagctggtctgagttcgccggcggcaagcttctgtaaatcagcattgcggtcttaaaacaaaagtttttgtcaacataataatcacctgatgttgtttctattttcttcaaggcacggaatagccgtctggtttggcgtagtggagaaggctctactctacattgatagactttttatttggccttgacaaagcacctttgacgggaaaggtggctatgctcatgtactccggtggaacttggttctctttgttattggtatccaaaaaanaaaaaannnnnnnnaaaannnaaaaaaaanaaaaaaaannnannttttcctgcgggcgttcgagcatgcttttaaagggcccattccccccttatggggagcatttcacaattctgggccgcggtttttaaaaacggtggagaggggaaaaactgtggggtcccactaatatatgggtttggaaaaatacccctttttcccagtgggtttaaaaaaaaaaggcccccccccttccccttttccaaaggttggcccctctttctatccggggttttagggtc

SEQ ID NO: 5594 - DNA, 1188 bp, Aspergillus oryzae
  misc_feature (1)...(1188): n = A,T,C or G
cctgccaacgttgatggtaatctttctggtggccccacctgcacgggagcttccaagttcacctacaccatccctgaaggtattgagcctggcaaatacaccctcgcctggacttggttcaaccgtatcggaaaccgtgagatgtacatgaactgtgcccctcttactgtcaccggtagttcttcgaagcgtgacgaagttcccaaggagaagacggttgagaagcgctctgctaacttccctcccatgttcgtcgccaatgtgaacggctgcaccaccaaggaaggtgttgatattcgtttccccaatcccggttccatcgttgagtacgctggtgataagagcaaccttgcggctgagggcagccaggcctgcactggcacccccacattcggtggcgatggtaacaccgccggttccagtggctcatctggcagttcttctggaagctcttctggcggctccagctcttcggctgccggctccggtgctactgcacctcccgcgccagcggtttcctcgactttggtccccaagccttcccagtcctctgctcctggtgtctttgtccccaccggctctcccgcccagcctacccacaccagcgccccctcgggtggctctagctccggctctggttccagctctggttccaactctggctctagctccggctccagctcttcctctagctcttcctccagctctggtgctctgaccggatcttgcagctcggagggaacctggaactgcattggtggatcttccttccagcgctgtgccaacggacagtggaccgcagtgcagcagatggccactggtactgaatgtactgctggtcaggcctccaacctcaagatcaaggccaccaacctcaagccccgcatgctccacgagatgcgtcacaggaagcgcaactaccacaaccacgcttaaagaacgtctgatatccgctggcccggctattaggattccctgatttctcttcgttttccttgcagcggcgtggacgcttgtggggatcctttctgggatggattttcttcttcaattgtatttactttctacggtaaatgaaaagaaggttgggactcgagacctttcttgaatagaagctttgatcattatattcagttggcacagnnnanannnnnnnnnnnnnnnanaaaattcctgcggccgctcgac

SEQ ID NO: 5595 - DNA, 645 bp, Aspergillus oryzae
  misc_feature (1)...(645): n = A,T,C or G
caaatcaccgcaaccaaaataaaatcaatatgggtttctctgacttgctccagtccgccgtctcccaggccgttagtcaagccactaacagctctggcggcaacaacaacaacaacaaccagggtggttccaaccagggctacggaggagactcttacagcgagcgtccctcccacggcggcaaccaaggaggctacaacgaccgtccctctcagggctacggaggcgactcctacaacgaccgcccttcccacggcaaccagggaggctacaatgaccgtccctcttcaggctacggaggagactcctacggcgggcgtccctcccacggcaaccagggaggctacaacgaccgtccctcttcaggctacggaggagactcctacaacgaccgtccctcccacggcaaccaaggaggctacaacgaccgtccctctcagggctacngaggcgactcctacaacgaccgcccttcccacggcaaccaaggaggctacaatgaccgtncctcttcaggctacngangagaactctacngcggccgtccttcccacggcaaccagggaggctacaacgaccgtccctcttcaggctacngaggagaactcctacacgaccgtccctcccacggcaaccaaggaagct

SEQ ID NO: 5596 - DNA, 681 bp, Aspergillus oryzae
ctttagattccctcgttttaaatatacttaatacttttatcctttcggatctataatcagtcaccatgcgtctctcttacgccatctctctcttgcctctggctgcttctgttggagctctccaggtcacttcccccaagaagggtgaggacgttgacctctccaagtccttcaccgtgaagtgggatgccgtcgataccgacccctcttctttcgatctctacattgtcaacaacgccgtctaccccagcgttgagcagaagatcgcctccgacgttgactcctccaagggctcctacgatgtctctggcctgtccgacctgaccaacggcaagggctaccagatcaacttcctctccaactccgccaagaacagcggtatcctcgctcagtcccagcagttcaacgtcgagggctcctctgagtccacctcgaccgccagcgccagcgagtccaagaccaccaccgccgctactggcacttccaccgctactactgtttcctcctccgcccgtgcctctgcttcggccagcgcttccgccaacagcacctcttctggcagcacccccgtctccaccggtgccggtgtctctctcgctgcgcccgtctccgccgccgctggcctcctgatgggtgtcttggccttaaccttgtaattcgggaaccaaccgacagcaagat

SEQ ID NO: 5597 - DNA, 463 bp, Aspergillus oryzae
  misc_feature (1)...(463): n = A,T,C or G
agcagatcgttcggaacttcttttaccttcgtgccggtgtgattggccaagaacttgatcttggccaacccattttatttccaaaccgccaaaaccggtcatttaaccaaccagaagttttcctgggagaaccctaaaaccctcaagttctaaccccgtcgctgtgactacataatcttccttctcctgtttcgttacaaatgtgatgattttgctttgtttcaacaactcaaagcatgagcatagacacgtcagaaaagcttttgtccatatttcttttataatttttgcatgatcgtctataaaaaggcgggttcggcgggataaattcaacatgataccacttttcatcntgtgggagggatgttacngcgttatccgggagcgaaagtcttcaacacactgcctcctcangcttgacatctgcggaccatcagcgtcattcaggaccaggtccgcacag

SEQ ID NO: 5598 - DNA, 646 bp, Aspergillus oryzae
ggaagaattcgcggccgcaggaactgttgtttcttttttttttactgtttctattgttctttttttgtctttatttttttttttttttttctcccacaaagcacccagggggaaaaaaacacgcaccccggcaagaccacggcctaccagcgcgacaccgcacaaaaaggcgccaaacagaagagcatgaacaacgccggggaaccgcacaagacccacgccaaaaacccccccgcggaaccccaaccgcgcataatgaccgacaaatgcgccagaccgaacccccaaagcccgaaaaaccgggggaaggggaacacaaggcccgcccaccccgggaaaggggccacgaactgcgagcaaaccgccaaagaccccaacaaccacgaccgcacgggcgcggaaaacccaaaagcgcctggcaaggcgggccaccaagctcgaaaggagccgaccaaacgggggaaaatggcacgaacggcccacctcggaaagccgcgccaactagagcggacacacaccggaaaagaccgacgcggacgccgacgaagcaaagaacacgtaagacccccccagatacgggtcgcccagaacccaaacaaacaaccggggaaacaatccgcccgccccccccaccgaagaacccccg

SEQ ID NO: 5599 - DNA, 724 bp, Aspergillus oryzae
  misc_feature (1)...(724): n = A,T,C or G
agacgacacgctccgaattcggcacgaggcatggccggtgttctcgttcaaaacggattcaacctatcattgatggcacccgatgatctacgcgaatatgccggtctaactacgacaactatcacttgcaagcaacatataaccctcagctcggcgagtatggacctgatcaaatgggcgctcgagggcactttcggtgctatcgaggaaattggtccgaagaccgacgtcaaggaggagctcgtggagaacgagaaggtttccaaggaaatatccaaactcaaggaggaggctgccgatgaagaaattcctatcgaaaatgaacaggcctatcttgttatgggttgtgtagtcattcgctatttccctcgtactcgcgaggtcgagctcgagtgggaaggaaacatgatgaatgatggggttgccgatgctgtcatggcagtcctgctcactgtcgaaagcagccctgcatctgtgaagcaatccgccaagcaaaagcaccaccaccaccaccatcaggacactctcgaacttcctaaccctcattcacagctaggttctgaagaacggttcgcacgccttctcatgatgctngaggcacagttcggatcggacatatcacccattgagcgtccgcgactacccactactcaacttaccaacggggcagcgaagaacgaaacgtcggcgcaattgagtgctgcggagcagactctcaaagaan

SEQ ID NO: 5600 - DNA, 688 bp, Aspergillus oryzae
agaagttgaaagacaccgatttgcttgcggcgcagtcgaatggttaccgccggatgtctgcaaacctatacaaaactaagaatgagggcgaattcttccatattcatggttccctcgaggccacgacgacgctgaatatgattggattggatggtcaccgtccagatctgacagactacgaagagattatcaaggtcattgagagccatgtgcagaattacacagctgcagagttggaagagatgaataaggagagaaagcaagctggtgtgacggcatttaaatacgaagactttatcaaaaccccgcatggtgaacttaatgtccaacaacccccatggaaggtgtcccgcctcaagggtgacctgcctcccacaccctttcccgccggccgcgctgggagtaagaagattcttgaaggagtcaaagtcctagagctttgccgcatcattgccggccccactgttgcacgcatcctgactgagtacggagcagatgttttgaagatcaccagtccgagcctctctgatgtgccatttttccaagtggatggtaatatgggcaagcacgctgctgacttagacctgaaatcggaagaaggacggcgccagtttgaagagcttttggctgacgcagacgtggtcgtggacggttatcgcccaggggccattgagaaatgggctatggc

SEQ ID NO: 5601 - DNA, 621 bp, Aspergillus oryzae
  misc_feature (1)...(621): n = A,T,C or G
gatgatggaggacgttgtgggcgactataaggacaaaaccgttactcttgaggatttcccgtggtacgatggcaacgtcaaaatggccagtgtacacccatgtcgacacgcttcggtgatgaagacactcctcgaccgtgcagatgcagcgctgaaactccgccgcgaaaagctgaagcaagctcaatctgacccatccaaggctccttcggtcggcgaaagcggcttggaagggttggtcgatgacatcaaggcactttccttgagtgaccaacaacagcatggcagtgataagagcggcggagatgaatgggaggttctccagcacgatgaagaagaacaggtagccatcagagtggatcagtatttggttgttttcctgaagttcattgctagcgtgacaccagggattgagcatgatttcaccatgggagtatgatcgaaggtgtctcacagatatgacctcgtcttcgaattttctccttttctccatttttaaatctggcgtagtggttacattcatgatggcatggtttcacaatcagttctaggagtattacagctcaacattagcaggtgacttagacattaagcgaacannanaaaaaaaaaaaaattcct

SEQ ID NO: 5602 - DNA, 685 bp, Aspergillus oryzae
gattccccccacccaatcgtctcttcaagatctcaaaccttgccaacactatacaagtgctagtccttccatacttccatactaatcgtcgtagccgcaagcaagcaatgacaatgatcaacaccgtcgacgaaacctccctcgccgcatcacccaccgagcgacgcaattccctggagaagcatctcctgaatcgtcctgatccccaggatctcaaagagagacacatcctcctcgacaccaatgttgctccatctatccaagcagcaagacaggaactagaccgtcagcgcactactgatagtttgaagaaacatctcgagcacagaccggatcgcgaagaactggttgagcgcaatatcctcccgcataccaacgcagccccggcgcttcaggctcacgcccgcgaactggagaaacatatgctggctgatcatctcgaccagaagattcagaaccggccgcagccggaggatctcatggctcaggggatcttgacggaagatgaggatccgaggcagccgactatttgactgcaatcttcggcagttgttgacgggttatgatggatatgggttatggattatggtttgatggacggagtatatggatggataaatgggggacatttggttgatctttcttttcgaaattacacaaggatatggtaataacgtacaaccta

SEQ ID NO: 5603 - DNA, 552 bp, Aspergillus oryzae
  misc_feature (1)...(552): n = A,T,C or G
gataaatccaaacaaagatggctcctcacgcaattgtcttcgaccttctcacagccctcctggacagctggtccttatgggccgaggccgcaaacaatgaccgcaaagcatcctaccggtggcgcacaagatatctcgagttaacatttggatgcggcgcataccgtccctatgaagatctcgtctacgagtcagccaaagatgccggcctcccggccagtgcacccaaagccctgatccacaattgggatcagatgcgcccttggcccgagacaaagcaggtcttactacagttgaaagaaaaaggatatcgcttgggagtcgtctccaactgttctgcggaactcggccgtcgagccgttgcgttgtgtggtgtggaattcgatgcattcgtgactgccgaagaagccggcttctataagcctcatccgaaagcatacggtacgatcctgtcggccttgggggtggagcctcgagatgctctctttgtcgcaggcagcaatggcgatgtcgtcggtgcancagcggctggtatggatngtcgttggcatn

SEQ ID NO: 5604 - DNA, 702 bp, Aspergillus oryzae
  misc_feature (1)...(702): n = A,T,C or G
ggctcgtctacgtgaaatcgcagcagaccggccacttagtctccggcccagtgacctagtcattctaaccggaattgccactaccttcccaacctctgatcacttccacgccgtcgcaacgccggcacacctgtgcctttcgcggtacctaggtcagggtgccgtgaacattctcgcagatttcgcaacaggtgcatatgccgcaagcctggttctccaataccaattagtttccaagcgctacatgcccgaattgatcaactacgtcctcaacgccctgtgtaaccttgccccggaggagccaaagagcagcctcggcctcttcccgtctcgtagtccggaggaatctctacgactgaagatctccaagtcgctgaagtcgaggaaacttcaattctgggacattactggcccggacagcccgaaggcccaagaagagctcaaactttccctcataaacacattcatctctctcctcagcacccgcttcgatatgtggtcagacatatcagccttccttgagatcttcgatcaagctcagaaaggtctccgcttcctgaaccgatcctgcaagggtaagaattccnttcgtcgttcagaataccctgcagtcgaccctcgataaactcgatgggcacacccttgaaagccccgccttactcggcgcccgcttttacttcatgatcaccgccccgctgctat

SEQ ID NO: 5605 - DNA, 683 bp, Aspergillus oryzae
  misc_feature (1)...(683): n = A,T,C or G
cggtgattgatcactctgctcaatatgtctcgttcttcccatcgggatgatttctttcaaactacggcggcgcttgacgagcagaaacgaaaggacgctaaatctaaaaatacaaatggagaccccatcaggctacaaagtaagatcttggcagtcgaggcagaccctctgaatcctggcgccgtattcgtggcgcagagtggtggcacggtccgaaagattatactcgaaacaggtgaaacggctgctctttacaaaggaccaacggcccccatcacaagcatctgctttagccccgacggtcgattactcttcgccggttgctgggacaaatacgtctggtgctgggatgtggcttcgaaggaagtgaaacagaaatacgacggtcataccgactttgtaagagcggtggtcaccacccgactccagggcaaggatgttctcgtctctggcggggctgacgcgcagatcttggtgttcgacattgccagtggcgagcggctctccgtcatgaaggggcatgccaagggtatccaaggacttgttgtagatcccgtctctttagattctgacagccaagagctggtttgtttcagctctggcagcgatcgggagattcgccgtttcgacatcgccagtggtagcaaagacctgacgggcacagacgccatnctagtncatga

SEQ ID NO: 5606 - DNA, 555 bp, Aspergillus oryzae
  misc_feature (1)...(555): n = A,T,C or G
ctccttgcctgatctnnataaacatgacctctccctaccatcgccgtcctattccagattacttcctcgcctccccacttgccaccttcctctatcctctccaccacattctcctcagactccgcggaccacctcgattacctccaccagacgcccaccctatccgagtggtctgcatctccgacacccacacgctcgaatgggacgatgtgccagatggtgaccttttaatacacgccggcgatctatgcaacgatggcagcgtgcgcgagatccaagcagcggtagactggctacaaggactgccccatccccacaaggtagtcatctgcggcaatcacgacagctacttcgacgtacggtcgcgactggaagaagaccgggacaaatccttcgcagcgggctgatcctctactgccgctctacgctccatcgatgacctcgaaagtccccaccgcatcgactggcgtgacatccactaccttcaacactgcgccgtgaccatcttctttccttccaactttattcaccggcttttggggcccgtttccgtcg

SEQ ID NO: 5607 - DNA, 632 bp, Aspergillus oryzae
ctactggaccccatgatcatgaatgatattatcacttcccattgcatactcttaaatcattagggaaccttctaccctacggaccatatcatcaagttacctaccaccggtcagcgcccgcctactctttgttcaacaagatattgacgactcttcctagtgccatgtgtcctacttcttctttaaactggtctacttcgaacacatacagaatcgccagacgtaagcccgagttcttgcccttaaaaatctaacactaatcttcctctcattggcctcttctcaggaaatattttaaaaactctaaccggacatacgggagacaatctggcttctctaagtctgaagcgctgctctctgggaactcatagaccacatgtcggccggctaaacggcagtaaacatgtccgtatgcatcgagaccgggagaacacccatcgcgctcgatttgatccggaatgacctctagggtcttgctgccattctacttgctgcagattcgcttgccaactatctgatcggagtctaccaggacttctaggatcgactgatgtacaggaaatcgactgctcaaacctggaccttgaggcttggttagacctgcagttgacgaacactctgtacttgggcct

SEQ ID NO: 5608 - DNA, 1522 bp, Aspergillus oryzae
gcagagcaggcctcccagaacgtggccatcaagaagtctgcgaccggcctccttgccccacctgacaaatcccttttgcataggtcacagtctcgcgctttcctttccgatgatggcatcccccagccagctgagtttttcttgtcttctgacccatctgcaattgtcgagcatacgaagaaggtcctctatctcgaagatgatgatatcgctcatgtgcatgagggacagttaaacattcatcgcctcacaaaagatgatggtacttctaatgttcgcgctattcagacaattgaactcgaattgcaggagattatgaagggcaagtttgaccacttcatgcaaaaggaaattttcgagcaacccgagtctgtgatcaataccatgagaggacgactggatgttgcaaacaagcaagtcacactcggtggcctgcggcagtacatttctactatccgccgctgcagaagaatcatatttgttgcctgtggaactagttaccattcatgcatggctgtgcgtggagtctttgaagagcttactgagattcctatttctgttgaacttgcttccgatttcctggatagacaggctccagtattccgtgatgacacgtgtgttttcgtttctcagtctggcgagaccgctgactcccttatggccttgcgctactgtctcgaacgcggagcattgaccgttggtattgttaatgttgtagggtcctctatctcacttctcactcactgcggtgtgcacatcaacgctggacccgaaattggggtagcttctaccaaggcctacacgtcccagttcgttgctatggtcatgttcgctttgtctcttagtgaggatagggcgtctaagcagaagaggcgtgaggagattatggagggcctttctaaggtctccgagcaattcaaggagatcttgaaacttaacgaacccatcaaacaattgtgtgcaaacttcaagaatcaaaagagtttgcttctgctgggcaggggtggtcaattccctactgcccttgaaggtgcacttaaaatcaaagagatctcttatctccattgcgaggctgtcatgtccggcgagttgaagcatggtgttcttgcccttgtcgatgaaaacttgcccatcatcatgattcttacgagggacaacctgttcacgaagtcgttgaatgcttatcaacaagtcattgccagaggtggccgtcctattgtaatttgtaattccgatgacccggaattttcttcggctcaaaccgtgaagattgaagttccaaagactgtcgattgcctgcaaggtcttctgaatgtcatccccttgcagttaatcgcttactggttggctgtgtctgaaggtctcaatgttgatttccctcgcaatcttgcgaagcaatcacagttgagtaaattgtcgcttatagcaacagccaagttttacctattgaagttgcaaagcttatctaaaaaccttactatctctgattaatttccacgctttggtcctctattatttttat

SEQ ID NO: 5609 - DNA, 740 bp, Aspergillus oryzae
  misc_feature (1)...(740): n = A,T,C or G
ggccggccgattcggacgaggccctgctgcaggcaccccatctatattcgccccaagcgccgccaaggccggtgcggataatacttggaagatgaattctcccattaagtttgccagtgactcaaatgcggcttctacttcgaaacttgattccgcatccgcgacgccggctgctgattcctcgaaaccattctccacactatttggagcggcatctgctaccaagcctgcatcttctggtactggatcgccatcacctggcttcacatttggtggacctgcgcagccaccatcattcctggctccatcgactgtcagctctgctgctgccagccgcgcgtccactcctggaattacatccgacacgggagccgaggagtctggagatggtgatgcagctgaggctttgcctcaggctaaccttgctcaaagtcgagccggtgaggagaatgaagacgttgtgatcgagactagagcgcgcggcttgaaactcaccaaagatggatggaacagtcaaggagttgggtttcttcgtgtgttgaaggatcgcactacctctcgcggccgtgttatacttagagctgacccgagcggcaagattgtcctgaacgcatncttgatcaaacaactcangtacactgtcaagggcaccagtgtgcactttcctgtaccccaagccgatgggcctncggaacaatggggcaatcgggttaaaaaggaggaaagcgnnacgcctcgga

SEQ ID NO: 5610 - DNA, 648 bp, Aspergillus oryzae
  misc_feature (1)...(648): n = A,T,C or G
ggctgatggtcttctcatctggggtttacagtctttgaacgatcacattcgacaaatcgttcatcatgcatgcggagaatcctctacagagtaccgccgaagtcaactcggtcggacaacagtcagaatcacaaaataatgcccttcctgggcaaattctcacaggaaaacaagaacattaccttaagcgcgagctcatcgcccgccaagtgcaaagcgaaatcgccgagttaaactctcccacagccctccaacgtttcggtgccccattcaggtcagagtacggagaagtcgccccagttgactcagaactccctatcctacgatatatcttcgttcatcatgtgcgcaattttccttttctcgaccaggcccgcgagaaggagttttggcagggataaatacaagtgttcctagaatccttcgcgaagaagcatgtttcgtcgtccgaaaatcgcttggaggagacaaagccccaaaaaattagccaggaagtgccaaaaacctcgtggagctcatgatggtatcttgtatcccaacgggcatcggatatgaaaaacgaaatcaagtttcggaaatcgaagttgaaaatcgcgtggccattgaccagggccttttggtcatatgccngaagggaatgccttcacc

SEQ ID NO: 5611 - DNA, 726 bp, Aspergillus oryzae
gcgggatggttctttcattcatattggtccagaaccgacagggcaatattcgccttgcaaaatggtatgcgccgtacagcgatgacgagaaagtctagctcaaaggcgaggtccatctcctgtaatcaccaatagatgcaaaatactcatacatctttatcaaccaccatcctacctcgcatattctttaccgacgatacatcgcatcattttaccaccgtcatgccataattatcaaagtttgactcttgacgacatgtgtcactgtgacgctgcaatttctctttttacgtgacgtatttctcttttacagaccatgcactatctcgttttgttgtgctgagatgatacctccacgactattctaccctctctcatgactttctactcgacgttaacaccgttttaccatcttctcttcgataccatatctgtgacttcactctacctacatgcgatctcgacttccaatgctgtcagactctatctccacatcccgcgttgctcccatcacattatgactattacgatgcaatacacattcgtcgacgttgccatctcgtgatcacttcaatatcacgtaaattaccacgattattctgacaattatcgacgacatgtcctattcgtgatcatcgcgacaatcacgatgacatttatatctactcaattgcttcatactatccgattataccgcctacgactcaacacttcattactctctcg

SEQ ID NO: 5612 - DNA, 673 bp, Aspergillus oryzae
  misc_feature (1)...(673): n = A,T,C or G
ggcgactctatctttcgcacttggggcagcgcacaccgtccggaggaggagctactggagaagtatccatagctctatcgactagtatgttctcacctatctatctgcacagagatacggccgtggcgtgagtaggatcaccatccatatgcatacatcggccgtgatatggcgtgtttgctcggcgatgcaggtcatccgatgatgcctgaccaaagccagggtgcctgtatagctattgaagatgccgcagcgctgggaaggcttttcaacaacgacaacttctctggagatattgctgaaactctcgccatctatgacgaaatccgactgccacgagctactaagggtcaatctggcgcatcataggcggcgtataatatcaatgaacggatagggttctcgagcaatacttcttactacgtgtactgagatgaatatgagaagaacacactgactattggagagatgaatgcgtgcgacatgtacaaagatatcgaagacgcgatcgctggcgcaaagggtgtacctttacagcaccatacaccatggactaccatttcggctgaagctgtaaaaggagtgccagtcggagaataatgtacgaattatttgcgtgatgcctcctttaataatgctttcttgacattgggcctgctataagcgtcttccn

SEQ ID NO: 5613 - DNA, 1033 bp, Aspergillus oryzae
  misc_feature (1)...(1033): n = A,T,C or G
cgcgtctgacgaccagactgccaatgatatattcaccacttttgccgagtcacagagagacaactacctcttcgccgccacaagtgatgcatcgatcgctaaggcagaaggtgttaagcaaccttcgattgttctctataaagacttcgatgaaaagaaagctacttatgatggagagattgaacaggatgccctcctcagttgggtcaagactgccagtacccccttggtgggcgagctgggcccagagacttactccggatatataacggctggcattccactggcgtacattttcgccgaaaccaaagaagagcgtgagcagttcaccgaggagttcaagttcatcgccgagaaacacaagggttccatcaatattgtcaccattgacgccaagttgtacggcgctcatgcaggcaatctcaaccttgacccctccaagttccctgcattcgctattcaagaccctgaaaagaacgccaagtatccttatgaccagtcgaaggaagtcaaggccaaggatatcggtaaattcatccaagacgttcttgatgataaagtagagccaagcattaagtctgaggctattcctgagactcaggaaggtcctgttactgttgttgtcgcgcattcctataaggatctcgtccttgacaacgagaaggacgtccttctcgaattttatgcgccatggtgcggacactgcaaggcccttgccccgaagtacgaggaacttgcaagcctttacaaggatattcctgaagttaccatcgccaaaattgacgcaacggccaacgatgtccccgactccattacaggatttcctactattaagctcttcgctgccggcgccaaggactccccagttgaatatgaaggctctcgcacggtggaggatctcgccaactttgtcaaggagaatggcaagcacaaggtcgatgctcttgaagttgatccgaagaaagaacangagagtggcgatgccaccgagactcgggcccgctctgacgagaccgaaactnctgctgctact

SEQ ID NO: 5614 - DNA, 699 bp, Aspergillus oryzae
gcgtcctgaacgtcttccttctatccaaacttagacggtgccttgattcagtgcgtacgacttgaaaacctataccgcactctaaactcctaccacggataccattttgccgctcaacgtcatttcacagtgcaaagttgcaaacccctgtgctcacacacggaatccgtctgccttgccttttccccgccagtaacccggcccgaagcataatcaagaattatgggctcatttgtggaggatctttgggctagcgtctttaccccgggtcccactcccaccttgctagtcgctgctaacgccactttcgccgcactccaactggtcctcttgctgcttctcctagcgacctacagcatccacttgatcgttctatccgtcctcttcgcctcactatggtggtcgatcaactggattgctcaagaattggcaacggtgcatgctcaagaagctgagaatgagaagacagagtcgaacgaactgctcacagaggaagacgactatgacaagaggaaatccgaagctagtttgaaaacaaccgtgagctctggacagcacagaaagtgaccccgagaccgagagtttgatggagcgttaaatattttgcggtgttcgctgccggttcatccgtacaccactgccggcggcacttataacggtttcttttaaaccgccgggacaccaagggaggatttcgaa

SEQ ID NO: 5615 - DNA, 719 bp, Aspergillus oryzae
  misc_feature (1)...(719): n = A,T,C or G
gggaaatctcaaagacagcgtctcgcaaggctggtagtgagaagatgtttcgaacaccgatttactttttgagtcatgggggtccgaatgtcatgtaccagacggaccacccggcgtacaagaagctggggcagatcgggaaggagattacgactaaggtgaagccaaaggctgtggtggttttctcggcgcattggcaggcgggcagggatacgattcaggttaatacggctgagattacggatttgatttatgatttctacggtttccccagccatttttacaaggagaagtatcccaatgtgggcagcagggaggttgcgaataaggtgcttgatctgctcgggaaagcggggattaaggcggaaggtgagaaaagaggcttggatcacggcgtgtggtcaagtattaagtgtgcgatcnacccttgattggaccccgttgaatgtgcccattgggcaaggtttccttgttcaagaagaaaatccatgcaccgcattaccggctccggtcaagccccgatcaaactactgctatgaaatacaactctcacgattactcattagatacggaacatatctcgcctctcagacttcttcgtttcatcgacaacattgtaagtaacgcctgccataccgcttacatcacttattacgtcgatgtctatcgacatcgtcgacggtcaatatcctcgatcattccccttcatccctcgccgc

SEQ ID NO: 5616 - DNA, 701 bp, Aspergillus oryzae
  misc_feature (1)...(701): n = A,T,C or G
cttcgagaccgttgccttttttatctctggcttggttgtaacattccttatccaggatggaaaatcaaactatcttgaaggcggcttgtgtctgggaatgtacgtgattctggctctggcattctatgtatacccggatcaggccaccgacgacgccctatttcacatttagatacgcgcattagtgtggattgtgataaggtgcatctaccgttccccttccgcgtgttcatctctaccctttcgagaaacgtgaagatacgacgaggacaaaggcggattgcattgtccacccactaaattatctatgtgatgctcctgtccctcctttttgattctcatttttgttgtaattcatccttggatggttcccgggctaccctttaatcttttcatacgggatccgaaggacctgtactgcgggtcagtcactttggtctatattgttgcgtatctcgcgagaaaatggcacatttgatttggtcgtgctcggtggctttctttttgtctcaccttgaactctcttggtcatatcgagtcaggtcatgtatcgttggacacagcaaattttgatgctacagttagggtcgtgtaatattaaaatcttangctttggctttgagagaatnggataanccgacgannnnnattttnnnnntttannnnnnnnnnnnnnaaaaaattcctgcggccgttcgacc

SEQ ID NO: 5617 - DNA, 653 bp, Aspergillus oryzae
  misc_feature (1)...(653): n = A,T,C or G
cttttttgttggaatcacctggtctaggcatattccatcgatgccgtgagaacggacctccgtgcacccccgtctgacatgctgagttccgaaggtttacatccgatcccgaaggatccgcacgacgagcagattaataaatgaaggaattgctattggttttacccggatgattatatcacagatcgagaacagccaagaaagtaatcaactaagcctttgttaacggtgtacccaacgggatagcgtcccccgcgtccctcactgaaacctcgccaattccgaccgcacgttcaattttgtctcacccggcttcagaccggacttgaaagtgaccttcttctcgaagacgacaaccacgtccgagcccccaaattggaagtacgagatgttgtcgcccttcttgacatggtcgcctttcttcacggtcatcacaacggatgatacctgagccatgccaatgggcaacaccgccaccttaccatagtctttcgtctgaatgacgatgagcccacgggtctgacaccattgataaccggcgttgtccggagcatccagattgtaatagccatgaccgccactcaggagcctttccctgcgtcttgtgatcatatgcgggttccggatcagtcttcngtcgccggacaagtgan

SEQ ID NO: 5618 - DNA, 714 bp, Aspergillus oryzae
ggtttttagattgagttactcctctcttcagttgaagattatacacatttaattgattaatatatcgcttacaaactacactacaaacaaacacacataatgaagctcctcaccaaggaagaagaagacgctcactacagagcagtcctaaaaggcggcacaatcggcaccgtcctcggtctaataggcggctacgccggcgtcctcgccgcatcccgccgctaccacacaatccgcaacctaacgctccccatgaaagccttcctcgtcacctcctcgggtaccttcgtcggcatcatcgcagccgacaactcatcccggaacttcgaagttgagcgcaacgccgaccagcaatggtaccagaaccgggagcagcggctgcgcgaggagtcgctgcaggggatgagtttcatggagcggtcgctggcgtgggcgaggaaggagaagtatacgattgttaccgcgacgtgggtggcgtctatgattgggagttttgtgctggtgggacgcaatccgtacctcagtggacagcagaagattgtccaggcgcgtgtttatgcccagggtttgacgcttgcggttctggttgcttctgcggcgtttgagatcagtgatcagaggaaggggaaggggattttgaaaaaaaagttgaggaaaaggaggctgctgatggaaagtctggtgttgttgttgaggaggaaccttgtaggcata

SEQ ID NO: 5619 - DNA, 580 bp, Aspergillus oryzae
tatgcccgtccattcgaatacggcgcgagggggtaaagatactcactggacaggcaatatcccgcctacccaaagacatcctccatgaagtctatctactcgcttgtgctgtgcactgcgctcacggcggcttctccgcaccccgcatttccacaatcacctctgggtgtgccgacaacatcgtcaccatcaacagggacgttcaattccgccgaggaagtgatcaatgcctcgcccttcctgtcttttcaccgagatattgtgcagattgaatctatctctagcaacgagcacaatgtcggggagttcatcgccgattttctccgcgcccgcaacttcaccgtcattgagcaggcagtaacttcgtcttctcaaacagaaaaccaagagcgttttaacgtctttgcctacccgtcgtctaataccccggaaatcctcattaccagtcacatcgacactgtcccaccatttatcccgtactccttggacaccgactcgaccacggataatgacccgtccacgatccgtatcttcggtcgcggcttcggtgaccgcaaaagcaccgttcaagcctatattt

SEQ ID NO: 5620 - DNA, 653 bp, Aspergillus oryzae
tacccctcttacccctcaccctgaagtatacctcgatttaactcaaccagcaagcaagatatacaacacactaataaatcggaaacaacacccacacgaataagaaaatatagaaaggggaaaaaaaagtcaacatggctacccaccgcttcgaccccaatttcaccgacaatgtcgtcaacgccatgggccccaagaccaaccctcggttccgcaagctcatgaccagcctaatccgccatgtccacgacttcgcgcgcgagaacgaggtcaccgttgacgagtggatggctggtgtccagttgatgaactgggccggtcaaatgagcgacgacgagcggaatgagggacaactagtttgcgacgtgatcgggttggaatccctcgtagacgaaatcaccttcaaactcgtcgaaaaggccgaagacgctcgcaccggaactgctatcctgtgcccattcttgcgcgccgataccccctaacgcaagaacagcgaaaacattgtcaaaggggtcccagatggcgacaaggctgtcatagcatggcgaggtatggaatttaccaccaagaaaccactcgtgggcgccaaccgggaaatgcggcaacagttgaccaaagggtggacaaacggcgggatacaacccagaaggaac

SEQ ID NO: 5621 - DNA, 1908 bp, Aspergillus oryzae
  misc_feature (1)...(1908): n = A,T,C or G
cgatatctacctgctgaatgattgtgcccctcctactgagcttggtgccctggagtgggtcgtcactgaggcccagaaccagcttgaccggatggagaagcaggctgaagatatcctggaagagcaaggtcctgacagccctatcctcgaggatctgtatgatcgtatggacaaaatggatccctccactttccacactcgtgcttccttgatcttgactggtctgggattcaacanagttaccatcaacaagaagaccaaggacatgtccggtggttggcgtatgcgtgtggctcttgccaaggctctgttcgtcaagccttccctgcttctgctggacgaccctactgctcacttggatctcgaggcctgtgtgtggttggaagattacctgaagaagtgggagcgcaccctcgtcctggtttccaactccatggacttcttgaacggtgtctgtaccaccatgattgatatgcgcatgaagcagctcctgtcctacggtggtaataacgattcttaccacaagaccctgtccgaacaggacacgacccatatgaggcatccaataacgcgcaggaaaatattgcccacattaaaaattttatcgcttccgccggtacatattccaacttggttagacaggccaagtcgcgtcagaagatcctcgacaagatggaggccgatggtttcatccagcccgttatccccgacagaatcttcagcttccgctttgccgaagttgagaagcttccccctcccgtcctgtccttcgatgatgtcagcttctcctactccggcagctgggaggataccctgtatgagcaccttgacttcggtgtcgacatggattccagaactgctctggtcggccccaacggtgtcggcaagtccactctgctgcgcatcatgaccggaaagctgcaacccattggtggtcgtgtcagccgtcacactcacttgaagttgggcatgtacagtcagcactctgccgagcagctcgatctgaccaagtcgtctcttgacttcgtccgcgacaagttccccgagaagagtcaggactaccagtactggcgtcaacagctcggccgttatggtctgagcggtgagtctcagactgctctgatgggcactctgtctganggtcaaaagagccgtatcgtgttcgctctgttggccattgaatccccgaacatgatccttctcgacgaacctactaacggtctcgatatccccaccattgacagtctggctgatgccatcaacgcctacagcggtggtgtcgttgtcgtgtcccacgacttccgtctcctcgacaagatcgccaaggacatcatggtctgtgagaacaagaccgttacccggtgggatggtactatcggccagtacaaggaccacctgcgcaagaagatgattgacgccggtgctgtctaagaaacggcacgaaaaaaaaatgaaggaaaacgacgcttcttgttatgattggaatgtcagagacgacaatgaaaactcaaaagctgcaggggagttgaaatcaaaaagtttcttacaggagaaatgatccatcctgggtgatatagtgacattggcgggtgacggttttctttcttacatacatatctggtgatatctgcttctgcttgtttgggttgctttacttttattagatggtctgtctgtgtttcatacctcatcccctgctagacccctcgcgtttcaagggtcaatttatattcttatatctttctaccgttntatgggttcacccgttggtatagacattatgtaggacttttgtntgatgggtcttggacctctcgctgcactatgtagggntatgntnatgacgaggcatggaactacggaccagcaatccagtgacattatctanttatcccaggtcaaaacacc

SEQ ID NO: 5622 - DNA, 1140 bp, Aspergillus oryzae
  misc_feature (1)...(1140): n = A,T,C or G
gaagaacagcatgggccctaaagctaacattttcgtccctctctatgtgtaccctgcccctggcgcctgggatccattggaagcagagatctcttcacatccggaggccaactttaccgttgtgattaaccctagcagcggcccagggcccaatgccctgcccgatgctaattatacccgagagattcccaagctcgcctcttatgacaacgtgcgtctcttaggttatgtccctacaacctgggctaaacgcaacatctcggccgtgcgtcgcgacatcgcaacctacgcagaatggccgaccaacagttcgaaccctaagctcgcggttcggggtatattctttgatgagacgccccaacagtatgatgccgatgcgttgtcatatttgcaagagctcacctcattcgtgaaaggcctttctggtcttggtccagacaactttattgtccataacccgggagccgttccagactctcgttacatgtcttcagctgactcgactgtcgtattcgaagcggcttatgacaccttcaacgagcgtgatggcacgaagcaattcgacgttcttccgaagagcgatcgcggtcgcggtcagctctgcattgtgatccactccgttccggatggggttgaaggttcgaagcttcgtgatctcgtcaagaagcttcgcaagaccgccgatgagattttcattacccacctgagcacggattactatgccaacttcggggataggtggggcgagtttgtcgattggatggctaaataattcctacgggcggcgcttttcgagcatacctgatgcaacattgcttatgatcagggcccgattggcgtcgactgataatatatgcgccggcgctttcttttgatggattggattgactaattaacttacgacctgtctatactgtatgaacgtctatatcctgtatgatgattctactgataatatgctatttgactttggccgttgggactatcanatgatacctagaattacgatagagtttacgatcgtcaagatttcctttttgttttctcaaaananannnnnnnnnnnnnnnnnnnanaaaaaatttccgggggggcgtcaaaaatgtctttgaggggggcaaacagtttttttttttgccc

SEQ ID NO: 5623 - DNA, 1596 bp, Aspergillus oryzae
cgaggcttcatcaccaccttattctctcctctttctcgtccctattttcccaccctttttttaatagttcttccccttctcgtttccttttttttattctccccctcgtagtaatcctattcagtcatcatggaagaggaagttgctgctctcgtcattgacaatggttcgggtatgtgcaaggccggtttcgccggtgacgatgccccccgtgctgtcttcccctccattgtcggtcgtccccgtcatcatggtatcatgattggtatgggtcagaaggactcttatgtcggtgatgaggcacagtccaagcgtggtatcctcaccctcagatatcctatcgagcacggtgtcgtcacaaactgggatgacatggagaagatttggcatcacacattctacaacgagctccgtgttgctcccgaggagcacccggttctcctgacggaagcccctatcaaccctaagtccaaccgtgagaagatgacccagattgtcttcgagaccttcaacgcccccgccttctacgtctccatccaggccgtcctgtcactgtatgcctccggtcgtaccaccggtatcgttctggattctggtgacggtgtcacccacgttgtccccatctacgagggtttcgccctcccccacgccatctcccgtgttgacatggctggccgtgatttgaccgattacctcatgaagatcctggctgagcgcggttacactttctccaccaccgctgagcgtgaaattgtccgtgacatcaaggagaagctttgctacgtcgccctcgacttcgagcaggagattcagaccgcttctcagagctccagcctcgagaagtcctatgagcttcctgatggccaggtcatcaccatcggtaacgagcgtttccgtgctcctgaggctctcttccagcctagcgttctgggtctggaaagcggtggtatccacgttaccaccttcaactccatcatgaagtgtgatgttgatgtccgtaaggatctctacggtaacatcgtcatgtctggtggtactaccatgtaccctggcatctccgatcgtatgcagaaggaaatcaccgcccttgccccctcgtccatgaaggtcaagatcattgctcctcctgagcgtaaatactccgtctggatcggtggttccatcttggcttccctgtccaccttccagcagatgtggatctccaagcaggagtacgacgagagcggtccttcgatcgttcaccgcaagtgcttctaagctcttgcgcatgattagtctgtttcgtcgtattttcctgtattaaaatatcaaacggagactggcgacatgcgggcctctctgactcgcactaggaggaagatcgcctgaaaaaggaactttgttttagttgtggaatagagatggtttctttgggatgcttgtcgctcgatgcgggcgctttcgccgacagtaagttgttcctgaaagcaagaaggggaagagagacgtaagcgaaggatgtacatgggtcatgtggacggaggggtgaaagctctatttcatatagttctacgctcgtgtttgaatcaaaatttccaaaaaaaaaaaaaaaaagac

SEQ ID NO: 5624 - DNA, 657 bp, Aspergillus oryzae
gcagcccaccaccatgaagctgtacctgctattcttcttctttctcaccctccacgctctcccaggtctccccaggtcaactgcggacaaaccgccgttcttcctcctagccggcgacagcacaacagcagtccaatcgacgaacggcggtggttggggcaatggattcatccaaacgacgctggccaagggagccaaaggtcagaactacggccacaacggagcgacaaccgtcagcttccgcgcgggaggtgactgggacaccctcctcaagaaggttgaggaggtgaaagccaattatcagccctacgtgaccatccaattcggcaacaacgaccagaagccgactgccaatattaccatcgcacagtacacgagcaatctggagactttcgtcggagatgtgcggaatgcggggggagtccccgtcctagtgactccactttcgcggcgccagtacgataattctaccggagtgcccactattatccggagtctggaaaatgagcgggtcgcgacgatcaaggccgcaaagaagacgggagcgtcgtatattgacctgaatcgcgctagcacagtatacctgaacagtattgggccggtcagtgcgcacatgtatgatttgaaaacgggtgactcgacgcatttgaacgcggg

SEQ ID NO: 5625 - DNA, 721 bp, Aspergillus oryzae
  misc_feature (1)...(721): n = A,T,C or G
cgtgatgcatgcttgcctgagtgagcaggttgtcgatgatctgttgcgcaagaagatgaaatttgacggtgtggtagtttcagaatgcctggagatggaagctctcactcataatatcggggtgggtggcgggacagtcatggcaaagaaggcgggctgcgacatcattcttctctgcaggtcattcccggtgcagcaggaggcgatcaccgggttaaaacttggcgtggagaacggtatcattggcagagctcgtatagaacagtcattacgcagagttttgagcttgaaggcgaaatgcacctcctgggaacaggctctcaatcctccgggtctttcctcactcacccagatgcaaccttcccataccactctctctacgagagcgtacaacagctctatcactgtcgttcgagataagaaaactcttttacccctgtccaacattattgagcccagtgaggaattgctgcttctgaccccattggtcaagccattacccgcttctgcagtgtctcgttcagtcactgagcacccgaatttatctattgagcccatgacctgngaccggacttcctctgtgttgagtggtgagagtgtcttcagggaactagggaggtcactatcacngcaaagaaatgggcgtgttttgcatacctcctacacaagcaatggcgtccgnccgatccacgaaaacttgatagacctggcccaccgcagt

SEQ ID NO: 5626 - DNA, 679 bp, Aspergillus oryzae
  misc_feature (1)...(679): n = A,T,C or G
catcctctagtcgatccgcgcaatctgactatccgcctggtctccggatccaatctcctctgcacccgatcaagacgttccctgcccacttgatgtagctcccgcaccttcaccctcttgagcagaagctgccggtacttcttccgtgcccccgttcaccagagacagaccttttcgatctccgcgcgctccttcgccgccgtaaacgcagctatggccgacgcgaccgcaggggtgacccccgagggactgaagagcaagttgatcgagcagttgcaggcacagcatgttgagattgaggacctttcgggcggctgtggccaggcattccaggcggtgattgtatccccacagttcgagaagaagaccatgctcgctcgtcaccgattggtaaactcggttctgaaggccgaaatcgcagctatccatgcttggacacctaagtgctataccccggagcagtggcaagctttgcagcagtagatttatgatatggtcctgtgatattacggcccgggaaaagagagggaagaagaatctgatatatcctgggtatttcgacgcgcttgtagcatatangcatgcgttggagattttattaatgtacatttggcgttgctatccggctgtggcctatagtatacttgttttgggctatggttggtggacttataaaaat

SEQ ID NO: 5627 - DNA, 648 bp, Aspergillus oryzae
  misc_feature (1)...(648): n = A,T,C or G
aattaattttccctcggttggcatggacccgaatggaccaccaagtacatcggggctgccttcgcctggcgatttaatcctgcagcagaggaaagatgctatccaggcggcggcgcagcccaccggagatggcgggcttttcgcccagctatctagcaatcccttcttcacagcgggcttcggtctcgccggcttaggtgctgggttaagtttcgctcagaagggcattcggcatggcgcagcactcctgcgaaggcgcatgctcgtggatgtggaaatcagcgtaaaggacgattcgtatccctggtttctacattggatgacgctataccaacgttcgcagctcagttcggctcagtcagcggccagcaggtctggctatatggaaaccttactccagaagatgacccccgggatgcgccacctctcaatccaaacgcagaaagtcgaacactcanacggggccatacatacacatnnttcgctagtccccgggtcagggagacacggtcttgcgtacaagaatgcgtttatcttcgaaatcggatgcgcgagtcgaagcactggaccttagactggtcgcccgtggaaacgattacctgacactctctatcgcatcgcatgttttgagacctctcagagagctac

SEQ ID NO: 5628 - DNA, 736 bp, Aspergillus oryzae
  misc_feature (1)...(736): n = A,T,C or G
gttgttcgactccgacgctatctacccccacaccggttgcggccatgttgtacgagttaattgccgttgtccgtccgggcagcctccacgaggtccgagaaatcgcccgtaatgccggcattcaggtcctgcgctccggcggcgtagtccgcggatacaccaactggggcaccttccgactccccaagcccaccacaaagcaccaggccagatacacggaaggtcaccacttcattatgcgcttcgatgcttccggccccgtacagatggctgtccgcagaaccctcggcctcgatccccggatggtccgcttctcggtggtcaagctgggcgacaagcttgaggacataaaggatgtccagggcaaggttgaatggaacaacgcacgcaacatctccgagtctatctaaaagtcgacgcttctttggttacggattggatggatgagatgaagaagagccgttgtacagctcgtctaagttgttgatttgcattcggacattgatggacattgacagttcactgtattattgggattgagggttgtatttttgtactatcataccagcatcgcaggcgcacatatatatcacttaatcgggtttcactttgaggtgctattctacacctgtccagattctctacgggttgctcaacaggacacgtgacttangatcctangtctcaaacaacagtgtcatcatggcccagttngaaagggactcactttcgctan

SEQ ID NO: 5629 - DNA, 674 bp, Aspergillus oryzae
  misc_feature (1)...(674): n = A,T,C or G
caaaaaatcagcagcacagccctctcgctccagacacaccgactacacccaaaaatgaacagtgtagacatagggcgatgcagaaaacgcatcgtacaatatatatgggatcccgagcccaggaatgatgaagagccagatgcttctatttggtgcttgggagtagagtatgccccgcagcctcaaaaaatcacagcaaatacaacgcccgatcaggatgaacttgaagctggaacaagcaaaatagacgatgtaacagcacacggctggccagaggcattcgtctcggactttgaatcgaagatctggatgacgtatcgatctgatttccccccaataccaagactagacaacgacgaagcgaatcatccgatgacgctaactgtacgcataagaacccagctaatggaccctcaaggcttcacttcagacacaggatggggttgcatgattagatccgggcagagcttgctagcaaatgcaatgcttacactgtgcctatgtcgaggtatgaccccccaccctttcttagccctacatctacacatataactccaatataatactcttgttctatataggccacatgctaacatatactagactggcgccgtggcgataaagcggaagaagaggccgnctactatcactggttgctgatcatccagatgcac

SEQ ID NO: 5630 - DNA, 682 bp, Aspergillus oryzae
gttgacaagcacgtcagtatccagcaaacacagtcggcgacatgtcgtcgggatccaatggtgccaggcgcatagcgtctgttttgcggccctcgattgccgaccccaaagtgtgcagaagttgtcaagagacgcttgttcgccgcaattattcctcggccgctgcacagccttcttcagaatctacctctaccgctacaactaccttccccgtcgtgaagcccgtctacacaatcaatgccggcgtggccctatcccgcccccctcagattacccgcgacctctcacaattcgagaaagcatactatttctaccagaagcgactgaacgagcgtttggcgcttccatttaccaagtacttttacttcaagcgaggaacgccggcggacgaagactggaagcgtaaaatccgggagcgccagacggctgcgcgtgacatcggcaaatacaatgcgtactcgaaggacgcatggaacgatgaacttctcgtcggagccgtcgaggccgaaccggagcaccaggtggagatgcttgtgcaggatgcggaagctacagtcaatgctaccttccaagacaccaacaagaaaggaggagatccccaggccattcccccgagtaacggaagcggatcagaagaacgaccagagaagcctgaaccgggcccttcagaggacactctatt

SEQ ID NO: 5631 - DNA, 613 bp, Aspergillus oryzae
  misc_feature (1)...(613): n = A,T,C or G
cccagcatgtcgccccaaaaagaaatccaagccaacgaactcggaatcgacctctcctcaggaacagaaacagaatacttcaaatggttcctcgcatgtctcctcttcggcaagccggtccaacaaggcgtcgcaaagcgagccttcctcgagctcgtacaggagggcatcacttcaccggacgctatcctggccgcagggtgggatagactagtcgagatcttagatgaaggtcattacgtccggtatgacttttcgactgccactaagttacttgatgtggcgggtgttatcaaggangagtatgggacttttggggagatgttgaaaaggttccagaagtgtgatgaattggagatgcatttgcaggagtttaggggggttgggcccaagacggtggagatttttatgagggatatgaggcctttgctggagtagttggctggggaatatggattgttggaagttgccgttggggttttgggatggggtctgttgccaagattgttattataatgattatgcttggaagccttggttgcctaggtttgaaattggctgcaacggaaaatggtccatgtattggacttaagtttgtgcttgttgctttaca

SEQ ID NO: 5632 - DNA, 500 bp, Aspergillus oryzae
tgaccatcgccttttggatggccgggaggctgttactttccttgtcaaggtcaaggaatacattgaggatcctcgccgcatgcttcttggctaggcgactgtgctctgctcattcaccaaatagctttgctaatgtgcaagatatatattatcagttccatgttaatcaagcaactttaagtacggtagcttaagtcgtgcgatttttaccccgctgtttgtaccgtacctttcaagccaatgacccgctttcactagtgtgcatggtttggccgggtcatgttgatatttgagtcctaccctatccttcagttgcttcgtctctgtgcggctcaacccccaaagctgcccgcgttcgagctggaacagtacaagcggctcaaggaccttcatgatatttaccagcgtgtcgaaaaccgaatatttgaacttattaatggggaaccttgcggagacggtacgcatgtgaacattgagagaagtccgtctggtggttgaag

SEQ ID NO: 5633 - DNA, 689 bp, Aspergillus oryzae
  misc_feature (1)...(689): n = A,T,C or G
gtactgttcgccgaggatccattccttattatcgcgcttttcttcggcgttgtatctctcttcactggattcctggccatgtgcacccgtatcggcagctacctctcatccctgatggcatggatttccttggttttccaaatcataacgacatccctgatgaccgccgtctttgtccagggtcgcaacaagttcaacgccaacggccaaaccgcccgcctgggcgccaagtcattcggcttcatgtggactgctgtagcctgtctcctcctcgcttgcataatgtactgcctcggaggctccgtcggcggtaaagaaactgggtacagcggtcgcgagcaccgtcgtcgtggtttcttctcttcccaacggtccaatagcgtccggagcaacaaggaggccaacccatgagtcagctagccatataacccccgattctctcggtctctctacgagggatagattcagtgaaccatatatctggaatcgtggatggtgggtgagaaaatcagatattattttatanggngtgcattcgacgcagccttcagcttcggtcattataaatttggggaccagtgatggacaagttgtcacaagcccaccctgntnacaataaaacaagggctttcttttcgtccggtttataatttggggctaattaacggagcccatggacttatttggtt

SEQ ID NO: 5634 - DNA, 929 bp, Aspergillus oryzae
  misc_feature (1)...(929): n = A,T,C or G
cgatacgactctgtccgaattcggcacgaggctcccttactgcggggtcgtcccatatcgtcaccgccactgcacgattggagactatcctcaaggccaacaaactccctttccgcgcaattgatgtagccaccgatgacgccgcccggaagctctggggtcgtcgctccaagggtaaaaagttgccgggtctggtgaagtttggcacagtcgtcggggacctggaagagattgaagaatggaacgagtatggcgagctgagaatgcaggtcaacagcgtcgaagattttggtgatagtattcctgctacgagcatcgtgaccacccagcctgagtctgctgtatcgacccccgcctcagaaccttcggtaccaaagcagagtactatcaagatccagaacccgcccgcaaaagaatctcagaaagacgactccatcacggtcgctctgcgccaggctggtgaggaggccgccgccaaagccaaagaaagcaaggccgagaaggcaactccagctgctgagcagaagcagcccctccctccagccgtcgaagagaaaaaggaaggaggcgcagacagtgtacgtcggaaatcatcggttgctcccgagatcgttgagggggccaacccaaagcggccacctctggtgccagaggttgccgcggtgtcctctgccaattttcatgctgataatgccgaagcactaggattagttgagcatcatcgtggctccatcgtttctgccacgtccccggaggaaaaagcgaaggtcgctcaggatatccgtaagtcgatttccggcggtcatgcagagatgctggagtcgttgcgcgacgaccaggcgcagaaagctggtcaggaggaaaccattgatgaagagtcaaanagtggcgaggctgtccaggatgctatgaatcgaaaggcaaagaac

SEQ ID NO: 5635 - DNA, 552 bp, Aspergillus oryzae
gatgcggacaatagcgacgacgacgaagaacttcaacggctacaacagaagatcgccgaaatgacacgtcaggtggaagctattgctcagaagaagaaaaagaagacaccacccggatcgaagaaggctgggaagctcaagtctagcaccaaggaaatcaagaaacctggaagcatgaatctccccaagaaggacaagaagagcagcataaagccatcgaaacccgagaagcagcgctgggtcacatatcaggagaagcaaatcatatccaatgggatcagtagccttccggataaaaagatgcaggaagcgcttaagatcatccagagtaatgttccatctctaaagggcacccaagagacagagattgaactcgatatcgatgagctgcctaacgatgtattactaatgctgctcagattcgtcaagaagaatgcaccccaggtcatggaagacgaagacgtggcgacgcccactgctatgatgaatactgctgctgctccccaacccaagaagaacaagcctatgagcaagtttgaacaggaagcttaa

SEQ ID NO: 5636 - DNA, 524 bp, Aspergillus oryzae
  misc_feature (1)...(524): n = A,T,C or G
cgccttttttctaaggaacaattcgtgcaactaatcatggcggactccgaattgcccactcgccctaagcccgaggagacccccgccgcggcccccgcggagggtgcggagcagagcaagagcgccagcaagaacgctgcgaagaaggccgcaaaggagaaggccaaggccgagaaagctgctgcgcgcgccgcccaggagaaggctcaggccgccgctgctgaggccaacgacaccgcaaaggatctctacggcaagatccccgaatccgaagacgtcctccccaccacgaagttcgatgatattaccgatgaccactacgagaaggagatcaccgtggtcgctcgtgtggacaatgcccgtgttcagagtgccaagctggccttcctgatgctcagacagcagggcaagaaggtgcaggctgttattgccgctgcggagcccatctcgagacagatggtcaagtacaccggtggactggacgtcacctcattggccaggttactggggtggcaagaaccccn

SEQ ID NO: 5637 - DNA, 671 bp, Aspergillus oryzae
ccatcagttggataatacttctcgcccacaattgaataatcgcgctgaattcgattcttcagaatgaaagacagtgactcacgtcctcattcaggacctcaacgcaaaagcctcttaaagtacacagcaggttggcggagaatcgtcagcaactttagtccatcatggttttccacaacaatggggacaggcatggccggaatcttgttccatcttatgcctttcgagcatgccgcgctgcagtacatagccatagccttttttgttctgaatgccttgttgttcctcaccgtgctcggcatgtcaattctccgctatactctctatcctgaaatctggaagggcatgatacaagacccagttaactcgttattcctggcaacttgtcccatgggctttgccaccttgatcgagttgtgggtgtttatttgcgtaccacagtggggagactgggcgaagacaacggcctgggggctgtggattattgatgcgggcgcaacgggggcggtcaccggatcactctcatttattcttatttcgcaacattacgtcccatcgttagagcgaataaccgcctggcattattggcgatcggtgcacaaacttggcgttcggggttggaagccagatcgcgggaatttttgtcaacgcgccagcacgcccatggaacg

SEQ ID NO: 5638 - DNA, 734 bp, Aspergillus oryzae
  misc_feature (1)...(734): n = A,T,C or G
caccatcgactttctcatacttgaagcatatctggacattgcacctcaggttggggcttccttgggcttacagcctaatgggctccgaattctcgaccagttgggctgttgtgatgaactcttggaacatgccaagggccacacagtgcaagagagtatttaccggctgccaaacggcgaaaggatatgggatttccgcaagctaagcgaccatttgatagaacgacacgggtatccaatagcgtttatggatcgacaaacagttctccaaacgctatataacaaaattcaggataaaagcaagattcttacaggaaagagggttaaagccatagacagctctgatccgaccgtggtgaaagtgattacgaccgatggatcaatatacagtggggacattgtcgtcggcgccgacggtattcattcaactgttcgccaggagatggcacgtttaaacgtaaacacgggtcgagattacttggaagaaaaatcattctctgcaacctactcctgtgtcttcgggatttcacaccggactcccggcattgatgcttgcacccttcaggacgtattcaatgagaagttctcatatcttattgctgacgggcctggtgaccgtacctatttcttcctgttcgagcacatggatagggtacgatttggccaggatattcctcgactcacggagacggaccgagacgaaattgtcgcagacaccttaatgatccgatcan

SEQ ID NO: 5639 - DNA, 656 bp, Aspergillus oryzae
  misc_feature (1)...(656): n = A,T,C or G
ggggtaggactgggacgtgccgacgaacgttgcgggtttcccccaagtgccaccgattggttacgtccgcctcgctcaccgtcccgtctgcgcatttttcaacttcgttggattggccacgcgaccaccgcggaagaagccgaaaaccgcacaacttcgtctcgccttatctacttggtaacagccgacaatgtcatctgcagccatgtcgaaaaagaacaaagggaagaaagtggccgatccgaatgagacttccaaactccttgccgcaaagatttcgcagctggagcaggatgctgctggcgagaaggaccaagaagcggaaatcgagcgtgaagttaagaaagctacacgagacctgaaccagctcctcagcaatatcgaatctccgatgacccgtcttgaaaccgtacacaaaaagtacaccgaactgttggccgatatgaaaaagctggaccgtgactattccaaaagcaagaagcgggccgatcaactacagaaggatcaagacaaggggaaatcggagctcaataagactgtgaccatgaaggataaactggagaagttgtgcanggagctcacgaaagaaaataagaaggtcaaggatgagaacaagaagttagaggataccgaanagaaagcacgactgatcgtgn

SEQ ID NO: 5640 - DNA, 1197 bp, Aspergillus oryzae
gcgttcaccgtgaaacgtattgagtatttctaaacatcccacttgctcatttaaaagaacatcgtccataatgtctctctccaacaagcttgccatcaccgatgtcgaccttaaggacaagcgcgtcttgatccgtgtcgacttcaacgttcctctcgatgccgacaagaagatcaccaacaatcagcgtatcgtcggtgctctgcctaccatcaagtacgccattgagaatggtgctaaggccgttgtcctcatgtcccacctcggccgtcccgatggcaaggccaatcccaagtacagcctgaagcctgttgctactgagctggagaagctgcttagcaagtctgtcatcttcgccgagaactgcgtcggcaaggagactgaagagattgtgaacaaggccactggtggccagatcatcctccttgagaacctgcgtttccacgccgaggaggagggcagctctaaggatgccgagggcaagaaggtcaaggctgacaaggagaaggtcgaagagttccgcaagggactgactgctcttggtgacgtctacatcaacgacgctttcggaactgcccaccgtgctcacagctcgatggttggtgttgacctgccccagaaggcttccggcttcttggtgaagaaggaacttgagtactttgctaaggctttggaaagcccccagcgccccttcctggccattctgggaggtgccaaggtctctgacaagatccagctgatcgacaacctgttgcccaaggtcaacagcttgatcatcactggtgctatggccttcaccttcaagaagaccctcgagaacgtcaagattggcaacagtttgttcgatgaggccggtagcaagattgtcggcgatatcgttgagaaggccaagaagaacaatgtcaagattgttctgcccgttgactacgtgaccgctgacaagttcgccgccgatgccaagactggctatgccaccgatgctgacggtattcccgatggatacatgggcctggatgtcggtgagaagagtgttgagctgtacaagaagactattgccgaggccaagaccatcctctggaacggtcctcctggtgtcttcgagctggagcccttcgccaacgctaccaagaagacccttgatgctgctgttgcggctgctcagtctggttctattgtcatcatcggcggtggtgacac

SEQ ID NO: 5641 - DNA, 1065 bp, Aspergillus oryzae
  misc_feature (1)...(1065): n = A,T,C or G
ttctaccaattcctctttcaccactatcgctgcaactcgctcgagctcttgacctcaaattgtgccaagatgtctactgacaagattaccttcctcaccaactggcacgcgacgccgtaccacgctcccctgtacctcgctcagagcaagggttacttcaaggaagaaggcctgaaggttgctctgctggagcccaatgacccctctgatgtcactgagataattggtagcggtaaggttgacatgggcttcaaggccatgatccatactctggctgccaaggctcgtaacttccctgtcacctcgattggctctcttcttgacgagcctttcaccggtgttgtgtacctcaaggatagcggaatcactgaagacttccgctccctgaagggcaagaaaattggttatgttggagagttcggaaagattcaaatcgacgagctcaccaagtactatggcatgactgcggacgactacactgccgtccgttgcggcatgaacgttaccaaggccatcatccgcggtgacattgatgccggcattggcctggagaatgtgcagatggttgaactggccgagtggctggcatcccagaaccgtccccgtgacgacgttcagatgctccgcatcgaccagctcgccgagcttggctgctgctgcttctgctccatcctctacattgccaacgatgccttcttggccgccaaccccgagaaggttcagaagttcatgcgtgctgtcaagcgtgcaacggactacgttctcgcagagcctgcagcggccttcgaagaatacattgacatgaagcccatcatgggaacccctgtcaaccgtaagatcttcgagcggtctttcgcctacttcagccgtgacctgaagaacgtcagtcgtgactgggctaaggttaccaactacggaaagcgtctgggtatccttgatgccgacttccagcctaactacaccaaccagtacctctcctggacgttggacgcggatncgaccgaccctctgggtgaccagaagcggattgcggaacttgcaaaaggaggttgcttgggaggttgt

SEQ ID NO: 5642 - DNA, 561 bp, Aspergillus oryzae
ctaaaaaaaaaaacccccaaaattgggggccccttaaaaaggccccccggggcccagcccttttaaaccttaaaaaaaattcccccaaccctttggcaatcccaatttaaaaaaaattggggggaaaaaacccaaagggggggccaaaaaaaaaaaccccccccaggggtcccgggttttaaaaaaatttcccggtgggcccccaaaaatttggggaaacccccccggccaaaaaaattggggcccccaaggggggccccaaggggcccggaaaaaaaaccctggggggaaaccccttaagccccaaaaacccccaaaaggggggggtaaaaatgggccccaaaagggccctttttcttaaaaagggccccccagggggccctaaccttggggaaagggtttttgggttttcccctgctaaaaaacccccccagagaaatttttttaacccgggttaaaaaatatgaaattttggccaaagggagccttcgaaaagcaaaactccccctaaaaaacttcccgggaaaaatttttccccgaaaaattggcccctttttcgac

SEQ ID NO: 5643 - DNA, 650 bp, Aspergillus oryzae
  misc_feature (1)...(650): n = A,T,C or G
cattgacaaaactcgaatacatattgttgagatactcctagagagtgggactatcgacgtcaacttggctaaccttggtggggattaccctcaacatgtgatagactttcgaaaacattatgcgtggtctattttacacaagctcattgagaaaggagctgatagttcacgagtgaacggatcgcatcagacgtgtctccaccttgccagcagggcaggtaacctagaggttgtgcgcaatcttgtagcaaacggccatgatattctgctgaatgatatccatgggctgaatccattccactatgcactgaattatagttgcttagatgtcctgcagtacatgtcagagtctcgcgagagcgagctttcccagctttggcactcgctggatgaccacggcaggagtccattgcaccatcatgtctcgtccgtcctctgctatgttgacgcggttgatttcctgatacagtgtggttgcgacgccaacanacacgacgcanaggggaactcttgcctcagtctggtgctgatccactatgggtcagtgaacgtcaagaaaatctggcgcatcttcttaatgcatataacggagcagatcatgagacactcattttactgtttgatttgggttttggacccagcagcacgag

SEQ ID NO: 5644 - DNA, 439 bp, Aspergillus oryzae
gctcagaccgctgctgtcggtgatggtgccaatgaccttctcatgctccacactgctggactcggagttgcctggcgcgccaagagcaaggttcagctcgaagcacccactcgtctaaacggagagactatggtggatattcttcaccttctcggtctcagcaaagaagatgtcaaggaactgaccaccgaagtagcatgagcgtcccagaagccgtaggtgtgtcgcaaacacgacagaagacacatcctattgcaatgatatctggccaagattgcgtggggacgttcgcccggtgcaggttttccacttggatcttgctagcagggacttagaaaagcaccggttgatcggcgcgctttgctcgattattttctttcctaaaccgagagactcagctttggtacgtatgggctgcctgagttttcactttctggcg

SEQ ID NO: 5645 - DNA, 1215 bp, Aspergillus oryzae
  misc_feature (1)...(1215): n = A,T,C or G
gtctgattagtaggtctgtcctccttcctttcactttcttctttccctcgtttgaacctctttatcatctttattgttattgttatttcgctttcctccacctttcttatccctcgttccattcctcttccccccttctcttctatcaattctggatacccgtttgaccctctcccaggggtcccgctctgatatccgttttttcccctggcagccgcaacgcgtgtccccccgacgtcaacctccaacacccacctatcaatgtgcagaaattgacttgtccctgcgctgtgcctcgccagacctttcgaccttaaccggtcgtccgcagcaaaattcaccgttgacaaccaccatcaacaccactgttcttgttcgtggaggactatgcccaatccctccgtcctttctttctcataaaaagacgctttccgacgtatgatcctatcgtaacgctcacgacttgacgtccgttcgagccttccactctttttgaatcttcagtacacgttcattacgccgttgaccggccagccactctttttctttctgtgttgccagcctttttcattttaacgacgattcccaatatccgcttttttctccccttcttattccttttattctcaaaccgtcatcatgtccctctacccaaccgacccgtctttttcttctaacgtcctgtccggtcgatccatcttcaaacgatgtgtctcatgcgattcaactgccccgacgtgcccgtcatgctcttcgggcgaaatatgtaccatgatcagtcagtcgtgtgaccagtgcgccaccacaaaatgcattaagacgtccagcggttcgagctcgcagggtagctcgtcaggaggaagtaacgtaggggccatcgccggtggtgtggttggtggtgttgctgctgtggccctcatcaccttcctggtatggtggttcttcgtccgcaagaagcgtcaggaattagcccaacaacaaggaaccagcgacggcgaaaaattcagcaccttcaccgatgctcgccaggcacggaagtcgacaaactcgatcgcttttaccgtgctcactcgcgcttcgaacgtcatccagaatcgctacatccctggagtcaccaaccgttcgcccccggaaacgcccctggtgccggcagttcctccgcttncggggtgccgctcccgaacagcacttcttcatgcccggggacctgcgcga

SEQ ID NO: 5646 - DNA, 1128 bp, Aspergillus oryzae
  misc_feature (1)...(1128): n = A,T,C or G
ctgaatatcaacctacaactacaaatcctttaccatgtgtatcgccttcttttccaccgctcatccccaatatcgcctcatcatctgcaacaaccgagacgaattcctccaccgaccaacttcccgtgcagactggtggccgtcccctcattcccacgtcctcagcgcccgagatcttgtgcgccccatccaccccacctggctgggtatcacaaaacaaggccgcatagccgtgctaacaaattaccatgaagacacctgcgcaaaagccgtcgggaaatacagccgtggcgaggtggtcaacagctggctcgcattgtcgccggatagcgcgcaaaccacccaagagttcgtgaaccaatggaccacgaacggagagttggccaatatcggcggatttaacctcgtgtgtggaaatgttatggagccgctggcgattttggacgatcgggcgttggagacggaaccaatcctctggatcgcagacaaaccgggccaaacggtcgggctgagcaatacggactacgatgatcggtcttggcctaaggttgagaagggggaagacgcgattgttgatgcgattgcgggacatgttcagaaccaggagagcgaggacaatttgatcgagaggctattgggcgtgcttagtgtggatacgctaccacgattgagcaacgatgctggagtccaggaatacatcccgcaccttccgcagagtgtttttattccacctatcgggcgtgataaacaggcgcgggatgaagcagagtcagctaatcaggacaagagggagcagagtccagttctaccgtctactcctgagggaacgcccaatcgtgcatatctggaagggctgtatgcgacacagaagcagacggtcattttggtgggtttcgatgggcgggtccggtattttgaacgtacattgtacgacgatgatgctcagccagtctctacagaggctcgcgaccggtcgtttgagttccgtattgaanaatagacgccatacaggaggtttcagctgcatgcgattctagttcgtccatgtatattaagagggtattgcggcgttttggggacatatctctcgaatcataaagcttagtgattgatccggtaaaaaaaaaa

SEQ ID NO: 5647 - DNA, 627 bp, Aspergillus oryzae
cagaatgagacaatgaaacaatgaccatacaacctccttaaagatattgattcaaccaaccctcttgcgctgccacatagacccccatcgtcaagacagacgtatacagcgctgcatcttcctccacctcattcccacttcgtaatgacgacgccagatactccctctgtgcgcgatcccaccccccaaccttcagaccctgcttcgtcaacgtcgccaagcacggcctcctcagccccagctcagcaatattcaacgtaaacctccaatccgcattcgtctcactcccctccgacgccgacgacgacctccccttagccaccctcttctcccattccacaacgcgactcactccatccgccctccccttaaacataaaccgataccctcccctcacagtaacactaacctcccacccctccccaaccggaaaccacaccccacccccgggaaacgccatcttcctattctcctccctggccggcatataaatcaccccgacaacaccaccctgattctgttgttcctcaggtaaatgcgcatacccatcgctctggacaatgtacatgtccctggccgtcaacttgcgcggcgcatcgcccagatgttattgccgcagagcacgcg

SEQ ID NO: 5648 - DNA, 993 bp, Aspergillus oryzae
cttatttcctcattgaatcgccatgtttgacacagtctgcacattaccgctttctgcggatctattcgcccaggctatacaccctaaggagccaattgtctccgttgggcttgcctccggtcatgttgaaaccttccgtcttccgtcagatgaagtggacagtgacgacgatcaggcgtcgacttcctcatcgcgaaatggtcgaggacatattgatacgatgtggaggacgagaagacataagggcagttgtcggtgcttaacatttggaattgacggtgaatcgttgtactccgctggaacagatgggttggttaaagctgcaaaggcagagaccggtgtggtagaaaacaagattgcaattcccccggagaaagatggctccgttgatgccccaaccgtcattcatgcgctttccccccaaaccctccttctcgctactgactcgagcgcactacacctctacgaccttcgccttccgttttcccgcgtctcggcccggccacaacagtcacaccatcctcacgatgattacatctcgtctatcaccccattgcctgcatcggatactagtacctcgggatttagcaaacaatgggtatcaactggtggtactacgttggccgtgacggatctacgacgcggggtaatggtgcgcagtgaggaccaggaagaagaattgatcagctccgtgtatgtcggtggcttggccacgaccgggacaagccgcggcgagaaagtgattgtgggtggctccagtggggtcctgaccctttgggaaaagggtgcatgggacgatcaagacgagcgcatctacgtccagcgaagcggcggtgaaggagagtctctcgaaaccctcgcgatggttcctgatgagctcggacggggcaagatggtcgcggttggtctcggaagtggtggtgttaagttcgtcaggattggccccaacaaagttgtgtcagaggtcacgcacgatgaacggagggagttgtc

SEQ ID NO: 5649 - DNA, 1188 bp, Aspergillus oryzae
gctccttcgacccgtcagtatacggctttgcaccattggagtatctttgatccaatttcgagaacggtgaactccccaagggggaatcgtgcgtgcgcggctttgacaatgcgggttttgtcatgggtaccagctcttccctgtttaaccagttcattctgcgtctgaacggcaccgatatccctaatttcctcaaggaggcgattgccgacgtcttggaacatctgggcgaaaacgatgaggacattgcagtttacgcacccaaccccttctacaaatatcgcaattcaacggcagcatattcgtcaaccccagagctggacgtggtcgacggaggtgaagatggacagaacgtgcctctacacccgttgatccagcccacccgcaacgtggatgtgatctttgccgtggattcgtccgctgatacggaccatagctggcccaacggatcctccttgatctacacctatgaacgtagcttgaatactacaggtatcgccaacgggacctccttccctgcggtgcccgacgtcaacacgttcctcaaccttggcctgaacaaacgcccgaccttcttcggatgcaattcatccaacaccagcaccccgaccccattgattgtctacttgcccaacgccccttacaccgccgagtccaacacgtcaaccttccagctggcgtataaggaccaacaacgcgatgatattatcttgaacggctacaacgtcgtcacccagggcaatgccagtgccgatgcaaactggccctcgtgcgttgggtgcgctattctccagcggtccaccgaacgtacgaacactaagcttcccgatatctgcaatacctgcttcaagaattactgctgggacggaaagaccaacagcaccacaccggccccctatgaaccggagctattgatggaggcgtcgacttccggggcctcgaaggatcaactgaaccggacagctgcagtcatcgcgttcgcagttatgttctttatgacgatctagtgcatatatcttgttctgggatatgttgggtgttgacgtagtatgcctcatgaatacttccactgatttattatttgctatcgcaaaattctgaatattccctgattgcattggttgtgttttatagcgcattttgaattgagtgtaccttaaaaggaaatttaacatgagacagcataac

SEQ ID NO: 5650 - DNA, 1248 bp, Aspergillus oryzae
cgggcaaagacatcaacactgtcctgggtagtatccacacgttcgatcctcaagcgacgtgtgatgatgctaccttccagccctgttcggcgcgagccttggccaaccataaggtagtaacggactcgttccgatcaatctatgccatcaactccggtcgtgctgagaatcaagctgttgctgttggccgctaccccgaagacagctattacaacgggaatccttggttcctgaccaccctggccgccgcagagcagttgtatgacgcgttgtaccagtgggataaaattggatcattggccatcacggacgtttctttgccattcttcaaagctctttacagttctgccgcgacagggacctacgcatcgtccacgacggtgtataaggatattgtctcagccgtcaaggcctatgcagacggatacgtgcagatcgtccaaacctacgctgcatccaccggctccatggccgagcaatataccaagacggacgggagtcagacctccgcccgggatcttacctggtcgtacgctgcacttctcacggccaacaaccgacgaaacgcggtcgttcctgcaccatggggcgagaccgctgccaccagcattccgtcagcttgctctacgacttccgcctcgggcacctacagcagcgtggttatcacatcctggccgaccattagcggatacccaggcgcgccagacagcccctgccaggtgccgacgactgtgtcggtgaccttcgcggtgaaagctactacggtctacggtgagtctatcaagatcgtcgggtcgatctctcagctcgggagctggaatcctagcagcgcgaccgcattgaacgcggacagctacactactgacaaccccttgtggacgggaacaataaacttgcctgctggacagtcgttcgagtataagtttattcgcgttcagaacggggcggttacgtgggagagtgaccccaaccggaaatataccgttccttcgacttgcggggtgaaaagtgctgtgcagagcgatgtttggcggtgatcatcatgtcccgatgaagaggaggaattggtacgtggtattggtgatgtggcgctgtcatattcagtatatatgttcgattctgtgaaatccgaaggcagagagaccaagagagggcccacctattcgtgtgtaatagacaagatattgttagtgtcctatgaaatcccatgatataaatttcgagaaaaaaaaaaaaaaaaaaattact

SEQ ID NO: 5651 - DNA, 633 bp, Aspergillus oryzae
tggacattctttatctacgactcctacaccatgctcaactatctgcgtcggaccatgtgtcagaccactggctaacattatacctctcgcttgaccctaggtagaataagagagctcatgaccctgtcgacccgaaccgtcgccacacgaacactgctagggcccatacttcatatcctgcaccacgacctgacatttcacagcgtatgcgcagactccatggatcatgcgagagatgatcatctactttgaatacacctttctcgtcgcccacttgatccttgaaaagtgcgatgacgatgtccgtccgctttaccgatatataggctctgtgccccaacctgtctgcttacgtttctttagaacgtacagcttgcagaacgaacaccctcacctggaggaccgattcctgaagaaactgatggagctggacgagacctacattgctctacacactactatgtatagcaggcgtgaccgtatagacaatattgacgatgtacctaacaacagtgaagtggatgctgtccaagctgagatatactacagctatgctaagagccgaaatgactgtagcattcttctggacgaggtatcatacagaagcggagtacacaacctctgagttttctg

SEQ ID NO: 5652 - DNA, 643 bp, Aspergillus oryzae
caccacccgaaacagaagcggagaatcaacggaaattaccctctcctctgcaggactacactcctcacttataaactccgcagacccaaccaaactgcactttccatgccaccttaaccaaaccaaacttctacactacagaaagtgaaaagcgaccatgtcgtccctccgtcagcgacaggtccccgccggcgccggccccggcaccaacgaaccatctacatccaaaccgacctcccaaaagaccaaatctcgcaacgagaaaaacggcctcagcgtccttgatatcatccgtgtggtggtcacactgatcgtcgcatcatgcggcttatcctactacatgacgtcttcggagtccgtgctatggggctacaggccgtggttcactagatggccggtgttggtccggtacttgcaaggacccttgagtctcacgccctcgcaactcgccctctacaacggctccgactcgactctcccaatctacctcgccatcaatggctcggtgttcgacgtctcggcgaacccgctcgtgtacggaccgggcggacactacaatttcttcacggggaaggatgccacgcgcgcgttcgtcacgggctgtttccaagaagaccagacgcatgatctgcggggtgtagaa

SEQ ID NO: 5653 - DNA, 690 bp, Aspergillus oryzae
caagagtaccggacggtaagacatgcgaacagtgacttcggacagttattcataaacccctataactgactgacgaatatagcatctcaagaactttgttttagtccaattgtacctcatactttattatactctactccctggacaagattattcatctactcaaactacgaatatgtctcttcaaacccccctctgctcgctgctcaagatccagcaccctgtcctgctggcaggaatggcgcgtgcctctggggctcctctcgcggccgctgtttccaacgctggcggtttgggaacagtcggtggtctgggttacacgcccgagcaactctcagagatgttgacggaactcaaggcctccctacgggacccttctctccccttcggcgttgatctggccctacctcaagttggcggaggagctcgtgctacaaaccacgactacacccacggtcagctggaccagctcatcgacgtcgtcatttcccacggcgccaagctcttcgtctccgcggtgggtgtgccccctgagcgcgtcatcaagagactacacgacgccggcattttgatcatgaacatggtcggagcacccaagcacgccgagaaggcacttaagctgggcgtggacatcgtatgcgctcagggtggtgaaggaggcggtcatacagggcgacatcccctttttcg

SEQ ID NO: 5654 - DNA, 713 bp, Aspergillus oryzae
  misc_feature (1)...(713): n = A,T,C or G
ctcaaccccaaactccattactttcccactccgctttaggttttgatagtagtgctgtgctgcattgcgagcatttactgtctaccttttttttgacgtctgggaatttttgattccagaacccttatccgctaacgttatctggcggggccgaacaggtcgaacaagctcctcaaaaacaacgcaagtcagtcgcattcagtgaaggctctgtcatcatggataccaacggcgaagtcacagaggcgcctaaggtggagaagcccaccgagaatgaagccacagccgacaagtcggtcgatgaagttaccgaaatgttcaagggattgtccaagaagaagaagacaaagaagcctaaggatgcagaggccggcgaaggcgacgaagcttcccccgcagctgacggcgaattcgaccccaccgccttgaaaaagaagaagaagaagaccaagaaggttgacgcgggcgatttcgaggccaagctggctgaggctggtgcagcaaaaaagggagctgaggagacagaggaggtcctccctgagggcgacctcgaggccggaactggtatctgggcccacgacgcaacgcaagccatcccctactctctgcttgtctcccgattcttctccctcattcagagccaccaccccgaccttctgtccagcggtgccaagtcgtataagattcctcctnctcagtgtctgcgtgaagga

SEQ ID NO: 5655 - DNA, 667 bp, Aspergillus oryzae
tgctgccgtgacttggacaagcattcgaaatggcccaccttcctccgaatgcatggcagtgtgctgcccaagatgatcctgcctctgtcttttgttgcggcgtgggccactctgatcacactactctcgaaattcgtacaccctctggggatcaacaacattctgctcacagttactggtttcgtcgtcggtttggcattatctttccggagttcgacggcttacgaacgatgggctgacggccgcaaatactggtcgctgctgatccagacctcgcgtaatctggctcgcacgatctgggtcaacacaaaggaacgtgaaggagagttgggaaaggaggatctcctgcaaaaactaaccgcaatgaaccttatcctagctgtcgctgacgcgctcagacacaaactccgtttcgaaccggatatcgcttatgatgatcttgcgggcctggacggctacctggacaccttcgccaaagatgcgcatgaccgtcagcgcctccagcctcagcggaagtcactctggaaatcgacaggagaatacctgagtgtctcctttgccgaatcgaacccccggaagctcgtcaaacgatccaagacgccactgggtcatcttcctctggagattcttaaccatttgtcggcttatatcgacagatgtatcgcga

SEQ ID NO: 5656 - DNA, 672 bp, Aspergillus oryzae
cgtgcgatggtggtcactggtgtcctatttttgcctgcgtagtgctgcttttttcgctcatgcgatttgccgtgaggcttttatcttgactggctttcccctgtttgtgttacggctgcttgcatggaagacgtagctttcgacaagtgataaaagaggggttgactctcttttcgtcctttttttattttatttctttgaatagacatcattattattatctgatttctcctcaaaaccgtgacaaagaaagatgtcaggccgaaacatcaacctcctaagcctagatggcggaggcgtgcgaggtctctcctcgcttatcgtcctcaaagagatcatggaatccatagaccgcgagaatccccccaagccatgcgactacttcgatttgataggaggcagcggatcgggtgggttaatagcgatcatgctcgggcgcctggaaatggacattgaccagtgcatccatgcttacaagctactatccaagaatgtgttctcccaaaagagactcctacccatcggtagcaatctgcgcagtcgcgcgaaatatgacatcaagaaagtggaattggcgttgcggaagatcctgcgagaactgagttatgagaaggatactcttctgagggaggaggcggggtgtaaggtatttgtttgtgccaccgatgatac

SEQ ID NO: 5657 - DNA, 271 bp, Aspergillus oryzae
agcaacagcagaagtgcttggaggcgcaaatcagctctcgtgcgggcgagactgaacacagaccatggagagaatccagaacgacccagacatcttggctatccttcaggacccagtcatgcagagcattctgcagcaagcaagaaccgacctgctgctctgcagaacacatgaagatgcccaagtccgcctgaagattcaaaactgtgggtggctgtgcatccgctgggaccggaaacgagaaccctggatttaggggataatccgactg

SEQ ID NO: 5658 - DNA, 681 bp, Aspergillus oryzae
cggccaatttgtagaagaggcggaggagattcttgaggagcgtatcaaatatgccagagagcatggccagacccatctgcatgtcatcgtcggcaaaggcaaccactctgccaaccacgtccagaagatcaaaccccgtgttgagcaagtctgtcgcgaacttggtctccagtatgcgacggaagagaatgcgggacgcatttatgtcaatctcaccggcggaccggctgatatgtctgaagttccggcgcactctggctatgggcaatcacatggtcagtatccaggccagcagcaacaccaacagccacaacaacaccaaccccagcagcagcaacaccaacaacaacagcaacaggaccccgtcgaggagatggtcaacgcggttctcccacgtgtgttgcgcaagctggagaaggcttgctgtattgttatgtaaatatcatgggattggtcaacacttatcttcacgatcaccatgctacgaaggatcagacaaccttcgatataatggtaccgatatataatcgttgcaagggacgaaaatgcctaacttactgctgggatatttgcatgagagcttggattaatatacccagaagtggttagattctcgctttaccaacccagtttttatcaaatatgattcgcaccatttatctttaccaaaaaaaaaaaaaa

SEQ ID NO: 5659 - DNA, 546 bp, Aspergillus oryzae
  misc_feature (1)...(546): n = A,T,C or G
cgaggcgtttgtggacttgactaagacgctcgctgagatgtcccagaatggaaaactatcgccagaagatatcacaatggaattggttgatgcagaaattagcgagatcaccgacacagccgtctcagacagcgttaccgactgccgctgggaacaaaacaatatctatcccggacgtttccgtaaagccagaacctgatttactattagtattcaggcccttcttgaaattagatggctatccaccctggcatattcgacttacggagatgtattgtacaggtgacaagagcaacagcataacaggctatggngaggctgtcgaataccagggctttcttangggtttatggcattatgcaggngctcaaatgaggttcgggcgttgagccctctctccctcctggctttcngtacttccatgctcacctcttttccgttgttggaaggaccctgaatcgaggcttcgtataaagcgtcagaatggtttcttgatgagttgacttgggaaagatggtctanaattatgtacctcaccctactttt

SEQ ID NO: 5660 - DNA, 679 bp, Aspergillus oryzae
cgaccgctacgcaacagccggaaacctccggcttacaaaatatttccgctttattggaaaccattactggctgtctcaccgctgccggatcatccctccccaaggacaagcgagatgcaccctcggaagtatcgatcgaacctccgcaagatggtatatcgctactagacaccaaaagcgacttgcttctctcctatacacacaatcttgtttttctgatgctgtttcagttgcgcggactatcaaaggatcgtgatgacgaagctgaagcagatcagtccttgcgtgaagagactgtcaaaaagcttgcagaattacgggtttacctggaccgcggtgtgaggccgttagagggacgactcaaataccaaatagacaaagtgatcaaggccgctgaggatgcggagagaaccgagcgaaccgccgcgaagaccaaggcaaccgaagcagaatattctggcagcgacgatgaatcggcgtcggatggtgaaggcgatggcgcggatgaaagtgatgaagaccaggaagatatcgatgagatggcttaccggcccaacgtctcggcctttgcgaagaaagtggaacccgaagcgcgggcagagaagtctaacaagatggcccccagcgacggcatctatcgcccaccgaagatcatgccgacagctcttcccaccactga

SEQ ID NO: 5661 - DNA, 607 bp, Aspergillus oryzae
  misc_feature (1)...(607): n = A,T,C or G
gaacacgaaggcctttgtacgtccgcatcctcgaatgtcaccccttcactacccagaccttcaccccgattgacctctctagtcagtcgaccgccggtgggcaggaggagccgtattacttggttgtggttgcgccgacgttgaagggccagacggttacggctatgacgccctcgggaccggtgacggtgagggatccgccggatttgaagaatctgagggcgtttgtcgcgcgcgggggacaggcggttacgtatggcgcggggacgtggcatgcgcccatggtggtggttgggtctcggcgggtggattttgtcgtcgtgcagtttgttaatggggttgaggaagaggattgtcaagaggtggcgtttggggagggtggtgttgtggaagttgggggagggctgttgccaaactttagggtggngtttctttttgaatggtgaagaccgaggggggtttgcatgggttatgggtgtattatatcccggggcggggaaaatgggttgggggccatcttataaattgaggggttttgttcatattgaacgggggtaaaaggacttggccctgaagatacggaattttattcctggatgtgggttgg

SEQ ID NO: 5662 - DNA, 573 bp, Aspergillus oryzae
agggccaaaccttaaaataaaaagaaatgaaaaaaaaaggggggccccccaaaattacccccccaatataaatgccaaaaaaaatttaccaaaaaaaaaaaattccccgggaaaaaccacccccttgggaaaaaggggccaaaaaaaaactgggaaaagggcccccccaccttaatttaaccaaacccgccctccaaacaatttcaaaaccctttcaaaatttcccccaaaaacaacggggaatggcccaaaaaacccccaaatttcaaacccccaagggaaacaaacccctggggaaaaggccccccctcccaaaatggcaccctggattccccaaagggttttaaaaaacaataaaaaactcccgtcccggaaaaattttaacaccccgaagggtgcccaaccttaaaaacctcaaaaaaacccccgtgttccccaccagacaccacctaaccaacctgtctccaaagccccctaaaacccccggccccaaagggaaaaacgggcgcgtgggctccttagaaaaccaacacacaccaaacccaaatttccccatccctcaaggcaaaagag

SEQ ID NO: 5663 - DNA, 1493 bp, Aspergillus oryzae
caaatcttcctcccttcgataaacctttggtgattggaataactgaccatcttctatagttcccaaaccaaccgacaatgtaaatacactcctcgattagccctctagagggcatacgatggaagtcatggaatacttttggctggactctcacaatgatcaaggtatcttaggtaacgtctttggcgtgggccggtgttcgttcccagtcatcgatgcattcacatgccctccctaagctgggccctagactctaggatcctagtctagaaggacatggcatcgatggactgggttcgttctgagattatacggctaaaacttgatctggataataccagcgaaaaggatcatgccttctctcgttcttcctgttgatggaatggctaacagatgatagtcattgcaacttgaaacatgtctcctccagctgccatctacgaacccactgtggccgctaccggcctcaagggtaaggtcgtggtttctgagaccgcccccgttgagggagcttctcagaccaagctgttggaccatttcggtggcaagtgggacgagttcaagttcgcccctatccgcgaaagccaggtctctcgtgccatgaccagacgttactttgaggacctggacaagtacgctgaaagtgacgttgtcattgttggtgctggttcctgcggtctgagcactgcgtacgtcttggccaaggctcgtccggacctgaagattgctatcgtcgaggccagcgtctctcctggtggcggtgcctggttgggtggccaactcttttctgctatggtcatgcgccgtcccgcggaagtcttcctgaacgagctgggtgttccttacgaagaggacgcaaaccccaactacgttgtcgtcaagcacgcctccctgtttacctcgacactcatgtcgaaggttctctccttccccaatgtcaagctcttcaatgctaccgctgttgaggacttgatcacccgtccgaccgagaacggcaacccccagattgctggtgttgtcgtcaactggacgctggtcacccttcaccacgatgatcactcctgcatggaccccaacactatcaacgctcctgtcatcatcagtaccactggtcacgatgggccattcggcgccttctgtgcgaagcgcttggtgtccatgggcagcgtcgacaagctaggtggcatgcgtggtctcgacatgaactcggccgaggatgccatcgtcaagaacacccgcgaggttactaagggcttgatcatcggcggtatggagctgtctgaaattgatggctttaaccgcatgggccctaccttcggtgccatggttctcagtggtgtcaaggctgccgaggaggcattgaaggtgttcgacgagcgtcagcgcgagtgtgctgagtaaatgactcactacccgaatgggttcagtgcatgaaccgggattgtcttacggtctttgaccaatggggaatgaggataatgggatagtcctgg

SEQ ID NO: 5664 - DNA, 659 bp, Aspergillus oryzae
ctattctctgaccgcttggttttgcgtagtgttcctgggctgcgagctcacctttgacgcctgaccacccatccgtaaaattctcacaactgccccttttatatcccgtttctttacctcacacaacttgaaaccctaaacccaaaaccatggcctccaaccgatcccggcgtatcgcaaaggaaatagccgatatacacgccgatacgcagtctgggatcacagccgaaccagtaggcagcgatgaagacctcacacatctacgcggtacatttccggggcctccacgtactccgtatgatggcggcacctacgtcgtgcatttaatgataccacacgactattcctcacctgacgcgacgagttagatgacgtccacaaggtactgatcacgatataaagacacgataccgcgaaattatgatgcctacgaagatgattactcgacatgaagacgacgctcacacagacacgacattgcgacacgtagacgaaatgtacgacacgataactttaagatgactattccgatataattacgacttcatcctcacgctattacgaagcgacgtcatggtatcgacgacaatactacaatgatgatcttcccacgaatctgaggataaattgatgacgaacgtgacgatcaacgcgatcaa

SEQ ID NO: 5665 - DNA, 671 bp, Aspergillus oryzae
  misc_feature (1)...(671): n = A,T,C or G
ctcgtaagcagcgtgccgctgccgctgctgctgccgtggctgctcagagtgccgttgcagcagcgcctagtcctccagctccttcttctactggaaagcggtatgccgatctggctagcaaggctcctgctcctgctgctcctaccactcccgtgactacgggtgcctggaccacagttggtgccggcggtaaggccaaagctcctcctgctgccccctccggaccgcgctcgactaccgcaacgactcccttggcggcctctccagtgaagcccaagcccgctacaatttccactccgcgtgccgttactgtgaacaccgtgaccccggcgaaccctaaccgtgcggtcgaggagttcaccaaatgggccaagctggcactgggcaaggggttgaacagcaacatcaatgttgacgattttgttcagcagcttctgttcctgccggccgaagcggagatcatctcggactcggtgtatgctaactcgcagacgctggacggccgccggttcgccgaggagttcatccgtcgtcgtaccctggccgacaagggcatcgtggaccccgtcgcagctagcgcatttgcggagaagagtancagtggatggagtgaggtggccaanaagggctcatcgaatgcccatcgtgaagaagatagcagcaatgccgcg

SEQ ID NO: 5666 - DNA, 676 bp, Aspergillus oryzae
gcaaaacccccccatttcacatcgtcttgttcaaaactagacgccacctttcgcattcttacagtcttccttatcggaagtcattttatctatttctcaaccctcccgtgtgagacgcgcacaagtccctcccttggcgcgtttctggatatccaacaaccgcaatcatggcgcctaaacagaaagcccagaagatgtccatcagcaccttcttagctgatgagaactttggctcttgggccgacgagatggatgacatgcctttgcctgccgcccctcctcagcccaggttcgacagcgatcgccgtgctggtggtcccccgtctgctggatttggcagtggcttcggtgaccgtggctacgccgtgagggagcccctccccctccccacccagcccccgtatactgcccacgtcggaaacttaacctttgatgcgacttcggctgatatctctgacctctttgttgactgtgctgtgacgaacgttcgtattgtggaagacaagttgacgaaggcccctaagggcttcggtttcgtcaaattctaaaccgaaaacgggtttgataaagggctcttgacctttccggcgccacccttgagggaaggacccatccgggtaactttcgaaaagcccttctaagggaacgtgttgtcaaggaatttgatcgggactcc

SEQ ID NO: 5667 - DNA, 730 bp, Aspergillus oryzae
cttggagtcacacagatcgtacataccacgagctttacttggtcctctatacccggtgtggacaagtccagtttcatcatcaagtcttgatatggtcaccatgttcggccgactcacccactacgcttttgacgctgtcctcttctccgcctttttggcaggtgtgaagcgttcgactggtcttacccccagtctcgactccgacaaaatcaccgacaacaaagacttcaagaaatggatcgatagctacctcggcgttggcgagtgggtgatggatcagtccgttgccgtcctgggttccaccagctatttcgagcgcaggcggtgaattatacaccccgggttatccggataaatcggagcgacgctttgggtggggattgaattgataccgaggcgcgctctgggttttccctaagtcagcctgggaatcgagttcgccagaagaataaataggaggacatacattattacccgcttgggacatcatgtcgagagagtgcgtgtcttgtaaaaaaatatcaagagagccgtcgtgactggtattttggcgtcctgcatagcggcttggattacgattgatgattaccttgtcctttatcaggtccggtattggggaccgtggcgttaggactctcaccttgactgtatatcttggtttcagtttggtattatattcgctttacatgagaaaaaaaaaaaaaaaaaaaattcctggggccgcgaattc

SEQ ID NO: 5668 - DNA, 681 bp, Aspergillus oryzae
  misc_feature (1)...(681): n = A,T,C or G
ctttatttctccgaggaaattcgggtactcagtcagcatcacctatcataacagcagccatacgatcatgccaacgaatggggcttcatcgtgacgttcccagaccccatctttcccaggccgagcaagaacagaggaagagggtattctgggttgcctatatccttgatcagagcgcatgcatacggacggggagttcgcccacccagcatccagacgatcttgatatcggttttcccgaggtggataatgatgatgagtttacaatgaacggcaatgcttcttttttccgccagctttgccatttgacgctcataagaagccgggtatatagtaaactttatgctgttaaagctctgcagaaaatgtctcccagagagatctacgatattgtccgggagctccgagaggaacttgaagaatggcataatgcaagccccttcacccaacaactgaagccgaaaggacccagncaggatttcctgggtggatttgctactgctggtttgcagctttgctattataattctatgatcaagaaccaccggctggccttgactttttattttgcctataggcaaaatttacaattggcggcggggggacgttaatacacaaccttttcaccaatcggctaagggaatcttattttttgttaaggtgcccggaaaaactgaaatt

SEQ ID NO: 5669 - DNA, 522 bp, Aspergillus oryzae
gggacaagcgcgatcttgcaaccggcgaggttatattctcaggtgacaaacttttctggacacaaggcgtcttcgaattccgctatcatcataatgccaaacataacgtcatggcaatctccagaccatttgagattcgcattggtcgatatgaagaggaggatgaccatgaacttacacaagcgtccgtggagaagagcctcttacccgtcatccgcagctgcttcgatcgggatccggagatcgctccagaggccgtagacgagccgttcggaagtctggtggagcgcgacggtaaattcgctaagcgggttgtattcgccgtacaccaaatgtttggtgttgaattcgcacctggagttgttcaggccgatgggactgtccgcaacctcgcctggagggtgtgcaatgcgaagagggtcctggctccttacagcatgtcaagaaacggcgcgtccaccccgaccgagaggaaagaagaagggtgtaaaatcacttggtgccttttttaatcacgaaata

SEQ ID NO: 5670 - DNA, 683 bp, Aspergillus oryzae
  misc_feature (1)...(683): n = A,T,C or G
ttttatccaccccttgcgatacagatgcgtcatgaatggcttcgcatcgcacgacctcgatgagggtgcgtacggngagaagtccgggctgcagggcggcctgaagacattcgacgcattccccagaaccaaacccgactacacggctccctcccgtcgaggcggccaatggaccgtcctgatcctcctcatctgcagcgtcttctccatctccgaattcaaaacgtggatcaaaggctgcgagaaccaccacttcagcgacgaaaagggcgtctcccacgacctccagctgaaccttgacatacgactccaaatgccctgcgacgccctacacgtcaacatccaagacgcctacggcgaccgcattctcgccggcgagctgctgaagaaggaccccaccaactggaagctttggacggacaagcgcaactacgaccacgagtatcagacgcttagtcgcgaggaaccgagccggttagaggcgcaggaggaggacgcccatgtgcgccatgtgctgggtgaggtgagacacaaccccaagaagatgatcctcagggtcccaagctgcggagaggagatgctgtcgattcgtgtcgcatttattgaagtctggaaggaaatacggtgcatggagatttccatatcacggcgagaggtcatggntatagggatatggggggacn

SEQ ID NO: 5671 - DNA, 552 bp, Aspergillus oryzae
  misc_feature (1)...(552): n = A,T,C or G
cgagggaacgatgtcgacggcgttacccaaatgcgtgtgtcgtggactggagttcccgttggccaggaggatgtcaccaagcagaactgggaaatgtactatgttcgcagtatcaagcagactttcgggtttggcactattctctgatctagtgcgcccgtatttagaagcttgacgatttgaactccgcttggggtatacagatgacctgatgctgtctgcgatcaacgcgcccttcggggctggcgtaattatcttttgggtcgacttgatagcgttcttggaaagcagacactctgtacatcacatccgtgccttttgtgatacaactttccctcttgcattcgaggggtatggtccgacgattccacgatagaatttcatgattagatcaatgtaaaacgaatcaataacgaaaacctacggttggatacactatatctgtctgtatggcattggataactacacttactcacgataaatcaaattttccttaaccctttttgaaaaaaaanaaaaannnanaaaaaannnaatttccgggggcgctc

SEQ ID NO: 5672 - DNA, 682 bp, Aspergillus oryzae
  misc_feature (1)...(682): n = A,T,C or G
cccaactcaagcccgtccaaaatgccagccgacgaatactccgtcggcgggggcggcaagctcaaactaaaaggctccaaagtgagcgacggccgcatagaaaagaaaaagaagaaagccaagaaaaacccggaaaccggcagcaagaaagaaagcgaagatgctccgtctgcatcaacatcccaggcagtggatgagaaggagaaccctctttcgcctccgccagctcagcaggatgaatccgatttcggggtgagcgctggggctactgggaagacggaggcggaaaggaagtatgaggagatgaggaagaagaggttacaagaacgtctcaagcgagaaggggtcaaaacgcataaagagcgagtagaagagttgaacaaatacctcagtcgactgagcgaacatcacgacatgccgaagattggacccggttaagacaggtttattattcttattaggattattggtttttttttctttctttgttcatgcatgtatcctgggtattattgtttgttcgttatatattatagggttgtagaatttcctcatgcaatggttgtcatgtgccttttttatttttatttggatttttatttttgggttttcctttttgctggcgctccctttttcttaatgtctatcacgttagaactcgaaggtgaaaatcatatgaccn

SEQ ID NO: 5673 - DNA, 675 bp, Aspergillus oryzae
  misc_feature (1)...(675): n = A,T,C or G
taatctcaatctcaaccccctctccctttattactgtgtatgttcgtacttcgacttctagagattgctccggcttgacagcaacttattccgtttctttactgtagcgatacctttcatgtccaccatggaccgcagcttggatgagatcattgcggagcgtcctcagaaacaaaaccggggtggccgccgtcctcctcagggtcgtcgccgtgatggcgtaagaaagtcttacagagaagaacgccctgatttagatctatattacagggattgggtacacgacaaatatgaagacgacagagattcacgcccatctcgtgcccctcgacgacctcgcggtgaccgctattccccgccgccggaccacgctcctactggagctaagcttcgtattgagaaccttcattatgatattacagaaagtgatcttgaggatctattcactcgaatnggtccgatcagcaacctgtctctcgtctatgaccgagcaggacgctctgaggccgtggctttggtacctatgaacgtcccagcgatgcgagaactgccantagcgagtttgacggcgcgaatgctaaaggacaacctattcgtgtgactcttgttnccacgggtggtggacgacgagaccggaatccnntttgacacgttgagagacctaagggtagcttg

SEQ ID NO: 5674 - DNA, 1348 bp, Aspergillus oryzae
  misc_feature (1)...(1348): n = A,T,C or G
tattgatgagatccgtaccggtgactaccgccagctcttccaccctgagctgttgattagcggaaaggaagacgcggccaacaactatgctcgtggtcactataccatcggaaaggagcttgtggacaacgtcgttgaccgcgtccgccgggtggccgataactgttcctctctacagggcttcctggtcttccactccttcggtggtggtactggctctggtttcggtgctctgttgttggagcgcctctccactgaatacggcaagaaagccaagctagagttcgccgtttaccctgccccccgtgtatcaactgcggttgttgagccctacaatgctgtactggccacccacagcactattgagaacgctgactgcaccttcctttgtgacaacgaagcagtctatgacatttgccgtcgcaacctggatatcccccgcccgagctatgagcatctgaacctgctgattgctcaggttgtcagctctatcacctccagtctgcgtttcgatggtgccctcaacgtcgacttgactgaattccagaccaacttggtgcccttccctcgtatccactacccgttgatctcctttgcccccgttgtatccagcaaccgcagttctcatgaaagcttcaaggtgcaggatcttaccttccagtgcttcgagcctaataaccagatggttgtctgcgatcctcgtaacggaaagtacatggctgtggctctgctgtaccgcggtgacgttgtgccccgtgactgcacccaggccgtagctgccatcaaggccaaggcttccttcaacctggtcgaatggtgccctactggattcaagctgggtattaactaccagaagcccgtgcgcgttcccaacagcgaacttgccccggtcgatcgctctgtcagcatgctctccaacaccaccgccatctccgaggcctggagccgtcttgatcacaagttcgatctcatgtactccaagcgtgccttcgtccactggtatgtcggcgagggtatggaagaaggagaattctccgaggcccgtgaagacctcgctgccctggagaaggattacgaggagggttgccaacgatgggcgagccattggaagaggaagagcctgaatactgatcggcttgcaactcaacgcccgctctgcttgtcggttaatccttggcttgtctactttgtgccaaaattgtatctcgtccttgtgcttgcgacaaccccttttgtttttttgttccctagcggtcgntttatttctcaaccttgtcccgtagccaagccgggagaatatgggccggaaatacgaatacacatcctaatttcctgcgaaggaaaaaaa

SEQ ID NO: 5675 - DNA, 621 bp, Aspergillus oryzae
ggaaaacttctctgtgaccctcaacgtcgtcttcttctacaagtccaactggcagaatgaaggattgcgtcttcagcgtcgtaacaagttcatctgtatgctcatggttgccctgcaagagatcggcatcgagggcccacgcatgaacctccagggtgcccgtgtggatattcctttccatgtcacgggtttcccacctcagacgtcatcggccgaccacgacagtcgcccaccgctgacccccatccacgacatgcccgagaacaccggacacagcagctccagcgccgcccgccacccgtcaatcctgcgcaaaggcatgaacaccgctgcggcccgtgctcggggagagtcgatccagtcacacaaacatgtcgacttctcattgggcatgcgcgatctctcctccggcgatgtgatgggcgatgtgtttgaaaccacctcccctcgtgttgatgacgttgtccgctcttccaatcgcgaagccgcccagcgccgcatcctagaagaggaagaggaggaagaagccgaacgccagagccgctcgtcgtcctcccgggcacgtcgcccgtccaacctcagcgtcccgacccagccgggcgaaaggcgtcggtcgacgga

SEQ ID NO: 5676 - DNA, 570 bp, Aspergillus oryzae
aaattggggcccaaccccaaaacccttggattttgggcccggaaaaataaacccccaagtggcccccattttcggggggaacttttccgggaaatccccaagggggttttttttaaaaaggaccctttttaaaaggggcccaaaattccccagaaaaaaattttcccacccccagggggaaaaaaccccattttcccccattccccgatttgcaaaatgccccgggaaaaaaaaaccttttttttccccaaaattgggaacaaagccaggggggcccttaacaacccctgcccaattttgtaaacccccttttttgaccccccgcaaacgaaaaaccttccccgggggtttttcccaattccccccggaacccttaaaaccccccaaccttggggaaattttgcgggttccccaattttttggaaaagggccccttaaaccccggggtattttaaaaaccggcccgggaagggcccctttttttccaaaaggggcaatattggggaattttcccccgttaaccctcttaaaaaaacccccggggaaaaacaattgggggggggagcccat

SEQ ID NO: 5677 - DNA, 668 bp, Aspergillus oryzae
  misc_feature (1)...(668): n = A,T,C or G
cccaactcaatgagaagtttattaaagcgagacgggagtatgaatctctggtggaggcatccatgtcgcaccccgcccagcctccgtatggcaggcctggtccatctcagtatgggtatcctgggcccgcggcatccatgggctatcctcagggccctccgcaatctgagcctcaaagatatttcagccctcggcctcaagaaacccagtcgcaccagcccaatacatccccttactacggtgcagaccaagcgcctatgtaccctcccacgtctcaatcccccgatccgcgcaaccgcacacccccagctggagcatcctatcagcctgtgcatcatcgaccagaatccacatatgaacacccgcaagaactaggaacatctngttatgactcccctgtcgagcatccttccgcaagccaacgacttccatatcctgccagtggacaangccccgncgctgcacagccccccttccagcagcagcagcaacagcagcagcaggaatacccaccctatgccccctgagatgcagcttagccacaancccccctaccctataggcccagctttcaatcagcacccaccaatgcatcaaccgccccttgcccgggcacaacgtaaacacggcactttaccctctttaacccccgggcagaagctatcaac

SEQ ID NO: 5678 - DNA, 576 bp, Aspergillus oryzae
cattgggccaaaaaaccccccctttttggaaacttgacccccaaaactggttttttaaaaaattttcccaaaatttttttaaacccggggatttttaagaaattccccgggggccctttttaaaagggcccctttaaaaaccgggggaaatccccgggtcccaagggggggaaaacccccttatgtggggcccgttaaagggggcgggttaaaacccactttttggaaccctttggccccaaacccttggggttattcaaatccaacctttttctttgggggggaattgggcggccggggcccaatattccggggagggttggggaaaatccaaattttggggacccgggtaaaaattggaacccaggccccaagggtttggggcctttttttcgggatttttttcggggaaaattcccggaaagggccctttttgaaagacctgttgcccccctgggggggtcggcccttggggcccaacgggaactttttgggtacccgggggggtttgcccaaaatcggggtttaaacccccctttgaaggggaggttttgggccccggggcccaaaaaaccg

SEQ ID NO: 5679 - DNA, 695 bp, Aspergillus oryzae
tcaccctagtttatttatctcgagatcctcctcctacgtgaacgactctctagtcattgacatcttgaactttctatcccgccgaaccaccgagtgacgtcatcatatactacctcatctcacgcgacagctcatagacctcccactgctttccaacttccacctctccctcttcgttacctccaaacgaaaagtgaagcatcaattgactttctccaacttcaattcaatcctccaaacacgtcaagatgactcgtgccaacgaacaaactgcaaaggtcttctacaagggatcttctgaggacttcgtagtcttcgtcgacgatattgagatcctcaacaactggcgcaaggatcgctcaatcccactggccgatgtggtaaacggctttaagatttttgttactcacaaacacggtgctcaaggcatcatggacggcgctagcaagggtattctggagaccgagttcggtacctcgaacgaggatgagtgcattaagaagatcctagagaacggcgaataccagtcttctgtgacgaaggaacgccagggtggtaccaatgacgctaaagactcccctgtcgttggccggtaattttcttaattcagcagagctatgcatgtttttatgagccatggattgatttgtttattcgggtggttttctcctgaattttaatatatttgacgatag

SEQ ID NO: 5680 - DNA, 676 bp, Aspergillus oryzae
  misc_feature (1)...(676): n = A,T,C or G
cctggcttcaacgcgactagaaactaatgctatagatttaactagcgacatttatcctggattgaaatcaaccgacaccggtgatctagggctcttttagcataacttcaacaaatccgaagtcctagataggaagtgaaaagaaaatggcaacttgtcttactgcccccaaacggccgtttctagccctgccgtcatttgttccgtcttcgtgtccgtcgatcactttgcaaacacgccggcatcaatcctcgtataggcggacgaaacaacgcctacgtgtcaaaccagatgcgtcgtttggtgtttcgtccacccaatttcatgatcaaatcattcacaacccgccttcgagcgccccctcggtataccatacacccacgaaattcctccctctcgatgatgttcggagaacccttcgtggcgcttccatgaacaatggaaattctgctcaactaccctctgttttcaaaacatccgtggagaagagatatcatttgaatccttcagacatagaggagatccgcagactgcgattaagcgacccgatgacttggagccgttggaaactggctaagcgctttgactgctctccaatgttcattgctatggtatgtgaagctggcccacanaagaaggaattaccgaaacaggtctgggaagcggtccattgaga

SEQ ID NO: 5681 - DNA, 678 bp, Aspergillus oryzae
  misc_feature (1)...(678): n = A,T,C or G
cgctgatgctgtcgaatcactattgcaacggaatgattacatcgcattcactgtacagtgtcgcaacgatttcaggacgcttcaaagggaactaaatatcgggcaaaagttggccgatatcagcatcaagaccagttctgtttccttggatagtttccgtcctcccttaactggagacgagattcggaatctcgggttcgatggttgggcgaaagatttcatcaatggaccagacccagtggtcgccacactatgtagcgagaatcggctgcaccaaacacctatcggccatcgagctatcacggacgaagagtttcgcaaaatagaacaggggtcgatatcctcctgggtggctggcaggcaaagctaccaaattacgcgacgaaaagaatatggtcccagtgcaacttcaacccgtgtgagacatttgaagccggcgaaggtgtggacatcacaacccttggatgcatcagcgaaacaggatctggttcgaaatattcaagttctcaaggacgaagtgcgcgagttgcangaaaagatggacatggagagagccaatctacagcagctcggccatgattntgatgaatgtgaacgggaacaggctcgaacttgagagggagaaagtccgaanaacaacggctcttacaaactaccgggctatccccgaaagaattn

SEQ ID NO: 5682 - DNA, 661 bp, Aspergillus oryzae
aggaatttttttttttttttttttggggatattagattataatcaatctccgtcgttgatagggttcgtaaaacagaagcaaccagggcatagatgctctgactctaaggatacttatatatgagatgcatgggtatataacatcacacgcagacagagagtatcaagcctaacgacgctgcaaagccgcctcgatcaacttccgatatccgcgaacagcctcctgcagatccccaacagttatagcttcattatcaccatgggcaacatggatactaccgggaccatagaggtagcgacgaacggggccgtcctcgcgctcatggatctgcagattcggcacgtcggtgccgtagtttaccgtcgtgatgtcgaagccatcaacgtctgtatccaagtcctgagggggatatccttcggagcgggtattaaactccgcgtacacatcggggttaccatccgtcgcatcgcgcacggcccgtcgaacgatatcccgtgcctcgtcaggggtgcccgcggtcagacgcacgggaacgtcagcgcgagcagtggccgcgacgaccttggcaacgacaccagcggctacctgggcgatgttcacggtcgtgttggcatactttgggctgggaagaaaaaccgcccttgcccggccggatgttca

SEQ ID NO: 5683 - DNA, 869 bp, Aspergillus oryzae
  misc_feature (1)...(869): n = A,T,C or G
tggatcgaggagctgcgcgagaatgagcagaaggcccttgaaacagctgcgaacgacacctctttctcgatccatgttcgtgctttgcaggggctgatcgagaaggtgacaatcttccgccaggtcactaagttccaggacacggagcgtaccaaagagtctgactggaagctcagcaacttgtacgacaagtatattgaatatgctgatgtggttgctacccatggaagactacaggtcgcccagaagtatttggaccttgttccggagaagcaccccgaggccgaggttgcaaggaatcgtatcaagctggcgacgaggcaaccaactgctcagaagacacagcaaacgactactggtcgtggaacgccactgaacaagcctctcccaactaccaacgcttaccagcctcaacgaacattctctcctgttgcgacagccgcagctccgagcccgtacgctccccctgctcctactaccaatgcgtacgcccctccagctgctgctaccaatccatacgctcccccggctgctgctaccaatccgtacgcacctccggcccctgcttcgaatccttacgccccgcctggtgctgctgccccaccacagccaacgaacccatatgcgccggcttctggaggcagctatgctcctacaggataccagcccacgccagcaccgtcttacggtgctaaacccctaggtggctcggtgcctcctccaccacgtgcgtcgaatcaatccccagccactgttaccacgtacactacagctaccaacctccttgcttggaacgatcttcccgaaggcttcgcgaaggcttcgacaccccggagaagaaactccgnncgagctgctgcacctatcag

SEQ ID NO: 5684 - DNA, 663 bp, Aspergillus oryzae
  misc_feature (1)...(663): n = A,T,C or G
gtgtttgtaaaggagccgttggcaccttccttcttcgaatcgtgcgaaacaaaattcagatttggtttatctggggatgtcttgggatcaccacttttatcactctgttcgccagcatcactgttgtggtacagtgctttccagtccagaagacttggaacccaactctagaaggaacgtgttggctcgacttttctaaagtgggttacacggttggttcgtggttcgtcgcggccgacttctccttcgcgattcttccatggttcatcatctgggatctcaacatgaagcaaaaggagaagatcaccgttgcctgcggtctcagccttggaatctttgctggagtatgtggcatcgttcgcactgtagccctgtccggcctgaatgcatctgagtacatctatgataccgtgccaatgctcatctggtccgcaaccgaaagttgcgtgacgatcatgtgctcgtccatttccgttctccgtcctctctacgttcgcgttaggtacggcacgaaagatgaaagcaggttttggcaacacttcctacaaactgccattgtccggcagcggtcgccagtccggcaaacttttcgaattccggcttggacccttccgcccgtcgaaacgaacggggggtttctctttgggcaccctgctggagaan

SEQ ID NO: 5685 - DNA, 653 bp, Aspergillus oryzae
ctattcatacttacttactacacatcagagagtccaatatgtcttcaccagcaaacaacccacgagtaccacgcggtccagtcgaggctgagatagtcttttataaagaccccgcggatggctctgctcccttcaactacgtggaggagccaccggagggacagcctcagcgcaactatagcgaagctgtccacaaagttcatattacggatatccgagggcaagaagatcagttcacgttagatcgcgacgcattccaagttttacgagacatcccttcacaaacgacgtacgagacattcaattcagacgatgccatcaaacagttatattaccctgaggtagaaaagctactcctggaaaaggttcccggagcacacaaaatcatcatttttgatcacaccatccgacgagccgatcccgaagcgtcacgccaacccgtccggcaagcccatggggaccaaaccaaatggtccgcagcgcagcgagtccgtcgacatgttcctgatccggaggaagcgggaaaactacttcagggacggtatcgtttatcaacgtctggaggccgataaatggcgcgggtgaatcgttccctctggcttttgccaacgctgcaactttgggcgacagggacttcgctaagaatgaacatt

SEQ ID NO: 5686 - DNA, 714 bp, Aspergillus oryzae
cgaggtcgctaccttatttcctctctatcctcacagcgtattagctgtgttgttaagctagacacgcgccattgacttagcctcttacaaaaatcgcatccatttcttctatccatttccactctacttagctcctaagacaatcatgtccacccgtaagagaaagcaagaagccgaagaagaagaagagctccaggcgctccctagcgacgagagcgaagaggaagaagagtatgaggactctgaagtaggcgaaagcgaaggtgaagaagagggaagtgaagaggaggttccttccgatgaggaggaagaggaagaagaagaagaagaacccgctgaagagcaaggaccccccgccaccaagaaacgcaagacagcagccgccccagctgaagaaggtgagggcgaagtaaaagaaaacggcaaaggcgccgatgaaaacggagtcggagaggaagatgaagaggaagcagaagaagacgaaggggaagaagaagcgcccgaggagacagccaaaaccagtggtcctgctgcttctgcagccaaggccaagggtgcgactgttccgaaggaactctgagtcgacactggagtcgaagaggaggacgagtgaatgtccttccggcctgtgttgatgatttgggggggctgtaatctttacgtcaaataaatttggttcgggctgtaattggaatctagctactattttggcta

SEQ ID NO: 5687 - DNA, 675 bp, Aspergillus oryzae
tgcactcatggaacttgccgtcaaagacttaaagatggaccaagctacgtcggttatcgactacgaaggcgaggatccttatcagatgatccaggttcatgactatctgaacgtcagcttcctacgcatgaaccccagcgtcaaggccgctactaagaagaccattgacgtgttcgccaccgcctatccagagctgcttcgggaaaagttcttcgtcaatgtcccctctatcatgggttggatgttcgcggcgatcaaggtcttcctgagcaagaacaccacccgcaagttccaccctatctccaacggcgccaatctggcaagggagttcccacctgccgtcaaggaacagttccccaaggtctacggtggaagcgctcctgatcttcatgagggcgctcgtacggtcgcccttgaggaggacaacgagccagctcccgcccccgctgcccccgcggaacctaccgaggaggccaaaccggagcaagaagcacccaagcaggaaccggccccggaggccccaaaggaggaagcaatcaaggaagccctggtggaggctccgaaggaggaacccaagcagccagctgtcgaagagccggccaagactgacacggccgttacgactcaggagacagtggctcccgcttgagccaaatagatgcaacgactttgtcc

SEQ ID NO: 5688 - DNA, 1767 bp, Aspergillus oryzae
gttttttcatcttctatacttattttctgtaattgtttgaccgtaagaggctcctttcggtcatatattaaatatacttcagacggatctcgccattcttttcgagccgtcgcaatcaactccagtcgtttgataaatcaatcagtttcattttcaatatgaagggttccgccattgcgacagccctcaccttgggtgcttccactgccctcgccgctccttccatcaaggcgcgtgacgatgtgaccgctgtcaccgtgaagggtaatgccttcttcaagggtgatgagcgtttctacatgcgtggtgtcgactaccagcccggtggctcctccaacctggccgaccccatcgccgatgccgaaggctgcaagcgtgatatcgagaaatttaaggatctcggtctgaacaccatccgtgtctactccgtggataactccaagaaccatgacgagtgtatgaacgccttggcggatgctggcatctacctggtgctcgatgtcaacactcccaagtactctctcaaccgtgccagccccaagatttcctacaacgaaaactatcttcagtacatcttcgccactgtcgatgccttcgccggctacaagaacactctggcgttcttctccggtaacgaggtcattaatgacggcccctcctccaaggccgccccttacgttaaggcggttactcgtgaccttcgtcagtacattcgcagccgcaactaccgtgaaattcccgttggatactctgctgccgatatcgacaccaaccgtctccagatggcccagttcatgaactgcggtactgatgacgagcgcagtgacttcttcgctttcaacgactactcctggtgtgatccttcctcattcaagacgtccggctgggatgagaaggtgaagaacttcactggctatggtcttcccctgttcctttctgaatacggttgcaacaccaacaagcgtcagttccaggaagtcagctccctttacagcaccgacatgaccagcgtctactctggtggcctggtctacgagtactcccaggagcccagcaaatatggtcttgttgagattgacgatggcaaggttaagactcttgctgactttgatgctctgaagtcggccttcgagaagaccaaaaaccccagcggcgacggtggctacaacaagaccggtggtgccaacccttgccccgccaaggactcccccaactgggacgttgacagcgatgctctgcctgctatccccgagggtgctaagaagttcatgaaggatggtgctggaaagggtgagggtttcgccggcaagggtagcatgagcggtggtggtagcacctccactggcactgctgagcccggctctggctctgccaccggcagcgctggcagctcctctggcagctcctcctcgtcctcgtctgctggtgtcatgaacattcccaacatgtccctggctcctctcgtcgttggcatggttacggtcatgtccactttcgtgggtgctggtcttatccttgtttaaaccttgagttcatgttctttgagcttgggtcattgttgtttcatgaatttcttcgatatcattagtttctatcggtattcagatggattatttaaattgtatatccagattgagggaaactgtctttggcggtaactaaatgggaacgccggcagaaggcttgtgactttgtacagttgttgacacgcattaacaagttttcatggggcagttagaaccattaatggacgattcaaatcccttt

SEQ ID NO: 5689 - DNA, 1362 bp, Aspergillus oryzae
gtcaccggagagattcccgggttggatgaccgtcaccccacccattgcttggattctagacttctataagaactgtccagcgtctcaccatcagcttacttcactttctcatcacttctctcatcgtgtaaatcaaccctaactccaccgcaacctcctttcttccctttctttcaacacaagatcccaaagtcaaaatgtcgatccccgagatgcagtgggctcaagtggccgagcagaagggcggtccgctcatctacaagcagattcccgttcctaaaccaggaccagatgagattcttgtcaaggttcgctactcgggcgtctgccacaccgaccttcacgccttgaagggtgactggcccctcccagtgaagatgcccctcgtaggtggacacgagggagctggtgtggtcgtcgccaggggtgacctggtaactgaattcgagattggcgaccacgctggtctcaaatggctcaatggatcctgtctcgcctgtgaattctgtaagcaagccgacgagcctctctgtccgaatgcttctttgtccggctacacggtcgacggcactttccagcagtacgccattggtaaggccactcacgcctccaagcttccaaagaacgttcctctggacgctgtcgcccccgtcctctgtgcgggtatcacggtctacaagggactgaaagaatctggtgttcgcccgggccaaaccgttgccatcgtcggtgctggtggtggtcttggttctttggcgttgcagtacgcaaaggcaatgggcatccgtgtagtggccattgatggcggagaagagaagcaagccatgtgcgagcaactaggcgccgaggcatacgtcgacttcactaagacccaagatctcgttgcagatgtcaaagccgctacccccgaaggcctaggtgcacatgccgttatacttcttgccgtcgccgaaaagcccttccagcaggctgccgaatacgtccgctcgcgcggtaccgtcgttgctattggtttgcccgccggtgccttcctcaaggcccctgttttcaataccgttgtccgtatgatcaacatcaagggaagctacgtcgggtaaccgtcaagacggcgtggaggctgtggacttctttcgcccgcggcctcatcaaggctccattcaagactggaccattgcaggatcttccgaagatcttcgagctcatggagcaaggccaagatcgccggcccgtatgtgctcgagattccgaatgaagggacatgttcataacgcataaaatgaaaacagctacgagtattatgagaattcatcgtctctttctcagggtcttcggctacagactattaaggagataagaccgccg

SEQ ID NO: 5690 - DNA, 1352 bp, Aspergillus oryzae
gtgaattatattgtcggacgggtttgtgctacggactctcttaactaccgagaattgttgttgttgttgttgaatgcgatactaacaaaaggaggtaatgggggccagtcagtgagaacaaagtttgcacgggcaggattcacaccagccccaatgcggaatgccgggaaaacagcccggaggcctatgactgaggacaagacagtcagggtggaaaggatcgatttcttcctagtgggtatactataagtccttagtgacaagagaatttcttgggtgagaattgcaaagaaatcctggaaattctaatttggattggattcaatctttaagagtgcaatctgagccaccgggcgatcggcttctcatctttttcaattccattccctattttgaatttctccgcttcggaccttgtcatcagctttcccccccccagttggttcttaattccacttttctactctctctttccttcccccttcaagttcttgtctcttgttcgacccgttcgtactttgcattttcttaaacatctatcatcatgagttaccaacaacagcccccttatcctccccagcctgcctacggtcctcctcccggtaactacggacctcctcagggcggctaccctccccagcagtacggcggttaccctcctcagggtcctcctcctggacaatacgcacctcaaccccaaatgggatacccgcagcaacaaccagctccacagcaggagaaaaagagtcacggctgtcttggtgcctgcctggccaccctttgctgttgtttcctgtgtgaagagagctgcgaatgctgtatcgactgcatcgaatgctgcgaaatgtgctaagcttcacgacccgtatatgacctcaatgatacgataatacctacccatcgcgtgcgggatagccggttggggtgagggcgccgggaggcgctgaacgattcggcgtgcagcccttttcgcttatttcgctttcctttaaacccgtcgatctgtcctccgaacaacgtggagcgtaccgatttttatcaatcatgtttacttactttgggataatggctcccaggacaaagaggtggtgggtttgggaagagatctgcttttgctggatggcgctttcagttcgatgaccttttaatttcttgcggatcgttttttgtttccttgcgtcggtgtttcttcgaagggagcattgttttacgatcgattgtcttcgtggatcgtcgagtgcaatatgtccatccgcagtacggagatagtcttcaattcgatccgtcgtgccgaattctgatccgaggtccctgccatggtaatcgtttccggtgatgataggcgtaaccgg

SEQ ID NO: 5691 - DNA, 1107 bp, Aspergillus oryzae
  misc_feature (1)...(1107): n = A,T,C or G
cttcgagctttctagggaacgtcgagctgaaaactgggaggacgagtacgacctcctccgagatgcatatgacaatcatgtcagaaccaaaaagtcacgcaagcaagaccttcactcgccacgtagagcacgtgataaagacaaggagaacaagcgccctggacgcagagattcgccttcacctggaggccgacccagaaaaaccaatggaagcccgggctatagggatcctgcctccaaggatacagccttgacaaaagagaaaaggcgtgacaacgtagctcatttgaaggagaagtctaatccagcccgtccgaaaccggctcatcctactggtaccgaccccgatagcgctcgtccggatcccagaccgaagcagctgcttccaccaagagagggtgagtctagtcgtggcgaggaagcccctaagagacgacgcttgatcgctggacgacctccccaagatcgaaggaggcctagcctaccctcgtccgattctttgtcgagccgggacgaaagctcaaaagcgcgtattgatcaccttgaaccctcaaagtccggaccaccaccccttaaacgtgggcgtagcagcgctagcccggagcgaggtcgtgccttggaacccgagcggcattctcgtgatactgttcagaagaaaagacgtgtcttgtccgaagacgggaccccgaacatcacgaatggaggcctcaaaaaggatcacacaacaggggatgccaagccccgccggaaggatgatgaagatcaccatgcagagtccagaccagatccattacgtcaaacggacaacccatcccataaggcacctgaacggaagccggttaaggaggaacaggagagacatgatatcaacggcctcaacgatattcctatggacgactataccgaacgagctgaggcagaggcagaggctcgtcgacagaaggaagcgcgaaaggctagnacagaacgcctggcagaggaagctcgtctcgctgccgaaaccgaaaaaacttcgttggaccaaaaanaaggaagaacgtgctgctcattcggctcgccttggctaagaaaaagaaaaagctgctgatgaagaaccccaaccccaat

SEQ ID NO: 5692 - DNA, 646 bp, Aspergillus oryzae
ccgacatcaatatcaattcacacaaaatgggttggtggtggagttcgtcttctcctaccaaaaatgaagcgcaaatcatctcatcattcgatacgcaaccggcgccagagaacgccggggtacctacatcgcaaccacggacattaactcgcgaagaacgagcagatgcggagttgaagcaattgctagccagcttggagggagacatcaataaaggacatgaggcatcgcaagggtcaccgtcctccgcagagtccacatcattacccccgtcatccatagcgccggaatctctctaccccgatacaatgtcctgtcgttctgcgttcgactacgcattcttctgtcaatcgttcggcgggcagtttgtcaatgtttaccgatatggcgagctgcgatcgtgcagtgaacactgggataatttctggctttgcatgaagaccaggacatggtcggatggtgctcgtaagaaggcagtcagagaccactatcgcaagaaagccatcaagtataagacggggcccagtagtgaggatgtctgggatctccggacagagccggatccgaatgcttttgaaggggatattgctgctctagagcatgagatgcaggccgatgaagaatcccagggggctggtgcccgctt

SEQ ID NO: 5693 - DNA, 679 bp, Aspergillus oryzae
  misc_feature (1)...(679): n = A,T,C or G
gtccgccggaggcagagagccctcttctcgctcagagcagctactcgcaccatccaccttccgccatggcgcccatttccatgtccaaagatcggccctcaccacaggaatctttcacgcaaatggccgacaaagatctagaatccatcgggcgacactgtcaattcgagtactgcaaccaacttgatttccttccattccgctgcgagtcctgtcgcgggacgttctgtctggaccaccgcaccgaaacctctcataaatgccccaaagccggtgaatgggctcgccgacgaaacgcccagaacgcaagccccgacaccagtctccctacgcagaaacccacgatctacaactcggaccaatgcgcacatctcgactgcaaaactctcatcaacacgatgaaggacccgggcgtccgatgccccaactgcaaccgccaatactgcctgaagcaccgactccgggaggaacacgactgcgccaagatcaccccgctgggcggtcggccggccgccgcaggcgccaacgccaacgagacgctgcgttccatgttcgccccggtgcgcacatggggcaaagagaagagtcacgcgggcacccagagtctcacgccgactccgaaaccggataatccggcggcgcgggctgtncagctgaatacacctcagaagtctgccac

SEQ ID NO: 5694 - DNA, 618 bp, Aspergillus oryzae
  misc_feature (1)...(618): n = A,T,C or G
gagattgtccgtccttgctgtgatggcaagcatgatgtcagctcactctcaaggacaagtcggtccagcccgcgtgtaaatcggcatcactctcatcactgagcctgtcgacgcccatcgtgaagatgcgttctttctccccaaggacctggtatatgcatcgctcacatctctttcctttccaccctcctcaaccttgatagcatgcgaatctcatgagcgcacgtgttagcattttattactgactccctgtgcttttcggtagctgccaccctccgggcaccctgtcttggaaccttgagttacgtatagccattattaatcttggggggttggcccctttggcattgatccccgctcatgtgtctggactgttcctgtcattcattcgtgatatttgcaaaatgacatagtgatttagtcatttactttgatgatactcaatgtcagccggtatattcatgccggtcgttacacctaagcttggcccntacttattaccaacactttcatcgtgggtgcatcttgcgttcggccatgaaattttgactttcttttcttccattttggattgaagccttgcaatccgtgatgacaccaagattgcacaccttcct

SEQ ID NO: 5695 - DNA, 854 bp, Aspergillus oryzae
  misc_feature (1)...(854): n = A,T,C or G
gattgataagttgaatcttcttacacaggatactgtcgatgcggatgcgaaacctggagaactgctggtcaagtactcccggcgcccagagatggcctccgtattcaactacgcctctatggctcataacaaccatttcttcttcaactgcttgtcgcccacccctactcagatcccggacaagttcgccaaggacatcgttgatacctgctcctcgatcgaatccctgaagctcgacttccttgcaactgccaatgctatgtttggccccggatttgtgtggctggccaagaacctggagagggaaggattgatgcacatcttctgcacctacaatgcaggctccccttacccggccgctcactcccgtcggcagcccgttgatatggctacgcactcccccgacgctcccttgggcaaccagtttgctggtgcgatgggcgctcactccgcgaatcagaagagcctagctcccggcgctgtcgatgtccagcccattctctgtgtcaacacatgggagcatgtatggatgatggactacggcattggtggaaaggctgaatacctcgagcgctggtgggatcgcattaactgggaggttgtgttcgataactacaacgcggtcagctcgatgaagggcacacggcatgcggccaatcggaaccgcagcctaagcatgctatgaaggaaaaaatgttctacagagcggatacatatgtggttcccctcctttcatgtcttgataattgtattatatactacatggtttggctgttcagggtttctttatatctgggtctaattgtacagcgattcatcgcanaatagaaaaaagaatgagactcaaaatagag

SEQ ID NO: 5696 - DNA, 1351 bp, Aspergillus oryzae
  misc_feature (1)...(1351): n = A,T,C or G
cgctcaactagacattgacccttcccaaacccctggtggaatttgggaaccgtcccatgattttgcaccaagtcgagagcttggctgctgctggtgtcacggatattgtcctggctgttaactaccgcccagatgtcatggtttcggccctcaagaagtatgaggaacaatacaatgtgaaaatcgagttctccgtcgagtccgaacccctgggcactgccggtcccctgaagttagcggaaaagattttgggcaaggacgactctccattcttcgttctaaactccgatgtcatctgcgactaccccttcaaggagctggctgagttccataagaagcatggcgatgaaggtaccattgttgttactaaggtcgacgagccctccaagtatggcgtcgttgttcacaagcccaatcacccctcgcgcatcgaccgctttgtcgaaaagcctgttgaattcgttggaaaccgcatcaacgccggtatctacatcatgaaccctagtgtgttgaatcgcattgagctgcgcccgacatccattgagcaggagacattcccggctatctgcaaggacggacagctccactcctttgacctggagggtttctggatggacgttggtcaacctaaggacttcctcagcggcacctgtctatacctcacttctctcgccaagcgcaattcgaagctgctcgcacccaactccgaaccctacgtgtacggtggcaatgttatggttgacccctccgccaagattggcaagaattgccgcattggtcccaatgtagtcattggtcccaacgttgtggtcggtgatggagttcgtctgcagcgttgtgtgcttctagagaacagcaaggtcaaagaccatgcctgggttaagtcaaccattgtcggatggaatagctccgtaggcaggtgggctcgtttggagaatgttaccgtgctgggtgacgacgttactatcgcagacgaagtctatgttaatggtggatccatccttcctcataagagcatcaagcagaacgttgatgttcccgccattattatgtaaaacccctcttctcatgtcgacatgtcttcaaatactttgcttccagtcgcctgcacctcgaaaccgtccgatgcaaaggaccgaagtcggtttcttttacttaaattgatttcaagcaggcctgagcctgccaggcttcctttggtcaagtcttgaccaatttttggaatacacgacggtcctgacacctttctatttaccttccctcttcttgcataaatcttttattccatttcttatcttgctncaccgtacgcaacttgctgaatgccttgatggcgatagcgctgcccttt

SEQ ID NO: 5697 - DNA, 652 bp, Aspergillus oryzae
cctgtagccagcaccaaggacttctaccagtccctctcgtccatgctagacggcgccttcgcaaaggacaaaatgagcttcaaacaagcctacaccatctacgactacctcaacgtcgccagcatccacaacacaaccaacacccccacaaccgaacaactagagcaactcttcctcctcgccaatatcgaacaatacaacctcgcctacaacacctccgacaccgtccgtgcaattgcaggctcccaactcgccggcgaaatgctccagggtctcaacgaaaccatcacctccaagggtgcaaccaaactcaacatccagttcggttcctacggaaccttcctctcttacttcgggcttgcgcagctccccgccgctgatgtcaatttcaccggtatcccggactatgcgtcgtccatgtcctgggagctggttaccgattccactgcagatggattccccgatgcatcggagattaatgtgcgttttgtcttccacaacggtaccattaccgggtccaacgatgcgcccaaggagttccccctgtacggccagtcgagtgccacgatcccgtggtcgaagttcgtcgaggagacgaagaagattgccgtcaccgatacggaggagtggtgtaaggtttgtggaaacacgg

SEQ ID NO: 5698 - DNA, 648 bp, Aspergillus oryzae
gaccttcgaagacaaacttactggatgggggtgttttcagcgagctttgctttagcagcttacctatttttgaaaattggtggcttgggtgcccatggactaatctgggttaacattatcaacatgacagtccgaacggcctggagtttcatcttcctccggtcctacttttacctgcacggcagtagcctagccctgtctgaattctgtctacgacctcaaacatggattgctggggctttatcatcaataatcctggccagacaaggacacgacgatactgtctattgtagctctgtgaaggcattgacattttgtactggttatagcctcctgattattctcctcgaaagaaagtaccttgcaacacgatacgcatatattcaccggataatcaagtctaggagtgcgagaataaagaccgaatgatgtgcagaactaatcgtcgaacacaatttttgtggctgtcatgtcagtgtcaacattcctgaagaatgcaacatatgcatcatgttgcttcctcttgacagttgttccaaacttaatgaagtcctctggtatatcctgttttgctgctctgaggacgttgatcaatctgcggcttattactgaaaggtcctcgctcatataatctcactatcaaatggt

SEQ ID NO: 5699 - DNA, 1095 bp, Aspergillus oryzae
cttcgacgactaacgacaacagggtcaagatgagtcaccggaagtacgaagcgcctcggcacggctcccttgcctacctgccccgcaagcgcgctgccagacaccgtggaaaggtcaagagcttccccaaggatgaccccaagaagcccgtccacctgacggcctccatgggttacaaggccggtatgaccactgttgtccgtgaccttgacagacctggtgccaagatgcacaagaaggaggttgtcgaggctgtcaccgtcatcgagacccctccccttgtcgctatcggtgtcgtcggttacattgagactccccgtggtctccgctctctcaccaccgtctgggctgagcacttgagtgacgaggtcaagcgccgcttctacaagaactggtacaagagcaagaagaaggccttcaccaagtacgccaagcagcacgctgaggagagcggtgcctccatcacccgtgagcttgagcgcatcaagaagtactgcactgtcgtccgtgtgctcgcccacacccagatccgcaagacccctctcaagcagaagaaggcccaccttatggagatccaggtcaacggtggctccgttgccgacaaggttgacttcgcccgcaacctcttcgagaagaccattgagatcgactccatcttcgagaaggacgaggtgatcgacgttattgctgtcaccaagggtcacggtttccagggtgtcaccagccgttggggcaccaagaagcttccccgtaagactcacaagggtctgcgtaaggttgcttgtatcggtgcctggcaccctagccacgtccagtggactgttgcccgtgctggtcagatgggttaccaccaccgtacctcttgcaaccacaaggtctaccgtatcggtaagggctccgacgaggctaacgcctccaccgacttcgatatctccaagaagcagatcactcctatgggtggcttcgtccgctatggtgaggttaagaacgacttcgtcatggtcaagggttccgtccctggtgtcaagaagcgtgtcatgaccctccgcaagaccctctacccccaaaccagccgcaaggccaccgagaagatcc

SEQ ID NO: 5700 - DNA, 1191 bp, Aspergillus oryzae
ttcctagtacataatgtagtcacgccttcttgcgcttctttcccctctttcttctctttcccttttttcgaatcgaacagccttcattccttccttttctgggtacccttgttcctgcgtatatatctacgcatcgtccttctttttgactatcctactgagttcactcctttaaccatcaatcttacgacgaaggctttcccgtctcgctgtatctcacttgcattgcatatcgtatcaacatcgaccttacctcgacatcttcaattacctttttcggattatcaaatcgccttagaacaatttcatcaaaatgcgttccatcttctacttgactctcagcgccatggcgtctctcgctgctgctgctaccaacagtgccaacccgttcaacatcccctctgagggttattcgttcgaggctggtgagccgactacgctctcctggaagcctaccaccagcggcaccgtctccctgaagctccaatggggcgctgtgatgacttcgaacacgggtactaccattgcccagaacattcccaactcgggcagctacacatggactcctcctgccaacctcgcggctcagcctgactacaccattgagatcttcaacgacgatgacaccagtgaggtcaactatctcccgcggttcaccgtggccggtgctactgccgccgcgtctaccaccgcgtctgccaccactaccgctgagactacctctgccaccgagtcttccacgactgagacgaccactaacaccaagtccgccaccgagactcataccacattgactaaggcgactgctagcactgcctcgagcacttcggctactgcctctggcaccagcaccgagtccactagcgcctccgccagcgccaccggcacctcgaccggcacctctactggttctgcctcaacctccactgaggcttccagcaccacctccgccagtgcatcggcctcgaccactagcgttgtcaacgtcaatggcggtatggttaaccgcgtctctggcggcatgctggcgatcgttctgggtgccattgccgtcctgtgagcttcctccggactctagtcggcgatctgaccatacttcattaattagatagttcttaactactcttctatcgcttctttggtttctttttcctctttttcttttttcgttcactgagcggacctgtttta

SEQ ID NO: 5701 - DNA, 674 bp, Aspergillus oryzae
  misc_feature (1)...(674): n = A,T,C or G
gaaacgaggatatggcagcattacggacgacgcttacatattcgatagcgtcgatgcggctctcctgcatctgctgctggaacaagattcaaatgtacctacggaacaccgcctttcttcacgaacacgtacggaattgaataggctggtggataattggaagggtaactttgaccgggcagtcgcgcttctggaaaactacaagcgactatttctcctgagtcgcttgtaccagagccaaaagatgtcccgtaatgtcctcaagacgtggcggcggatcattgaaggggaggaagattctgggaatgagaccaccgcctctggcgttgagacacagatgcgcaggtatttggtcaagatcaaagatgcacagcttgttgaggaatatggtgcttggttggcacagcgaaaccctagtcttggtatacaagtctttgcggacaacactagtagagtcaaattagaccctgcaaatgttgtccgcctgctcaaggaacgagcaaccaacgcagttcaagattacttggagcacctggttttctcaaagaattatacacaatacgcagatgacctcctttcatantatcttgatactgtgctctctggtcttgagaactcncctgctgctcggtcgtcgctttgcgaatccatatcgactttacgtgcattacacg

SEQ ID NO: 5702 - DNA, 682 bp, Aspergillus oryzae
  misc_feature (1)...(682): n = A,T,C or G
ctggactcagccaatggttgcggactggtagtgtcgaagccggagcctcccaaagaaccacaagcaagcagagtcactataccctctaggactcctaccaacaccagcaccaacctgcaggacaggccattaccccctatcccggtggaagattctccttcatcaggcaccacccaacgacctccgacaacaccaaccgacacccgaccacccaccactccttccgagaatcgtaaccctaactcagcaacaacaacacccacccgatccggccgcgtcacccaatggctcttccagtcaagcaacaagacctcccccttctcttcatccgtatccccttggaagtccactttcaccgacaaaaaccccttccgcatccgctcccgaaccctcagtggatctactatcacctccagtctgaccagcctaacaggcggcttcaagactaccccatctttatccagcaacactacagcagccgccccagctcctccaccccacattgattcccgtctggaaaaggagttggatgtgcccatgtccttttctcgtccctatatacctaaacacgctgatgagcccgacatctatccaactatctttgaaggtcagcaacagcatcagcatccgcagaacggatatgatgaattcgatcacaattactacacgacgtaatcgcaan

SEQ ID NO: 5703 - DNA, 670 bp, Aspergillus oryzae
  misc_feature (1)...(670): n = A,T,C or G
caaatcggagccagcggaccacgaattcatgcagcgactgttccggaagtggtccacggagccatctgaggggctcagcttacaaaacgtagtcaatggacttgcacgccttaaggggccgcgtgatatcatgaacaatatcaactactttttcgacctgtatgatgataatgggaatggcactgttgatcgggagggaattttaagaatgtcagaagctctccttttcctctcccggcgaggctttgacggcgcaattaccccgagtgaacctctggaggaggttggcgaacgcgaccgcttcgagcaggataaattgagtaccgatgagaggttcttggggagtgtcagctcgttcatccgtcgctgcttcgagtacgccgatcccagtaaccctgagggcaaggctacgcaagaacgaaaggatacagatacagaagaggcaaccgaaaagcttgacgcatttgctattggcgacgacgacgaagaagaagacctcatcgatattgctgacgaagcanaacccgagccatccgattcgaagaagcaaaacagtgatacccagcacaaccggngtgcatcagaggctgcaaatccagccctcgacccgaacaaccctctacacattacccttcccacattccgcatggtcatattggccgacgagcta

SEQ ID NO: 5704 - DNA, 660 bp, Aspergillus oryzae
cagcgatcccccggactctccgcggtcaacttacctgcttgtttcccaacgtcttcttcgtcctgcggcgatcgcatccgtgcatacttgccctgtagggagtaacttaccgtggagctttgtcgcgaacgccgtttgagaacgagagatgtccggcgacgatcgtcagtgacgtgaagctgccctgtgatgggatcggttgtgcccctccgctcaaagaacaataagtttcattgatttaataaaggaagcgcggtctcgccgttctactttgttaagctctggaagatatatataccgttttttgccgctttttcaactctacagtacactttagagaagaggactggattggacgtcatcgctccactcgatcgcctctagacaagatggcgatgaacttcgtgacattcaaccaggactacagctacttggctgtggcgactgccaaggggtttcgcatattcacaacagaccctttcgccaagagctatgagaccaaaggaagggaacattgctataatcgagatgctggtttcgacatctttggtcgcgttgattctctcaccacgttgctttgcaaatcacttattaccaagcgcccaatctacaattatgcgaagttaacgtttcccaccactggcctaacggttaaaactg

SEQ ID NO: 5705 - DNA, 649 bp, Aspergillus oryzae
  misc_feature (1)...(649): n = A,T,C or G
tctggtctatcgcctaatactccaaacgcatcgttctctcacccccacccaccatgtcgaactcaacacaatcccacgataagcccgaagcttcacagcaaccccaacagcagaagccccccgtgttggaggaagacgatgaattcgaggatttccccgttgaagactggccacaagaagaaaccgaacaagcttctggatcagcaaacggcgctaatggtcacctttgggaagagagctgggatgacgatgatgccgctgaggacttctcgaagcagttgaaggaggaactgaaaaaggtcgaagcatcccgttagtatgcagagtggcatggtatcggttcggttcgcgagatgaatgacagctcaatgaattaattgaccgtggaattacaaatatatcaagacgaaacgctatacataacctcacaactgggctaagctagatctcgatgctcgaagaatttattccaaatcttctttgacctgcactgtattgggattgaggatgtgcagttgaggagacaacctatgatgggatactngacagcaggcctacagacgagaagaggcgacgacttgagtttttctcgccacgtattctataagtatctacaatttaattgtgaaacgattcaaagtccaaaaaa

SEQ ID NO: 5706 - DNA, 1074 bp, Aspergillus oryzae
gctcgtgctcttcacgactttccaacctttaaaaccaggtaccatctacgagcgttccgttcacagctcgtcattcatctatcctaacaacccgcctcatctcaattgacggcggggtccgctacgatatgggagacggttctgattatcccagcccacgaagcgaaggtcccggcgggcctgcaactgtccttgtcactgctgctcaagaaccccttcctccagcaccaaaaatgacagaccaactgtctccgagtttcatggaaggaactcgtccgcgactgtcggtgagacgggcgcgagatccacccaagaacgctgcaggccagatttattgcgaccatcctgagtgtcagcacgcgcctccgacgttccgccgcccatgcgaatggaacaagcatatggacaaacacgaccgcccttacaagtgcttagaacctggatgtgacaagatccagggattcacgtactcgggtggccttttgagacaccagcgcgaagtgcataagaaaaacatcaacgccaagaaacctttgatgtgcccatatgccgattgcaatcgcagcacaggcaatggatttacgcgtcaagagaacctaaaggagcatcttcgacgccgtcatatgcataccgataatggacacgcgtccgaactacctattgtgccagtgcctgaactggatggcaccgcggccctgccagtcacttcgcctgtcaagcggaaacgtgactcgatcgattcggtcgaaattcctgatgaagaagaaaacggcgttgacttgcgaaatgaaatcaagaggctgcgacgcgaagcccaaatgaaagatcgacggctggaggagttggaaagaattgttgcggacttgcagcagagaaacccgcaaactgcagtctcgcagggataggtgggttcggactgtggtctcatgagaaatatcaatcttcaatgcatgtagctctttcacgaagctgacatgtctctcccttttcccctttcaaattggggttggcttttacacccattgtgacatttggctttgcaattcaacaggcggttttaccatgcagagtggt

SEQ ID NO: 5707 - DNA, 648 bp, Aspergillus oryzae
cccttttacttcataaaatatcagaggttatttggcttgtctaattagtctggcaatacatattcccggtcatagcaccctcaattgtatcaaagagacaaagaaatcacccactatgcactcgtctctaaaccgagcgcaggccgtcttcggcttctttacaaccgtggccttgttcgtcgccggatttgccgcgttgtctgtcttgttatttcccaccgatgaggcgaaagcagcagtgtcattgaaggatgtcaaagtaatcaaaggacgaccacattactattcaaacaagaaagaagaatacgcacaaatgcgtttcgatctggacgccgatctctcctccctcttcaactggaacacaaaacaactcttcgtctacgtctacgcctcctactcctcctctgacaaggaatccactctcctcccccagtccgagtccatcatctgggataccatcatctcggccccggaatcgccgtactccttcaacactctccgtgagcgcttcttcccgtccaagtcttcttcgaaacggaccaccggcgccaagaagtcgactaagaaagataaagccgcgcctggtgttcttcgtctgaagaaccaacgggctaagtaccaaatctcggatatcacggggaagatggc

SEQ ID NO: 5708 - DNA, 667 bp, Aspergillus oryzae
  misc_feature (1)...(667): n = A,T,C or G
gaacttaatataattctacttttctacgagtcgagggaattatctctctagtcaaaaaattatctctgccattttgagtttcttcgatctcatcgcataatgttccgccctcaaagactcacagctcggctgaacctgcgctcagtacgatggaattcgactaccagcccatctacgccgcctttgatggctaaaatcaggaccgaccttaaggttgctatgcgtgccaaagatacagcaaggttgaacgttctgcgcgctatcatttccgaaacgaacaactccttgaagacctcatccccgatccaaactgatttgcaacttttgtcattgattcggaagcgtatgacaggagcaaaagatgcggcacaacaattcgctgaggccaaccggcccgacctgaaagagtccgaggaaaagaacgtcacgattctggaagagtatgcgaaccaggtggagacaataagcctagatgatgtcaagcaaattgtggcacaggagatctcaaggttaaaggaagcgggccaaaaggtcgagatcgggacgttactcaaatcactgtttgctcccggaggttgcttagacgggaagccagcggagagatcagaggtcgctaagatttgcagggaggctgttttctgcctctaaagacatgaaccgatcggtn

SEQ ID NO: 5709 - DNA, 1448 bp, Aspergillus oryzae
  misc_feature (1)...(1448): n = A,T,C or G
ggcccttctgtcctataatattcaggtcgagttagccctcgatcctgatcctctgtgtgtcgtttcttcgtttttgcactttactatacaaccccgcctctaaggcttttcacaaaaaaaaaaccgccaaaatggttaacttcacaatcgaagagattcggtccctgatggacaagccgaagaacatccgtaacatgtccgtcattgctcacgtcgatcacggaaagtccactctgtccgactccttggttcagcgtgctggtgtcatcgccgctgccaaggctggtgaggcccgtttcatggatactcgtgctgatgagcaggagcgtggtattactatcaagtccactgctatcaccctgtactccaagtttgatgaccccgaggatctcaaggagatcgagcagggtcacgacggcaacgagttcctgatcaacttgattgactctcccggtcacgcttacattctccgctgaggtcactgccgcccttcgtgtcaccgacggtgccctgggtcgttgtcgactctgtctccggctcttgtgtccagaccgagaccgtccttcgccaggctattgctgagcgtatcaagcccgttctgatcatcaacaagattgatcgttctatgatggagcagcagctccccaaggaggatctttaccagaacttctgccgtatcatcgagaccgtcaacgtcaccatcgctacctacgaagacaaggttctgggtaacgtcatggttcacgccgagaagggtaccgttgctttcggttccggtctccagggctgggctttcactgttcgccagttcgccatcaggtacgctaagaagttcggtgttgaccgtaagaagatgcttgaacgtctgtggggtgacaacttcttcaatcccaagaccaagaagtggactaccaagagcactgatgctgatggcaagcctctggagcgtgctttcaaccaattctgcttggaccccatctacaagatcatcgacgccgtcactaacaacaagagggatcaaatcaccactctcgtcgagaagcttgagatcaagcttactagcgaggagaaggagtatgatggcaaactgctcctcaagaccatcatgcgcaagttcttgcctgccgccgatgctatgttggaaatgatctgtatccatctgccttctcccgttactgcccagaagtaccgtgctgagactctgtacgagggtcctcacgatgacgaagccttcaacgccatcaaggattgtaaggctggttccaaggaggaccccgctcccctgatgctctacgtctctaagatggtgcccacttccgacaagggtcgtttctatgctttcggccgtgtctactcgggtatcgtcaggtccggtctccaagtccgtatccagggtcctaactacacccctggcaagaaggangacctgttcatcaagaagaatcacg

SEQ ID NO: 5710 - DNA, 1293 bp, Aspergillus oryzae
  misc_feature (1)...(1293): n = A,T,C or G
tcaagtctggattcgtattcattttcattttcaccgagatcaatatcgtggtataatcaactgaacacaattcaaaatgggtaaaattcttatggttctctatgacggtggcgagcacgccaagcaacagcccggtctcttgggtaccaccgagaatgagctcggattgaggaagtggttagaggaacagggacacactctcgtcactacctctgataaggagggtgagaactccaccttcgacaaggaactcgttgacgccgaagtcatcatcaccacacccttccaccccggctatcttaccgctgagcgcctggccaaggccaaaaacctcaagatcgcagtcactgctggtgtcggatcggatcacgttgacctgaacgccgccaacaagactaatggcggtatcactgtcgctgaagtaactggctgtaatgtcacctctgttgcggaacacgttgtcatgaccatccttactctggtccgtaactttgtccccgctcacgagcagatcacccgcggtgagtgggacgttgccgctgtcgctaagaatgaattcgatttggaaggcaaggtcgtcggaaccgttgctgtcggccgtattggtgagcgtgtccttcgtcgcctcaagccatttgactgcaaggagcttctctactacgactaccagccccttagtcccgaggttgagaaggaaatcggctgccgtcgtgttgacaccctcgaggagatgcttgctcagtgtgacgttgttaccatcaactgccccctgcacgagaagacccgtggcttgttcaacaaggacctgatctccaagatgaagaagggctcatggctcgttaacactgcccgtggtgctattgtcgttaaggaggatgttgctgaagctgtcaagtctggccacttgagaggctatggtggtgatgtctggtatccccagcccgcccccaaggaccacccactccgctacgtgcagggcccatggggcggtggcaacgccatggttcctcacatgtctggtacctcgatcgacgcacagatccgttacgctcaaggcaccaaggctattctcgagagctacttctctggccgtcatgactacnagaacgaggatctcattgttcgcggcggtgattacgttactaaggcctacggccagaggaacaaggcttaggtctctccaatcactttgtaatgagcgggttaaaatgttttcttggcgcatgcttctgggctgaaacagccttaaggagcagggcgatgtttacttatgatacctaaaattatattgcg

SEQ ID NO: 5711 - DNA, 703 bp, Aspergillus oryzae
  misc_feature (1)...(703): n = A,T,C or G
cggaagtcagcttgcatcagtagctttgaatggaaccgctcaggtgtggaaaccgactactagtgatcatctctcgatttccggatacggtatcaagcggattacagatattgcctggtctcctgacggaagtcaacttgcatcagtagctttaaatggaaccgtttgggtgtggaatctgactactgagagtcagctctcgagttttggagataatcactggaatgatgcagattattcttctaaagttgcctggtctcctgacggaagccagcttgcatcactttcacatagtaaagtggttgtattagatccggcctctggccagtgcatctcaaagtttcctgttccaaccggtgacctccttcggttcgatagcatcgaccctaactatctccacacgacgcttggcacattcgatatgagagatttgaaacgtgcctcaagaggctccaatgactcaaaccatgtaccaaagccacatgggtatggcctcagcgaagatctttcctggataacatatgacggaactaaggtcttgtggttacctnctgaccatcgaccgcaaaacttgagtgcagttgctttgtcaaacctggctgtagccatcggctgtgcatctggtgctcttgaaatacttgaattctcgacgcctaatcctctctcagaactttgaatacatcattcggtgcattgagtccct

SEQ ID NO: 5712 - DNA, 678 bp, Aspergillus oryzae
gtttgtcctatttcgagcagaccgggttcatccagtcaggcaagatggtcttcatcctgggcgtgaacttccctgagcggaacctcgtaaagaaatcgctccagtcatttttcggcattgggaacaatggctcgtcacgccttctagcccgcttccacatccaacccacgtgtaaagtcggcgaacttgcaaacaagcaagtcctcgacatcaacggcgccttggccgagatgaaaatccgggacgaacttcgcaacaagttccgggttggaatcaaagccctaaagggaacgggttatttccggggttacccaaattgatttggaacccccgttgcgggcacaggggccgaaatctacatcaaactggggttgaaacccaaccgcgtgggaaaaagggctcggctccaaatacacggggtgtgtgcactttgtggcccctcgtgttctatatgtggggggacaggatatggtttaaactcttaaatcctcgtgaattgtgaataggtaaaacttttaaaccctcgggaaggtgtaaaatctctaaaaaaggggttttgccccaaaaatggcggtgtcccccggttttggtcccagagggttctaagaatcttcaaagggcgtccgcctttgtttggggtgggtggcaacaaggggggagaaaaaatatttttttttg

SEQ ID NO: 5713 - DNA, 718 bp, Aspergillus oryzae
  misc_feature (1)...(718): n = A,T,C or G
ggctctgcagaagcaatcgcgaagcagtgctcgggtgagtctgagaatctctgtggtgaaacatggggcaaagacacttgggatggtatgaagggcctggaagttcaaatggccgcattgggtggaattacttcgaacctgatgctcttggagagcaagtcgccacagaccatcgatacaaatcccgacgcagctgaacatcacatcgataataacgaaaacagcagcaaagaccccaccaaggcgaagccgattgagacagcagatcgggccggagcctggatcttgactgtcatgatcgccgccggtgcgatcggcgccgtggggtggttaatcaagacgcaataagggctcgggttagctttttattttcatgtacagatcgtcgcgctcaaactggtcaggtgggacatacctttgcattcagaaatagctttcgtacattatgttttactactatgctttcgtttcatcatgacacccgataaatacttaattcagaagatatatcaataccctccttgacccatatttccgagcctaagagagcgcgttaaacctgagaatcagaaagagaaagtcaaactttactgggccaatttgcgataagtcaatngtattgtaccctacccatcaagtgcctgcgcaacttgtgtccaatccccannanaaccanntaaacaaaaaacatttctggcgccggtcgagcatgcattta

SEQ ID NO: 5714 - DNA, 1621 bp, Aspergillus oryzae
  misc_feature (1)...(1621): n = A,T,C or G
cgacaggagattcaaaatgctgagccgctgtggtcgccaggctttgcgattgatcccgcgcacgggaagctcttccagagctatcgccatcactactcaactccgaccggctgctcccttgtgtgtctccagctcaatttctcagagccggagtgtgtcatcctccagtcgtgatggacagcaacatttgctctccgcacacctcgaggaggaagaccccacaatctacaatattctccagaaggagaaaaaacgtcaaaagcactttatcaacctgatcgcttcggagaacttcacttctcacgccgttttcgacgcccttggttctcccatgtccaacaagtactccgagggttaccccggtgcccgttactacggtggtaatcagcacatcgatgccatcgagctcacatgccaggcccgtgccctgaaggccttcaacctcgaccctgccaagtggggcgtcaacgttcagtgcctgagtggcagccctgccaacttgcaggtctaccaggctcttatgcgcccccatgaccgtctgatgggtctggatcttccccacggaggccatctgtcccacggttatcagacccccgccagaaagatctctgctgtctctacttacttcgagaccttcccctaccgtgtcaaccttgagactggtatcattgattacgatgccctggaggccaacgctgagctctaccgccccaagtgtctggttgccggtacctccgcctactgccgcttgatcgactatgagcgcatgcgcaagatcgctgacaaggtcggcgcttacctcattgttgatatggcccatatctccggattgatcgccgccggtgtcattccttctcccttcgagtacgccgatgttgtcactaccaccacccacaagtctcttcgtggcccccgtggtgccatgatcttcttccgcaagggtgtgcgcagcactgacaagaccggaaaggagattctttacgaccttgagggtcctatcaacttctccgttttccctggtcaccagggtggtccccacaaccacaccatcactgcccttgctgttgctctcaagcaggttgacactcccgagttcaagcagtaccagcagcaggtcctgaacaacgccaaggctctggagaacgagttcaagcagctgggccacaagctcgtctctgacggcactgacagccacatggtcctggtcgacctccgtgctcagaagttggacggtgctcgtgttgaggctgtcctggagcagatcaacattgcttgcaacaagaactccatccctggtgacaagtctgcccttaccccctgtggtatccgtatcggtgctcctgccatgaccacccgtggtatgggtgaggaggacttcaagcgcatcgctcactacatcgacaaggccatcaagatctgcaaggatgttcagggtgcgctccccaaggaggccaacaagctcaaggactttcaggccaaggttgcctccgagaccgtctcggacatccttgagctgcgcaaggagattgccgcctgggcttncaccttccttctccccgtttaaatgtgataccaaaattttctggggttcattngttaaatctgcgagtcaacatctttg

SEQ ID NO: 5715 - DNA, 1145 bp, Aspergillus oryzae
  misc_feature (1)...(1145): n = A,T,C or G
cgtgatcgtgatctggatgagattgttaagcctgacgatgacaagtctggtgtcaactgggagcaatgggagaatgaagaggatggatgtgaagctaatcttgtctatcagctggcagcctatcttcctccctctcttgtaaattttattgaggacaaggctcttgccatccgtggtttcctcgagcagaacggcatcctacctacgaaagacgagggctccgcctccgagtccaaggcagtgactgaggcccgtgacgccgtcgatgcagtccgcaagtccatcgaagatttgaagaaccaggtaaaggatcacaaggaggaccttgatacggactacggtgtgggatccatcttccgtgctcttaaaggtgtctgtatccagaaggatgccggagagtatacatacgaacactgcttcttggatcagactaaacagatcccgaagaagggtggatcaacagcccgcatgggcaacttcgttcgcatcggatctgtcactattgatcagctcaacgagtccggtgagatcgtcnccgagggagagatatctcttgagtacgcaagggacagacctgctggaacggtcctgctcggtccacgagtgtcgtcttgcagtgtggtgaggagaacgagatcctgaagattgcagaagacgaaaagtgtgtctattcgatgctcgtcaacacccctgccgtgtgcccaggaggagaggaagacgtccatgcagcctcgggccgcaaggacgaactgtgatgtgacatgctagttctgcatatatataccgagtttctccaagcattcttgtctttcctttcctgttttagccctctcgtcgagcccactccttgtcgctttgtattccttgaatagatctctgcatgccctgaacagattactgggcaaggctaaatagatagagagatagcgtgagcgaggtagctttaatggaatgcttctagaggaanannnnnnnnnnnnnnnnnnnnnnnnnnnnnnnnnnnnnnnnnnnnnnnnnnnnnnnnnnnnnnnnnnnnnnnnnnnttttccggcggccgcttgaccttgaattgtaagggcccatttccccctttagggaatacaattacatgtgccgggcccgagtattacacgggctgggaaggg

SEQ ID NO: 5716 - DNA, 680 bp, Aspergillus oryzae
gctttatctttctccctacgcttcaacctcttccagacctctttactccatttttatttccgctccgaattgcctttacattccctccagttcacagcctaatccagacccattatggcaaacggcgccgacctccggactctcgtctcagagcttcacaacgctctcaaccggaaacagtttgatgctgccaacgacctccttagccgcgcaaagcgcaccctcctgctgcagaatgccctcatcccaacatcttcaacatcacctgagctgattgctctcgcccgggaagtgttggagctcggcgctctgtcctccatccggcaaaccgacgcaccctctttcacacgatactaccagcagttgcaacctttctacgatctggagagggatagcgctaatgcaggaaaggtggacttcaagaccagccaacgcagcaagatcacgggcctataccttttgctgttgctgagcatgggcgacagcaccagtttccacacagtcttggagggtctcgttgaggaggcgagtttgaaggggaagagcattgaggacgacccatgcattaaatacccagtggagctggagagaaacttgatggagggaagctatgataaagtgtggagagagaccaagtcggagagagtgccttcagaggaattcggcctgttctctaatgc

SEQ ID NO: 5717 - DNA, 1016 bp, Aspergillus oryzae
ctcgtttcctattccttccaacaattacactcgcttgccttcctctgcgtgtcatcgtctgatcatctccacacccggttcactgtcaaaaatttgattaacggatctacttcaaacgtcaaaatgcgtgctactttcatcctcgctgccttcgctgctgtggccgctgcccagacttcttctgctgttgagagtccctccgatgtcgagaccaccggcgttgctgagactggcagtgccactgccactgccactgccactggcggcgctgagaccggctctactgtcattcccaccgtcacctctcagcccgtgatcccctctggaacggctactgaagcccctactacccccaccggcagcggtgccgagtcctccggtgctgtgaccggctccagctctgctggttcctctaccctcgttaccaagtccagcagcgctgcgaagagctcctctgccaccgcgactgagacctccaccaagaccaagtcgaccgacgaatccaccagcactaagggctcttcctccaagtccagcgccgctgcctccagcacctctgagggcgctgccgtccccatggccactgccggtcctctcggtctcattgccggtgctgccatcgctgctctcctgtaaatggacagctcgtgatccattaaacgcttggtcgattgacaatatcgctttcgttctcaagcattagtgtgctccccaagcggacttgtgctttatggacctcccccctccgactatcccagctaccggggatagcgggacgaaaagagatgaggcatacggatactgaagttcattttcatactccatatgtatcattgccgggaagggctttttattccaatttcctttcttttctcgtctgacattaagtcgccgctgttacacaagacacgcttaatattcgccgcgcacatatcaaacttgtctttcttcgaagtttaatcttaataccataatgatgctacgctacaggtaaataggaattccattctctgagg

SEQ ID NO: 5718 - DNA, 695 bp, Aspergillus oryzae
gcaaacgcaaacacagcgcatagtggcacaactggcggaggtttgttcgggggtgcttctaccgcacaaactcaatcaaaacccttattcggtggcatgggaacgtccaacaacactggcggatcgctattcggcggtgcgaaccaaaacaacacgcaacaacagcagcaagctcaaaagcctacattatctttgtttggaaaccaaaacaccacaacacagcaaccagcgcagcccactgcagcagctggaacagtagttccaggggtcaaagtggacttaagcaaccttctaccgacaactaagtatgagagctgtgccgacgagatcaagaaggagctggaagtattcgacaattacgttcttacgcaaatcaagatgtgcaacgaagtgggaaacatgatccctagcattgctgcccagggagaaaccattccgaacgacgtggagtttgtccaagggaagttggaaacaatgcaacacgcactggagaacgatgccagcgatattgatcagttacgaagtcttgtggctcgtgatgcggctgaagcacatgtgggctttcgggcgattgatacccctcagctacctctgcagttccagcctgcagcgggctctggatggttttctgttcaagaccaaaaattggctgatcgacaatcggtgcggtcaacacgcaagaacactttggccct

SEQ ID NO: 5719 - DNA, 1186 bp, Aspergillus oryzae
  misc_feature (1)...(1186): n = A,T,C or G
gcgaattgttagcaacacgatgcgcgccctctcccttgccagcctcattggcattgctagtgcggcgtgtccgtacatgaccggtgagcttgaacgtcgcgacacaggaaccgacgatgccaccgccgcgacagaggaattcttgtcccagtactatatggccgacaatgacacattcctgacctccgacgtgggcggccctattgaggatcagaacagccttcaagtcggagaccgcggcccgacattgctggaggatttcatcttccgacagaagatccagcgcttcgatcacgaacgtgttcctgaacgtgcagtccacgctcgcggtgttggtgcccatggtgtcttcacctcgtacggtgactactctaacatcactgctgcctcgttccttggagctgagggcaaggagactccggttttcgtgcgattctcgactgttgcgggtagccgtggtagttcggatttggctcgcgatgttcatggctttgcgactcgtttctacactgatgagggtaacttcgatattgttggcaacaacattcccgtcttcttcatccaggacgctattcttttccctgatctcatccacgctgtcaagcctcgtggtgacaatgagatccctcaggctgccactgcccatgactctgcttgggacttcttcagccagcagcccagttccctgcacaccctgctctgggccatgtccggccatggtatcccgcgctctcttcgccacgtcgatggctttggtatccacaccttccgcttcgtcactgacaacggtgactccaagctcgtcaagttccactggaaagtcctgcanggtaaagccaacatggtctgggaaagagcgcaacaggtctctggcaagaaccccgacttcatgcgccaagatctcttcgaagcgatcgaggcgggcagataccctgaatgggagctcgtggttcaaatcattgttgaagaagaccaactgaaatttggctttcaatctgttgatccaaccaagaacgtccccgaggatacgtgcaattaaccaagctggccaagatgactttaaaccggaaccttgcaactactttgccaaactgtaccggtcatgttccaccctgcccacatcgtcctggtggttaacttaaccaggatccttttttcacagccggtttttttcgaacctgaaacc

SEQ ID NO: 5720 - DNA, 738 bp, Aspergillus oryzae
  misc_feature (1)...(738): n = A,T,C or G
catgggactgacctagcactactactcgtactaccgaccaacactgccttagttcactctaagaaggcatcgtcaaaacccactcactacgaccgccccccgcccagcctcccccaaaaatagtgcactccaccgctcaattcgctccccttccagcttttctcgacccttctctgttctttctctcacgtcacggccacttagcgcattgctacctctccgctctcgctctcttgagccttccttcttactatctttacgcacttcccctgtccccaagaagaccacacacaccttccgctctcatggctccacctcctccgtcgaacttgcctttggccgagaggctgaaggccttggcccagactctacaatttgcttggtttgctgggcacgtcaccctgctgctctccgtcttccgctatctcctgtcctacatcaccttcaactactactcgtcctcggcccaggtgtcctaccgcttggctttcctttcggcggctgcgacatatggtatcggggtgtacaagggacatattgcccgtggtcgtcttcagggtagcgttccgaacattgcggtgaagctcgctggtgatgaaaatgtccagtatcttggaatggcgattgtctggctctattcccgccaggtcccatnggccctnnctccntntagcgtctactcgatncttcacgtngcgacatactctcgcgccccactgatccccactttgcagcccn

SEQ ID NO: 5721 - DNA, 841 bp, Aspergillus oryzae
ggagactatcaaaccgggggcttgatctggagaatcatgggataagagtatctctaaattactagccttcggcgagagcgagtacgatcggatcgtccaccttgactccgacgccaacgttttacagaacatggatgagctatttttccttcctccgaccaaggttgcgatgccacgggcgtattgggggcttccggataccaaacagctgtcgtctctgctgattgtaatcgaaccgtcctacaaggaatacaatgctctgatggaggcggcgcttccggctatgtacggacaaaaagcggtcaatacatcatcgacacaaagatacgatatggagttattgaacgaacgttatgccgattcggccaccgtgcttccgcatcgccagtatggcttagtgagtggcgaattccgcgcagaggatcatagaaatttcctgggcaataactatgaagtttgggatccggataaagtgctagcagaagccaaacttgttcatttttcagactggcctttgcctaagccgtgggttctgtggccgcagaatttgctggctgagatgttgcccaagtgtaaacacaaccctggcacaccacaagaaagtgggtgccgtgatcgagaggtgtggaaaagtatctatcatgacttccggcggcggcgaaaggacatctgcaaacttctgagttatccggcccctgcttggcctccaacggagcattctgagtcttccggctcaaaagaacctgtataatgcatatttgatagagcgtgatcggcgttaatgggtttccacgcgggctaagcattacatgtaaatcagatagactgtcacattttatga

SEQ ID NO: 5722 - DNA, 671 bp, Aspergillus oryzae
  misc_feature (1)...(671): n = A,T,C or G
ttccctgtgaataccttgtgtcctgacgatgtctcgctcgatgctatcatctgctgtttgccagttatggcggcagcgctcccctcgcacaggagtttctgccttcccatcctcaaaaccccgttcgagcatctccccatcgttcagcgattctaccccccgccgctcgatatcatatgccatctgcgagtcgaagacaaaccgactcacttccccacggagatccctccccgcaattgtgcgtcttcaacagcgttgcgccttttcgtccacctctaccagacccgccaccaaggttatacagaacccgagaaccggcgaagatggcaatccactgacgattgaaatctcgccccgcgctgcagaacgtctccgcgaagtcaccgatcctacatcatctccatctgtccttaaagagaacccataccaccatctccgtatcacagttaccagcggaggatgccacgggttccaatatatgatgtccctggaagccgcatcgaagatcgacccggaagaagacaccgtcttcgaggcagaatactcccccgaggaaggatcgtctgaggccgccggccaggccaaggtagtcatggacgagccctctttggnagctctgtacggaagtacagtggactatacaatggagttgatcggcagtcagttcaaan

SEQ ID NO: 5723 - DNA, 625 bp, Aspergillus oryzae
gcttttaaagatttcctctttcactgcgaactccaaacgaaaaacttcatatcaaaatgggtcctcaactgtttctgatcgtgggattgttcctccaactgctctctgcccacgagctacatccacgcgcaggccctgactgtcagttctcagtggccgcctcctaccttggagaaacttgcgacactttcactaggaggtggcatattgatcgtgccacatttctgtcgttgaatcccggtgccgactgctccggccttgctgatgatcgcacttactgtgtgcagccaagtccgtcggtctcggctacttctatggcaacgacatcgtccacaaccacagctacctctacagcggcaatgtctacaaccaccgatatctctacagtgacatcatccacaagtaccagcagttctacggcgacatcgtcaacaagcactggcggctctacagcaacatcgtccacaactgccgacagctctacagcgacaacggagtctgctactcccacagctagctccgagtcttccgccacatcttctaccgttcctctgcaaatcacaatgattcttacactactactatctctgtgcttcatttaaccggggagtctcaacaagcgtgt

SEQ ID NO: 5724 - DNA, 663 bp, Aspergillus oryzae
  misc_feature (1)...(663): n = A,T,C or G
ctcatgtcgttcctaagggaggccgcatggtaactatactggctacggaagaagatgtaaggcttttttgtcccttcggaccgtaacctggatcctccctttgctctcgctattctttaatagctctttctgacacgattgacagcacattaaacccataacttcggcggttgtgtcttccgacctgtccttgacaccccagccagacgcgcataattctctgcaactgaatataccaatcccaccgccgacaaaagaatcacgggatcagacagttagtgttgcgaaagcggctatggaaaaggccacagcggcagtccgcgactccagaggctccgtacacaaacgccttcaggatatgcagaagaagaaaatagctagaccggatgatgttcggaaagcacaggaacagatggaaaaggtaacggagaaagggcaaagggaggtgagggatctttttgaggcagcaaagaaggcgatggagagggcataacctgaagcgttggcgagaaatgtgttttgtgaatgattgtaattgttgggcatcaaggttcgtgccaacgtcactacttgcgatgtgactccagtacctgactaacagtatgattngcctcgcatatgtaccaatatatggaattgaacattaatacactagtgctaatg

SEQ ID NO: 5725 - DNA, 639 bp, Aspergillus oryzae
ctgcacaatctctggccatgggaaataactcgggcaacaccaccaacacgagtgtagcaacctgtgtaagcccttgccaaactatacattgccccaacctgacaaaactagtgcctagccttgattggcgctctcggcaaaaaggtctcattcccaaacagccaaccctacaacgactcgatcaacacttacttctcccaacaaaactccaacctccaccccctttgcattgtttctccaacgacagcacaggacgtgtccaccgccatcaaaataataaattcaacccctgaaactccaaatttcgccattcgctcatgcggccatgcccccttcaccggcgcatccaacatcgcaaacgggatcactctcgacctccgtggcctaaacagtatcaaagtaagccccgatcgcacgaccgcctccatcggcgtcggcgcaacctgtggcgacgtctatccccacctcgaccaattatgcctctcagtcgcaagcggtcgcgcaggacaagtaggagttggtggcctaaccaccggcggggggatctcataattctctccgcggtacggctggacctgcgagacggtgactaacttcaaagtcgtcctcccaaaggcacgatcgtcaatgccaatgatg

SEQ ID NO: 5726 - DNA, 791 bp, Aspergillus oryzae
cgatcactgcctgagatcagatcatacctccacaatgcagatcaagtcatccaccgttctcgtcacccttgtgggctcctccatggcccaggctgccaacctccagcaaagacagtttgaatcgaccgacgtggccgccactaccaccgacagcaactcgggttctacggagaccggctcagtcactctcccatacctcaccgagaccagccagacgggcagtacgactggatctgaagctcctacaggtaccggctctggaactgccactggatcaggatctaccactggatcaggatctcccaccggatcgtccagtagcggagccgaatcgacctcggactccgctactcccactagcggatcggcctcgcctaccgagtccggatcgaccacttccacttccacttctaccactaccgaggcctcaaccaccactagtcgaagcgagaccagctcgggaactgcttcctccacttcatcatcggcttctccttcgtcgactgactcgggtgcgtcctcgaccttgcctcaaggttgggccacatggatgctccccttcgttttgggcgccttcctgtgagatgggtttttgattgaatgctgtaatgcgcttaatgaatatccgaagggatttggaaatgggctatgatccacgtgtgttttgtcggactgtgcatattgttccctctgtaccttcgctcaaccataatgatgctttcgttggctatttatctctacagctatgcagatagttagattccctacatctaatcatgcggaccactgcg

SEQ ID NO: 5727 - DNA, 732 bp, Aspergillus oryzae
  misc_feature (1)...(732): n = A,T,C or G
ttcatggtcatcgacaggtcgccttgtcaataaagcctctgacttgatcctggtcaaccatgccgtggaggtcatcgacggtggcccatgccgattactcaacgccgccgcgtgcatgatccagacagccatccatgctgctacttccgatctctgctgggcaacacacaggcacatgttgcacagtcgcgcgtgatgcagactcagtcgctcatcggatattatcactcaagatgcgtctacctctctcactgatcatgtggcgtgcacacaatcaaaggccttagtcctcgccacagaagaacgaaagaatatcgccgcagcattgggcgacaggaacgcggctctgttgcagaatcatggactcttgacagttggaaatacgatcgacgagacggtgttttggttcgtgagcttggagaagtgctgttatgcacagttattgactgatgcggcggcggcgggacgaggaggacagacgatcaaggtggatgatgccgatgcgggctttacgtataaatctgtggggacgcctttagcgggttatttcaccgcgaaaccgctgtgtgatgtgattcatgatgagaccaacgggagttatttgaatcattgagctggctttactatacaggatgccttactgaatgacctttcttcttccaagcgctgggtaattacctgcggatgcatataggatgaaactacagtcggntccttttcctgaacaaaaaa

SEQ ID NO: 5728 - DNA, 657 bp, Aspergillus oryzae
  misc_feature (1)...(657): n = A,T,C or G
gcagcaagacacaatggaatcctcaaaaactacagctgatattgctattgttggcgcaggaattgtggggtccgcgctggcttatttcttatcgcagaccgataaaaaagtggttctcatcgatcgctcattttcagagttgaaaggctcgacgggtcatgcccccggcttcgttggtcaattcaatgaatccgaggttctcacacgccttgcaattgaaactgtgggagaatacacgaaggtacccggcggatttgatgttgttggaggtcttgagattgctaccagctgtgaaggtgtcgcccgattaagatcgagatgtgagatggccaagagagctggactctccgccgaattaatatcctccgggcaggcaactagcttggccccagaactggtcaatgacgacaaccaaatagccttgtactttcctggtgatggtgctgcgaacgctatcagaataactacgttttatcacgaaaacgcacgggctcggngcgtcgaactcatcgaagcagaagttaccgaagtccaacatgccaatggctgcgtgaatggtgtgatgaccacatcggggctcatcccggccagaagtcatatcgcacgggaattgggcactactttgcagtcacattcaaccgatcgactgtgccatct

SEQ ID NO: 5729 - DNA, 483 bp, Aspergillus oryzae
ccaagggtttaattgccccaccctatgtgttcgccggaatcgtgatgtacccaaccgcctgaattggtgataaatatcgcctacgaggagcaatcgtcgtcttcaacgctttactctgtattattggacttcccattatgggctttgcgaaaggcaatgctgcgcggtacgtgggcgtattcttcgctgtggccggtgccaactccaacatcccagcttgtatggcatatcaagcgaacaatgtccgtggtcaatggacccgtgcattttctagtgctacattggtgggatttggtggcatcggaggaattgtgagtagcttggtctttaggtctcaggatgcacctggataccgaccgggcatgtggacgactattgcatgcaatctcctcatgttagtcattgtggccgcgatgagcttgtggttccgccggtcgaacagagaagcggaccggggggagcgtgtcatcgaggggtctccag

SEQ ID NO: 5730 - DNA, 673 bp, Aspergillus oryzae
ggcaagcctacagtatccactacgccgcctcctcctactccccgccaacctatcgcagcggacatcactatcccgtcggcagtttcatcagcgactccaggcgtgtcccagccattcagcacacccgaagaagtaaatgttgatgtgtcttccaagaagcccacaaagcctgctgtggaacgtccaccaagctcctgtcccgctggaacgaagttgaacggcctcaactacttcaagaataagcctgatatcgtcgccctggaagactctgaatatccggaatggctgtggtcgttgttagatgatgctaagaagcaatcgaaatccgaaggcggagtggatccgagcactctgaacaaaaagcaacgcaagcgctatgagaagaagatgctgctcgcgccgcaacccttccccctaagatccctgttcaccaacacgctactgatattactcctgcatcgtacaaacggggcgggcaagcaactgatgatcttctggtcgaaggccgctgaaagtcttggccgcgcctccagattaccaaaacgccaaagaggcacggaggaaggcctcataaaaggtaactttctccgcgggttgaaatttaaggaagcgtggctggtggtgggttgtccactctttggggttttaacaggggtattcatggtcaaatggg

SEQ ID NO: 5731 - DNA, 638 bp, Aspergillus oryzae
  misc_feature (1)...(638): n = A,T,C or G
ctgatatcgagacggctgtcaaggatcatctcgagaaacaccctattcgaccttggttcaatcctttccagcaggtcaaggttgccagtgtccttggaagaccatggatagaggatttatatcgcataccgagccctcggctgagagttgagttcctgccgggcagcgccaatgatttagcaaatgatcctactacggaatctttgtactcactgttccgcagctatgggaaactgagagacattgaaaggcaaccgtcggattccaagatcctaccaaggtacgcctacgtagaatttgctcgtcccaagttcgcggttatggcgaaaaactgcatgcacggattcacaatcgcagagaaagaaggtggcgggaaatttggcacaaggttgaagattaactatgaacggaagatcaaattgtcaatgattaaggactggatcttgagccatccaagaatagtaatccctgccgtcgctgcacttatcgcggccatcactgtgactgattttgaccccattcgcaccttctttatcaagatgaagattaaggcaacgcttcatgtccaagagacagtgttctgggatggattcgaagcaggttantaggccaacatcatcggcttgggtgttgtggcc

SEQ ID NO: 5732 - DNA, 631 bp, Aspergillus oryzae
gtcgatgcccgaatactcccaactccaatctttagccatgtcacgtgctccaggccatttcccccggtcttcgaacttggaaggctggtatcaaagctgtttgaaaaatggcggatatgccacctcgtccggtgccgggacccctggtgccgacggatacgatctcttatcgagactgctcgagtatgatcccaccaagaggataactgcgcaggaggcactggagcatccatattttaagaatgggggtcctatctccgccaactgcttcgagggctttgaggggaaatatccgcaccgtcgtgtcacccaggatgataatgatatccggtctggaagtctacctggtactaagcggagcggattaccggatgatagtttaatgggacgcgcctcgaaacggctcaaagaataacctgatccttgtcgatactttgagagcctatctataatttggagcgggagtagttgggggcttatgggtttgcatatacttcatttctgacattttgcattggcgttggtttggctgtgatgcacagatggcttggtaaatttaacatatctacagtatataagaaggtaaatatgggaccatttggtaagaatctacccctttaacgctatttat

SEQ ID NO: 5733 - DNA, 724 bp, Aspergillus oryzae
tctgtctttcgtttgcatttcgagtctacactttcaactccaatacactcgttcaaatcaagactcacttgaacaacaacacaagtacattcataatgtctactaccaccacctccgtcgccgccagcgccactgcctcctgcaacagcgtgacctactggcagctccccgtcgacgatgccgcctgcgccctccccaagaccggcaactactctgatgtcatggacaaatgctgctccccggccaaggtgaccgatttcgacaacggctgcggcctctactgtctcgcccagggccagagcgtcggcgacctcaaggactgcctgcgcaagaacggcgcccaggacggtcgcgagttctactgcaagggcaatgataccgccaccgccacggcctccgctccgtcttccaccaagaccggcgacaagaccggtactgccactggcagcggtgcctcctccacctcctccgacagcgccgcctatgctatccagcctgctgtttccaagggcggactcggtctcttggccatggtcttctgctccgctttgatgggggttgttgcctagatacttttcacttggggttggctacctgggaagaatgggtggatctgtctatatgctttggtttctttggtgatccgtcttgcgatgcatccggcaggacataattattaatacccttacgatatgagcctgctgaatatactttttcttccggt

SEQ ID NO: 5734 - DNA, 693 bp, Aspergillus oryzae
gcattcgaataatcccttattctgcggttcaatttggaagttacaatttttacaaaaggtttgcagaaccaactccagatgctgagttgtcaccagtacgccggctcatttgcggaggcgctgctggaattacctcagtcactataacttatcctcttgacattgttcggacacgtctttctattcaatcagcgtcgttcgcagccctaggtcactgcgatggcagaggaaatctaccgagcacgttcgagaccatgcgctttatgattattactgagggtgtgtctttatcgctgttaatccgagatgatacctcacgcgacgagtctggagatactatgcgctatgtcactaccatgccacttcgtcgtcccgatctgacatgctacgacagtagtgttgctaagacgtgtcgatatattactacaatacgacatcgataatgtcgcgacatcacgtcccgtcacgctgacgagacgcgcgatcacgttgtcaagctgatctccacgctgcgtccacgttatcgagcagcgatcacgctaccaccacgaggagctatctcaatcgatcatcatgatcgccgctgtcatgatctgaagatcactactgtcgacaatcacgatcctgatcgccgctgacgtcgaagattcccagctatcgacgatcgttcgttatgaacaaccttgacgtgcc

SEQ ID NO: 5735 - DNA, 639 bp, Aspergillus oryzae
  misc_feature (1)...(639): n = A,T,C or G
caagaaacaagtcggcttcgcgtgggttgacggcgatttctgggaacggtggttgagaaatacgtatggtattgatgtggcaaatggggaacgagtcatcatcaacgatcacgataaccgacggtactgggactcatcttcgagcgggtctcctatcctggcctcgcgtacttctattctcgaaactattcctcttgtgatcgccaactcccctaagttgacaccgaagtccactgttggcacctttgagtctgtctttttctccgctcggtccttcatcgtcaaccaccccatactctttgtcctcatcctgatcttctcggttgttggcgcgacgtggttggcacgagccagaggccggcgtgccggccgcggtggcattcttggggtcactaacggcaacaatggtttctttcaccttgatgggaaagaagtctgttgaacggcggctcaactggnaaggttgattagtcgacggtcgatgatctcggaagaacatttgtacagttattatattcatttttacctcttttccctcatgaccgttctcctccttcctcaatccttcgttcgctcgcgtttgattcacctgggtctttattgggtttgtaaagttttaactgggttcaaatcttggaa

SEQ ID NO: 5736 - DNA, 678 bp, Aspergillus oryzae
  misc_feature (1)...(678): n = A,T,C or G
tgacatgccggatggaccgactgagaaggtggagaagaagacgactcccccaagtgctccatcttctggtgttctggcgcacgctgcggcctttgacggccggctggcgctcgttgaggctgcgatgggcatctccagctcctcgaaccccttcatcgccgatgggagctcggatgtaccactccagcccgtcctaccggctctagaccacctcacgtcccgtctgactactctaatgaacattcttgtcggcccggctcctgtctcggcggtcccaacaataggttccgctccaccttcaacaaccgtgtcgacacctcatctcgagaatctgtcgacccgcgtgagaaagctaaccgccgacaccgaagctctcgcatccgcacgcaagcgcgccgtcgatgccgctaaggctgcgcaaaatgctcgcatcgctaccgcagctctcgaaccctccgacatgtccgtgtcctcctcatccgccacagaagtcgaccccgcagcgactcaacgtgatgagcaagccacgaaggtccaagctctctacgccaccttaccaaccattcaatcccttcaccccattctccccagcgtcctggaacgacttngctccctccgcgccaatcaagctaggcccggttaagccttttgaataccttgacaagcttgaacgaccct

SEQ ID NO: 5737 - DNA, 866 bp, Aspergillus oryzae
taatcccttgccttccttctcaacatgtcagacaaagaggataaccctcaaatccctcagcaagagaacaacaacccccaggaagagaacaaccaggggtcccctcagcccaaggaggagcaggacgttgagccaaagcaagagtctaactctgacgacgctgagcctaaacaagaacccaagtcggacgacgagtctaaacaagacccccagcctgactctaagccacaagaaaaagaattcaagcccgaagccgaacccaagcaagagcctcagtcagaagctgagcccgaacctcaaccccagcctcagaaagaagaacctcggcggcgcccacggagaccccgcccacagaagtaccaacaggactcggacacagagaacatcgaccgcggcgatatggataacaccgctgttgagaagcctcgtcgtcagcgccgctcacgccgccagcaacaagacgggggtcccctcggcggcctcggcggtatagaccaagccggtgacctcgtacaaaacacagccggcaatgccgtcaacggcgtgaccaacaccgctggcaaagctgtgggaggcatcctaggcggcaacaaaggggaaggacaggacgacagcggcgggcaaggacgaaacacttgcggttgcgggtggacctgaacctggttatgaaagtgaacttaaaggctagaaacaccgggatctaacccttgggttactcaacttaaaacggatgtgaatggcgcctatagaaaaaagattttatcccaccgtggcgggtcttggttaaaaattttgaaacccaggttggctttcacctttctttggtggcggcctcctatggtacctttttcctggtgagaaacgcg

SEQ ID NO: 5738 - DNA, 637 bp, Aspergillus oryzae
cgatgcgttcactgcgtttgaataggtgaaagttttgaatcatcttgccttcatcgacgaagccttccactgcaaccttgacaccatctcgcagaccccacacatgcagctcgaggatctccaccggtcgttcgatatacttcttgcccatttggttcgcccagcgatcgacatatccgacccagcgcagctggcttgggatactcaccccagggccaaacccagaccgcattctccgttcggtaaaccgctgcaaagcatcctccatcttccatcctgcatgtgtcatcaagtagctgcacgcgaccgttccactccgccccttaccagccttgcagtggaccacggcaactctcttccgtttctcctgtgcctccccctgagaatccttgccatctaaaccatggagccagttgtgcatggaccccataatcgcggggataagtgcaaatggcgggggatggtggtccgggaatgggtagtgatgtattctcccgtagacagccttgtcggggtagcctgtcccctcagcccggaactcgaagatacaccagtcctcaccatgtttggagtcaaggtattttactagatcgtcgagcgggtttctgtaggcacgtttcgggttagtagggggacg

SEQ ID NO: 5739 - DNA, 704 bp, Aspergillus oryzae
agatatactcggtgatacaattcgcacgaggcgagaccttcaagctgaatatgatcacctctgctcagatcctgtccaccaagtacgacccatctacgagactttgggaggtcaagatcaaaacccctgctggccagcaaacggactactctaaacatctggtgcttgcgactggcatctcgtcccaggagccttatctgccaggcgtggcggatagtgacttctaccaaggaaccagtcttcattcggctcagtaccggaatgcaaagcagttggcggagacgggagccaagtccgtcctagtagttggatctgccaatactgctttcgacgttctcgaagactgccacgccgctggtctcaagacaacaatggtcgttagatctccaacctacattgtcccggtcgagtacctctgcgacaaccacagtcttggtgcctatgacatgggcgtcgagatagctgatcgactcttcctgacgctgccgtcatatgtagacgcccagctcgctcgaggtctgatgacccagttcgcagcacaggagccgcatcgctacgacgctctcgcagccgccgggttcccagttatcgacagtcgggacccagacatggcattgatgcacaacttgctggagcgagcgggtggtcactacgtggatgtgggtggtaccaagctgctggcggatggaaaggcggggtgaaag

SEQ ID NO: 5740 - DNA, 1304 bp, Aspergillus oryzae
  misc_feature (1)...(1304): n = A,T,C or G
gtatgactcgtccgtatacggccgaggcggcacgaggtatacccgcattctccatctcccgacttgtttggttttcttcttccagactatctctttctctcattacatactctctccacatattccatcatgggtaaagacgacgaacctagaacctaccgctacaacgagaagccggtttacaccaactccaatggctgtccggtcttcgaccctcaggccgcgcagcgcgttggccgtaacggccctttgctacttcaggacttccacctgattgaccttctggcacactttgaccgagagagaattccagagcgtgtcgttcatgccaagggtgctggcgcctatggcgagttcgaggtcactgatgacatcagcgacatcactgtcatcgacatgctcaagaccgttggcaagaagaccaagtgtttcacccgtttctcgaccgtcggtggcgagaagggttctcccgacagcgctcgtgatccccgtggtttcgccatcaagttctacactgatgagggtaactgggactgggtgttcaacaacactcccgttttctttcttcgtgaccctgccaagttccccatcttcatccacacccagaagcgtaacccccagaccaacttgaaggatgccaccatgttctgggactacctctccactcaccacgagtccgttcaccaggtcatgcatctcttcagcgatcgcggtaccccctactcttaccgtcacatgaacggctactctggccacacctacaagtggatcaagccggacggcaccttcaactacgtccagatccacctgaagaccgatcagggcaacaagaccatgaacaacgaggaggccggtcgtttggcctctgagaaccccgactggcacacccaggacctgttcaacgccatcgagcgcggcgaaaacccctcctggaccgtctacgttcagaccctgagccctgagcaggctgagaagttccgctggaacgtcttcgatctcaccaaggtctggccccaggccgaggtgcccctgcgtcgtttcggcaagttcaccctcaacaagaacccccagaactacttcgccgaggtcgagcaggcggctttctctccttcgcacatggtccctggtgtcgaggcctccgccgatcccgtgctgcagtcccgtctcttctcctaccccgacacccaccgncaccgtcttggcggcaactacgaacagatccccgtcaactgtcccatgcgggccttcgccccctggcagcgtgacggctacatgaacgtgcacggcaactacggcgccaaccc

SEQ ID NO: 5741 - DNA, 663 bp, Aspergillus oryzae
  misc_feature (1)...(663): n = A,T,C or G
ctcaaccgcatcaccaccacatagaccatccacacacggtcaccaatccattttctacaaccaccatacttgttaatacattataattccacacacttcaagttaattacaatcgattaatcacaatgcatttccataaaatcacgctgggcgccaccctggccgccctcctgagcctaaccaccgccctcccaaccacctcatattccttccccctcaccacccgcgacgacacccagtgccctaccggaaagtccttctatcgctgctacaaaaacaacttccgcggctgctgctccgtcgacccatgcgatctcgatgacggctgtccagacaatgacaccccaacctgcacgccgggcaaaatctaccagcccaagatgcaaacctacctcctcccctcctcggacccgatctccaccccaaaccttaacgtctccaaatccgccaccgccgaatgggaccagacgatgacgttctccgtgccccagggagctaagacctgcacgctgaattgnggtgtgcccgccgagcgcaacttcaaggccggcaataatgcgctggtgagagtgtggcanggggataaggtcgagggggagagtattggcgcggcggactttaccaattggcccggtgtggagggtccccatntgcataccgtgg

SEQ ID NO: 5742 - DNA, 665 bp, Aspergillus oryzae
  misc_feature (1)...(665): n = A,T,C or G
cgtgtatacttacatcccaagcgtctccctatggatgtcccatccgttctcggttgcttgggttgacccctgcagctctgtaacaaatgcagcagaaccggaaaagttcgccaaaagcccaacatctaccggaagcatgagtccatcactgcttgagaaacaacccgtggttgatttgaacgactacatgagagaaagtcaagaaccaacatccgtctctcttatcgtgagtgcgcgtcaaggtatgacgagaaagctatacaacaaagccctaattgcgcccaatcaaatactacacctctcaggatacatcgaaggaccgtacagatcgcacgtctccaacatgggcagctatggtaccgccgtactcttctctgctggtgcaggcatcacccaccatatgctgtacgtccgcgacctgatcatccgcgcaaccgaaggccgtgtagccacgcaaaaagtctacctcatctggtccgtgcgtagcacagagcatctcgcctgggtacaagagtggatggatgaaatcctccgcctccccggccgncgtgacatcttgacaattaagctcttcgtttcgaaaccaaagagcagccgtgagatagtttcacccagcgccactgtccaaatgttccccggtcggtgtcgccctcatgtcgttctgg

SEQ ID NO: 5743 - DNA, 680 bp, Aspergillus oryzae
cggcacgagggcgatgtgttttgaagatggaccatcattgccccggggctcgcgacgtgcgttgggctgcataactacaaggcctttctcctgtttcttatttatacatcgatattctgctgggttgatttcgcggtggcatcgagttggatctggaccgaggtactcaatgatacgcggtatatggacaccattttacccgtcaatgtggtcctgttggcgatacttggagggattattggattggtgctgtcgggatttaccatctggcacattagtcttgccgtgcgtaacctgaccacaatcgagtgtttggaaaagacgcgctatgtatctccgttgcggaaagcgctggatcgtcgccgctacgaaaacatactgggtaatggtcacaatggccatgaaaacgacgaccctgaaagtctcgggcatcggcttcaggactatggtaatcagatcttggacgcccatgcgaatgcgatccccggagtcacacgaccggaggagggagaggagccccttcctgcctactctcaatcgggtcccgggggcactcccgcccaacaggccctgtcgcgatcatatgcggacttggagagggcacgcgagcatgatcgggacccatagtatcttgaccaagaggataatgagaagatgcggacgctttcgaacacggaggg

SEQ ID NO: 5744 - DNA, 550 bp, Aspergillus oryzae
  misc_feature (1)...(550): n = A,T,C or G
cccagaacaacccattttcaacagaccatttcgtctcgtcctgcgcttcttctctccccaaaagtataggtagccaacatgaagctgtactatatctctgtcatactcatgacatgtctgagcactgctcttgctcaaggaatggacggcctcccagactgcgcgaaagattgtgccactggctccattcccaagcagtgccagactatcgatgttgcttgtatctgcggtgacaaaagctttatcaatagtatatcttgttgcgtcgccaataagtgctcaaaggaccaacaagatgccgttctcaaattcgcaagccagctctgcagtggcgccggtgtaaatgacctccccaagagtgccagctgcgccgagggaggtttgagcgctaccgagacatcctccgattcttctgtctccagcaagtcgactactgcgaagagcacggctacggatgaaccggctacaactacttcnggttctttctgacagtctgcatcaacaacccgtttccaaatctggccacaacacttagacttaatccacctca

SEQ ID NO: 5745 - DNA, 684 bp, Aspergillus oryzae
ccatacagcccgacctctagactgtataggttctttgatacggtcattttaccttctaatctagcctactcaagacaaacccccagaccaacaaccaccgaagttaaccaccgtccaaaaaacacccatctcaaccctcaaaaagagaacaaattacccacaatcccaacaccctcaaaaaccccaaaatggccgacagcatcgacatatacaaccaataccctctggtcctcgacccaacctcgaaagccatcaacctctcctctcaaaccacaaccccagcctcagcaagcacagtaaccaccgaactaaccgaactaaacgccctccaccgcggcctcatctccctcgacccgcccaacatccccccgcccccgctccccatcaaccccaagcgcagcgcccaaatcaccaagctccgcgacagcgcaaacaccggctaccgcaagaacaaccacgccgaggcagtccgactgtacacatacgccattgagatgggaatcgcacgggccgggtgggaacctatgagtctggccagggaggaactggcggggttatttgcgaaccggcgcaagcgtatatggcgcaacaagcgtggccggagggattggtggatgcgaaatgtaatgttgaagtaaaccgggggggaatgtgaagcttgtggtaggctgggaatgtttgcct

SEQ ID NO: 5746 - DNA, 657 bp, Aspergillus oryzae
  misc_feature (1)...(657): n = A,T,C or G
cttttagctaatcgctccttgttattgccatgacacgctcctttgatttgttacaaactcttagaatagttgttattaatggcgtcgtctgttctctggtcgatcttgatcgctactcctcttgccctgggctacactaaccctcgctccatttcaattcctgaagactacgatgtattgcaatatgttgacccgcttatcggaagttcgaacggagggaacgtcttcgccggcgcgtcacttccctatggcatggcgaaggctgtagccgacacagattctgtgaacaaccagggcggcttcgcatacgacgggagtaacatcacggggttttccagtctgcatgattcaggtactggaggtcaaccgtcgcttgggaacttccccattttcccctatgcgagctgcaaggatgacgatgtcaatggctgtgtgtatcccaagaaactgcgcaagacgcgctacgaccccgggtctgtgtctgcgagcccgggttattttgcattgaccatggcatcnggaattcaggtagacatgactgtatccnaccatgcatctntcttccgttttcggttcccagcagatcgcgaaaccaaaccccttatcctgttggacctttatgacttgtccgacacgcgacaggacaatggaaccatt

SEQ ID NO: 5747 - DNA, 678 bp, Aspergillus oryzae
  misc_feature (1)...(678): n = A,T,C or G
cttaccctcttagaaacgacttgtactccgtagttctgctcgttttaccttaccttcccacccctcctctccacctccccgaaacccaatcctgattaatttatactcaattccatacatacctcccaagcatcccactctaaacctccccgatccgataacacttgcgttgtacccccattaccgatgcctatcatctccggtggctgcgcttaatttccagcctgtaaggtgtccttcttccaaaacgtggctaatgcggcttgaatcctcacccccctctacctgaccttttcgtcgttgcgcgcctgaggtggaaaaaacgcaccaaccatagcctgccctctctggcctcaatcttcaatcctcctgtcgtcgtgcacgcccgaccaatgtcctccccatgtcaagccctccgtctgcatcagaaaatacctggtctcgacccctggtgacacctgttgcgtctgcccaaaatgattgctctgacgggcctgaacgccgtgatcacaagcagccgcgccaccacgcccgggatcagctcctccaccatggcatccanaaagctccttctccttcccgtgctgaatcccccaccgctcatcaatgggccaaaccgtcggccggcttcggtctaaaaaggccacaaccgtcccccacgaatagctctcccgccct

SEQ ID NO: 5748 - DNA, 697 bp, Aspergillus oryzae
ggcaagcccgaagatgatcttccacctgccccacatatctatgaatacattgtgttccgtggcagcgatgtaaaggacatcagtgtagccgaggacaagaaggaagatgcaccccaagagcctcaacaggtgccagatgatccagctattctcgggagcatgtctcgtccaggacccgcccctcaaggaattccccctcaatcccagacaccacaacaatcccatgatgccccgtccgacgccgcctgtatattcccatccacagtttcagggaggcttcgacactccctatgggcaacgatgttgactggacgtgaaatgacatactgcgacaacgatctcctgcgttgacacccatagtaccgcgacatacggcgagatttgacatgaccacaggtcacctctatgcatcacaagatgtctcgatcttgaggatcgtcgttataatatgaagtctacttagataccgccacgtacaatactgtgtactaaccgacgacgttgatgatgatcataatttaccatatgattgtacatgcatgacgtccgcgaatttcactaaggaacgcgattaatatctacaacgttatttaaggcctacaatcatgctacgttgtctaacatcgctccacgatgtaccatgcctgattatcgaagtacgtcgtccatcgacgatgctcgtatgacaagcgtaccc

SEQ ID NO: 5749 - DNA, 718 bp, Aspergillus oryzae
ttgacgttctggaggagctttttctctagttttatatttggtatactccttgcggttaccatttaagcccagtgcccgatcaattgcatatcatcatgtcgaaccccgtctatctcagtgtcattggagttggaggtgtaggcacagccttcctgagccagcttgcccgtctccccaacgcccccaagctcgtgctcctcgcccgctccaggcaaaccctccagtctccgacaccggcctattcccccgccatccccgccgcatactggaaaaccgccgttgagaccccctccctgatcaaatcgggtgctctctccgtcgacgaaattgcctgctacctgtcctctgacgccggtcggtccatcctcgtcgacaacaccaacgacctcaccctcgctagcttctaccccgtgttgcttcgcaagggcatctccattgacgcccccaacaaaaaaggtttcgtctccgacctctccctgtggaaagacatatgtcctgctgccacaaagggcaacgcccctcgtgtaccattgagaagccccggacgcgccaagtattccccttgtactcaaaccttcgcgaacctcatatcactgggcgagtagggcacttgcctaccgaggtggattttttcggctacacttgccttatcttatcgaatcaccttcgacccccgatgttccgggcctgattgaggcacaatgagtgtaccataggg

SEQ ID NO: 5750 - DNA, 688 bp, Aspergillus oryzae
gtttatcccgataccctaagtgatactaaaatcgaatcaccatgaaggtctatctctggacggtggcagcaaccgccactctctcctcggccttattcattcccacctcccaacaagccctaaaagacctcgacctcaacaacatagacgtaaacgataaggccgccctcgacgattacctccttcaactctcactattggacgccgcatccgaaatacaaaacagtcgcctagacgacatcctccccccgatctttgacacagtagacgcagaagactacgactacgactacttcgacgatgacgactatgacgacgcagaatacttccccttggacatcaccgagctgcctcccttctcccaactacatcccccacaccacccgccctccgacaagaccatctacgagctcatcactgaaagcaaatacaccaccatcctggcgaagcttatcaaagaagacgaggaactagtccatctcctcaactcgacagaagcaaaccacactttcttcgcgcccacagacgacgcattcaagaagatcccgcaccatgacgaccacaaaccgcccaaggagctcatccgcgccttcatcaagtaccacctcgtcccgggactttgggacgcccgcaccgtcttccatagccacacgctgccgactgaattggagagtcgagcattgggaga

SEQ ID NO: 5751 - DNA, 667 bp, Aspergillus oryzae
  misc_feature (1)...(667): n = A,T,C or G
ctcctccaccttccaacaatactgcaagatgccggccgcgctggtctccaagacgcctagtaacattagcgacgaccaagccgcaggaataagtcttgcgaccgtggctgtcgtgacagcattctacgacaagtcgggccaagggttaaccccaccatgggacccgaatggcccgcaggtcggaaatggcaaagccatagtgatcatcgggggcgcctcatctgtgggccaatatgctattcaattagctaagctgtcgggtttcgaaaagattgttaccaacgcaagtgctcaaaaccacgagtggcttaagaagctaggcgcacatgttgtcctggaccgagccccttcgagcccggaggatttcaaggctgcgatcggcgggttgcctctggaattcgtgttcgatgctatctcggtgaaagagacgcangcattgggtgtgggcattgtccaggctaccaaagggcgccgatagatcgtgacagtccagggtgccgactcggatgctattgcacttggtcaatcgaaggagcccgaaggtagcggttaaacaggtcttgggaatggggagctccccagcattacgttatcttagcgaagctctggtgaaacatctcggaggtgaagatggttatatcgggaaaaacgttttgtttctaaccgg

SEQ ID NO: 5752 - DNA, 1253 bp, Aspergillus oryzae
  misc_feature (1)...(1253): n = A,T,C or G
cttttcgcacaccagtcattcttttgtctcagacactacatcccactccagtcactccttgatctacagcttcacagctttccagctcttgcgcaccacctcgaggtcactctatcttttcacgtcgatatctgaccaattaaaataaagaaagcaaaaatgcgtttctccatcttcggtgctctcactgccctcgcggctctggctactgcccacaccgaccctgactacagccagggtcctactggcaaccccatctacactcccggtctgaacgaggccgtgcccgttggcaagccctacgccatcacctggggtcctaccaccgagggcaccgtctctctggtccttctccgtggcgagagcacgaacatgcagactctcgagactattgccgagcagatccccaacaacggcaagttcgaatggactcccagcaccagccttgaggccgatgtcacccactacggtctcctcctggtcgtcgagggaactggccagtaccagtactccacccagttcggtatctccaaccctaacgggcgcttcttcttcttcctctgctgctcctgagggtcccacctcgaccgctggcaaccccggagcttcttcttcccgcacctcttacgtgacttactagatcaccactactatctgccccgagactgagaccgctcccgctactgccgctcctaccgcttccaccagcgctcctgtcatccctcctcctgctcagtctcactcctggggcactggcggtgttagcgtccctgtcgtctctcctaccaacaccccctacctccccaccaccctgcgcagctcctctgctccctctggcactgcctccagcaccacccctggtgttcctctgttcaccagcggtgctgaccgcaacgccatcagcttcggtgctgccgccgctggtgttcttgctgtcctcgctttctaagcgcctggcgatcttagaccagcccagtcttgtacacaagaattcctatgaattttcattctccgaaggcttgccttccagcagatagtaatatcatcttttcgttacacctcacctaggtgtgttttatcggaccataaacacgccccactactcgagtcgatggcttgagctcacttgataccttctcttcatgtaatgaacttctcatgtattctttccatggacatgatttagcattttcttttatctaatggcatatgttttcgaaananaaaannnnnnnnnaaaaaaaaaaattcct

SEQ ID NO: 5753 - DNA, 593 bp, Aspergillus oryzae
ccccaagggaattacccaattttcccttttcaaaagttttaaaacttttaacaaaatgcttaatccccccttataaattgcccggtttattaaaaaaaaacctcctttttttttccccccaagggtttccccctcccaaaactcccccctgtccttaaattcaaacctccattttaaccccttaaaaccctcaggcccgggattgggttccccccccttaggtcattttaaattttaaaaaaaaatcccacctctatttctcttttaaaaggcctcccccgcggtcccttcccggttgggttttccccccccaaacccttatttttatccccttggggtatttctaaccccattttttttccccccaaaaaaaagcccatattttcttggggaaaaaaaaaatacccctcttgaaagaattccgaaaggccccaactactctttttttttgttaaaaaaattatttaacccccctcccccgcggggggggcgcccaaaaaaagccttttcccctactttttaaaaaaattaaaatatttttttccacccacacacccttctcccccccgacgatggaaaatattataacaacg

SEQ ID NO: 5754 - DNA, 677 bp, Aspergillus oryzae
  misc_feature (1)...(677): n = A,T,C or G
cgacaacatcggctacaagcggaagcgcaagngtaggatctgggctttcagctggtggaacaatagcagttgcagtggttgtaccggtcgcttccgtagcaatcattattttagctgctttatatttctggaggaaatggaaagcaaagaaagcagcagaagaggaacgaaggaaggaagtggaggagtacggtttcaatccgaataatgacccaactcttccacctataatgggaggtggtgctttcgagcccaaggatgatacttcaggttatcggggatgggggaccacgtcggctggtcgcaaagcatccactaatctgtcaagtggtgctggggttggactggccatgtccgaggcaagaagtgcccctggctatcatcatgtcactacccccagcgatggtactatttaatattccgagggcccggcaacgggggagacaaaaccgatcggggttctaagagctgctccgattgcttccaccaacaaccgaaccccagatattctttgtgggcccgtctaacactttcttcgcatattctgccgccaaccgctcggaaggcctataagaaaagtacatgtttgttacccattctaccgggccttttttttgatgataacccattcttcattgaaagccccccccacttggggcggttgtgtgatggcccct

SEQ ID NO: 5755 - DNA, 658 bp, Aspergillus oryzae
  misc_feature (1)...(658): n = A,T,C or G
gctgtctgatgtttttgattcatatcttgggaccaacaatccaatcaatttacagaccaccttcttggcctacactactgatgtcctgtaccattacatgtttgatacagatgcgggctaccaacgcgactcgggggccgctcagcaatggaggcactcgatggacgctgtcgcgcaagctacccctttcttgaaacaattccccagcctcctgtcaagagtagcattaataccgcttcctatgctgatatgggttctcaagcggattcaacccgacgttgctggattactgggcacacatcaactgatggcaagcattgtatcaaaatacatggcatccaaacccgaagaggatcaagacgaactgatagcaacgaaggctgtcaagccccgtaccttatttcacgcgatcgaagcgagctctttaccacctcacgagaaagttcccactcgtctggcgcaggaaggtctaaccgtcctatttgcaggtggcgagacaggttcacgtctgcttgcccacacaatataccatttatttgaagaatcccgagattctcgagaaggttaggaaggaaatccttgacgctgccagagactccaaccacttgctgacttgaaagctcttgaggctctcccttgcttaactgccttgtnccaa

SEQ ID NO: 5756 - DNA, 698 bp, Aspergillus oryzae
ttctcagtggtgtttcacttttcctggaatcatgtcgcgcaaagacgacactgtcaccgtcaacgttgacgatttcactagaacccgcgatagcgtgatcgtcagtctcgcgcaactccaggcggctgtctccaagctgtcggaggcttatatcaaccatgcgaacaccgtactaaaccgcggcccgacggtcgacatcgggaacatcgccagcatcaccaactcgctctatgaaagtggcttgctgggcgccctcggcggtggtgctcgcgctactagccccggcgcaaagtccgaggtgggcgagaagaagaagcgcaagcgcgctcccccggaccccaatgcgcccaagcgcgccttgactcctttctttctttacatgcagcacaaccgcaccaagatcagcgaggaaatgggtcccagtgccaagcccaatgatgtctctgacgagggcacccgtcgctgggccgagatgcccgaggatgagaaggagcactggaagaaaatgtatgcggacaacctcgcaatctacaaggagaagatggcggcctacaatgctggtcttccttacactggtgaagcgaaagctgccaaccagcttgaaaaggaaggcggaccgtgccggaaccaacccctgctggaagagtccgaggaggagggagaaaatggaacatgaggaagaaggaggtggaccccct

SEQ ID NO: 5757 - DNA, 564 bp, Aspergillus oryzae
  misc_feature (1)...(564): n = A,T,C or G
tggggagtttgacttgtcctgattcggcgcgaggggcgcagcatcatcaccccatacatacatacaatatatcttaatatgacggatatgactatagatggatgatgcaacgtcagacgcagcgatcgtcatcaattcgtaccacagtggatgattctggtccacctcgggcgaagcggccccgtgctgctcaagcctgcgacagatgcagactaaagaaatacaaatgcgatgaatcatacccttgctcacactgtaagaaaagcggcatcaattgcgtatatcaagggaattaccgacagcgtgaaaatgaccgctcagccagttatgtttccgacttagagaagaaagtagacgagctttccgcaaagctccgggtggctgaatctgaaattgcttcccaacgctctccacagtctcagagagaagcgacagcccctgaaaccaggcagatgccccattccattataaaaagcgaacccgggttccatgcctcggcatggctcgaccccaagagngagataccgngtcatacgacaatcatgatgaggccggggactctgt

SEQ ID NO: 5758 - DNA, 719 bp, Aspergillus oryzae
  misc_feature (1)...(719): n = A,T,C or G
ttccgtactttctactcgtatagctgttacgtacccagttgggagtgtattcgtcggtatccaacagttcagccacaggctccagttgacgtgaacaagcgccactgcccggtcttctaccacaatatatccatttctccttcctgccaatctttactcctgctccagcggcatcatgtctgacacgcctgaaggtattgttgaatacggctacgacaatattacagaatggtatctgcagtgggtgaagagccagaagtcaccacgagaaagatacaccaagatgctcctagacaagctgcaaccttcaccctctattctagagcttggttgcgggcccggagttcctattctaagaatgcttcttgatcaaggcgctcaagtggtcgccaatgatctctcatccaagcagatcgagttagccaaggcccgttgcccggaggccaagctggttacgggcagcatgaccaccctcactttcgagcctatgagcttccatggtgtcattagcttctatgcactgttccaccttccacggtcgcagctcaaggccatgctcactacgatctatgattggttgaagcccggnggtgtcttcgtctttaatcttgcaactgtcgatgaagaagaaatccatggcgaattcctaggatatgggatgttctggagcagctatagtgtggatcagaaccgagcaatgttaacagaaatcggatttn

SEQ ID NO: 5759 - DNA, 691 bp, Aspergillus oryzae
gtgttcatcaaattacatactgtcaacggggggagcctcaaaatcttcgagcctctggcaccaacgaagcatgaggaagcacttctatgctatgagtacggtcgaaccggactgggagccaaagtctacggattcttcaagacacaggatggcatactcgggagaatcgatgagttcctggatgcacgtaacttggagccggaggatgttgaggattcggttatcagagcggatgttgctagaggactggcaatgtttcatgtcttggacacgtcactggagaaaaaggcggtggaatcgtactatgaagctgttatcaatggactcgggaattactacatgatggacaagttgaaagcacttgggaaggaaggaggtgtcagtatcgacaaactagttgactatgactttgggagaaggctgagaaatgtggtggataagctggaatccataagaagaaagaccgggtggtgtattcatgacattcagtttatgaacgtcatggggaaaaataacccgaaggaaggagagaacaaaggtaccctgaatgactttgagttcctgatgccaaactacccagcctttggcatcggtggacactttattgcaaaatttggtcaatgggttgaccaggagaagccggataacaaattgctgggaaatattcctaagaaggaaagagacacttttg

SEQ ID NO: 5760 - DNA, 712 bp, Aspergillus oryzae
tggtatgtgattagtgacactatagaagagctatgacgtcgcatgcacgcgtacgtgagctgggatcctctagagcggccggcgactactgaggtcgcacacccgggaatgatcatccttgggctggccatacgggccggtgcccaacactcgctgctcatacacattcccgtcactcgcttcataacctgaagaatactacgacatcgtttctaacgatcacagcttctgaatctactattaatcacttccccgctcagattgggttcgcatatccttcattcggctcacgaccaaagagacgctaggaccgtgggcgcatacgtggatccttcacctaggggtgaaagcagaactgaagacaggaaggctgtacggacatgctctgaacgtataagattcggctcggcgctcgatgcatcgattgagtgacgtgcattacgagagcacatacgagatagaccgacgattaacctgggagtgacacaaccatgtcgaatcgatattcagagcactccagccattcggctgctgtctgcagcggtggccgagcgccccaggcaggtgggcaggagtcaacgacgacgtagctgaatgcgtcgcatgcgcactatgcgacggcacaacgctaccaactcgacgcgggaacctggctgcggcgtaatacattgcttactggagggcaattgttcgcataaagccataccgggct

SEQ ID NO: 5761 - DNA, 636 bp, Aspergillus oryzae
cggactggatcaggctttcatatgtgcagcagcaatgatccccaagatcaagtcctggactacaatatctctctacgatggcacttattctaagtctcggccatccaagtcactgggtgcctcaaccataatagatctggaagccctgcttggatacacattttctgataaaagtctggcgatagaatcaatgacacacccatcctgtgtcggactctacgggacagcatcttatcgacgtctatcctttcttggggccggcatcatcgaattggtagttgtcaggtacttacataggcagaagagctttaccagctccaaaaggctgcaatctctgaaatccgctgtgaccaacaatatgttccttgcattcctgtgtctcacgttccattgggagaagcaacacgatattattgaggtcgatagtatgggcgtcccaagcgtcattcagacccgtggccgagtagcgctttatcattttctacgctcacagagcgactctctctcagacaaggtatccagtctggtggaagatctcaccagtcagctccacgtcatcaagagggatctatgggaaaacggaatatatccctgggcacgactaagtgtctttcggggtctcaaagtattctctga

SEQ ID NO: 5762 - DNA, 683 bp, Aspergillus oryzae
caccaccaatccacccaaaatgcgcatcctctgcctccacggccggggcaccagcgcccaaatcttcaaatctcaaaccacctccttccgctcccgcctcaacgacctccccataaccttcgacttcatcgacgccccctaccccaccacccccgcctcaggaatcgacctcttctacgaacccccctactacaccttctggcccgacgactccccgacctcccatcaaaacgcccgaacctggctcctcaaccacatcgccaaaaacggtccctacgacgccgtcctcggcttctcccaaggctgctccctagcagacctaaccctcctccttcacgcccatgaatcgcccctcacccctccacctttcaaagcagccatcttcatctgcggcggtgcaccgctccccctcctcgaagaactggggtataccatcactccagaaatgagaacccgggatacagaagcacggaagaaattatccattcaagccgattttgctgcgaatttgggaaaaggggcggacaaagtggtgaggggggtgcatatatctccaaccatcacgatatgataactcatcgatgacatcgcgaaaataatggcgacagcgactatcctttattatacccattacaatatcgaccatgttgtccacgcccatcttcagggcgatccttatgatg

SEQ ID NO: 5763 - DNA, 1306 bp, Aspergillus oryzae
gccaattactataccagtcagatcatggagatcctactccgagagttctcttccccagatgaggagatgaagaaggttgttcttaaagtagtgtctcagtgcgccagcactgatggtgtgacagccggctacctgaaagagcatgttttgaccgacttctttaagagcttctgggtaaggcgcatggcccttgacaggaggaactaccgccaagttgtcgataccactgtcgaccttggacaaaaggttggcgtcggtgagatcctcgaacgcgtcgtcaacaacctgaaagacgagagcgagccttaccggaagatgacggtggaaaccgttgagaaactcattgcagccctgggagcggcagatatttccgagaggttggaggagagactcatcgatggtgttctctacgccttccaggagcagagcattgaggatattgtaattctgaacgggtttggaacagcggtcaatgcacttggtactcgttgcaagccgtatcttccacagatcgtcagtaccattctttggcgattgaacaacaagtccgctactgtgcgtcagcaggctgcagacctgatttctcgcattgcaatggttatgaagcagtgtggggaggatgcactaatgggtaagcttggtattgtactctacgagtacctgggtgaagaatacccagaggtccttgtttccattctgggtgctctacgttccattgtgaccgctgtccgtattaatcatatgcaaccacccattcgagacttgcttcctcgtcttacacccatactgcgtaaccgtcatgaaaaggtccaggaaaacaccatcgatcttgtcggtcgtattgcggaccgcggtcccgagtctgtcaatgctcgcgaatggatgcatatttgattgaagttgcttgacatgttgaaggcacacaacataggtatccgtcgtgcggctgacaacactactagtttcatcgtcaaggcaatgggttctcaggatgttctcggaacactgcttaacaacctaagtgtgcaagagcgtgactcacgtgtttggactgctgtggccatgggtatagtggctgaaacgtgtgctccgttcactgtgctttcaacggtgatgaacgaataccccgtacctgtattgaacgataaaaactgggttgtgaacgccatgtactttttggtcgaatacttcggccagatggcttaaaactacttgatgcccgtacccccctttttaagatggctttatatgttgaaaacaaattgcgtcgacagaattccgcccactgttgtcaaggacatttctt

SEQ ID NO: 5764 - DNA, 668 bp, Aspergillus oryzae
  misc_feature (1)...(668): n = A,T,C or G
ccgagcagatttgaatccggctcctaggaagaggaagaagaagaggaggacaacgctgcaccaaaccaggccgactccttgactaacctgacttccacagttgaggcatctatacccgatcccgtccccgagtccggttcaggctcagactcagaagaacaatcaggctccgacgaagaggatgaggatgaggatgaggaaaagcaaggggaagaggaagagaaagacagacccacagacgaagaaagccaaaataaagatgccgaccaacacgaagaaaaggaaaaggaaatggtccaggaaccagaaactcaaaaagacgatatagtcccagaaaccgaagaggagcgagagcaagaaaccacaaccccagcccaatccaacccaccaccaacagaaaccctttccaaacccaaccctgccgaagaagaaactgagtccgacgcggatgaagaatcagacggagaagaagaagaatcagacaatgaatccgacaaagaaaaccgctctctcccgaaaccagcctcgacagcaaaagccaacgttcttcgtcgcacaagtctcaaatcccccttattccaaccgaacccgccttcagccagcaacaaacaaacctctcttaattaacccccaacgggttccgaccaaccggaataccctcaaatccn

SEQ ID NO: 5765 - DNA, 691 bp, Aspergillus oryzae
cggcacgagggcaactttgctccacaaactatttaccaaccaccccaaccccaaccacctccacaaccacctcacaaccaccagtataaaacacgaccactgaccccacaaccgccccaaaacaactgccataacaattaccataacaaccaccaccacaacacaaccattcaaaatgctcttcaccaccatcctcgcctctactcttgccctcagcatgggcgtctccgcagcacccagacccgctccccctgccgacacgcggtacgtgcagctccgcctctggggcgaacccagctgctcggctctcaaccagggcgagctgggagtctacggcggcgccctcaaccagtgccagaccttcaacaacaacaccatcgtcaagtctgtgcgcttcgaagccaagtattctgacacctgtaccgtggctctttacgatgacgtcacctgcagctccagtccccacgaaatccagcttgagacttgtctctccagtgatgcgcagtatcgcagctatctggtccagtgccccggtgttcctgtctaactaaggggtctggacttgcgtgtgcttctttcttgtcgcgttgtgtgaacgttatgaacttgacgatgatttgctgaaggttgagtctggagagtggttatgatttattggatatgatcttatgtacagcgatgtatagtctat

SEQ ID NO: 5766 - DNA, 828 bp, Aspergillus oryzae
  misc_feature (1)...(828): n = A,T,C or G
tgatggccgtccaatacggccgaggctccgatcccctctttctctcccttctttttccctcttctcattcctcctcggtcccctcgttgtgctctcggaccagatatctagggcaaccagccactcgcaataccggagttaagccacccgccctaaaacaaccgccaggccgcatcgactccaactgtcagctcaacaaccctctacaactcctcaaccgcctcttacaaccccccaaaatgtcctacaacaagcccgacggaccacctccctcctatcccgcccccgtccacgacgcagggccctaccctccccaaggcgcccagggagactactacaaccaaggcggataccctcctcagaactacggtccacccccgcagcagggctactacggctctccgccaccccagggtcaacagcccatgtactacccgccgcagcaaggatacccacagccggggtactacgccgatgaccgcggcggtggcggatcttcgggcggtggtatttgcgccggtatcatggctgcgctggcctgctgttgttgtctggatattctgttttagagattgcgcctttgccttcgttttatacgctgcttcggttttgatcgtgttcctttcgttttttggcgccggaatgggaattggtttcgttcatggtgtaacggagtgttttttcttgcttgttgagctttgaataggtgtctgttgcatttgatgttcggtggttaatcgatcactggttggtatcgttatcgngatatattgcttatgcgtatgctatattatatatcatggtcatgctcgctacatacataaaaaa

SEQ ID NO: 5767 - DNA, 702 bp, Aspergillus oryzae
  misc_feature (1)...(702): n = A,T,C or G
gggagcggcatagctaattacatgacgcaggcctgtacatgcgtgctcgaccggctgcaaccgctatgcacacgaacaaatactgaggaccgtacaggatctgcaccccgacggccagcagaactggactctcaacagggaatatcgtgttgagctggacccatgcaaggttaacgcacaagctggaatctggttacaaggtgaccacgagcaaacgcatgggctgtgtgactgtatattgtgcatcttaccgacacgcaggggtgaaatggtgaactcgatttttggaggcgagttagtgggaactactgtgccggacaccactcacatgcgcgctatgctctaaaggaagacgtgggattcagcaatgggaacgtgggcatggncttcctgagctgcgatttattgagcttaacgtatcttgagtccgcttcttttgcgcgttttaggcgctaaagaagattattctctaacgaaaggacgagccgaggatcgacagcaggggcaaaatgagagagcaagcctgaaaaagaaaaagaaaagggaaaaagaaaaaaaggcgggaagaaaagggaaccacaccagagcaattattacactggtatacgatgttttatttgttggatacctgttctattattcatagactatatattacggagtactctataattttttacatgcttgtttgactatgtaaaa

SEQ ID NO: 5768 - DNA, 679 bp, Aspergillus oryzae
ccacaacaaacatgaacaccgtgtccagggcgctacaacgccccagtcgatcactgacatcgcaactctgccgatcaatccgccaacatcaccaccgagctttcccgtcgccctccgcctcgatcgccactcctcattatactctcggctccggatcgccatctcttctccgcacatccagctatcctacaccttcgcaaccgcaccgtactttctcgcacagctcaacaacgatggccgcagcaccgaaatttgcccgaggcatgaacaaaggccaattgcaaccggagctgaactcgttactggaacaagggtgggcgctggatgaggatggaatgggcgtgaagaagacatactacttcaaaacatatttcaaggcggtgagcttcgtcaacgtcgtcgcatcgcaaagtgcagccaagaaacaccacccaaccatcacagtcagaatcggctccgtcgacatccactggaccacgcaccaaccacgcggtctaaccgataaagatctgacaatggcgcaacactgcgacgaggcggcagagttaatgggcgctgtggaaaaggatcagggcaagaaatgcggtccttcttccccgactccctcttcgccggggttatagtcgcaaacagaatatataaaataatcaatcgggtatatgattatcctgccgtgcat

SEQ ID NO: 5769 - DNA, 1092 bp, Aspergillus oryzae
  misc_feature (1)...(1092): n = A,T,C or G
ctgcaaggattccagatcacacactcccttgtttgtggtacgggttccggtatgggaactcttttgatctcgaagatacgtgaggaattcccggatcgtatgatggccactttctctgtggcgccttcgccgaaggtctcggatacagtggtggagccatacaacgccacattgtctgttcatcagctggtggagcattccgacgagacattctgcatcgataacgaggccctctacgacatctgcatgcgcaccctgaaactggcttctccttcctatggtgaccttaaccacctggtctcggcagttatgtctggtgttaccgtcagtcttcgattccctggtcaactcaattccgacctacgaaaactggctgtgaacatggtgcccttcccccggcttcatttcttcatggtgggctttgcaccactgaccagccgaggggcccattcattccgcgcagtctccgtgcctgaattgacccaacagatgttcgatcccagaaacatgatggctgctgctaatttccacaacggccgctttttgacttgctccgcgatcttccgtggaaaagtctcgacgaaggaggtcgaagatcaaatgcgtggcgtccagactaagaacagcggatacttcgttgaatggatccccaacaatatccaaaccacggtctgctccgtgcctcccaggggcctgaagatggcttcaaccttcatcggtaattcgacatccatccaggaattgttccagcgtatcggcaatcagttctctagcatgttccgtcgcaaggcattcttgcactggtacaccagcgagggtatggacgagatggaattcacggaagcggaaagcaacatgaacgatttggtgtcggaataccagcaataccaagaagcctctatcgatgatgaggaggacattggagagtatggtgaggaggagatcgaggagcagtagttatctcgtcactattcgcggcacgcttgggaattgcaagaccctccttttatcttattacatactttggtaatgatagtgcanaagttgctgccnnnnnnnnnnnnnnnnnnnnnnnnnnnnnaaaattccttg

SEQ ID NO: 5770 - DNA, 1396 bp, Aspergillus oryzae
  misc_feature (1)...(1396): n = A,T,C or G
tgttgaccagttcttgctcaagtctggtaccctcaccacctccgaaaccgctcacaacctcaaggtcatgaagttctccatctctcccgtcgtgcagcgttccgttgaggtcaagaacgccgcagatcttcccaagcttgtcgagggtcttaagcgtctgtccaagtccgatccttgtgttctgaccatgattaacgagtctggagagcacgttgttgctggtgctggtgagttgcatcttgagatttgcttgaaggatctcgaggaagatcacgccggtgttcccctcaagatttccgaccctgttgtctcttaccgtgagtccgtctctggcaagtccagcatgactgctctctccaagtctcccaacaagcacaaccgtctctatgtcactgccgagccaattgaggaagaatgtgctcttgccattgaggccggcaagatcaacccccgtgacgatttcaagactcgtgcccgtctcatggctgatgactatggctgggatgtcaccgatgcccgtaagatctggaccttcggtcccgacaccaccggtgccaacttgctggttgaccagaccaaggccgtccagtaccttaacgaaatcaaggattctgtcgtctctggtttccagtgggctactcgtgagggtcctgttgctgaggagcccatgcgtgctgtccgcttcaacattctcgatgtcacccttcacgctgatgctatccaccgtggtggtggtcagatcatccccactgctcgtcgtgtcctgtacgccgctcagttgcttgcagaccccagtctcttggagcctatcttcaatgttgaaatccaggttaacgagaacgctatgggtggtatctacggtgtccttacccgtcgtcgtggtcacgtttacgccgaggagcagagacccggtacccctatctacaccatcaaagcctacctccctgtcaacgagtcattcggtttcaccggcgacctccgcgcggccaccggtggtcaggccttccctcagtccgtcttcgaccactgggcagttcttcctggtggttctcctcttgatgtcaccactaagcctggtcaggtcgttactgagatgcgtaagcgcaagggtctcaaggaagtggttcctggatacgagaactactacgacaagctgtaaactcgttgattgcaatactattcttatgagatcgacgaacacaatacagtgtctatgctanggccgacacccgaaaattcaaaataaagtgcaacagctgaatgtcgtatgtggatcttcgaccactagaagtagaatccaagagtgcatctgctattgcttttcatcatctataggtacggttacgaaatgccaagttttttacatggtttcaaaaaaaaaanaaaaaaaaaaatt

SEQ ID NO: 5771 - DNA, 643 bp, Aspergillus oryzae
  misc_feature (1)...(643): n = A,T,C or G
gtcaatccctctccggatcccacgccatccttcttctttttaacctacgcggtccgttcttggtgtccacactacattcaatccgcaacaatgctttgcttccggtgcagggccatgccctccgccctgaggacgtactcctccccgatgtccatgtcgagatacctcacccccaaaacctcaacaacaacacctttcagtaccctctcctcaccactccgccccatgaccaacttcaccaccaccatccgtccccaactccagaccctaagcaacacacaacttccctccgcagccacgccctccgcccaacagacccgctctttcaccgccagtgcttccctggccggtaagcgcgcgacctacaatccctcgcgacgggtgcagaaacggcgtcacggattcttggcccgggtgcggtcgcgtggaggacggatgatcattttgcggaggagggcgaagggccgcaagtcgttgagttggtagacggtctatggggcgtgtctgttatcgtgtgctgaacggatgggaatgccttgattgtcgggtgggtatataccgtcggacaacatggggggtttgatgatgggtttgttgagctatttggttttggtcttttggtcgncatttgagggcttgaggc

SEQ ID NO: 5772 - DNA, 684 bp, Aspergillus oryzae
  misc_feature (1)...(684): n = A,T,C or G
gtctacctggctcatagatacgcttcgtcattccatggaactgtagtgaggacccaaagcgggtgacaaacgccgctacggctgccaggatttctcgacttctataccccagatcatccacagttgaggacgactgacgacttgaacgaccgcacgatttttcttttcaactacactatttaccatattcttcactgtttggggtttcatcgacataatcaatcgaccgtataccctcgtccgacaaaacccgagtgaacaattcccccatgcccgccgctgcaatggacgccctgggagccttctcccacctcaccgataatttacccacatggataaaccgtatgtctgatctggctacccacaccgccgccaaacatgccgaatatgccgaggcgtacaagaagctcgccgtcacaccggggaaaccgcgtcgtcgcaagaacagctccgtgtgctccatccggaccgacgagttgcggaatgccgtcacacnaatcgccgcccccgcagaagcaccgacccaaagagaccccgagaccccccacccgcctcccaggacctgtcgaccccggaccctaacccgcgaaagcgtggcacggacgaagccccgtccttagcctncgaggagaccccctttgtcatacgcgatacaaactaatcatccattacgaccgggagacn

SEQ ID NO: 5773 - DNA, 303 bp, Aspergillus oryzae
  misc_feature (1)...(303): n = A,T,C or G
agcaggcacacgttccgttccggtcgtcgcccctgaccatggtgctgcgtgaccacttcctaggcacaaatacgactgacagttattccgctatgatcctcacagtgtcaccatcgtcggagcaattcgccgccactatgaacacactgaagtacgggaaccttgtaggtgtagccggcggaaagaagaagagggtgacgcggtcgaaagtgaaccagtgaggaccaaaacctgcatccggaccatctggaatacagcgaagggtgcactattagaaccattccatttgcgannaanaaaann

SEQ ID NO: 5774 - DNA, 656 bp, Aspergillus oryzae
caaaagcctcaccttctctccgtcccaaacacctccatcatcaccacagatttcacctttctaaaccaactcaaaatgtccgtcgacgccttcttcgaaaacctgagcttcgcccagtctggcgccaagttctccgacctccagtccgaagcctccaaaatcaacgtcgatcttctcaaggaggctgttaaggccgtcctcgccggcggtgacgacgccaaggtcgatggccctctggctgatgccctgaaggccggtttcgagttcgcgactaagctggtcaagaagctgacaaaggagcctggtcagactgagatgctcactttctacaagtacttcaaacaggccagaaacgagaccgttgctgaggccggcatgttcgacttcgtcggcaaggccaagtacaacgcctggaaggagatcaagggcatcagcgcccagaaggcccaggctttgtacatccaggcggttaacgaagccatcaacacgtacggcaccagcgaataagtgttgggcttgatttgtgttgaactaaggaggaatatgaacttggattttatgggcttggtgacgagttacgaatgatgctagattactggcttttgctgtcatctacatgcttctagtgcatatacagattttgcttcatttgaaaa

SEQ ID NO: 5775 - DNA, 579 bp, Aspergillus oryzae
  misc_feature (1)...(579): n = A,T,C or G
cgaggcaacaagattgcacctgcattctaccaatggctttcaataccatttaaccaaggcttttaaaggcaggtgttaaaaagggtgaattcacccaacccaagggtccttctgaacccgtaaacttggccaaaaaggaacctgttcttaaacttgttgccaaaagaaccacaacggccgttaacccaaaaaaggttactgcaaccattactagaaaggctaaaaaggccaaaaaggccaaaaagcttanaacaaccaccagaagaacgtggcttattactactaccagaaaagagtgtcggcaacttaacgcaaacacgcgaaaccttcgcaaagtatccattagtgctcccgccgttgtcaaccaacccaaggttatcggcaacacaaactctggtcgtgagaccaagacaagggacaaccctgctgaaagggccaccaagatgctaccaagagcgctctacgcaatgtctcgcacaacatatttttggagcgacatttccgctttctaaaccgggnttggngcttttttaggttgaaaattttccccgggtttaaattttaaaacacaaaaaaacc

SEQ ID NO: 5776 - DNA, 658 bp, Aspergillus oryzae
  misc_feature (1)...(658): n = A,T,C or G
tgataccaccagggggtgccacggtgatgaaaccacatggaacgaatcgcttaactccggccctcttcgcagctttggcaagaggaatttgatcctgctgctcggcaggaccaacacagctgatgacgacatcgattccctcgagtgcctctgtaagagattcttcagggccttttagatcgcatctgcggatttgcatgccgcgatcttggagggaaacgatggcgggcttctgtaccgaccgggggcggacgagggcgtagagttcaaagattggattttccagaagtccatttgcaatcgaaccaccagtttcacccgctgctccgacaagcaaaacctttgttttcgacatggcgtttcgacgggtggcgagatcagttacgagaaaaaagtgctggttgtgcgataattgggttggggggaaactcgaatgatttgggaagtgagagaaatcaaacggagtgcgaanatgagcangggattttccgccgactggtctctttatttctgtttcaagattgcctctctcccacgcaggattganggtcagtcgacgtattagggccagcgtccacacactaccacactgctttatcanattgccccggtggggcgtcagggatgttagctcccaagatagaaggcttttgtgcgg

SEQ ID NO: 5777 - DNA, 1083 bp, Aspergillus oryzae
gaagtcgagagctgctcgctagatatcaagcagcgcaccgccctaaattcgaggcaaacacaagcaaattccccctactggtccccaaactgttagatattgatgtcgttcgccccgcctccaggtcccccgcctccggctgtcccggaggggtggaaggctcagtttgatgatcggtataagcaatggttctttgtaaatctgcgtactggcaagtcccaatgggaatcccctcaaggaccggcacaagaggagctgcatgcacccgcctagcgaagcacctccctcatacgaagagtccgggcctgcgaacccgtctgcagtacatggtgcaaacgagaagaaaaacctgggttctaataatccctataaccaggccggcgccagaagcagttctctggacagcgatgcccggctagctgcccagttacaggctgaggaagatgcccgcgctcgtgacagtagaagcccgagacagcaagcacagcctggggctgcagcagattactatacagaagcctcgcgaccgcagtcagttggataccagtcgtcctccacccccccacaacatataaccggtccagagcagaagaggagcaaaggctttctgagcaagttgatgggaaaatcatcaagtggtagtgctgcgaatcatggaaggccatcttcgcagccgtcacaaccatacgggtatcctccaggcggatacggtggttatcctcaacaacccacagggtatggctatccttcctatccagcccaacctggttattatcctacagcagcacaaccagtgcgacgtcatggtggcggtatgggaactgcgggcgctgcagctttaggtgtaggtggtggtttgatcgggggtgctttgttggcagaagctttggacgaccatcatgactatgatgattacggctcaggcggttatgatgactttgacggtggcgacttcggcgatttttaatgttaccacgtttctgcatgatagcccctgttgaactatccgtcagcgagttcttatgtttcggcctcttccccccttcctgtattagttcccccccgggccccccaactctatta

SEQ ID NO: 5778 - DNA, 668 bp, Aspergillus oryzae
  misc_feature (1)...(668): n = A,T,C or G
ctctcatacgtatatctatctagtctttcgttaacccctcctgcatctgcagttcactgagtttcccctcttgatacgtacaatcgtttgttctaattccccttcctgccacctcctatcctctcgttggaagtctccggagtatccgtcagtcatagagtcacgagattgaatcgctttgtctttcgcttcatcgcctccggaccttcggatcgagactacttggattgatttcatcccgcatcacccgcccaccatgcgagtctcgagtctttcgttcctcttatactctttgtccctgttagccgctgtctccggtcagagcgtagcggctacgggcggagatgtcgctacctctaaggatgccgcacctaccaagactgatgctaccacaacatccacatcgtctacatcatcaacttcttcgacttcgtccgaatctacagaaagcacttcgacaactagtgagaccaagccaacgaccaccaaggctgaccccacaacaacatcggaatcagactcgtcaacttccaacacagacccccctaaaaccacgggcaaaacagcgactaagacatcggcattaaccactagcggacctacaactgatagcaacaacaacaacgacaacaactcccaaactacagcagacaacagctcganaacta

SEQ ID NO: 5779 - DNA, 662 bp, Aspergillus oryzae
gaacagccgaccgtcagcaaagtccattgtcttgcagtagatgcgcagcacggtcagagcctcccaaaatcccataagattgttatctaccctggatccctcaatgtttctgcgctagggctgagcaccagggaagtcgactttttgaagtcgaccgtagacgccttgatccatgcgggtgcgaatggacattgcctaaacaactacttctcgctgcggatgcccaatctaggatcaactcgcttcctcaccgagctggcgctctcgagaggcgttcccctacactacgtttcttctaaccgggtgacgttactctccggcgatgtcgcgctccctccggggtcaatgtcggcattcccgccgcccgagactggcagcgatggttttactgcgtcgaaatgggccagcgagcgatatctgggagaacgttgccgatgcgacggggttagatgtgtgcatccaccgaccttgtgcgctgacaggcgaccaagcgcccagcgaggatgccttgaatgcgatcctgcggttttctgtgctgatgaaagtcgtaccacagtttcccaatgtaagaggattctttgattttgaaaaggtgggagttgtgggaaccaacattgtgaaagaatgctttgcaaattgtgcaggtaaaccaggggtcatgt

SEQ ID NO: 5780 - DNA, 687 bp, Aspergillus oryzae
ctccggcggaggggcatctgtctggaaacagttctgcctaccttccatcctccttccgataacatccctggttttctccaacctaaagcacgggtggtctatgagtcttctgatgcggagctcggccgacttctacgtccctgcaagtgcaaaggatcttcacgatatgtccacgagggttgtctccaatcatggcgacatgcggacccgggctatagcaagagaaatttttggcattgcccaacttgtggctttcaatatcggctagaacgtctcacatgggcgcgttggatcagtagtacttccgcgcagctaggattgactttgttgatattgatgttcactgtttttatgcttggttttgttgctgacccaataattaacctgtacatcaaccctatggaaaccatcatctactctgaattttgggatcccagtaccgtgtctagcgtcttgccgactgagaagcaggcttcatggattacacactttgtgaaaggtttggcatcgttaggctttctgtcattcatcaaagctatagtcgccatgtcaccctggcagtggtggcatgttcgtccaagtggctgggtcagtagtggcaggaccacaggcagaagccgagtagcgtcaatcacttgggttgtcatcctggttggcgtttgcagtttcctttgggccgtctacaag

SEQ ID NO: 5781 - DNA, 791 bp, Aspergillus oryzae
tgaagggtcttgaccgaggtctcgccctcgtctccacactagctttgctcttcgtccaggctgtagcggtccccctctcagctgccgaaaatgcctcccccgaccagacagtcctaggcgatacctacaactttccctcgacccccgaaaacaatgctgacaccttcgagaaagaccccgaggcagaagccgcaccgtcatggttcacttccaccctgatggcccgccgactcctcgctctctcaaccacaggcgtagcctccaccatcttctctcacacacccaaggacgtccacgtcccagccgccgtggccggcctgtccatcagccagaaagaatacatctcagactgcgacgaggccctgcccccttcaagcggcaacggcggcaacggcgacccgaccttcctcgccctcgaagtcgaaaccaccttccgcaacaccgctgaaggctctaacatcagcatcaccctcgactggtgggaccacttgaacgagaccgagccgctctggcccggcttcccgctcagccctgccggtctcccccgcgttactctcttcgggtacgtcgagtccttcccgtcccctgtcccggaggacacggaggcggctcttcggtcctgctatcttaaagctcaccccgatgcccgggtgtggctgccggagcggccgggctccccgcataggagccactgggtccgcatggttgtcactcacgtttattggattggtggcttcggcggggttcaacgcattgggtggatgaatgtgactgaatggaagggtattcgc

SEQ ID NO: 5782 - DNA, 335 bp, Aspergillus oryzae
ctcgttattcattgtcgactggctaaatgcgcaaggcactcagacggtatacctggccctgggtggaattcagctgggattccttctatttacgatccccatgtacatttatggcaagcggcttcggatgtggaccgtccggaaacgcctgatggagcaatggtagacacggtgctcgccggtcgtattcctttcgcctttgatgagttatgattggacatatgtgagcgttgaagtacatatgcattgttacgtccctgcgtcgtcatgatgtacaatatagatggcgagctagtatatatatagtatagagtgatatcaactttatctgtctg

SEQ ID NO: 5783 - DNA, 659 bp, Aspergillus oryzae
  misc_feature (1)...(659): n = A,T,C or G
ccaattaaaagctcttcaatcaggattgaaataaaaatcaggcaaaacagcatcaaaatggtggtctttcagtcggatcgaccgcgtatcaaaatccccacggatatcacaatctggaaatggctgtttgactcccgctactctcccctaaactccaacaaccccgacaagctcggtgccttcgtcaatgccgccacaaaggagagaattcgctatgataccttaaaggaatacacgacccatgtttctactgctcttgtgcgcaactatggcctccaacccggcgataccgttgccctcttcagtccgaacacgatttggtatccagtcgccatgttagcggctgttcgtgccggtgctataatatctggcgcatcncctgcctacaatatcgaagaaatgacctatgccctcaanactggtaatgccaaatttcttaatgacgtccnctgcggtatggacgttgcggttcccgcagctcgggaagctggcatccctactgagcggatcttccttctcganggcgaaagggcgagtatatatccgttcaagatctcgnttcgaaagggagagctatggacccactggacagacgacaccttttgagctccctcgtgggtagtcaaaccgggatgtgttgtgatttttaagttttagtc

SEQ ID NO: 5784 - DNA, 669 bp, Aspergillus oryzae
  misc_feature (1)...(669): n = A,T,C or G
cagcatcttgtaaacaatcttttgcttatcgtaaaaagaaccacctcccaactcaactcagttaggaccaatggcacattattcgttatatgctcgtcattttacaaacgagagcccacacgtcaatcggtgatcccgggcccttcgcgaatggtctaagtccgtctaaaatgcgtcgcaatcggattgggcctttcccacccggcgcggccggttatcgttcatcgccgaaggtaccatttattgcggcttcttgccctgggcgccagaggtcaggcggcccaggtcagtactctcataggcctgacgaacaacacccttaaaggtctcccatccctggcgcacagccggnggagtgctctggtgcgaaaccgaagcatccacacgggcggtgaaatgacgcacggcctgctgaacaaacgagctctgggtgtatctcgcgcggaanaaggccacgtagataaagaagagaagaatgcttcccttggagaaggtcaaaactcccagggccaggcggaacagcagcgccatctcgagcccagcgacgagaaccatgctggcatcggaatactgcttgacaaaattttcaatggggtctgccaaaggactggcaagcggctttggaacacccagaaaaggggggcgacgcggattccgcgccctgggcgg

SEQ ID NO: 5785 - DNA, 305 bp, Aspergillus oryzae
ccgaacaatcacccacagtagccgcagcgattgagcgaattggccaggcagcagacacatcttacatcgaaactgaggagctctccaacgcattaagcgcaagctttgccgagcctatgagggaaagcgcacagttcgctagcgttgttcgtagtgttctacgttaccgggtgctgaaacgggtgcaggaagaaatgacaagggatgagttagcgaagaaaaagaccttgcttgattctctggaacggagcgagttggaagcaaagcgtattgaacagtacctgaatcggacgtcagctcaagga

SEQ ID NO: 5786 - DNA, 572 bp, Aspergillus oryzae
  misc_feature (1)...(572): n = A,T,C or G
gagcggctcgctaatcgccgaggagctcgtgggcggaattcaagggctcccgagggagtggcgtggcaaatatccagcctgttgatgagcgccctttccgtgatccttaccggtctcggtcccctcgccggagttatccacccgtagatgagtacgaccggagattccctccacctcggggctacagtccccgtgctcattaccgggagcgttccccaattccaatgcgccgggattattatgaccgtgatggctatggacgccgtactcctcctcgtcctcgtattgatgattatccacctccacgtcgaccctatgatgacccttatgatgtccgtccgccgccgccgccgcctcggtatgaagatccttatatgccaccaaggccatacggacgccctcgaagtcccccccggggtgaatatgtgccctatgaccgccgtggttactgaaacccccccgaaaatcaaaggaaaaggtatgcgacgacagtctagtcactgtctatcttagcgcgccgcacgctttcggcgagatgtgtacaatttccttgtggntggccaccgctgccn

SEQ ID NO: 5787 - DNA, 1454 bp, Aspergillus oryzae
gcattctcaaaaatggctgtcaggattgcgagattccttggtctttccaccgtcgcctatcttgctttggcgaatgggatcgacgcccgcgacaccatctctcgcgatgtaatcatccttggtggtggcagttcgggaacatatgccgcgattcgtcttagggatcaaggcaagaccgtcgctgtcgttgaacgcaacaactatctcggcggtcacggcgaaacctactacaccgaagataatacgcctctgaacttcggtgtagagggatttttcaacacgaccgtgactcggaactatcttgaacgacttcaggtgccctatgggcgccgcgaccctgctcccgcgcacgaggactacgtgaacctcaacacagggcaaagaacagaatacactccaggccagcttcaggacagggaggcattcgcgaaatgggtcgacgccatctctcagttcgggttcttagatgacggcgtctaccgaatcccagagccggtgccagaggacctcatcagtccgttcgcggacttcgtgaagaagtaccatctcgaggatgccgtgtacgctctcttctctcacacatctggcgatgtcctggaaatgattaccctctacgtcattcagtacatcggagttccccatgccgctgccttgaatgagggctacgtccgtcccatcgagggaattgccgccctgtacaagagcgctggcaaagaacttggtagtgacgttctcttggaaacgacccctgaggccgttcagcgattcgaggatggtgttgaagtcatcgtgcgcagtgctgatgggaccaagactctccttaagggcaagcaactgctagtcaccattccgcccctgctggaaaacctccacggctttccactcagcgaccaagaatcccgccttttctcaaagtggcaatatcaccagtactgggcagcgctggtcaatgacaccggtctgccggacgatgtgaacatcgtaaacgtcgacacagagcgcctatacggtgttcccgaggagccattcatctggcgcctggataaccattgggcccccggctaccacaatattaagctggttggtggatctgaattcggagaagacgaggcgaaggcgtacatgtatgagaggctcgatcttctccacgcagagggaacatacgctacgcacaagcctgagattgtcaagttcgcgagccacactcctgttaccatgtttgtttcagcggaggaaatccgtggagggttctatcggcagctgtatgagctccaagggctgaacagcacgttctggacgggcgccacttgggcgtcagattactcgaccttgctgtgggggtatacggatgaaggtctcgatcagatggcttcttcctaaaatgctatcaatgctatcaatggtaactgtgtaccgtgcaattctatagtggcgctcgcacttcgatagttgtc

SEQ ID NO: 5788 - DNA, 658 bp, Aspergillus oryzae
  misc_feature (1)...(658): n = A,T,C or G
gttgctcagtgtttctggctctctcctttcctctttctggataacagggtggcacttaattgtcactcagggtgttctatgcgccgttgggaatggtctggtctttagcccgacaaccctatatcttgatcaatggtttgtccgtcgtaaaggcctcgcgtatgggattatgtgggctgccaaaagcatctgcggtgtagtcctcccttttctagccagcgcctgtcttgaacgttttggagcgagaaccaccttgagagcctggacagtcactacggtcagtaccatcttcacgcacaatctatntaatggcaagacaattgccgaaacacgcatatcctcgcaatgcctctatccccagtatggctgtgcccctaagtcctcttctttacgtggctttcctagtgctgctttatttccgccatgatcatccggtacttgagatagccgcatagcttgccggcatgttactcgcttgnaataagtttatacacccagcataaagccacgcatatatttccaactccaggcaaccagcaggccctaatgctttnggctcgttgaaaacataccccacattctttcagcgcttgggcgcgcagcaaccgactgatttttccaagtacttttatctttggaggtttggccttccgataac

SEQ ID NO: 5789 - DNA, 589 bp, Aspergillus oryzae
ggaggtatttcgacagtaatgcttcaacaggaaggcaccacggattcggcaatttcccacgccatccatggatgcttcgtgcttggtagcgccacagcatgttaactgcaacaccactgatcgccctagtttcggttggccccatataagcctgctgatggcattaagaataagcggctcgctcctccagctgggatcttacgaactcatgctggttacttgtctctctgctctggcgtagcattattcacgttgctcctctatatcggttatttccattgatcttctgccctttacctctacgccaatggatggaagctccagaccactaccccaaaccgcgcagcgtaaacgtcgacgcccagtcttagcctgcgatcgatgtcggagacgaaagattcggtgcgaccgtaaggtcccctgcagtcactgtcttaggaccgggtatgccagcacatgtacatacctggccaactcgaattcctcatttcccgaagaggacctgccagggctcgacaccacagattctgccatggacatggctacttcacatccaaaccacgggcacgaccgcgtgcccactgacaat

SEQ ID NO: 5790 - DNA, 620 bp, Aspergillus oryzae
gcatttcagaaagactattgctacaatacacccaatggctcatccactgcccaggtcaatgaaagcatggacgttcactcgagcaggatccgctgaacaagtcctccaactatctcagcagcatcccattcccaccttaaggaccaacaccgatgtcctcatccgcataacccacgtgtccctacaccccggcacaaccataatgatgaatctcgctccatccatctttcgaaacacaccttgcattgcagaaacagacttctcgggactgatcatctcagccggcaaaggagtcccagtgacccccagcccagacaatgagcaccggtgcttcccgcccggaacgcccgtattcggatccattccggtcgggcaacatctaaaaggtgccggagccttggcagaatatctggttgtggacatgaattgcatagcccgcaaaccagccaatgtctcattcgcgcatgctgcgggtttacccgtttcgggcacaactgccctaacactcatggatgcggcggatatccgtcccgctgatcgggtgctcattaatgctccatgtggggggatcggacaccttgtcacgcagcttgtttctcataccgtggctgaggatggga

SEQ ID NO: 5791 - DNA, 704 bp, Aspergillus oryzae
ctttctttttatttacgttagtttgacctccgttgcctccgtctccctacgtgataccaccgtcgttccctccctagatacaatatgtcctaccagcagccttaccagcagccacctcctccccagggatactaccctcccccgggcggccaatatcctcctccccagcccatgcagtaccagcaacccccaccccaggaggagaagaaggaccgtggttgtctgaccgcctgtttgatggccatgtgctgttgtttcctgtgtgaggagacctgcgaatgctgtattgagtgtgtcgagtgcttgtgttgtgggtgttagcgatggaatctggtttttaattgtcattcttttgttttcttacgcgaatattttcgacgtgatggtttgatgtttaccttcttaatgctctgcagctttctttatttacctatacatttccatgttaccaatatattgatcatgtgactttagactgggtccttttctttggtatgactaatcgcagaatccttttcgttgatgaaaatagtggttaggtctagttcgtgtgctcattgatcgctgttgtcgttagttgaactgccgtctttcatatttgcatcgaggttatatgatctttgttgcagaccatcgtgatgtctatagtcactatattgctaacgatggtaatcgtcgatagcgtccctagttcatgacaagcg

SEQ ID NO: 5792 - DNA, 673 bp, Aspergillus oryzae
  misc_feature (1)...(673): n = A,T,C or G
cgagcacacccacgtccgcttgctagtcatgccgaagccgtaaactgcggtgctcaagggatcttccctcatgcactcgatgtcaacgcctcggtgttgactgctactatgattatacaaagaataaacctggggttaaagtgggcataattcagacactgactcagcgagtggagtcgttagaggctcaattggaagcactaagcgcccagaatcaggctgttagtggtattccaagtcctgcaagcaccgttcaggatgtgaacgcgctccgaaacttggtttcatccctgatggaggagtggcgagagaataacacgcccccaaatgatgctccagaccaacgtcttaactcccctccggatcgagatgtgcaagattccacaacgtcggcttcaggtcctgagacctcgcggaaaaggccatgtccagaccccgggagctctgtggattacacaagtcaagtgganctgcctccagataagctaatcaatgggattctggatgcatatttttcggtcgttcatccgttcatcccaatcgtccatgagccaattttgcaatctcgcctgcgtgatccagctgaaaggctgaagctaattcccttactgcatgccaagatggtaagtttccttagggtacgttgccaaccaatcgaatttgctgcaaaatg

SEQ ID NO: 5793 - DNA, 1292 bp, Aspergillus oryzae
  misc_feature (1)...(1292): n = A,T,C or G
cagcatggacttattccgtttctggagcccccgtttggtttggtgaaaccatggcctgaatctgttttcttttgtattctgtttcatgcgttccctttggataatcccggactccactattgcaccaggaaatcaactcacaccgcggaattctctaggaccttaaagacttcgcacgtggagcgggtcttgatgtcgtttactcggaaaccggccgtgaacctggcagagggttcgttgaatttgagactgcgaacgatctgaagactgccattgagaagctcgatgggcgtgatttcaaaggctcccgagtgagttgcgtggcagatatccagcctgttgatgagcgccctttccgtgatccttaccggtctcggtcccctcgccggagttatccacccgtagatgagtacgaccggagattccctccacctcggggctacagtccccgtgctcattaccgggagcgttccccaattccaatgcgccgggattattatgaccgtgatggctatggacgccgtactcctcctcgtcctcgtattgatgattatccacctccacgtcgaccctatgatgacccttatgatgtccgtccgccgccgccgccgcctcggtatgaagatccttatatgccaccaaggccatacggacgccctcgaagtcccccccggggtgaatatgtgccctatgaccgccgtggttactggtaaatacctgtttcctgtgatttggttgtcttgaatgcatggcggatacccatgtgctttgtgtttattccccccttttctcttgtgttcctttgtgtttgcttgattccactttcccctgctttccaaaaggaatcggttgtgatccaagcccaccctcatttcccggaatggacgcaccgaagatgcgacgtgcctgttgtcgaaaaatttccgtttattgcttgacatgaggacaatttctgaggcccttgagcacttactagaaacccccccgaaaatcaaaggaaaaggtatgcgacgacagtctagtcactgtctatcttagcgcgccgcacgctttcgtcgagatgtggtacattttcctggtggttggccancgcttgcccgggtgttgtggatagggcccgcttttcgttcttgcacatacagaattccctgatatgatatgacatggacccatttacgacgatattgtacggtgaccaagcaagtctatcgcttgtttactctacnnggagggtctggatgtatattaattaggattactcggagctaccgttttggagtcattgactgatg

SEQ ID NO: 5794 - DNA, 679 bp, Aspergillus oryzae
  misc_feature (1)...(679): n = A,T,C or G
tgcgagtctagtactgtcgccattcgcatcacttgccagttaatttgtcaactaaactggttcatcccattgtcgcatcatggcatttacttcagtaccatgctcctgttgactatgcggcgcagttggacgccttcaaggatttcctcacgcacttcataacattcgaatcagcttctacatccgctgcgactgaggctattgaagacttacatgattgtgcggttgactcgcacgcatgcgtactgaggtattgaacttttactggtatcatagctggttccatgagtgatggagtccaccagagagtgatcatggcgaaagctgcgctagccaatactgtagtatatgcagatgctccacgatgtggcagatcactagcgcattacatatcttaattgagcttgatgnactatctaccttcgagaaatcccttccggaggacacagaccttaagcttgttgaatccgtgcagaagaatacaaagcgctatgtttgatgttctctcacaggctgccgatgctgtcatgcncaaggaaaccaaggagatcacattcaaggatgatgtacttgatgttatcatgtcacagcgtgaaaagcggaacgaggccatgactatgtgcatggnaggcgacatggacccaacggcagcggcctcgatcttcccccctgagttaac

SEQ ID NO: 5795 - DNA, 847 bp, Aspergillus oryzae
gcttagagactggttagctaaccaaaatattccttctagcttcaagaaattcgcgcgaccctcgagaaagctgcttctatccctgaaccatctgtcgatatccgacaattcatggcctttccaccagaggacattgccaattctgatgacaacaaggtgccagctctgttgatctacgccctgaatatattctcgaaatctttaatctcgtctctgatcacggaagcctctatcaatcccggccacgcagagccagtcggcatcgtagctgcgcagatcttctccacggacgcctttatctataaaggtcatcatatggttgacatactctgggccaaatatcgtgtcgtctgtccggcgctctggggattctacggcaacgaaaagaccgaagccggtaggcgtgccttaggatggtggcgagaagcaccaggaggtcctttcatcagtgaacaggtccatatggaccgaatgacagctcttggtgctgggtttgcggcgctcaccctgcgcaattttggaaagaccccacggaagaatccatttcccaaccacatgttttggcttgcgatgcacaaaattttgatgattcccccgagcgagattcaggagacacacgttatcctgctttcggccatgctcaaatcttctgctgaaaggatcgtcggcttctttggtcatatcggtctggcattaatgaggaaggccatagtcgatgtaccaagcagcgtgcctcgtcagagtatgggcgttaatcaactgaaacttctgaaagacctatacaagcgagagaagaacataattatctgagagatctgtggccggaaacagttcctgtaggtgcagc

SEQ ID NO: 5796 - DNA, 784 bp, Aspergillus oryzae
ggaccattccccattacacgcgtgactgctggcatagtgtgtgctacccatgcgatatttaatatttaccatagctagcagcaaccaacctagcaagagcccactgatcgtataccgtcatacctaatattcatgaatggtgaccttcgtgtcatataggccattaaggaatctcgatttgtttcggtgagcgtgttgacacctggaacatagacgatcatttttacaatgacgcgctctcacaaagtaaacgatcgtgaccactccgtacttcatgatggaatagctgtatcccaagagaatcttcctcgctactttgcaaaatctggccccgttgatgctgatccccggaagacaaaaaaagatggcgggggaaagggaaactggggccaaccgggcgacgaagtctatgactataattgcaaactcacaaacgctcggcgctattccaatagtagcactcaaggattagcggattataaaaccaagtttgagacgattgagccagagcctgtgttcgaggaaagcttccatggtgtgcaaaatgaagaaagacctgtggatggaaacaaagtgctcaacgttgacggagccactagcctcggtaagacactggtatagcagggtcatggactgtgtcccatatgagcgctgggactgctgtaactattttcatcgaagcctgatagtgcgtgggagaattcaaactcggtgtcaacgagagcagattatggattcagaatgtcttatcttagtatgtgatggatgattaaattaacagact

SEQ ID NO: 5797 - DNA, 1041 bp, Aspergillus oryzae
catctctttcgcgatcgtcaaagttagacactcttcaagatgcactttactagcaagtccctcctgctcgctctgagcactcagctcttggctgtgagcgctgctccagtctcgagtgcctccacctctgaggtcagccagcccacgccccctgccggggttgctcagtatggcaactatggagactatggcaagtacggcaactacgcttcctacggcacatacaagagagatgatgtccctgagggtgacggcgaagatactgagccttccaccacgacttcgcctaccgaaacccctacccaaactcctatcaactatggcaactacggcaactacggcaagtacggacagtatggctcctatggggcgtacaacctcgagaagagagacgacagcagctccacgaccacctcttctactacctccacacccactgaaacacctatcagctacggaaactatggcgactacgggaactacggtggctacggctcttacgggtcgtacaagcgggacgaggtccccgaacctgaagagagcacgactactaccacatcttcgacccctactagtacccctgtgaactacgggagctacggtaactacggccagtatggctcctacggaagctattccgaagctgctgtcgctcaagaataagctaagagtgacggttgtgaccatgtaacacggtcgcacttatgtgtaacgaggcaacagccactatgaacgaaatgtaccgaatgatgacttccagcccatggtcgccaaggctgtcagcatgaattgaaaacgtgagactgccaggggggagttcagcaagggatgtgttaccgttatttgtgcaatcagtaaggatggccgttggaaaggatggattggatgggaacacttcacgtggacgaatgataatgcttattgaacattcttatcttgggtcatatgtcactagttaattaaaatagcataaatatgttgtgatttctgtgtgcctgccaaaaaaaaaaaaaaaaaaaattcctgcggcgcgaattcttc

SEQ ID NO: 5798 - DNA, 688 bp, Aspergillus oryzae
ggatttctctcgtttccacgattcctctcagcgggaggagttttgtcgccaatttgtctcaacattgaaggagtatggatttgccaaactgatcaatcacgggatttcgtgtgcacagattgacctggcgtttgcagcagcccgccgcttcttccaattacccttggaacaaaagttaaaatcacctcatcctgccaccgcgcatccacaccgaggcttcagtccggtcgggctggagaacattggagctgtctccgactatggcagcgcagctgggtctccttacctcaaagacatgaaggaatcctacgacattggatccgagtatgacccactttacaagaacatctggccacccaagggagtggatgatgcattccaaccgaccttcactgcattcttcaaagccggctttcgcgccaattaaccatcctgaatgcgctgtcattcgactaggtctacctgagcataagcttggacagctccacgcagaccagaccaatgagctgcgcatcacgcactttcctgcggtcgcccgaggggaatttgcgcattcgacacgtatcggtacccacactgactttggacgatcacccttgtttttcaagacgccgtcggaggattacaaatggagtgttcaccgcattatgggcagttcccggacattcgaaattgtaggcccttacct

SEQ ID NO: 5799 - DNA, 526 bp, Aspergillus oryzae
cgagggtttccgtttctcttttataaatacggcccggcgattaggacgcgatgcaagtatgcagcgcaatctgatgcttttatgaagaagttgatggaacaaactcgcgatgttcctgacgagacagatactgagaagaagtccgagaacaatgctacagaagggttgaaggaggtggatgacactgtgtctgagcccaccccagcaagctcgcaactggatgatctcccgtctgcctccaagtatgaccgaagaaagtctatagcatcacaggcgtcacgccggtctgagggggtaaattctcagactgtgtatgatgctaacccgtacgacattgatcgagtcaacacccgggagtccttcaaatagagaccatccctctattcttgcatcacggctgagtgtatcctgtattgtgatccgttgatggatccggagcatcgcctttctgattaccgattcccctcaaaataccctatagatagtagttagtttgtaatttctatagaattcactgataaaagct

SEQ ID NO: 5800 - DNA, 982 bp, Aspergillus oryzae
  misc_feature (1)...(982): n = A,T,C or G
gttggcgatcattgccggcatgatgcctgctcaaaaagttatataaaccctgacgatgtccgtcctaaatcgactcttttcttcttcaaccatccacattctcttatacattctctagacaagctctgtctgtccttcctttcgagatcgaatctcgtccttcttttttaccacctacatcaaaaaagttacatccttgcgtctgtagaacagacccagtcaatctcttgacttcaaaaactcagaaaactttcacaaccaacacaatctcatcacagtctttttccttcttttccaaaaagacccccacattcaaaatgatgttcaccaagactatcactttggccgctcttgccagcctcgctgctgctctccccactgccaaccctgtcaagcgcagcggcggtgtcaacattgtcaacaacctgggtgaaaccgtttacgcgtggtctgtttctgatagagtcagtaacatgcataccctttctgcgaacggtggcaactaccaggaatcctggcaaaccaacgacaacggtggtggcatctccatcaagttgtccaacacccaggagcagtccaacgtgctccagttcgagtacactcagtccggtgacaccatctactgggacatgagctgcatcgacctcagcggggacaacgtcttcaccaagtacggtttctccgtgactccctccagcacctccgacaactgtccctctgtcaactgtgctgccggcgacactgcctgcgccgaggcttacctcaagcccaacgatgaccacgctactcacggctgccccattgacaccttcttcagtgtcagcattgggcgctaagcatcncttctctctctctctttctttacttgagataagaagatgacttgactacactcattttgctacattgattgctattgctactgcttttggccaaaagtgaatgaattccttaccaatgggaaaaatgaatcccacgacga

SEQ ID NO: 5801 - DNA, 422 bp, Aspergillus oryzae
  misc_feature (1)...(422): n = A,T,C or G
gatatgctcactgagatgggggcatgcgtatggccccgattatccggtgccgtacataggtgaataccttcgatcagcttcttcggacgaaactggaccctcgcgtcaaggactgggttgcgcgcggtcgcaaggcgggcgcgtctgcgctagaggataaatcggggctggcggaggcggagctggcggaattgtgggattgggcacccgtggaggcgaatcatgaggcgaggcggaggaactggggtgggaattttacgctcgaggagagggagatggtggtgcagaatgttgtgactgtgttgacgacggtgttggacgattaggggagtgagagtgaggatgaggaggaaggggaggaggatgagatggagaatgngggtgttataggttcncgaatcgtgctgctttctgatacctan

SEQ ID NO: 5802 - DNA, 688 bp, Aspergillus oryzae
  misc_feature (1)...(688): n = A,T,C or G
catccacgtcattactggtatttctttgtcttctggctttgatttcctcgtgttctgaggatcgtcaaacttcttgcttacatttaaggtataatctgcagctgacgtttaccgaccatatcaacgcgagaggtctcgttcaccccgtcgtcgttcgcgcagccctcgacgtagccgtcgctcttattcgcctcggagtcgctctcggagtcgtgacgattatcgccgcagtgaacgccgttcccgttcgcctatgagtgctgcaccaggtgcctctggaggacattctggttctggttacggtggacgcagcagctacccgccgcctccgagatcgtttgaggaccgcgctgtcgccaaagaacaaatgatgcaagcagtgcgcgagtcttcccagcaagaccgtcgggtctatgtgggaaacccttcctacgatgtcaagtggcaccacttgaaagattttatgagacaggctggtgaggtcatcntttgcgacgtcttattacttccccatggaatgtcaaagggatgcgggattgtggaatacgcaacgaaggagcaagcgcaaaatgcggtcacacgctcaacaaccaaacccttatggtcgtctagtctaccttcgcgaggaccgtgaaccccgaccttgttttaccggtggcccttttgttggggatttcggcggtggtgg

SEQ ID NO: 5803 - DNA, 693 bp, Aspergillus oryzae
ctttcagcagcagcttcagtgctgctatcagtggtggctttgcgggccaatgcgttgagtcgaaactctccaaggacgacgagacgtccccggagatctcgtccggcagcgataagaccttctccatcagcaagcttcacctggtgaccgccgaggaggctgatatcaagatcatctatgacatgcccgatggttcttcctgcaagcatgtcgctccctgctctccgaagggaactgttgtcaccaacgaccagtgcggtggtgccagctccgtccggtttgaactcgcagaggaggccgccgtggatgccgtagtcttcggtatccagaatgtcgagtttgagtgctcccctggccagaagaccccaaccccctctcatcaccacacgagcccgactgcgactggacactcgtctactccagtgattccagtaccgtcgtcctccaatgcagtcacgcctccggctcctagcactcccgtcaggatgaccacctcgaccgtgtttctacaagcctgatcaccatctcgagctgtgcttccaccgttaccaactgccctggagaatcgaccacttgtgtcactttcaccaatgctggctcgaccactgtcttgccggtcacctttactgaaacttctgggaagcctactgagacttctgtgaagcctaccgaaccccggggagcgctctggat

SEQ ID NO: 5804 - DNA, 1050 bp, Aspergillus oryzae
  misc_feature (1)...(1050): n = A,T,C or G
ctctgcaaccgatctggctgccgaagtcgtgctcagcgcttcggctcagtcttccttgtctacattcctctctggacaccttggtgttggtctcgatgtcgacatcagggctggtcttggcctctgtgctggcggtggtgttgtcgctgacctggccgcggatgttaaggctgccctgaaggcttggctctctggctcggagtgcaccttgagccattcgttgaaggtctctgttctggcctggttggagggtaaggtcgaaaccggtgttgtctccattggctctgttccttctggtggtttggcgactatctccgctggtgctgctattggcagcctcattgaagagtctggaattctggtcgccagtgctctagcttccctctctgccttcctcgaggccgacattgctgctgaccttgaggtcgagatcctcaccgccctcaaggcttgtgctaagggtggcctcgccgctgacctcagcgttgaagtccgtaccgctttggctatctggctctctggctccagctgccgtcttggtgccgaactcaagtctgttgttctattctggcttaccttcgctgtttctgccgatgttgcggttgatgtgagcggtggtcttctcactgatatcacctccttcctcaccggaactgtcgacacccttatcggcacaaacctccgtggcgtgatctctgttctcatctctggcgagagccttgtctccatctccctcgacgctcgtgctcagctcgctgccgtctgcggtggtgctgctggtattgagattgacacccagattatcctcgtcattattcagtggctctctggctgcgacaccggctctggcgcccacatccgcccccctacttccggctccgttgttcctagcattcccgcttctacgcctgttgcctctacccctgctgcctcaacgccccttgtgccgactcctgtccccaccagtgccggtgccactggcagtgacgttccctcggtcccgcttgctctgctactaccggtgtaccctncgtgtcaactncggctctg

SEQ ID NO: 5805 - DNA, 636 bp, Aspergillus oryzae
gaggttattacccaaacgaagacaccatcttctgtcgtcaccctcacctcgacatcaattagtcggctcccccttacgtgcgccttccgccgctacgtccgactctctctcctcgcgtatcgactccctctttcagttttaaccatctgtgcatgcgccgtgatgtatgcacgctcgagagtcctttctcgccggtctgatatggcacgagtcccggaactagtagccaccacgctcgatcgccttgcgacacaagccgctttgcatgcccgtggcgaagcccgtgaaccttatattccaattggacaactgcgcgacgacgtccttcgatccgaattgcgtggcagtcgacgtgaagaactatggcgacgggttcgcagtgtcgttgaagggaatgccaacattcgagctgccgtgcgagacggtcgtggtggtgacgttgctcgcgtgtgggaatggattggcggcatcggcagtgttcgtggagacattgaatgatccgcgacacggccgcgcgacagcagcaacctgcatttgtcgggctcacctcatgaacaaagccgtcagttgatggccagccatgcccattctccagattcagcagaagctcgtcgatgggacgaagggaggcctatt

SEQ ID NO: 5806 - DNA, 667 bp, Aspergillus oryzae
ctacaacgagcaaacgtctctcacgcagcgggaggccagcatgcagcttgagcggagagcccaccaaagtcgcatgctcccggaggatcgtaccggtgcgagctcacccaacctgcaggagaaccagcaacaggctcagaccccgccggccggtggcagcgccagtgctgtttctatgatggctacgggagcgaccaccgccggcgctggttagcttgcggcatgacgggatcaactgactacccctgatggacgacctctctttgtctcactaagcaccctctcgagcagaaagctgtttccgctacatcagtactactttacttcgatactagcagatattgacttcatcaagctctagattgcgtgaccctcatgtactgtatagattacactatcttttacagcatcatcctcttccgcgacctcacgtcctgtactgacgcgattctatacattaggtcactcgatgtttcctgtatacgtcatactgttcacgttatcacgacttctgtcttaccacttcatcgttgtatgaaagacctatgtcacgccatggctgtgatatcacgcaagatacttgcgtcttcatctcatatacatgacgagcagacttctatatgatcattatcttactctcatcatcatgtatccccctccctcgacc

SEQ ID NO: 5807 - DNA, 630 bp, Aspergillus oryzae
  misc_feature (1)...(630): n = A,T,C or G
gaagcgcggattgagcggttcgagcgcgtgttcggccgtgcgaactgggatgtgcgatttcagctcccactagagcaggttgataacgcgactgcacccctcagtgctcccccaacgctgcatctgatcaacctcaacaccttgactctcgactccccggccctatcctcggacatccagtcccatagctacgcctacattaacgatctgatctctcatcgattgtaccccgtggaagaccgcacgacatttactctccttctgacccacctccccctacacaagaaggagggtatatgtaccgacggtccttacttcacattccatgaatcagacgacgaggatggccccgacgatgtgccgcgcttcaaggaaggaggattgaaagaacaaaaccatctcagcgaccacatcagcagcagcggagtgctccagaggatttcggcatgacaggagacgaaagcggccccgcggaggaagagacnngatgactcattctacaggcacgacacacagggtgaacgtgggcacttgtgaaccgactatagatacacaccgcgagactcgaacacgagttgaatggaccanaacctcgatacgctgcgatacttacgccgcattaagagtatn

SEQ ID NO: 5808 - DNA, 640 bp, Aspergillus oryzae
gcggttttatggacgattttgtttgtagtctctattgccatataagcggcttacttgctctaaaccctgtctcgggtagttttgcggcgacggttttcggagcatgagtctctcacacacctgatctagtggatattagttaattaggaatcacctaccttcaaacctagagtgcgctgtatccatgtcacagccatgggattacatcgctaagctagtttgaattggtgactctggaactggaaagtctaacttgactattccgctttgcgaaggacgcttttcatctttccacgatgtgaactattggtgtggagtttggatcgcgtattgttccaactggaccacctgcttcacaggcccttaatttaaaattaaacaccaactctcacaaccgttcggttcgtcgccagttacttcagaataccttaatgaacccagtcgtttcgggtttacctaaccttcaccgaaaaagggtggatctctaaaaagaaggaggtatcactatggggaaccgcagggcgggaaacgtcaaatccttccaccggttttttttaaaggggctctggggcttggttgtgtgcaattttactaaaccatttacgttatcttccagcccctaaaggactcggatggtttg

SEQ ID NO: 5809 - DNA, 977 bp, Aspergillus oryzae
  misc_feature (1)...(977): n = A,T,C or G
ctccttttctctccacagtccttcgttaactacttactaactacgcgtttctatacactcgttaatttcttcgagttttattatcgcttcagcgtctttgttattttcaaaccgtcaagatgaagctcaacctcattgctctgacttctctggtcgccttgaccgcggcccagtcgactgactctacgtcggactctgccaccggcaccactgttgctccttcggcgactgtcagcttgtctcctcaacagtcctgcgctaagaagtgcgacgcaaccgatctgtgctgcattgctggatgcttcgaggtcccctgccccaacgattctcaggctaacgacaccaacacttgcgtcgccgcctgcccccagggcagtggcaccccatctgacactgagcgctacgccgcctgccagagctcctgctacagcagccacttcttccctatcactgccacgggtaactctggagcctccaagacctctgccagcaactctgacgccaccaccaccggtactggcaaggacagctcttccactggttccagcgaatcctccggctcccgttcttcgggctccaagtcttctggcactggtaccagcactggtgctgctgccaccggcaccgagaccaatgctgcctccgttgccaagcttcagatgggtgtgtctgccgccggtattgcgggtctcgctctcggtatctgggctctgtaaatgggcttaagcttattgatttggtgatctcacgtgggacgggtaatgggagaatgtgaaaggatggaaaggtattaatcggtataaggatgtcgcataatggtctacctacatagttgtacttctgcgctgtaatattgattcccaagcactttgtcgttaattgtatcggtattagctaatacaactgctacccccaagctgatcttcgacatcctcaaggttgagaatnnnnnnnnnnnnnnnnnnnnnnnaattcct

SEQ ID NO: 5810 - DNA, 760 bp, Aspergillus oryzae
  misc_feature (1)...(760): n = A,T,C or G
gttaaganacttatacttaaggcgaattctagcttcgtacccgagcgatggctctagaatccggntcgaggcgagctccactatccattatttaggacacccttctatgatgggcctacacagtatagccagaagcatcctcaatggttgcgcgtaaagccccacgaacctaggaaatgattgaagatcctagtaaacggcctcggcctgccatgcgctccaaagatggatgccttacctgccgtcgccgcaagaagaaatgtgatgagcgtcatcccacctgcacagggtgccatcgaaatcatctcacctgccaatggccaacgacggaagtggccgtgcgcatgcgacgtccgcgccgacgtcaagttctctcggacatgacaattccgcctgagctagcagcgatggtgacggtcttcgcagttcccagcccaagcctggttcgccggcttctagaccattttgcgaaacatggccctatgtggctaacttccaggatgggtaatcgacgaactgcgatcctctctcatatttttccggagccatggnaagcccccttatcctccactgtgtgctcatgatcgcagcgaaagattactgaagtatgattcgaacgtggaattacaagcttcngcagttgaatactaccgtcgagctatttcgggcctgggtgaggctctcaatggaaaagcattggcaaatgaaccaactttgataatacctgttagcaattggctaattcttcctttaacaatcc

SEQ ID NO: 5811 - DNA, 657 bp, Aspergillus oryzae
cgaaggtttttccccgtttatattgacataactctatggcacgttcatccgcagacggactgaaatacttgtccaacgctctcgcaacacccgaacaactctccaattcatcgtcagctatcgatggcgttgctccagaactagaagcatctattcgatttgccggcactcaactcacccaagctgctggggtattgcttcgattgtcgcaagatattatcgcgcaggccattgtgacatttacccggttctggataggtgctgaaggcgggagccttcgattttactctgtcaaggatgtctctgctgcagctctatatatgacggccaagctatccttccagcctacatcaccacggtcggtattgaatgtttacaacttccttgtatcgaaggacgcttctcctttgtggttcatcaacccgaagggggtatcggagaagccctcccctgagacatactgtctatccgaggggggctaccagagccagcgaatggtgctgctccgaaccgaatcgataattttgcgcacactgggcttcaatacccatgttgccctgccccatacgatcgcgttaacctaccttcagacccttggtgtatcggcttctgctgttgcgcaaagggtgtttgagcatctgaacgcaactcttctat

SEQ ID NO: 5812 - DNA, 696 bp, Aspergillus oryzae
  misc_feature (1)...(696): n = A,T,C or G
ctaggaatcgttcaagttcccgcccctccattcaatcaacctcccaccatcaccagccagatatcattagtccctcccgctcgataataaaatagaacatacataagaagaatgaccgacacagctattcaaccagacccgggcttagctcaatgtaaatggcggcaccttgaacctaaaaaacatggccccccatctcccctccccacaagcacaatacacctccacatcttccacacaacagccaacaacatcctcctccctctcagaaataatcgcccaatgccaccacaaagtgcacgcctttctcgccgagtcccatcctcccgattccctcctcgccgccgttcaacgccaaactcgcatctccctcgacgtcgccgcaacggccctctcccgttacagcctcccggagctcgccctctcctataacggtgggaaagactgtctggtcctcctggtgctcttccttgtcagccttgcaccgcatccaccgaccgagaagggcgggctcaagtacatgccagcgatatatgctctaccgccagatcccttccctacagtcgaggagttcgtncagtggtcgtcgagcgcctaccatctngatatttataagtatacgacggagccgnncaagacgacgctcaagtcaagtttcgcgcactacctgtctctncatnctagtgtgaaggcgat

SEQ ID NO: 5813 - DNA, 760 bp, Aspergillus oryzae
  misc_feature (1)...(760): n = A,T,C or G
gtatagccttccaattcggacgagggttgattgtcgatataatggccgcgtgcggatgctgcacaggtcggttcaagactttctgctgttggaaatgcaggatatcaaccctagaggatcaaattatgctctttcatatcggtgcatcgaggttatccttcagtattgtcgaccagacatggatatgtcaacactggaatctagccacggcttccttggttattcagtactgcactggccggaacatgcaaacttagctcaaacagaatttactgtttcaaaggagattgagcaattttttcggaaccgactcgggccgtggaaatgttggctagatagtcacaactacttaaaaagaggctctgagggtgatttgggcactgggatctcggtcattcatgttgcagctcgctgggggattatcccattactctcgtgctttcaagatgagctggaagaaaaagatacgcgtggcagaacccctttgctcactgccgctcaacactctcaacttgaagccgtaaaacttttagttgaatctggagcgtctgtgaatgctctagatgacaattgtcggaacgcactccatctgatctgcaaaaatagccgagacaatgactgcgaactggccgacttcctgcttaaaagccgggtctgccaatatgcgtgtgacannagatatatgacgcctttgctttatgccatngggaactcagatccagaacttgcacaagttgtcctttcagaatggatncgaggg

SEQ ID NO: 5814 - DNA, 1418 bp, Aspergillus oryzae
ccctcctcccttcatctcctatacctcatagtcctccaagatgtctccagccccagttggtgaaaaatggtggaaaaactccatcatctaccagatctacccagccagttttaaagactccaacaatgacggcatcggcgatatccccggtattatctcctcccttgactatatcaccagcctgggggtagacgtaatttggatctccccaatgtatgacagtccccagtacgacatggggtatgatgtctccgattatgagagcgtctacccaccatacggcacagtccaggacatggaagttctcatcgacgagtgccaccgtcgtgggctgcgcattattctggacctagtcgtcaatcacacctcgcacgagcacaagtggttcaaggaatcgcgatcatcaaaagcaagccccaagcgggattggtatatctggaagcctgcaaaatacgacgccaatggaaaccggaagccacccaacaactggcgcagtatcttcggcggcagtgcttgggaatgggacgaaggaagcgaagaatattatctccatttgttttgcaaggagcagccagacctcaactgggagaaccaagagacccgtcgtgcgatctacgactcggcgatggagttttggctgcagaagggtgtcgatggattccgtgtggacacggtcaacatgtacagcaagcaccctgagtacccggatgcgcctgttatcgatcccaagtcggagactcaaatgtcgccggcattgttctgtaatggacctcgtattcatgaatacctcagtgagatgaacgaggtgcttgcgaagtatgacgctatgacggtgggagagctgccgaacacgcacactgtcgatggcattctgcggtatgtgtcagcggcgcagaaccagctcaacatggtctttcagttcgatatcgtcgatctcggacaaggaaaggattataaattcttgactacgctgccgggctggaccctgccggaactcaagaccgctgtcaagggtactcaagttatcatgaaggggacagacggttggtccacggtcttcacggagaaccacgaccagggtcggtccgtctctcgctttggttccgagaagaccccagaattgagagtcacctcggcgaagatgcttgcaatgatgcagggcacgttgtcaggcactcaattcatctaccaaggccaggaaattggcatggtcaatgcgccagagagctggaccatcgacgaatataaagacgtcgacagcacaaactactaccaaatggtgcagaagatttccaataacgacccgctggagctggagactgcgatgaagtcactccagcgtttcgcgagagaccatgcccggcttcccatgcagtggagctctgagactcatggtggattctcctcctcagaaaaga

SEQ ID NO: 5815 - DNA, 1323 bp, Aspergillus oryzae
ggcgcaatcacaacccccaggatctccctgcagataaattgacccatatcctctatgcattcgccaatgtccgacctgagtccggagaagtgtacctgacggacacctggtccgacatcgagaagcactatcccacggactcctggaatgacgtcggcactaatgtctacggatgcatcaagcagctgttcttgctcaaacagcagaatagacaactgaaagttttgctgtctatcggtggatggacctactcggccaattttgcccagccggcaagcacggaagccggacgcactaggttcgctgaaactgccacgaggctggtgttggaccttggtcttgatggttttgatatcgattgggaatatcccaaggatgataacgaggcatataattttgtactgcttttgcagaagtgccgtgaaaccctagacagggcagccggcccacagcggaagttctatttgaccattgcttgcccagcaggtaaggaacattactcaaagctccggcttcgtgagatgacaccctatctggacttctacaacttaatggcatatgactatgctgggagctgggacagtgttgcgggtcatcaagcaaatatctatccttctcctgacagacctggctcgacaccattttcgacagtcgacgcacttacatattatgagacggcgggtctcgtgccgcgctctaagatagttgttggtatgcctatctatggacgtgcttttaccaataccgatggccctgggaccagtttctctggcgtgggcgaaggaagctgggagaacggggtttgggactacaaggcacttcccaaaccaggtgcaacggagtatgttgatcccagtatcggtgcatcgtggagttatgaccctgcaacccgcaaaatggtctcgtacccaaatgtgcgcataagtgatctcaaagcgtctttcatcgggccccatggaaaacttgttggaatgtggtggaagccaaccggtgccaaagaagccaagattgccaccaaagcgaatgttagcttgattggaactttcgtgaagggcgtggaaggaccggcccccttggatcagaccccgaacgcacttgcatacccggaaagcaagtacgacaacctgcgagccggtttcgcttagacctaagtttgagatacccccagtatacgacagtcttgttccttgtcgaatttgcatgttcttgccgtggtcttcaatgcacatatatatactttacgcatcgttagatttagatccaagctatgggacgagtgtttcgaatttttaaaaaaaaaaaaaattcatacgaaaaattcct

SEQ ID NO: 5816 - DNA, 624 bp, Aspergillus oryzae
  misc_feature (1)...(624): n = A,T,C or G
cgcagaagttctcgaaccctctacgaagatgagagctaagtggagaaagaagcgcgttcgtcgtttgaagcgtaagcgcagaaagatgcgtgctcgcagcaaataaatgactcgcccaatccatctcagttccccatgcggtgctcacgttgaatgctgaacatgacaaaagtcgacgacgtcacgatgatgattccctattatgatcgtttcgtggtttagccactccaacgggacttggctggtctgctattctctatatcctatcgaatccggagtcttatcattcaacgaaaacatacatccaatctcgcgggctctttcaacggtttcggattttgaccaggcaggaatgcgcactacgtattcttcgtctcggagggcgaatgtgtttggtggggtttggaggggtcgtggaagaagttgatggtcacgtttcttatgtactatttgttttcattccacaggccctttgggttccgtatgggatctggtcaatcactcttcttagggcttgtgctgtagcttacagttcctgtgcaagttctgagccatggagaggtcatcgaggatttatcacaaattaaaaagtttgcaatgaaagcaatgactgaaaaanaaaaa

SEQ ID NO: 5817 - DNA, 578 bp, Aspergillus oryzae
caaaaaaaaaggccccttcaaaagggcccaaaaaagccttttttaaaccgagaccaaaaaaacgggccctttggaaaaacccaaaaaaatggcccaatccaacctttgaaacttgaatttttccccctttgcccaaacgggggttttttccccccccaaaaaggtaaacccctttggggtttttaaaccccgatttcaaaccggggggcaacccattgggaaaccccccccaattccttaccccccgggcccaagggatctttacccccggggaattcttgaccccttccccgggaaataaaaaaaaccttgggcggttgcccttttgggcctcccccagaaatttaccccgaacccccttggccgtttttaaaaggacctttggccgtttccccttccccggaatggggctttttgggttttggaaacaccattttaaaccccccccctttattttagggttggccttttagcccgggggcccgggcaaaaaccccccttggggaaaaagggtttccccaaaacacttgggttaaggaaccctggggaaaccgaaagggtaaaaaacgggggatacc

SEQ ID NO: 5818 - DNA, 459 bp, Aspergillus oryzae
  misc_feature (1)...(459): n = A,T,C or G
cgaggggtgcaaacggagaggaagagagcgaaactctgcaacttagcaacatgaagggcatatcagatgccaccgaacaattaatctccgcgctatctttgcaacctcttgagggaactgatgtggccctcagcaacagcacacacacgctcaagctctttggaaagacggtatcaggtggccgggttgcagccctgatcaagatggcattctccagcaagaccggtgtcacgacgaagattaccgtgcgggcggaggaagaagcgtcgcaccggctgtgattgcatccctttcctaaggttgtaaattgtaaatggtaatggaggaggttgtcatgtcaggaggcgtaccctgcaacgagtcctgcattatgagatcggacttgttttgtttgttcttttcccaatttttgataatccaaatgtcaagctagatatgatggcttttttttcttcttan

SEQ ID NO: 5819 - DNA, 634 bp, Aspergillus oryzae
  misc_feature (1)...(634): n = A,T,C or G
gcaagcgatatcctgctacgatcgtgccctttcctcgtgtccgaattacctcaattacgaagtcgcggtgctacggagtaatatggctgcgtgctacctgaagctggaagactggaaagcctctgttgattcagcaacagcatgtctcgactgtctagagaaagtggtcccatcggcgactgagaggacggatgctccccaagaaaagcagcaagagtcgggctcgacagattccgtggtggagataacatgtgatgatgaagaggcagaacaagaagagctcaagcggttgcagaaggttaacgaaaggaagaatgacgttatgcggattcgggcaaaggcacttatgcgacgtgcacgagcaaagtcgcagcttagcggatgggggaacctgcaaggagccgaagaagactacaagttacttgccagtatggacaatctatcgctcgatgataggcgcattgtgcaaaaggctctccgggagcttccggataagatagccaaggcaagagaaaaagaaatggcggagatgatgggcaaattgaaagatctgggtaacgggatccttanaccatttgggctttcgaccgatattttcaaatcaccccagatccgaatacgggtggatatagct

SEQ ID NO: 5820 - DNA, 694 bp, Aspergillus oryzae
ggcgggtgaaggtctgggagtggaatgctgggtggttggggctggcgttggctgttgctggggcgtttatggccaccgaggggttgaaggatttgtatggccggcccagaccggatatgttggctaggtgtgatcctaatttgagtaatattggggattatgtggttggggggcttggggggaaggtggagggtgccccaacggtggtgagttgggaaattttgtaaaataggggaaaaaatgttggttgtggaatggtttaaaattttccgaggggcattttttttttgcctttgcctgattgacctatataattctggggtttgcccaaaattccttatggttatccctattttgggcaattcccctttagacaaaattttttctcccaaaaaaccataccattttcgacatctgaagagttgcccccacccttttattggataccctcactttggcccaagaaggatctatttttttaaatttccatcggtcgtttgttttaatttcgcataatatctatctcaattttttgcaactcctctattgataatttttacaccacggggtgattataactatatttaaatctcactattaaatgtggtagggtgggtgctttaatgttgtcattaataaaaaatttacatttctttttttttgaatgatataaatttccaaatatatattggtc

SEQ ID NO: 5821 - DNA, 577 bp, Aspergillus oryzae
  misc_feature (1)...(577): n = A,T,C or G
ntcgggggggaaccgttttttttatttaaacccaaaccaataacccacaaaggtttggaaaataattattacccccaaaaaatcccctatattgggaaacctttattccaaaccccaaaaacctactagctcttttcaaacttaaattgttcccaatcaccccccccaatgaaataccccaatatataatacttttccccattttcaaaacccaaaatccctaagataaaccccccaatccgggttgaaacaccccccatataaacttgtgaaccggaggacaatttgttcttatccccgtggacacaacccccatttctgttcccacccccaaaaaatttaaccccctaaatacgcaacccgatgtttttcttaacccaagaaaaaaattttcttttaccatccccgggagggggcgcaaaaataatttcgataacaaatttatgaaccctcaaaaatatcccctcgaccatattaaagaaaaaaaatgatcttatcaaataacacactctcaccatcgcactaactcccaacaatatcaaaatggtgcccccctccacctttgtcaaacacacct

SEQ ID NO: 5822 - DNA, 688 bp, Aspergillus oryzae
ccccagaccacttcactcaccacctcacaggctcgctcaaccacaaccaaaatgggtatcttcgactacgacttcctctactcccaactcttcatcagacccgcctacccgacaacatcattcaccaaccaaacaatcataatcaccggctccaacgtcggcctcggcctagaagcagccagacacttcacgcgcctcggtgcagcgaaagtcatcctcgccgtccgcaaccgctccgccggcgaagaagcccggcaatccatcgagagatccaccgggaccaccggcatctgcgaagtatgggatctagacctggcatcccacgaatcggtgctcgcattcgcaaagaaagtagccgagctcccacgtctggatgtattcatcgccaatgcctcgatagcaaccggtacctttcaactggcagagggccatgagcggactataacagtgaatgtgattaataccattctattggaattgttggtgttgccgacgttgcggaagagtgccaggttacatcctggtacgaagcctcggttgacgacggttgttagtgaggtgcatgcctgggctaagtttgcggagcggagcgccgagaatgtgtttaaggctttggatgataaagagcaggcgaaacatgccgagaggtatgagttgtcgaagctgttgcaggtactcttgttgcgcg

SEQ ID NO: 5823 - DNA, 1095 bp, Aspergillus oryzae
taattctatctctcccatctataactccaagccaaccccaggcgttcgtcactgagatctctcccacttcttagttcaatccttcgaaggaaaccaaacccccatttacatcatccatctctcccccctactctactccaagcagcccaaaatggaaggactatacttcgactccagtcgacctataaagcatgtcgacagaaaggcaatctacacccgcctcgaagcccgcatcaactatctccaggacttcctggacttcaattccgctgacgtcgaagccctgacaaccggctccaagtacatcaaagctctcatccccgccgtcgtcaacatcgtctacaagaagctcctggaacaggatatcacggcccgggccttccacacacgggatactagcgacgagagaccgatcgaggagttctacaatgaggagagtccgcagatcatgcgccggaagatgttcctccggtggtacttgaccaagctctgctcggatcccacgcagacggacttctggcggtatctgaataaagtgggtatgatgcacgccgcacaggaacgcatgcaccccctcaacatcgaatacattcacatgggcgcctgcctgggcttcatccaagacattttcaccgaagcgctgatgtcacacccgcgtctgcagctgcagcgcaaggtggccctggtccgcgccatcggcaaaatcatctggatccagaacgacctcatcgccaaatggcggatccgcgacggcgaagaatacgccgaagagatgtcgcaaatgaccctggacgagcgagagggatttctcggcgacaagaagatactgggcgacaacagcagcacattcggccactcgaacgacgaagaacgcttcaatgtgcacaacaaccccagtatagcacccaacattgggcccctcacgatctcggcggggtcctttcgcgatattggcatggacaaattggcggcggcgacattgagaactaaaaactgggctggggaagaaattgaaccacacttttgggttctgggccgaaaaactatatgtgagaaacaaatttttacgcccccccgcaggggagacctttcggg

SEQ ID NO: 5824 - DNA, 735 bp, Aspergillus oryzae
  misc_feature (1)...(735): n = A,T,C or G
ngcatgcaattcggacgaggccgaacaccagccataccatgtctgccttcgcctcatccctgcgcccaatgatgcgcaccgccaccggcggagctctctccgcgcgttccttcagctcctcctcatcgcgctcagtagctcgtatgatcatcaccggccgtctggcggccgctccggagctgcaggccacctcatccggtcaagatgttatcagatacaccgttgctacctcgaccggggcgcgcgaaaaccgacagacaagctggtttaaggtcgcaagcttcgaccagggtgctcagcgcgattacgtgcttggtttgcagaagggaacccttgtttacctcgaaggaagcgccagcctgcgggactgggaagattctgagggcaagaagcagaccaccctgaacattgttcaacggaacctcgaggtcctcaagcgcccgcacaactctaacgaaactgagtctgcctaagcttcgtccgccgaacaaaagcctgcacaaggagaaatacatattagcttgatgggcgggtatccagagattagaggctttctgtgatcccttgtaggttttatcggtgaacgttgaatgggccatatgtgttctaattggattttggatcatacggcttctgtatggtagtttgtgtacaagtatacccttggatactagcgctcttttagcataaaannannnnnnnnnnnnnnnnnnnattcctggggccggtcgagct

SEQ ID NO: 5825 - DNA, 574 bp, Aspergillus oryzae
  misc_feature (1)...(574): n = A,T,C or G
cgaggaactcttttcgtgcgtccctcgttcattcgccaaaccaaccatgcacctccctactcttgtcactctcgcctgcatggccgttagcgccagtgcattccattacccggactttgtcccattgcaccgtcgccaggaacccggtacgcctgaatacgattgccatgcaaactgcgggggggtaattgttgctgctcgtaaagacggctactgcgataccgacactttcaaaactgagttatctgactgtctcaactgcgccctcaagtacgacatctggaagtattacggcgcgtccgtttccaaggccgctactggatgtggtgtggacgccacccctgtcgaagcgtcctccactacgactactgcagctgctagcgccagcgctactgaaaccggaagcccaatcacctcatccgcgtcgtccacttcgactgacaccgctgcaaccacgggtgtaacgtctgctgcttctagtgctgtgcccagctctagcggtgcggctagctcgacacccgcggnctctaccgttgctttctctgcgacacctttcccagaattcgactggtgg

SEQ ID NO: 5826 - DNA, 1198 bp, Aspergillus oryzae
cgacgcccgcatctcagtttctctggaccgaccactcaactgcctgttcctagcgatgatgaaagagtaaaggcacttgaagagaaggtgcaacgcctggaagctgctcttgccgaaaaggaggctgctttggcggagaaggatgccgctatagccgctaaggatgccgagcacgagacgaaagctaaagaacgtatagagaaattgaaggagactttcaacaacaagatggctgaagtcaggacggcccaccgacaagagatagaaaagttgaggactaatcaacaggccgcatcacaaccgcaagaacctggaacccctgtgtcgaaaccaaaccaggcccccgcaactcctgcaaagacggaaggagaactaccgcaactcaccgatgagcaagctaaagcactggttgctaagaaccaaaccattcgggccatttattcgaacaattatccgaaccatgcctgcttaagaaaagaaagaaacagggggcctcacccttcggcgggtgtgaaccaagaaaaccttggcttccatggtgcaaaagttcaatgaggagaaggaagccatcaagaaggctcacgaggaaggtgttgaagagagaatcaaatcagccgtcgagctatctgataagaaaacgttggtcaagatcagtatgcttgatacacggtgtagaaatgcgcaggcgaagatcgacgttgttcagaaggcggccaccgagactcctcagaagcctgttgttgaggtgtgggaaatagcgaagacaactaaggctccgcctcaaacccaaaagcttgcatcggctgcatcgcccgcacaagtagcgtgaccagcgcccgcgccaacacctacgccaacaccaacggcaggagtggtaccgaccccatcaccgggtccagcaccgacaccagtgcccactccagcgcctgtcaaccagcagcaaggcccagcagcaaccggctctgtagtgacggccactcaagccaagggacctgccccagccgaaattcatggcccaggaaatgtacagcaaaagccatgaacagctaccacccaccacaaagtaccgaaggcccagcaccacccagcgcgaatgcgcctgtgaatccctttggacaaagcagaataaacagcctacatcggtaccaagtaaacctcctgctggcgctaacagtgggaggtttaaagctctcccccg

SEQ ID NO: 5827 - DNA, 694 bp, Aspergillus oryzae
ctatacatttattccggtccctaccgagtacattctttatttcacgtcactctttaccttcggggagaaagtctaccaacgatataaaacaaaaatccaacctttaatttcatattcgccgttctttggacagaaaatttaacaaataaacaaaatgcgtttctccgtcgctgctgttttcgccgctgtggccgctggtgttgtcgctgaggaagtgcgcactgttattgttaccgaaaccgccacttactgccctaagtccaccgatgccatcggtgtttctcccaccgagtctatcagcatccctgctggctacaccaccactcgtcctctcatcacctcgaccgtgactgagtgcaacaagtgctccagcaccgcccctcctgctggcactcccactggcgtcaaccctgttggcagctctacccccagctctcccgttattcccgtcgttccaagcgttcccggcgtccccagcagctccaaggctactcctagcagcagctccatcatcaagcgccccagcagcagcagcatcgtcatctcctccacccctctgtcctcgacccctctggctcaccccaccaagcctgcttccaccaacgctcctcctgctccttctgcttccggtccctctgatggtctcccccaccggcttcgctaccacccccgctgtccctctcttcactagcgg

SEQ ID NO: 5828 - DNA, 668 bp, Aspergillus oryzae
  misc_feature (1)...(668): n = A,T,C or G
gtcatcgtctgatcatctccacacccggttcactgtcaaaaatttgattaacggatctacttcaaacgtcaaaatgcgtgctactttcatcctcgctgccttcgctgctgtggccgctgcccagacttcttctgctgttgagagtccctccgatgtcgagaccaccggcgttgctgagactggcagtgccactgccactgccactgccactggcggcgctgagaccggctctactgtcattcccaccgtcacctctcagcccgtgatcccctctggaacggctactgaagcccctactacccccaccggcagcggtgccgagtcctccggtgctgtgaccggctccagctctgctggttcctctaccctcgttaccaagtccagcagcgctgcctccagcacctctgagggcgctgccgtccccatggccactgccggtcctctcggtctcattgccggtgctgccatcgctgctctcctgtaaatggacagctcgtgatccattaaacgcttggtcgattgacaatatcgctntcgttctcaagcattagtgtgctccccaagcggacttgtgctttatggaccttccccctccgactatcccagctaccggggatagcgggacgaaaagagatgatgcatacggatactgaagttcattttcatac

SEQ ID NO: 5829 - DNA, 618 bp, Aspergillus oryzae
gcgtcatatgcgggcgcagttaccacgctggagctcggcaggtccgacgcaggttatgagttgaagacgatctcagacacgaccgactgcggccccaatccttcttggctgatgctgaatgacgataagagccttctcttctgcctcgacgagggcctcaatggaccgaacggcacattaacttccttcgaagttggctccgatgggtcgctgtctaaagttcatcagttgcagactgtactcgggcccgttcaatcacacctttatactgcgggagatcgcacattctttgccgtggcccactactcagggtcatcggtgacagcatatgcccttgaccccagtggtgtctttacccgtcgccagaccttcacatataagctggacggtcctggtacggatcccgaccggcaggatgcaccacacccccacggtgtagtccttgaccccacaggtcaattcattctggttcctgatttatgagccgacctcgtacgcatcttccgcatcaacccttcatcggggttgttggagccgcagacacctttggctggtgtctccaggatctggccccagacacggtacattctggacgcccaaaggcgcacgtctcggctg

SEQ ID NO: 5830 - DNA, 672 bp, Aspergillus oryzae
ttccccatcttccccagctggtgccgtcgcgccggtgaggccgtcgaggacttcaagcagcacatgctcaacatgttcaatacagagaaaacgctcctcgaccagggcaaaccaggcaccggcacgctgatgtcgtccttcgttcgcgaatccaccgtcgatcccaagagcaataagactgttcttaccctcgacgaaatcctgggcaatatctacgtgatcaacttcgctggccacgatacaacagccggctcccttacctacgtcctattcttgcttgccgcctaccccaatatccaggaatggatcgcagaggagatccgcaccgtcttccccaaccccgaccgcgacacatgggattacaaggaagctttcccccgactaaagcggtgcctcgcagtagtcctcgaaaccgtccgtctctacccccccatcctggctttacccaaatccgtcgccccgcaatcaaccagcctccgcctcccagaaagcaaccgcaccatcgtcctccccaagggaaccgtcgtcctccccagcctcctcgccgctcaaacacacccgaaatactggcccgacgagcccaccacctggaatccccgtcgctggatcgaaacttctaacccaaccgacgccaccaccagcacaccggaagaccacctcgcaggcgaagaa

SEQ ID NO: 5831 - DNA, 1513 bp, Aspergillus oryzae
tagtttgtttggagacacctgtgcactggttgcattggtttagttgttttgttcaattcattctactataccttaataatcatctttctatacttgccccttcacctctttgatatcaaaaaaacaaaaatcatactcaaatccccctaacagacgagctgtgctctctaataccccaatttccattatccacgtcttgattttgacagttcaactttgtcgctggtcgacgtctccattcagcagctcacaaccttgctcagccttgttcattttatcgccgaggctttttactatctttttctaattttcgtgtcgtggactggatccgcgagcaatactgttggataccgcagtcaaccaaccaacaaaccaacacggacttgattgaatcggctctggtagtctttcgactcaagtcttatatcttctgcatcgaatactgtggaagagtgctttcatctttgacttcgacacgataacctatacattcaccgtgaatattattaatctttagtctaactacgtcaatcactcaaaatgtccgctgtgcaactcaagttcactcttcggacttcgtccaatgtcaagactgtccacctgcttggctcttgggacaactactcccgccagatccccctctccagggatgagggcaagcccggttcatgggttggcaagttccgcttccagacctccatgcttaagctcggcggccgctactggtactattacatcatggatggataccacgtctcccatgatcccgccgttgagtacaccattgagccaaccaccggccgcaagctgaacatcctcgatgttcccggaggtagcaagaaatccagctcttctgcccagaagcccagaaggacctccgatgaggtcgtgaagggccgtgctccgtccccgtcgaagatccatcatcccaagccctccaagccctacgcctcccgccaaatccgggagaccgacttcgctcctaccatggaggacctctccatgcgctttgcgggatcccgcctgtcagacgagtactccctttccaacagcccccccagctcagttggctcatccctgtcttctcggtcttctcggtcctctggcagcacctctccctcatcgctgtcttccatgagtgacccagctagcgtctgccgctgcgagcgctatggcatcactcggaagggcgaccgcgtcaagctcgactgcggtggtagtcgttgtggctatgtcaccgagtcgtctgaggctagctgctccgagtccgacagtgacgaggagtaccgccgggcccgccggggtgttcgtcgccagggtattgttgtgcgtcggtaaatcatgcacttcgtggaatcttttacttcgtcaattttacggagatgggttgaccccatccgtcaagcaatgtcaatcaacgtggcatgttacagccatgccatgatgctcggaacacagtctctccttaataggacttggaagagaacatttttatacacaaaaaaaagaaaag

SEQ ID NO: 5832 - DNA, 175 bp, Aspergillus oryzae
cgatgcatatcgtcgccgtataaccatggaggaccaccctcgacctcgagtacacaaggcatgcgacgcgtgcggacgaaggaaagttcgctgcaatggccagcaacgatgccagcaatgtgagcacatgggcctagtctgcacatacaccgataatcgactcgcgcgatcacgg

SEQ ID NO: 5833 - DNA, 651 bp, Aspergillus oryzae
  misc_feature (1)...(651): n = A,T,C or G
gacgatcagaaggatgggcgtccggaacccaaggatgacgcggaactgactgttaaccttgagtgtaaaatctgcatgagccaacttgttgatactgttctcattccttgtggacatgcgatcctctgtcgctggtgtgctgagcagcatgcgcggccggatcggtctcgaccaaaggcagcggtgctatgcccgctttgccgcactcctgtgaagcagaagctccgcatctatctctcctaatcccactactacaatggaggataccatgtgtggtggaatctacgatttacgaccgttatgtagtgcatctcgagcctctccttgctttcttgttcttctctgacttcgttcgcttattcttgtccattgtcccatattttggactaactggggcggtgatcgcattatttggagtacaggttccagcgaacgactatcaactattttggtcacatgatcttcgccagtgcagattggcactgagacaacaacttccataatgagacagactagtttacgggttccagaatggttcttagacactacccgtatctacggtagacatgttttgcaattgcatgaatatctcttgtttnnnnnnnnnnnnnnnnnnnnnnnnnnnnnnnnnnnnnnnnnnnnnnnnnnnnn

SEQ ID NO: 5834 - DNA, 681 bp, Aspergillus oryzae
  misc_feature (1)...(681): n = A,T,C or G
cctgcgcgccgacgccgagacccacgaaagatcttttttcccgactccgcctccgactctaattcatacaactctcccctccatcctacatccgggaacgccaacgttataataggcgccactcagagacttaatcaatcactggctcgatcagcgggtgtggctggcctaggctccccaactgctgcgcgaagctcagctcccgcaactcccgccggtggcaccgctcattttcaccaacgacaacgtgaatcatcagctggcgctgtggagaacaagcgacggcgtctaaacccttcactagggacgctaccagcagcatcgtcgaatctccgacaatcctctctaggtcccggcacacccaaaggaggtacaccagcttctagtcgtgctggcagtgccgggccacgctcatcaagcacaactaaaaaagccttgaccaagaaggttgcacctcatcaacaattgaaaaagatcaaggcatcatctggattgaatggcanatcaactaaacggtcttctagcgctagtggccgtatcaaacttactacaaagaaatcgccttccgccccgggcggcgatgaagacgaagatgattcgatgctcagtaacgccgatgtctcggactctgagaacaacaccgatggcccgcgcggaagatgatgaccatggaaaagaaga

SEQ ID NO: 5835 - DNA, 687 bp, Aspergillus oryzae
ccacggtatatccagcgtcctcatcccacccccaacaaccaaaacgctactcgacctagtccccacaaaattcagcaccttcgacctcgccatcctcaaaaccaacctcaccatacccgaaaacacaggcaaagacaccgggaaaggccacacgatctttgccccctccaacacagccttcagcaaactcggcctcaaaatcaacgcgttcctgttctcgccctatggccagaaatacctcctcgctcttctcaagtatcatattgttccggatcggacgctgtactcggatgtgatttacacggaggagggcgagatccggccgtttggggtcaaggggttcacgcatttggatctgccgacgttgttgggggataggaggttgagtgttgatgtggcgcggtttgggccgaatgcttcgttgaaggttaatgggtttcagcgggtggcggttgcggatgccttggggcgggatggaaatgtgcacattgtcgaacaggtcttgggtccgccgaaaaaagtggtggagggggcgaccgaatgcgaagagtggaacgaggagatgaaggtggaggggctgaacgaacaggttgcccccggggtgggtggagatcccgattaatatatgacaggggaatggagttgagggcccatgccttccaattgtgatcgggaggacgaccctcg

SEQ ID NO: 5836 - DNA, 724 bp, Aspergillus oryzae
  misc_feature (1)...(724): n = A,T,C or G
cacccttcacaccacaacaccatggacaccgatttgaacaagtacaattccaaatgggtcgagttccatattcgggaccacctgaaggacggcgagatctccgtgcggcacaccgtcatcgaggacggcgaattccaagaccccaacaatcgtagaaaatcgatccatgaagacgtgatcgacgagatcgtgatcccttccgacggcattggcgaaatctgtgcccacggacgtagaggcagtgaaggtcgtctggacctgttccatggcaacgacaagatttgcgaactgcattgggacgatcgtgatgggagacgcgagaacctggtcgagatgttggacgaaagtgacaaatacaggatcgagcatgggggatggagcccagaggccaacggacctctgggccatgtttacgttgacgtgtgggctaaggacaagagcaagtagtctctctcccctatacgtgataccgtagtcttttacgggtgtagtcctttttttcttttcattatgagtncaactttttttttttttttttttnttttttttttnntnnngggcgtctccatgttcacgcgaagatggtacatattttgatatcataccaagagaaacccactatattaggaacgaagctcgattgttccncccnnctanaanngttntattaacaaaacacttttattcccttgctgggtcccaaagttaagaaaataccgggcgg

SEQ ID NO: 5837 - DNA, 692 bp, Aspergillus oryzae
  misc_feature (1)...(692): n = A,T,C or G
gataccaaggggctctcgatgaactactatcttgggaccgcctagtgggcgcctatccatcgctagttagcacgcagacagaggccatcttgctctacgacatctgcgcagactttattgccaacgccaaccagatcgtcctgtttgaccgggcgcttctggccatcgatccagacatggcagtcgagatgcggaccttcacagatgagctttggaagctcgtgcaccggtcacgattagttgacaccacggaagtcactcgaatcctgcgccagtatagctccgcattcaagtcctacctgcagctgccacccgaggcgcgcccgaacgaaacgcctgtgatccgtactttgctagagacatatgccgagctaggaatccatgaggacgaccgtgccgccatgctggtcatgatttgctgggccggcgatgccaatgcctacaaagctgcgtactgggtccttgcatatattctgtacgacccccagctgcgggaaataatacgtcaggaaacagcacccgcggtcgggccagacggcaagctggactggccttatctcgctaagcgatgcccacgactctcgtcgatctatcacgaggtcctgcggttgaccaagcgcgatgtcattgttcgacaggtcgtccgtgacactgccctcgcggntaagcggntacggaaagacagcattgcn

SEQ ID NO: 5838 - DNA, 553 bp, Aspergillus oryzae
tgaaccacttattcacaattcccaagctaaacacccctccttctaaatctccttcccgttaatatccctcggttgatacgcaagactcgccctcgacaaagcaaccacagcgtcactcctcctcccctcaagccaatgctcaaacatatcaattcccgcaaaagcaggacccccagtccaaaacttgccatcgatcacccatcgagccgtctcccaagtagtctcgggacaatccttcttgacatattcaagaaactcccaattagttgtcgcacgtttaccacgaagcaagccggccttggcggccacaataccaccagtgcaggtggtgaaaaaacaatcgacctcgtcgaccttccggtgcaggaattcacggtaggagtctgggatgttgttccagaaatcggggccagggccgcctaggaggatagcgtcgagtttgggacattcggcgaaggtggtggttggttggattttgaagccgctcatcaggcatacagtgtccatttgtggggcgatgtattggaaagtgatgtccataccttgggcaacc

SEQ ID NO: 5839 - DNA, 564 bp, Aspergillus oryzae
  misc_feature (1)...(564): n = A,T,C or G
cccactacaccagaatatgcagcaatgagcaaatgaatactgaccttgtggctgagatcgagagtacggtgagaaggaagaaccccacttgttgggatatataggaagtgcttctgccacctttgctggaccctttttactatcatcaattcatacccttcaaactttcaaactactttattcactatggccggaaacttctacgagtccgctgaggctgtccgtcttgatgggcccgtcctctttgctcgccttcgcaatgttgacggcggatgggaggacgctgaaattgatttgaacgaattcattggtaacgttgacggccagtttgtgtgggacgaaccaaacttttttgagactgctgcggaagtcgagttcaatttcgaaggagatgacaacgtgcccatcctncgtgcccagctgcgggacanggagggacagtgggtgccagctgatatcaacttgggtgaaaggcttatcaacatcaatggtcacttcgagttccaatattaactggtctgactcctgatatctatatatgccttgaaataaccggggatgccc

SEQ ID NO: 5840 - DNA, 1185 bp, Aspergillus oryzae
ttgccgagactgagcaggtcatgttccaacctggccacatcgtccgtggtgttgacttcaccgaggatcctcttctccagggccgtctcttttcgtacctcgacacccagttgaaccgtcacggcggacccaacttcgagcagctgcccatcaatcagcctcgcgtgcctgtgcacaacaacaaccgcgatggagccggccagatgttcatccccctgaaccccaacgcctactctccgaacaccctcaacaagggctctcctaagcaggccaaccagactgtgggcaagggcttcttcacggctcctggacgcgagtctactggccgtttcacccgtgccgtcagcccgtccttcgaggacgtctggtcgcagccgcgtctgttctacaactcacttactcccgccgaacagcagttcgtcgtcgatgctattcgttttgagaactccaacgtcaagagctcggtcgtacgcaacaatgtcatcatccagctgaaccgcgtgtccaacgacctcgcccgccgcgtcgctcgcgctatcggcgttgaggagcctgaggctgacccgacctactaccacaacaacaagaccactgacgttggcactttcggacagaagctgaagaagctcgatggactgaaggttggcttcctggcttcggttgagacccctgcctccatcgaggcagcctctgagctcagcaagcagctttctgaggacggcgttgatgttgtcgtcgttgcggagcgtctgtccgatggcgttgatcagacttactccggatcggatgccatccagttcgatgctgtgatcgtcgcgcccggcgctgagggtcttttctctactttctccttcactgcgcctagcaatgccacctcctcgtccactctgttcccggccggccggcccctgcagattgtcatcgatggattccgtttcggaaagcctgttggtgccgtcggcagcgccgctactgcgctcaagaacgccggtatccagacttctcgcgacggtgtgtacgtcgacaagtcggtgactagtggattcgtcgatggtatcaaggacggtcttcgcactttcaagttccttgaccgtttcaagctggaccattaagccggcgtgtactattagcccagccgaggatttgtaaccatcggggcatcttttactcaacattggccgatct

SEQ ID NO: 5841 - DNA, 1216 bp, Aspergillus oryzae
  misc_feature (1)...(1216): n = A,T,C or G
ctctatttctcttccttcaagcgatgaaagatcagaacactactgctccccaagtagacatccagcaaccacagcggacaagcattgagcattccctctcccatacaaccactacttcctcatccaactcttcctcaagccttccagaaaggcccactacctcaactcaatctcaaacaaagtccaatcacctctccctgaaagcaggaagactcttcgtttcccgctctcgctctcggtccaaatcccccgctcctagcgacatcccaaccaccacacgcacgcgtcgctccgactcagagagcacctacatcctcaaacgcgacaaaatggctcgcatcagcattccccgtcgctctgagagccccacccaaatgtcccccccggcttccccttcttccatcaaggagacccactccacaaagcgcagatccgacgcctaccactcccgcaaatccagtgacgactaccgtcgctacagcggaaccgtgaaccactacggtcgtcactcgaacgactggttgttcggaggattcagtcttcgcgacactgtccgcggcggtgttggccgcttgcgccagcgcgatgacaagagctgaatgaagaagtggttccgtcaattctgacggattgtttctcatcttcttttcctctataccgctcttcggcttcggtatatatggttatatagccatgactgtcattatctaaggattatggcagcggctacgggctactctacccacctatttcggtctcggattgcctcttccacttccgagtgagattagatcattggtactgatcggaggtaatgtcttaccccagagggggtagactatcttgtcatcgagttcctgggatgtcttcagttccttatggaggatttgtgttcgccgttatgggaatatcctgcnaccctacctgcctgtcaggtttcctttgctgtcattgaatgagcgggtgttgtatccggttatgcaagcatcctaaggatggagcatctgttttcttcattttctcggttgtaccgagacataccttgtttatgagctatgttgccatgaccttttgcgacttgcgagccaaattgccgatgttttcctttttgttaattgaccgaagtgggctttaaccctgttcagccctcttgggtactgagttataaccactaatcacaatatgattgaacgggaagaaatgcccttctctcatg

SEQ ID NO: 5842 - DNA, 687 bp, Aspergillus oryzae
  misc_feature (1)...(687): n = A,T,C or G
gcagcttcctcctagagatcgtcgacgaataaaagcaattcctgagcatgactccgttgaaactacacctaatgagttagaggaatatcatctggcgaaacaaataaagctgcccagccaagtaccggcaagtgcaggcggtctgaataaaacaaattgggagttggagattcgaaaacgctatgcgcaacctctggcgtcagagactggtgagttcccagatgcggaatctattcatgctcgcatgatccctatatgctacgaagagtcaattgtcagtggcgcgggactaccctgcgctgagttcatggccattgccacggaaacttttgtgaaggaagttttatctgtcgtattctcccgtacgaggtctaacggaccatctggcactatcaatggtatgatgatgcgcaagtatcgtcagcagcttgaaagggaagaattggctttcacacgcggggagattgtgaaagatggcgcaacgggtttgttacctgtcgaggccaaagaagcaagtattagaaagcccctcggggtcagagacctccgtttggctttagagcttggtgggggagttctcagtcatatgccactgattgtggatcaaataatgggcggttaccttgaggatgagcttgaaacggacaaagcagaccgagctgacgatgtggcggatatttccaangn

SEQ ID NO: 5843 - DNA, 674 bp, Aspergillus oryzae
  misc_feature (1)...(674): n = A,T,C or G
cccacgcattaggcgcacatgaatcttggtaatgtcaagcaggggggcccgattacaaagtttcagaaagaagtgcccgaaacgtccgaaaatagccaacttggagagcttgttctaaggtggctcaaggaagatctcaaggccagaggtcctagaaatgggcggcatggccaagccaagacctacgagtcgtttgatgggagggggggatatggatttgaaaaacggaattgaatcaattcctctaatcctgtcagtcactcttcctagttttgaacctccctcctaccctccctattcctctcttcttcgccggncttggttttctttctttctttctttctttctttctttctttctttctttctttccttctttccttctatccttctttccttctttccttctttccttctttccttctttccttctttccttctttccttatttccttccttgataatgaattcattcatctttgtggctcattcaacaatatttacttttaccatggcatggcatgcaagaaaagggcctcactgcattggaatatgaggatcaactcccagggatatattcaacattcgataattccttcaacatgcatagacctcgccgatgatctttgtcttgcggtcgcatatatggcatatttcatctcatgaaaccatatn

SEQ ID NO: 5844 - DNA, 590 bp, Aspergillus oryzae
tggagcgttattagtgggccagctgcccaccaccacacaccccagcagtccctaatatctgctgaatcgctacacctccgcattctacatcgcctcggatcatcaatccctcacaatggccgccatcgcccccatcaccggcatgctccgccggaacctcgtcctggacctgagcaccgctttcggtttcggtactaccttcggctacctctggtggtacggctaccacctcccccgcgtccgcgcccgtgacaactactacgtccgtctggagcaggagcgcgctgctgcccaggagtaaatcttcgaatcatgacccatgcatgaacctcgctcgactggatttgtcaaggataacccgatgatgcttgtttcgtttcggtccgctttcgctatagatgtctagaaggaatgggactggtgttgttggttcattagttgggttggggacatgttatgggagtgagtcagtgaggttgaattaaatgtgaagtatttgatttgaggcttgcagttactacgggttagttgtttgaatagggttgtatatattaaaaccaacacacggcagtaaccaaaataaaattcct

SEQ ID NO: 5845 - DNA, 964 bp, Aspergillus oryzae
ccttcagtccaatcgcagtcgatctgcctgttgtcggacgtattttctccattcatttcatttactcggtcggatagcttcccggagaagtcgttttctcgatcgaacgcagttgacctgtgaaaacacctctcgcaaaccacctacaagaccaatcaatcgtccccaaccaaacatcatgcggtcttccttgctgatgggcgctctttgcgcggccggtgccatggccaaccctctcgacaagcgggcctacactacagactggacggtcgtcacggtgaccactaccatcaccgcacctgtgccccctgctgctaccgcttcctcttccacctacgttcccgtccaggaaccccgtcgcgagtgtggagcctgcaccggcaccggttgaacagagctcgtccgccgtctttgttgaagtcccggctacttcttccgctcctgcgcctgcagagcccaccgccgaggtgcagccaacaaccgctgctgctgcggccgatcaaggatctgcctggacctctgcttggacctccgcgtggacctcgtcctggacctcttctgctgcccagcccaccactctggctagcaccacctccagtgccagcggcgctactgccacgaatgcttaccagtcaaccgtcttgtacaaccacaatgttcaccgcagcaaccactccgccagctctcttgagtgggatgcctctttggaagctagcgcccagaccctcgccgccagatgcgtctaccagcatgacacgtaagagtacccctgctttttcttaggtgttaaatgtactaacagtttctctagcaccattaatggcggtgggtatggccagaacattggatatggtgtctcctcggaaaagattggagagatgatcaccaacctgatgtacaacaacgagatgggctacttcgaggccctgtatggcgaggctaaccccagcatggacaacttcga

SEQ ID NO: 5846 - DNA, 632 bp, Aspergillus oryzae
  misc_feature (1)...(632): n = A,T,C or G
gcatgctgcgccctgggggctacatggagatgagtctactcgatctcgacatggtgaacatgggaattcgcacccgaaaggctgtcagaaatctcaaggagaggacctacctaacagactccagtatcagcctcaagccttcaagcgacagcatacaacgcctcctgggacgacacgggttcgacaacctacgacgctgtatggtacggattccagtcgcaggggtgatcgtaagatcatcagcctcatcctcatccacatcatcctcgaatccttccacattagcggtgacagccacctcctcaaccgcactgtcacacccctccaactcatcgataggcgcccaggcaaaagcccatagcaaaacatcctccaacgacaccgacctatccctcggagatctcctttcagacccgttcccttccccttccaacgacgaatcaatccggaaaatcgtcgccagagtcggtcgttggtggtacacaagatgctacgagatacccgtcctggcgaacggtgacgcangcctcagcatctggtccgataagaaagtactccgcgaatgccagaagcgaggcacacgggttcgcctcttgatcgcatatgcacagaagccgagcgagaaacgcaga

SEQ ID NO: 5847 - DNA, 673 bp, Aspergillus oryzae
gaaccgaagacatcgccttcggaactaaattctgcacttccaacttaaccaaagaaaaaaaaaatgacaaccccggagccccagccaaagacatccgtcgccacagaaaaagtacacctcccacgcatcacgatcaaatactgcacacaatgtaaatggatgttgagggctgcttatttcgcccaagagctcctctcaacattcagcaccgatctaggcgaggtagcgctcatcccggctacggggggaatcttcacagtaacgatatatcattcctcgtcggaagtggtggagacgcaagagacgatcttgtgggatcggaagacgaatggggggtttcctgaggtcaaggtgctcaagtcgttggtgaggaatgtgattgatccgtcgagggatttggggcatacggatcgggcgttgaaggctggtaatgtgtctgtgaaggaggggggtgctgctaaggtgagttcgagtgaaggaaaggggggtgagaaagtagatggggagaaaaaagagtgtgaggattgtcggtgatggggtgaaagggtgggtattggatagaagctaaaggaatctgtttgtgaacgctgttattaggtgggactgcgtgggaaaattttggttcccatgggatgattttcctggtaattttaaaactgtctaaattgctatt

SEQ ID NO: 5848 - DNA, 644 bp, Aspergillus oryzae
  misc_feature (1)...(644): n = A,T,C or G
cgacaaccaattcactcgctcaatcaaaacgaacccacatcaatcaaaccgaaacaagctccagccagaaatatcaacaccacaaccaccaaaaagaacccaaaaatgtccaccccggacccccaattacaacctgaagaccaatccctccaacaagaacaaccaacattacaaaaccgactcccagtccacacccaccactgccgcttctgcaaccacctcctcctcgcaacaacccgcgacatcccctccctcccacgccngaaacaccccgccaaagacaaagccatcatctgccccctcccaacatcaaatacctccgaggacaccgactcctctaacctacaggaacactacaccatcctcctttcgacaacgataccggatcgcaaggcgacgctcgtgcggcgcgaggacggcttcnagaagagatngtttctgcngtgtggacggtgtcgggttgtggtggggtatttcttggaccggtgctttttccaatgaactctgttgctgcttctgcttccggggtgatggggaaggccaagangaccanagganganaangtcttttatttctcccggggccttaaagaaaccggggtcatgggggattaaggaggttaaaggggttataaaaatggagg

SEQ ID NO: 5849 - DNA, 822 bp, Aspergillus oryzae
  misc_feature (1)...(822): n = A,T,C or G
cacccccaagcttcaaccattggtgacgaaggccgagggcaagaacctcatccaggcctgtctcaatgcccccgatcccaccaccaatgagaacggtgtcgaggccggtgatgtgccaacagaggcgccagaggatgtcgccgccgcccacaacaatgtcaatgcccagcagcagaacattcctcgccctgcgggcatgcacccaggctacatgaccaacgaacagcagcagcagatggcctactaccaaaatcttcagcagcaacagcaagctggtgggcagtaccccggaatgcctgtgggcaaccggatgccgccccagcatcaacccactgcataaacggtggtccttgcttctgcgtaatatgtcttcagaagccgcggaatccagatgtttgttgtttcgcgtcttcgttaacttcaacatgtgcacctccgcaccatcggccttcctttgatacccagcgaaatctgaattctcttgccccgcaattgacgctctaaatgcggtttccgtcgtataccagcaacataacatgaacaccaaaggtgccttaacttgtaacctgtgtatatcatgagccgttgattcaacgttgaggagtctgcggcaccgttcttgtgctggcaagattccgattctctttattccgaggtcatacaaaactaaggcttaaaaatgaaaagacaaaaaaaaattcgggaaaaaaagttcaactgacgatgaaacacgnaagatgcnaagcgctggttctggggtccgaagctattaaatggtttcttcacgttcatctaattatctgctagacgacaagtggaagt

SEQ ID NO: 5850 - DNA, 669 bp, Aspergillus oryzae
  misc_feature (1)...(669): n = A,T,C or G
ggagctccggttgaagatggtggcatccctcgccgcatcgaagccggtcccgatcagggttacgacgaccgtgatgcgaagccgtggcagcgtgggccaccgcccagtgatgtggctccttggcagcagagaggccgagacaaccgctcccgtgacgactatggatcgcgtgaccagggaagcgcacccccatgggctcagagcagccgtggaggcgattatggatatggctcgcagggcggctacggagcccctggagctgcaccctggcagcagcagcagcaagcccctccgccccctccgggtggacaggctgcgtatggctatggcgcttatggtggatacgctcctcctgttcctggcatgggcgcaccgggggcttcttcctctagcatgggagttcctcctcctccaccgggcatgccacctatgtactacggctctggtggcagnccaccaccggcacccccttcttctgntgaaggaangncnnngaaanaannctacaacgagggctgaccaagcgtgaccttttgccttgagttgaatggggcatgctggcaaaatccttggctttcctttctttggatactatgggaggctacttggaagggggtaggattgggtgggtgctaataaccagaatggcccttttttacttgagggtcc

SEQ ID NO: 5851 - DNA, 632 bp, Aspergillus oryzae
  misc_feature (1)...(632): n = A,T,C or G
gatttcttgcatccttagggtgtcatgacttgggcctgatgcgcgatacactggggcatcccgatgccgtttccaacattacagtgaatgaaccattctactcggccgtgttctattacaatggcagcgttagtcggggtcaccatccgtttactttgatatacgaaacaggaaccgattccgttcctcgatgtgacgcacacctagctctctatggtaataccaagaccgtgagcatgcattatgatttaccttacgcccaaggcaagccatcacgggtggttgtggaaacagcggatggcaaggggaatctgaaaagaacggagagtgttagtagctgggaggatgcgtttaacgccgagcttaaggcgttgcatgcgtacttggttgagggaaagcctgcccggacaacagcaaaagactccctccaggatctcaaattgtttcaaacgatttttgagcagtatgatcgacagtgcgggaccattagaaccccccttggctaaattggcgacgtacctgtgcctggtcgagcaagtctgctattggatttgcgggggggctattttattcttggtattgggcatggtcttctacttgtggntgacatgaatattancgtgaaaggcggn

SEQ ID NO: 5852 - DNA, 644 bp, Aspergillus oryzae
cagcgaggcggacgaggtatgtgaagaaaactatggagaagcataagctgctcgacacggctggtaccgttgatcaatatgatgatgaaattgacgacgaggaggacgattcaaatgagttcctgtctcaccggcgctccgccaaaagtactgtgaaagccgggagaggcagctcaagtacttctgcccgtgctaccctaggaaacagcgctgttaccaagcgtccaaccgcctcgaagcggcgaaataaccgtgatcgttacccccaatcctggggttgccccaggagcagcatcaacctaaaaaggcgcgttctgtgtgtgttcgatggccaacgcaatctgtggaaggatgaaatgctgcttcaaaacgaccttgaagtccgtataaagcttcctggtggcgctggcgatggcactaatcgagaggcatatgtgaccgatctggacgtcgagacgctaaagcgcgcggaaggcatcctgaacgctactgaggaagaacggggtccttggctagatggaccctctacgaagatgattgggtcaccggccatgccgttgcccagcctgtctcgtccttatgaaagagaggtagatattgatgagtttgtgtcttaagagactccaatttcgcaagttcgggtc

SEQ ID NO: 5853 - DNA, 1028 bp, Aspergillus oryzae
cctctctcattcctctcggtgcccccgatcctcaatccaacttgtacatacttctcccaactctctgctatatccttcatattcccatactacaagatgtccgcagtaaaagcagcccgctacggcaaggacaatgtccgcgtctacaaggttcacaaggacgagaagaccggtgtccagacggtgtacgagatgaccgtctgtgtgcttctggagggtgagattgagacctcttacaccaaggccgacaacagcgtcattgtcgcaaccgactccattaagaacaccatttacatcaccgccaagcagaaccccgttactcctcccgagctgttcggctccatcctgggcacacacttcattgagaagtacaaccacatccatgccgctcacgtcaacattgtctgccaccgctggacccggatggacattgacggcaagccacaccctcactccttcatccgcgacagcgaggagaagcggaatgtgcaggtggacgtggtcgagggcaagggcatcgatatcaagtcgtctctgtccggcctgaccgtgctgaagagcaccaactcgcagttctggggcttcctgcgtgacgagtacaccacacttaaggagacctgggaccgtatcctgagcaccgacgtcgatggccacttggcagtggaagaatttcagtggactccaggaggtccgctcgcacgtgcctaagttcgatgctacctgagccactgctcgcgaggtcactctgaagactcttgctgaagataacagtgccagcgtgcatgccactatgtacaagatggcagagcacatcctggcgcgccagcagctgatcgagactgtcgagtactcgttgcctaacgagcactatttcgatatcgacctgagctggcacaaaggcctgcaaaacaccggcaagaacgccgaggtcttctctcctcagtcggaccccaacggtctgatcaagtgtaccgactgccggtactctctgaagactaaattgaagacaacatgattctcacgttccg

SEQ ID NO: 5854 - DNA, 578 bp, Aspergillus oryzae
  misc_feature (1)...(578): n = A,T,C or G
atacggctcggttccattctgcgcgaggcgaccagagtcttgcgaccaagatatgcagagcgctactatcgcctgatatctgctgtccgtgagcaccttcttccccttggtgtaacgcttccatccacctcgttagaggctgtgggagggtattttgtctggatccaactacccccaccactacaggcggatgatcttgcgaccgtagcgcttcgagagtataaggtgaatgttattgctggtaatagattccgtgttcaaggcgaccccgacactagaaggaacagttttaaccgaagcatacgtctttgtttcgcctgggaacatgaggagaagttagcggaaggggtgcgccgacttgcatgcgctatacgctccgcattgaaataaactcttcgtcataaaatcacaacgtattgcgagggacagatttcaagaaattccaggtcgcaacaaccaagggtgggcggcggatcgatccgctccggtccttgngcagacatttcttgggtttttgatgtggttgcgtancggtcattggtgcaangaaggggggttctgccaattagcaagtgagn

SEQ ID NO: 5855 - DNA, 700 bp, Aspergillus oryzae
  misc_feature (1)...(700): n = A,T,C or G
gggaaacagcctaccctttcatcgcattatatatttccacattccccgccgaaggcctagcagcgcttcacgcgcgcggaattcgcacccaagccgtccccagcgtacaaccaggccaaagcagagtcttcctccaggatccacgcttcaatgaaacatggaacaaactgattgtattctcgctggtggagtacgaccgcatcgtcttactagacggagatatgctggtgcgaaagaacatggatgagctgatggacgtgccactggacgggccgggttcaggattaagcagcgaggagaataaacaggagagagtattcgcagcgagtcatgtatgcgcctgtaatccgctgaacaagccgcattatcccaagacttggatacccaagaattgtgcctacacaagccagcattcggatcctgtccgggcgcagacatccggcgctccagccgcgaccggtgtgccatgctgaatagtggcctcttagtcgtgcgttctaccatatcggcctgggcggagatccangctagacttcacatgcccgatcgcacggataaatacactttnccggatcaagagctctngtcngacgtgtttcggggtcnatgggtggtattgccgtatgtgtataatgcgcctaaaacgctcngtgggagggagtgcacgacaatatctggaaaaataccaagtgaaaatggn

SEQ ID NO: 5856 - DNA, 246 bp, Aspergillus oryzae
gataacgtttatgttgtgacttgtacgttgaaccaaacaatatcatcacaatgacaatcccagatatcccaacacgccaacgagccgccgttcgtcggggcacaggcgagtccgccacaacaaccatcgagaacattgacgtcccgcagcccggtccgggccagatcctggtaaagatcaactggactggactttgtggctcagacaagtctctcctgcatgatgattggaaggatttcggggtga

SEQ ID NO: 5857 - DNA, 663 bp, Aspergillus oryzae
cgctcttcgtgaccaggtctgataacaagacccgagagaagccgactcatcacaggagtcgcccacaccctcatcgcgtcccccgttcatcggccagaatgcgatcagatagttctaccttctactcacccgtggtgtcttcgtccatgtctcccgctgcccgtccttcctcacctcaaccaccccgttcccggtcgcagaatcccaccaaatccgttccagccttccatctcagcaatctgccacgatttcatcccgcggtctactcagcggcgggttctcagggacaaccgacatccccacgtcaaccgcggccatctgcctaccgcaccacctcgggctctcgggacgcgatgtggcagtatcaggaactcgtcgagggtgtcaccttgtcgaagacaccctcccggccactctcgcccagtccgtctgctcctcgcttggaccctctccgcagtcctgggcccgtcacccccctcgccctggaggaggccagtggctacctgatctcggggacgtccaatgcttccgcttttgcttcccgggacgccccatccggtccggcccccgacttgatcgaccggctgatcgtccgcgagaccgagcgagcccgtcagaatgccaagaaaggcactaagactagatattgacgttcgccgtccg

SEQ ID NO: 5858 - DNA, 698 bp, Aspergillus oryzae
ctcgcgtgacgtctgcccctacttcctctatttgccgctgaactcgtggcctagtgttacggggagagtggcgttggtgattgggtgtggggtttcgggcacggttgatgggccggagaggtattcgtggagatctggggtaggttagatagttgtttctctttttcatagggtatgatgaaaaaggttaggagtctgtgtaatgggattgtggaacgtaccgcttccgcaaattccaacgaaagaaggtcggatctgggttgttgttagtttctggggatggttctggctatgcgttgagcttgtggtttgtgattttgcacctttacttggccattttgacagacgggttcttcgatctggtcgatgcggatgtctccacttccgtggaagccaactgcgtgcattgtagattattgcgtgttgatattgaggagggttgatgatatatattgtatttgtgtattgcttggtgacttgatacctatatatcatttttaggttatgttacgtggtataggaactggtggttgtgtcctcattatttggatttttcaggatctgaaggctctatttcatttttatattgtttatgtatatttttgtgcttattatggaatctattattatgaagatttatatggatgtgtatctttaacatttttatcattattactttattgattctgatgttcccg

SEQ ID NO: 5859 - DNA, 646 bp, Aspergillus oryzae
  misc_feature (1)...(646): n = A,T,C or G
gctccatccttcccctcctctctgcccccctcctcaagagctcctttataggtcgcctcgatcccctgatcctactcaggccgcattgcctgtatccttactctatccgcgcccccgtggtttatcactattcttgtctatcccgagtggcaacggttcggatcatgattgtttagcttggatcacttgttttgatttatcgactctgttgaccaggccacgattatcttgcaattgcaggacatttctatcttagagacgcccgacttactgctcacccccctatcgattgtttagtgttcatattgctgttagagatttgttttggtgacgcattgttgcattcaaaatggctggaaacatgggtgattacggccaaattattgagtatatccaagatcgtctttatttggcttcttatgacgacgcaccggatgcgagaactccattcccttatccttccgagcaacctaagtctccaagcaagcgctctgcgagagcccagccgaacacccncagtaggaagaggcgaagccccgtgtatttcacggtcgatgataccttgctttacaactctttccatgcagacttcggtccactccacataggtcatctgtaccggttgcggtccattttcatgaaattt

SEQ ID NO: 5860 - DNA, 671 bp, Aspergillus oryzae
ctgggttttcctccactttttatacggatatcttctccgagattgcccaggagttcccccggaacagtcacgaatggcaatctcttcgacccacggtcgacggcatggaactgttccccagcgttgacggcgatggaagcgacggcaacgactacaacgactaccgcaaccacctcgtctcgctgggtccatccttcctctacaaagtcctccgtcaaccatcctacgaggcacgccgcaacctcatcgcctgtaatgccgtctcctccaaatcctcctttatgatcctcgtccaggtctcccgggaccccccatccctcctctacccagccgacaagtacgaaagcgaagacatcggcagaactctcccgctcatgccggccatcgagcaacccaacagcggctggaagcaccactggcacggctacgggcccatccaccgcgtccgggaagtcgtccgcagcgacaacctccaggaaccctggatcgagcggacgatcggaaactccgctggatggcaatgggggtacgcgatctgggacgaggaacgaaatgcggccggtcaccgcctttaattcccattctccaaaaaaagtatcatctcttagaaatgggaaagaaaagaaaaagaatgcatcatccgtgaatcgaacaccggcctcatcgatggg

SEQ ID NO: 5861 - DNA, 781 bp, Aspergillus oryzae
  misc_feature (1)...(781): n = A,T,C or G
ctttttcccgaagccatccaattcttcataggatccatccttctttacaaccacctacatcagttaccttggtctgactcagtcgcttttcctcgaggtcaccggtatcgcgagagggtcgggcgtgtatcaagtttggtcctttaccaacgtgatctttgcctgtatgggtagctcaaactctctgtttctgtatccccatgtccgtgttccgatcaaaagctgggcgtacttcttcctgagtgttaactttttgtgtgtgctgtggggatgtatcgggatcagcaaccacgtcacgatcgggtacaagcatgccgcggagttctgggtggaacaggtgctcttcatgagtacgagtagtgccctgcgatcctataacaggacggtatttgcgtcgctcatcccctgtggatccgaagcacagttctttggtatggaaattacgttggatcttgccactggatggattaatcccctcgtgcagggcgtgattcaagatcatacgcataatctaaggttccccatgattcctaacgtattgcttatttttgtggcgggcttactgtacgtctgggtggacattccgaaggggattgaggatgcgaaggtgccgttgagcgaggctaaaggaggcaactaatgggatacccagggaattctgtcctacgagcgtcttgtgagacagaaagtcgattattttgtcgttgattggaatgaaaggatcttctcctctaaannannnnnnnnnnnnnnnnnnnnnnnnnnnnnnnnnnnntttcct

SEQ ID NO: 5862 - DNA, 1094 bp, Aspergillus oryzae
gtgactttgcgcaatcatggcgtcgaaccagtttatcgtcgcgtctccaccgaccgatgccatttccgccttgaagttctctcccgaccctaattccacacgaattgttgtatcctcctgggacaagaatgtgtacctttacgagctgcgcgatgaaaatgggaatgtaggagaaggcaaactgttacagaaattcgagcaccgtgctccagtacttgatgtgtgtttcggcgcaactgaggacgagatctacacggccggcttggattgggacgttaggaagatcgacatagcaacatcaacccagaccgtgcttagcagccatgaagcaggagttcgaagcgtcgtttacagcaaggaacaccaactggtgatatcggcatcttgggactccacattacacgtacatcgcatcgatgccccagactctataccgtcgatcattcctctcccttccaagcccttctccgtgtctctcactgctacgaagctagtcgtcgcaatggcttcacgcgcgttgcatatctatgatctgaaggcgctgtctctcctcacagctcagttggatggtaccgttccgaacaaggttgaggtccagccgtggcagcggagaaaaagcagtcttaagtttatgacacggtgcgtaacatgcatgcctgacgatgcgggttacgctttttcgagcattgagggtcgagtcgctgtcaaatggtttgatccttcccctgaatcgcaagcgcgaaaatacgctttcaagtgccatcgccagacggctgatgatgtcaatgtggtataccccgtgaccacccttgccttcacccggtacatggaacctttgcatttggaggtggtgacggtgtggttgctctttgggatggcatggaaaaaagaaaaatcgggctgtcttaaaaatccccattttatggttcctgccgggattttaatgggaaggggaaaatatctccaaattgttgacaccccagggtttaaaaaggaaaaaaaaactttgtgaggggacaacaaaattttgtgcgagacttggaaaaacaaaggcaggggaaggggcgataaaaaaaccccgactttctcataat

SEQ ID NO: 5863 - DNA, 693 bp, Aspergillus oryzae
  misc_feature (1)...(693): n = A,T,C or G
tgcggctataccttcctctggaaccttctcgactacacagctggtgtgctccccgtctcccacgtcgacgctaagcgggacgcactcacagcaccctacaagaagatcctcaagggcctgggcgccaacaatgccattgcacagggcgcctggaagcactacgacgcggcaaagatggccggactccccacagcagtgcaggtcgtcggcagaagatggcaggaggagaaggtgctcggatacatggaagcagtggagaaggcactggaacagtaccgggatccggcgaccggggagagcggcaagtatactttgattgaacttgactaattaggttcggtgaggttacattgaatggttctaggatttttgagtcaagctttcgggtttgacaggttcggtcgtaccgagggtgtcagtgcttttgccgcctatcacttatagtataagtgctggtgacatcattntctcgcccgatagaacataattaggaaagagtctagacgaatgccgctcaatacatgggaaactntattgatacaccattatgtgtcanttaattgggtgggcgtctccatttcatgggtggctctctaatgaaccataaatacctggcagacacgtaccaatancctatttttttgtgattaacatttcataactactttaactatgtaccctgctctatgaata

SEQ ID NO: 5864 - DNA, 1045 bp, Aspergillus oryzae
gaccgaccctgactgactaaggcgctttgcctccgttgcctctcccctcatctctcctgtccacctacttaaactgctctttctccttctcgccttctaacttcttcatcctccatcatcctctcagtcactgcggctgttgtccacctacctttctcccaacgtctccctaaaaatactccttactaccttctatacaactgaaatactttcaccgtcgtcatcatgcagatcttcgtcaagactcttaccggcaagaccatcactttggaggtcgagtcgagcgacactatcgacaacgtcaagagcaagattcaggataaggaaggcattcctcctgaccagcagcgcctgatcttcgctggcaagcagcttgaggatggccgtaccctctctgactataacatccagaaggagtccaccctccaccttgttcttcgtctccgtggtggaatgcagatcttcgtgaagaccctcactggaaagactatcacccttgaggttgagtcaagcgataccatcgacaacgttaagagcaaaatccaggacaaagaaggcattccccccgaccagcagcgtttgatcttcgctggtaagcagctcgaggacggtcgtactctgtcggactacaacattcagaaggaatctactctccacttggtcctgcgcttgcgtggtggtatgcagattttcgtcaagactctcaccggaaagacaattacgctggaggttgaatcatccgacacgatcgataatgtgaagtcaaagattcaagataaagagggaattcctcctgaccagcagcgtctcattttcgccggcaagcagctcgaagatggccgcactttgtccgattacaacatccagaaagagtctacattgcacttggtcctccgtcttcgtggtggtatgcagatcttcgttaagacgctcactggcaagactatcactttggaagttgaaagctcggacactatcgacaacgtcaagtcaaagatccaagacaaggagggtattcccccagaccagcaacgtcttatctttg

SEQ ID NO: 5865 - DNA, 1275 bp, Aspergillus oryzae
  misc_feature (1)...(1275): n = A,T,C or G
gttgctctccccattcgctttttcttgccccacgaaacaccgatccggacgcaattcggtggtctcatcttaattcagagctgaagagagaccatgcagaagtgccgggccgtcaattccgccttgggctcgagggcatttgcccccgcccccaaggtccaacaagttcagcgccggaatctccaagatgtcgcgatcactagaaccggaaagccgatcctgaaggtccagggtggacggtcgtctcttggaggtcacaccgccactgtcttcggtgctactggtttcctcggtcgttacattgtcaacaggctcgcttcgcagggatgcacggtcgttgttccctaccgtgaggagatgaccaagagacatctgaaggtcactggtgatctcggaagggtcaacttcctggaatatgacctgcgcaacacccagtcgatcgaggagagtgtccgtcattccgatattgtttacaaccttgtcggtcgccagtatcctactaagaacttttcctataccgacgtacacgtcgacggtacagagcgcatcgttgaggctgtcgccaagtatgatgttgaccgatacatccacgtctcttcctacaacgccagcagggactctccttccgagttcttcgccactaaggcctggggagaggaagttgcccgttccatttaccccgagaccaccattgtccgccctgctcccatgttcggtttcgaggataacctgctccacaagcttgctaaggttaccaacctccttacctccaaccacatgcaggagcgctactggcccgttcacgcccccgatgttggcaatgctctggagcgtatgcttcacgatgactccactgctggtcagactttcgagctttacggtcccaaggaatactctactgccgagattgccgagctggttgaccgtgaaatcgtcaagcaccgccgtcacatcaacgttcccaagccgatcttgaagcctgtggcccactacctaaacaagctgctctggtggcccattatctcgcctgacgaggttgagcgggagttcattgaccaggtgatcgaccccaatgctaagaccttcaaggacttgggcattgaacctgtngatctggccacccttactttccactacctgttgggttaccgtagcgcttcgtactacgatctgccttcggccacggagcgggagagacaggaggagaagaagtatctgcacgtcttggacgaccagtaatctgtggttctttactgtacataagctagacatcca

SEQ ID NO: 5866 - DNA, 643 bp, Aspergillus oryzae
  misc_feature (1)...(643): n = A,T,C or G
gattttttgacaatcagtttgtcctgtatgttctatgtgtggtacctgagacaccgtgcctggatcatcatcatctgatctccgccatctgattggccatccactttagcttcaattttggctctcttcagcagtttttgtttattccccggactttcatcattttcaaccccgtccgcgtcttgccgcctttgtttccccttgttcctcccctccttcaatcctctcagcggcatgtccaaggcaactttcgccgcaatcgccgcggctagcgcagccaccggagctggtcttacagcgctgctctattcctcttcctcccctcggccccaacagcaacaacaacaacagcagcagcagcagaagctacctccatcagcaccagttacctcgaccactcctgtcccgacccacccgacagccccgtcactcgccgccaaatacctcgccggaccagtcgacccgtccggtatctaccagtatggctttcccggccccgtcgctgataccctgctctcaactnctcttgccggcgcatacgaacgtcgcacgcgcaattccgccttggtaggcgaacacatacaccggcttcgcttgcgatgaagaacgcagaccgcaaacacaggaccttttacgaagacac

SEQ ID NO: 5867 - DNA, 673 bp, Aspergillus oryzae
tgacggagtggaatggcatccgaaactcttccgtcgggttcagggaggccctggtggcgccgacgaaggcgaggaggatcttgactggatcatcaacgcacagattgacgcgcacaaccccgaattggccaccaagcagattttatccattgccccgatcttagaaggtcagaccgagtcctctcaataccaaatcccacctcacaaagaggggcgtgaggcggctccacctgaccacaacggcgctgccccgagcgcagctcagcccgcctcctccggaggtgaaaagctcgaagaggtgcagcgcaaagacacgcgaacatcggacgttgacaccttcgtggacgccaaaccttgatcgtattcccatggggatacgtgtgactcacatctcggtggtttagtatctaacgaccgcatctcggaccaaatacaggtctcggagggtcaatgagatgaattaaaaaaagagaagatcgagaagcaaaaaagaaagggtagcgcaacccggagttacaaacgtggttagcctgcggtgacggagcaaatgaagggacgtgactgactgacttagccgtacatcagaaggtactggcggaccctacgactccaggcccttgtcgatcaaaaccaggtttacgaccgatatgccctaccggacctctaatggata

SEQ ID NO: 5868 - DNA, 691 bp, Aspergillus oryzae
gcaccaccagcaaaacctctcctactggtttcattaccagcactaccagcagtactaccggcagcaccactgactccaccgaatccaccactggtaccaccaccggcactaccaccggctcttcctcctcggaaactggctctggctccaccactgctgagtccagctcgagcaccggtgcatccacgactgagtcttctgctcccgggtcttcttccggcgctggatcttctactggcgcgggatcttctactggcgcgggatcttctactggtgctggatcttctcctggcgcgggatctgcctctggctcggcttctagctcggccgctggtgctacatccaccgttcctctctccaactccgctacaacaccttacggtggatctttcatgggcctcatgacggtcatgggcttgatgaccgccatgttgcagctgtgattggatcagtttttgtttttgtttttgttttactgacctaatgaccccatggcggattttgtaatggatgggatttatgacgcttttgggagaccacgctcctttttatgacctgctgattcatgtatcgttaattgtagccttaggtacatacataccacacacacactaactataggaagaagaatctttactagcttatatttaagctcgggtggattcaaacaataccaattcaaattcttacc

SEQ ID NO: 5869 - DNA, 1370 bp, Aspergillus oryzae
tctgtcttatcgtcatctcccatagctcgtcaaaatgcctatcaccaagatccacgcccgctctgtttacgactcccgcggtaaccctaccgttgaggtggacgttgtcaccgagactggtttgcaccgcgctatcgttccctctggtgcttccactggtcagcacgaggcccacgagctccgtgacggtgacaagacccactggggtggaaagggtgttctcaaggctgtcgagaacgtcaataagaccattgcccccgccgtcatcgaggagaaccttgatgtcaaggaccagtccaaggtcgatgagttcctcaaaaagcttgatggatctgctaacaagtctaacctcggtgctaacgccatcctcggtgtcagcttggccattgccaaggctggtgctgctgagaagggtgtccctctctatgctcacatctccgaccttgctggtactaagaagccctatgtgcttcctgtccccttccagaacgtcctgaacggtggctctcacgctggtggccgtctggctttccaggagttcatgattgttccttccgctgccccctctttctccgaggctcttcgccagggtgctgaggtctaccagaagctcaagactctcgccaagaagaagtacggccagtctgctggcaatgttggtgacgagggtggtgttgctcccgatatccagactgctgaggaggcacttgacctcatcaccgaggccattgagcaggccggttacactggcaagatgaagattgccatggacgttgcttccagcgaattctacaaggctgatgtcaagaagtacgaccttgacttcaagaaccccgacagcgactcctccaagtggctcacctacgagcaactggccgacctttacaagactcttgccagcaagtaccccattgtcgtccatccaggctgccaaggactcctacgctgacaactggggtgtcatggtttcccaccgttccggtgagactgaggatgtcaccattgccgatatcgctgtcggtctccgctctggccagatcaagaccggtgctcctgcccgctctgagcgtctggccaagctgaaccagatcctccgtatcgaggaggagctgggcaacaacgccatctatgctggcgaaaagttccgcacttctgtcaacctgtaaatgaaccgtatgattatatgacgtctaccagccaacctgacacattatcgaaagatggttggactcgggaccacactgcatacccgggttcccgctacttgcaacctctgagctgcacaaagcactacagatgatattctcttaagatttatgatgacgattcgattaggccagatatagtggcagtaatgcaataaaagtgcc

SEQ ID NO: 5870 - DNA, 305 bp, Aspergillus oryzae
ggcaccgtcacatggcaataaccagtatggtggatatggaggtcagccagggaactatcctgcacaaaaccaatatgggcagcctccgcagcagggctactatcaatctacacccgcttacgatcagcaacctcatacccagcattcctcgtatggccagcagcagaactatcccccaccctacagcgccggcccccaacaaggcggatatcctggcgactatggccacgggcaaggctcatacatgaacccaccacaagatggtggccactctccctacccccagcagcaatatcaacagggtg

SEQ ID NO: 5871 - DNA, 657 bp, Aspergillus oryzae
  misc_feature (1)...(657): n = A,T,C or G
ttatttctctctcttcgtgttcttctcaacattttctatactagcttaaatttgacgtcgagtttcaaaccagtcaatgaacaatgcggggatctgaggcatcggggctcagtgccctatggggtgctccctcgaccctcaccacttccgtgataagcggtccgacaacgtcaccagcctcgcagtctcgctatgcgaccaccgatcctcaacgagtggcatccaatattgaacatgtcctgttggcaatgtcctctccaagtcaagatggtggcctggtcagcgccagtggcaattcttcgggttctaccggcaagggtatcttgatcggcgtcctctcagccttcggatctgcagcagttgcagtgcttgttcttgcgatattcttctttttcaagtatactcaacgtggtagaattattctggaccgcattgggcgcccgggtgaatatgatgatgagcaagcgttcttgcgcgaggagacttgaggcttagaggccatggatgatttgtcgcggtccgagtatcttgagggcaatgcattcatcgaagccaaccccgccgattcgatgccaaccgatatttctctctccagtntctcgcgatccaggaaaaggccgtttcaacatgggagtttcaacccgaacctgaaaatcg

SEQ ID NO: 5872 - DNA, 671 bp, Aspergillus oryzae
  misc_feature (1)...(671): n = A,T,C or G
ccgcaacagcaagcggcaacagagacgccagctcctccccagggcgtaaagcgcaaagagcacgatgaccgtccatcggacccagatgccacacctgccctgcttatctccgatctgtactggtggaccactgatgatgatatccgtggttgggtccgcgaggccgactgcgaggatgaacttaaggacgtaacgttcagcgagcacaaggtgaatggcaagagtaaagggcaagcttttattgaattcactacgcttcaggctgcgactgccaccaaacacaagctcgaatcttccggtacgacaggacggaagtactctgttaactataccaacccccaaccaaaccctttccgcacacttccgaaggatgcacctatgcgaaaggataaccaggctcggtcgatgtctggaggcttcaactcgcctgcgcagaacatgaactttggaatgaactacatgggtggtggtggcngtggcttccgtggcggnctgcggnggnttcaactctccggngtggcatgaatannntacatggagggttcancnnaccgaaacttcagaacccaatgggctttcaaaacccgatggctggaggctttcgcggnaaatcgatgggagtatgcaaactatggcggcttcatactcgcgagcatgatggcggcatgccn

SEQ ID NO: 5873 - DNA, 693 bp, Aspergillus oryzae
  misc_feature (1)...(693): n = A,T,C or G
gctgggttgctgccattgatgccaaggctgccgaagccaaggctgagaaggaggccatcacctccagcgagggctacaaggctgagctcgagaagctgaccaagcctgctgtcgttgagcccgttaagaaggccgctgagaagcccgctgaggctaaggaggaggccaaggaagaggctgctcctgctgaggagaacaaggacaacaaggccaagagccgctcccagtcccgcaagcgcgccagcattttcggaactctccgtggcaagaaggaggagactgaggagaagaaggaaggtgacaagaccgaagaggccaagcctgctgaggctgctaccgaacctgctgctgaagcttccgccgctaccgagactactgaggcccccgctgctcctgctgagcctactgaggccaacgaagacaaggaagagaaggaggaggaaaagaaggaggagaagaaggaagagaagaaggctgagactaagtccaagcgcacttctctcttcggcaacttcttccagaaggtcactancccttctcacgagaagtctgagaaggaggccaccgcacctgctgagacccccgctgttgccagcactgctcctcagctcgacaaccctgtcgaggaggcttccgtgaagccatctagcccgagactgtgaccgcccctgctgaagctgaggctgctaatga

SEQ ID NO: 5874 - DNA, 661 bp, Aspergillus oryzae
  misc_feature (1)...(661): n = A,T,C or G
catttccttacttaacccaatccaagacaaaatgcagctcaaagccctctccctcctggccctgacccccctggcagccgccgtgggcaacgcagtggtcaagaactcctgcgaccaccccgtctacgtctggtccgtcggtggctccgttggtcccaagcagaccgtcgaaccaggcaagtcctacagcgagcccttccgccacgacgatgcctccggcggcgtctccctgaagatcaccaccgtcgacaacggtctctacaacggcagtccccagctgaactacgcctacacgcttgacaacgccggcgtgtggtacgacatgtccgatgtcttcggtgaccctttctctggcagcgcagtggtcatcaagccatccgacacctcctgtccttctatctgctggccacagggcgtttcacccggcggtagccaggtgaaggtttgccagagtaattcggatgaggtcttggagctttgtgccgaggagtgttagggtattgtatgaggttgaatgaatcaattcgtcacggttaacaaccttatgctatgtttatgtctgggtcatgggattgggttacttaatgaatactgganactatgtgataatgatgaactctgtatgtaaaagaatttagcaaatgaaacttgctctatgctt

SEQ ID NO: 5875 - DNA, 551 bp, Aspergillus oryzae
gcgggtttagtaccaacagtaggtcttagacgtcgctctagcagcctatttacatattacggaagtccagagactagaaggatattctggatggcagtagagaagggctttgttgatgtggttttactactgctgcgcactgggaaggcagatcccaatctgaccgattccgccaagaagagcgccctaatgctagcagttgagaacaagcacaaggaagtcgtggaagccttactgtgtgttggctccgcatgtaccgatgcgatggcagagaacggggatactgctctgtttctagcagttgttaagagagatgtggatataacccggattcttctagaaatcggaatggctaacccggatctcgtctacgacggcccattcaaacacccactttcatacgcggtagagaataattaccaagatatcgtccaaatactcttgagcaccggaaaggcagacccgatccccgggctccaagcagcaatctccatgaagcaaatagcaacgattcgcaactttcttggccttaccaggtgtagaccctaacc

SEQ ID NO: 5876 - DNA, 716 bp, Aspergillus oryzae
  misc_feature (1)...(716): n = A,T,C or G
cagctgctatgttgacgcagcgaataatagggataatggcccactggcgggaatacatgttgacacgcggcaagttgtttcgaccatcgcacatatacacaggtgaaacagagaataacaagccattgcccaagatttgactgtatgagccgagaggctcacctttgtctatcagtcagtatcatgatggcctcggaaaagagtttatgctttgaggcttgagccactctaacccagagaaatgctatcctgtgaactaggcacttaacaaaccttatgaaggtgcttgaagacaatgtctttacctcatggccattgcacataagtagtccacagtagcactcaatgtacatggcccattccattaaggaagacctaaggcgatatgaacaacagccagggagctgcggaagatggaccacctaccgaaatcacaccccttttacaatctcatcctgggaaagaacgatattcagttttcagtaccagacagaagcggttgattattctcacagcagccatagcgtcgacgttntcccctatctcagctaacatctactacccagccctcaattctatagctgctggcctggatgtatccagttcccaaatcaacctaaactatactacatatatgatatgtcaaggcttgggctcgaccctcacaggcccgttcgcagaccaaagctgacgtcgnccggnctacatcctctgtn

SEQ ID NO: 5877 - DNA, 960 bp, Aspergillus oryzae
  misc_feature (1)...(960): n = A,T,C or G
gcctcgcgatcacagagtccatctacatctggaactttttacagtcctaagcatctactttgattcatcgttgaacgaaccggatcatacacaatgcgtaccgcccaattactcgctctctccggcctcatgctcatgagcaacgtcgccatgggcgccgagctggaccacgacgatgtacccaatcgctgctgggatgtctgcggtccggtggtaggaattgcgcacaaatgcgacaacatgcacgacagtgaccgcgccgagatgaattgtatctgcgactggaagcaggcaccatccctgatccctctctgcgaggcctgtatcgcgcagtatcgcagcgaacgcaacaacagggaccacgatgatgatgacgacgatgatgaccgtaacccccaccacaacgatgcctacgacatcctcacctcttgctccctctcaacaaccagctacaacccgaccgccgcagcttccgccgttagctccgcaagcgccaatgccaccgatgcaacccctaccgcaacttcatcgggcatctccgactccacgaatggtggctcctcgggtaactctaacagtaattcggcaagcaacaccaactccgcggttagcgcccagaacactggcaatgcggcgtctgcgtattccagtcccaaggctgcttccttggctgctgttgtcggactaggctntcttgcctggctgtgaacatctcatgacctgatgacattacgagattggatatggtccancgcggagagagcggangaaaatatatggaaatcgattcacttgatcgtatggagatgggagaatgagatatatgaataccgttcatgccactcatatatatacccagctggtngatgagttatgttactcgaatatgccctggtgttttacttatcatgtggatatattgaatcactcctttgattgcaggggtctgtgttgctcacc

SEQ ID NO: 5878 - DNA, 676 bp, Aspergillus oryzae
cgagaatacctcaaggctaaaagtccaaaagcttcatccaatttttctctagttcaaaatgatcaaatcaattgcctctatcgcccttctattctccacagcaatcgctgtcccaaccccaaccgagctcctacctcgggcctgcactactctagcccccgctgtcatcaatattctcgacgccgcaaatcccaacaccccctactctggccagcagtttaccctcgagcgcagcggttctcccttggtcgataacaagatctccgtgttgaccttcaacaacattcccgccggcgccactggctgtcgactcgaaatcgaacttcctcccctgagcgacggccaaatcgctcccagcgacacccaggcagatgtctggtctgccgacccagtagacggcagctcgttccccacgtataaccatccgccacacaaaagagaaatggtcgcgacctacatcttccccaagggaccaaccacaaagtcgacccacaccgtattggcatctaacacttgctcgaccaccatgagctggttggtgcagttgagtgaatggcagagctcggctggaagtgtcaatttccagaactctgttgggaatggcgcggatatcggcttcatgttggtttacaactgttaaactatgggttgttgacgatcccattgtgtgaccact

SEQ ID NO: 5879 - DNA, 699 bp, Aspergillus oryzae
cagactttcatcagtacaacattgggcattgtctcaagccaatatagacaatgatactgccaccgacggggaacagaaaagcgatccagaatttattcatgaaattctactacgtcctgttgttcaggctgatgacgaaaagtcacgacgccagttgcgaccgctgacccgaaatatactcacccaattcgatgacttacttatggctcttcacaacgcccgcaatggtggagtgggagcggacgacagctcggcgagtgagtggcaaacagatacagagagtattgcctctagcatctcatcccgcaagagaaggacaataaaaaataccgctgagcgaagtcaatcgaggggtagaaagcgcacacgcaggtcatccgctcgaagtgagtcaagccgtcaacgttctcacagtgggcatgcatcaagtggacgagcaccttctcggcttggctcacgtcgtcaatcaaaatcacaaaactcaaggccgcgggggcgctcagctggcagcgaccgcaaaagatctgcaagtcgtatgcgtcttggcctccgcgactggagcgaagtactaggaatcgcctctatgatcggctttccaccagccgtgataatgcgttcttcacaaagatgtgccgctctgtttcgtgaggatatggagtttcgcgttttgcaagaaggtaccttacagcaagttcgggg

SEQ ID NO: 5880 - DNA, 704 bp, Aspergillus oryzae
tgaattcacgaccgcagcgccacgctgcctaaactctctgatgcatactacgccacaactcggattctcttgatgagatgacctacacgtcgcgacctacattaatgcttccgctagtgtcttctacaggctcatcttttcgccagccaagtactcatcatgctgcgccccagcagcaattgactgccctggctgcccggataggctgacacaacgcctagctctatgagagcgaagcaactccgtgagatgagtggtgcgctagcgatgcaaatgcaagtcttagaagagaagatagggacgcttaaggatggcacagaagctgttgcctgcgttcttgctaactgggacaatgttctacggtcgattaacatggccttcacagaagctgtaaatgtataaagaccgaccgtgcaaaatacaaacaccttggctgatggtgataaatcaaccgatactcccatgcctgcgactgtagttcgaataccagcagatcatgcagcatcggcgagagagtaatgcatggcttctgattaacccgcatagtcatttcatgatgagcctcttctgatatcgccgatcaaacagaagactccatgacacacggcgctcgaaactgatacgtagcgctcactgtatgaattcaatacagtgtcagactcactatagtgtgactcaaccaataggaatgcaacatactccct

SEQ ID NO: 5881 - DNA, 674 bp, Aspergillus oryzae
aggaatttttttttttttttttttttcaaagcttcaaacgcccaccagtgttcgtcatcataaattcagagtacagaactgagagaaggagaccgttcgtacgcccactattggaggacagcaagccataacgaaacggcagaagaacatgccacatgaagggaaagcctaaatcgagaggtgtttggggaaggtgaaagttgcagacaagtatttcgattataatgttctgtctggttttgacgataccaatgctcaccctgccttgatcttggatgaaattgacttactaattaccattcttcttatcccttagatagatcccattttgcttacctttttattcttaattttttgtctgctctttttatatttattttttgctttttcaatgtggtttttctttcattttgttattatttttgcagtattatttaggcttttgatgcttcaatttagtgggatcttttaatcgttttcatgctctatatttgttatcttgttttttatacggtgatttcttagtttgcgttcttattttgtggatattatattatattttttagattttgttgttttgtcgatctattatatcaatgttttataatctctttcattttatagtttgaattgttttaattttcttactcttttctctgtttatatttctctcg

SEQ ID NO: 5882 - DNA, 525 bp, Aspergillus oryzae
  misc_feature (1)...(525): n = A,T,C or G
caacgacgaaatgcccaaaacagctttatttgtggtcgacacacaagccggccttatctcgattcccgacactgctataccccacagcgctcgcatctgggaagttgggaacaaaatcctagaccgcgcacgaaacgttgccagcactgagctcgagatcgtcatagttcagcattcagacgatgcagaagaccccaatgcgagccttctccctgggacaaaagaatgggagctgtcattgcccatgaaagtgggcgccgataacgagagaattgtttccaaaacgactcgggatacattcaagtccaatccatcactggcagatgagctcaagagccaggggatcaccactattgtagcctttgggattcaaagtgagtgctgcgtgctcgagacttgtcgcggggcttgggaagcggggtttaccggtggtttggtttaggaagcgcatccaacttatgataaccaggctactggggcttagggcagagcagattgaaaggcnggttgagcaggagttatgcn

SEQ ID NO: 5883 - DNA, 755 bp, Aspergillus oryzae
  misc_feature (1)...(755): n = A,T,C or G
ggggaaactggcgtcgccgagctcctggagggacccagtactcatgttcacctgttcggcacagtacttcgccctcttgcccagttacatctgcacgctacaagtgtatgcattttgtagctctgggagctcgccccctgcatccccatcgaaccttgcccaagatcgcgagattgccgtcaaaatgtgggatccctacgtggccagccaatacaggtgtcttacaccagcagatatcacaagtcaggccgaaaaggcccgcaaaagcactgcacgccgcgacggtggggctaccctggcctctatacaatttgtagcagcgaaacacctacggtcaggtgatctgagcctcacgcttcgcagcgcccaggaggcagatatcgcgcggacgcaccgtcgctgggtaaagatcttcgagagcgattcagtgattgacctccctctctggggtgtggtggtccacgacatgcccttaaaatgggttgggggcctgtccaccccggccgcgagacagcgagtgatcaatgacctgctggccgccaacatcttcacctggggaggagacgttgacgttgctgcatgtcgctggctcagtagcccggctccgggaacggagtcgtncgcgatggtggtggaantcacgcatnnctgaggcggncaacttgcgcgatcggtaccgaaccatntggggagtcaaaatgttgaagacgtcctntacgtncggcccccctgcatccgcgctggttcagtggcan

SEQ ID NO: 5884 - DNA, 666 bp, Aspergillus oryzae
  misc_feature (1)...(666): n = A,T,C or G
ccgttcttcctaccttgttactactgcgcttcatattcggttcttgattccagtacctgcctcgcatccctttaccttccaaccgtcactcgcatcaaacccctaattacaatgggctggctaccctggtcctccgactcgaagaacaccgcttccgatggaggccgcatagcccccgatcggtcctctcgacaaaagtgctgggagggtcgcgacctgtttttctcttgcttagacgacaataatatcctggacgcaatcaaggaggataaggaagcgcgacgaaaatgtgggaaagaaattgcggagtttgagtcggcttgttcaaaggcttgggtcaaatattttaaggaaaagcgggtaatggaatacaaccgagataagacaattgagcggatcaagaaggaggatgcagcaaaggttcatgacttgaaggcacacggatggaaccctcggtaaaatggttagccactatggtgggaggaaaagcacagggagagaacgggtaggatttgatttcagcccaaaagctctgtactacatactactacctatcaaaagctatgccactccaatctttaanaaaaaaatntaaannaataanttatatttttcctgcggccggtcgaacatgcatttataaggccccctcattgtaatttgttt

SEQ ID NO: 5885 - DNA, 657 bp, Aspergillus oryzae
ggggcttttaccccattgaattgaatttcgcacattttattcacttctagccactgcagctagcactcctacacaggtctcggaaacaagtcataatggaccaagaaggttcccctccaattccggagggcatttgctctcttcttgataccgatttgtacaagttgacgatgcaatgtgccgtcctgacgaacttccctgaaacccacgtgacttatgggatcacgaaccgtactccacacctgatattaacgctgagagcacacgatgtgtatcttaagacataggtcaaatgtgtgatcatatcatatcacgagaaacgcgacacagtagccgagatatatacgaaatatgacatgagacgataaatgggacgtcaggacaacatgagagagattgcttgacgagcattcaatgactgcgtgatgacaagtcgtaataatgcgatgacttgagccttcgcatgcggtattgccatgcgacgacatgatcacgtgagtgtgatatctcatcttatcatgttgcgatgatgttgacgatgaagatatgagtagatgatcatcgtcaagaacttaacgtatgtctcgaatattgaatacgacaagactgacatgatgacgcggtgatcgaagacgatgatcaacgtatgggatcgcc

SEQ ID NO: 5886 - DNA, 732 bp, Aspergillus oryzae
  misc_feature (1)...(732): n = A,T,C or G
gtatactcccacactgccaagcacattttccgagaggctcttgtacgaccgttgatgtttgaccgaacctgcgtgcttgttacccacaacattgctcttactgtcccgcatgcggagcatgtcatcgatctggacaacggtaaggtggtcgtccgcagacattctgacgaagtgcgaacgaacggagtgctgatcgcaaagagtttctagtccagactcatatctangtgcatctttgaatgcgcctccgtggtggcgaccgatcgtcaacaccagtatgatgagcacgtcaaagccgctcctggagaaataccggtggctcatccggaaaaggttaaaccctagaggacgtaagaacctacgggtgggagaatgagaggcttctgagtggaacatgatggtctaccgtcaaaatggccctctgcgtctaggggctcaccgatactactgaagccggcactatggtgcggttatctggttaaatcaacattgcgaacctgtgttcaacaaaatggtttgggggctacacagtggggtctttggggcttaaactgaatggcgcagtgtccggataccaaatgacgtgttggaaccttcctcggaaaccaactaagtttctaaaaacccccttaatttacacgcttgggggggtgtaggacaaatctgtaaaacgcccgtgggcggaaaatttggggcaggggaaaaccagggggatcgttcgggtacgctcat

SEQ ID NO: 5887 - DNA, 1151 bp, Aspergillus oryzae
  misc_feature (1)...(1151): n = A,T,C or G
tcacttatcagctgtctatcaacaactaaatgattgtttatccactaagatacccaccatactgccatgacccactctctccgtccaatcttcactccttccgaactgacttttcacagctcctcatttcccttcccagctctacctttcgctatagagattatgtgaatcatatcgcgcattgtcattcgacatgcaatccacaagccccatacctgccaacgacaccgaacagctgcctgaaacccaagcgccacctcccactaccgaggaagcttcgcagcgccaagcctggtcatccgaaggatatgggctgcctcccaccagtgacaagcctccttacggccccgttgaaccaacgccctcacgaagggaacctgtcgcaagacctctctccaaacatgctacgcaccttttcacgctntcatacttgatattcttcgccattttcggcactttggcgcgtcttggcctccaagccctgaccatctacccgggagcgcccgtggtaacgggcgttctctgggccaacgtaggaggatcgctactaatgggcttcttcctcgaagacaagaacctcttccgcgaagaatggggtgacgtgaaccaaaacaacagcaatggcacggggaccgacccaagcgccgaatcgaaacgccacaagtctgttaaaaagacaatcccattgtacatcggcctatcaaccggattctgcggctgcttcacctccttctcgagctacatccgtgacatcttcctcgcgctatccaatgacctgtcggacccctcaacccccaatggcggatacagcttcatggccctggtagccgtcatcctgaccacagtcgcgctcagtctcggcgcgctcatcttcggcgcccatctcgccctcgccctcgatcccttaatcccctcgttccccttccgcttcacgcgtcgattaatagacccgctcttcatcatgctaggctggagatgctggctgggcgcctgcttcctcgcaatatggcctacggatcgtcatgacaatggaccagagttctggcgtggtcgcgcagtgttcgcagtggttttcgcgccgataggctgcttcctgcgttactatgattctttagtgatgaatacccgactccccgccttaccgctgggta

SEQ ID NO: 5888 - DNA, 700 bp, Aspergillus oryzae
caccaccgatctcgtcccatgaacgccttcaaatccacgtcactcacgacatctcgggttacccggccattgatccacttgtttacgctgtcttcgctcgcgtgatgtcccaggtagaaggtggggatcttcttgtgattcaacggggtcaagaatctgcgccaaaacgggggttagatataacaggtagtcagtctacccctggctggcgcgatggcccgtggtggcgcacagtgctgcctggaacccctcgcagtatctcggctgtgcgtggctctgttgaggccagcaagctcgctcgtgcaagcgcagagtcttacgctaccgagttcttctctgcaaagggtggagttgaagaagctgcgaaacaagctagccaggttctcagcgaatccaaccccgtccggagcagtgatattttccttgccatccaggctatcagccaaatcctcttcaccgagccagttcaggctggcccaaccaccgaccagacccccgcggccgtggttgatgtccccaaccgcttcggaaaaggaaagggactttcgttttttacttcatgaacccattaacggattgccttcccaccattttccaggttggccaaaaaaaaggaacaatgggttggttgccacgttccaaccccttgataacactactccgattatattgtggacctagcccctgttcccggagaacc

SEQ ID NO: 5889 - DNA, 1045 bp, Aspergillus oryzae
gaagttggagtgtttataagcgttggtactgtgtaaacgtccacctggtacgaataatcgacagcatgaatggtgggaggacttctttggcgatgcgctgggcacatttgcagaggcgcgccgtcggctgatcgctaagatcgaggggtgtgaagatatccacaaggatatgctccgggagcatctggcgaagcgtaacgtggttaaggataactactaccggctgaacgttgaagtgggagtgggggagtttggtatgaacgaatggaaccggctggcggatatcagtaccaacactcgccgctacctcaccaggcctgaagtgaagaagcaaattcttgacgccggtgttaagttttctagaatcgagcgcatgcaccgtcgggcggcggcgcatgcggctgctggaaatgatgtgaccaatttccaggatgacagttctataacccaaagtccaaggctatctgtggtgccgcctccaattccacatgctgtggaattgcccgctgagctgccaggcgattttaccctgctgtcaccaacagggccgacttcacccccgatgaacgacgatgtactcccaggtcatccaatcccacaggatacagttttgccaacaccggcgcggggttcagtcagggacctgagcgacatgagccgacccagctgacaacaacacggttccccgcgacaaagtaccgatcatgtgcatgatggcatgccgccaccagcacctccaaaaacccatgtcccgtaccccagtgagttgggaggaattccagtgcctaatccattgggaacagcgacggtgcctctgtggcacggatcaaatgggaagatacgaccgccctatccagtggatgagcctccaccgggggatagacggcatcgaaaaccaatctatcacgtgcgctaagactgtcttttagactttttctatttgaagtgctgctctcctttgtttgatcgatgtgaacgtgacgaagtatccgcatgttgttgatgggcgtcatgtatgatgagcggtgttggatggcctaaaagg

SEQ ID NO: 5890 - DNA, 1015 bp, Aspergillus oryzae
ccgtatctaccactatgaaggtcgccctgctcaccttagcagcgggcttggccaatgccgcctcgatcgccgtcactccacgggcgttccccaatgcccctgataaatatgctcccgcaaatgtttcctgtccgtcgactcgtcccagtatccgcagtgccgccgccctgtccaccagtgagaaggattggttgcaagtgcgtcggaatgagacccttgaacccatgaaggatttgctcgggcggctcaatctaagctcctttgatgcctcggggtacattgaccgtcataaaaacaatgcatcgaatattccaaacgtggccattgccgtttcaggtggtggttaccgcgctttgaccaatggcgcgggtgctatcaaggcattcgatagtcgtacctccaactccacagcccgtggacagctcggaggccttctgcagtcctctacttatctatcgggcctcagtggtggtggatggctcgtgggctccgtgtacatcaacaacttcaccactatcggtgacctgcaggccagcgacaaggtctgggacttcaagaactctattctggagggtcctgatgttaaacatttccaactgatcaacactgccgcgtactggaaggatctgtacgatgcggtgaaggataagagaaacgccgggttcaacacttcgttgaccgactactggggccgtgctctctcctatcagttcataaacgctaccactgaggatggcgggcccaattataccgggtcgccaattgccttgggaaactatttaaaaaggggaaaaaccccctgctttattctttcgcaatggacgaacccggggcaaaatcttttgtgaaaaaactccggtgtttagaattaacccgggagagtgggtctcttcaacccataatatgcggttgtccccattggaatttttgggaccttttaaaaaaacgtgacctccccggggggtaatcgcgcgcccgtataaaaaagaggggttgttagaggggccacccctcg

SEQ ID NO: 5891 - DNA, 1323 bp, Aspergillus oryzae
  misc_feature (1)...(1323): n = A,T,C or G
cgattgctaacccaattgatacggccaactttctggacaatgaatttgttgcctctaaggctacaacttggattgacctccatgaccccgccaccaacaatctcgtcactagagtcccccaaagtacagatgaggagttgcgggccgcagtcgagtccgctgagaaggcattcccagcatggcgggcaatgagcgtgattgctaggcagcagatcatgttcaagttcgtcagtctgatccgcgccaactgggaccgtctcgctgcgtctatcactctcgaacagggcaagacttttgccgatgccaggggtgatgttctccgtggcttgcaggttgccgagaccgcctgtggcatcactacgcagcttacaggagaagtgctggaagttgctaaggatatggagactagaagctacagggagcccctgggtgttgtcgcggctatttgcccttcaacttccccgcaatgattcctctttggtgtatttccattgctaccatcacgggtaactgtctgatcctcaagccatcggagcgcgaccctggcgctgccatgatcttggcggagctggctaaggaagctggcttccccgctggtgtcgtcaacatcgtccatggttccgccaagaccgtcgacttcatcattgatgagcctgccattaaggcaatcagctttgtcggtagcaaccgtgctggtgagtacatctacactcgcggttccgccaatggcaagcgtgtccaggccaatctgggagccaagaaccatgctgctgtccttcccgactgcaacaagaaccacaccttgaatgctatcgtgggagcagcttttggcgctgctggccagcgctgcatggctttgagcactgtggttatggttggtgagaccgaggaatggctccctgagatcgctgagcgtgccaaggcattgaatgtcaatggcggatttgaagagggtgccgatcttggccctgttatcagcccggagagcaagaagcgcattgaagatttgattgctagtgccgagaaggagggcgcaaagatccttttggacggaaggggctacaagcctgagaagtaccccaacggcaactttgtcggtcccactatcatcacgaacgtcacccctgagatgacctgttacaaggaagagatcttcggtcctgttctggtctgccttagcgtccctactcttgaggatgccatcgacctcatcaacaagaatgaatacggcaacggagctgccatcttcacctgttccggttctactgcgtcacgtttccagaaggacattganggccggacaagttggcatcaatgtcccca

SEQ ID NO: 5892 - DNA, 1453 bp, Aspergillus oryzae
  misc_feature (1)...(1453): n = A,T,C or G
ctttctccatcaacagaacgtttgtcacgatctgttgattatcttttatctctatttgatctctacgtgttatcattcaaaccgtagagtcttatttctttcaaaatgcctatctccaacggtgatgcacttggccgcgccatgaaggctgagatcgaggaccacaccaaggccctcgaagttctggagaaggattataccaccagagatggtcttgatgttgacaccttgctcgattcggacaagcacggagcattgacttacaatgacttcctgatcttgcctggttacatcggcttccctgcgtcagatgtcactttggacaccccagtcaccaagcgtgtctccctgaaggcccctctcctctcctctcctatggataccgtcaccgaacacaacatggcgatccacatggctcttctgggtggtcttggtataattcaccacaactgctctcccgaggaccaggcggagatggtgaggaaggtgaagcgttatgagaacggcttcatcttggaccccgttgttctttctcctaaggctactgtcggagaagccaaggagctgaagagcaagtggggatttggtggcttccctgtaactgaaagtggaaaccttcggtctaaactcgttggaatcgtcacctcccgggacattcagtttcaccccaacctcgaggacccagtcactgccatcatgtccactgaccttgtcaccgcccctgccggtaccactctggccgaggccaacgaggtcctccgttcctcgaagaagggaaagctgcctatcgtggacaatgatggtaacctggtctctttgctgtctcgcagcgatttgacgaagaaccttcactaccctcttgcgtctaagcttcctcactccaagcaactgatctgcgctgctgctatcggtacccgtgaagaagataagcgcagacttcaactgcttgctgatgctggccttgacattgttgttctggatagcagccagggcaacagtatgtaccagatcgagatgatcaagtacatcaagaagactcaccctgagattgatgtcattgctggtaacgttgtgacccgggagcaagccgctcctctgattgcagctggtgccgatggcctgagaattggcatgggcagcggtagtgcttgtatcactcaggaagtcatggccgtcggtcgtcctcaggctatctccgtccgcagcgtttcttctttcgctgctcgcttcggtgttcccaccatcgctgatggaggagttcagaatgttggccacatcgtcaatggtcttgccatgggcgcctccactgtcatgatgggtggtctccttgccggtaccactgagtctnccggcgagtacttcgtcagcaacgaaggccagctggtcaaggcctacccgggtatgggcagnatcgctgccattgaggacaagaanggctgcgccggctctaagg

SEQ ID NO: 5893 - DNA, 618 bp, Aspergillus oryzae
  misc_feature (1)...(618): n = A,T,C or G
tgtgaacactacgattttttctccctccctcatacaactccgacattgtgctgcttggtgtcgcgcgcaatttttctattttcaacattctttgcagacagcgctgcgaaggtttcacacgaaaaccagcaacgatattatgaccccagcctgaatactccccgccgacatttaaactccgttcgatcgctattccaggacagccatatctgtcctatacaacgccatggtaaactggctcagtctcgccgtgccgttcgcctacctaggtgttctaatcggctccctagcaaccttctcctcattataccgcaagcgcaaagcccaaaaggcatactctctagaaccatggttccccgctcacctccaacgagatatctatttctcccttcttcacattgacccgcctgcgacctcttctaaggagaagaaggcgcctgctgtacccgagtcggtgcttaaggctgcgctcttaagacgtgcagaggaggatatcaaacgggttttggccctgcgcagtcagaaacaggctttgggtgtgctacttcancgtggtantgtgggtgatgatttgtggcaacggttcccgaaggcggaaaangagatggangatgaggt

SEQ ID NO: 5894 - DNA, 657 bp, Aspergillus oryzae
  misc_feature (1)...(657): n = A,T,C or G
tggttttgctatcagcngtttacaggacgctcggctgctcagtcggcgaggaaaatcgtccgccgcgaaaaactccgaggtcaagcgaagcggagatcgtctttaaccgtgagcttctctgatactactaatacacctcctctcttcgccctttatccggttctcctttccgtccgacaggctaagggctgcctaatggtgctccgtcacaatatcttccgggtatcaacaccggcgagctggatctcgcgggtttcaccagcaaccatgcctctccgcgccaaagtgacaaacccagctttcaaagctgccacaatgtcaacttccacgaaccttcccaaagagttgcccggcgatgagcccgacgatgttttgttcaattctttgtacggagtgcgcttggtcgagcttaaccgccctaagaagctcaattccctgaacgggtcaatgggtcgaaagataccccctcgactgaaggagtgggaaaagtgccaactgggcaacattgtcatgggtgccgggcaagctcaaaaactctctgtgctggcggagaccatgcaaccctcgctcttgagaatgaacacgggccccgtggggaaccaaaaattcaccgcactttttctggctggagaaccacaactcgaacacaccttcgcg

SEQ ID NO: 5895 - DNA, 249 bp, Aspergillus oryzae
ccgcctcaacggcaaactatatctgaaaattgctttaacacatatgccttactcgttaaagggaagaaacgtgctggtgacagccggctctagaggcctaggcgccctggtatgcgagaagtttgcagcagagggtgccaacgtgctcatcaactaccactccaatgtggaggctgcgcagcaactggccgacaaactcgagaatgagtactcggtgaagtgccacatcgcccaagctgacacgctcgt

SEQ ID NO: 5896 - DNA, 684 bp, Aspergillus oryzae
caattgccctctacaccaagtcctagggactcaattgctcaacatgttgcctttggctcgaagccggatcgcggcgttctctgccgcctggactcctcgcgttgccgcccgggccagctactccaccaccgtccctcgtttctccgagaacagcatccaagccaacgacccgaaccccccgcaaccgcccaagcccaatgtatccgccacgaatgccactcctgttgatgctatgggttcccgggatgcgcccttgagggaggatgtcgaggctggtgagcgcaaccgccagcttcaggcccctaaccgcgccaggacctgggccgccagccagcagccaagagagaatgctatgactggacctcgcttcgagcagacaatcatggagatgcagccccaaccctatgccgccattgagctcattcacaagcagcccgtccggtggaaaaaaaagaaagccgtcagctgtgacagggggggcggaccctttgggccccccaaaatctatatcaacacctacaacccccaaattgctacctgtcggtactgaggacggctttactcccacaagacagcaaccggcattaccttgggagtccctccccggttaccagcttaccctttaaaaaccaactggggacgccccccgaggagaaacatacttcacgttgcccccgaggggct

SEQ ID NO: 5897 - DNA, 668 bp, Aspergillus oryzae
cacaagcgcgcagttattattagttacttctcaaccatctttgcccatacttagctatcttcttattttttcaacaggatgcgttatcaagcggtgagtctggctcttcttggacttggcaaaagctatgcagcgcattattcggatacttgcaactcgttcgacctacaggggtctatcctgatggcaaaatgctcgaaatcgcctaatggctactactacgatactgaggctgacctgaacaagcgtgtgggaaataaagacggcgttcttataagaggggaaaatgtcttacgaaatatggagcgtagtatctgcctgtcaatacgaacgcagatgaggtgcatgtgttatggaacaaagggggtgttggccccatcttaagtcttgaacctggacgatatcattagcaaccaagggggaacgctaacctgagaccaagaggtccaggtagcaccgcgataaagccagcgatgagactaatcttgtcatatgattggccatggtattgtagtgaggaaatatacagaagtaaatctagcactgacgactacgatgatgctgattaatgttcacatcatcactgtggaggctagcatcatgccgacgtttaccatatatcggatcatacttagtacctagcttaggttacattagggttaacttgt

SEQ ID NO: 5898 - DNA, 1057 bp, Aspergillus oryzae
cggcaatgtcggaaccccaagacaccacttccccttcgactgcggctgctcctattgccgcgtcgacttcgcatgagcaaccccaaacccagtcaccgcctcaagtctctgctaccacgacatcctcggtgacggcaaccgcagccgcagcgaccgcagctgtggcatctccccctgttaatggtgctgcgcgcccgaccgaagagttgtcttgtctttggcaaggatgttctgagaagtgtcccaccccagaatccctctatgagcacgtctgcgaacgtcacgtaggtcgcaagagcacaaataatctcaacttgacttgccaatggggcagatgccgaactactactgttaagcgcgaccatatcacctctcatatccgagtacatgtgcctttaaaacctcacaagtgtgacttctgtggaaaggccttcaagcgccctcaggacttgaagaaacatgtcaagacacatgcagatgattcggttctggttcggtcacctgaaccgggttcccggaatccagatataatgtttggaggtaacccagcaaaaggctatgctaccgctacgcattacttcgaacccgccttaaaccccgtccccagccagggttatgctcacggagctcctcagtactatcaatctcatcatccaccttaaacagcgaacccgtcttacggtaacgtttactatgcgcttaatcacggacatgaggccgccacgcatcatacgagtcgaaaaagcgtggatatgatgccctaaacgagtttttcgtgacctcaagcgtcgccagttcgatccaaactcgtacgccgcatttggcaacgcctacttggtttacaaagcctgtctcttccattcttaaggggtggcccactccctgattataaccccatgcctgcccttgtggaaaagggggcggagttatacccgtggggacatcctcccgccccgggtataatctccttccatgaaaaacggcccgcccaaaacgacttgttaaaattaatttttttttggcggagagcgcggatccctttttaaaaatgacgccc

SEQ ID NO: 5899 - DNA, 446 bp, Aspergillus oryzae
  misc_feature (1)...(446): n = A,T,C or G
gctttgaagtgatcactgtgaactacggaaccgatgctcctgccctgaagattcacgaccagaggactcaaagggttaagaggtatttgtatggacctggaagcatccttgttgcgcatgccgataatgaggccatcacggtcggcgaactggaagaggcggtgcgtggttacaagagactcatcgctgcttctctataggcgtttcagaatgcgttgagtacatctacatagccctagagtacttgggggtttggctcttgtgtactggatctccgtattggggttaaattatcaaggcaagaggcggngtgaagaacacggttgttatcggtcgccttataaacaatctttaaagcttacaagttcgtagatgttgagagccttgtgagaactgaacctatagtctagattgggcatgcgacttctgtataattctcgatcagc

SEQ ID NO: 5900 - DNA, 614 bp, Aspergillus oryzae
gatcaatcttatcgatccggtgatataagaagccactgaagtcttacatcaagcatcatgagcaaccagcagaacaacccccagtctcctcgccattggcacggtaacctgggcgatcgctatgagcaccacaacgtctgggtgagaggaggccctccccagccatacatggcccgacgtccttctgctgccgaagcagcaagtgccacggatgacagacgtgagtctgtctcatctagcatgtcttccggctctaacagccccccaactgctccgaacagaagacggtctagtcagggttcgtcactcttcgaaagtctgacaaaccagaagcggaactccacggatcctgcttcggccgcacgccgcgcgagttacaatgaccaggcgcagcagggcggtttctttgcgaagtggtgggatgggtatactcgtggttcgaaataagccatggtcaagttcatgctgtgaaggaaggcagaatgaattactggatgggaatttactatgttgaacgtttatatgactgtatgctgaagagtttggcgctggatcttgtatttattcgttcgtctacaagcatatcgtgttaattgaagtggatatatataggg

SEQ ID NO: 5901 - DNA, 704 bp, Aspergillus oryzae
cggccgccacaacctcgggactattggacagtggacttttgtcgggtctcctgcctacaaccacgggcaactcgtcggagtccaccagtcagctcacgtcgattgacgtgatcccgacgccgtccgctctgttgtcctctattctgtcaccctccgccgctatctcctccggattgttggacacggggcttccgtccggcgctctttcgactcccattgccaacggttcggaaacatcgaccgccaatggaagctccaccgacctcctgagctcttccggtattctgccgactatctccatcagtatcccgccagctacgccgaccccctccgccggcacctcctcgggagccatcccggaacccagtggcctgcccaccagcggcgttatcccaggatcgtccggatcgagcggctcaaccacatccagcccggtcatcccaggagcgtctacgggaactcaaacttttaccccgggaccgtccggcttggtcatcagccccgggcgttcctacatcgaccagtggtgtcgttccttcgaccggctccagtggttcgtctttgccgtcgtcggtctcgtcgacttctctcatcggcttcttcgaaacccaccgacgtgcccaccaacccaaggaaaccccgatttcgacgaacacacccgacttcccgtttttttcaccaacgtggaccccgaacaggcacgg

SEQ ID NO: 5902 - DNA, 714 bp, Aspergillus oryzae
cttccgtccattggcctcgcgcagcatgtcctttcggccgatgttccagcagcgggctgtggcccccatcgctgccactcttttggctggaggtgtagccttctatccccggcgaaccgccttcgctgaggagcctaagaatgataggaaaccgatctatgatgacttcccggccgatatcccggaacccaccaagtcccttcctctgtctcctcccaagtcatctccattctcctcctcgtcccctactcccacagacatcttgactgctcaggtccgacacgcccgtcttttcctctacgaaaactccctcgccgccgagaactgcttcaacgacttcctgtcccgggccctgcacatcgagaacgctttcaccaacaccatcgcctcgttggccccgtcgcctgagtctggcgagcgtctcctccccggcggcgcctatgtcatcgtctctgccatggccggttctatcgtgtcccgcaaccgtggtatcctcctgcgcactgcctcgccgctcgcgttcggtaccgtggccgcctggaccctcctgccggtgacgatgcgcaacatctccgacctggtgtgggagtacgagaagaggttcccgctattgctgagcagcacctctacctccgtgaacgggctgagcatatctggtctactggcgtggcacacagccgcatgggcgcggccatgatggaagattagatcgga

SEQ ID NO: 5903 - DNA, 686 bp, Aspergillus oryzae
  misc_feature (1)...(686): n = A,T,C or G
gatggacccaacttttgggcttgccccctcttcgatccctgccgccccggccagtcctttccaagtctcgtcacctccagatgtctaccaacctcccatacacacctcaccgcctgtccctatggcatctccgccacctcctcggatgtcagcacctccgccgatgagctctttaccaagccgctcgtcggacgggccacagattcggttgaatccgctggttatgaagcctaatctaagccattctctcccagtcacgacgccatttaaaaactctccctataatcaagcacattttcagaaccaagactttgaaccaattcattgggaacctagtgaatctcgcaaatgatcctcgagtatattcccaactctgatacacaaataccccaaattcaggtcgccacggagcatcacgtccaaatctttctctcctatgattcgcgttcaatgaccccacactacgctcgttgactagctcctagactctctgaccggcgctttatcaagggcaggccatcatcgccactctcgacgaaggatcttttgactgtgtcatctactttcggtacaaatgagagttcacacccccactcgcttncctaatctctttcttcatctatggatctggctggtaagctggtgcttaacgtctgtcttgcgcgttggatgggtatgagcgtgaa

SEQ ID NO: 5904 - DNA, 707 bp, Aspergillus oryzae
gtcaggtgtctactttcggatggacggatgactatattttcacggatgggttgagctacgacccatccaagctgcagatacaacgacgacatcgaggcgggcctcaagttcctgcagttgttttgcatattcagatgtcactgcatcccatttcacttagctcctatttgaactcgcagccacgtgaggttgaagatggccaagtcccacgccgacattgttaccacttggccccgtctctgagactcatgctacgtataatctcaggagtcgaatatttgcactcgaagggcatagtacaccgggatctcaagcctgctaacatatttctgtcgtgtccggaatctcgagactctgaaggatgccctccttgtcagttagataacgaacattcttcatggtactcgcaccctcgaatcggtgatttcggtctagttgccgatatctcccacttcaacgagaatcagtcggacaatacctctttgcagcatagaacgaaggtgaatcgtgtggttgggacagagttctatcgcccaactttgattcatccttatgtagatagccccgagaactcagaagagaccggcagctgttacaagattgacgagtctctggatgtctttgaccttgagtgatcctttttgagcttctgtatcgcttgacacaaagatagaaacgcaattcgttctcggtgaactaacgcgctg

SEQ ID NO: 5905 - DNA, 735 bp, Aspergillus oryzae
  misc_feature (1)...(735): n = A,T,C or G
cttgctcctacaaaaatcacaatggaattcgtcagcaaacttgccgaaaagttcctcgacaaggacaagtccagcggcagccaagaaggctatggcaaccaaggcggctacggtggaggtgaccagggatatggcggcggctatcctcaacaacaacagcattcaggccctcaagtgccccccccatggatcgcccggtgggatggggagtcacagcgctggttctacgtgaacgagcagaccggcgagaggacctggaaccacccaggccagggcggtggctacggacagccgcagccttcgtacggtggcggtgcaccttacgggggagaacagtcgtatggccagcagccctcgtatggctatggcgagtcgcgccagggagatttctatcagcagcaggaggagcctaagaaggatcacactgcggcgaaaattgcaggtgctgcggttttaggtgttgctggtggagcgttgggagcgtatggtctgcatgaagcgcatgaaaagtgggatgagaacaaggaagagtggaaacaggatgttcaggatttccctgaaaatgctgcggagtggaccggcgagaaggtcggtgaagccgaagcaggctgggatcgtgccgaggatcgagtcgaacaagctgggataacgccgtcgataaggtgaggacttccccgaaaatgctggagagtggaccggcgaanaaggtcggagcccgtggaacgattcggggac

SEQ ID NO: 5906 - DNA, 666 bp, Aspergillus oryzae
  misc_feature (1)...(666): n = A,T,C or G
cgcgctcgtccttgctacatgtatgcatgagcatggcgaaaagacatgtcaggatgtgagcccatgcgagaacgctctctacgttatcaatatcactggcaatttcaatcactctacacgctaatcgtgtgagcatggataatctgtatgatctggctcgatgtacctactatcctatctatgggatcaagagctaacgaacccagaacagggaatttctatacatcgtatagagactttaccagttggactgagacaatactaaattagaccattgggccaatggatagcatacctcagaacactgtgcacacatcttgcatccgtacatctagatgaattctgttaccatgaaccctatctacgcagtcatgagcagatgtgactcctgacgagccatcaagacaatcgtgaacgacaacactaacttggacatcagacagagcgtgatcatgcgtggacgaggatactagtttcgtagctgatactggcgatgagatctctgcaaacgagctaagtgattaccaactgcacaatgccatctgcgtctatgaacactatctcgacgactacgatgagcatgcgggatnggctgctgatcgtaccatgtctgactagaatcgtctatgacacctgatggctgatgctataaagcggacctactta

SEQ ID NO: 5907 - DNA, 1170 bp, Aspergillus oryzae
  misc_feature (1)...(1170): n = A,T,C or G
catcgactcttgtcctcttacgccccgtgcttggctcgctgatacccgctcgtccgctgcctaatcgcctcataaccactacctctcaccatgcctagcgccacgggagagaactgggagaagtacaagaagaacttcgccgatgatgaagagccagagaagaagatcacccctctcacagaatctgatattcaagtgctgaagacatatggcgccgctccctatgcgaatgccttaaagcaactcgagaagcagattaaagacaagcaagcaagcgtaaacgagaagattggtgtcaaggaatccgacactggtcttgcacctccacacctttgggatgttgctgcagacaggcaacgcatggcagaagagcaaccgttgcaggtagcccgctgtacgaagattattcaagatgagaaggactcggataagagcaaatatgtcatcaatgttaagcaaatcgccaagttcgttgacaacctaggagagcgagtgagtccgacggatatcgaggagggcatgcgggttggtgtctgccggaataagtaccaaattatgctgcctctgcctcctaagatcgaccccagcgtaacaatgatgaccgctgaagataagccctatgtgacatacggagatgttggtggttgcaaagagcatattgctaagttgcgggaagtcgtggagatgcctcttgtttccccagagcgctttgttaacctaggtatcgacccaccaaagggtgcacttttgtgcggacctcccggcactggtgagactgtttgcgctcgagctgtggccaaccaaaccgacgctactttcattcacgttattggtagcgagctggatcacaagtatgtcggcgagggtgctccgatggctcgagagctgttcgagatggcctgaacaacgacggcgtgcattattttcttcgacgaaatcgatgccgtgggtggtgcactgtttcgacgactgtgctggcggtgacaacgaagtgcagcgtactatgtcggaactgatcactcaacttgatggtttcgatgctagcggtaatatcatggtcatgttcgcaacaaaccgaccgtcgacgctagatcctgccctgatgcgtactgtacgaattgaccgcgagatcgagttgtcgctttcggatgtananggtcgaactgacat

SEQ ID NO: 5908 - DNA, 1220 bp, Aspergillus oryzae
  misc_feature (1)...(1220): n = A,T,C or G
atatcttcatcaactcttcagactctctgcacgcacatctcgtcgatgtcgatctaatcaaccctttctcaatcatatattatcccattttttagtgactggtaacagcaccgtcgcgcttatgcgttttttctcgaccttcacttctcaggactacatctcggatcatctctggaaagcttccggaaactactgaaacctttgtttcaagcaccaactgtacactcttctactctaaactacttgacataacatgttcgctgcccgactcttcaaggcaatgcccgccagggcctctgccttcccttccgtgaacgcttctatccagtctcggttcatggcaactgtgcgtaacggtcgcgttgcccatgagcgtgccaccttcacgatccgagatggtcctatctttcacgggaagtcgttcggagctcgctctaacatctccggcgaggccgtcttcacgacttccttggttggataccctgagtccttgactgacccctcctaccgtggtcagatcctggtcttcacccagcccctgattggcaactacggtgttccctccgccgagaaggaccagcacggccttctcaagtacttcgagtctcctcacctccaggctgctggtgttgtcgttgccgatgtggccgatcaatacagccattggaccgccgtccagagccttggcgaatggtgtgctcgtgagggtgtccctgccatctccggcgacgacacccgtgccattgtcacctacctgcgtgagcagggttcctctctggcccgtatcactgttggtgaggaatatgacgctgaccaggatgaggctttcgtggaccctgagcagatccatctcgtgcgtcaggttagcaccaaggctcctttccacgtgagtgccgccgatcctcagtgccacgttgccgtcatcgattgcggtgtcaaggagaacattctccgtagcttggtcagccgtggagccagtatcactgtgttcccctacgactaccccatccacaaggttgcccaccacttcgatggtgtcttcatctccaacggccctggtgaccccactcactgccaggagactgcttaccacctgcgccgcttgatggagacctcccaggtgcccatcttcggtatttgcttgggacaccagctgttggccnttgccattggtgctcgtaccattaagttgaagtatggtaaccgtgctcacaacatcc

SEQ ID NO: 5909 - DNA, 684 bp, Aspergillus oryzae
  misc_feature (1)...(684): n = A,T,C or G
gaccaacatgggggaatcaatgcatcgcaaaatcgaacttcaagcccccgccgatttcacatacctttatggcaacactgtcgctctctcacgccaaaaactcgaccttcatttaccaccctctgcaaaccctgaagatggaccggatccaatgcgcgagcgggtccgcgagctagtcgatgagtacatattacgtaccttcacatcggcttcctcctcgataagtatcaacggccttgactcttcatcgcctcagtttccctttccggctgctttcactgcacctgcggagacagtcgagtacgaaccatatgacgggcatcttgcatcacgtgtgacttcgctctacgcacagttagaatcgctcacgacgacagtcgcacagttaagacgggatgcgccgcagcgtgcagcagagatgtatgcagcggaactgaagaaggtgttagaggaggacgaacatgatgacttggaagatgaggaaattctggaaaatggagaaaacaatgaaaggcaaacaacagaagacgttgacatgcctgatgcagaccagaacctagagcagacttncgagcatggtcccagtacgactggctcactccggagaacagcgaanacgaagtggatntacatgtgcccctggcaccgaccatgaagcgaactatggcgcactggagagatggg

SEQ ID NO: 5910 - DNA, 695 bp, Aspergillus oryzae
  misc_feature (1)...(695): n = A,T,C or G
ccccacagggctgtatctaactattacgatacttcccgagccgcagaaagctaatattcgcgatacttcgaccccgtattctgttttgtcgccttaagaaacccctctgagaaccatgaatcgaagctcttcgacccggggcccgttgccttctagctcccatacaatacaagcgtcccacccccgtcgccgacggccctccgaccctgctgagtcttcagaaacccaaggcgagggacgaaaacgtcgccgtttgagtagctctaatgtagcaactaggagtgctcaatctgcattggatcaccacgacgatgacatcgaatctattgatttaacagaggtggagggtccctcagcattagcgaaggtgctagcgaagcaacgggaggacgctgttagggcccaagaatctgttgagccggagaaggggcaatcaatattaaactcatataagtgccctgtatgtatggatacaccggaggatgccactagcacaatatgcgggcacctcttttgccacaagtgcatcatcgacacattgaaattcagcgaagaacanagagcagatnacctcttcaaaggtcctcgaggaacttgccccgtgtgcagaanaccccttgcccggaacgacgcgccangctccaaaaggaatctggtaccttttacactcaaacttgtcacgaaaaagaggaatn

SEQ ID NO: 5911 - DNA, 665 bp, Aspergillus oryzae
ggggggaaaaaaaaaatgaatttggttttttttttgggggaaattttaaacccgcccccttccgttttggggcccaaaaaaaaaaaaaccaggggggcttttttttgaaaatttttggggcccggggtcctttttggggggaggggggatttttaaaaatttaaaagggcttcccccagggggcgatcccggggggggatcattttaaaaaattaccccttttttttgaaaaaccccttttttgttggggttaaaaagtttgccccaaaaatgccctgggaaaaaacccccaagtttttttccgcggtggggggaaaaaaaaacccccccccctttgggggaaaaaggggtgggggcaaaaaaaagtggggaaaaagagggttcccttaaaaccaaaacgggattggggggaaaatacccccaaaaatgttccccaaagggttttaggggaaacatgttttcgggcgcggggataaaagcagggggttttgtttttttggggaacccccaggggatttgggaacggggggggttaatgggaaaaactcttttaaaaaaatattctcatttcccctgaagggggggcaaatggcccagggggggcaaaaatatcctgttttaatttggtcaaaccgggttgggttaagaatgcgggaaaaataccc

SEQ ID NO: 5912 - DNA, 672 bp, Aspergillus oryzae
  misc_feature (1)...(672): n = A,T,C or G
gcctcgctctcaatgctcgcataggcgcgagttgctccgtatttaaccctgtcacatccatacgctcctgacatgacgccgttactatcgccaattgaacattatagttggcccctcttcgtacccctcctcatcgcctttgccgcccctcctgtgaatcactcagtggatatggcttcctattcgaccggcagcgaggcatttgcccgcgaaaagctctcttctactgcggaacagtccacttccccgtcatcgtgggcagacaagtaccgaggggctactgtcgaagatctggacccccctccggcactgtctgtctcacctaacgacttagtctcctccgccatgctcgcagcctacgaacgtgatttcactcatttaacggtcacctcttctacgaaacgatccctacttggctacctcagcattccccggctcaagcagcttttgaaagaaggaactatcaaagaatcagattccgtgtctgctgccatgcagcggtttaaccggaagcggggtctgtaccaggtaatcacaatggagactcccttggaggaantagagcaattcttcgagagtgaaaccggtccccaatggcgaggggcgagagaaaacagagtttgcgtgggtacagatgcttcgcggaaatcntgctcggatggtgaccaaggg

SEQ ID NO: 5913 - DNA, 650 bp, Aspergillus oryzae
cttgttcgcacacattgtatgaggctggtatgctgcgatacgcctcgatagagatcgggcctaactgggcggattttgggtgtaccactagcttcttggcccatgcagcggcttcctcagcgggaaggtcgttgaaaaaaaaggtcgctgggtcagggacagtcaacatccccttttcatcctagaaatgcttattaacgagtgcatatcagttaaggtaagcgactacctacatcgattgttatgaaaggaggcaattggccgccgaacatacccgcgaggctgttgccactagggggtataaaagcagtcatgtagatcagacggttgatcgccagtccgtctagggcatcagtgccaacaattccgccataggagtgcatgaccgcgacaacagactttccatcgtcaatgagcgactgtgccgtctgtcggatgagccccacgtcatccgacaatgtcttcggcggggggtaccttcttgttgcaggttaaaaggcgaggacagactgatttcttacccaagtcttcaaacgccttgcgtacgggggattaaattacggtgatgccatgcgcccggaatgacaaagatggtagggccaggtatagttgtaccagcatggttgtccgcgaaattttgtaaaaaaaat

SEQ ID NO: 5914 - DNA, 872 bp, Aspergillus oryzae
gcatgccgagctggaagctcttcgggagtccaaggctgccgagactgaggccgagcacagtaaggcaattgaagaactccttactgaccacgaagagaagctctctagcgtccgagctgatctggaatcctccaacaaggctaaggttgaggagcttcagaagtcacacgaggcggctctcgcggaagttcatgagcagctttctcacgcgcaggcagctgcccaggatagctctgtcttggacgccttgaaggccaccattgcggacatggagaagaagctgtctgctgctgagcaatccgttacggaatcgaaggagatcgccagcaagcagggtgctgagctttccaggatcgaggccgagaagaatgagtgggagcagaagcaccaggccgtgagcagccgggcgaaggagctcgaagagttggtggcggcttctgccagctccaagtcggaagccgagacggtacagcagcagctgtctgcgtccctggaggagctgtcgcaggtcagaagcaagcaggaagccatccacattgaactcgacgagctgaggacgcagaaccgggcgatggaggagaagctcatgcagggcgagagggacctgaacgatcagattgacaagaacatgtcgatgctcaaccagttgggcgaggtcgattcggcgatctcgagcagccgcaagcgcattcgtgagctcgaggctgaagtggcggccctgaaagccgaaggcaagggcgcaggccttgacagtagccggtgggcagcccaaagcgaaaaaggcccctggtggaggaaacgccggtccggcctgcacggaagatagcaagcattcaggaacagcttaagcacatccgcactgacaacgatga

SEQ ID NO: 5915 - DNA, 677 bp, Aspergillus oryzae
ccgttcaggaatggattgacacctccgccggactgggtgacttcagcaacctgctcgcgaccgagaaggccgacaccatgcgccatctcttcggtcttcatcgcgacccttacatgttccaccaggccaatcttcgcaatgtcggcgttgacccggttgagatcaacggtgagactggccaatggtccatcatgcaggcgtgggtggaaaccatggtgcaggaattcgtgcgtctggtagactggcccatcgttaccatcacccaccaggagatgtccgccaacttcctcgaccgctacaaccgtgatcagtgcaactactcgctgcagtacaccatcggcaacaagcagattactggggtgactctgagcgccaaggacaacacttgcaatgcgcccatccccgtcagcttccctgtcgcccccaccgacaccaagggcttcaccaccgaacagtacggcagtgacccactcaccgtctgggtgcagctgtcgggctcccccgtcactttctccctctcgacccctattcccttgtaaatggattgaacgatattgaattatggaacggctttgaaggattcctggaccataatatctaatgttattaatgggttccgggtacgatttcgaataggggaagagatgaatgaaatgttaggtacatacatacatact

SEQ ID NO: 5916 - DNA, 647 bp, Aspergillus oryzae
caacaagtccagctcgttctttgacaatatctcgagtgaagctaaggatcgcgaagaaggctctgccgctcgtgccggtggccgcgagtggcgtggtgaagaagagaagcgtaacattgaaaccttcggtcaaggtagcgtcgacggctatcgtggcggttaccggggccgtggcagaggcagaggatatggccgaggtcgcggtggcggctatggtcgaggctactgtggccgtggccgtggtggtatgcgtggaggccgtaatatgtctcagtccactggcgtccctgcccaaaactagtgtcgtcttcggcatcccgacctgattgatcttcagtcgtatttcttgaaacgcttagcgttgaatattccctttattttgccttttctggaagtgatgcgtgcttccacggcctgtatctgatattacccggcgtctgatggtaccttctcacgaatacttggcatacagtcaagatctcctcatgtttgggatgttctatggttacggtggggattggtgaattacctgctgggatggttttgcgttgcgcggcgtcgaattatggcgttctacatatgttgcatgggttggtcatggcctccattgcattgatcacatatcttgatgatcatcatgtgttggc

SEQ ID NO: 5917 - DNA, 887 bp, Aspergillus oryzae
atcagtcgctctttttttaccggtcattcatttagtactctcttttttcttcctaaactccttttgtgtcaattgattcaggggccggataccaccaagccacaaaaggaattaccgtaaaggaaccccaaaagaaagacaagaaaaatgcgttttctgctcccctttgccattgggctcacccccctggcttccgccctgagcatcaacaagccgggcgccaactcgacctacgccgccggatctaccgtaacggtcaactggagtacagtggacactgaccccaccgaaatcagcctgtacctgtggaactttgtttcctggcctccgtcttacgttcctctggctcagaatgtgcccactgccgatcagtcatactcggtgcagatcccctgcgacaccaaccccgaatggggttatcagatcagcgccatcaacgggaccaatgtctacattatctacgcgcagggtgaccggttcacggtctcagatcctgtaaatggcaccagctgatctgaccccgtcacgccacccccagcttcttccaccggtgctcccaccacggcgttgtctgcttattttgtcacgactccccccccccggccctttgcaaagtgcccccaacagggcccgggctccggtgggccccaaatcccgtggcacgagacatattttgcccaggggtaacttgcgcccaaagtgtggtcactggcgaagcaaaggtcgtgacgatcactattacggtgtccgtacctgctgctccgggagacgaccaatgtctttttgtttgaacacggctatgctgtgttaaagattaatcttacttcttcgatactatgtatttgtatactcgtttctgaatggagatacggtttcaccatataaac

SEQ ID NO: 5918 - DNA, 651 bp, Aspergillus oryzae
  misc_feature (1)...(651): n = A,T,C or G
caactgcacagaacatttcacctcacaatgggtctcatcaagggagtcctgaagctcaccacctatggagggctcgcctcggcgggcgccttcttctacaccacgcgcaatgacgtcttcgtgcccatgtcgcccacggatcccatcttccagtccgccgcctaccgcaagttcaatcccgaacaaaacccaaccacccacgacctctgcgtgcgcaaagtacctctgtccgacattaacccgaccttattagagaagaagggcaagctggccgaagccttctgtgctggagtctggagcggctggggatatgccttccaacgtgcctacctcgcccggaaataccaaggtcccgagaccgcgaaccacctctgggaacggccagaactgaaggcctccacttacgatgtcggcaccctcattaccgaccacttcgaggttattgagaagacccccgagcggatggtagtccgctgcggtgacagcccccgtaaacaggactgtcgcgattcagacggnnctctcgaaatgtncgcccgtcgtaagcccgagaagggagtgcggagttgctttcagagcttgtctacaaaggaaaaggaggctgacagccaccgatgccgccgatatttctggctgataagcagataccaa

SEQ ID NO: 5919 - DNA, 672 bp, Aspergillus oryzae
  misc_feature (1)...(672): n = A,T,C or G
ggaatttcatatatgcgagcgttcattgctctttgtatttaccgctatcttcgccttattgtgaatcttgcatctttctggaccttcaagccaattctcccaccagagaacccgaggctgaccgcacaagatgtgactgtcatccttcctactctcgagggatgcggtgatgagctggttgagacaattagaacaattctcgacaaccatccttatgagctccttttagtgaccatcgagtcaaatcggaagaaagccgagagaatgttgagcttgatgcccgcttcaaaaccgagaatccggctttttacggtcacgcaccctaataaacgccgccagatgacgagggccattccagaggtccgtacgcctattactatcttcgctgatgatgatgtgagctggccgagcacagtactcccttggattctggcaccattcgagaaggatgagcgatacggaggtgtagtgacatgccaanggctncgtcgtgcttgcacactcacatttttccagagagtttggggctttttggagctctttacttanagagagaaactntgattgcgcggncacgacgcatgtngatggaggtcttccntgtatgtcnggtcgaactgttgcgtataggacggacattctgcaagacgaaggctttacttatgctttacg

SEQ ID NO: 5920 - DNA, 548 bp, Aspergillus oryzae
ttgattgactacattgtttttccccctccctccacttggttacgccgcaatgacatataccccggtggattctttcccacccaatgtagcaatgccaaccacggctgagcactagtcgatttcctcaaggaatcgatgctcaggtgaatgaccgggggaccatggaggcctataaataccccgctgaggtgccatcattcttcgaaggtccccaacccatgagcaccttgttcgcttgactctacaccaatcaaatttaattgatccgattcgtgacatcagaatgcctttgtccggccactgtctgtgtaaagccgtcacctataaggctgacgtcgaggcgccgctcatcaccgcatacgatcactgcgacgattgccagcgtcagagtggatcaacctattctctcgtcgcggtagtacctaaggacaaactgacgatcaatggacccaccaagagctacgcaggacagggatcatcaggcaaagcagttcaccggattttctgttcggaatgcggctcccctattgcccacgacctagagctgg

SEQ ID NO: 5921 - DNA, 719 bp, Aspergillus oryzae
  misc_feature (1)...(719): n = A,T,C or G
cacggtagtcatttgacacctcagttcgacgatatatgcagtcaaaacgatattataccactctgtatgcctgcgcactcatctcacctacttcagccgcttgatgtaggctgctttggccccctaaaacgcgcgtacggacagctggttgagaataagatgagattaggcttcaaccacatcgataaacttgactttcttgaagcctttcctcaggcgagagctcagatatatactactagtaatatctgcagcggtttctcagctactggtcttattcctttcaatcctgagcgtgtattatctcagctgaatattcagctagaagcaacacctccaggtagtagacctagtagtaggtctactaattcagtgcctaaaacgcctcataatctaaagcaactacaaaaacaggaaactacactgaagaagctgcttagagctcgtacaaagagccctgattcgcctactaagattgtgataaagcagcttttcaaaggctatgaacgagctttaaatgaagctactattgcaaagcaggaagccagagaactacgcgccgcgcatgaaagaatgcttaaaaagaaaaagcgctctactagacagctgcctatagaatcaggcgcttcagttcaggaagctcanggagcttatacagggcagaaattctactgtagagcctataactactgcctcagtagatatagggcgctcggtag

SEQ ID NO: 5922 - DNA, 735 bp, Aspergillus oryzae
  misc_feature (1)...(735): n = A,T,C or G
gcagtcttttctaccgtacttacacggacagcgagaagatggttggtttgacggttgttgaacgctttgagaagccaatgcgacaggatacgattggcatgagaaagggtacttatgataaactggacgaagatggtatcattgctcctggcgtacgtgtctctggtgaggatattattattggtaaaacggcccctctagctcccgacgcggaggagctcggccagagaaccaaagcccataccaaactggacgtttccacgccccttaggagtactgagagcggtattgtggatcaggttctggtgtccaccagcaatgatgacttgaagttcgtaaaggtccgtatgaggactaccaaaatccctcagattggagacaagttcgcttcgcgtcacggacagaagggtaccattggtattacctaccgtcaggaagacatgccgttctctcgagaaggtgttgcgcctgatttagtcatcaaccctcacgccattccctcgcgtatgactattgctcacttgattgagtgccagcttagtaaggtatcagccctgcgtggctttgagggtgatgcaacaccttttaccgatgttactgtcgattctgtctctcgtctacttcgcgagcacggctaccagtctcgcggattcgaggtaatgtacaatggccataccnggccgaagctagtggcgcaggtgttcttgggacctacgtactaccaacgtntgcgan

SEQ ID NO: 5923 - DNA, 667 bp, Aspergillus oryzae
cagtggtgtcaacagtatccgcataatttccatccttgccgacacagacttctctctcacctgccgcgcaatccggcatttgctctactacaattgtctcttcctcctcgacatcttttctttctctgcaatttacgctaccacagctcaattcagctcgacgattgcctcaaacgaggacatgcagcgagaatgcgcacgctatgtcaacactctctttgcatcccctgctgccgtatcaaccttcgcgaatcctacccgaagctatgacccagacgctgtatggccacccctgggtgaaatcgtcacaggcactaccgccaacgtcgacatagccagcagcattggcagtgctagttccaggagccctagcccagctcctaccatcacagcgccaggtagcacagcagcgacaatagaggaccaaccggaaagagaagtggtcgacggggtcgggctagtcgagctttacgccagcctcaaacaaggccaaagcgtcaaacaatggtatatgcaccatagccgacaactagcccacatcgacatccgtcgcttcatcacctttggaatcatcaaagggttcctataccgtgtacacaagtgcgcctacgcgacatgttttcccgctccaccctcgaaatatcaccatcaccaccattatcacagg

SEQ ID NO: 5924 - DNA, 1175 bp, Aspergillus oryzae
  misc_feature (1)...(1175): n = A,T,C or G
cttcaacacaatccccagtccatcataatcaaaccaactccaaaatggtcacaccccagcaatacccctggaaacccaccacccccgaaggcgaaatctggcaatctctccccccagccatcagcagcagtgcagccgccaacctcacccccgaagaaatcaccagtctaaacctcgacccgagctccccaaacgcaaccaaacttgtcctcctcgaacaagcccttaccaaaaagctgcagtgcctcgaaaacgctgcaaaacccactcctctctatgagaaagaccaccccacctggcagagcttgaaatccgctctcttccacatcaatcgcagtaccggcgacctcgagaaacaagaaagtcttttacttgagcaagtcaatcatcccggaccgaagggaaaggatctagctgctttgcagaatctggctggactttatgaggagaaaggagagtacaagaaagcggagaaacttgcccgtgagacgattccggcgctccgggaacatcctatcttggggagtaatagtccgcaggttcttgggtctttgaggatcttgattaaggatttggcggggcaggggaagattggtgaggcggaggaggttatcagggaggcggaggagagtattgagaacttggcggagggtcagtttgcggaacatcagcaggaggagagggatgcgctcgagaaagttgttgctgggttgaagaagtgagggatttgtggatgcccaagaaagtgaaacaggctcaagcccccggctccgccaaatcaatcaccgtgaacttaaaatccgcgcggaatcctgtccttgaaatcaagctttccaacaagcctatctctacgacttccgttcaggacctcaaggatgcagtgcgggaccgtgtggtagacgctcaatcgaacaagattcctctggacaagatcaagatcctgtataagcgcaagccggttacggggaagactatctcggagatattggctgatgagccggagatgctggctggtgggaaggaagttgagtttggggttatgattatgggtggcgcgaaggttgttgatgaggatcangagatggttgatcgtggtgcgtcgcccaaagctgctcttggacctattggggagagtgttctggagacagacgacttctgggaagatctggagggat

SEQ ID NO: 5925 - DNA, 677 bp, Aspergillus oryzae
gtaatccaccactcttgacagcacttgcaagggtttctgatcgcctggaatcgcatccatgggtcgcttcctccacgataaagatcgcagagctcccattctcaatgtagtcaactggttcctcctcgtggtcgccgtcctcagcgtgctcacgaggctcggcacgaagctgtggatgttccatcgcttcacaagcgatgattacttgattatagtatccctgctattcgccatcggaggatcggtcagtatgtcagtcgccgtccacaacggctatggcgatcatgttggggatatcgacgctttgcactgggaagcaattcagaaggcacagtatgcgggattcctggtgtttaccttaagtctctacttttcgaaactatcgctgtcagtctttatccgcaatctgacgcctgtatctcgagaccactttcatgcgaccatcctgcaaattctgttgaccatctgggcggttgttgcactctttggcagtgccttccagtgccaagcctcgcgaccctgggatactagcggcacatgcattgatctgaacgcttggcagtactatttctgcgcctccaacatcgtgaccgacatctttatcatcgtccaggcgctggtgctgatcaatcgcatccaagcgttgttcaaaaataaaagcggtgtttgccaccatg

SEQ ID NO: 5926 - DNA, 668 bp, Aspergillus oryzae
  misc_feature (1)...(668): n = A,T,C or G
cgagaattgaacaagcagtatctttggattgatgctctctgcatcattcaaggtgaccagaaagactgggaggaggaaggtgcaaggatggacaaagtatttgcctctgcatactgcacgatcgcgtcaagttcagcatccggttggcatgatggcttcctcaatcgcactcagaatttctgtcaatcagagggagtcagctccgatcaaaagatcattgatgacttttgtaagcttgttgatgaaggccaactgcatacacgggcctgggtgctgcaagaaagagcgctttctcgccgaactatctatttcactgcacaacagacatactgggaatgtggaaggggagttcgttgcgagaattttaccacattaagatgtcccactactagattatatctacttgactcacggtttcctgagcggctcgtactcgcaggttataaaacgggcagccttatttctccaagagcttatcactgactactctcgtcgngatcttacttttccgaaaaggataaggtagttgaattttccgcatagctgaacgtattaaggaagtctagctactgaattcagatacggngtctttcattgctttctttctcggctcctcttgtggaagcggctggaatgagagtgatcaaatttttacgacaatgattatg

SEQ ID NO: 5927 - DNA, 468 bp, Aspergillus oryzae
  misc_feature (1)...(468): n = A,T,C or G
gaagaagctgaagaaggctaaggaagcggaggacagcactaccgatgagaatgagaaagctacacgcaagagcaagaaggagaaggaaggaaataacccagaagaggactatcctactccgatatcgatcgagaacgaccagacagagtctagtggacgtgaggagtcctctgattcgatagaaaaatccaagaagaagaaagagaaaaaggaaaagaaggagaaagagaaggataaggaaagcaagaagaggaagaagagtgaggagtcctcacctgaagacggctcgaaatcaaaatcaatgaagtcgaaggatgccaaaaagtcaaggaaggagtagatttgcttttttcaggatatcattttttgcttacggccgtacatagatagatacccatttgctacagctactgcggtctttatgaagattatattacatatcgtgtcnnnnnaaaaaaannnnannnn

SEQ ID NO: 5928 - DNA, 576 bp, Aspergillus oryzae
cgaggcaccagtgaccccggagcaaggtcagacagtggctcggcggatgaatgcctcgtacattgaatgtagtagcaaggaaatgcgcggcgtggacggggtattcgaaatggccgttgacactgttgtgtcggccgaagaacagtttagctggaacaaccgtcaaaatcatagtgccagtggcaaagctactggaggtggcggcggtcctaagaaggtcaagaagcgtacatgcaagattttatagatcgcttttcttgtctctcgacgtgtcctatggcccccttatctttgcttgatatgttactgttccccgccgaaagaagcctggttgcttcggcgctttgcttctccttgtacgtgatatgaattggatacgacctggagaggatggcctacgcggtccgacccattatgtgcttttctaactattttgttaacggcggctttttgatttttacatcttcatgttgctatacctgtttttgccttgatgattgtcttcatgaaacactattacccttcctttatgtctactattatttgtctgagaccttgaatttttaaaattgcatg

SEQ ID NO: 5929 - DNA, 654 bp, Aspergillus oryzae
  misc_feature (1)...(654): n = A,T,C or G
catnctcttgctagtgctctttcttctctgagaattacgttgttggtatatcagggctatatacttgaattatatattttcgccttttcacttccattctaatttgctttaaacaacatgagcgacaagaagcgcaagatcgtcgaaaacgcccccgaggaggctattgagccccacggaaagaatgcaaagtgcgaggagaagaacgagaagaatgagaaaaagcgcaagtcgaaggatgtcgtggaagatgtgaagatggaggataccggtgttgaggagcagaccaaatccgacgagaaagataaaaaggatcttaaggacaagaagggctagaaggaaaataacgagaaaaaggaaaagaaggtatacaacgagaaaaaaaacgaaaagaaaaaaaataatgttatagccaagaagatacccccatgttaaacgggcccagaaaaaaaacaggaacccgcgggcaatggtttggaataaaacccccccggagaacggggccaattggtaaaaggccccaaaaaaaagacccggagagaaacccaaccccgtaagaaggcccaagggaaaaaaaaagcccgggttaaaaaaccaaatcttgtttaaccgggcctttatttagggcccattttttttaatataatccccaaa

SEQ ID NO: 5930 - DNA, 675 bp, Aspergillus oryzae
ttaatcgcataagatatcatacactcggagcgtatctcgctagcattagaagtgtggtttgacctcactgttgtttgcatgcgaaccgttcccctttcagcagccccgattttcgctcagataccgcagtcatcgactcagcctcccccggatctccacaaaacacttttcatgctcagtggatcctgttaacactacttcgcttgatctcttttgaatcgacgcggtgtgagcagccttgcgctcatggggttgacgcagcgaatctcaaaatggctgccctcttcgccgagtctccctgtggatgacgtttcgcgcgaaaagggccgcaacatttccaggttcgcgtttttcaagagaagaatacgcttgaagggcaattcatcgatttctataccattgggatttgttttactatttccatgccttgtaatagtcctggttttgcttctttttgtccgacacccttcttctcccggtggtattctaatcccagctggcacacctccatctataagaaaaataagtgaaaagcatgacgaggtcttcgcctcgggatgtctgcaggtcgagaaagaggttgagggtaagcgtgcgaatgccgcgtttgtcgttctcgctacgaacaaggaattggacggaggtcttcagtctttgaagtccatcgagagacat

SEQ ID NO: 5931 - DNA, 682 bp, Aspergillus oryzae
  misc_feature (1)...(682): n = A,T,C or G
ttgttatggttaacgaagatgaggaagatgaagaagtacccgggtctgactccgaaaattacaagcagcctaagaagctgaaacaaagaagggtatgggtaaaccaaattatgggtcggcgtatgcgaatggagtttgctgaagatgcaacaacacggtacaaaaagcgcttcgggaaggatggcgaaggcaagaaaacacaaactacagatgttcgtgggacagaaccgttcgacgatcaggatacaaccggaagacaacctcaaagatcacgatctgcaaagactaggcagggaaggacggattactcaagatacgaccaggaaaccgtgcaaaagcttagtggtgccattgttgagtctcagggaaagaagactacgttcgattgaaatagcctgggttttttttctttgaaggagataagagagtagttcgtggctagtaacgaatgaagatgttgttggtgcccatgagctcctcgaggtgagaaacgaactacaggcaagagagttatccataatttcagctcatcccgatggatctgccgccgttcggaaagactngacattctgcatggtaatgatgaacaatttgctccaatgcgggcacttgttgaaccagctggcgaatagtgttccagattattgatacccaagagcagcaatacgtatctaaaataaaa

SEQ ID NO: 5932 - DNA, 676 bp, Aspergillus oryzae
cgccaagatacataccggtgacaaaccatatgaatgcctctgtggtaatgtgttcgcccgacatgatgccttgactcggcatcggcaacgcggcatgtgtattggcggctacaagggtatcgtgcgcaagaccaccaaacgcggtcgtccgagaaagcaccggcctgaaatggatgaaagacaagagaaatcctccaggacgcgccagagaatcgccgaaaagtcgtcatttgactcttctggatcagacacttcgcacaattcgccgccctcggaagtcttcgaaaacatgagcctgcagggttctagtccggtgggagaaatgccaatgttcagcaatgttaattattcattgccccctgagggcctgactttcacacttccggctctcctggcggaactataagaaacaaaccatacctgtccacagcaacgaatgattacacccattatttgagatgaaatgcgccatagtatctcttcattcacctcctgatcgcaactctgccccatgactctcgtgactaatgacactacttgtaaacctgttaacatctattcaacgtttcgttctacactacctgtactcataccattttacgtctcatgactacacatcccattatcccatcttctctattcatctgcatacatctactatagttactatgttccg

SEQ ID NO: 5933 - DNA, 730 bp, Aspergillus oryzae
  misc_feature (1)...(730): n = A,T,C or G
gatcgcttctcctaacgtgagaatccctttccctaccgtcatgctccccgacagtcactggagtcgctccgctcggaacaatttctttttttcaatgcggctcgggacaccgtagcatacggtttctcccactcattactggatttcactgacacttggaaaggcaattggcgctgccaaagatgctgcccgtatggaccgcgttgtgaacttctatgcccgccttccccgtggctcggctcctgaagttaagcctactggtctcattggccgctaccaggctcgttacttcggcaagaacccctctgctgctcgtaagtcgtctcgctcctaaagttatatatgatattcgctgatggccaaatagcccttgctcacgccatcggtggcattctcctcctcggctacagcatggagtactacttccacctccgtatgttttcctttctataccatactctgagcatcgagagtctaacacactcctaggtcaccacaagaaccacccccactaaattttctcgctatgatttgaggggcgcggaagattcgtgtatataccgctgacctagaatgaaggcaatgtagaacacattcaagcttattatgtttcacagatgcctagtttagtagtgactcaccattgtctctagatcatttagcattgtgtcatagtatgacttgacaatgaatcatatcttgcgctacttcatggagtgatctttaatcn

SEQ ID NO: 5934 - DNA, 1337 bp, Aspergillus oryzae
cattcttcaattgacaatcttcccttgatatatccgaacacattagatcttttgtcatcctcggctatcagttgttgaccttctagcccgtgccttcccataatataacctacaaaccactccgttgggtatcagtgggcgtggcgagaaagaaggcagtaatgaacgtccttaaacttcaaaggaagtacccacagttcgaccagggcgaaatcttctcgctccaagatgcttttagaaagttagatgtcgatgataaaggttacttggacgaggcaaccgtgatcaaagctactcaacaagcagagcgccagccatatgacatcgtacggcaggcgctcaaagaggttgaactggatagctctcgccgggtagaacttgaagactacgtggatcttatctccaagctgcgctctacttccgggcaaagcgggcctaccggcactgccagtcccgccgcggtagtacccggtaatggcgctggatcatctcgccatgtctccaaaggcagcataggcggaagaattcacgtccagggttcatcggcaaatgtaactcatactatcaatgaggatgaaaggaccgagttcacgagacacatcaatgccgttcttgctggcgacccggacgttggtcacttcctgccgtttgccaccgatacgttcgagatgtttgataaatgtaaagatggattggttctagcaaaactgatcaatgatagtgtcccggatacgatcgacgagcgtgtcttgaacaagccaggaaagaaaatcaaggaattgaacgcattccacatgtccgaaaataacaacatagtgatcaactcggctaaaggtattggttgctcagttgttaatataggaagtggtgatatcatagaagtgcgcgaacatctcatccttggcctaatctggcagatcattcgccggggtcttttgggcaaaattgacatcaagctccaccctgagctttatagacttcttgaagaagatgagaccttggagcaatttttacgtctgcctcctgaacagatattgctgcgttggttcaactatcatctgagaaacgcaagatggaatagacaggtgacaaacttttcaactgatgtgaaagatggcgaaaattatactgttcttctcagccaactcgcacctgatgtttgttcacgaggtcccttgcaaacacaaaacttgcttcagcgtgctgagcaggttctagctaacgccgacaaactgggctgtcgaaagtttttgaccccaccttacttgttgcgggaaatcccaaacttaaccttgcgtttgtaggcaatttggttcacacgaattccggtcttgact

SEQ ID NO: 5935 - DNA, 674 bp, Aspergillus oryzae
  misc_feature (1)...(674): n = A,T,C or G
cgccctgtacgccagcacccgggcgcagaatcatcatcatccggtgtgacaaccatttcactccacctagtctttttgtctcattcgaccgcgtcatccctgcggcaccctccgagcaaagcgcagcctctataagtggcagctccgcaaaaacagagtctacatctgatacgcagccgcctaaaaagagatggaatctcttgaaagccatgttcggtagctcttcctcgaaatccaatggcgaggcatcgcctgcaagtagctcggaggagtcattagacataaatgggtctgatagcgctgcatctgccgacaaacgcatggatgagatttcccggtcaaataatagttctggagaactctcccgacccaagacagcacaccagccttactccttcaagttctcattggagtggatggaccggccccaatggcccagcaaaaacaagcgcctcttcactccctgtctgcctgtggcagcccagctacacctgcagcttcgtagatctgcggacgcagacgacgaatctgagatagattccgaggaagaagctgggagcgatgacgcccgagagggctcaccatcagccaaggagacagagacctcaaaagacaccaacaccggctcggaatccggnaanggttccagtanaccagccccggnagccngcaan

SEQ ID NO: 5936 - DNA, 850 bp, Aspergillus oryzae
  misc_feature (1)...(850): n = A,T,C or G
cttctatatctactgtactacctactatacattactgattgaagaattgtgtatttggtgatcggtacaatacttacatacaatcataccaacaactacaactacaactacactacaacaaccacaaatccactcaagtggaaagaagcaaaatgagcttcacaaaaaacctaacccgagccctaaacaccacccccctacgacaacaacgcagcacaaccactttcccctacgccacgcacgagcccctcgaataccaactcagcagactctctctatcaaaaatcaagcaagagtctgcccggccagagcccgacctgcgtcatgtcgtcgggtatgcgtcggtgaatcgcgccgcgggggataagatgtaccagaatctggtgcggggggtggagcttttacggacggagaggagggcgaagtatgctgctgggaggagtaaactttcttcctcttcttctaatacttcctccggagggaaggggaatggggctgggattgggggattaggggtacttcggagagaagaggaagtggtggagacgaggtgttttggggagggcgagttggagggaaggggacggcggaggaagaggagctcgaagaggttgagggaggagcgggtttagtagctctgaggatgggatagctatgagttatgaaggtatggtcatgtttttccctgtcaacctgtgtggttttcaggagttctctgtttcttgggttggcgtctggctggatcggattgtgattnttatagtttcgggaaaactatgatcaaaacgttattcgcattaagcgctgcngtgtatgagtctcttgatagcatgttaattcatttgagtaa

SEQ ID NO: 5937 - DNA, 750 bp, Aspergillus oryzae
  misc_feature (1)...(750): n = A,T,C or G
cgaggctcgattggcattcctcaacgctgaggcagcacttgaagcccttcccaatatcatcgacttgatgagcgaggaactcaattgggataacaaaagaaaagacctcgagtggaaagagagtgttagcttcctttcgtccatggggcttcccaagaatttccttggattgtccagggcgcaggtcgaggcgggcaaagtgaagcaagtggattctgcggaacaccaagcgtcctccagaactgacccccccgcagatgtgctcaatagcgacctccaccccgagacttccgtggcttctgaagcatcaagtcgcttgataagttcagaatctgctgcaaacaaatagaatatcatgatatatagagcggatgtgtataagtgtataataaagttgtcataacgganganaaannnnnnnnnnnnnnnnnnnnnnnnnnnnnnnnnnnnnnnnnnnaaaanaaaaannnnnnnnnnnanannnnnnnnnntttttctgggggccgttagaccttgctttataagggcccaatttccccttatgggagtggtataaaaatcaactgcccgggctttaaaaccgtggggatggggaaaacccgggtgtcacaaacttaaatcgcttgggaacacaatcccctttttcgcaggggggataattacaaaaaaagggcccccccggttccccctttccaaaaagttggccacctctttatttgggggggttagggggttcacacctctaaaaat

SEQ ID NO: 5938 - DNA, 731 bp, Aspergillus oryzae
  misc_feature (1)...(731): n = A,T,C or G
caagcgcactaagaaggtctgtatcacgggtaaatanggtaccaggtatgctcttgcgccctttcgcctagaaatcgatatgaagccgatcgcgttcctattccgcacgattaaatgaaggattcgaaatcgagctttcgacgaattggacaatgtattgacgacatgatttaacagatacggtgcctccctgcgtaagcaggtgaagaagatggaagtgtcccaacacgcccggtacggttgcaacgtttggcggtaagaccacctgctacgcccaggctggtggttatataggacgcgccctgggttataaataaaaccgtcgcaaggctgcgtgcaagcacggacgccatcacgtgggcgagacgaggcctcatactcctcctatatctactctctcgtgaattcaccgaagagatctcgtggcgatcgccccgttagcctagtgatgcatagttgcctacgagtagccttcaatgagcatgtagtcatctaggagttaatgatggatgggctgtgatcaaataattcaagcggtatccacgccgattgagactgttccgttacatgcactgcaatgcaccacttcatctcatggccgttgatcccgtctgcgataccactttgctactaatgtacgatgtagtcgtgtggtgaaactgacagagtgccagcaaactcgtaatgggtacgcgtgctacgctatagcatgtagttgttttgtcgagctg

SEQ ID NO: 5939 - DNA, 683 bp, Aspergillus oryzae
  misc_feature (1)...(683): n = A,T,C or G
ttctttgaaacagacagatatggctgaagggacactcgcatcggcagttgtactgcccgaacaggacaacctccccccatccccggatgctggtttgaagcgaaggaattccgttgcagaagccgactcggagagcaaacgccgtcgccttagctcacaacaagatcacacgggcgaccgatcacctgcggagcgcaaacaatcttccccagatggagcggaacgcaagccggaacggagacccggccgaggtggacgtgaggaggaacgcaagcgtggacaacgtctattcggtgctttactggggacgctttcgcagagctcgacttcggcggctcagaagcggcgtgcggatattgagcggagacaacaggataagcttaagctacaggatgaagagtatggcgagttgaagaagaagagacgggaggaacggatcgctatccggaagaaggagcagagactctatgaagaggaatcgatgcgcacgcgacactcgaatctactggcaatgtcccattttctgaagacaagaactgagcctgtattatactataagccatggcagcttcggtccggagatgaagcgatcatacgtgaacaggttgaagaagcngaagccacaagtgcccgggaggtcgcanaantcgaggcgcgttatccagctcacgaagaagacactt

SEQ ID NO: 5940 - DNA, 734 bp, Aspergillus oryzae
ggaatcgctttttactgccgtccaaacccttattcgtgagacgctcaaggctccacgtcctaaaccaactcactccgatggcaggcaatcaccgaacaaacagccacacttaacctccatctcagaaatacacctaactcccttcgaagagcttcctcctgcctacgagccttcaacatggtggttagacggctactgtcctgcacatccccacttcgacaacgctgatagaatccgactccggacgaaggaagttaagcgtcccctacttcagtacattttagaaggatgtcgagtccttctggaacgagcggacaagaagtcccttcaactctccttcgatcaacacgagacgctgtggagggccgccatctccgtccataagtttggcgttctatatctagccactcgctcagagtgtcgtgaagagttcctcccagccgtggaatccaacttagacctcttcaatgagatggtcaccttcctctcccacgataacaatgccatccgtgccatcaactacggtgtccaccgccttgtcaacagcaacactttcacagtcgactaccagaccaaactcgtccccccaaccgccatatcatcgattggccccaaccacattgccgttcgagaaaaggatttcgaaggtgatagtaccgccatgctggacaattcgttccgcaatctgggacctccatgacttcgcccaccttaccgttgttttgtatgccccg

SEQ ID NO: 5941 - DNA, 832 bp, Aspergillus oryzae
tcccttctctcatcctacctggatctcaaccatacctactctgcaatacctaccaaagattgcagtgatcaccctcttgatcattccccatactcgtccctatcgcaactatgtcggccgaactcacaaaagtcgattctgccattgctggcttgtcaataactcctaagggggagaaagaggccgacaagacggcaaaaaagactcacaggcgccactcatctcagtcggagggcgtctggaacatcaaggacttggaggagaagaagatagagttgactctccccattgaaacgcaaaagaccgggtggaagctcaacacttcaccgtcttcaatcgaggacaaggatatcctcaaactccatctcgtaaaccccccggtgaagaagattgacttgcatttcccgctggggttggaggtgactgctcgtaatctcaagggagtcacaatcaaggacgcgcttgacgctatccacaagcagttcaagaagaaggccgatgatgaattggataacccctaccttgctggttttgagtgggacaaggaagagtgctggacacgcctaatcgtccaccagacaaagaacacgacggtcccacagacctccagtaagaagtccaagaagaagaaggaagaggcatagaacgggcatgcctactggtgtgctaagtgccaacggtttctctcctgtttccttcccggacgtactttccagacttaatcatttctctcatcttgcctcttagcacttacagagcttgttcggtatgtagatgcctcacgtagcttgatttaatttttcaacctcaatattactccacctagtttgac

SEQ ID NO: 5942 - DNA, 757 bp, Aspergillus oryzae
  misc_feature (1)...(757): n = A,T,C or G
ttagctgtatacactactatggtgaataccttggtaacaacccgattccattccggccaaggaaggaatggccattcccacccggggttttaatctcctggcatggtggaacgccgggtccacctttggacaagtcttacccaacttcgttgccgaccatgccggccctttgaacgtcctcacccctgccgccaccgccaccgctattcttgcctttgcttggattggtgtgcacaacgtccctggtatcattgtcttggccattctatatggtctcacttccggtggtttcgtttcgctaccaccggtggttatggctagcatgaccaaggacatccgcaacttgggaacacgcttgggtatggttttctcaaccacttcgttcggactgttaatcggaacaccaattggcggtgccattctggacagcactcataagtatcttggtgtccagctttttaccgcctgctgtctcatcacagcttcttcaatttttgccgcgctgagactgtcacgcactggcttccatcttgctgttaaagcctaaactcaagtgtcatgtctctttctaccangcatacagggcaaatgaggaaacgcccgttttacccttttcggcctattcccgataggaaaagcaagtcgcttcagatcagagctatcaacattccttctccgggggtttggttctctacacgtngtcagaacaaaaaggagggacatgactacctcgggactcactaattaattggcattt

SEQ ID NO: 5943 - DNA, 692 bp, Aspergillus oryzae
gggattccatcccgtttcaattctcacacatttgcatcgatatacatctatcaatattcattctgcaaccatggcagctcaagtactaaccgaaaacacctacctggctggagcccgtaacagtctcaagaaggaagactgtatggagctctatgagaaatgggccgcctcctacaacgaagaccttgccgacgcatcccagaactatatcgccccgctcctggttgcccaagccgccctcgcctcaagcaaagaccccgaggctaccgtattggacgccggttgtggcacggggctcgtggccgaagcccttgctaagggcagcaaatggactattgatggcatggatttgtctcctgccatgctcaaggtcgcagaacagactggcgtgtaccgaagcctcttcaaagtagacctcacacaaccgatcgatcaaccagaccagaagtacgatttcgtgacattgctgcggcaccttcacgcgtggccttgttggcccgaccctgccctgagggaactcattcggcttctaagccatacggtgtcatcgccgtcaccgtccccgaaagaattgggtgttcggcgggtccaaaccgatacctaaatgctttaaaaggatgtctttcaaaagtgatactctaaaccttatcacatataaaaggaagccgtgaataatacaacattgcttcttg

SEQ ID NO: 5944 - DNA, 719 bp, Aspergillus oryzae
  misc_feature (1)...(719): n = A,T,C or G
cataacctctttctaccccagtggttccctcagattattattactcgcatcctcctcctcagcactaactgtggctaacctccatccattttttatttcttgacttgtatactcatatctcttatctaacctaccccgcatcaccatggctgcccccgcagacatcaccatcaaggacctcagtggagagtggacgatggacaaatccctctccaaccccactgagcccattctggccctgcaaggaatgggctggatgaagcgtaaggctctcaacattgcaaccgtcaccctcagcgtccaccaatacgcggacgaaaaggaccccaaggtcctgcacgtcaacatcgaccaaacagtcaccggaggtatccccggcacaaccgaacaccgtattaccgactgggaaggacgggagcacgatgaccacgtcttcgggaaggtcagaggtcaatcccgcttgatccggggctcgaagggcgacgatggaaaattccgccctaacgtggaaatcgctaccaagaccgatgacgaggatgtgaagaagttcctgaagggcgagattctggctgatggaaaggatactgagggcttcgttgctgacaacgtcggtgaagagtatggtgagggcgagagtctcttcctccagagcttgtgcagaacctggacagcaccggccgctggactgctgacanatttgggcttcgagtgatcgatga

SEQ ID NO: 5945 - DNA, 552 bp, Aspergillus oryzae
tggatacgacgtgtcctataacggccgccgtgtgctggaaaggcgacaacatcgacaacaataacaacaataacgacaacgcagcttcacagaagcagaagcagatgccgtcatcaacaaacagccacatcgacaacaacaatgaagcgatcggcgcagaagccaccggcgacatgcaagtagacgcggccccgtcagcaccgtcagcgtcagcgccggacatggagacggaccaggagcatcacgacgaaatcaacagtgacagcgagggtgagagtgagaatgccgccgatcgggagactgtcagcatcactgtgtcgcatcgaggccacaagtttccctttgagatcgaggccgatctcaccgtcaccgacttgttccacgagatcgagaatgttctagagattccctttgagaacatcaaggtcatggtgcccaagggcccatttcttaaggcgacctttaaagattccgaagattaaggtcagaccttggccggaaaaaccgtcaccgtcatgggctcgacctctgccgatgtccaagccgtccagg

SEQ ID NO: 5946 - DNA, 631 bp, Aspergillus oryzae
ccaagtctagcaccaagacatgatatcctttcacaccagtagctcttcatatataatttaagcatgccttccaacaaacatcccatcctctcctacatactattacctctccttctcgccctctccaccattcaaattgtccaatgcgccccatcagcctgcaatggccaatccacattctgcacccgcaagtactcgaacatcacccaactgggcgcccacgacagccccttcgtcggccctctcccacagcataaccaaaacctggaggtaacagaacaacttgacctggggatccgcttcctgcagggccagacccataaagcccttgacaatgccaacaccatccagctatgtcatacatcctgtctcctcgaggacgctgggaccctcgagtccttcctgggcacggtcaaaacctggctggacagccaccccgatgaagtggtaacactgctgcttacaaacggcgatggctttcccgtatcacggttcgacgaggtattcaccactgccaggattaatgattatgcgtttgtaccgagctcatcgccggatgtgctggccatggattcctggccgacaatgggagatctgattagtacagggaagcgacttgtggtatttttgg

SEQ ID NO: 5947 - DNA, 711 bp, Aspergillus oryzae
  misc_feature (1)...(711): n = A,T,C or G
atgagtggattccacctacgatccagtcaatcgtcctatggcgatccaaggcacttttccggcgcctcctttggcgctccgcagcctcccccgacgaaggtactcatggacggataccatggcgctcccatcctaaaaaatgtggaaactccgcgctacaatccattgaatacggcccacccaagaagctctgctttactcaacggcaatgatcctgtgacgatgtatttattgaccgaaactgctatgggtgacagtgcgcattatgaggtcctgtccttggaggaggttgaagggctgaagaaagaattcatggcgctgtctacatcgtcgaaggcactggagtctacaccaccatcgaaaacgcctccgctcaatgcaagggtggcgctaagacggctataatacttgatgattttgatgatacgccaataatatgatgngggaagttctccgaaatccaatcggagtcgcatgagcatgttccgtccgaatggcgcttcaagtaccctcaacaagaccgatggagagttggcaatgaacacccgaaagtgccaggaagctttcgcaagaaagctgtgacctggaaaagtagagttcaagctgatttaaaaaacgtttatctgggaacttaccgggtggccgtccttacagaatacccccttangagaattaaaaacatattccgaggaaaaaaaaaagaaacagaat

SEQ ID NO: 5948 - DNA, 671 bp, Aspergillus oryzae
  misc_feature (1)...(671): n = A,T,C or G
ccagcgattgaagcaattaccactgtatttcctaacgagaaggtaatccgagctacgttgtcaggatgtcgctctctccagaagcccgcgaccaatatgtaccaatcattgactcgatcctggcgaagagcgaccttaatactatctccgagaagcgaatccgtaaagggcttcaggaagaggtcggctatgatcttactccgcagaaggctgtgattaagcagcttatcatggaacggttcgacatctttgccgagaatggtggtatagaagcttctcccgaggcggcggtcgctactgctcctgcgaccaatggccacagctctgcgacaccggtcgaggcttcgtcccctgcccaatcctccaagtcacagaaacgtcaggcggatagtgtggaacgcgaatcagacaaaactcctccgatgaagaggaaaaagcccgatcacgatgtggatgcggatgcccttttcgcggcaaagttgcaggcggaggagaacatgcgtgcccgtcccactcgcggtgctagcgcacgtaaagttcagccggcaaagaagaagacaaccaagggctaaacgtcaaaaaaggtcaaaggcggaggacgactcanatgtcgactccagttcggactccaaaaagtaaaccgctctggtggattcataaaccgcttctcn

SEQ ID NO: 5949 - DNA, 658 bp, Aspergillus oryzae
caatagtttccttccccccatacacttctagacgtatttagtttccggtagtatttcggactatagtcttttcttctcattttgacccagtgttggtattcaagcgcatcaccgattatcgcgtccttctcctcgcctgcagtttgaccctctcccaagccctcatcgatatctctcagcatggccaccgcagagaagaagaaagaagaacaacctgccattcaaccggacgaatactcggacggcgattacgatacggatgactattcactgtccgaagacgagcaggatcagaaaccccaacgtccgaaacaacagcaagctcgacgacgtcaacaacaacaacgcaaacgtcaaaacgacgagtatgaggatgaaagtgactatttttccgacgaatacgattcagatgagtacgatgacgatgacgatgcgggtcagggcaatgccatgcagccatataagcgcggcacccagtccttacacaaggcacaatcacaaacggagccatgacggacgccccaggacaagggaaaaacgatgaggagcaggatggctctcaaactgaaactggagctgaacctcacatcgaggtagaactcaaagcccactttcacggagacttgcacttgcgtgcttgcatggatggggaaaaggt

SEQ ID NO: 5950 - DNA, 661 bp, Aspergillus oryzae
  misc_feature (1)...(661): n = A,T,C or G
cgaggcgcggagagaaatcgagggattgatagcagacgggcgaaagataatcatattgggagatcaggtgctgaaggtcgacacgtggatcccatatcacccaggcgggaataaatcaatcttgcacatggtcggtcgggatgccacagacgaaataacagctttgcactcaaaggaagctcaggcacatatgcagaaatatgtgataggcacaatcaatggacgatgggagaactttctgcctccgatccagggaggaatattcagacccctagcatcgaagggcgtcgacgacgaaacgctcgatgccgaagaagatatcagctcatctggaaaatcgacaccaccgtcaccagtcttcgatccggtagagaaaggagatggagttcgtcggaggcgtacaggcactgaaacgcccatttcccgagcttcatccgtatactcatcagagctggagttggcgccattcggatctgcagaagcatcaatagcccacgcgatatcatcagatctttcaaaatatcctcgtcttgatcaaaagtcacaagacgaagtcgtcacaaagtaccgccagctcgatgcanagctgcaatccgaaggactctacgattgcccatatagctcctacgcctgtgaattcatccgatactctgtccttttg

SEQ ID NO: 5951 - DNA, 656 bp, Aspergillus oryzae
  misc_feature (1)...(656): n = A,T,C or G
cgaggtgcggtcttgcccagttctgtccgtaaatccaagctttaccagcgaatcgaagacgaggggtttcaggcggtattcccttgcgaacgttgtatccgccttcatcgttcttgtattaaatccgaaaattctggtcgttgtagcgagtgtgtgaaagcgaacggtgcctcttgcaaaatgtccgaaccttccttttctgatgctgagtggaaacggctcgtgaaagcccagaatactattgaggaggaggaggaggttattttggcgaagcttcttcgtttgcgaaaacaaaaacggttattgcaaaaacgtgcaggtgatttcattgcgcgtgatattaaagaaattgaggaactcgaggaacttgagcgtcaagagcaaaaagagcgtgaggcgcaggagaagttgcaccatcaggaaactgcggtttcctgttccggggctagtgcgtcaagtggtgatgttcaactagccgcgggttccgggttagatcctagcttgactcagctgatggatgacccttccttctgggtgaattttgatccttccgctggtggtacttgtcaaccanctggtggcagcccgtcaaattctcgataagcttccatgaatttttctgagtatttttttcacctcggattccgacccttttc

SEQ ID NO: 5952 - DNA, 663 bp, Aspergillus oryzae
ggctggtcagcccgcccctgcttccccagcacctactgcatcccaggcgcctccaaagggccctgaacctggccgacaagcaaacattcctcgacgcccagacccagaacgagcgccgcccagcaaccagaatgtacgctcgcagacgcatacccctaatcgtccttaccgagaggatggaaggttaccaccacggcctgaccttttagacgacagacgcgatagacattcagattaccctcgagggggccgctatggtggtgagcatgattacaataggtcgttcgaacaacctgtgggtgatggaaggggctatggccgtctcgatagagagtatcctttaaggccatctatggatgagtcgttccgtggtcctccttaccgtgaggggcgtctcctaagagaaccggagtggccagatcgtcccggacgtttgcgcccttcggatgctcgagaggcaccacctgtcgcacgctccggtccaccgacacaccctgatcgtgcagaaatgatacacgatcatcctgaccgggaaagctatcgacgtggggaggcactgcgacaagagaatgatgataggcgacctttgccatcaagaacgttttcgcctcccataatgggacttcaaaccgcccataacgcttccctgaataaccgccatct

SEQ ID NO: 5953 - DNA, 1210 bp, Aspergillus oryzae
  misc_feature (1)...(1210): n = A,T,C or G
cgccatattactcatcaattattctccatctcctagatcgcgacacttggtcctcaacctatctgttccacaaacaaggactactgagcagtcatgagctggacaaaagtatcagaacgccgctgggagcgccctgtcaccggaatggagggatattttgtctatacgggatcggtgtcagccgctcactgcgatggccgccaccagtacaccatcttctccaagctgaagatcgatctcggtatcagtccggcggacgttgaatccgcactgaagcgcgcctggaagcggctacggtctgagcagccccagatcgccaccacagttgatgggacgacgatggtgtatgaggttcctgatgaggcagctttgcaggagtggctggcctcaacctttgttgtctcatctgctgcagatgcggaggatttataccgcaatgctgagcctatcaagcaggttacactggattatattccgaagtcatcggagcttgtactgggtgcttaacattacacaattgacggcaccggtacactactcctctgggatcgctatctgacagccttggcaaccccagccgaggaggtcacatttggtgacgagcatacccggctggccccctccattgaggatgtgctcaaggtctccgagccgacggcggaagaaaccgagaaggccacggctctcctcatgagctatgcgaccaaagctccgggtgttggccccgtttccaaagttggcaccgtgcctgctggccggtcccaatatgcagaagtgactttcccgacgcggacaacggaagcaattatcaaggtatgcaaggagaagggcatcagcgttacctcggccgtacatgcagcctacatccaggcgattatcaaacacgctaatcccaacggcacattgtcccgctatgtcagcttagggctgttcaacctgcggccctacctgccgaaaccatacagcacaagcgagtacgcggcttcggtctactacacacctcttcctttggactttgacctccctgccccattctgggagacagcccatttactggataagtactaccggaccacggtgaaggatgatcctgagatcctgcccctgcacacacacatgacacgcatcctctgccaagcttcccagatgcctgagtaccaggggctcattccccgcgatgcacangtcagcagcctgggcatcgtcgagc

SEQ ID NO: 5954 - DNA, 604 bp, Aspergillus oryzae
  misc_feature (1)...(604): n = A,T,C or G
ttacccaagccatgcctggccgtgacaccgtctacggccgtaccggatctgcccaaccatcagagagccagcagtctacagccggctcgaacaccttcggatcgggcatgtccgacgtctttggtcgctcccagggtggctttgggcagaaccagcccatctctcagcagcccccagtgaccacggaggaaaccaagacctttgacacgcccaaggcctctggacccagcccttccctagctcaggctaaccgccctggttccgctaccaacagcgtgccaggtcagccgcaggcacaaactggccttccccctctgcaaggccagcagggtcagcagggctttggcacctatccccacttgaaccctcagtatgggggtctaggtggacttagtggacaccagggtgcagccaatcaaacccaccaccaggctactggctacggtaactacggaggcgccggcttcactaattattatggcaacaccggtcgcggtggctggggaaggcattacggtcactaaatgatgatgacattgcatttttcccgaatggcggaattcatatttggctcaggngggtggcaccctgaactcaaagcttn

SEQ ID NO: 5955 - DNA, 696 bp, Aspergillus oryzae
  misc_feature (1)...(696): n = A,T,C or G
cgctgtgtggcctcgtgcgccattggcacggcgctcgtgcgcggactggtgctgcgagagattcacacagaggcagacatcgattccatgatcggcgcggccattcactggtatgcgaagtaccgggttcgggcgttgcaagagcacccggaacggcgagacgagccagacttggacgtttcggagctgcgccgacacgccaaggtagagagcctcgacgatttagagctagacgacagtggtaagattggctacgtatacaagactctgggcgcaggcgtgcacctcctccgtctcgccatgcgtgatactgcaaccggcatgctcacatcccgggcactggcgtttgagccgctcatcacagacctaatcatgcgaggcggcgacgctgacaccaatgcctgctttgcgggcgctctgctgggcgcttatttgggctacgctaatctgccgcttaactggcgcaatgggctgcgacacggcgagtggttgctgggtaaggctgagggcctgagccagatgttgggcgtcgcagatggcgagtatgtcgggtcggcagaccgggagacggcgctggacggcgggcgaggtgggatgccttctgaggctgataatggaaaggaagggtatggtgctgcaagcatggatggcggancaagagcaagaggccaagcggagagccagcaaactggagga

SEQ ID NO: 5956 - DNA, 690 bp, Aspergillus oryzae
gacccagtcgtctcagcagcctccggtcaccgcgccttcggccacgcctcaaatcaagtctgaggtccaacaccagcaaccaacaacacagttgaatcagcagatgcaagtgacaaagacccagaacgcaacacctggaaaaggcgccaaaggacctgcttctaagcaaccgccgaagaggaagatgccaaatgaagaaagcgcggacgcccagaatacccctgcacaaaagtcggcgcagcctgcgacttctcaaggattgtcaggttctacgccagcacgacctaacatgccgttcactcgtgagcagctggtcaatatgacaccacagcaacgtgcacaattggaggcgcacatacggaggcaacagagccagaatcaaacgcgagctcccatttcgagaaccgctgcggaagagcaatggaacaacctaccggacaagatcaaacaatggtacaccgaaatcttggccaacgccccatccaatgatcctatttctgttcaaccagagcaaaaagctcaaatggcccagcaactacgggagtgtacggatatgctgggtaggatggatacactggtccaatggttttccaagattcccaatcaggaaaaagaatgtcaaaagcttattagctatgcgcatacaattaatgaggcaattcaaatctggactgactggacgatcaatga

SEQ ID NO: 5957 - DNA, 680 bp, Aspergillus oryzae
  misc_feature (1)...(680): n = A,T,C or G
gcctcgtagaagtcgattctctcgaagcccttgtcatcatcgacaatgagctcgatcctctctccccacctgccccggacaccgtccaggtatcgggtctgatgggttctcttgctctacactctacacatgatttacatgaccgaggtgaagccagaaaggaactgcagatggaggacatttgctgttcggcgcatggactgtctatccttgtgacagctacaaaaggcgatgtaaagcactcggttctgttcgatgcaggtccagaaggcgagatatgggagaggaatgtcaagcggttacggccggatctgtcttctgttgagctggttcaattatcccattggcatcgggaccattcgggtggccttgtccgagccattgaaatgatagctgaggccaaaaaagccaaaggccacacagacaaagtggcggtagatcttcatcctgaccgtcccgactatcggggattcgccctgggtccaaacattgtttcctttcaggcggatcctaccttcgaggaactcgaagctgctggcggagctatccaaaagcatgacgaggcacacaccgtgcttgacaatntctttctgatctctggcgagattccccgccagacggcgtacgaaaacggtattaaaggaggcatgcgctttgataaaaggaanaggattgttttt

SEQ ID NO: 5958 - DNA, 900 bp, Aspergillus oryzae
gccagcgcagacacagccaccatatgggcgacaaagtagagacacttggagggaatgacggattgtccgatcagaagcgggagattatgcagaagattttatctgcagctctagaccaagtgtccggaaacccagagcctagtcaggctgattcgcagacggtgcctgacagtaagtccgacaaaaaaggctggatacaatgcgaattctgcacgaagcgcacgcgtctgcgctgtgaaatgaagaaacacaagaagcgccatgagcgaccgtatggttgcacattcgaaaaatgcagcaagaccttcggtagcaaagccgactggaaacgacacgagaactcccagcatttccccttgcagagttggcgctgcacccttcccgatgctacgcaaggggatcgatcttgtgctcgcctattctataaccaaggagaatatacccgtcatctgaagaagcatcaccatgcagaagataaagaggtacaagctgcactcgccaagaacagcatcggtccgcacggacagtcgcaattctggtgtggcttttgtcgcgacatcatcccactaaagggccagggccttgccgcgtggaatgagcgcttcaatcatatagattctgagcacttcaaaaatggcgagcggattgaggattggctccttccttcggggcatctgaccaagggcgcagaacgcgatgaaggaaaggaacgaatcaacacgcccgaagatgggaatggcgagcctccagcggacgatgtgagcgacgatgaaactgccggcagtatctgtaactctgagggtgagaaccaacgggatgaaaccccgatgggagcccccaaaacaagtacaaaaatctttacttttagcaagtgaacaactcatttccaaaaacaatttc

SEQ ID NO: 5959 - DNA, 1199 bp, Aspergillus oryzae
  misc_feature (1)...(1199): n = A,T,C or G
ttgaactgatccctcttcatcaactttgtggtttctgttgctttagtatgagattcatcgtcttcgttgaccttctcagtacctgtatccaacctgtttcgctcgcctatatcatctacttgattgtctggcttgccagagattcgtccaccattccatggacgtcttttgttctcatcgcagcgatctatggtcttcaggccctcatcttcatcttccgccgcaagtgggaaatgattggctggatgattgtgtatctcctggccatgcctatattctccgtggccttgcccttctactcgttctggcacatggatgacttctcttggggaaacacccgcgtcatcactggagaaaagggccgcanagtcgtcatttcagatgaaggaaagtttgaccccgcctctatcccgaaaagagatgggaggagtatcaagcggagctctgggaggcccagacgtcgcgagacgaccgctcagaagtttcaggcttctcatatgggaccaagtcgtatcaccctgcgcagtccgaatacgggttccttgagctagaccaatgtcgcagttcgatcttcctcgctatgggtccaggatgtctctaactccttccggatgatgagccctcatatggacatggaaatggaggatctctcacatctgcctagcgacgatgccattctcgcggaaatccgtgaaatcctgcggacagccgacctgatgaccgtaacgaagaagagtatcaaacaagagctagagaggcgttttggtgtgaatctcgatgccaagcgtccatatatcaactcagccaccgaagctgttctatcgggcgcgctctaatctgagggtcaagctcgatgtgtattgcatggaagaccgttaccttttccacggtgtataaaaatttcttatctgatttaatattcgcatatccattgtcgcaactttataaactcgcagctgtgattgtttgtctacagcttcgtattttgccttctcgaagcgatctatgatgtctatgactatcgcaacatactgcccaacctttggttgatgtcttctttcatgacaatactcgacgtctttcggatgcattgccacgctttgttagactggacggaatcaacttgaatggacaggacctgctttgttctaatttaatctgcggggtttgtgaatgattgaaatgttatcgtgaacctt

SEQ ID NO: 5960 - DNA, 1247 bp, Aspergillus oryzae
  misc_feature (1)...(1247): n = A,T,C or G
tcaaggcctaaccttgtctcgcgacgctccctcttgacaatgatgatgcatcagccaactaaaatgggagctcctacgcgctccagtccagccttgcaacggtcgcgtttgacatcaccaaacggcccatccatccccgcctcgccgcctgaagacgatgaggataacttgacgatgcgtggcccaggtgtccctcgatcgaagcccatagtcatgaaacctactccgcagtcagtcgctcactcgccgaggaccacgcgacggaacatgcttgccaccgaactcacggagtcactccgacgccatttactttgggaacgacagcagaagagtgcgactgccaatgccttcctcaagcgacgacacactgcacatgacatggcaaacttgcaggaatatcccaatcctaagggggcacaaaagggacagggtgttggcgtgtccaacccccgtgcagacaaggacaaggatatggcgaagacagcttctttcaatcaatatactgactttggtccgtgggagtnaccacgctaaggtttgtaaacgaccaccgatcgcatttcgaagtgacacgatcgggtcgcccttgagaatacccaaaacaacttgctttctttatctttctacttttcacattttgttatctgtgtcatgacatattcttcctcagatgggttatgttattgactatgatacccaaaccttcaacgcgtttctttattatctatgtaaagccgccgattgaatatccttgtgacacgtacgatcacgactctgcattgcatcttggcgcaactatggatcatatggttgttattatcgacctaattccttttttcgggtctttgattttatttctcagctcctttttcctatcatcttttctcgtggcattgtgtggctatcagttatgttgatattatacgagccatcttgaggacaaaacctcaagcgcgattaatcatgtacagatgatcttcttttaccttccatggcgggcggaactgttgcgattcgaatttggcatgggttcttatgtttttctctttccagtacgggttgggtggaacttttcaaaaagaggccttttatggatgtcattgctacgtctcgtgactgcatcttagcagaaaacgtcattggtatcattcgatgcatntgaagcccttgncttttctttctttttctttgttggtctgataccagataccatacatatgtntttgattntgcttcgcgcctttact

SEQ ID NO: 5961 - DNA, 664 bp, Aspergillus oryzae
  misc_feature (1)...(664): n = A,T,C or G
gtcccgtacatcctaccaacctatggcgtcaccctctttcagctctcccagatctaccttataaactgtgctggctgtctcacagcttccttttccaatatccatgtttgctcgcgcatcggcacgggcggtacattagtgctaggagcagtgatccaaacacttggattcgcactgatgtactggaacccgccctttgcgctctttactgctgccttcttcttaactggcatgggaggtgcctatcaagacgcccaggcgaatacattcacaacaacagttgacaatgcgcatcgctggctgggaattctgcatgcggtgtatggtgttgggacaattatctcacccattgttgctaatgtaattgcctcgcgaacgcccgtctggcatgatttttactttgtgatgttgggcttggggctattaaacttgtgtcttttaaggtggacattccgagaaggtctctttaaacctaacaagaggaacgcgagcggaacagccgccagcgaattgaaagccacgctatccaataaagcggtctggatactaagtggattcttctttttgtatgtcngcgccgaggttactgtccgtgtttggatggtccaattcatcgtctccgtaagaaatggagacccaaaagaagtaagctacatagcctctg

SEQ ID NO: 5962 - DNA, 705 bp, Aspergillus oryzae
  misc_feature (1)...(705): n = A,T,C or G
gcagatataccgggcgcaatcgtcctggcctacaacctattcttgtctgaaaaagattgacatcgatatcgctcgttcgctcgctagactgtctcagcaatgaatcttcgagccgcgggccttcgcaaggcccgccgccaacgctccttcacatggcttttactcctcattgccgttctaatgttggcgcaaatatccttggcccaagataccactgggaatgaccccgcgtcgacaaccgacgtaacaactaaggagaccactacagctacgacaaaagatgacactaccacgacatccaagaccacggaaacatccgcgacagacaaatcagcaacgacaacaacatccgagtccaaatctacagactccagtacaacctccaccgcaacgaatgattaccccgtggtgacagtccccccactcgccgacgcaccatacatgcaaacatcagataccccggaaggaaccgtcttcatcgccgtcngggcagtcctaggcttcgtgggcctcgcactcctagcctggcgcggaatggtcgcatggtccgtaaaccgatctgtccggaaagcagccataatgcaatcctncgaggcaaanggactcctncgncacaagaagaagagatccgngcaccggtcttatcggnggcccaaaaacagccgtgttccttgaaaaaatcggcnggcgggcaccggacaaacc

SEQ ID NO: 5963 - DNA, 697 bp, Aspergillus oryzae
tttcaacaattgtttctctctcctcgccccagctgcttttataccacttcgtctctttccatcctccattcgcttttcgcgtctggtcatatcgttgatttactgatcaattgaggactccattactattcatccatccatacacacatctccaaccccattcacgaccattatgttgccgatcgtgtttctctccactttggtggcctccgctactgcagtgactaccgccagcaactataccttccctgagggattcgatctgaaccaggtgaaaccggcggataagtctgcctggtgtcaggccgagcggaacgcctgccctaagatctgtggcggagttgctgataagaacacttgtgacccgcaaactcttgatttcacttgcacatgctccaatggcaccgatgctgacgtcgcgccttacgcggagactgtccccttcttcgtctgccaggagaactaccggcagtgcatccagcgctctactgaccttgacggcgacgagaagtgcaaggaggcccaaagccagtgtggctcgaagaatgcgtccgatgcctctggctcgtcttcatcgactactacggccacgtccttgcctacctcgactggttcttcgggatcgagcaagagcgaaagctcatccaccggcaccgcgacgagcagtggcagcacaagcagcactaccgctaatgtc

SEQ ID NO: 5964 - DNA, 718 bp, Aspergillus oryzae
  misc_feature (1)...(718): n = A,T,C or G
gcgaaatggcgatctcagatctcctcaaccgtcgcgtgcgagctttgccggaggaagacgaagaaatctattcagaagaatcagcatttgaagaaaaaagcgatgacagacgctcaggtgaatccgattcagattcagacgatcttgatgacgaagcattggaggagaccgatgacaactctgaacacgacgggcccgttggcttagaagacgacgaagatagtgaagatggtgaagacaatgataatggagaggacgatgtccaagcttcccttagtagcatatcctttggagccctcgctaaagcgcaagcgtcactcggtccgaaaggcaagcgcaatgcaaaaaccgccaaacctacagaggagtccccgcagactacatcaccgctagacgacatcagagcgcgaatccgcgaggcacgggagcaaaaacgtcaagaatccggaaaatccaaggactcggcaaaacctgcaaggacttcaaaacatgcccccatggttcagtcatctaaacgcgccgtttcacgcaagcgcactgttgtcgaacctccatcggtacccaaatcgcgagacccacgatttgatccgacagtgctcagtcatggtggtcgccataatgctgaatcggccangaaggcatactcgttnctagacgactatcgttcttcagagcctgaagatgctaacgccnnagtcgtcaatacnagaacgccgan

SEQ ID NO: 5965 - DNA, 647 bp, Aspergillus oryzae
  misc_feature (1)...(647): n = A,T,C or G
cgaggacttcgccaaggtcaagatcgacccccctatgaaccagaccgatgtccccgccgttgtcgagaagctggccgctaagatcactgagtggaagaagaaccaggcttcgaagaccgaggagaacatcaagaaggcccaggaggaaattgcccgcctggaggaggaggcctctcaggtcgacgaccgtgcgactgacactgccaagaagcccgctatcatcaacagcggtgttaacggcaaggtctcggccgaggccgagctgaagcaggagaaggatgccgccgccgatgtgtccgacgagctccagaaagcctcccttgaggagacggcttaagtgacgcgccccggatagacttatgcaactttgcatgttcttgcatcagcgaattgacgctttagaccccaagcggagatttagcatttacatttcatttgtttttggttagttctgtgcatcttatcgacaactctttgcttttgcagatcctccctttttctttctccgcgcgggaatcttgcaccggtcggagggagcttaattctcctttgcgaggccatcgtctggctgttattcctttcttgtaatccatatttactacactttttgatttctcggcnnnnannnnnnnnnnnnnnnnnnnnnn

SEQ ID NO: 5966 - DNA, 713 bp, Aspergillus oryzae
  misc_feature (1)...(713): n = A,T,C or G
ttgagtatgctactcacattgaagccgtcttctgagaacggactcaaggctctcatgactacgctatcgttcggcaggctattccaactcctcggtcctctccgccctccgcacctgatcccgccgcggccattgtaacatccaagagaccctccgtggaccactctatggaatcttctcgtggtggcttgccacctccctcaactctggcattgccgccgccggatgttggcttctcttccatgaattctgtgaatcaatcgctgccgcgccctgcggcgcaacggcagagcgccgatgatactagccagtactggcatgcgaaggcggaggaagaccggagaaggcaagaggaagaacggacccaccaggaatcgctgcgtctagagcagcggaagatcgaacagagtatgcttcgagattccctgcaagccggcgtacctgctcatatgattccgctcatcttcgccggcatcagccagaatggcgtcccccaatcagtcatagaatgggcccaacaacatatgacacaggcgcctgccggtccccgtgcgccaccaccttcggcaccggctctatctcattcatcccatcggcgcagcttgcacgcccgcggagagtctcgctccattcctcctggcccttatgcggctncaccaccgcaacatgtcatacctgccccggggatcctcttattacaacctcttccttct

SEQ ID NO: 5967 - DNA, 865 bp, Aspergillus oryzae
  misc_feature (1)...(865): n = A,T,C or G
cgcgataacgactctatccgaatccggaccaaggtcggctcctacctctttctcaagtggttttggatcccacctcctcccaaaaaagttttgtggggctctttctccccttcccaccttgcgcatctacgtggaatcatttcctcttgttccacgtagcttgatctatcctgcaatccaggctcaggttgccccttgttggaggaatcatctgtgaagagaacatataacccttaaccttctgtacccggagtttctactcttataccgagtcccagatcagatagcgtaggtcggccaccacaggtattaaactcttatcacacagcaccttacggaactgtcgaccctcgctggctcgatactgctgaccggacgggtccggaggcactgcccgagtcagatgattctctccatcacttgagccaagacactccaccacaggatcttgatcaaactcagcattgggaaggagagtctgcagatacacataacagtttcgagtcgccgcaattcatttttgaaccacgttcgcccgagacacaacatatagcacctgagttaccctcggatctctcaatttcaggacaagatacatcctctgccaatcaatcgagtgattctacctcacagtcgttcccgtgtgaccggtgtgatcgtgtctttgacaaaagacatctactcaataaacacaagacttccgttcacgatcgccctcacaagtgtgacgtancaggcttgtccccgacagaggggtttcaattcaagaaagatctcagacggcattacaacactgtccacgggggatgaagttccaaggattattacttgaagtatcgctggtgctccgcttcaagccacaact

SEQ ID NO: 5968 - DNA, 637 bp, Aspergillus oryzae
gaagaaagactcaaccagaactattcgttccagtgcacaaagaatcagaagaaatcataacccgaaagaatggcgactacctactttcctcctccacctcaggaccctcaatttcctccgcccccaagatccgcaacttctcactcgaatccccaaagcctctccgatttctcgcaaccgaatttcagtttccccccgccgcaacgacaacaaacagctcctgccgtgagcccattcgcaacggataccaatgccacagcgtacaccgcgaatggggatatcggcaatccatacggatcaaactccgtgtctcctccccctcaatcatcgacgcccccagcggccgtacagccccaagctgcccccgtcgtgtcggccacaagtcaagatgaagtcggcacattcaacggtggaagctaccgcatcagccaccgggacaccaactcagtgctcacaatgcagctggcaatgggatgcccgatcgaagccaaccaggcgccatggttgcaatgtcccgcgacatttccctcaagggaacagtgaaaatccgcctatcgaaaatgtcgccggggggatgacctcctcgattacacggggccgggtgaaattctcttggcgccgctttcctaagcgaaat

SEQ ID NO: 5969 - DNA, 645 bp, Aspergillus oryzae
cgatagacaatcagtcgttccttcgttccttcattcttttctattaactctagtcattccttcttgaatcattcacttctcaatatgctcttcaacaatccctcgactatccttgtgggtgcattgggttgcatgtcgcttttgtcccagcgggcgtatgctgcgcatattccttatcgtcaccgacatagccaacatagccctggaggcgtctatgattctgctccaccagtcagcgcctgtggaaccggcgctccaactgccacaacgactgtgactgtaactgaaaccatcgatgccagctcaacggagctgaacgtcattactcccacggttgttcctgcttcctatactactgtggatatttccagctccagctccagctccacctttaccagtgtcgtcgccgtttcctctacgtctacatctacgtctacgtctacgtctgtgtctgaatctacctctgtctctacctctgcctctgcctcttcgtcaggcaatagcacttcaaaggcaaaggtcatcatcccgtactatctatatccatcaaccggcgcgtggacacccttggaagaactgatcgttgccaattccgatgtccaattcaccgtcatcatcaatccagataatggcccttggctcaac

SEQ ID NO: 5970 - DNA, 1175 bp, Aspergillus oryzae
  misc_feature (1)...(1175): n = A,T,C or G
ccaaggaacctcatttccctggccgaaggactacattttggaattcttttccaatggccatacaatcaattcctgaaaactctcatcgcatctctttggtcctgttcttctggtggttgcaacccttcggaagattccccacttgcaagatcttatctttttagtccgtttctagaatctttttctccccctctatcagatcaagactctccgatcccctcctcactctctcatccactctccaattcttccctttcaccatgactcaaccctccaccatcacacaacgcttcctgtccaagcccggaaatctgggtgtggtagcagtcggcttcaatggcggccagtgcaaacttggagttgaggctgcccccatggccctggtcgaggctggcctcctcgatcaactccgcgacgaccttggctacaccctcgactatgacggcaccgtccactactacgaanaccagatccccgccgaagatcccgaccaccgcggcatgaagaagccgcgcgctgtgagcgccgtgaccgaagcgctgagcgcacaggtctacgagaaagccaagcagggtcagatggtcttgacactgggaggtgatcactcgatcgccatcggatccatctccggctcggccaaggctacccgcgaacgcctgggtcgggagctggccgtcatctgggttgatgcgcacgccgatatcaacattccggagatgagccctagtggaaacatccacggtatgcccatggcgttcttgacgcgcttggcccgcgaggagcagaaggacatcttcggctggttgcaggatgagcacatcgtcagcacccgtaagctggtctacattggtctgcgcgatgttgatcgcggcgagaagcaaatccttcgggagcatggcattaaggcgttcagcatgcacgacattgaccggtacggtattggccgtgtggttgagatggctctggcccacatcggaaacgatacccctattcacctttcattcgacgtcgatgctctggatccgcagtgggctcccagcaccggcactcccgtgcgtggcggtctgactcttcgtgagggtgatttcatctgcgagtgtgtgcatgagacgggcaacctggtcggcatggacctggtggaggtcaaccccagcttggagtcngtaggcgccttc

SEQ ID NO: 5971 - DNA, 958 bp, Aspergillus oryzae
cagtatatgctcatgtaattgaatatctattgaggtcatgctaaagtaggttatctatacgaaatggggattgaggtataaatagcacttgaacaaaacagaattgggatagacgttttgaacacccagcgctaagccgaaacatctttgggtagaaatagagacgaggaacaaaaacaatatgaagtaacattcgtgcgacgagtttcctttatccggccattcttttaagcggatgtgccaccaccaccgcgtgagacgttctcactctcctcctcgtatttctcccagttcgccaaaatgttagcaatacgcggtgaattcgtgagcctgtagacatcctcgaaatattccttggtgagttcgaaggggcgagctgtgacatttggaatatattttccaaccaacttgctgggatcaatagtgtttttattgatcttctttagcaaaaacgaccggaaaggcttcacaccagaacggaggaaagtgctgtggaagggaacgtcaattcctctcagagggatggtagcgaagccacgctcaagggtaatgggcttaggcttagactcagtctgcttgacacattcgtgaatgattttaaccaggtgagccttcacatcttccagagacatgctttgcatgagagcgggaatgtcaatgttctgagccttcaagtaattgagtagatttgtaagacagtcaagtgctcggagatctccagcagcaacgtattgcatgtttgcgacgttgtagttgacaatctcaagtagccagccagtctgttccgagatattctctaccacatactgcagagcctgctcattaaatgtcttggaaatccggcttggattgacagcgcacatagagtagttggagcgaccttgttcatcgcgctcaaccgcaacttgcatagtcaacccgcgatagaatacgacagaaaccaagctttcaataggca

SEQ ID NO: 5972 - DNA, 866 bp, Aspergillus oryzae
  misc_feature (1)...(866): n = A,T,C or G
acagatgtgagaagccacgacgccnctacagtttacgaccctgcatgtgttgagatgacatcacatcgntcctntannccaggtgcggcttgatccgatccgcacgaggcccacggtacactattagatcatagatcaccacagtggagggccatcacgtcagggactatatcccactgacctccccgaacaacgcgcgatgatggggtcattggaagctggtcataggcatagggaccatctgccagctcttggttttctaggaaaagacggatcgggatatccccccaaacacccttccgttgcatcggcccctgtcacatacccaggaactcttcttagcccaacaagcatgtatgcccgccagccattaccgtgctcataccccacgtcggcccgtcagcgtaccctttgtgcaccctggttatatttcgcctacggattcgcggcgcgcgcttgaggaggaaaaggagaaacaacagtcacaaccaccaaggcaatcactgccgaccatccacgaggggtaggaaaccaacaccccccttccgtattcttgcgcccacattgggtggctccttaagcagccttgtcaatgccccgcattcacattctcctctgcctcaaattgtgataggaccgccagacagtgcctcggactttaatccgacgcattgtggactggcactcttgccagagtcaccccccaaaatacgggagaccatacagagcctgtgactttggggatgccgaccctggaaccgctatagagtagtaactcgccgagagtcgacctggggagtgcacacacgcctcgacacgtcttgactccagacgtgtgctgtagaccacctacgacgctacgcccg

SEQ ID NO: 5973 - DNA, 304 bp, Aspergillus oryzae
cgggttccgtcagtcaccagctactactattctccattccccctcacgctctatacccgccgcaaaaaccaccaactacatctatcagagaagaaccatgtcctcagactcagcctcagcctcgggccgctacaaactcgttttcttcgtcccgcattcccacctcgaagcgtgtaaagaggccatcttcgcgaccggggcagggaccttcccgggcggtaaatataccaagtgctgcttccagatgccgggtcaaggccaattcctgccgtctgatgaagccaaccccgcgattggagctgca

SEQ ID NO: 5974 - DNA, 711 bp, Aspergillus oryzae
catgcgatacatccacacatttccataccactcctaatatcaatcacacagctcaatccacccacactacaccgactccagcaatccaaaatgaacctcctcctcctagccctcaccctcctcaccaccctcaccagcgcaactcccacccctcgccagatgaacatcctctacccctacgaaacctaccgctactgggtccaatccggcaactggaaactcgacccccaagaccaactcctcgtcgtcaaaaacggcaacgcagcagacgaaaccaccagcatcgtaaccttcaacatcccccccgcagccgacggccacaaatgcaagctcctattcgacctctgggaccgcgacgtctccagcggctcgaagcaggccgacgtgtttaccgctaccaagcccacaggcgcgagtgcctctgacgcgaatactgactctgcatcgctgcagtctgtgtcgaaggaggtcgccgatgtgattgtccagtcgagggatgagcatgtcggcaggattagtgttcttgccctggaacggcggattgggtgttggcttatcagggttatcccgagtttgaatggcctcgctgggcaaattaggggggtttgagtttggtgggggttggtgatgaggaggcttattcggggggatctgtggagttccggggcccagggggcccaattttgttagattggggggtggggttagggg

SEQ ID NO: 5975 - DNA, 693 bp, Aspergillus oryzae
  misc_feature (1)...(693): n = A,T,C or G
caacactacaggttttgtcgtctcaagttgctgctgtaattaaagaacgctcttcctgctcagggtctcagcaggaggacgtgcttctcattctcactggcaattgtttcatatagtacgatcatgagctgaatcttgcaacaatccctactccagacttccaccacaccttccgtgtttcatcgacttccaaaagaatacctctcacgcgccatggcgtccctacgaagtgagcacaccaatggcgtaaacggcgaaacacaccccacagttaaatcattagcgaaccttcgtttttcggacattccctctgccattgatattcctgcatccaccctcgacagcgaggtcgaggtcagtttggaaggtcttccagacgatcctacggagctttgcactctactagagaatgaaaaggcccgcaaaaatttctgggttatcatcgcgctcgcttatgccanacagaagcaaatcgaccatgctatcgacatncctcacaaagggttgacatcngtcgctcatggagcgacgaaagagagcctcgctngctgggnttggtatgcctggtgcctatgttgaaaaagccgacaagccccccaatgggcccccgaggggaattgatgccgaggcttaaaccaaggacattaccttcagctggcgacgtcaccataaatgaagcatttcgccctgacc

SEQ ID NO: 5976 - DNA, 691 bp, Aspergillus oryzae
cccacccccaattgaataccgtatcctcctctctccgtcaagatggcatactggaaagctgctggtttgacttacaaccgctacctggccgttgctgctcgcgcggtccgcagatccctcaaggagacccctcgtctggctgctgagcgccgtggccagatggacctgcgttttgctaagtgggagaacggcaagcagggcgaggttcgctccctcggtgaggccaaccaggaggccgccgttgcccatgccgagaaatagacgcttttcgaaatcactcgcatgcgataatatgggatattttttacgagaagggggttacggttgatgatgtgtggtgcaggaaatgatttggagctctgtagcatattcgttcgttgacctggtataaatacaatgaaaagaccatttcttttctgccaacagggctgtttaaaaaaaaagaaaacaaaaaatccctgaggccgcaaattctgtcgtaaacgacgctccactgttaacttgacacctctgttaaaggttacatgccttcccaatgtcaagcggttaaaggtttccgatgttgcggaaatggtcccccatcctagcgtcatctggggaaccccctaatagttgagttgaagtaaaaaagaaggtggttatccttacccacatggattagctattgtttgaaaccaggaatttaataact

SEQ ID NO: 5977 - DNA, 853 bp, Aspergillus oryzae
tctccccccagcgggcaatgtgggatcggattgcctttgtgtacaattgttgtcgtcagctttgtctcgaaattgacccctccgccatacaatcaatgtcccctgcaagtgtgacttggtaaaattgggtacccgccaagtgccaggcaatcgtttctcacagcaatcactattactacggaaaagtagatctgacagcctttacctggccgttccaacgagcttttctttttccttccttccaatcactggtatcattcgcttgcacggcttccttctgcgccggtccctgttgcaagtatcgtacaacgacggaagcgctggccgttcattgatccgttaaccccagggcggctcggcttgccttacttatcccctcaattaacacggcgcggcgagtacgacgcttcctatatcccctcagagtcttaaccccccgtcccccctgggtcgtgttgcccgatctctgccgccatctttggacggcgtaaatagcctctccctttcttccgaggcccctctgcctctttaagatacatggcaggcgtgcaactgcaacaacccaccatgaccgactatcgattgccgctccatcagccaccacctgctcggaagccggttcctgggatgcatgctggttatccattccagtcctatgatggacctcataagcaacagctctctcacccatctctcgctcacaatcggggccggatgccttcggccaatgcgtcgccctatatggctcagcaacaaccgtactccaataccccttcgcctcatcataccatgacctctactcctagttaccctccctcgagaagaatgtccagcgccacaacctctacaagct

SEQ ID NO: 5978 - DNA, 1749 bp, Aspergillus oryzae
  misc_feature (1)...(1749): n = A,T,C or G
cccttcccttcaactcgctttgctttaaatctcctccttttcacttcctttcgctaccttccaatcgatctcagatcgtcgttccgttttcgtctttatcctatcgcaggaacaaagcttctttccaagcagttaaaattactgggttctgctctgcatctgttgcaagctgagatatcttgaaaaaccacttctttagtctatatccttcacacacacatcaattcatcatgtctgaatcaacaaccatctccaacacggagaatctcatgaagtacatgaacctcgaccagcgcggacgcgtgcaggccgagtatgtctggattgactccgttggtggatgccgcagcaagaccaagactctctctaagaaggttacgtccgttgacgaactccccgaatggaacttcgacggttcctcaaccggccaggcccctggtgacaactccgatgtctacctgcgtcccgttgctatctaccccgaccctttccgtcttggtgacaacatcctcgtcctttgcgaaacctgggattcggatggaacccctaacaagtacaaccaccgccacgatgccaaccgcctgatggaggtcaacgccaaggaggagttctggttcggtcttgagcaagagtacaccctcctcggcaacgatggctggccttacggatggcccaagggcggtttccccggtgcccagggtccttactactgcggtgttggaactggcaaggtttactgccgtgacatcgtcgaggctcactaccgtgcttgcttgtacgccggcatcaacatctctggtatcaacgccgaggtcatgccctcccagtgggagtaccaggttggcccctgccccggtatcgagatgggcgaccagctttggatgtcccgtttcctcctccaccgtgtcgctgaagagttcggcgttcgtatctccttcgaccccaagcccatcaagggtgaatggaacggagctggtctccacagcaacgtctccaccgtcgccactcgtgctgagggtggtatgaaggccattgaggcttacatgaagaagttcgaggcccgtcacgttgagcacattgctgtctacggtgagggtaacgaggagcgtctcactggccgccacgagaccggcagcattgataagttcagctacggtgttgccgaccgtggtggtagcattcgtattcctcgccaggtggctaaggatggcaagggttacttcgaggaccgccgccccgccagcaatgcttgcccttaccaaatcactggtatcatcgttgagactatttgcggtagcaactagataccttaaccacccaataaaaacgtgaagacttttgtttcctcttagcgctcgtataccctccggcgtcagttgggatcgaactaggagagcagcctggcagtgtggagcacatagattttctttttctttttctcttctcacggtggtatttcaggttttctttaactcagatgccagagcttgcctttgcgttcattaccccatgccgtttatattttaattacttctctttcgttacttgttatgtgggttatgtgttacgtcaacaacaacatagaaggatcacagtgaattggacaatcactaggaatggaacaactgtttaggaaacaggaaggaaagaagcaaacactgtcttagtactaccgtgtatcaaatacaactaatcattctctggtttcaaaaaaaaaaaaaaanaattaatgcggccgaaaattcttcc

SEQ ID NO: 5979 - DNA, 720 bp, Aspergillus oryzae
  misc_feature (1)...(720): n = A,T,C or G
ggggagtacgagctcgtccgattcggacgaggcccctctcgatcctttcacgcccgattagacctacctggcgctattgtcagtcgcttcgagagcgatttcatttttattatttttgaatacccacagctcctgaaccttcgattgtgagcttccctcaagtcctttacgccggactacagctcaagatgaagcatatacgtggttttatctcaaccacacaagctttgcgccgtatatttctcgcacctattgaaactcctagaccccagtgtcttcgtcccgcttttctcccaaccttcacgcaatcccgccttctttccatccgccgcaagcctcaacagcaagatgcacagccccaggcaagagcaaggcaggtgaaagatgaagaaatccggtcagaatatatccagcttgtgaatgaagatggcaaactggatccacccgtaaggcttcatgatgccttgctgacaatagagcgcccggacaatttcatattgcaagtctcccctggctttcgcggccgcgcacccgtttgcaaagtcgtgaatcgacttgagatacgagagcaagaacgtgcgaaagcaaaggctgcgcacgtcaacaaagaattcgctcaaacagatcgagctgaactgggctatngatgcccatgatctctcccaccgactgaagcaattgacanacttnctcgacaggggccgaaaagtagaggtatat

SEQ ID NO: 5980 - DNA, 1398 bp, Aspergillus oryzae
  misc_feature (1)...(1398): n = A,T,C or G
gtcctgcaggaaggactagagcgaccttcttttatctgtttagcaagaccccaacgggcctgagagaggcccgttcccgcaatacaatcatgtccaccgcagtgtccaccgccgtggcatgcattcagcttgcagcactcttctgctaccagccgcagcggcagtagtcacgattcccatcaaaaccaccttcatcccgcagacctttacttgcaatcctacgatccgctatatcaccccaatcctcattcctactctccgcagtcgtccctagattcacaattcaaaccgtccggtgatgagttcaccggcctcgagtcttgggatacttgggctacgctcgatgccggttatcagccatcgatagccaattcgacttctctctatccgacacccgccatagaatccctgcctactcctgttaataatgatcttacttcaatcctggaacttaatgactgccaagaattcctccaatgccttgacgctggtttgacatgtcctgaagattactgtcctgagcccgctaccacttttccgcctccgcctgtaaccgcaacaatgacatcatcccccagctcatcgtctccttccagcgactctgttcctactccatcagtttctggtgttgcaaaatctactagcgcttctcgcattgagaagcgccagcagaacaccctggctgctcgtcggtatcgccaaaggcgagtggatcagatgaagagtctggaagaggaactgtgcaaagtcaacgacgaccgtgaggcattcaacatgcgcgtcactaacctggacggtgaaacggaagccctgagatgtcttgtcaggcgggaaaagaaatagtgcttgctctattgctttgggtatatacagtagtgagattataattgacacggatcttgctgtcactcgccggtattgcggacaacagcaacagcttcttcatcctccccgtcgcccatttcccctggtctcccactgcccgcagtcgcaagaccgagcgcgagaccgcttagattattgcgaggtgcgaaggttgatgatcatagatcgattggaccgggatcttgtccctgcgtttccttttttccagatacccattgttgtaagatcattgctgcgagaatgtaatgccgtgtcagcattctgcatgttgtgttgcagatcagcttgaccaatcagtactatccaaatccgcagcaggtatagatggtcttttgcgatgatttcatttgcttttgccgtttgccagcaccttttatagctnttttaatgatggagatctgttgttcatgtggacgatggatgggggcgtgtgtctgtgtctgtatctatttctattaggtaatgcactcaatgatantgannnannnnnannnnnnnannaanntttttcct

SEQ ID NO: 5981 - DNA, 650 bp, Aspergillus oryzae
gctgctcagggcattttgaatgtgcagacaactatagacctgctacagtccgcacgagacgctattgcttccgattcgagtcagacgtctataacattggccaagcttcaaaactccgtgaagtcttccttcgactctataaatgacagtctcaaagacactcatagcagcctcaacaagtattcaaaggctttagataagctctttaaagatagaccacttccaagtaccgaacatgatgccctcgcctcccaagagcacctcatcaaccgagctatcgccatgcatctcctccgagaaggacagttctctgtcgctgcaacattcctctccgaaatggcggagaaaaaggccatggagtcacagcaacaagcgagcacgggcgcctcggaaaacgcagcgacgctcttagatatagatgaagtcccgtcgaacgaggttcggaaacagtttgctaccatgtactacatattacatgaaatgaaagagaaaacaacttgctcccggcaatccaatggtcaagggataatcgggaagcactggaagccagaggaagaaccctgaattcgaactggccggttgcagttcgtctggcttttccatggtgggcctgataggcagggacctattcccacagggcgacaagaagt

SEQ ID NO: 5982 - DNA, 1352 bp, Aspergillus oryzae
  misc_feature (1)...(1352): n = A,T,C or G
gccgttgcacctttactccatccctccccttccctccacatccaccttaattcttgtcacaatggcctcccggcgcctagcatttaatttcaaccaggctctccggagccgggctgctctgaagtccatccagcccgtcaagcgaggcttctcttccccggttaccctcccatccaccacccagtcgaccaccctctccaacggcttcacgatcgccactgagtactccccatgggcccagacctcgactgttggcgtgtggatcgatgccggcagcagggcagagactgacaagaccaacggaaccgcgcacttccttgagcaccttgctttcaagggcaccaacaagcgcagccagcaccaattggagcttgagatcgagaacatgggcgctcacttgaacgcctacacatcgagagaaaacaccgtttactacgccaagtccttcaacaacgatgttcccaaggccgttgatatcctcgccgacatccttcagaactccaagctcgagcctggtgctattgagcgtgagagggacgtgatcctccgtgagcaggaggaggttgacaagcagttcgaggaggttgtcttcgaccaccttcacgccaccgcttaccagaaccagccccttggtcgcaccatcctcggccccaaggagaacatccagaccatctcccgcgacaacctggttgactacatcaagaccaactacactgctgaccgcatggtccttgttggtgccggtggtatttctcacgagcagcttgtccgcctcgccgaggagcacttcggcagcctccccagcaagccccctacctctgctgctctcgccctcaccgctgagcagaagcgcacccccgagttcattggatccgaagtgagactccgtgatgacaccatccccactgctcacattgccctcgccgttgagggtgtcagctggaaggacgatgactacttcactgccctcgtcgcccaggccattgttggcaactgggaccgtgccatgggcaactctccctacctcggtagcaagctcagctccctcgttgagcaccacggccttgccaacagcttcatgagcttctccaccagctacagcgacactggtctctggggtatctacctcgtgtctgagaacctgaccgccctcgacgacctcactcacttcgccatgcgtgagtggtctcgcctgtgcttcaacgtcacctctgccgaggttgagcgtgccaaggctcagctcaaggcttccatcctcctctcccttgacggcaccaccgncgtcgccgaagacattgggtcgcaaatcattaccacttgcncgnncgcctctccccgaggacattgagcgc

SEQ ID NO: 5983 - DNA, 621 bp, Aspergillus oryzae
caacaacagcggacggtatcacttcccgaagctcctccagcggaccagatgcctgggccgatgaaagctgaagacagtcagtcaccgccgcagcaaaggtcgatatcgtcgaaatcacgtagtatctttacgccgattgatgatcgtggttcggtcttggctcgtcactttggagtcggtccacctacgtcgccgcgcaatgagaactcacaagtgaagcttgaattttcacataacgaagcaaaggacaaaaagggactcaaccagccagtggcgcctccccctccaccacgagccgcgactgaagcgcctcgtccccagccggtacctgggatcaagcctcccgttcggacgaacagcggtcagttaaatacgaaacgtccacagctaaaagtgcaaatacccagcgagaattcggatcggggcagcgcaacagcagattcatcctcacgcgattctgcagggaacaaaacacttacaccagccaaagccaatcttgacgggaaccattccagtgtcgtgttacctccgccttcgccttctgccggtggaatcctcagtgcaggcgctcacggaccaccgaatccatttgcccggccggctccccctagcacaactgtg

SEQ ID NO: 5984 - DNA, 668 bp, Aspergillus oryzae
cacacgtcatataatgtaccctctgctgtgctggtccatctttaaggaggttcccgcgaggatgtcgtacggctgttattccggaacaaccgccgaaatgatctcgaacgatgggtaccccgatcaactggcccatcttttctacccattcctgaacatcgatggtcctatctgcatgaatcgcaccatcaagtggatcttcctatccctcctgctattccttcaggtgttgtccatcatctggttcgcgatggtcatccgcgttgcggttggtgttctccgtactggaaatgcagaggactcgcgcagtgatgatgaggaagaagaagagatggagatgagaatctcgagcaaggatggccctaatggaagtgcggcaggttctgatggcaccactgccgactggcgccgattgaacggatcatctaccgtacgccctcgcgcacgtgggcgggttcgactcggtgagcaaagcgatcgcaaagcactactatgcagaatcggatgcgacaagccaacctagttgcgccatgtttctatttcgcatatttctttttaacggtatcatgggattgatatgcagcgatgccgatattaacgacttagccagcttttgaaaaaaagagagaacaccacacgttttccaatggacccaccatgcccaaccc

SEQ ID NO: 5985 - DNA, 706 bp, Aspergillus oryzae
tctttatcgcaagctgtcactcctttctcacccccagtccgttctctagcatcaaacttgttttagtcagtcttttttgtacagcaccccgaacttgacagttcagttcaccgcccgtacccctaatcatccactttgttccgccataatgttgttcgccaagtctgctcttttcttgtcctttttggccctcggaaatattgccgccgctgcaggccctaaggcttgccttctcgaggctctcggcactgagccaagccccggtgatctcaaagccgtctgtgttgataaagtgcagaccaaaatcgagagcctgtgcagcgatgatgacaagcaagacgctctgaagcagttcgctgacacctgcaccgctgctggacacaaagtcgtcgtcaacacctcgacctcttcaagcgcctcttccaccggtacttccactgccggttccaagtcaagcagctccggctttgtcactgctaccgctaccagcacttccagctccggctctagtacctccggctctgattctgttactaaccccagctcgacctcttctttcggagtacctcttcataccgccaatgccggctcgtctgataggcatattcccgctgctggctttgctgcagttgtcttcgtcggcttcgctgctacgctgtaagggtgatcaaccttcgaatcttctactcagctgcgcagtgagtat

SEQ ID NO: 5986 - DNA, 873 bp, Aspergillus oryzae
  misc_feature (1)...(873): n = A,T,C or G
attcgcttttcgcctctctcctctccctcccttcccccaccccctggttcattgttaagatgttttccctaaggacagcgcagcccgcgcaatctttccttcgtcgcgctgcggtgacagctcccaccgtccgctcctccttggcagcaagatccttcgctagcgttcagtcggacatcttcaagccgaccaagtatggcggcaaatacacggtcacgcttattccaggtgatggaatcggtgctgaagttgctgaatcggtcaagaccatttttaaagccgataatgtgcccattgagtgggagcaggtagatgttagtggtgttgatgcgggcaacaaacactcggaagaactttttaaggaatctatcgcttcccttcgccgcaacaagctgggtctcaagggtatcctcttcactcctgttgagcgctcgggccaccaatcattcaatgttgctctccgacaggagcttgatatttttgcctcaattgttctgatcaagaacatcccgggctacaagacacgccatgagaatgtcgacctttgcatcatccgtgagaacaccgagggagaatactctggccttgaacatcagtctgttcagggtgtcgtcgagtcgctgaaaattatcactcgtgccaaatctgagcgtatctctaaatttgcctttggctttgccctggcaaacaacaggaagaaggtcacctgcattcacaaggcaaacatcatgaaattggccgacggtctgttccgtagcactttccacaaggttgccgagaactatccgactctggaggtcaacgatatgattgttgacaatgcatncatgcaagccgtgtcccggccccagcagtttgatgtcatggtcatgc

SEQ ID NO: 5987 - DNA, 1438 bp, Aspergillus oryzae
cacttggtctcatcctctatagaacaggagactgctactctgtacattacctgaacactttgattccccctccgttacgaattccgttcctctcttatctcattttttaaacgaattacccctcctactcttttcacaatggcccccgctgtcggtatcgatttgggtaccacctactcctgtgtgggtgtgttccgtgatgaccgcattgaaatcattgccaacgaccagggtaaccgtaccaccccttccttcgtggctttcaccgataccgagcgtctcatcggtgatgccgccaagaaccaggtcgcaatgaaccctcacaacactgtcttcgatgccaagcgtctgatcggtcgtcgttatgccgatgctgaggtccagtctgatatgaagcactggcccttcaagatcgtcgataagggtggcaagcccatcatccaggttgagttcaagggcgaagagaagcaattcactcccgaggaagtctcctctatggtcctgaccaagatgcgtgagaccgcagaggcctatcttggtggtactgttaacaacgccgttatcaccgttcccgtctacttcaacgactcccagcgtcaggctaccaaggatgccggtcagattgctggtcttaacgtcctccgtgtcgtcaacgagcctactgccgctgcccttgcctatggtttggagaaggaggctgaccgtgtcgttgctgtctacgatcttggtggtggtaccttcgatatctccgttctggagatccagaagggtgtcttcgaggtcaagtctaccaacggtgacactcaccttggtggtgaggacttcgatatcaaccttgttcgccacattgtccaggagttcaagaaggagtctggcctcgatctctccggcgaccgcatggctatccagcgtatccgtgaggccgctgagaaggctaagatcgaactttcttcttctcttcagaccgagatcaaccttcccttcatcactgctgatgccagcggtgctaagcacatcaacctcaagatgactcgctccaacctcgagtctcttgttgaccccctcatcagccgcactgttgagcccgtccgcaaggccctgaaggatgccaacctccaggccagcgagatccaggacgtcatcctggttggtggtatgacccgtatgcccaaggtcactgagtccgttaagtccatcttcgggccgtgagcccgccaagtctgtcaaccctgatgaggctgttgccattggtgccgctatccaaggtgcttgccttgctggtgaagacacccacgttctggtcctcgatgtcactcccctctcttttgggatcgagacccttcgggggagtgttcactacttctgataaaacggaacaccacttttcccaccaaaaaagtccaaaccttctctaacggcggcgacataccaaactgcc

SEQ ID NO: 5988 - DNA, 692 bp, Aspergillus oryzae
  misc_feature (1)...(692): n = A,T,C or G
gatttacttcccaccccgccttcatgatgtctgacccttatgcccaacacccacactacgctcctcctggtcctggacccgaggccaacttttatgcgcccgcagatagcgtataccaaaacccaccgtacgattatgagccccagaatccgtatacgcagcaatctcctccaaaccaaaactaccaatatggctcgcagtatgacttagcgcaaacacccaggtcttatccccctcaaatgtcgggcccacagcaagactacctcaatccggcttctgcgggaggctttgagcaggaaaataaccatcgagaaagtaacgctgattattacaacgcgcccaccgacgaacaagatcggcaccatcctccagactctcgtccccaagaagccgacaacacttccgacaatgagggaactgagcgcaatcttgcangggcacttgctggtggcgctggtggctatgttttgggacgccaaagtaaccatggtcttctaggggctgtggggggtgcgatactatggaacttcgtcggagacaagatggaggattaaccagatgatgangaggatggtcattataaccgnaccaccaccaccatgggcataatcaccaccgtcaaaagcatttgtaccgcccatcgccatcataaacatcatgggcattaatcgaggcattcttcgaacagaacn

SEQ ID NO: 5989 - DNA, 676 bp, Aspergillus oryzae
gcgccgcattaccatccgtagtctgtgccctggcgcaagcatctactgttactattaccgaccacccctcttctcccgcctttgctggcgccatcgccttcaatgttgaccacaatgtccgcaagtccccctcaactactgaggtcattatcaaaccccatgaatggggaacgctagacagcgacccctgggccgtcgataagaaaggaaccttcacacggatcatcggcgcagattgctactggatgtcttcgcagcacgagaacctcgtaaatacgatgaaatggttccttgcacccggcggcaaggtctgggttgttgccggatttcacaccgggcgaaccatcgtggccgggttcttcgaaactgccgtgaacaacggcctggagattgagcggatctatgagcgggatctcaattccggggcggaagacgggaaggaagtccgccgggactgggtacctgagcgggagggcgaaggccccgagaatcgcaggaggtggtgtgtgattgctctcctcaagagaaagggagagtagatgggcccaaggattcagatacccaggataaagcccccaaaccagcatccataagcggcatatgccaatggatccatacatcatgactgatgaaacgtgacgactgtacagcatgattgaagatgaaaaagaaataa

SEQ ID NO: 5990 - DNA, 691 bp, Aspergillus oryzae
gttatatagtgtgcggtaacaaaagtatatccatccaccatgtcagtcgaaattgctcagctccacagtgaggtcgaggctctcgtcgagaagttcgacgttctctctaagatcaaggaaatccaggaggcaggtgatgtccgttcatccgtccctgtgaccatctctgtcactaccgatgccaccatcagtctcctcgaggacaagtcaaccattggcgagtcgaccgaagccccgaagagcctctccaagggcgagaaatcttccttcaatatcacccagggcgatgaactcaagtacaccgtcactgctggtgagctcactagcgacttcaagatcgtctttgacgttgacaagagcgcacccaaactgaagctcagcgacgaactcgaggacgacaacgccccaatcggattcgagaccactaagaccgagaccaagactgaaatcgaaatcgaacgcgaggtcgaggttgagaaggaatggaccaagggcaagaagccagagaggaagaccagcaaggagactaagcacgaggcaaaggctggtgcacactccctccagcacgaggtcgagaccaagttcaagcaggagaaggataagagcgagacggaaaccgagactgagattgagattagcaacaagaaggtcgaggttgagtatgttatctactagcgcttagggtttcacg

SEQ ID NO: 5991 - DNA, 1004 bp, Aspergillus oryzae
gtcacattcaagttcaaatggcgtccagtacgaactccacgagtgtgccctctggtatgctgccatcggtgataaacgtgacgaggttaccattcgatcttcattgcgaaacggacttatcggctttacgcatcgcagaatcgcgtggtcaatttagattacaccacactgccttctacatcagagttagtgcccatatcttctggtgggttttacgcaaacctcgtatccttcttcttgaacgcgctctttgcgataccagacctgggtattgggagccacccggtggggctgccgaagatcaggacgaaacaccgggagatgccctaaagcgagaggttggggaagagaccgggttacaactgtcccaagtcactcatacgctcccgactcaaacctggacacggtcaaagggacgcgaagactacaattgggttggccttccatgtatcatcaaggtctctgagcttgaaacttttgaatcacgcggaagtagccaacgtgcgtctcagcctgtactgaaatgggaggacattatacgactgaatcctgaggagcaccaaaattttgcatgggcaacagaggaggaggtgcgatgcgacaagtataagatgtttggaaaccacaaggagactgccctcaaggcttttgcagcagtgacagagaactgctcagtctaagtatggggtgtgtggatggaatgaggctgaaggatgaggctggaggatgaggctggaggatgaggctggaggatgaggctggaggatgaggctggaggatgaggctggaggatgaggctggaggatgaggctggaggatgaggctggaggatgaggctggaggatgaggctgggaggctagaataataaaagtcacgcgagaaagaagtaaagtcaagaaggtcaggattaattccaaactttagactagtcttcagaaatgtgatagaagatgggtaccccctgaacaaaaagcagagaaagccaatacatgctgtctgggtg

SEQ ID NO: 5992 - DNA, 712 bp, Aspergillus oryzae
ggcagcggttgcgctcgtgacgacctccctttctaacggcgtcagcgtcggcaatggcaccgttttcccgcacgcccgcaatggtggccccaaagatcgcccggtctccggcatagttccgccgtactggagtcaccatcggaatgcctcccgtacctctcagatctctctcgaacagcccgcgatcaccctggaagaccatacagaggatccagattcggagacgagccgcggactatgggccaggagcgtatcagtagatgatcatgttgtcgtccagggaaagtccggcattggcgcatatgtggtgtggagctgtaccatacaaaccctcgagggtggtcccatcagcgttcgcatgaggtactctgaattcgatgacttgagacaaaagctgatatcctcattcccgcacgcgaagaatgctttaccagctctaccaccgaagagtgttctcttcaaattccgtccagcattccttgaatcccgacgggtcgggttggaatacttcttgaactgtgtccttcttaatcctgaattttcgagttcgccggtcgtgaaagactttctatttggacgcatgtgctaattgcacgtcgactgtaccactgctatacactcacagaatcatgacgttacgcctatctatatatttgccggagtgaatggagatcccgagcaacaataatacttgtactttaacatggctaag

SEQ ID NO: 5993 - DNA, 723 bp, Aspergillus oryzae
  misc_feature (1)...(723): n = A,T,C or G
gttctttcctacacactcgctcagtcttcaatcgctgtatcctctagtctgcgctactcttttatctggccatggtcacatattgccgcgaccggtgggggaacatctatcggtgtcggtcgtcatggcataactggggtcgttgggtcttactggccgtcatcatcgtagtagccttgatagccttcttcttttacgcatgtctctcggctcgtaaacgccgtcgccacggtcaacgacccatctacggcaccggctggatcccaggcacacagcctccgccaggccaatggcagcaacagcaatatccatctcaaccaccacctgcgccgccgggataccaaccgtccaccgagcatggatacgggcagaattacggttcaaaccaagggtactttggtcagcagcaatacggatccgagctacagcagccaccgaacgcatatgcgcgagacggcgtatactcaccccccgcgggaccaccgnctggtcatccgaagtaggngataccagaanagaaagttatggatacatatagaccgtatacatggntaccgaaggaanntgacgagnggccattgggcgtgtatgataattcgggtacggtgcttncatttcgagggtatcggagttctttgattttctttcacaaggggctttactagattcttgccgctggttgacactgaatacagattcttatcttgataagtaagaatacgt

SEQ ID NO: 5994 - DNA, 697 bp, Aspergillus oryzae
  misc_feature (1)...(697): n = A,T,C or G
gcagactcttcgcgccaaaaccagctacccctttaagccagccggagagcagaagccttccacggagcagaagccactgtcctcttctggtaacgctttcagtaaccttttcgctccaaagccctctacacctagcgagggatcgaagactagccagccagagaaggctgccactcctacaccgcttttctcaacccccacatcaggacctgatgctcctaaatcttctggtcttttcgcgcagtcgccgttgttttcggctcctactgtaggaaataagaccccggctccagctgtgaccgccccgaccccgtctcaaagcccattcaaggttaatggcacaagcacggcctcatcggcctcatcggcttctgctaccgaaaagagctcgacaacaagctttgaggacatgcgaccatccggacttcctgatgatcttgataaagcaagcaaggaagaagtggagacgttgtatcgcatgcgcatgttgaatgaatgtttcaaacgtgaagcgagtcgcttggatcccactaaagacgactttgatgctcttgtgcagatctacatgcgtgttcgtgacaccattggagcgccagctggtccgcaaaagcgtaaagctgcggacgaaaggcaactgctgatggccattcccgtaaaaaggtcaaacccttcggtttgatgctgcctctacaaggan

SEQ ID NO: 5995 - DNA, 932 bp, Aspergillus oryzae
  misc_feature (1)...(932): n = A,T,C or G
caggtttaccactcggtccgattcggccaagggacactgcccaagcgatccaaagccacaagagatatggaatagataggtctgcaggtgtaaatgatgtagagttctgacgacactgtgaagttaaaaaggacatgaaacaataaatactacggaaatgacggagtaggaaaccttgtcacgaggggaatggcccaaatggcgcgattccaaggaactgacggactgaggcaacagcttgtccttccgcgctatcgggcgaaagtcacatttcaccccttatcagtggtgatattgactcaaacccccgcaaggtggtataaagtctcccggtgtcccaccctgtccacggcttgtttctcttactaccctccaactgtcaaccccttaagcacaccaccttacctgtccacttcgaacacttctccattgaaacattcactacacctttcaatttgcgcacgtaaacatgcctctctacaacgtcacacttaagaaagactctccccctgaagagttggagaaagccaaggagcaggccagggaaaaaggcggaaccatcaagcatgagtacactcttatcaagggtttcactgtcgagtaccccgaggaccatgtcagtactcttgagtcgagtgaccatatccacgtcgaacaggatcaagaagtaaagacccagtgataggaatacgcatcgatcccggggcaaacggcgatatagtcactgcttgcaacaaatagcagaactggccacataactaagcatcgatgctggcctggggaagttgcggttcaatggtggctgtacgatttacgaatatcctagtctagcgtttcaagagaatgtttctcatgagtaccgggactgctgtgcggaaagctggactcatctgggactgttcccttggtcaattatgacccanaatcatatc

SEQ ID NO: 5996 - DNA, 688 bp, Aspergillus oryzae
  misc_feature (1)...(688): n = A,T,C or G
agacgtgattcgtcttgtcaccctttctccatcccaatttactgagattatcgttcaaacacacattgtttctcaatataccaaaatcttttatttttatcctgcacactgctgtgcactatagcaaaatggcacctcgtggctttacgaatcctgctcccaaaactgagtctgctcgctctgctttgagctcgtttacctgtacactctgcaacaaatcctattcgcggcatcccgagtatgaagcacatatctcttcctacgatcaccagcatcgcaaacgccttcaagatcttaaacaactctcccgagacccaaacgctgcggagaaggctaggcgagcggaaaggagggctgacgcagaggctggcctaagagtcattgataccaaagctagcgcagcagtgggaaccgggggcgggggtggcggaggtttcaagaaaggggggttcaagagctcctttaccactgtcaaaggtcctgtcgttccgacagcaccaacgaagaagaacgtacttggggatgatgacgacgaagatgaaataccagaatcaacttatataagccaacgtgctcaggctacccaagacccaagtgatcagcctgattacgccgaaagtgacacggatgctgaatactncagtgatactatgggtagtgcctactatgatccccttaagccgacggg

SEQ ID NO: 5997 - DNA, 657 bp, Aspergillus oryzae
  misc_feature (1)...(657): n = A,T,C or G
ttacgaggcgcttttttctcggcggcttctattgcctcacgctctctcttgacgcgcttgagttcgcggagtttccaggcggcatattcggcttcggggtctattccatccttgtcgtcaataccattttcttcaactgcctctaattcatcgtcatcccattgcttgtttgcagcgctccgggcaattgcttccttctccaactgctcgcgcactaacatatcggccttttcttgtcgctgcactctgcgggcctctgcctccgccgctgaatccgcagcggctgtattaggtgatgctccctgcccgttttgtgtctgatttgctgcattgttgcgcttgtcttttttgataaatgtaggtcgtagaagaaccctcctcggcgtctcctcctccgaactactctcttcttcggagctctcttcctcctcttcctcttcttcctcactttcctctttgctcaccggctcacccgctgcttgaacaggagctgcggccgcagcacccccattgtcgccagcaacacgagggggaggtttagactcttcctcttcttcctcagtaacgaagccctnctcatcttcatcctcttttatttgcacatttttcacccctttagtaatggttccgccgggaaagaagtcgccttcggtgccc

SEQ ID NO: 5998 - DNA, 687 bp, Aspergillus oryzae
catcaggtttgaaaataaccggacagtaggcatatgagtcggatgcgtcaacatgaagttggtacttgaaagccactatcggtgaggggcgagcaattgtgggaatatgtatgctgtattgtcctcttttctcatccgatagatccttatctttctcttcactcacaaaatgagggtttgcagctaccttctccagtacctggaaattttctaaacgaactgtggtgttcgcgttgggggttccgttgtatgccaatgcaagctctccgataacggatgacttggttacaacaccgtcggagaaccatgcattaaccgtttcaatgatagacgcgttcagacctggttcgtggagatcagggtgtgcaactgcacctgagctaccgtgcaaggtgtgccccgagcgtaccgaggttgtatctgacagagcatgatcttctgttgcaatgctgggagaagccgcatgctttgatgggagacccggcgagaccggcatatggacgtcagacccagatggttgagtaaggacatcactaccttgcgttggattaggaatgaaaacctgggtaccggcgtcacgccggccgcgcaaagtccctacattgcgccctaaaccagtttggttgggctcgcaatcttcacctgattaagccctaatctgccatggcttgcgttaaacctgaactt

SEQ ID NO: 5999 - DNA, 1247 bp, Aspergillus oryzae
ctcctctcttggttgtttagtttttattcttcacagccgccaagatgtctgctagccagagcgacaagtccgttttcggcatgcccggattcgttgtcgacttcatgatgggtggtgtttccgccgctgtctccaagaccgctgccgcccccatcgagcgtatcaagctcctcatccagaaccaggatgagatgcttcgcgccggtcgtctcgaccgcaagtacaacggtatcatggactgcttccgtcgtactgccgcctctgagggtgttgcctctctctggcgtggtaacactgccaacgtcatccgttacttccccacccaggctcttaactttgccttccgtgacacctacaagtccatgttcgcctacaagaaggaccgtgatggatacgccaagtggatgatgggtaaccttgcctccggtggtgctgctggtgccacttcccttctcttcgtctactctcttgactacgcccgtacccgtcttgccaacgatgctaagtccgccaagggtggtggtgagcgtcagttcaacggtctcgttgatgtctacaagaagactcttgcttctgatggtattgctggtctctaccgtggtttcggtccctctgttcttggtattgttgtctaccgtggtctgtacttcggcatgtacgactccatcaagcctgttgtcctggttggtcctcttgagggtaacttccttgcttccttccttctcggctggactgtcaccactggtgctggtattgcttcttaccctcttgacaccgtccgtcgtcgtatgatgatgacctctggtgaggccgtcaagtacaactcttccttcgatgctttccgccagatcgtcgccaaggagggtgtcaagtctctcttcaagggtgctggtgctaacatcctccgtggtgttgccggtgctggtgtcctgtccatctacgaccaggtccagctcatcctcttcggcaagaagttcaaatagacgattgattaacttcaattcgtttcgggtgtgacgttaatggggaaaggtgtgatctgacgtaactgccaggtgctgaaaatttagagatatgcgtcaaggggttgtgtaatcttgagcatagagcagtgtgctatttccttgtaccagttgtactttactgcctgcaagtttattttatttccttttctttcaatattgcttccttgccagtctgatgcgaaatcaaatagcctgtctttttggaaaaaaaaaaaaaaaaaa

SEQ ID NO: 6000 - DNA, 685 bp, Aspergillus oryzae
caattgggcccccgagagctcaccagcagcccatcaacaggaactcgatatggtggacggtggcgaggatcttcagaacattcctctgcatcctttaattcagccagagcgtcacgtagatgttatctttgctgttgactcctccgccgacacgacttattcttggcccaacggcacagctctcgttgccacttacgagcgcagcctgaactccaccggcatcgctaacggaacctcattccccgcgatccctgaccagaatacctttgttaacaatggcttgaatacgcggccaacgttcttcggatgtaacagtacgaacaccacaggccctacgcctttggttgtctaccttccgaactatccatacgtgtcttactcgaactggtcaaccttccagccaagctatgagatctccgaaagagacgacaccatccgcaacggatatgatgtggtgacgatgggtaacagcactcgtgatggtaactggacgacctgcgtcggttgtgctattctgagtcggtctttcgagcgcacgaacacccaaggttcggatgcctgcacccaatgctttcagaaatactgctgggatggcactacgaacttcaccaaccctgccgactatgagcctgtcaccctgtttgaagatagtgctgggtccgctcttttcccggctgtatataac

SEQ ID NO: 6001 - DNA, 681 bp, Aspergillus oryzae
tgtcatgcagcgccagacttgttgctatcctacagcgtacggtgtctggtggcacacatcctcgccgcccaaccttcagtaatgcaagtgccattagacctcaaccaggtgatatccaattagattcgcctgaggatacatgtgcccccccctttgaacaattgggcagaattccggtgattgactatgaagagttggaggagtttgtggctcttaatcagaagacgaagcctatcacaacgcggcgcaagcacagccttagctcacagagcaagaagtctcgtgttttctacgatcttcgtccgaacgcccagaagtccgaagcccatgaagcgaagcgctcatcgagtgttgagcgctcatcagatgacattattggactcgacttgaaagacaacgagaaagtcttcgcggatgctgtcaacgaaaaacaattagttgaaaatctcaaaaatgagaatgaaccgactctgttcggcttcttctcgtccgagtcacagagtactgtacatgctgcggaactgggcgaattagttttccctgtggaacacctttcgagacctttttccaactggccccggaaagaggcgttggtggctcgaagttttgaatccccctgaacccaaattggtgctctttcgaaaacctttttcaattcccccactggacaaacaaagaaat

SEQ ID NO: 6002 - DNA, 694 bp, Aspergillus oryzae
  misc_feature (1)...(694): n = A,T,C or G
cgaggcccagcgcagcactgtcaatattcccatctcccttatccgccccttcaatacaccaggcccatatggaacacagttttttccacagcctacattgcccccctagggtcacaaagacgacccctgtcctcccagacacccagcacctcagcgcgtctcaccggccggacctgtatgatcacaggcgggacatcaggaattggattcgcaatcgcaaaccgattcctccaagagggcgcagagcgcatcatcctcgtcggacgatcgtacgagcgtctcctcaaagccgccaccagactccaagtcaatgacgaaggcgcccgaaaccaagaagcggctgatgaaaccgtacgaaagtcacagggaactttagtcgaatcatcggatagaatcagtctccttgtgggtgatgtatcggaggctgggtcgtggctgcgtgagctaaagaaggcgatgcaacccgtcgatatcctaatcaatgcagctgggatctctaactccaatattcttccgaagacatctcctgaggaagtctcacaaaccctccggacaaatcttgaaggcgcgatcttcacatgtcgcgctcttatccgggcttntctccgtaacaggttaaaggggccgaaccgcgagacccgacccccctcgaaatgtatcataaacatctcgtcattactagcgctgaaagggg

SEQ ID NO: 6003 - DNA, 674 bp, Aspergillus oryzae
  misc_feature (1)...(674): n = A,T,C or G
ccagttctacataatgattgccccttcagagcccgtcccatcctccagcgctgccgcagggctaacccaattctttcccaatgccaactttaaggaggcttttgatgaaaaggttgtcttgattgtgggtggcgccaatggtattggagctagccttgtagagctctgttgccaaaacggcgcttacgtctgcattggagacatcgatactgcccgaggagaggccctaagcaagaaatgccgggacaaatggcctgtctacttggaccctgcccttccaccaaagccgccccgagcctccttttacaccacggacatcaccgattaccaggccgtagcctccctctttgaccgtgtattcaagacctacaagcgcattgatcatgtagtagtcacagcgnntagcatgnaaagcgggcacaattggtttgaccaaaagtgaatttggagtcgtgcaacagccttcttccacganggatattgacgtcaactcatcgggttcctctatgtcacccgnattgctagcgtctacttccgccataaccgagaccaggagttgatcgaaccatcctggtggtctcctgtgcccgttgcttcaaaagagacactggnggatcaatntaccaggcttcaagccacgtgtccaagcctaatgccgttttttcgccttaatt

SEQ ID NO: 6004 - DNA, 670 bp, Aspergillus oryzae
  misc_feature (1)...(670): n = A,T,C or G
gaaaatacaccgaggccattactcgacgtggacgctcaacggtcatcttctgcacactcttctttttgcgtttgaaggaaactccttgctctacccgtacaagtgtaccgggcgaatccatcgatcataacaagatagttcgtttgcagaccacttaaaggtcagtcatgaccggcatggttcagactgacctagcacatccatcgacgtccaaatacaaagacgagccggctgacgagcatcttcgacaccctgggcatcaaggcccaccacatcttcaacttcaacatccaaggccagcgagtcttgtccaacagcaaaagcaccccaactctcctcttcaacccagcgcaggtctatcttctggatcgtacgccccccacgccctggggaacggagttctgcaccatccgaatccgtacggaccacccgcacaagagccagcgtactacgcatcccaccctccatatacagcagcaagtgcaccagcacagtatccctctagtggaccccctgaaatgatggcnacagccacccagatgcaaaggccttatcctccaattaccaaacaccacagtccggttctccagcatcgggaacttctcagtcacatgaacagcacagccggaacctttacagtcaatcgccacaaatggcatcgcagatgtat

SEQ ID NO: 6005 - DNA, 732 bp, Aspergillus oryzae
  misc_feature (1)...(732): n = A,T,C or G
ctcgcgccggcttcgtcaatgtcctcgaatggtggcgtacttccggtctcgaactccggtacactgagcgagccctcgagtcagccagcgcggaaggccgtgtgtccgttctagactggtggaagaaagcctccgcgaacgcacccccatcggaccccatccccctcaaagtcggaaaatccgtcctcctagcagcacaatcaggccgcacagcatccctcgcctggtgggacgcctcaggcatcccctacagccacgccgaatcagttgcccgcatcgccagcacgcacggccacgtccacgtgctcgacttctggtaccgactcaaaggcgccaagatgatcttcgactcgcaggtccttgtcggaccgacaaagaacggacacgacaacgttctcgaatggtggcgacagagcggtctccgcgtcgagttcaagacgtgcgatatcgaagaggccctcgaagatgcagaccccgtgtccggtgccgaagaaagagttcggcggtggtgggctcgcaatggactcaaccttggcgtggggacgagcgaatggatganaacgaaagtgttgtgattgtacttcttgggcttcccttcttctccttccatttgtataatgacttgatcggattcttatngttagaaataccccttatttggctttacgggttacngagcacaactggttacgcacttgattatataggtatagcctacactttaaaatgaac

SEQ ID NO: 6006 - DNA, 665 bp, Aspergillus oryzae
ctcggaatgacgccaatagtcctgtcaccatgttagccaaactgctactcatctctaagctctttggaccaatctttggtcaaatatacgccatacttggaggggcggtttccacccgcttacaccgactcacctaccgcgctgtcgagcatccgcgcaatgttgtcgttatcggtgcttctttcgctggataccacgcggctaaatgccttgctagttcgcttccaactggataccgggctgtggttatcgagaagaatacccattttcagttgacttgggttttgccgcggtttagcgtggtgaatggccacgaacataaggctttcattccttatgggccttaccttgatcatgttcccaaagggttcttatcaatgggttcgtgatagtgttgagcgaattgtacccggtgagaatggacatacggggaaggtagagctcgcctctggtaaagatattgaattcgactacttggtgcttgcgactggggcatctggagcacttccatcgcgagtaccagccgggagcaaacaggaaggcatataccagctactcgctgagcaggaaaagctccgagctgcgacgaatgtggtcattgttggtggtggagctgcgggaattgagctcgtggcagatgctaaatcgcgatatcctgaaaaaag

SEQ ID NO: 6007 - DNA, 764 bp, Aspergillus oryzae
  misc_feature (1)...(764): n = A,T,C or G
agttcagacgtactccgttggtttggccagggataagttcgtcaaatccggcgattatgtcactatctcgcctcaccggtgtatgactcacgacaattcgtggcctgttgcattgaaattcatgtctattggtgcaacgaaactacatgatccgaagcagattgtgatgacgctcgaccacgatgtacagaacaagtcggagaagaatctccagaagtatcgtcagatcgaagactttgccaagcaccagggggttgagttttatccggccggaagaggtattgggcatcaagtcatggtcgaagaaggctatgcttggcccggtactcttgtggtcgcttccgatagccatagtaacatgtacggtggcgtcggctgcttgggtacgccaatagtgagaacggacggtgctagcatctgggccactgggaagacatggtggcagatcccgccggttgcaaaggtcactttaaccggtgtattaccaccgggtgtgaccggcaaggatgtgatcgtcgctctttgcggattgttcgataaggacgatgttttgaaccatgcaatcgaatttactggccccgaggagactatgcgcagtctatcggtagatgcccggttaacgatcgccaacatgacgacagaatggggtgccttgtctggactgttcccaattgacaatgtattgaaaggatggctganaggcaaggctacaacagcagccattgggctttgcgaagggtctcttcaagaccctagccccccag

SEQ ID NO: 6008 - DNA, 639 bp, Aspergillus oryzae
ccgacaaactgattgcgcctgactcgcataaaacactgctattctaccgcgcaaggaaatggcaccacaaaagtccgttaccgaagtgccacggtctatactccctcgcttgacatggaacggctcctctgctcggactactgttcctcctccccagagcaacattttatcagcaaggcaacaacagagaacgctacgcatacatagctggaactctgccgggcgacaactacatactttgaccttttctcctcactcttctacatttgtttccgcaacagtccgagagccgaccttatcctcaatatctagacgattaccagaatcaacgagtcgtccaaccagtcgaccggcagcacccacaggtaatcctatccgatataatggtgtttacgtcgctgcatttaaaccagctcggcgcgctttccatgcctccgccacccaacaaagggaccaccatttcgatacgttaaagttcgttcagcggttgaaagaggaaggtttcagtgaggaacaggctgtcgcgatgatgcgagtcctaaatgatgttatccaagagtctattcagaatttaacccggacaatggtcctcagagaagacaccgaaagatcgacgtatactcagaaagtcgatttcgg

SEQ ID NO: 6009 - DNA, 1216 bp, Aspergillus oryzae
  misc_feature (1)...(1216): n = A,T,C or G
gatcataagtgctgccgtgttttgacaggtgtttacggttgttcaagccgctgcatatagctcaggaatataccagtctaacaccaggactaccacaatgaagggtctcgcttttgtgtgtggcctcctggctacatctgtgtctgcccacatgcaaatgtcgaaaccatatccgattcggagtccgttgaacaaggatgcagatggcgagaaggactattcatacacaaacccgctgtctacaagtggctctgactacccttgcaaaggatacgctaacgacccattcaactctgtcgccacatacagtccaggccaggagtacgagatcgaattgcaaggtagcgcaacacacggtggnggttcgtgccagatcggactctcctatgacanaggaaagactttccatgtgattcactccattcttggagggtgccatttganaagaaatacaagtcacagtccccagcgatgcgccaaatggggaggctttgttgtcctggacgtggtttaacaaggttcggtaccgcgagatgtacatngactgtgcacaggtcacaattgggggtgctgcgaaactgcaacaacaaacgctctctctcgtcgtgacagcttcgacagtctcccggagatcttccaggccaacaacaatggaccaggccaatgcaccaccactgagggtgaggaagtgaatttcccactaccgggtccctctaaagagggaagcctctctggcaagggctacacatgcaagagttccgctcctttcctgggtgattccacgtccgcagccagtggtactagctctgctgcccacgcccctaagagctctgctcacaagttcggctccgcttctgcgtccgcgacaccttccagcaaggtcgcttctgccttcggcagtccgtcctcccttcatggcgcttttgccacgccatccccctcgcagccagggcgcgtcgactcgcaccccctcaagcaccacgagtcgagccaggaaaactgcagagacggtagcattatctgcagtgaagacggccaaacctggtctatgtgcaccttcggtcatcctaccttcatgggtcctgttgccgccggcatgcgctgccgccacggcgccatgcaccgcgtgtggtgaagttgaatctctatttggacctgctaagtgcatatccctcgaccacgcttcgccggcgccagtatacaccattcttcatat

SEQ ID NO: 6010 - DNA, 696 bp, Aspergillus oryzae
  misc_feature (1)...(696): n = A,T,C or G
agaatgagtactatatggccgagggcacaacactgttgctggggcgtgcgcaccgcttcccatggtcatattctccctttctttggcgtgggtcgctcctcaagtctcattactttctgggagacagtctgatctgtctggtgttactcgaagattgattgaacaaaaagccgattatgagatgtgacaagaccaacagcacggaatctgagcgataagcgnncnnatttactctccgccgctgaggagaagggggagactgaattggttacatattgattctgtttatgactgtatttatttattctactattcttatctattattatatgtgtcactattagtatgatatttctattgagaggttatctttgtgatgttatctcctactattagaattagagtgtctgatgttattttatgttatttttataacatttttatgttgtgtgcatacagatatgtgattgtttatagttcgaacttctattagttcactgtatctgactagttatgtgtattatcgctctctcttttagagttatatttatctgtgtgagtgatagtttctatatatctgtgttagtgagtctgtttatgtctgatagtatctttcgctgttactgacatactgtcagaaaataaaatttcctaagggttaaaagaagttacccattgtctcattttttattttgt

SEQ ID NO: 6011 - DNA, 681 bp, Aspergillus oryzae
ttctataatattacttgcacacgcagctctaattccttccttgaaactgtgatcgaaaatgggaattacaaaaccctctcatgatgactatacgattgcctggatttgcgcgttaccgctggagatggcggctgccaaggcgatgcttgagaagacgcatgaatccctcccccaaccacaagcggaccagaactcctattctcttggagaaatgagcggccataatattgtcattgtctgtttgccctctggagtgtatggaaccacatctgcagccacagttctctcccaaatgctgtcaacattctcgtctatcaaagttggtttgatggtggggattggtgggggtgtacccagcgaaagtgttgatattcgccttggggatgtagtggttagcatgccatccggctcctcaggtggtgtgatacagtatgattacggcaaggcattatctgatgggtgctttcaacgtaccggttcgctcaacagcccccctcaggtactgttgactgccgtctctcagatgcgcagcaatcacatgattaaaggttctgaaatttatgccactatcacaaataccctggacagtaatcggtacatgggagaacatttctcgccccctgatagaaacttgctgttcaatgcgaaatattaacttccaaagcactgtcttgaatgctt

SEQ ID NO: 6012 - DNA, 970 bp, Aspergillus oryzae
  misc_feature (1)...(970): n = A,T,C or G
ccactcccacgagttcatctcgaccaatttctgggtgaataccctcatctccactcttataccttttcttccttactttcccgcctcaattggctgccttagttgacaatgttctaccgtaacgttgctgcccgctctgctctcagggctttctctagctccaatgcctctgtggctcgctcggcccttgcaaacaatgtgttcaaggccccattgacctcttccgctcgttatcccgctcgcccgaccacttctcccagccttgctctggctgctcgcaagcctgtgaccactgctcttatccgccatgcctctaccgctcccaaggagggcaaggaaggtgaggaggatactgatatgatggccggtatcaagagtgaggcgaaagtgatcaaggataccttcagcctcagcgatgttcccaaggaggctctttacctcggcatggcgggtgttatcccctacgttgccacttctcttgagactgtctacctctcctatgagatcaaccgtgctgcttctctcggtgatggcctcatcttctctggccagagtgccgagctgatgcttcacatgctcgagcccatccaggtcggctacggtgctgtgatcctttccttcctcggtgccatccactggggtcttgagtgggccggatatggtggaaagctcggctacaagcgctacgctgccggtgtcatcgcccccgctgtcgcctggcccactctgatgttncccgtcgaagttgccttgatcagacagttcctgctttcactttcctgtactacaatgaagctcttgccgcccgttgccggcctgcttccgcctggtacggcatgtacccctttgtcctgaccttattgtcgggccacctttgtccccactttatcggtccgaaccaaatcccattcccgcaccgagccccgctttaaaacaaaataaacctcttctttattttgctgaaaaggaa

SEQ ID NO: 6013 - DNA, 728 bp, Aspergillus oryzae
  misc_feature (1)...(728): n = A,T,C or G
gagtgtgccgtacggatcccagtacggcgcgaggactacgccgtcgcaggcgtgcacatggacgacgcaggaagcctaataccaccccgcaacgcaccatcaaactaccaaagtcgccccgcattctccccacacgctcgggcacacaacggcgccgtcacaggcgtccgctggacctccaacggctcccacctagtaacatcaggtcaagacgcgcgaatccgcgtatggaacgcatcaacaggcgcaaacacactcgtccacttcggacccagagtccgcaacgccctgacctcccacctcgccgaaagggcaccactagttctcccgaaaggcgtcacggggcctggacaagagacgctcttatgggccaatttcagcgagaacgatgaccgtggggagatcctgatgttcgagctgcgggagggcacttttgtcaagcgtcttaaggtgcctgggctgatgggcgggcaacagcagttccggggccggtctagtgcgctcagtgcggcgaggattaattctctcgtttggcgtggtaatggggcgtcgggggagggcatggagatgttttctgcgcatggggatgggacgatccgttcctgggtttcgagggaaccggagggagaaccggatgaagcggaggaagctgagcaagcggatcgaanacggaaacgggatgttttggatgagatttacagggggtttattgggcaagcgtaagctan

SEQ ID NO: 6014 - DNA, 620 bp, Aspergillus oryzae
gtttggcacactgaccccaatcaattgcaagtgggagtgataatcgcctcgactaatgcatatgatctcatatcattgacatttgcgtcatgctaaagaccaaatagtgctttaactgatgatctttaacaagcgtggcgttggtttttcaaaatgtcaaacgatggatatgactggctttcgaattatccacgaccggacttatatcacgttgatcatagatatggacctgcttctggaccggctcaaggagaccaggctccgtatctcagtgcgccgccagcaataaaagctgccacggacagcccttccggctattttcactccccatatcagctacctaaccaagagttgatgagttatacaaatagcacctcccagtaccagtctgccgctcccatgccaggctcttaccagggaccaccaccttactatacgccgtcaactgctccagagacctcccaaggacaggtctctcaacagcccctcacttattacagtacttcatggaaattcacacaccatacgtcatactatggccatgatacgaaaaggcgccgtacagacacttttactccattcaaccagcattggataacacctacggtcactcccgacat

SEQ ID NO: 6015 - DNA, 658 bp, Aspergillus oryzae
  misc_feature (1)...(658): n = A,T,C or G
gcgaactcacaggcaagatcgtcctagcgattgtaggccgcgtcattgacgcctccggcgaagagcgcggacagctcaagcaaagattggtcaggcacaaatccgacttaggccagaactatcgcgaagtagtcgcattcctcgacgagcgtaaacccaagaaccctccccgacccaagggtaaacagctacctacatccacggaaccaaaccgaaatcaaagcagttcaagcaagcgccaagacaacgctaaatccgctgaaagagtggacgatgatgacgatgaggaagaggaagaggaggtgcagctgaatctggaagaggacgatgacgaggatctacgagaaagaggcctggtagaagacgacaacatcgaagaagatcacgatgaagaagaggaagatgaaaatcattctgctgctaattcagacgaagatgaaattatgggtgattgattttgccaatggagtgttatctgtttatcaatgttttcgggaaacgggatgagctcgagttgctntacttttcattcaaacacttttcaaacttttattttccgacgaggattttccttttttaaagggggtggtccgtggaatcttctctggtccagtcatgactgtcaactcttcagggttattacgacaaaattcttctt

SEQ ID NO: 6016 - DNA, 603 bp, Aspergillus oryzae
  misc_feature (1)...(603): n = A,T,C or G
gctgtcagcgaagctgctatttcaatcactaactttgcccgcgagttgggcttagacactatggacagtgcggcggagagctcgacagcttcctcggattcatcgccgagtgatacgcgaagcggctcttctttctctagcatcggatcagctatcagtatgtccaagcgtcacccgtccgatcaaggccaactaggtaccttagtggaggacctacaaaaaggaaatggcgagaatacaacgatgtcaatggcagggtcggacactctcgagcctccccggatgccgcaacatcttttcagtccagactccccaaccgatcccgccatcagtatgggaagtgtgtcccttcttcatgataagcccatgcaaaaaccgacaaagcaggaccagccggagccccctgcaacaactagccctaccactgatcgacctgcccgtgcagccccccgcccaaagggcccttgccgcggctgtggcgagatgatcatcgggtaatctgtgtcgtccgggattatacccgcccggaccgctacccccccatgcgcgtcaaccctcgcggggctatccccgtcctncacctncccgatatgcaagacgccn

SEQ ID NO: 6017 - DNA, 643 bp, Aspergillus oryzae
  misc_feature (1)...(643): n = A,T,C or G
gtccagagatggcaagcacactcccagccctggccattccaggccaacgtctgggcccagtgacctcctactccgccggtccaggcacacacgtacaacaatccaatgtctacgcctccatcgccggcccagtcgtcgtcgaaccagcgcaacccggctccaaaggcaaagctaccctaagcgtttctcgctcgatcagggctcctggaacaggcaatgcctccaaacccgtaaccacagcacccggcgccaaaccagcggcaacttccgctacccccaagcccaaagtgaaatataacaccctccccgcagtcgattcggtggtgctggcgcgcgtgacgagggtccagaaacgtcaggctacngtgtctatcctcgttgtgttggatgaaatcggcaacacccagggtgtcaacccctcacagacaacgtccgataacgacaacatcgaggcgattctctnctncgncgncaatcccgagaaccatagcaagttcgacgagctccgcttncaggctcttattcggaaggaaatgtgcgtgctggtgagaaaaccgcgtcgttatggacgagatgttccgcgttggtgatattgtccgtggaaccgttatctccctcggggatcagagtttctactatttga

SEQ ID NO: 6018 - DNA, 561 bp, Aspergillus oryzae
ggatagcggcatagctactaacttggtgcgaggcgatatgatgcgtgatcgcgcgggccgctaatcttccttggactggacgagagccgtaagcaagatgggctcgcttggaatatctataccggcgcacctttctttgctcttgacgtaaccccaaagggggatgaagagcaacagaccaattccaaagctgtgattagcgccatggaggaaaaggggttgagcttcttccagtcgagagtggtcatgaccttttcagctgacgaagctgccatttatgcccagtcccgcgctctcatggattggaataaccgtaatagcttctgtggcacttgcggccatccgacgctctctgtaaattccggtaccaagcgtgcctgtccacctacagacgttgcccgtgtcgtggagggaaaaccagccgaacgacctgcctgcaacacgcgcactactctttccaatctctcctttgcacgtaccgatccaacaatcattgtggccgttcttttaaccgatgcccaacggggttttggttggactatttaaaacgcttatccgccg

SEQ ID NO: 6019 - DNA, 699 bp, Aspergillus oryzae
  misc_feature (1)...(699): n = A,T,C or G
cgcctataaatcccttggggccggaaaaggcaggaggagcagtacctgatggccagacagaaggaacacctcgcacagcaacaggccatgatgaagcaaatgcaattccaggggctccccccgacgatccacccccatcagctccagcatcattcgagcgctcacagccttcacagccagccaagtttcggtagcattgcctcgcctgttggtttccaaccatcgcctattcagggacccatccagcagcaacaacagcagcagcagcagtcgcagccgcagccgcagcctctcgctggcttcttcgacgcggccggtccgatcaggcagaacctgcccaatgttggtcctcagatgcttggaacagacctgggcggcagccaagatcagcttcctgcccttcttgagcgtttgaacgtcaaccgaccggacccgtttgcatttggcagcgccgcgccctttgccactcggcagccggacaacttgttccatcaacagcaggttgctaccatgctccaagatcgggctcagctgcaacaggaacaagaacaatttgacagcactcaaggtgacagcttgttcgaccaacaggcccgtgaagaacggctccgccagtttcatgctttgagggcacaaggaagatgaattcngcatgcgcactgctgagggggcttcaactcaccccactactggcccntn

SEQ ID NO: 6020 - DNA, 688 bp, Aspergillus oryzae
gcgggtgcgaagaaggagcttgcttacttagctaggttcggtaaaagactgcaacctcgtgagcgtgtttatagagcgttatacggttacaaagaagtgtcccatttgggtcaggtgaggaatttggaagactatctacgtgttgcaccgtatctagtgccggaaaacatcaaatctctttgccagcctacaatcagacacccggactggcacccgaacaatatattggtgtccgacgatcttacaattactggtttaatagactggcagcatggctctatcttaccactcttcctaaattgtgggtttccgcaacatatatggaattgtggggacgaggtttcaaaatctctcgacacgcctaagttaccagacaatttcgatgatcttgatgatagcgaccagcttaaagagctggaaattctccgaaaacgtcgtatccatcattactacgcatggtatactgcaatgttgaatccttgtcatactattgccatggaccacaatctaagcttgatgaagggcctgtttttcaaccacgcaaccaacccatgggatggggatttggtgtcacttaaagcgggcctcgtttttttagggcaaaactgggaaaaacttggccacccttgttccggcactaaggcggggggctggccattaaaaatattcaaacggcgagggaacttcg

SEQ ID NO: 6021 - DNA, 832 bp, Aspergillus oryzae
tattttatcaagtatgtctcatttaagtagaccaggtatcagtgctaaattgtcaatgaatgtttacacaatatgcagtacatcgtttcctcatcacgaatgcaacctcaagccttgttagggttcttgaagtgtctcttcaatggccgccagctatgctcgttatactcttcctgtaccttctggcacgtcttgagaccccactcagatactccgaccatgagagaactttcgaacatgaatgccatgcttccatcgccgaccttctgcggcttcagttcagcattactggccccctcgaaagcatcggtgtcgggaccgtgcgcgctcatgacgttatgcaaactcgctccggctggttggaagccgccgccggttttcgcatcataattaccggagataaggcccatgaactcggacatggtgttgcggtggtaccatggcggacggaaagtgttctcttgcaccaaccaacgtggtgggaagatgacaaagtcggcgatggcagttccgacatggtcagaggggccagtgaggacagtgaaaatggaaggatcggggtgatcaaaggaaatagagccgatggtgttaaagcgacctaggtcatacttgtaagggtagtagttgccgtgccaggcgacaatgtcgaatggagtgtgatcctgacgagcggagaaaagggtgttgttgaatttgctgtacaggcggtactcggatggttcctcctcatcatcgaaagaagccacaggggcttggaagtcacgcgcgttggcgaggcagttcgagccaatgggaccaagttctgggagctccctcgtgccgaattggccat

SEQ ID NO: 6022 - DNA, 653 bp, Aspergillus oryzae
  misc_feature (1)...(653): n = A,T,C or G
gttccccaccttccattgtaccccggaacctgcggactcgggtgtcgaacctcttgtactttcgctcgcctacccattgacgccgacttttcccagttctccatcttatccgctgaccatggccggcacgaaccccaccggtttcgacatcaaggaattcaaggccgccgcttctccccggtcggtctgggcaaagaaggacccttgggctcgctatgaggcctggagatacaccggccccttcagtcgcttcaaccgtttcaagcgtatcttccccggcttcggtatcgccagcgttgccttcgccggatactgcgcatacgaggccgtcttcatgaagcacgacgaccatcacggcgacggacaccactaaaccagcccaattgaagtcaatgcattgagaacgggaggaataacacgacgaaccgncgaccgatatcaatgggttaaaaagacgaggataccccgggttgcagacgaagacgtccgtataccangaagggttgcggcatttaggtttcatacaagggggtgcgatgtaatgaatctgttctggggacgctcggacgagcgggaaataaagattctgatggtcatgacgcgcgcccttgctctaatcggcgcttgggttgttggaaatttgtccgtgtaca

SEQ ID NO: 6023 - DNA, 690 bp, Aspergillus oryzae
  misc_feature (1)...(690): n = A,T,C or G
cggcatcgtgatcatcgcggtcagttgttgggtgatagccacgttcggctatcaggtcttccattactacgaacgcttcgcgttccttccccagattatcgtagtctctatactctacgctgtgtcctcatcgaagtttgatctgtccacgccttcatctggngatcctcgcacgctcngctgggaatcggtgtcgttttttctatctgtctcagtgctggcatcacctatgccccgtgggcggcggattttttcgttaataaccctgaaaaaccatgacgagtgacactcttctcactttcattggcaggccctattggatcattcactatggcgctccttgccggacatgtattcgcatccggatccaaacgcattcatagtatcgtgtcgcgcctacgtccagtgggcacctcctacttctctacgtcttctcactcttctttcacgactccatacttctccatgtagctaaattctcttcctgctttcatctcgcattcgacctcgtacgtatcttcgatgtgacacctccgatctatccaccactgtcccttcctaccactcccttacattcatcactactactactatctccatatccttgacgcagcctacgctcatccattgcgacgctctcgccgatgaactcaaccaccgtcgccgacttcctcaaatgacaacctaccg

SEQ ID NO: 6024 - DNA, 676 bp, Aspergillus oryzae
  misc_feature (1)...(676): n = A,T,C or G
cacgaactcatctaagaatgtgatagactagtgttgcaaaaacgagcacgatcgctgaggagagcgaacatgaatccgccgaaccatccgatgaggatggttgaacaatatgccgaggcaaatattgcttttcatattattagcgcgtctttgtccgcttttgattttctttcttctcttcgtacctattcatccttatgattctatggatgagtttatttatgtgtgcttttgtagcgagcgatgtgtgactactcacctatcacgtttctactaccattatctggcagcaaccagtgctatgtctgtttatatcgttatgttatgttggtacgaagtttcctattgtttccaaagaaacctgcttatgtttactttactgggaacgcatgtatggaatgaatgttttgatggccctcttatttttgttcttgtttttcttggtttttttatttattttatcttttttcctatctgcaccatttcaaattcttgagatggtcaaactcttggatgatctatgatgccaaacacgtcttgcctttagctatatgccgaatccagccttactctgactgatcgaactgttccttaaaggtgattataagatgagttgtgggccccgatataactatgatgcangtggcgtgaagttgggtaattcccaccgcactta

SEQ ID NO: 6025 - DNA, 677 bp, Aspergillus oryzae
  misc_feature (1)...(677): n = A,T,C or G
cccttggttagctcggacgttcatattcgcggattcaggaaagaaggccttatgcgacacaattttggagctcgatcgtcgtgtacctgtgcggtgacttgagcgcacagttattgtttccgtcagataacaagtcggtcaaggatacagcccgagaaaattcagagagtgaagacaatgacgccgcgacatccggagggggatatgccccgtggaggacattgcggcatttgaccgtgggcgcaggatcaagcattccgtcgtataactggtatgctgtccccggtcttttagctttgccataatgggacaatatactaatagatcaacaataggttcatgttccttcaccaccacttcaatttcgcatccaaattcctctcgatcctcactaaggtctgcgtgcaacaggccgtgttcacacccgtcttcaacacctacttcttcagtgtccactcgctgctttccggcgcaactctcgaggagacctgggagcgtctgaagaaagcgctttcggtgagtatcaccaacagcgcgaagttgtggcctgcagtcaccgcgttcaacctcatgtacgtgccggctcaatttcggaatatattttctggagttattgcggtcggattgcanaacgtatctcaacttgttgaaaccanaagcggngcgagaagtctagg

SEQ ID NO: 6026 - DNA, 650 bp, Aspergillus oryzae
gtccaactactgcctgtccttatcccaggtttattcactcgttatccctcacaatcgacccaattgaccccataaccacttcctcccgccgcgcatcaccctcctaccaagcccaacgtgacgacgaccaccatgcgaacccacgacgaattcctcgccgaccaagatgagcccgaccagcccaccaaaagaaacaaggttacccatcccgcgaaccgcatctgctatgactggatggtcgtatctggaaactgtcactatgctagggaccgcgccgtattcacgacctaccgctccgtcgacctgcgcctgaaaaacaacatcttcaatcccaccgacgagctacacgtcgcgggctttggcaccgttcatctcaccgtgtgtaggagcccgcaggacccgacgtcgcatgtcatcgtgttggaggatgtgctgcatatccccgaggccgtgtgtaatggtttcaacccgctgctattcggtagtagcatgtcgtgtaatgcggattactgggagggtgcggatcggagtgggcagccggtgtggtttagtttgccgtttgcgggtcatacgaagttggttttggcgggggatcccaagggtgagtctgagttgattgaggggaggtattatacgcctaatttgtatat

SEQ ID NO: 6027 - DNA, 678 bp, Aspergillus oryzae
cgctattattacccacctccaacatgatgaaaatagccttttccttcatgagtcgtgcactttttcttctaagctttatcgtcataccaatccaggcaattgttggcggtattgaagccgcacaggcttcacatataggtgcactttacgctaaatccgagtttggtttctaccagtttagctgtggtggagtcctgatatctccgaataaaattctcacggcagcaaattgtgtggatggtcggtccctgagcgatttgaaaattggatatggttctttagaccgagatagcgaaccaactaccagtcatttatcggagattactattcatccggactatgatccgttgaccttgtcggcaaatatcgctgttcttactctacgagacgttttctctgcgccttcctacgcgccgttagcccaacagccttctattcgaactggtgattctctgacgttatacggttggggtcgaaccagccttgaaaagataaaattaccaacaaaattgcataaggtcgaagtacaagctttggacacaatcgcctgtgtatctgaacatcttgatcttggctccggacaattttgtgatacatcgacttctgggaaaggatcctgccttcggtgatcatggcggaccagccctagattcatctgggactgtggttgggatcatg

SEQ ID NO: 6028 - DNA, 685 bp, Aspergillus oryzae
gaagtcgaagcaagatggtgtctttctcctcttgtctccgggccttagccctcggatcctcagttctcgcggtccaacctgtccttagacaggcgactggtctagatacctggctgagcacagaagcaaatttttcccgccaggcaatcttgaataatatcggcgcagatggccagtcggcgcagggcgcaagtccaggggtggtgattgccagccctagcaaaagtgacccagattatttctatacctggacccgtgactcgggtctcgtcatgaaaaccctggtcgatctgttcagaggcggagatgccgatcttctccctatcatcgaggagttcattagctcccaggctcggatccaaggcatctcaaacccttctggtgctctttccagtgggggtctgggcgagcctaagttcaatgtcgacgagacagcatttaccggcgcatggggtcggccgcagcgtgacggaccagctttgcgcgcgaccgctatgatctcgtttggagaatggctagttgaaaatggtcatacaagcatagcgacggacctggtatggcctgttgttaggaatgatctatcctatgtggctcagtattggagccaatccgggttcgatctctgggaggaagtccaaggcacatcattctttactggtgcagtttctcatcgcgctttggtaga

SEQ ID NO: 6029 - DNA, 674 bp, Aspergillus oryzae
ctttcaaccctacatacacgcgatcttcctgtcaaccagtaaaagccctccaacatgaagtggtcagcattggttcctctatcggtctctgcactggccgttcttccctccactggtgcgtgggagttcacttggagagacgccagcaacacaagacacgtggaatccggccacgggccctccaagtgtataaccgtcgaccataagaaaggaatggtattttccattgatgcgcaaggcgaaaagaacatcaacatgttactgtacggcaccgatgactgttcgggcaaggctgtgggacaggcgaccgagcgcttttccaaagcgtcgtcggtagacatccatggtttccaagttgagagtctctctaccggatcgaatgcgaccacgactgctgcgaatgctaccgtgacatcgacaagactcactcaatcgtcctccaccgccaacagcgaatccagcgatgtgccaacgacgtcggcgacgaccacgtctgatacagctgccaccaccacaagtgcgagtgaaacaagcacgtccaccccgaatgcatcactgcgactgtccgctgccggtagcgacatggccaagactgtgattggtatggtgttgggacttgcgacggtcgaatggctgtgttagtcaactcttgtggtaatgagaggaggagagga

SEQ ID NO: 6030 - DNA, 647 bp, Aspergillus oryzae
  misc_feature (1)...(647): n = A,T,C or G
gtctccgctgtcttcacggtgttaaatcggagctatattcaggcaccggaaaagactaaatttgtttttctgtctaaagatccgaggaaagggatcaatttccaataattaaacacataatgggcgccggtagctccaagcctgacgcttcggcgggctcgaaacatgttttttcgagcagtggccccgtcgagttctcatctaacctcgttgaccacctccaatccaacaccgagacggacgcctcccgtgcaaagagcatcgaactccagatccaggcccgcgtagcccaagagctcgaacgtctccgtcaacgcgagcagcagaccattgctgagatcgagaagcgcattgcggaatccaaagacactgctccctcgtcgttctcttccacaccaaacatcagctaccctcctggctcgctgaacctggatgctccccggatccccttcgcgggccgcgaatacactcctgcccctgtccccgatgcgcaggccatcaaccgtgatgtgtccngtgactcggtaaacaccgaaatcgaggaactgcgtgcctagcttgaggccggagaaaagttggttaaattgatgagagcgttgagaaggccaagtcaatgtcgggaactgtttgcctttgatgaccgccgc

SEQ ID NO: 6031 - DNA, 677 bp, Aspergillus oryzae
gaagatccattgactcccagcctcccagccaaaatgaagatctctgctgctatttctactgccctcctggccgttagtgccgctgcgttcgacaagaaccaaccctggggcaagcgcgactacaactgtgtcaacgtcttccaaggcatccccgacaactcgaccgtcgctcccggcgctgagatcaacatcaagttcaaccgcaactccaagaactgcgagtctctgacccagtataagggagcgggttattctatctatctctacaacaaccctgttagaaaccttgacactatccatttcgacaaagaacttttcatcaagaaggatatccctgagcaggacggtgctgtcacgatcaccatcccgtctcaggagcagctcggcaccgttgcggacgacagcgtttggtatctccgtctctctactagcttgaacgatgctccccagatgcctactcttttcaatgctgctggacccttcgctattcgtgcttaaatgtccatggtagtcgtttgtttaatcgcgatggactattgacatggatggaaggctatcttgacatatacccttgtatcagcgtatctctcaccgtgaacacttgaccttccatatcatctttcattacctggagatgtacatgttaatatcctacgttttgggaccaggccgttgaa

SEQ ID NO: 6032 - DNA, 551 bp, Aspergillus oryzae
  misc_feature (1)...(551): n = A,T,C or G
tgagaatggcagccttgatatggaggagttcaaggagggtagcaagcgcgacgagacgatcgtgagcgccctgtctctatacgatgggctggtatgagtcggtggtggtcgcacctgtatgtttcttctcccatggcctcttcttcttttctttctcggcgaatccggtgtggtcggaattcctggttttttttatctccttcttttcttatcttgacgtaaccatttctgttttgtgttcattacttctttttggtctttttgcgtctaggattcccattactacctgtccttgtacttgtctacccgttgccccgtatgggtggtattctggtcggactgcttctcctgtactctttctccacgtctcgatgaaatgtgctatatcctggtttcatctttcggggacatttatatcatgaaaaatcacgggcaatggtttgtctcgctggcatcattggctttgattgacaaattcctgttcttccagtttgcagtttgcagaaaagaaagcgcgagatgngtgattgaggttatgcttctcctgatat

SEQ ID NO: 6033 - DNA, 686 bp, Aspergillus oryzae
  misc_feature (1)...(686): n = A,T,C or G
ctgacctgggggctaagaagatctgtgtatcttcgggcatctcaaaacgcatcgcagccttggagaaattttcgagccgaggtgatgcgcaaccaacctcgaatcaaaacctagcagcaccttcgtcggcttccttcgaggctcttaggaagagagcctccgtctcactgaatggtaatccggactcggcgccaggatctaggcatgggtcgttcactcctgaaagtttctctcgagcttccagtgtgaggcgccccgactcgcagtctagtgcaagcgtcaaacgtacaaactcagtgtcggttacagcccggataattcgtgactccaatactactccaggagattccaaggttgatccttcagagaacagcgtgctcaatctccacgctagtcccctgacagttgagcatgacacctgcgaatctccttcacccgatccgtcgccagaacctatggctagcaagtcgaaagagcgcagcatgtctccgtcttccgtcggctcgagtaaccagccttctgcgctgtccatgccgcgctcagagagtcggatgtcaatctcctctgcctccaagaatgaagacacctcaaaacctgtcgtggatgcccctttgtctcccgaaggaaagaaagaatctcgcgcttctcggcttcttcgtcaagaaagcacgccgcttgattcangg

SEQ ID NO: 6034 - DNA, 859 bp, Aspergillus oryzae
  misc_feature (1)...(859): n = A,T,C or G
ccttatctatcctcaccagtcaccactcgttctcaacatttcaaacttagtcattcatttcgaaaacccaccaaaatgaaatctctcactttccccatcctcctcactctcaccagcctcgccgccgcccgcaccgatctcgacggctgcaccaaatccgccaccgtcaaccaatggggcgaagccagcatgatctggtacgtgcccgacaccggcgagatctgcgatttccctgactgcggcggtggtcgcgctccccccaagtacaaccagcccgggtgcgccgcctacaccggcaccgagaccttgaccccgagctacctccccggctggggtcccgacggcaaggttgcgccgtccacttcggctgtctcggcttcggcaacgcattccgaggccgaggccacttccactggagccgttacctctgatactactaagaccggtagtactttgattactgctgcgccgaccttgtccactggggtttcgtcttcggcagctggttcttcttcgccggctggttcttcttcgcgggtggcggagagtggttcgtcgtcgagctctgcttcgtcgggttcgaggggctcttcgaatacgacgtcttcggcgggtgttctggcgactggtaatgcggctagtgcgatgggtatgaatgccggtgttatggctttggtggggggtttggtgggtatcttggccttgtagggatatccttgaggtagatcacagaggttaatgctgggagaatntattgtattatcaaggtggaggtattcattctcttgtattatgcataattggaatgagtacaagtgccatcatcttgantcnnnnnnnannannnnnntnnnaaaaa

SEQ ID NO: 6035 - DNA, 717 bp, Aspergillus oryzae
  misc_feature (1)...(717): n = A,T,C or G
ctcgatctgaagatccctgttgcaaaagtctagcagggaactttgatctctagttaagtccgatatcagaaaagaaagcaagatggtggtctgcagcttcttccagcaaggccggtgcaaatttggagaacgctgcaaattcgagcaccctggccaatcaagtttaggctcagggaaccgctttggagtcctgtctggaggaggtggtggtggaggcttcggaggtcgttctgcgcaacagaaccagcagccagcaaactatggtgtcacagcggatgatatcaagaccgacctaaccgctggtaagggtcgtccagaatgggttttttcttgttatggccctggtaaaaacgccccaaagcaattatttggaggtgctcagcgagagcaatctttcgaagagctgcggctgcgtcactatgaagctgctgcaacaggaaatgtagagcaggcagtccaagaggctcaggctttgtacgccgaggcactgaaacagatggatgtcatattgaacgaccttggcggtgccgtgaaatacatcgttgatggtatcaacgagcatccgaataggattgatatcatagaaggtaagacaggtcctgctgccagtcaagggccctctccatttgccaacccntcgcatntcggcaaccagctgctagcggtcagacataaggatttgtccacccgtcgcatttgggcagagttctggattcg

SEQ ID NO: 6036 - DNA, 671 bp, Aspergillus oryzae
  misc_feature (1)...(671): n = A,T,C or G
caagactctcacggcgatgcagatcgattccagttgccaaacggagggcaagtcccgatgtgtaccataaattcactgcctgtggctcattgtggccatacatgcaaagaagcaacaggcattgcgcgcattcaaaatcatcgatgcgcataacgtaatgcaactccagcacggcccgaccgaagaattcccgatgaataaaccgattttcttgctcgacccaagacttctccgtcgccgcaatgctaagaccatatatacaaagaaattggataccgggtcgacttccagattagtcatgaaaggagtaagatatttggattcgaaggttggccgatggagcactgggaggtaaggccagcggcgctcaaagaagatattcacaagctctacataggcagcatcattgagaagactcaaggaaataggctgttctgttggcattgaatcatccccccagagattccaggcgcaactcaatgtgctcatattcatgccctcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 6037 - DNA, 676 bp, Aspergillus oryzae
gcagacaaccaatataatcattgggatctatttgacttgatcatcaaaatcgtcaattgtctttttctgtgcactaagtcttcgagctcgacttgttcattttgattaagcatccgcctcggctttacgtcatacatctagaaccaagtactaccagtttcaaggcaaagacttcttttcttagtgttctattgttaccaaatcgacgagaattcacaatggttcatcctacttccacctgttgtaaaacctcaggagacgggtcctgcgtttgcgcagctcaagccaagtgctcctgcggcaaggagagcgctcttcattgcacctgcaacaaggccgcaaccgaaaacactatctctggggctcggtgctcatgtagggcccgccccgctggacaatgtacctgtgaacgcgcaccgagtgagaaccatcccgtatcgggcgaggcttgcgcatgcggcaaaaggccttcttcttcctgcacttgtgagaaggttgaagctatcgacgcagccgtcgagagcattgagacagatttcacgtcccgcttccggtcgtaattgttcttttcacttttatttctcggttgctattttgtcttggttggtttttatcatcgaattcattcctagagttcttatagggcgttgggttggtgctcggaactgcatcatga

SEQ ID NO: 6038 - DNA, 720 bp, Aspergillus oryzae
  misc_feature (1)...(720): n = A,T,C or G
gcgatacttcgtaaccgccgaggaggattgatcttgatggtcttagaatacgcgtatactcagctatagacagacattggttccgctctgagcaccacatctangcagccggcccgcgggttgtgactgataacgatgagcagagctgtcgctcggaagcctattactacggaagtgaggctataactacgatccaggaagttgatccgacggccacttccttgcccgaggcagtctcgactatcacctccatcggcaccggatactatggaggagatgctaccgtcatccagaagctgtatcccaccggcgtaggagagtctctcgatgactacgatcgttacccctactaccgcgataattcccattacaccatcttcaaggtctatctgacctactcagcgccgacgggctgcgcaacacaatggacccagaccactgccgtcccagtgagtccgcccgttgtagtgcagaacttgctgcctcgaaccgccacggagacttcaatttcggtcgactccagccaacccttccagccgaccacttacacctatgacgtggtctatgtcgacccgacccaggtccccagtagcagtctcgactccctcagttattataaccgacccacctccctgtacacaggcgcacagtgctattacaccagcacagagggttcctacagcagaagttcctacggcgggtactacngntacgacgaca

SEQ ID NO: 6039 - DNA, 661 bp, Aspergillus oryzae
ggacacgagacccttctcggaggtcgacctgaatacattcacgctcacgagcttcgtccgggacatggtgaccctggtacatgcgctggggtatcggtctgtgcagtgcgtggtcggacatgattgtggagctgttacggcggcgatgtgtgcgcttgtacggccggatttctttaggagtgttgtgcttttgagtcatccttttaatgggagtcctgtgttgccgtttgggacttcttcttcttcttcctctggagaagaaggggaggagaagggtggtggaggaggaacggagtccgcggcaggggaccacgtgcatgatgagcttgctgcgcgcggcaggaagcattataagtggtattattcgacttcgccagcgaatgaagagatggtggagccggtggccgggctcggagagttcctgcaagggtacttttacctgaagagtgggagttggggtgggaatcagccgtttccgttggaagggtggaacgttgatgatttggtcaagttgccttattactacgtaatgccgttggaggggaatatgcgccatgctgttcataggcacaattgagtccgagtcggaagggactgtttcggcttcgaaggagtggttgtctgattacgaatttggcggttaagtgggttagtaatccct

SEQ ID NO: 6040 - DNA, 669 bp, Aspergillus oryzae
  misc_feature (1)...(669): n = A,T,C or G
cccccctgttacttccttctccatgcccctctttaaaaaaaagcccaagactcctcccacgaccaactctgctgcattccgatcagtcgagcatctcccatcttcggtcgcattccctggcgatcttgaccgacgcttttccgtctccaccaacgaaccggtgccgccacttccacctcaacatcctgcgcattccaacgtggttcatcgctcgcagagtcaccgccgtccgaacaccttgaacaactattcggtagtcccgcccgccgttgctgcgcctccgcgcattgtcgatgctgacccttccgaccagtcgtggcaacacccacctccagctgagagacccgaggagcacgaaaacccgcgacggtccagaagaaacctcttctccctacattcgcactcgtcttcctcccaagcccctagggagtcgacagggttcttggaacgtcgtcgttccgtaaggaaaacttctccggccccgcaacaacaggagcaacggcccttgtcggtggatacggctgccgacccccactcgccgtcaaaatcgagggagtatgtggtagacacaacccaagacccttccaagtctcccgtattgcaggaccaaggaattccacacgagccccgacctcctcgctcgccgcagaacccctctataacccgatn

SEQ ID NO: 6041 - DNA, 659 bp, Aspergillus oryzae
  misc_feature (1)...(659): n = A,T,C or G
gcctttccccgagaaaccagttcactaccaccacacctccaaatataaaaacagcagcgcagaaatcctaccaaaatggccgacaagctccgcacactccagaacctcgaggccatgcaggctcggtacgtaggtacgggtcacgcagacacgaccaagtacgaatggacatcgaacatcatccgtgacagctacgcttcgtatatcggacatccgccgatgttgtcgtatatggctgttggaatgggggagccgaaggagaaggttcgggctatgtttattgagaagatggttaggggggctgggaatccgcctgagacgcaagagtgaatggctnggggtttatgggtgactgtctgctgtgatcttgttataaatgggtggttgtgggcgtcnaggtatattaattgaccacactgcattccctgaaacggggactctggttcaagggttgggggttggactcaatattaacgctggtggtggcattgaatcatggggcctcttggaggcggtggaatggcggccgctcaatggtggccttgaacgcttggagtattggagatttttttctaaaacgggtggccgggatacactggggttaagaaatggatgcctatgaaccgacctaaaggcggttgaatacccagggctttaag

SEQ ID NO: 6042 - DNA, 687 bp, Aspergillus oryzae
  misc_feature (1)...(687): n = A,T,C or G
ggccgcaggaatttttttttttttttttgggctttgtaaacatgtatgcgcaaaaggaatacacatttaaacgcggaaattcggaaggaatatacccaaaataataacaccgcccatgacgaaagcctagtaaaagccccccaaaaggccccccttgtgggaactgcccatgccgaaaccgcgggggcccatctccccaaaggggaaaacgctttcaagggaacccaacccgggtgccgtcggatccaggccccgttagggaaaccagtcgtggagaaacaaatcagggggggaaaaaggatttgcagggttcacaaatcaagggcaaagagggccctgggggaaaaaaggaaagcccccccgggaacacggggggggggtcttgggggggcaagaaaacaaaccttgggttgggggaaaaacattgtgtgacccccctcaggggaggtttacagaaaaagtttgtgcgggaaaaattttaaaaaccgggggagattggggggaaaatttctccgggttcccccgggccaaaatccggggggtttaaaagggggaaatgggccatgtgtaaaacaagagaggttttcccaagaggctgtaagaaacgcctctctcaatccgcggtggaatcttttgcccggaatctgggggagcgttttcccgcggagatggtggagtttctccgtn

SEQ ID NO: 6043 - DNA, 440 bp, Aspergillus oryzae
aaacacactacccctattttttttccccccaaaaaaaaaagggggttttttttttttccccccccaaatttttccaaaaaattgtattttttccccccccccgaaggggcccctaatatttggcaacaattttttttttccccaaatatttccctaaaaaacccccgggggtttttttttaccccccaaaaaagggggtttttttaaccccccccccctttttttttttaaaaaccacctcttgggggggcccccactttttataaaagaaagtttttttttaacacataattttgttcaacccccccctttttttcttaaataaaaaaccgcccctcctatgggggttttaaacccggggggaaacaaaattgttgaaccccttttttcaaataaagagggggggggtatcccccccatacacgcggggggaaaaaaac

SEQ ID NO: 6044 - DNA, 822 bp, Aspergillus oryzae
  misc_feature (1)...(822): n = A,T,C or G
agacatcaattgggctaacctgcattgatgcaagcccattgtgacctgatatccccttttgatacttagatagtgttctattataccccaccaccatgccaccacgagtacagaatcagctcgtgaccaacactcttctcccctacctctcttcctcctccacctctacctccacaatctccaagatccctacccaatgttcttcctcatcaattacatccacatctcggcggacatgccgtcccttctcctcgactgtggcctctcaaacgaaactacgcaatgagatgtttacttggctgaacggtgaaggcgccgctctgaaaaaccacatcccggggtcaaccaactatctcacacaaatcaaggagagagatgaacagcctgtcggacggacccgtccgttcccactaaaccaaaacttcgtcagcgagtctattttgagtgaagagctgaggaacgagatctacgaccgcgtcgtanatcagaagaagagtgtcagagctgtcagtgtcgatctgggagtcgacatcccgagagtcngtgccgntgtcaggttagtcgagtggnaaaaacgccaaaaaccacaaggtaaatcactagccctgccatacgctcgggccattcatgnaatggtacccacgacacccctatacgaagatacccgtgacaaccngnnaccgcctcatgagtcaantaacgatcttcccgtcccacaaactgaccgaccntcaaatctctacccctgctcggaaccccgcaatcaaccgngtcgatcctggncggggcttttcgccgcccagttttcgaaacaagcaagtn

SEQ ID NO: 6045 - DNA, 906 bp, Aspergillus oryzae
  misc_feature (1)...(906): n = A,T,C or G
cgaaaaatggtactctggttggatcttttcgtataccactccactggagattcgaatatcattcaacctagagagccgctagacccggccagtggtcagcctgagggagcggcgccaattgtcaagactggtgagagaatagtgaatccccctattagggctctttacgaccagacggcagaagacttgctcctggagactatctctaacttcccgagagagccagcgacgatcaaagaagaagcagcaatgttacttctcgcaaacattaaagaccacatggagaagcttcttgggcgtgacctaacagcaattcaagaaatgggcaaggatccggagcaagtcaaagagatccgtgctgctcttacggcgatactaggtgcaaaggttgacggattctcggaccttcaagacagagctaaagatctgccacccgcccttcccgaagacgagccgccgcgcaagaaggccatacttacaatagatcgaagcacgacggccggattcccgcgtatctgctgggctgacctgcccgacctcaacgcctatggtgcccttgctgcatgggatgcgaccatcatggaggaagatacaagcatgccgcggtcggctcaatctgctgctgaaacgctccaggaagcgaatgatgagctgatggcacgacttcaagagtcatctcagattgtgggcgacggcgatcaggactatgacaccggcgatgcaggaacagttggcgacgacgattcacgtagccttgatgctgtggcagatggaatcatggaagaaaaagatgaagaagatgatgacgatgatgacgattatcgaggccgcccangtgatcaacaacgtggtctattgacggacatccctgtagtcctgggtaccgcaaagatagaggcgcattct

SEQ ID NO: 6046 - DNA, 670 bp, Aspergillus oryzae
  misc_feature (1)...(670): n = A,T,C or G
ctacattctgtttgtgctgggtgtttcaagtgtgtaactcagatactactgtgtcgtcactataaaaacccatatttcgaacctcatctcacccaaaccatactataccaatctaattaacccaatacaaaccaaaagagaaaaccaaagacgaaaatgcacctcaaaaccctcctcctcaccctagctctaaccaccccaactctcatccacgccaaagatgacacaacaacaacagccccctacttcggcgccgaagtatccatctggcaacccacctactccggtatagcgggcagcgtagccggcataaacgccaaagaaacaacctaccacatcagctgcaccaaagacgccccgaaatcgctctgccagatcgacaagccctggaccatgatccaggcccaggagtcctggagtctgacgggcgtttacacggcctggagcagtggaaaggatgccgtgacggctacgcaggattattcgtgtacgtttacgcattggtcggagaaggcgtcttgtgcgttgacggtgaaggcaacggggactttggagggggggaagtggtcgagtgatgcgtcgacgaaggttagtgttgcgagtgataaggttacgacgtgggggttgttggtgacggggggtgtggagagttttactatgccgcaggcgn

SEQ ID NO: 6047 - DNA, 1020 bp, Aspergillus oryzae
ggtagaaggatgtctttatccgattcgccagttctcgtccattcaaggacgagcgaaagacgccagtcaatccggcaacgatgctcctaaagctcgatctcttccctcgggggcctcatcttctcgcgctccttcaaggaagagcaaccttccaccagccaatttgaattctagaaaaaccgattctgacaaacctcgtcctcgacgcgttttcgacgcaagatctctcgcggccccttcagccaatggccaatctacaaacatccttaggagtacctcgttgcgaagcccccgcaagggaccatccattcgcgctcggaggccgagacccccagcaaagtcgtcagcccccaaattacgaaaaggtggacgacctcaacgttcgaaaaatacggatatggaagaaagcgatagctctcagattgagaatgtatatcgcgaactcgctgagaaatcaaggccaacgccaagccgctacgaaccccaggctcctgacttctctaacctgaaggaaacttggccctcttttcccacgggtacgactgcgaatacagccgaggttgttgaaaaattatcttttctaagtgaccgctttccaaatggttatgttactccttatgaactgggcatgcggctcttcaggggacagtttgttcagtttctcgacgaggaggaaaaggcacaggctatagcagaggcgaagaaactctcccaacagcgtgcagacaattactcgcagcggaaaggcgatttagtagaacccgaggacgtcggttttattccgctgagtgtggaggacaggaagtctttagtgcaatccttcatccaaggagcttatcccaaactcagtactgaaaaagccgcctcgcctattctcagtgaagtgaagaagaatctcagaaacaacgagtcttatcaagcagcccgtaagagctcacaatttgttgcaaaagtggaaatcactctgtcttcagctcgcccagtgaggcgagctctaacactcctgagaggtcattgtac

SEQ ID NO: 6048 - DNA, 820 bp, Aspergillus oryzae
ggtgtcctggataatatcgtttcggatggtatccggatggccgccgaagtcaagaagcgcatggacgaagcacagcgcgaactggaacgcaacgctctcagccggccccaggaagatgacgaagaggacgacgaggaagactacgatcctcgcagcggcacttcagccccaccaaccatcgtcggcggcatctccagctggggcgctggcgcttacggcgcagacccagaacgacgcagcgtccgcgacacagaccgggacctcctggaaggcgctgaagtggtcagcatccacaaaaaggaagatacatccctcttggacgagaaggaagaacatcaacacgcagccgaagggagcagcagcagacaacagggacaaagctcgtcccattcccaaaacgatggcaacgtcgttagcaaggttgaatttgagtcatgaggtctatggtcgggttttggaatgtatcggtgtcggtgtctctctgtctctgatggttgcggtatgagtgtttgtcctgcacattactgatctcattattcggccgctgtttggtcttactgttgtcatttgtatctctcatctagatagtccgttcttcccttggggaagtatggtcaatgtatgtatgtactattgatcttcagcgttaacttgaatctgaggactatggggcgttggattgtggagtgccgttctggtttctgtatgttttgtgggctttgattcgggcggtgtgcgccttcaagcttttcatgagaacttgcatgggttgatccacttttaccaattcattacaccataatttcctttaaaaaaaaat

SEQ ID NO: 6049 - DNA, 1306 bp, Aspergillus oryzae
caacgccggtatcctgcgtgacaaggccttcaccaacatgaacgacgacctgtggaaccccgttctcaatgtccacctccgtggtacctacaaggttaccaaggctgcctggccttacatgctcaagcagaaatatggtcgtatcgtcaacaccgctagcaccagcggtatctacggtaacttcggccaggccaactacgccgcggcgaagcttggtatcctcggtttctctcgtaccctcgctattgagggcgccaagtacaacatcaaggtcaacaccatcgctcccaacgccggtactaacatgacccgtactatcatgcctgaggagatggtccaggccttcaagcccgactatgttgctcctctcgtcgttcttctttcctcggacattgtccccggaaccggcaccaagggtctgtacgagtgtggcagcggttggttcactagcactcgctggcagcgttcgggcggccacggcttccccgtggacgtcaagttgacccctgaggaggttgtgaagaactggaagaagatcaccaacttcgacgacggccgtgcggaccaccccgaggatagccaggccggttctgagaaggtcatggccaacatgggcaaccgcagtgatgccgccgagggtggcaacgacatcttggccaatatcgagaaggccaagcaggcgaccaccgacggaactgcctttgactacgccgaccgggatgtcattctctacaacctcagcttgggtgccaagcgcactgacctgcctttcgtatacgagaacaatgagcacttccaggctcttcccaccttcggtgtggtcccttggttcaacaccaccgtgccttacaacatggacgacattgtgaagaacttctcccccatgatgctgctgcacggtgaacagtacatggagatccgcaaattccccatccccaccgaggccaagaccctgaccttccccaagctcattgatgttgtcgacaagggcgccgctgctctcgtggttgccggtttcaccaccaaggacgctaagactggagaggacctcttctataacgagtccaccgttttcatccgtggcagtggcggcttcggcggatcccccaagcccaccgctgcccgccccaagggagccaccgcggcctacaaggctcctcagcgcaagccagatgctgttgtcgaggagaagacctccgaggaccaggctgccctctaccgtctcaacggggaccgcaacccttttcacattgacccttgagttcaacaaagggcggggctttaaaaattctatacttgcacggtg

SEQ ID NO: 6050 - DNA, 613 bp, Aspergillus oryzae
gggggggacctagtcccataaatgggaaatccggggcccttgggtccagttcctttaatttttgtaactaaaaccaaaaaacctttttaaggggggcacacttaaacatagtggccctttccctttttttcagccctaaaagttttatttggagttttggctcctccccccaaaatttgccttaagggccgttcaccccgggatcactccaagggttttttaagggaccttcacccttgtttttttggggggggtttttttttcccccggggggggggttggggtaacccccttgagccccttcctttttggggggtttttttttgggcccgggggttgttaccccctctttaggggtttccaatttccttggcccccggggggctgtttaaaaaaacaaaccccttttggggggtttgatgagggggctttccggccccttaacctcgggttgggtttatcccgcatggccagttgtgtttaccaaaaagggccccctaataacgctcctttttaatgcccccgttaaattaaacaaaaagggctttttacattttataaatttgaaaatggtaagggggtgttaaccccaaggcctttattattttttttt

SEQ ID NO: 6051 - DNA, 659 bp, Aspergillus oryzae
  misc_feature (1)...(659): n = A,T,C or G
gttcgtgtcgctccttcggaaatccttcaaacttaaacttttcattcgtttctattgatcaacgttgaacatacatcacacaatgcgtgctcaagccctactttcatttgccatcatggcttctactgctacggccatcgccaatgaaactgccaccatcatattcaccgaaatggacagcgtcgatctagtgggaaaggtcattggcactgacggtcccttaaccacatacgtaatcaattgcaacccgaagccccccaatcaaaatttctaccaggttggagattgtgtcagctcatcacacggctggaccgtcaccgctggtccatccaccatgcgtgttgcctttgatgacccggaagctaccatgatagaggcatgcactctccacgactccacctccctcaactgcgacataactatggattatggttcttctaccgatgtagagtccgatggtggcaccaccgncccagccagtgacttctatcggaccgtgaccatcaccggcactgagatcgcttccggatccgcttctgcacagacttctcctaccgccggtcgtgctactgctacgactactggcaccgcgtctgccactgccgccgctggggagtcngngagtggggcgcagaaagcggcagcgaatacagcatcct

SEQ ID NO: 6052 - DNA, 1216 bp, Aspergillus oryzae
gttgatataaatatgtaggtcgtctggccggtgacaagtgccgttcctgacttatgatcacagcatccgacaaacgcagggacttcagtcctcccgtatataaaacaggtcagatcgattcatcccagtgccggcccacacaagcatccatgccaatgccaaatcccattcgacagtcgacttatgcttcggcaaccgtcctccgagcccacctctccctacttcaaatcattgaaggtatttacagagccttcttcttctcgcccttggagacatcaacgaccttgagggctattgtagtaaaatcgtcagcacaagttctgcgtagttgtggccgcgtagtcatgtctcatatcatgtcccagagcctccacctaagccatgcaaaccggcggagcgagcaagattgaaatccgaatagcgaccgagtgttttcaaatgggcctggaaggcaacgcacctgggggcaagctctgcttgagcttgtcggccttgtcggagtccttcagggcaagggtgtagacgaagcgctggcagcggacctggatttaaaatactcgtgaccactaccaagactggtttctgtctatcccccactaccatcgaacatatcggcgtttgctattagatctagaacttcacaacttcgctacacctataacacacgactagtatactagtaccctgcactgcaagatggctatcgccgttcggttcgtccgcccaactatccgccatttctctgttcgccgtccgcagccagacactcgcacctctcgattcgtcaccacttcgtgtctcttctcggcggtggtgctaccatttgttcctccagccctggagagctctcgcgctaaaaatacagacggtcccaattgcaataagccacacccgccgctctgtttccatgcccgttaatatgtcgtctcggttaccatccccgaagggggaatctgtcatcggtacctgacatgcatcgggacattttccgtattatcaccaaccttctgatgttacgacctttcttttttcccttggctttgttatcaccattccgggtggacttgcaattggtgggcgtactggcgttgatattcattacaccacagtatggaatccgttgtgtgaagcgcatcttctgggacggagtttgctggcgtcgtgctcttttttacttatcagtattacccatttctaattttggtctctgggcggg

SEQ ID NO: 6053 - DNA, 672 bp, Aspergillus oryzae
ccagcgaacttcatccagcttcctccatcacctctcctcgctaccttctgcctgattcacgtccagcctcacacattcgtcatcatgaagaccactgctctctcttttgccctgctggctgccgccaccaccatggtgagcgccgatgtttccgttggtgaatgcgctcaaatgtgcatcagcaacatgaacgccaaggcttccgagcttggttgctccagcggagacttggattgcctgtgcaagagcggcaactactcctatggtgtgcgcgactgcactactgaggcctgccctaacgaggatgctgctgccgacgaggctgccgctcttgcttcctgccctaacggctcttctgacagcagcgctactggtaccaacggtggtggtgcctccaacactggtgattacgcctctgccaccggcactgatgcctccaagaccggagactcgactgccactggcactgctactggcaccgatgctttcaagaccggtgactctaccgatactgccactgacgccctacaaaccggggattctatcgttactggcactggtaccggcgcttgcaagactggtgacatccccggtactggcaccggtgcttattagaacggggactagacgtgcaatggcaccgacgcgtccaaaatggcgacgccttcactt

SEQ ID NO: 6054 - DNA, 650 bp, Aspergillus oryzae
  misc_feature (1)...(650): n = A,T,C or G
caaaagacagaccgatagtggttctggtgcacctgcgggtgatgttccggaagtggtgaggcactcgatgtccgaggctcacgcagatcctgaagcagctgctatcaaggaggctgtcggagaaaagaaagagatggagcatgagcttcagcagaaagtcccggttgacgaatcgagaggcacgccagcgcccactactggtgtcactgctgcagccactgaaactgctccccaagcgaccatatcacaccctgattcggcacagctatcgccgcgggcgacaaccccaacgacgaggcctgatacgacttccgaagcggggccaactgtcacgactggccctgagactactaagacatctgaggtgtcgggacctggtagtggctcagctgccgcaacggctggtaatactggagcgagtgcaaccaagactgccgagccgacacatcctcaaaacacgagcgtanggggaacgaatggtcggtcgagtactccacccaaggacacgtcgcgcaaggactcangatcttcgagtggcaccccatcccaaaagaaaaagaagaaccgtgccagtgcgttctttcataagctcaaggagaaactcacctgagctcatatcccaccgatggccaaacgtacgcgctcgggct

SEQ ID NO: 6055 - DNA, 686 bp, Aspergillus oryzae
caaaatctctatctagtttggctttgtagggccgaaaacgctctccaccacccaatctattcgcgttttgagtcaccccgcgacactcgtccgtacttctgaagttttgccgactatatcagcgaagctgggttccttcctctctcgccttgtcgctggcggctgtccgcgcagctttacgagggttttgagcactaccaccaccatgtcgtccaaggagaaaactcggatcttgtcggtccgccgattgaataaagaaaggcttggcaataaatccctttcagaatggtgggatagcgagcgccgcaaccaaacggccgaagctgccgccattgatgaagctgctctgcttcttctgacgaacaataattcgggtggattttctaccaagacagtgtgccggttgggagctgatgcgaccccaagcgatgccgtgcaagggatctatcaaggcgagccaagaacgtccgacgatcccttaattgggcgtattgactcactctcaatggtggaacgggtgcttcacccgcccgaattagggtcttctaacgccttctacaggccgaggaacaaaatactttcggccattaattcttgattggccgcgttttgccaggtactccttcgaacgatcttccaaagcataccgattggttttggccaagggaaggaacttcccaaccggc

SEQ ID NO: 6056 - DNA, 743 bp, Aspergillus oryzae
cttctattcaggaagatcgctgagcttgtcattacccttttactctgctgatatttcagcaccagctctcatctctgcgatcgacgtcattctccgcccggcctcggataaagaggcctttcagccacgatgggtgtcatccacgcccgccgagagtgtgggtataatagctggggcgattgggtttgcagaccaagtagctggtatgactggggtcgttgggtagcgtttgccgtcattgttggttgtgcttttatcatattctttctttttgcatgccataacgctcgccgccgtcgcactcgcggccttcaacctcatccgggcacggcatggcttgctggcccgcctccctacggacaacaacatcaacaacatccttactatgccgaccctcattatcagcaacagccaccacctcagtatactccccaaccgcaaacatatggctactttggaggacagcaaacgggcattgagttgcagtcgccgccgaatgcgtatcacaacggacccgatcgggcctaccagccaccaccgggcccttcaccaaatggcaggaaagtataaacgtttcttcagactgttagctgttgaacgagatcttaatcccaaactcgaaatgatcgcatgattcggattctgttatcgcaagcgttggtggtcgctttttttgaaatctctgcacccctgcttttttgtcaatatccagcaaggaggatgttcgcgaaacattttttcat

SEQ ID NO: 6057 - DNA, 305 bp, Aspergillus oryzae
gcccgacagccttattcgcattggctgatgtggcagccgctgagctccctcgtcctaccatatcccaaaccacaccgcgactttcggcgcacagagctctcctcccgcagccttcacaggtggctcacgggccgacagatcctcgatcttttgtgctgcctccccccacaccccaacggcaacagccccgtcggctcctccctgccgggcagcaaattccgcccatcagtgagcaacttggtctcccagatccattcgcgagcaggggtggtcctccacagcttcctcctcctccggggtctaac

SEQ ID NO: 6058 - DNA, 742 bp, Aspergillus oryzae
  misc_feature (1)...(742): n = A,T,C or G
ccgaggatgaaattactttgttgcaaactttgatagaacaaatacgctccgacgtggagtctcaactcagcgaggcaaccaaggctcggacagacgctgaggagaatgcggtgcgcttgcaggcggaattaactgagctagaaggtgaagttgtgagggttcggactgagcttacaatggctcaggctgagctcgatggcgcttatggtagccggtctcaacgggcagccgctgtcgaccctgcccttcagaaggagctcgaggtgttgaccacccgtaatatcgagctggcgcaggagcttgccacttttaaggctggcaagcctgcaaacagtgacacacagcggcgtgtacagacattggagaaggagctgcgcgagacgattgacgactatgaagtcatgaccaaggctagtatcgaatttgagaaagaacgcgagaagtttgagagcctcattgacgcgcttcgggatcgctgtgagcaactggagacgcaattgaacgaagagcggatcacctggatgggcatgcactcagcgtcaatgggacgagatggaaccacgtatgagaccacatcaaccatggtgctgaagaatgaattcaagaaaatgatgcgtgacacgcggactgaanatatgaagatactgaaggcggagcaagaagaaacccgaggctggaggctctgctcaggaatctgaaaaaaaacaagccaccaagttggtccaatcaaaccgtacggttt

SEQ ID NO: 6059 - DNA, 649 bp, Aspergillus oryzae
  misc_feature (1)...(649): n = A,T,C or G
cggcttcggtcccaaggcgaacgatggccggccctttatccagaatccggtgccagaggcacagctggccaagctgatccagaagcttccttctatcccgcccacaacgttcgcaggtctacttaaaattacgaggagctccgtctcagccgctagtgaattggcagctgcaatggtgaccggaccagtgtctccgtcaatgtctgaattgattaaatttactacttcaccgccaccagtcgatgtcgacgtggagacgcctangcgacggaatgagccgcgggtcattcgagattatgatcgtgtaagacgttccgcaggggcccattttgctgccagttcggaagcactcactanagcctgggcggcatatcggcgtggcaagtctgatcgcctgatgggcggcgccgctgcttattactccgcagtctgacgagaccatctatagcgagcaaagcgggacgcggccgaagcagcagatgccctcgtagattcgcagtccacgcacaatacgctagatctgcacagtggttcagtgcacgatgctgttccattgccaatgaacggatctcatatggntgggagtcgtttggggacgccaaatacgtgcgcagcggtgaaatagcccggtcttgataccgcatcgtct

SEQ ID NO: 6060 - DNA, 674 bp, Aspergillus oryzae
  misc_feature (1)...(674): n = A,T,C or G
caactcgactcccggcctttttctgcacacctcgttccaacctcctcaaaaccgcgtgtgcagcgatggctattccacggccagccctctcagctccactaccaacagtcccacttcgtcgcccacctctccattccgccgcttcaaccgtggttaccgcccgacctccggctcccgttccgacgccagcgatgccggcagtcgcagccagagccccttccgtctgtcatccgttttccgtcggccctcgctcgtcttcatccgccatcgtccctccaaggtcgatctagccctcagcgaggaacgtacccgctgtgacgaggacgccatcgagcgacaaggtctcgacctcatggagccccgccccgttgacccggtcgggatccccatggacctgaatgccaatattttctcgtctgtcgcgggcgatcggtcgtctggccagagtcaggcgtcgcaagtgtcccagccgcggttcgtcatgggtggtatcttcgaggtcatggaggggcgtgcttgaacgtattcgcgccttttcaccctctttctttctttccttcttaactngccttcttagtctctttcttgactctacgtttgctatcatcgctacccgtgaagcgaattggtacattaattaacgattcagggtggcttgctatctgctgcatatc

SEQ ID NO: 6061 - DNA, 674 bp, Aspergillus oryzae
  misc_feature (1)...(674): n = A,T,C or G
cactccataagtggtattctcctcaatttgcgtttcattccaaaacatacaatctcctgaattttcttccttgcggttcgattgcatacaggccttctctcccttgccgcacctattctcttctcttcatttccctgtctccgctcgcattcaaaccatcggctggccttgcggaggaaccgactcagcaccacgatgaacagatcaaaccatacagtgcgcattgattcgacagtctagctggatgttacgagcgtgatcaattgaaaatggcgcaatatttcgtcgacctcctgtataactttaccgatngcatgtgctgctttcccaacacgccgcagctcaagatcacaatcgcagctttaaatgcttcgncttctgggtgaaggtggcttcatctacgtgtacctaaatcaagacaaaagcccctttgaactctttgcgctcaaaaagatcccatgccccttttggcaagaaactggctcttaaacacttaaaaaagggtagggccataaactggtcgcattacaatcccatatcatccattcgaatgaacactctgtgtccaccgaataaaggtctaagatccccgcccattgcggagaaaacccgggccaaaatggtgatatcccctggcgtaatattaacaagggaatatcccgaatgccctcttg

SEQ ID NO: 6062 - DNA, 719 bp, Aspergillus oryzae
  misc_feature (1)...(719): n = A,T,C or G
gatgacatcgttcacaaagctcttatggctccaactctctttctaccgtaaggtcctgcggccgatgaatacaattcgaggccaaagctcgcagtcacataagcgcactctggatgctgagccgtgacatgatccatggtataacgaatcgcattatccgtcttgatctggatgatgcattctggtgggtgtggattagcagtttggcaggtgaggaaccagctttccggaaggcagtatttggacgatgtgcattgctcgagactgtcattaagaatacgaagtggcttgttctggaggagcaagtcaaaggcgcggcaccggagcccgaacctggtgcttatatcgtcgagaagaagagtttcttcgggttttcgacgcgcaagcgactcgggcgccgtaagtccacggccaanaaggtcagcgcggtagaagagtcttacaagcggcctgagaaccaagggccacaaagtaagaccagcatcggtcctgaccagcatgcccgtattcaggctgcagccgctgcccttcagaggaagcatcgggagcaagaactggccgcattcggggaaactagaaggaatgttcgggataccactaactcaaagacaaactttgtatgacactggaaccggccattatgaacgaagccttccatgctttaaaatgggccagtactaccacaggggcagcttgcctacaaagcccgatatagtgtg

SEQ ID NO: 6063 - DNA, 654 bp, Aspergillus oryzae
  misc_feature (1)...(654): n = A,T,C or G
caggtcccagttcaacgtctattaccctggggttcactatcctcatggtcctgggccctataatgtggctaccaatgactcttcattcgccggccagccatgtatggtgggacccggtgtgaccccaccgggtatgggttatgctcagaatggccaaaatggggccatgtaccctagccatatgaacatgggctccatgcctcattattcaatgcccgtgtctcctcagatgaccccaagtggcccgtggcagaacggagctgttcctcagcaatccccgtattctggatatgcctctatcaatcagtcaccggctatgacatccacgaaatcctcacctgcacccaacagctacaatgtgcccaacgctgtacagttccagcacactcctccaggatggtcttccccaccatatcacggaggttaccagcantccacgcacaggaatcaanccacaatgccgtgggcanatttaccgtctcaaacagtcactcctacatcctacccatatggtcaatatcctgggcaacnccatgaatcanggtatgcangcgtccatccgttgcggggaagcttcaacggtccccattcancccacaaacacgttcattttgtcctggcggtacgtccttgggacggacccnagcaggatgn

SEQ ID NO: 6064 - DNA, 834 bp, Aspergillus oryzae
gtgctccttcatgaatgatgtgactactcataaacacgcatcaatcttcaccaagccgttgaccgaacgcgatgccccggggtatcgagatctcatctaccgaccacaggatctgaagtccatcaaatcatccattcatcaaggcagcaaagccgtggctgctgctacagaagccgcaaacacgcccgccgcagatggtgaatccccggccccgaatggcggaacaccatcgaagaatgcagttctcatgctgcagaagaccgaggacgttattcctcccaaaggaatagtcaactcggcacagctggagaaagaattgatccgtatgttcaccaatgctgtcatgttcaatcccctccctcagcgcggattcggacccgcctttccgatgactagcgacagcgggtcgagagagagcacccaggttccggagttagacgaaggaggtatcatcaacgacacgatagaaatgtttgaagatgttgaacaggcagtcacgcgatggcgcgcggccgaacgaactgccgatgaactggcgagcaagaacattctgtcgcttcgccggggaagcccaagtgatcttaacacgggtagtgccgacgaagttaaggggaagatgaaatgttcctgtaacgaattacagatattgttagtattacttgtgaccttttcaggaaaaaaaccccctttcctgcccttatttaatctgggcctctcggaaaggccttgtggttgaaagaaaagactttctttaaccactttgacacagtcttttaatttttggggcgatataaaaaaattaataaatatatttcttggggcgcggttggaccg

SEQ ID NO: 6065 - DNA, 586 bp, Aspergillus oryzae
gaatggctcgtccgatgcgcacggcgcctacctatgcggccatgtcactgcgaagactcgccagttaatggtaactatggagaagtcagaaaatcggccttatggccaataccactatgttgagatcccaacttctcccgatgcgaccccgatgcatgcccgacgcggtcgcatctctcgactcgcagttgccctgagtttcatctccttgctcacgctaagcaccgtgttcttcgccatcccaggcatcaatttctctgtctgtcacaaaatgagggggaaatttggtgcgcttttatccactccgaagggtggtgagacacctgtgccggcatcaagcaacaaggtcccgcttgaggctcatatcatgagcaaatgtccagatgcgcaggactgtctccagaaactggttgttcctgctatggagcagatcagtgagaaagtcgatttcgagttgtccttcattgcaagcgtcactaatcaatcatctgatatacattgcaaacacggccctggcgaatgcattggcgacatgcttatgctttgcgctcaggacctaccttttctaccttgagggtggagaccg

SEQ ID NO: 6066 - DNA, 673 bp, Aspergillus oryzae
  misc_feature (1)...(673): n = A,T,C or G
cccctcctagtgaccggctcgtgggacaagacagtcaaatactgggatctacggcaatcgaccccgatcgccacggtagaatgtcaggagcgtgtctacaccatggatgtcaagaacaagctgctagtggttggaactgcagaccgatacattaacatcatcaatctcgacaatcccaccaaattctacaaaactatgcaatcccctctcaagtggcagacgcgagtagtcagctgcttcacagatgctacggggtttgctgttggcagtatcgagggccgctgtgctattcagtacgtggaggacaaggactctagctcgaacttcagcttcaaatgtcatcgagagacacccccaaaccaacgcgacatcaataacatctattccgtcaatgctatctctttccacccggttcatggcactttcagcaccgctggcagcgatggaacctttcacttctgggacaaagacgccaaacatcgcctaaagggatatccctcagtaggggggaccatctccagcaccgcattcaaccgcaatggcaatatatttgcctactctgtgagctacgactggagcaaaggctactcggccaacacccaacagcttcctaaataagtaatgcttcatccagttgctcaagaagaggtgaagcccangcctggtaccagga

SEQ ID NO: 6067 - DNA, 646 bp, Aspergillus oryzae
  misc_feature (1)...(646): n = A,T,C or G
cgaaccctaccggtggatcgcagtacttgaagaactaccggcctgatagccccgatttgaaattccaatacccctattcgctcaacgccacacccccagagtcctatattgatgcgtctatcactcagcttttctacactgccaacacgtaccacgacctactctacactctgggcttcaacgaggaggccggtaatttccagtacgataacaatggaaaaggaggtgctggaaacgactacgtgatcctcaatgctcaggacggttctggcaccaataacgccaacttcgctacgcccccggatggacagcccggccgcatgcgcatgtacatttggaccgagtcccagccttaccgtgacggctccttcgaggctggtattgtgattcacgagtatactcacggtctctctaaccggctcactggaggacctgctaactctcgctgcttgaatgcccttgaatccggcggaatgggtgaaggttggggagacttcatggccacggcaattcggctcaaggccggcgatactcactcgaccgattataccatgggtgaatgggctgcaaacaagaaaggtggcatccgtgcttacccattctcaacctccctggggaacaaccctctcaactacaccagtctcan

SEQ ID NO: 6068 - DNA, 713 bp, Aspergillus oryzae
  misc_feature (1)...(713): n = A,T,C or G
gggatttccgcctcccaaggtcgtttcgatcaacgtgtctggccacaagtatggtctggtctaccctggcgtgggctgggtcgtctggcggtccccggaatatctccccaaggatctgattttcaacatcaactacctaggagctgaacaggccagttttaccctgaacttctccaagggtgcatctcaggtcatcggccagtactaccagatgatccgacttggcaagcgtggctaccgctccatcatgaccaacattactgttactgcggactttttggcccaagagctggagaagatgggctttatcatcatgagccagcgtcgcggccacggtctcccattggtcgctttcagactgcccgctgagcgggagggtcagttcgacgagtttgccttggcacaccagctgcgtgagcgtggctggattgtccctgcatacacgatggcgcccaacagcaacaacctgaagctgatgcgtgtggttgtccgcgaggatttcacaaagagccggtgcgacgcgctgcttagtgatatcaaggtgagcactgagaacgtgggtgacatggacaaggctcatgtggataaatacacccaanatgtgctggaccacgccacccactcgcacaagtccaagcacaaccaccctcactacaagggagagacgcactccctgcanggtaagcatggcaagactcatggtgtttgctaan

SEQ ID NO: 6069 - DNA, 1386 bp, Aspergillus oryzae
cgcgtccgattcggcacgaggggccaaggttgaccaaaaagttgttcttgtcgtcatcgacggctggggtgttgccggccccgactcccgcaaggatggtgatgctatcctcgctgcggagactcccttcatgtccggttttgccgaggccgattccaagaccgcccagggctactccgagctcgatgcctcgtcgcttgctgtcggattaccggaaggtctcatgggtaacagtgaagtcggccatctgaacattggtgcgggacgtgtggtctggcaagacagtgttcgtatcgaccaaaccctcaagaagggcgagttgaacaaggtagacaacgtcgttgcatccttcaagcgtgccaaggaaggcaatggccgtcttcatctcctgggcctggtctccgacggtggtgtccactccaacatcacccaccttatcggcctgttgaaggttgccaaggagatggagattcccaaggttttcatccacttcttcggcgatggacgtgacaccgaacccaagagcgctaccaagtacatgcagcagcttctcgatcagaccaaggaaatcggcattggtgaaatcgccactgttgttggacgctactgggccatggaccgcgacaagcgctgggaccgtgtcgaaattgccatgaagggcattgtctcgggagagggcgaggagtcgtccgatcctgttaagaccatcaacgagcgctacgagaaggatgagaccgacgagttcctgaagcccatcatcgtcggtggcgaggagagacgggtcaaggacgatgacacccttttcttcttcaactaccgctctgaccgtgttcgcgaaatcacccaactgctcggtgactacgaccgcagccctaagcccgacttcccttacccgaagaacatccacattaccactatgacccagtataagaccgactacacattccctgttgctttcccccctcagcacatgggtaacgtgctcgctgaatggctcagcaagaaggatgttcagcaatgtcacgttgccgagactgagaagtacgctcacgtcactttcttctttaacggtggtattgagaagcagttcgctggcgaggtccgcgacatgatcccatccccaaaggttgcgacctacgacctggaccccaagatgagcgctgaggccgtcggtcagaagatggccgaccgcattgctgagggcaagttcgagttcgtcatgaacaacttcgctcctcctgacatgggtggccacactggtaagtacgaagctggcattcagggtgttgctgctaccgacaaggccatcggtgtcatctatgaagccttgcaagaagcaaggctatgtgctcttcatcactgcggatcatggaaacgccgaggaaa

SEQ ID NO: 6070 - DNA, 655 bp, Aspergillus oryzae
  misc_feature (1)...(655): n = A,T,C or G
ctctacctatattcctatttctcaccgacacatcatgtctgctcggcatcgaaagctaccatcaactccgacgcctgaatacacaaactgctgattcagtaccatgccagtcttgcccacaaccatgggaccccaggccaatacaccaagccctccacgcccgataacggcacacgcatctagcaatcctctgaccgctatgagaccgaactcctcggcggaatatggcacgcccccgacgactacagctttatgcatgacgatacgttcataacacagcaactatatatcacgcagatcgagcgcaacactaccaatgaggctgttgactactgccttggcaagagaggcctcggataccgtgaccactagctcgaccagtagcccactgtcaacgataccgggcaccatggctagcatctgaataatggcgcaactgtgattgccaccgagcgcattatcgacgacgacatggccaccgttgacgacttcaggccctgactaagctgcttgacactcagaccgcgctactagatgactacgaaccgtgggctagcaccttgagctctgagctacgcttccgaagaggacgagccgacgctanagaacgcgacgacacgagaccgaaacgactgactaaccactgactggggga

SEQ ID NO: 6071 - DNA, 715 bp, Aspergillus oryzae
  misc_feature (1)...(715): n = A,T,C or G
ctcgaccccgacgagcactcgagatggttacagaatgctgttgatttgtgggacattaagactcccaatggtagaactttccctaagatgatccctagaggggctttcccagcggaacccgatccggagatggtacagtggcatgaagaagtcagccgacggttcgagcttgactactggaagaagaatatcctgcgctcctcccctcctaatttcgctccttaccattcatacttcagccagaaggatgtaccgacccacaaagaagatgaaccacctcgaagtcagcgccgaacaacccctcaccgtcaagagcctactaccgcaagtgaacgtcgaaacccccataaacaccgtcaacgacgaaacgacgacaagccttcctccactactcgcagggtacaatctacatactttccgcgacaatcggaaaacttcgataccgggtatacgtctcgaccatcatctccaccgttgcgggcgaaagagtccaccaagtcgcgtacgcgcgagcgcccacaggcttatgggcgatctgtgagtcccggagcagtaccagggtacggagcgtcagatgcatcttccgaagactcgggatcagcagcaccacagccttccaggtcagatcgatacagctaccatcgcaatctatcaccacccgcgagtgtnnccatacgcgtcgtcactcgcacgaggcatacgcccgccgaccttg

SEQ ID NO: 6072 - DNA, 533 bp, Aspergillus oryzae
  misc_feature (1)...(533): n = A,T,C or G
gtgcggtggacgttcaggccgtgcttcccatggcgcaagtccccatcggaaccgcactaatctggtttgtgcagatgttgggcggtgcgctcttcacctcggtagcgcaaaacattttcagcacccacctagcggagaacctcgcgaacctgcagctgccaagtttcgatctgacaggcaatcttcgtgcacataagatcacgttgcggatcattggagacccgtgtctcatctcccttcctgcaagggagcgcgaggaccccgagcctgccctgaaaaggaacgatgnttatttctttttaattcttgtcaaacggcttcggcgttacctcgttcaaccgcgggtcccttattttgatttccacaattgtataatcaacatcatcttcagcgtatgtagtactcgcgcctcgggccatgagtctaagcgacgctcatgttatttaatatagcgctcatacaacattcatatgggaggatctgcctccctggggtgtgggaactatatttggccggcctcccttttttgttgt

SEQ ID NO: 6073 - DNA, 785 bp, Aspergillus oryzae
  misc_feature (1)...(785): n = A,T,C or G
atcaaagctgagaagttcactaataatgcggcttctggatacgacgctctattcgtgcgtgacacggtacctgatagcacaattatgttgccaaacaaggtgttccgtcagacctggactctctataaccccggcccacttgcgtggcctgctggaagtgacgtacgctttgttggtggtgatgcaatgttcaatgtcgataccaaccaccccttgagcctagactctatctctgctgctatggaaagcaacaagttgacagagcccctagagtccggccagagtgccgagttcactgcaacacttaaagctcccagtcgagtaggtactgccatctcgtactggcgactgaagctcccaaatgggatgcctttcggtcatagactgtggtgtgaaatccaagtacgggaagatgcaccttctatcaagggcccgtctagcttagagccagaaggaaagcacggctcggaacgcacagagagtcaaatgatcttccctaaactggagaaggagtctcctgatgcaagtgcccacgaagcgggtgttgtagcgccagtgccaccctccgtatccaacccgtctgagcaagatgttctggaagatatggagagtttgtccttgggtaatcataaaacagagaatggattcttgaccgatgaggagtatgacatattggatgccagtgaccagaaatatatggatgccaagtcacgtgagtgattcttctaggccttgctatcgggtgctaccatttggaaagganngagttgtcangtaacggatga

SEQ ID NO: 6074 - DNA, 667 bp, Aspergillus oryzae
cctctgtgtatctcaaggcttcgacgtcttcctcaattcaacctagcttctttggttgagttagggtgagaagacggccaatctcgaagtctcgagctttgaaacttcaggttctgcctcagaagaagtcatgaagttaatccgtcacactaaccaccgacggtgaatctgccctcatcacttcttccctgagactgagatctgcgcatctacacctgccttaggcgtcaagatgagtttcctcgattccgttctttcatctatcgagacgggtaaaccgtctccactaccgccagtcactaccacacaatcagcgcccgtctcatcctcaactgccaaatcggaggcccgcaggcccagcacgacccctcgtgatgtcactgagcggacaagtaatgctgcaggtacgaaacgcacggctgatgagctgctgcaacgtcctcaaaagcctctcacccagacgtctatcatacaaccactttctagaccaatggctgcggctgcggctcctaagccccgtcctacttctacaccagctgcgatggccgctataaagagcactatatcaccgtcatcggcatcacagaaggcaagccccgtatcttcaaaacctcccccgaagggcgtcgacgccgggataatggaaatggaaaggactgcagcagaa

SEQ ID NO: 6075 - DNA, 680 bp, Aspergillus oryzae
gacgactcaccgaagcggtcccgcgcacgtcgccagtccacctccacgaggaccccgtcgaagcccaagcccacgacatcatccaagccgcctccgaaggctacggaagaagatgcggcgaaagctggcattcccgcgggctactcgatcaagaactgggatcccaccgaaacccctatcattctcctgggaagtgtcttcgatgcgaactccctcggcaagtggatctacgactggacggtcttccatcacggtgcttcgactccgatggccgatgtcgcgggcgagttgtggttgttgttgatcaagttggcgggtaagatcaagagggccgatgagtgtttagaccggatcaagcagcctgagcaccaagaagtggtagaggactttttggagagtggtgagcgcctgtgggcgcggtttaagaaattgctgaaaacctgcgaacagttcatgtggaaagcggccaagcgagaaggtggtaagagtgtgtcgatgggccgcaacgcaggctgtgaatttgtcgagacgatatttggtcgcgaccgcgaattggagagcacggagaagttgatgaacagcgttccgctatggaacatgcgatttgacgccaactgcgaagacattcttcgacgaccgttggcatagtccctcgaacccctttgcgatatattaaccgg

SEQ ID NO: 6076 - DNA, 954 bp, Aspergillus oryzae
cttttcttctctttcttgtctgttagattatctgtcaagaagacttattactatcgtgcctaattgattcgaacggaacgtcttctttccacaatgaagttcttctcttcgctcgctctgctggtctccgccgttgcggccaaccccattctccgtacccgcgacacacctaagaacttccatctcaagaccactggcgctgacaactcagcacacaacgacctctacgtctacggctaccacaccggtgctggattcaacgatgctgttctcacttcggacgttggcaccgcgagcccggccttcctgaacggcacgaatgtccagttcagtctcgacacacctttcccttggggattggtaatgcgaccacagaacaactacggtgcgtgggagccggtcgagatcaacactgggtatggtagcggtagtttctccatcaacgatgacagcctggagtggtcggaacagcagggattcggtggctggttggtctgcgactggtaccacaatgcgccccagctcttctatctgtacaagtaccgcgagcctaccattccctcctcctgcagcaaggttcaactcgccgtcgagccagtttcctaaagcggagaacctgcacaaggttttgccactggccttccatgggtaaactgccctgccttgggtctcggagtcaccgaggcttcgtgagtcgtgatttcataggggatccgggaaagacgtcccggtacctgagatgattgtatcaatacctagatacatgtatatgctgatttaatgctaataattataatgagtcggttgggatgggatttggattttgagtgtatattattacaccgtggttgacgatcttcagtacttaatgaccctgatgttacagataaatagcaatagccagagaaaaagaagaaaattcaataaacaaaaaaaaaaaaaaaaaaaattcct

SEQ ID NO: 6077 - DNA, 680 bp, Aspergillus oryzae
  misc_feature (1)...(680): n = A,T,C or G
gactgacgactacttggacgacacagacatggactcattcattgacgacgatgaacatatcgagcagggtcatgactcagactcggacagatctactgtagtcgggggtcctgaagttcgattcccgcctgatcaagatgatgtccagttgagctcagaggtaacaatgtcccaggccgacgactgtatcgatgattccctggatagcttagacgagatctcagatagcgaagaggaagaggatgaagatgatgatgacgaagatgatgagcctatccggcctcccgtagccggaaatcggcgccgccaatttccagcctcaaatggggcttcatcatctgtcctcgcgagtcgaatggnggggtgctccaacgtgaatcctacgcgatgcgccgacaggcatcacgtagtcaaagcacaaatccgtctctcttcgagagtcgaattccgcgaggtccaaacgtgatttcttacgcgatgcgccggcnagcatcacgtagtcaaagtacaaacaccgaaggaaacttctgcctcgaatgtcataacactggacaatgattctgacgagcccgttcaagcaatccgagacattgccaaattaccggccgttgacccttttttattcttacatcagatacgattcgacaatgattccgaccatttaaagcggtcttattggg

SEQ ID NO: 6078 - DNA, 602 bp, Aspergillus oryzae
  misc_feature (1)...(602): n = A,T,C or G
tccctccaaattctttgcgttccatagacaatccaccctaatagactcttatcttagtgaatccttaagttcttataaccatgacccgcgaagaggcaccaccagcctttaacctcaccgacatcgatcgtcaggttctcgctcagaccgacgaggaattcgtcctgcatgactgggaagatctcacagcgatcatcgcccggaacgatctcggaattctaaagcggaaaccctccgatctcaaacgctacctcgcctggacagcagacatcacagcccaatatggcacaatcacagactacatctgtcaacgccgtttacgctggcnacctccagaccctgacaccactaccactggcggcgccacaacagacagtggcgcagttttccacttcaaaaacccgaccccctttgccgaccccgccgactacaagattctccgcaacgactggccctacngcgtcaccccagatatgaaccacctcgtcgtgtggctacggactcctgtccccgtgaagccggatacggagacgtgaccgatgaagtccgcgcgctgattgaggattccgtgcagcgcacttttgtggcgcggcttgcgcagg

SEQ ID NO: 6079 - DNA, 686 bp, Aspergillus oryzae
  misc_feature (1)...(686): n = A,T,C or G
gtagtcaatctgactgcgacaccattgtccagcctccgattcatgctataacgatctgccccgtaagactggtcttcgtcacgatgtccaccaaccgtccattcctggccaactttttggcggcgtttcgcgcccagtcaacgtataaggcctcggccgctggttcccagtcggccaccacctcctcgtctctctcgccgactcagatatcacagagtgcccgtgctatagcaaccaaggcaagcaactcaggggcgtcttctgaggccgcctctacgactcattatcatcatcatcaccatcatcatcatcactcatcttcagccggcgcttcccactcccgaccccactcacacacccgatccccactgaatcaatcatctcctgccggggactccccggtgccctcgtcctcggccactccaccagctccctcatccccgccaaccccggcttcatccaatcctattccgattgccaatggaccggaccgtcaacgacgcgggagcgacagctccaatggatcgggcgggttccgagacgctctggggccggagaaatggtacatcggcgggaggaacgcccgcggagaggagcgtttctatcgattanggatggtgacnaanggcggcggccgattatgcgggagcggtcgantgggaagtatccaccagttgagcttgtgg

SEQ ID NO: 6080 - DNA, 2142 bp, Aspergillus oryzae
  misc_feature (1)...(2142): n = A,T,C or G
tacagtcgtcttctctccgccctcccctctacctctatctctccacacttccgcctgatacaggtcgcagagctttgctttcagcatttctctgctttggtggctaaaagaactccgggaagaaaactttttttaggaagttacaaaagggaaaagaaaaatataaaatatttttcttgctccacagtttcagatttacttactgaaacgggaagcttacaacctttttactcctcaggtgtctatcttccatacgacacactgcaagaaacacacactctttttcgcagatagacattgaaattccagaaaaggaaaagaaagcaaaaaaaaaaaaagagttttcgttgtttgccttgtttgcccccaaaaaaagcgcatatcctttcttgtgtccactcccttcgcgttgctgtcgatacctctttccccatcatagttgtgacagttgcgttgccctgttgagttaatatcctagaaaacacttgactgtgcttttctagttcccttccctactctacatcacttttgatacttgacttcctggtcaggtatcacttctcccttgctgtctatcaacatctcttgctggaggtcttacttgacttgatcctgagctcagtcacgtttcgcttctacacgaagcgttttactgtgatcaaaaacaaggcaactttgctgtcggggagacattgagttgtccatctccacaaaggactgccaatccaagctctcgtattcaatcagtttttggctggtctacagctcgagtatcatctactcacgtcgcaatggattctctcacgacccatccctccaccgcgcagcaggcccgggccttcacttctcctgcctccctgtcctttcccggtggtgccggtgacttgacgccgccttccgataaagacggaaatatggcgatgaaccttcagggtgtaaacggacatgtgaacggtcagcagcagggaggaaatgccaccaacggcaacggggtgacacccgctactcctgttgcaactccgggtgccaacactccggggagtggcattgtgccctacgttgcaaaacattgtcgctactgtaaatcttgactgtcgcctggatttgaaaactattgcgctccacgcangaaatgcggggtacaatccaaagcgtttcgcggcgtgatcatgcgtattcgtgaacccaaaaacaccgctttgatcttcgcctcgggcaagatggttgtcactggtgccaagtccgaggatgactcgaagctggcatccaggaagtatgcgcgtatcatccaaaagctcggattcaatgccaagttcacggatttcaagatccagaacattgtgggctcctgtgacatcaagttccccattcgcctggaaggtttggctagtcgccatcacaacttcagttcttatgaacctgagttgttccctggtctcatctaccgtatgatgaagcccaagatcgtgcttttgatcttcgtcagtggcaagattgtattgaccggcgccaaggtccgtgaagagatctaccaggcgttcgaactgatctaccctgtgctttctgatttccgcaaagtctaagaagactaatgtcggtgctcgcttgcataggggtcaccctttaagcccttcggcttttcgcacccatgtattaacatttgctctttttcgtgttgtctcttttcttgctccgcgagattgtatcatgaaccaggcaggacgtttcacgttggcttggtcgttgcctttgaactcgcatatcacgattcctatgctagcatttctacggcgttctagcgattcggtctgtttctggtcgtctgtttcaacaaactaaagtcttttacaattagaagtcgcacaccgcagattcaagggggcggtactgtgcgctggtcgatggttgctccctcttaattacttgttttgcgttctttgcctatcggctgctaaccctttcatcttgaccctgtctgcatggaagtggttctttgagccctatttgttttcacgactcttgcagaagatgacggatcagataggaagaaaattactgcaatattcctctagacctttgaacgaaagtggacgaatgcactggctggttggtgaatcaggcaatgaacctgtttttttgtgc

SEQ ID NO: 6081 - DNA, 677 bp, Aspergillus oryzae
  misc_feature (1)...(677): n = A,T,C or G
gcaaggtgaaagaggccgtgaagctcttcgaggccagctgtcagaccaatcagagcaccttggagggtctggaaaagtctatgaccactatcctggaccaggagctgggcagcatccaggacctcgacaaagagatcaaaaagcaccaagatgatattgctagctaccaggccatcattgatcatgatcggtatgagcaagagatgaccgccgcctacgtctggatccccatcgcgggcaccattgccgggcccgtggtcttcgctcagatgcaggccgaaattgataagtacgagggcaagatcgaggcaatgaacaagctcatcaaggacgaagaggccagcaaacaactacacaagacgcttcaggccaacgtcacctccatgaagagtcatgccactgatctcagcaatctgatcggccccgccatgcacaccgtcgaggccctggaaggcggctggaacgtcatgggctctcaggtccagttcatccacgacaaggctgaaaagttcgaggaaaagattccccggttgtccatgacgaagcgccagctcaagagcatctcgaatgaatgggtacagctgaacanatacgtcatgtcctatatccagaacgcccagctggtggtcccagtccaagtcctaagccttgaagattatctggcacagnntgaagga

SEQ ID NO: 6082 - DNA, 932 bp, Aspergillus oryzae
  misc_feature (1)...(932): n = A,T,C or G
tcgtacatctactactactactatattggaatataacagtagtataccactagtagtgcggtgatggcttcgtataatccattttcccgacaagagtcgcacggatcctattccctggggtcttaccgtttgctggtgcctttgtcgtggttattggtggtggtggtcgggatctactacaccatccatgcccccgccgatgtcaaacatggccatggcatcttcaaccaggccaaccaccatataacgccttttagtcagagcacaacggttactgggatttactggatccttctcctcctctcccaactcagctatggcttactggagacaccgtgcgctgcccccgctggtacacctatctgcaatcgcggggccctttgcctggacgttgatggcgctgttctggaacggtgccgttgccgtgcatagtagctcgctgccggcgcggatcgtcgccaatatcttcatctgggtgatcttcctcatcgggactacccatattaccgtgagacaggacgatctattaggctactgcctgagtttcttgtttctcggattggcactgaagcaaattgccgtcaaaacgatcgccttgcagtggatttttgcctttgtaatcttcgcggtcttcctggcagagtcactctacatcactggcactaaatataccggtcgcgatgttttgctccgcagactcacccaccccgaaacggcggatcgggagcgagaaccgctgctcaacgagcagtcaggagcggcggcctgagggtgggtcgcccaccaagcccttaacggagtaggtacacgacggtgccgtcaggagtcacttacatctgtaccccaaattgacctggttagtttttctgtccgntctaaaccgggtggatgcaacttggattttgacgatgcaccggagcctggagaccccc

SEQ ID NO: 6083 - DNA, 995 bp, Aspergillus oryzae
ggtaccatctaaacgatcactgcgacctcagtttcctggacctatgctgttttccccgcgaagacggcaagcactgttcatacaccgacccacattacaagatcgtggaaggcatgcccatgaagaaaatgtaccagttcaagtatctgcccgacatcgacgggaacttgttcagtgggcgttatcgcgcgttcttgttgtcaacttctttgcctatcaaggcgactgtatataaggagtgccatgattcgaggctcattccgggggcacatttggtgcttatggatccatggtatatggatatctatggcattattcagaattttatggggcttacggaacggattggacatcagggaccggcggacaatatcgctctgaatggacagatctgggcacaataggcgcacacacaggaggatatgcagctttatgtgtatcgcttgctcttggagtatgcccggttgtgtgatgacaggagagatagtttggcgtttgtgggtgatttattatgaacagatcatgatggaaagttcactttgtaaaataaagcaatataatgcaagaaattgttagcaagaccaacccaccataccacttgctagaaaactcagaagaaaaaaggaaaaggcagaaacaacgaaaaaaaaagccgcgcaaccccccctagtctatgagatgtcagtgaagtcttggtgaccgccatgtcactgtcagcaaattctcaccgttcatcaccaggtcatccttcagcacatcctcctcgacctcttgctggtcctgtggctggggctcgggctggggttgggcccggagctgggtgttttggtgaagatggatctgttttcgatatccaaattatccacaatatattcaatgccgaagactactaatataatctaatttatattattcaaattatcactataaaaaaaatcctgtggccttttaacctgcatttaaagggcccaatttcccctaaagggagctctacg

SEQ ID NO: 6084 - DNA, 1634 bp, Aspergillus oryzae
  misc_feature (1)...(1634): n = A,T,C or G
ttttggacacttgtccttttcaacaattccacctacggatgctgatcggtataccctaatggaatcggagcctagcctccactcactcaaccgtgatgacaccgtggcctctgaccttatgatctgggcctgtggacgtgatcttattccccctttccgaacaagacgtactctctggtttcccctcgtctctggcggagccaatacattacgcattttctagaattgcgaccatcataaaatcatcatgtcttgtgatatggagaagaccatgtcatcggtggattcgttgcccgccaccccggcatcagaggtgccggtgctgacggtctacccggccgacacatcgttgaatagtgcagatgtgaagacgcaggaagtcaagccggaagagaagaagcctgcanagaagcggaagtcgtggngccaagaactaccagttcccaagaccaacttgcctncgaggaaacgtgccanaacagaagatgagaaggagcagcgtcgcattgaacgcgtnctttcgaatcgtgcggcagctcagacgtccngggagcgcanaaggcctgnnaatgagaagcctgagaatgaaaaaatcagatggaaccacagatcaantnctnctttcagcggtgtctcagatggaagcagagaacaatcgctttagccaacagcttgctcaactggctgcagaggtccgcggatctcgtgccaacactccaatgcctggctctccagcgacagcatctcccacccttacacctaccttgttcaaacaagagcgtgatgaacttcctctcgaacgcatccctttccctactccctctctgagtgattactcccctaccttgaagccttccactctggctgagtcctccgacgtggcacaacatcctgcaacggtgttgtgtgacctgcagtgtccgtcgctggactcgaaggagatggaagcgccctcccacttttcgacctcggctcagaccttaaacatcactctacagatgacgttgcagctcctctttctgacgatgacttcaaccgcttattccacggtgattcatccgttgaaccagattcttctgtctttgaagacgggcttgcctttgatgttctcgaaggaggagatctatcagcatttccatttgattctatggttaatttcgactccgagcctgtcaccctcgaaggcatcgagatggcccacgggcttccggatgagactacttgcaagacttctagcgtgcaacccggctttggcgcgtccactacgcgatgcgacgggcagggcattgcagctggctgttagcgaaaatttctctcagggaagcatgtcggtcaccgatacccagaggagtcggtggagctgggagtcgctgctaaccttatcatgggcaatagaccgacttgagaacccgagacgacgcagacgaattttacatggtttgagaacatcgcagattgatcggcgcaataatctcgggaagcgtcagaggagtatccggagtacatggagttcaaataataccgagacgttgacgtctccgcttacgggcaaggattgctgaggcgcttttttgtacaataatcttgaatgatctcaaataaagagaccgctaacgactgagcgggttcagtct

SEQ ID NO: 6085 - DNA, 667 bp, Aspergillus oryzae
  misc_feature (1)...(667): n = A,T,C or G
ctttcatagcttcaagctttagtacttgcttcagtcaagatgaagctcatccaactatcatcagttcttcatttcactgctctcagctcggctttgactcttccgttaaaccgtcgctccccctgcgaagaggaaacgtcccacaatgctcccctccttgcaactctaggcggcagcgtcttcgacgttgacgtgactattggggctgacaaccagacctttaagctgctcgtcgacacagggagcagtgatacatatattatgcaggacggctttacttgtattaacgccactgataatcagatcatcgccccagaagactgcaagtatggtccagaaacataccatgtctcgtcaagctacgagcaagttcccgaccaaaactttggaatcgaataccgtgccggctttaccagtggtgtcatggctacgagactatcactatagcggatgttaccgggcgtacaaagcttgcatttgccgaccgctctcacccgatgggcgacngggtgaacaaccgactcctcggtctaggctaccccaacttgacctcgggtcatccgggcactttacccccaatgacacctacttctataaccgggccgtgtacaaaccccgtcgttaaacaaatgttccagcccgggcttgatataagaaccgtacctct

SEQ ID NO: 6086 - DNA, 694 bp, Aspergillus oryzae
  misc_feature (1)...(694): n = A,T,C or G
cttacatcagtaatcgttcagtggctcacaatgaccgaacaaacgcagcagcctgactaccacctcattggaacccatacgagatactccagctggacatctcgcgtggaaacagtcctcgagtacttcaatatcccctactcagcccagattattcacctatccgaggtcaaaaagatctcccacacaggcctggtcccgttgctggaatgtcgctcacttggcccaaacatccgcctcaatgactcgctagccatctgcgaattcctggccgagtccaatccagaactcaatctctggccgcgcgaccgacagctccgagcgctggcgcgcagcgcagcagcggagatgcactcggggttctcaacactgagaaataactacggtacgaacttcattgcccggtatacggggaatgtgcccgtgtccgagcaggcgaagaaggaggtcgagcggcttctcgttatctgggataatgcgaggcggacgaccaaggctcgtttggctgaattgaacgagagggacgaggggttcctgtttggttcgtttagtatcgcggatgccttcttttggcctgttctttggcgcttccgtaccntacacctgcctctngatacggccagccccgatgcattggcctggatggagaannatgtggaacaccccactatgcagagactggcgcatcactact

SEQ ID NO: 6087 - DNA, 647 bp, Aspergillus oryzae
ccgtccgtctcaagaagggcgccaacctattgattcccaaggctctccagtttgatcgccttgttgcaggccaagtgccaactggctgggacgctaagcgatatggtattcccgacgacatcatcgagcaggttgacccagtgaccctgtttgttcttgtctgtactgctgaagcgatgctctcggccggtatcactgatccttacgagttctacaagtatgtccacttatccgaggtgggtaattgcatcggctctggaattggaggaacccatgccttgcgaggaatgtacaaggatcggtacctagacaagccacttcagaaggatatcttgcaagagtctttcatcaacactatgagtgcgtgggtcaacatgttattactctcctctactggacctatcaagacacctgttggtgcttgtgcaacggctgtggagtctgttgacatcgggtacgagactattgtcgaaggaaaggcccgcgtctgttttgttggtggctttgatgacttccaggaagagggctcatatgagttcgccaacatgaaggctactagtaatgccgaggacgagttcgcccacgggcgtacaccgcaggagatgtcgcgtcccaccacgactacacgtgctggcttcatggaatcg

SEQ ID NO: 6088 - DNA, 703 bp, Aspergillus oryzae
  misc_feature (1)...(703): n = A,T,C or G
caaagatctcgttcttcgtaatttggtggttcatagctattgaagattatttcatcagcatattcggaccgggtccccacccccgattgttctcaattttcttcgcccgctccagtgatagagaggattgaccactggggccattcccgcccgccgcctatcgattctgcccttaccctttctcgcccacctgattctttgctctctttcttcttcccctctctgacagaacaacttttccccctccccccgaattttttggcctttccctctttgcttttgagttgtgcatgtgcatttctggcctacagtctttccagaacctctaaatcgtgatcatttgaaataatgggtcagactttgtcagaaccagtagtcgataagacttcgttcganggcgaagatgattgctggatctacagcgttttaaccatgccaggctggcgaattaacatgggggatgcttatgcttgccgtctataccttcccccgaaatattccaattccgaataaacattaaccggatcctgccaaacagcctaactttcttttgagtattccattggacaaccgcgggaaccaaatccccctgggttggttggagaaaaagtgccccaataactgtcgcaaaacagggatttttttgctaaagggcgacatttgacaaggccctcgataaatagggtttttaactacccaacgg

SEQ ID NO: 6089 - DNA, 656 bp, Aspergillus oryzae
  misc_feature (1)...(656): n = A,T,C or G
ctcccccagtgaggcttctagtctttctattttattggcacttgctcatcaacctgtgggctgctatcttttgattaatttccttcgatttttcttctttctaaatttttctttcatctaaaacctcaatgggtcgtgccctttggtttcaacccttaatggtctaaaccaacattggccaacccctaattccaaaacattgtcgtacccaagttaaaggctaggattaagttccggcttgacaagcttgttcgtcttcttaaggaacaccaggttgaatttcgcagccggaaagaagagaagaatttggccaaaaggaaaggttttaaaaccggcaatgttggaattgttttggaaaggcggattggcccttgcaaccanaaatgataataaggccattgccttaaaaacagaccttaattggaaacttccccaaatggtaaaagggtgttttttaaattaaatcgagtcgcaatttaagcccaaattaattccggaaattgtttttcaagagagcaaaccttcaatttgacctttttttaaaattgggtctgaaaaccttttcgggagttctttcgggttttcataacccggggccaatttaaaggccctttgggccttgacaaatttggtttgggaatttttaaaaaaacccg

SEQ ID NO: 6090 - DNA, 303 bp, Aspergillus oryzae
cggaatgtttctacaattcctggtcttcccaatcgctgccaagcgatatggtgtcctcaattgcttgaaggccatgattctcgtatttcccgttatctactttgtaaccccgttcactgctttggtaccggagtctctgcgtcacgtaacaatctttcttctcatgctctccaagcttgcggcgtccatctttggcttcccttgcatcacgatcctgctgaccaactcagccactagccttaccgtgctgggaaccctgaacggagttgctacgagtgtcagcgccgtgggacgagccgcagg

SEQ ID NO: 6091 - DNA, 702 bp, Aspergillus oryzae
gaatgctcgatcgcacagcattggactaccgtgaatgtgccatggtcttccgactaccacagcactaaattcatggtgaacgtgaccaaagcaggcccagtggtccttgtcctctcccagttggactcgcgctacttcaggggattagctggtgaatacggcttcgtcctcaagttccgggtgcagaaggaaggcgaagatgactacatggtgcgcagccaaagcagccacttgatctgtcgatccgtaaacgcagaagtggatctcgagcctggccgctaccatgtactgatgaaagtcacggcgtacagaaatggcgagatggaatcgaccgaggaagcggtaagccgcttagcaccgatcaaacgagaaaagctcgttcagatcggtctctcgtacgatctagcccacgccaaaggcatggtagtcgagacggaggatgagaggcgagtacgcgaggaactataacatcatcgcaaggcagcagaaagacagaaacagatcgaggccaccaggaagaagttgcaaaaagaatggattcggcagcagaagatgaacgcccggaaacaaaagatggctgagaagatttttgcaaaaggccaaaccaccgctgttataaacaaagctattgagcagatttttacggagggccaatccaagtctcattcgaatgtggaaatgttaagtcacatatctaccata

SEQ ID NO: 6092 - DNA, 635 bp, Aspergillus oryzae
  misc_feature (1)...(635): n = A,T,C or G
gattcctgctgcataaattcgaacgctgcgactcgatgtaaagatgtgaccattcctacgtcaacgacaatcccaccgattttcacttcgacatctagtccgactgcaggatcttcatctggccatctctccggaggccaaatcgcaggagctgtgattggggccatagctggagttgctcttttagcggcactagctgcactggcgttgatatgctggagacgaaagcgaagggctcgaaatgacaatgttttgaaccagccaaacccccagaggaagggcttctcgccaatgcaacctacccccggccagcaaggcttcgcaccgattccaggggggcgagtagctaggatgtctgccctgcgtgaggccccaagctattcacctggacgctctcgtaactccgctgcccttttcggtgttggaaaacatagcgaatcctctgattcagattactacggcgccagccccggggctatgtctaagaagatacccccaaccgcagggaagcgtactgcctcactatctagcaattcggccctggctggtgcgggtagtgacgggtcacctcgctctggcatangtggtcagtactcatcacccgatgggatggccagtggccagtcggagcaata

SEQ ID NO: 6093 - DNA, 690 bp, Aspergillus oryzae
  misc_feature (1)...(690): n = A,T,C or G
gaagaactgggaggagaacttcgaaaaaaccgtcgaatggttcgacagtgacattgcaggaatgtgcaaagcttcattgcaaccatccacgcccccatctagccgttttgccccactgttcgccaccgtgcgcaagagcggatggatgggcggggcgccaaagcccccgagtgtggagatgacagggcctccggtgctccctgcggaggtcttcgactcttttgttcaggatatgcagagaaccggcttctgggccggatctgcgtactaccttcaccatgcgcggaacgcggaatacaatggaaagcgcgaggggaagttggaccaaccagtcctgtttatccatgacgccagggatgtgatatgtgataccataacgtctcgccttgtcgagccgatgagagagaactgtagtaatttgactgaggttacgatcgacgcangacactttgcgcagtatgaaaaagccggagaggtacacgccgncatttttaggttcattggggaagagctgtcgaatgagtggtcttgattttggactggctggtatacttaaaaaaagtcggttatgtgagctggattaccctggggaactttggaaatgttacaactggaattttttgggactttggccagttcccaatatttatttagcttttcgcaaaacctttggtgggcggagttttaatn

SEQ ID NO: 6094 - DNA, 944 bp, Aspergillus oryzae
  misc_feature (1)...(944): n = A,T,C or G
ttttatttcatcaaagcagtgcttgccgttcatttaatcttgcttcttctcaactatacacaagagctgtcactcttttccagctccattcactcttttagtcaaagtacaaaatccagaaaagtaacggattacatatatactaccatttcgcgcacttctgtcgcattcctccgcacacgcgattcaagataaagccagacacaacgactcgagtccattattccattgcagtcgcaaaatgcagttcagcaaggctcttctcatcgtcaccgccgtgcttgcgcctttcgcgcttgcagaggatgcgccaaccaagaccctcaccatccaggtcgtccctgtgacgacctcaactccggcaccgacttctacggcgtctcccagctcttctgctttctcaatccacactccttctagctccgctagggcgtcttccactccgctcttgtcaaagacgccttccgcgactccttctgtgacaccctcgtcgtataccgtcccccaggctactggtggtgctcctgccattaggctctctaatgcgatagctgcgggcgttgtcgctgctgctggcttcatagtgctctaaacgcctttgcgagcagtccagagcaatgcgcatagacgacgatggtcatgtctcagtcatcgagccgatacgactgcagtagcaccatctgaattgcttctgagaacttgctggttgacgtgggctgagcacagagaggagacaatgccaataaggagtcaacaaacccaatcaaaaatcaactacttctttacggcagattgcattttgtatacctacctcattactcatgcgattatcttgagcagtttcagccaagactatagcggntttacatgatggtgttcatttgtggngacggttcgccatttattatttactgtgctgnngatcgaattctgattgtcacctt

SEQ ID NO: 6095 - DNA, 695 bp, Aspergillus oryzae
  misc_feature (1)...(695): n = A,T,C or G
ccggtccaaccaacgcaaaatgcccgcaacttcagcacatccgtggaaactccagtcccaagatcttccctatgcatgggataatctaattggcgtagacgccgatgtggcgccgatgtctgcctttgatacgatcattgagccaccgcccgccaacgctcatcgacgaccgaattctcaagatattctcgattctcccggctacttgccacagtggtctccatcttctgcagaccttctcccgtgggaagcgtacgagaattggacatctccgaggcactcattcgccgcgcccaaccagtttgaggacgcgcccgtgctaccgccactcaagcaagatctagtacagaacacatcgaaactttcttctaaaacccgcacatcgcctccgcaatctcattgctctgcctcgagctcaaccatcgcctctttatcgccgccgccatcttccccatctggttcgcccagttccacgcctcacgaaggttcagcgcatncctcatnccggcgctcagcacataacagaatttgaaaacgctaccgggagaacctcaataagaactttgctgcacttgagtcgtctctgcaaggctattacacncnaggggtttgaagttgcaggccccgcttctactgtcagagaaagcctgctttctagaagaatgcagttctgaccgatgccggccattatatcg

SEQ ID NO: 6096 - DNA, 642 bp, Aspergillus oryzae
  misc_feature (1)...(642): n = A,T,C or G
ggtaaaccaagtcttggacttgaaagaaagcataaagtactatgttgaagacgggcataatgtggactactctggagaggatgagacgctttatgatgacctaaacctagatggtgagactgaggcacagttcggcatgacgggtgataacgaccgggtatcatcgcaggatacacagtccgtccaggaggaagacctggacttgagaccgaaacccattaagagtgaatccacggcgcctcgaagaccctcagcgcagatgaaatcgccgctcccagtgcttgcgacgctacatccgtcaacgtccaccagtggcacatctgggatgaagcccgcaccaccgcccacccgtctacctggggagaccctcaaatatgcctccgcggcggccgcggcggcagccagcgataagaacggtgttggcattgctcccctccctccaccgccgggcgcaagtcctgctttcccagctgccagtttggcctcgagaccttcatcgactgcttcccctagcattgcctcggtgcaacctgtatctaaaccgaccgcaacgacaagtattgcttcngaggagcggtccaagacacccgcgctcagccccaatgtcaccgccgcgagtgcgtcgaatacggtacagtcgac

SEQ ID NO: 6097 - DNA, 1160 bp, Aspergillus oryzae
  misc_feature (1)...(1160): n = A,T,C or G
gtcctgtcaaggaaaacaaatatgttcaacattaacataccataggttggtctggccaacgtcggtaaatcgacgctcttccaagccatcaccaagtccaacttgggtaacccggccaacttcccctatgccaccattgaccccgaagaggcgcgtgtcatcgttcccgatgatcgtttcgactggttgtgcgagcattacaagcccaagtcgctggttcctgccaacttgacggtctatgatatcgccggtctgactcgtggtgcctctaccggtgctggtctcggtaacgctttcttgtcccacatccgtgccgtcgatgctatcttccaagttgtgcgctgcttcgatgatgctgagattattcacgtcgagggtgacgtcgaccccgctcgtgatctggacatcatcagcgaggaactccgtgtcaaggatattgagtttgttgagaaagctctggagggcttgacgaagcagacgaagcgcggtggtcagtcacttgagatgaagaagctgcgcgaggaggaagctactgttgccaaggtcctcgagcacctgaagtccggcaaggatgtccgcaaggccgattggggccccaaagaggttgaggtcatcaaccccctccagctcctcactgctaagcctgttgtctacctagtcaaccttagcaagaaagactacatccgccagaagaataagcgccttcccgatgttctggaatgggtgaagaaaaactctcctggtgaccctataattcccttctcggcctgtttcgaggagcgccttacccggttcgagactgaaaaggaggccatcgaggagtgcaagaacctgaacaccaagtctgccttgcccaaggtgatcaccaccatgcgtacatctctgaacctggccagtttcttcaccactggtgccgatgaagtccgccagtggaccatccgcaagggtatcaaggctccttctgctgccggtgtcattcacaccgactttgagaagacttttatccaggccattgtttacaactatagcactttgcgtgaatacggcgatgaagccgccgtaaggccggcggtnaagtcatgaccaagggtaaagactacgtcggttgaggacagtgatatcctcctgacaaaagccggtgccgcccgtggctaaatcag

SEQ ID NO: 6098 - DNA, 1052 bp, Aspergillus oryzae
  misc_feature (1)...(1052): n = A,T,C or G
caactttcattgctccggaaattgatcatttgcagtcaaggcgcaattgtttcaacctctgttcccgaacgataacgcttgtctccacgttttatcttcccaattgtcatcatggctcgtctgagctacctgctcgtgagctgccttagcgtcgtgagcgctgcttccgcagtcgtcgatctagtccccaagaacttcgacaatgtcgtgctcaagtccggcaagcccgccctcgttgaattcttcgccccctggtgcggtcactgcaagaacctggcgcctgtgtacgaggagcttggacaagctttcgctcacgccgaagacaaagttaccatcggcaaggttgatgctgacgagcaccgcgatctcggcaagaagttcggtatccagggattccctactttgaaatggttcgatggcaagagtgacaagcctgtggactacaatggcggtcgtgatctggagagtctgtctagcttcgtgtcggaaaagacgggcatcaagcctcgtggccccaagcaggagcccagcgaggttgagatgctgactgattcctctttcaagactactatcggaggtgacaaggatgttctggttgctttcaccgccccttggtgtggacactgcaagaacctcgcccctacctgggagtccctcgctaaggacttcgtcctcgagcccaacgttgtgatcgccaaggttgatgctgaagctgagaacgccaaagccactgcccgggagcagggtgtcaccggatacccgaccatcaaattcttccccaagggctccaaggagggtattgcctactctggcgctcgctccgaggaggccttcgttgagttcgtgaacgagaaggctggcactcaccgcgccgtcggaggcggtctcgatgacagagctggcaccattgcctccctcgacgagctggtcgccaagtacacctcctcccagaacgttgaggagctcctcggtgaggtgaagaatgtgccaagggcctgcangacaagtacgcccagtactatggtaaaggtgcccaaaagctcaccagaaca

SEQ ID NO: 6099 - DNA, 1251 bp, Aspergillus oryzae
catcatcttgaacactgctcaatcaacaccatcactctcagttcttcgaaatgaagccttctcaactcagcctgctggtcctcctcttccaggcctcctccattcaggccaagacgtacaagaagaatgtcccgacattcgaagttggccctgatgtggtcatcaccgacaacaagattgagtacgatgatcccgactgtgatcccgggtttacatgcagaacaagcaagacctgtgccgcgccgggtaccgttcccaccctcaccggcgacaagaagtacttttcttgctgcttgaagggactgaaccttcttggtagccctgagacagcattcgactgctgtgccgaaggccatgaccttgctggctctggagaagttggctataggtgctgcccaactggacagatctatgacggcctgatctgcaagccggtatgcgcgaatggcaaagttcttgtcgacggcaagtgtgtctgcccgaaagacacagtcgaaggtctggacggggcctgccatgaacaaatctgcacttccgggttaacatctggtaaatgctacaccttcaccgcacccaatggcaacaccctaggctccggcgccgacggaatctactacgccaaacccgacgacatgaacttccactatggtaaattccagctttgtctggacgagaagtgcgagggcaacctccccatcaacccccaggacggagtgtacattagagacctgtacggcgacgtcaagaccggcgcgaacaagggccagtggctcaacaatgcaaaggatggcgcccatatcggcaagaccaaggactttgccgcagccggcaaattctctttgagcaagtggccatgcggaaagtactgtcttggaggcgttgagtggggtgtcggtcccgcttgtccttctctgacacctgcgattaccttcttctcacaggatccgcagatgtgtactgcctttgatctcactgagatcccttgtgatattaaggcgcctgccaataactgtatttgcaagagtgggaagaaccagtgctgtggtaaggttgattgcggtctgtgattggctacacagcgggtgtgatcagctacgtactccacaggtgacttgcgtcttactggtgtagcaaatgggggacacagtttggagatttaatcggggtcttgatagtcaaggtgatagtagtagttagctgttggatgagtaattgagggtgttagttaaaaaaaaaaaaaaaaaaattcct

SEQ ID NO: 6100 - DNA, 1181 bp, Aspergillus oryzae
ccgaaagcgatgctgcaggtgccgatctatcttgtggtattactgaagagacccgcgatgatggtgaaactaaagctcctactcagccagaacttggcaaccctgagtctcacgatcgccagtcactaaatgaagaatcttatgactctgaagaggaacagcatacagaatcgactgctactatcaataatttgtctgcaactgatttgacagaggagcaaccaaatcctgacggctccacggatgttccacatgatgatcaccaagcccacgatatccatgaagaacaatccgcaccggacaacgccaacgacgaaagctatcccgaggagggagaaatcacgatcaattccaatcataacgatggtactgaggagtttgagggcgatgcttccgattatgggcatgatgaccatcatactactgagtcaatcacagaagagcttcgaggggaatctctgaaagaaatgatgaagacagtcaatccgaggtcgagggcgctgcgtctcaatttcaagacgatgaaacccgagagactttcagggtgataagagtgatgttttgcctaaattggataacactggctcagatctgtcaggaaacaatgttcaaccgagtcctgacctggtcgatgactcattaggaatagcaggggacatcctggacagctctattcgaggctcggcgattgcagacaatgatatcgagggtacagacctccctgaggaatctgatgatgtcactgaacatatcgcctcaaatcataccaaccaggaagccgaagagttaccctttgaggacgacgaagactatctggatctggggatcgcagaagatcttggtgttgccgaggcacttggcacacaatcacccggcccagcatctactaaacgacaccgcgagccggaagatgagtttgagctggccgagagtcctactccggacgctaaacgttccagatcatcatgatctccagtgagaatagtttcttactttcccctaatccagacctctactctgggctatatgggctgttagatttgtctaaccagccactgcacctttcggttcatactgggtacagtattgtttccgtcgggtaccacttttaagtatgacatttctactaacgaaaccttcctgcgcattaagtgttagcaaacacttgactgtacccggtg

SEQ ID NO: 6101 - DNA, 673 bp, Aspergillus oryzae
  misc_feature (1)...(673): n = A,T,C or G
ctcaaccatgaccagaccttttatcaataacctttcactcacatcattcatactcctcaccacccacaagtcaaaaacaatgccctctctctacgtcgcaatctactacccccgctatggcaactaccaacactgggctctccacctacacaccgcaaccgaagacctcatcttcgaagtcgacggtgaacaccccaccttccgaaagatggaatcccgcggcaagccctctgattccgactccctgatcatgtccctgctggtcagcgaaattggagatgttgatgtacccaccgtcaaagcggcagtagaggctgcccgcgtcgacaatgagacgctggaatgggattgtcaagaatatgtgcttgacattttggagccttgtgagcangaggccgtgttggatggaaatgatgagccttatgtagagggtatgaaagttttgaaagtaaagcgggggccgggaccttggaggctgatatttaatggtggggggagggttaagaggggtggttcttaccgaaggggaatcccgaatttcgggtttgggtccgaaaatggcactggggaggggaaacttataaataacaaggggcgcgggcattggtaacaagaacattaactggggacatcccttgctttcgggtgcgctaaggggaactcccgggggggt

SEQ ID NO: 6102 - DNA, 686 bp, Aspergillus oryzae
  misc_feature (1)...(686): n = A,T,C or G
tttttttttttacatcctgcattaaagtgtatcattatccacatacgttaagctggtatccgtccaagacgctaaagaaatgtagagaatacacatggactccaacaagagccgagaaggttatcccaatgcaagaaagatttgaacaccgtccaacaatgcatcgatgcgtcatataaagagaaacaaggaaaagtgtcgagcttaaagaaagacaataaggaatctccaccgatcatgccatgaaatttaatttcacgcgcctcgtcgaggccgtttactctcaccccccattctcatgcctccccggccaccgccatcgccgtgtccactgtcatcgcccccgggtcttccacgcttacgatgggagcctcctcctccgctgccgccgtcgcggttgtagtctcggtcgcgttgacgatctcgattccggtctcgatctctatcacgcggttccctgccgccggcccagcgcctatcttcttccgcgctgcctgggaggggcggcgggggagggggcggaggtgggtgtccaccaagtgaggatggtggccgaaggcgcccttcatgttcctgactctgggcgtctgatgcatcctcccgatcccgtcgacgaagattttcgtcgcgtgatccagcccctcggcgtgatgcttcgcgggactcgtaccgntcttccctagtgt

SEQ ID NO: 6103 - DNA, 679 bp, Aspergillus oryzae
ggatcttgaattactttgtcgatgatttcattcccgactatgaccttagggttcgtttctgtgaaacgatcaatcgtatgtatgataatgtcaaggctcgagaaggtggtggaacgagtgattcaaagattctcatcgacctcaaacgatgctggtatggaagatgttctgcctactgggattttcaggaccaacacatcgcatatcacacccctgactacctcattgttccgggaggtgatgaacagctagcgacaagctgtgctgaaagccaactgagaatggtgcgtactacaagtggccaggaccgtgaaggccggcctcggccaccacatgtgcggaatgattcatcagctacagccaagagtatgccagtttcggcggacagtgaccggagtattcacgcaacgtcgtgttcgctaccacctaaatctcccaaacgcctctcgatggcaatcatggacaccaagggcccacatccagtgcctcttgcgcctttgaaaccagtggggtccctgcaggatccccctacttcttccccagtcacatcgaggcgctttcccttccatagccatgcacataagcgaagtggtagcttctcagattctgcgcgggacggcagagcgcctttatctttgctcaagctcgactcccaagggaacctctcagccccggatac

SEQ ID NO: 6104 - DNA, 620 bp, Aspergillus oryzae
ttgataacctctgcctctacaggtctcttcttaggccttgcctctatggcgagtgctgttatgtatggatacaaccacgttcctctcataaaggacactgaaatagttgccggtgccttcgagaacgtcaatgatattgaactcctgtccccagcctttttgacgcccaatgtccggcttcctggcttccctaacggcactcaagggccgtcttctcaagatgacatggaggcattcctcgagcaactggccgaacgcaacgattacatgacctatcgcaccgctaacttcacctcggaagagggccgctctttcccctacgcccacctctccgctggtcactccgtctctaaagtgcgcgtgtggatccaaggcgccgttcatggtaacgaacccgctggcgacgaggccacacaggccctcctgggcaagttcgacggcgaccaggagtgggctgcctccattcttgacaagctagagctggtcgttctgccgaggtataatcccgatggcgttttctactttcagcgcactctagcgacaactatgaccctaaccgcgaccatatcaagcttgctcgccagcagacgcgtgatataaaacagctcatgaacgaattt

SEQ ID NO: 6105 - DNA, 664 bp, Aspergillus oryzae
agacagcttcgaccgacataccaatatcagctacagatccatcaccagctgttgagacctccctattgaatgaccatactacgcttaagcacatcacaagtgacgccatcgggatcgagtacaaaaacgcctaacacgataccgacgcatctaccacctgtcagctctttcaccatcactactacagttagtggcacatctcctttaattaccgaaggtattacgaagacatacagtccagtgtcatcctatggcgccagttatttaacgttagagtcaatcgcatcaagcttgtctagcaatttctcgagttcgagctccacagaggctgtcctaacgcatacctcccgtacaggaggggctccaacggcgactacctcaacggtatcgggagggtatcttcccaaaaataactcggatcatggagattcacttgtcgctccagaccatggctcacaggcctctctccggactttacttggtaacgtactcggtgcgatgggcttctattgaggcgtaatcccggatctgcttactgttattcagacgcatggggaggagatcgggcggggtccaatgctttggaggaaaccagaagcttctaaagggcgatcggtaatctgcggattccttgactgggttacaacacggaaatgtttctggg

SEQ ID NO: 6106 - DNA, 684 bp, Aspergillus oryzae
cctctttcttcggtaacttcggtaagaagaagggtgactccgacaacgaagctgagggcgagtctaagcccaagggcaacaagcttggtggtcttttccgcaagcccagcaaggccgtgaagtctgagcccaaggagcccgccgccgagactgaggctaaggccgagggtgctcccaaggaggccactgttcccgagtccgctgaagagtccaagcccgccgagcctgctgccaccactgaggaggctaagcccgtcaacgtctcttccacctctgctcccgtccaggccgccgcatgaagtggttcttcaagccgcgtcattgagtatgaaaactggtgggatcaatatggagtacacgcttagtgttcctccctcccagtgatgagtgcccatgggcgcataattttcttaaaaaaaaaagaaagaaagaatcgttagtaattgcttattgatattattttgtgttgattccagtgtcactgctttggtgccttgcttcgcagcgaggatcttgccaaattgagtgtcaatgataccctctgctgctttggcggtcattttcgactctgatgttcttttcgcgtctgggtcggatttatttcctttatgatatccgttcccgcaaggatcccctatttgggccttggtgccgtttgttggcgccgcccaaactaaatgaacg

SEQ ID NO: 6107 - DNA, 668 bp, Aspergillus oryzae
  misc_feature (1)...(668): n = A,T,C or G
ctcacattgcctgatttatctcaatatttatctgaccacgcattcgcaacctgtcacctcccactcaccatgtcctcgcaatcctggaaaccagtcagacctgatggagcgttctgggaatctcttgaccctgtcatcagcagcactgtggccgagtgcctctcccccgccgtgctcgatgacataaataaccattccaccctttccaacccggccaagttcgagctcctcgagcaggccttgacgagaaagcttctatctcttgaagagagcgcgaacccatcctctctccatgacacggactatcccacttggcaacgcctcaacttcgcccttttccacgtcctccgcggcgccggcgatgctgcaaggcagaaagaaaccctcctcaagctagtcaacaaccctggcccaagcggacaggatgtagcagcgttgcagaacttggctacattatacgaggaaacaggcgagcatgcacaggcagagaagctcgctaaggagaccttgccattgcttcggcaacatccagccctgggacaggatagtccccagtctctggggtcgctgcgtatcctgatcaaggctctntggaaacagggcaaggagaaaggaggcggacaggtgatacaagaggccagcgctagtattgatagattggcggnaga

SEQ ID NO: 6108 - DNA, 729 bp, Aspergillus oryzae
  misc_feature (1)...(729): n = A,T,C or G
ggaggaagagcgcatcctccacataacatgcaatccccacagctactagcattgtatcaccgcagccgccatctaccagcatgtcatagtatctccgaaggtcaacagatccatttcaaaatcacctgttctgttccgcgggcgatccgtgcgccacacgacccgttccgtttcagctcttccttgaataagcgattcggcttcggtttgcgcgttcggctctttttcttttttactctcttcctttaggccgagcctcgagaaacaactcggcgtgcgctggtcgttcgtgcatcgggatatgggatcgctggtctcatgatcgcagctggtggggattcttctcgaagcgagcggtgttcatgcctgagaaagatgatcactggttcggtctggttcattgttctggggcgtggagatgtgggatgacgtcaggagcgttggttagattgttttagttaaggatttggggggtttggcagggtcttttttttttttttttgtatcgagtaggtttgtaggtttggtagtgttagtggtggttgtggttagtttctttgtgggtggtttttctggggaggcataatatgaggataggtatgttggttggttagtatagggaagtgattgtttgtatgtagtttcctcggtggttttgtatatgtgtgcaattgaacgcccgttcttgtttgaacaaacanaataaagaggtagagactttcctgcaag

SEQ ID NO: 6109 - DNA, 665 bp, Aspergillus oryzae
  misc_feature (1)...(665): n = A,T,C or G
ggtgtgaagcatctcgtattcagctccggccctccttgcacagagatgacgaatggccgagtgcgaatgaaagcaatggacagtaaggccacttcgtcgcagaattcctgaccggagggatacgactaactccaggacagtgaagaacaagattgagcagtacgcaaggtcccttgggtccttcgagaccttcactcccattggcgccggatggttcctagagaacttccttggcaaggaggtcgctcctgttttcggaggatttccctattttcctgacgaccaaggataccttactttcagagtcccgtattggggaggggacgagcacgttccatggttgagcatctcagacgacttcggagatatcgtgcaaggtatcttcctggatcctggtcgatggaacggtcacttcgttcacggtgtcagcgacatccgcagttttgaacaagttgtcgcggatttcgccgcggttacaggaaacaaagcgcgttttcagcccatattaccgacgtgggaggcctttgatacgcatggaatccaggagctagaggacgtgaaactcatgtttggcttcacccagctgacaagcgggcgattcttncgaccggaagacacggaggtcgataccggcagacagttaaagcaaattacggggattgaag

SEQ ID NO: 6110 - DNA, 667 bp, Aspergillus oryzae
  misc_feature (1)...(667): n = A,T,C or G
cagagttttatcgcttggtgtatgaccaaagtattctttcatgaaatgatgctttggcaagcggaaaaaggtggttttatgcgctatactccgagcacattgcaaagcgcgagtgcgagagcagatcaacagggaccaagtaacattcccatgaggcagcctagctatccagactctgttaagaatggatccttcacggctcctaacacacaaaatactgttgactcaagatctggattagatacgcctgcctcggtagagagtatccacccggctcgatcctctttggaacgttcacaggtggacgcagaaccacaatctaacaacgctcctaatgaaaagccagcagacatttccgaaaatattgctagctttcatgcctcaaacaatgatgatagcgcgattgaccttgacgatgattcaatgctaatgaccgtgggcaaatacggcgatatgatggcctctgatccancaaatgctgaaggcgatngtgtcgtcatataagctgactatacatattcacttgatttcgtcaaagttttggaaaaaaaaaaaacaaccaaagttttcgtttggttattgggtggagttttaatcctcattttaagagtcttgtttttggttggtgattatttacgttcatgtacaaagaagtttcggcgttcca

SEQ ID NO: 6111 - DNA, 680 bp, Aspergillus oryzae
  misc_feature (1)...(680): n = A,T,C or G
ccacaacaccaaccagcaagaccccaatcctcctactccctcacccgcaaataattcaatacctcacaatcccagaaaggaagagaaaagaaaaaccaacaccaaagaaatcaaaatgcccaaacgcaaactctccgacgtggactccggtcccaagcgcacatacaacgtgcaaaccatgcgcctgacgcaaaagttcgagcagggcgtcgtcctcctatcgcgtgcgctgaaggtcgccaaaggcttcgagagacagaagttatcgaggagagaaaaaaccgccaagtcgcaggggagctctgaggcgttgcagaaaatcgcggaggagattgcttttatcaagagtcttgatccaaccgctacggcgcaaaaatatcttttcaaacagctgtttaagacgaaacgaatttccgaggcgccagcttttatccaatttaaaaagtcgaagaacatttctacagaggggccgcagagtacggccgaggcgaacgttactgcgcgattgtacaagtctaatccagtgaagaatgcgtttncgaaatatatgaccgatattaaaaagctactgggggtggaggaaagtgctggtggcannaaagattaaagcanggaggctggntcaaaagaaagtgcgactaaaacgaagactgaacagcggggctgtatcgtgtcggatt

SEQ ID NO: 6112 - DNA, 572 bp, Aspergillus oryzae
  misc_feature (1)...(572): n = A,T,C or G
ccataccacctctgatatccctacccgagacttgagagaacgctaacactgacgcaccatcctgcaaacattgccgccacttcttcctccaacgcacagcatcctccgactcctacgctggctagaccaattacgcctcagcaccccaattcgttcaacaaggctggcacaaatgctactaccagtgctccacagcagccaacgtctgcgcctgcaccccaaccgctggtacaaccaccgaccccgccaccaccggatcaaagtcaacagccatttaatgacctgagtatcccagatgcctccgccttcaatcttgatttcagcgctctggaaaacccggatatcttggagaattttgactttgacacgtttctcaatacggacgcggataccgccgggtttgggttcgatccgaacatatcatacccgacagatggggttgagaccggtgccggaaatggcttgtaaaggagtctaacggatatttcgttcttatctctcatataccctnccttgctcttgacattcctatatttggcttgngctattccgtttttgtccattcccctatt

SEQ ID NO: 6113 - DNA, 590 bp, Aspergillus oryzae
cgatatacgacttgattgtaagctgtcatagacctttgcgcagcccttttaaccctctgtacacggtcaggattcatgaatcgataccggaatgcccccagccttagaggccctactaaggcgactgccagtacactctgtcagaaatgcttaaaacgagggcactatagctatgaatgcacaattaccgcccaggaaaggccgtaccaatatcgtccttcgcgcacacagcaactacagaacccgaaattgcggccgcagctttcaacagaaactccgaatgatctattgcgctcgcaaggcgtcgccgatgatcttctggcaaaacgggaagaagagcggggccgcaaaagagacatagatgaatcagatcccctggataatcaaggccagacatcaaagcgggctcggtcagcgtcttcgcattctgtcagctctgtgtctacgatatctacaagccgatcccattcgcagtccccacctcgtcgtagggaattcaatacgagaaatgagcctcaccggacgaagtcgacgtcttctcaccatgaaaagctgagaaagagacggtatagcgactcatcttctagcct

SEQ ID NO: 6114 - DNA, 663 bp, Aspergillus oryzae
  misc_feature (1)...(663): n = A,T,C or G
cactccaggcacaggctgacagtatgtatctggagggtctgctgtgcactcctcgcgcgttttaccgcgagaagcacagcacatacgaggacgtagtcatcgaacaggagtttcctggtggacatttggccttcttggacatgctgatcaccagtaagcaaatccgctcgggtcaggatcacgcccggaatcaacatctagccggggtttatgacagctttgccccgcggtaccatgctgctcgagccaacaccgggctgagtcgcatgcaggaagacatgagccgagactacgatttctctggaacagtcctcgacctcgcgtgtggcaacggggagtttggtgccactctgcacgagaatggcgtctccgccaaagtcaccggcatagacgtctctgaggggatgacccgatcgtcatacattcaggatcactacgagaggccgctgttgatcgggccaatggacgaacttattatgggcatgcctgaattcgatcatgtggtttgtttcgcggcatttcagttcctggatcctgtgcacttgaccgcgtgtttagctcgcatgttcatggttgccagtcggtgacggcgatccatgaggatctcagtgacgcgtacattgaagatatgaagaagcggaacggtgaactgtgtanncattt

SEQ ID NO: 6115 - DNA, 671 bp, Aspergillus oryzae
  misc_feature (1)...(671): n = A,T,C or G
cgtggagtggaacctgaccagctcgccctcccgctggacacaaatgctcagtggccagacgattcgttcccaggatgaccctctacccgccaacatcgccatgtttccctcggtcgacccgagccaggtcttctccaatgcgaacccattcgccccgacgttcgatgagccacccagcgtcacgcgctattttgatcatgatcaccgggaatacatggccccggatgaatgcgatcggaaagagtcattcgcaacctccgtccgggaactctcaacggatcactcagtatcgctggcgtcgaatgtgccggagagggtctncgtacatccagaaattccattccgctaccatgtcatccttcatgcgcccaccgcgatgttcgaccatgcccgcgatattcccgtgaactattggacaaaagttaaggctaccccataccggcggtgattcccggccacggggggggccaacccggcggttaaaaccggaacccaattggaattcggttgaagaaattacccccgagccaacccgggccttttgttggaatttggggacaaccgcgggggggggatggaccccaccaaccggcattacccccttgggggggaatgggggggctataaggaagggggcgggaaaaccctgtaccaaggggtattggggaggt

SEQ ID NO: 6116 - DNA, 725 bp, Aspergillus oryzae
agacctactggcctgatccgactatggcgcgacgggtacatacatcgaaaagagaacgataagttctgataatcaatcccgataagaagatctggcgctagtccggactagtcgagagtctaaatcaaatagcttgcggaagtcaaaccctccaactccaacctcttttgtacttcaccacacacccaccttctactgacgctggtgcagcgatgggtgatgaccagtcattaaggtcgacagtggctgaaaatgacatttcagcaaaatgaaccctcggccgttccggcgcaatcctctctatccttcactcagggatttcttctcggacagctctccgttgtactactgatcggtgccttcatcaagttcttcatattcggcgaagctcctccaccgccgtcccgcggcctttctcaccgcgcctcaacccacagacgctccaattcgatctacaccatcaaccccaatgagggaacctctagatcactgagggaaaaaccctctacgtccaacgttcttcgtccggtgccgtcgtccgctaccaacactcgatccattcttcggaaaacctactacagtgctatacctacgaatccctcggggaagcacggccgccatagaatccaccattcctcccatcagccggaatcacttgattgggttaatgtattgatcgcacaaactattgcacagtacaagcaaacggcggatttggtgaacga

SEQ ID NO: 6117 - DNA, 664 bp, Aspergillus oryzae
  misc_feature (1)...(664): n = A,T,C or G
gataccacaatgtcttttgattcaaccgaggagaaaaccagagggttctcgcacccgatatactcatctcacaaattcaagatgtcacagcaacagcaacactatcctagtcacaatgcaccagcaccacctccgtatactggacaatatcagccgatgccaccaaaccctcaatatggataccctccccagccgtatgccagtcatccacaaccaatgatgggcaatccccagtaccctcctcagccgcatcacacccagagtgcaatgcgctccctgaaaatcgagttctccagttggacatcaagacacctagcaatcaatgatgtcgggcaaggctcgttgctctatacggtcgacctacacaaccgaaacccacagatggaattcaagaatgtcgcaacgaacaataccatcgccacggtgcatatgcggtctttgaagccagaaatggacatcaagctccatggtcgtgatattcatcttcgcgtccaacgctccatgaaacccgagacaacgtatcactcaatcgcgtttccccacatgtcttttacatggnnagacactagtgcctgggagttctcagttttngatgtgtgggacagacaggtcaccgttgcaggttcacgcggnttcntcntgtctatgcgcangtcggtcaatn

SEQ ID NO: 6118 - DNA, 702 bp, Aspergillus oryzae
  misc_feature (1)...(702): n = A,T,C or G
ccgtcagcatctcagactacgaagcgcgccaggtctacgcagaaatggcaaacgtagaaggtgacgggaatggccccgcaggcggctggaaactggacaaatacaagttcctccctctcatccaacacgcgggtcgcgcaaagcccgaggcgaagtggtacatctacatcgaagacgacggctacattttcctgcccaacttgcttctccacctagagaagttctcgtggcaggagccgtggtacttcggcggtcttgcctggaaacacggtgactatttcgcgcacggcggtgcaggtttcgtgctctcacggngtgcgtgggagcagagcttcggcttggaagaggacatggtcacgaaatacgccgatttcacggaagcccacggctgcggtgaccatgttcttggccatgtcatgcangattacgggattaatttctggcagacccatggcaagtcggagtattcttggggtttaaacccggaaccgcactggggcggttggttccgacgcgcgaacctgtgttattccctttacaagtggaccatacgcacaataaggatgtaccgcgactcttacaactttaacaaaacttggaattttaaaaaaaaaggcccggttaaaaatccgtcacttttttaaggcattgttaaaccctcaatccctcattgggtggatagtgggaaaaaccaatccttct

SEQ ID NO: 6119 - DNA, 698 bp, Aspergillus oryzae
  misc_feature (1)...(698): n = A,T,C or G
ggacccaaactccgtacgcctacactaactccatcatacacgcaaaccaccgcccatcatcattagcatcatgttcgctgcacttccccccatgcagcagttcaatttctcgcagtgcgctaccgcgcccgcacgaccgtctccactctcacctcacagttcgccggcgcgcccgatgccctcgctatcctcctcgccgtttcacttctccccagcatcagaaagccaatccaacacacccgtcacgtcaagaacagagtccggaagtctattcttggaatccccggtctccccttcgccttcgaagggcgcgggcacgtcctcccgctccaagacttcgcctacatatgctcagcgctatgcaagcaccatatctaatccattgaataacgcgtccagaaatggttccgcttcttcttcgccgtcggcgcgcgaagcgagacgcaatgttttcttgaatcggatcaagcaagggcgcgacgatgcacgtttcgctaatagaggcgagcagctagtgttgatggagcatgtggcagagcaaaagaagtggggcgagtcnatgcggaggaagacggattggattctgcanggatacttgagggatttggaagaaggtgttcatgatatgctggacgaagcggatatccaagctctggacgagtatttgtccaggagcaggcaatggagatggaagtgct

SEQ ID NO: 6120 - DNA, 691 bp, Aspergillus oryzae
cgaggtaacgcctcctgccccttcaacgacagcggtcggatcaggaactgatcaattggaccaatcattatcatcgctggtcgaaggaacatcgaatttaacgtcttaacccgaccgtcctttcctgcttgacaggggcctcaacccgccaccgcctgtcccttatcatcgactgctttaaggaccaggaattcgttagattctccgctacacttcatagccgcaatgtctgctcgtactttgtcgcatagccttcgcagccgctgccttttgcgcagacctcagaacattcagggtttctcgactcgtaccaacctccgtgccgctgatcatggagatcactacgatcctccgactgggtggctttttggtgtcaagccaggccagaagtacgtgaaggaaggctgggagaacatctggtactacggattcattggcagcttgcttgttgccggtgtcgcatacgttttcaagccagacacctcgatacaaacatgggctttggaagaggcacggcggagactggaagccgagggtattctggaggaccccgagaaagctcaaaggaaagtaaaggacaaatctggtctgagtatgctcttgtacgatgaacatagaaccgacggacatggaaacatcagctccgatgaaatgttcatcctgcgctacccggatatgattggacagataa

SEQ ID NO: 6121 - DNA, 672 bp, Aspergillus oryzae
  misc_feature (1)...(672): n = A,T,C or G
tgaatttgctctacacgataatctgcattacttctttgattcacttgaccggatattcgcgcctggctggcttccagacaatcaggacatgctccaagcgcgtttgcgaaccacaggaattacagagactttatttgaacttggccaaatgaacttccgaatgatggatgttggtggccaacggtctgagcgcaagaagtggatccattgttttgagggtgtgcagtgtcttctcttcatggtagccttatcaggctacgaccagtgcttagtggaggatcagaacgctaaccaaatgcacgaggccatgatgctgttcgagtcattggttaacggagaatggttcaagcgcaagcccatcattcttttgctaaacaagatcgatctcttcaagggcaaactaagtgtctcccccgtgtctaaacactttccggattacaacggttcgaatacggactttgatgctgcggcaagatatttcgctgacaggttccgcggcatcaatcgtatccccgaccgagagatctacatccattacactaatgcgactgatacaacattgctgaaaagcaccatggattcngtgcaagacatgatcattcanaagaatctgcacactcttatcttatgataattaatggtntatcagagacgattgcgttcacgatattt

SEQ ID NO: 6122 - DNA, 1064 bp, Aspergillus oryzae
gagttagataccgatggtcgaagacggcgcgaggcacacctaccccgcgcgtctctctaacccaacgcttattcgcacctctaccctgcagcagtcaagcagcctcggtcaccacactcagtcattcaacccctatgccatgtatccctcgaaggctgttttgaagctcaatggcagcttggactcgatgacagaaagctggactaaagaggagcgtgaggctaagcgtcgcttggttcaattcactcgtatgcaaagtgggagcaccatccatgcggattttaacccagttgctcccgaagaccgtgctcccaacagtatctgcattagttgcatctactgggatggtaaagatgaatgcttcataacgagcgtcgatacgatctacctccttgagtcgctggttggtgttagattcaccgtggaagagaagaatcgtattcgcaggaacctggaaggcttcaggccacttactgtttcaaaagcaaaagccgatagcgaagacttcttcaaggtgatcatgggcttccccgccccaaagccgcgcaatattgagaaggacgtcaaagtattcccctggcggatacttggccatgcgctgaagaaaatcattggtaaatactccgcaagttactcgtcgacagctggggcactccccacccccattagctcaacttatacaagtaacggcgctgcatcggactctggcactgagcccccaaacgcggcatccccacaatctgtctcggacactggtccatcaaccacatatggtgcccatgttgcagccgcagcctactcccctccagcacatcaccaccccgctcattccatgaccggcactcatgagctacgagctgtgctacctgctgttagccaaccctaccatcctatggctgccccctactcttatccagcggtctgccaacaacagggtgatcttggcctctctgcaccagttagcaggacttgggaaatcaaccctctcatcaacgcttctggcacaaacggaggccccacctacaactacctgaccccgatgtcatactccgtccaagacccgg

SEQ ID NO: 6123 - DNA, 900 bp, Aspergillus oryzae
ggccgaacaagctggaaagcagggagacgagcttcaggctatcgaagaccagtgggttgctcaggctggcctgaagcttttcaacgatgccgtcattgaggccatcaacaagggtgcccactctaacaagcaatccctcattgatcaatacctgaaggctgctaagggcaagagcaaccttgaagctcgcgcgatcgccaagaacatcactggacaggacatctacttcaactgggatgcgcctcgcacccgtgagggttactaccggctccagggtggcacccagtgtgccattaaccgtggtcttgcttatgctccattcgccgaccttatctggatggagagcaagctccccgactacgcccaggctaaggagtttgctgaaggcattcacgccgtgtggcccgagcaaaaacttgcctacaacttgtcgccctcgttcaactggaagaaagccatgccccgcgatgagcaggagacgtacatcaagcgcttgggtgctctgggttactgctggcagttcatcaccctggctggtctgcacaccacagccctcatttccgaccagttcgccaaggcctactccaagcagggcatgcgtgcctatggtgaattggtccaagagccggagatggagcagggagtcgatgtggttacccaccagaaatggagcggtgccaattatgtggataacctcctgaagatggtcactggcggtgtgagcagcactgcggccatgggcaagggtgtgacggaagatcagttcaagcactgagctcaactcacaagccgcttttgataattttgttttgttttagccgacttcgagtacccaccaagagtttttgatgtatagattgtagcttccttgatgaaaaggatcgtttttcttagcttgat

SEQ ID NO: 6124 - DNA, 651 bp, Aspergillus oryzae
  misc_feature (1)...(651): n = A,T,C or G
aggaattttttttttttttttttttcccatttagtatactcggtgtttttattttaacaataataagtttgtatccacgtttaccattaagaatttgatacttccagaaaccccgagaagtcctaggatacagaatcgcccaaatgccaggagaagacatgctattcatgcaggaagggcaaatcccaatctcatgtgcagcgtttgaagccaggtttggcattcttcttcccatattcaatgtgacacatcacaccgcacagatcatcacccttctttcgagtaacgatgcggcaaggccctggctccggcctgggttttaattgcttgtaattgtagagttcctgcttccttctctcactcgccacaccgccctttaagaatatcacaagtaatattctagctggattatccaaaagtgcactttgaagaaaccccactaccgtttacgtgacttgctttcaatatccggaggcaacatttgttatcgaagcattacaacgcctagtcatctcattctacacctttccacattttgactcgctctctctcttgacataccttaaccatgtgcggcatcttcggctacattaactacctcgtcgagagggaccgcaagtttattcttgacactcttctcaatggactctn

SEQ ID NO: 6125 - DNA, 696 bp, Aspergillus oryzae
caaacaacattgcatcctctctatctgccactgggaccaaagagaataatctctacttcacataataacaatggagtctccttcgcatcctctcgctgatcgctccaccaacactcatctggtcaacaccgagaaggccaacgagcttaaggctgcccccgccaagatcgaatcaatggaatatcaccgacaagtgctccagggcaagctggagagcggagacaagcaacaagccagctatgtatcgccctcggatgatattatgagcccgtgctccaagaaattgagcgacttgaagggcaagcgattcaagaatgctggcaaaccccaatcactatttgccaaactaggcaagaagaactttgagcaatcagctgccaaccatagcgccaacagtgaggccgagatgcagaagtaatcgacgttccaggatcgcttacgtctcatgcgccggtcgcatggatcttttggatgatacctggatctgatcatcggttgtttctcgctcggctcggtgtttgcaggactggttcttgatttctcttctacttgattttctttctgggcaaatgggggttcctgggaattaaatgttcttggggatgggcttgggacctactgggtcaattggtaccgggcctaaaattgtttttttaaattggcgaatgggacctttgaccggatgaaaaacaaaag

SEQ ID NO: 6126 - DNA, 437 bp, Aspergillus oryzae
  misc_feature (1)...(437): n = A,T,C or G
ggccgtgctactgtacatggtcccgaagccgttccagcagatcggtctgcacttcgtctcgttcatgatggatgaccgcctacgacgtgcgatgctgtatgaccctcccccggcatcatatgccaaactgttctcgtcgcttctgtccgttcgccgctttgtgttacgttacctgtcgctcccccggccttatttcctccgtttcactgccttcactgagcagccggaccggaatgatcgcattttcatcacccagtgggatgcggcaccctattacgtcgcgcctactttccggaaccgctggggccctgtcgcttggcttacctgngctatgggccggcctcttccaggcgatgaaggcgataagtattacccccggggctactatacacctgatgtaggccccaagtctttgaaagcaaggcccgaccttcctg

SEQ ID NO: 6127 - DNA, 672 bp, Aspergillus oryzae
  misc_feature (1)...(672): n = A,T,C or G
cggaatttatcatccatccttgcattaaattttcgacataatgaccctagcaggaagctgcatgtgcggtgcaattgcatacacctctgactccgagcctctagtgaaggctttgtgccactgtgttgattgccagaagtggaccggcggcccattcacgtccaacgtcatcgttccccgggattctttcaaagtgacaaaaggagaaccctcgttctatgatgtcaccggggcctcgggcaaaaacaaccgccatttcttctgtggcaagtgcgggtctagtctgttcacagaattagagctcatggccgacaagaccgtcatcaaagccgggactctggatggtggcgaagcgaacttgcgcaacaaggtcgatgttgaattctataccaaagaccgagtgtcgtatctttgtgctgtgcanggcgctaagcangagacacttctgggttgattggtttgatgcggctgcccctgaggtanggcgatgaggacgtgactgcaagacactcctatataangggtatgaccgttgggatgaatatggctttgacgtttggtggcgatgtacatcttgttatgtcatgtagtantatgcacggggtttgtgtanttgcggaagttgagataccatgcattgaagagatgttttacagattatatgatattccg

SEQ ID NO: 6128 - DNA, 548 bp, Aspergillus oryzae
ggaaaagcaatgttggaaacgtgcaccgctatgcgcgaggcacttactgagggggcgagcctcaaacgtactcttcctgctgtacggagggctttactaaggtgtccttattagggccctgcgtaccacggagctcggcctcaatctgaacaatgcgttgtttctcttcgtgggctgctgtgtctccgaaaataaggtccatatcttccaaagtctagtaacgggcttccgtcagtccaggacagatcttgaggtacggttataaaaatcatgagccacaaacctttccacgggtctccggaatacagaagaacgtgaatgccagtgcaaggagacagaatgccgcaaagaagatataggtaccccaagtgattgactcgagcatatcaggggtgatcaatccaatgatactagtatgcgatgtcagccaacgatcaatacgaaattctcaaagaaaaattcaaaatcaacgcacaaattgcacatccaggtcgccgaagttgtgaatgaaatggcctcttaaaccgaattgaaggttgaagattctg

SEQ ID NO: 6129 - DNA, 647 bp, Aspergillus oryzae
  misc_feature (1)...(647): n = A,T,C or G
gagacgcgcagaaggcggagacgataaagaacagccaccggacgaggaaaaagaccggtcgcacagtcttcagttcaagagtttcggaaaggccgatgacgactcgtatgtgctcaagctgaactggaggaccaagtatgcctgtgatcattacctggaagaaaagaaaggtgactcgtccagtcactggggtttctttacttggttgatcattattctcttcctctgcatcgctgcctaccttatctttggctcctggcttaattataaccgctacggcgcccggggatgggatctcctccctcacggcgacactatccgggatattccttatatcttccaggattggctccgtcgggtggtcaacacgctccaaggatcggggtccagaggcggttacagtgcggtataatgccgtgaggtatagcgtggtgtaagtggttctctttcgtttgtttacgtctggtttggcatttctttntgtttctacagcacggtggggccgtgtgtgcgatattctcatagaaaatctatatgtaaggtagttgcagactgggttggattgggcacgtgcatgataggtactgtacgatgaatgtcatgcatcggtctttctggggaaaaanaanatataatataaaataata

SEQ ID NO: 6130 - DNA, 713 bp, Aspergillus oryzae
gctgaatctagacgattcacttccaacaccaccagtcgtttccaatcacgcaacagaaaatgcatcagttcctcaccctagctgccctcttggcaaccacagccctcgcggcagatcgcacaccagccctggttgcccgtcaagtggttgagctcccttgctcctatcaaggtgaaaaagagtgtggcagcggctgcatccctctttcctacacctgctgccccaataacctcggtggctgtcccctgggatcctattgcgacggtctgggttgctgccctaatggaaagacctgtaccggtccaggaggcgtttctactcgtcccggatcgactatcaccgtgaccaactctctgaccaacacattgacgtccacaagcacctccactcacactttgtcgtccagcgaggttgtgaccccgacctacaccccaacacctagctcgagcacctcgtcctctcggagcgtcatccctcccagttcgagcgcggtgcctccctcgtcatctacaccggctgtgtcgcctacctctcctccgcttcatactggggcagcttctcacttgaccccgggtttctatgctgctgccggactcatcgttggtgctgctatcttttagataagtcttgacggatgccagcgtcttggtactgtgaattatggcttgttccttggctgatgccatgcgctgggatatgcttgcttaattgga

SEQ ID NO: 6131 - DNA, 666 bp, Aspergillus oryzae
ggcgagcaagatgtccaaaatctgcacgacttgggtctgaacattgtccggttgggccacagctgggctggagcagagcctgtgcgtggggagtacaaccagacatttctggatattatgaaaaagcagactaagatggcggaggaccatggactttacgttttggtggacgtgcatcaggactgcctggcgcggcaattttgcgggaacggtgtacccgactggtttgccaagaaagattgggtatcgagtggcaagatgtatccgtttcccctcaaaacgacgccgttcccggtggatgaaaacggcttccgttcgccacagtcgctttgcggttcggtcgactgggctctgagctacacgtcggtggcgctgggcaatgcgtttgggcggttatataacaattacgacgggctgggcgatgcgttcgcagcgtactggaaaaagctggcgtccgagtatggcaagacgaccaatgtggtcgggtataacctgctgaacgagccatgggtgggcgacacatgggccgatccgacactgctagtgccaggtgttgccgaccacaaggtcctagaagggctctggaaccgcgcggccaagcagatccgtaccgtcgacaatgacacactcatctggttcgaaggcgcaacgctggacgtcctgtct

SEQ ID NO: 6132 - DNA, 659 bp, Aspergillus oryzae
ttttttatcacatgagaacaatcaccataattaaaataaaaaagtcaagtagaaaaagaaccaaaggtatcgtacaacaacagaatatacacatcattaacatcgcttctcaaccagaccaaagttccatcccccatagccctcagcataataaaataagaaaacaaaggttagcaccaacacagactcacttatattgatagttctgcggcggtgccccggcctggggctggggatatccacctcccccagaagcctggggaggaggtccccaataggcttgtggaggtggtgccgggccagccggtgcacctgccgggggcctggtctctggcgtgatatcggggcgatcacggaggtcttgggtgaagcggcatgtgtaacatgtgacttccttgtacttttttgttgcgagtgggatcatgggaatgaagcaaacgggataccaaagccatcgcgttatacaaaggtcattatagtgttggcaggtataacaataggccccggggaaagtaaggtatggaatgttgcgtagggtaacgaagcggccggttgactcgtaagggaaggaacggttgcgtactggatggttggtttatggtatgtttatttaggagaggtgtgtgttgttgtgagtaggagctttctgtcatagcgcg

SEQ ID NO: 6133 - DNA, 1378 bp, Aspergillus oryzae
  misc_feature (1)...(1378): n = A,T,C or G
ccaactctcgcccagtttcggaagtagagaatcgcgcccggtcacgcctccatcctaacccttaactgccaccttcatttccatcaaccgtgaaccttcactactacactccttccgacatccaccacaactccttccaccatgttgctgcgtttcctgtccctgacaggcgcgctctgtctgagcagctgtgctgcgttgtcactgcccgagcataaggtcgaactatcggggctggatcccgagtttcgaagccgaatcatctccaatgcccgtccaacaaacgtgccgaccgctctttgttcattctcagattccgaatgttcgaaagatatcgatcttcattcccagctgacactggacttctctacggaaaatggcaccctactcgccaaccatgaccctatcttcccacccactttcccaatgcgattccatgctgtccggcattttcaatcaggccgagagacggtcgacctggcctatgaactcgatgtgcgacccatgccgtcacgccctgacgaagcactggggggcgtattccttttgaaactcagactgtttgacctccaagggcggggccgcctccgatcacctggtcacgatcaccctgaatcaagactcggagggaaacctgcaaatcactcaacttgaaaccaaccccgtcctcggccaccaccatcacgacggaccaccatcatggatggcccaattaaccgccagccttcaggcaatgaaggacgccgtcaaggactgcatgcacggtccgggaccgaggcatccgaccgcaagaccccagcacggccacatgcaacctccagtcgaccatcaccgcacgatcgctccggagcatcaccgctaccaccacagacccggctactgggcaggtcgggagaagaacttcggcaggctcatgcgtccggtcgtcatgcctgcccttctaggtgtgatggccggtgtgatcgcctgcatggttggattcgtgctgggcaaaatcttcatctcagtattctactgtgttcggggttacaggaagcagcaccagaagcagaacgagactgccattccccggatagtggtggtggaaagcgctcccagtgaaaaggagcgcttgatggcgatgtgcgatgatcagtgttgaccatacaagatacgatctctttacactcttcactttttctttttctttcacgtgtttttctcagatagcatctatatacccagtgtaacatgcctagaatttgacgaccacactctttaccctgtatccctcgaacatatacccgttaaagttccgattcctcaacaatcaaggccggcttggccaattgcaaggcggctgactaccaatcnagagaattgcaggntcgacccctgc

SEQ ID NO: 6134 - DNA, 1294 bp, Aspergillus oryzae
cttttgggtattgatcgtctcaatcaacttgttcggcgtcagaggctacggtgaggctgagtttgtcttctcactcattaaggttgttgctgtgattggctttatcatcctcgggattgtcctgaactgcggcggaggtccccaggggtggatatatcggtggaaagtattggagcgatcctggtgctttccataatgggttcaaaggtctttgcagtgtcttcgtcaacgccgcgtttgcctttgctggaaccgagctcgtcggtttggctgcagctgagaccgctaaccctcggaaatcgctcccaacagctgtcaagcaagctttctggcgtatttgtctcttctacattgtatcactcaccctggtcggccttcttgttccctggaatgacgaacgacttcttgatgggagctccagtgctgacgctaaagcctctccatttgtgatcgccatcaagaatgctggtatctccgtgctagactctatcatgaacgtcgttatcatgattgcggtcttatccgtgggtaactcgtcagtttatggctcctctcgtacccttgcagcccttgccgagcagggacaggcccccaaattcctgtcatatattgatcgcaagggtcgccctctctgggcaattctaattgcttctgccctcggtttgcttagtttcttggccgcatcagacaaacaagaagtggctttcgagtggatgatggccatatccggtctctcgtccatcttcacttggggttcggtttgtttggcgcacattcgcttccgtcgtggctggaaggctcagggccacagtctcaatgaactcgccttccaatcacaaccgggagtgatcggctcttggatcgggttcttgttcaactgtctcgttcttgtcgcacagttctgggttggatttgcgccaatcggttatgcgacgaagaccgctggtgagcttgttgaggcctggttttccgtatacctagctgctccagttgtcctgctcttttatatcccttacaagctctggttcaagacgccatttatccgggccaaggacatggacctgcaaaccggtcctcgcgatctcgatcttcagtacttgatcgagcaggaacgagctgaacaggcagaatggcctgcatggaagaaggtgtataaagttcttctgttagcattgggagtttcatgattctttggtttggttcgcaagcttgaaattcatatgctgatcctcactgttccattattattaatgtgcctatatccccactgaaaaccccaactaatattcctgcg

SEQ ID NO: 6135 - DNA, 684 bp, Aspergillus oryzae
  misc_feature (1)...(684): n = A,T,C or G
cgttgactgagctctttatattcccaatccggagaacgcttctgatgcggactaaacttatgacagaggcgccaaggacgatgttttcatcaagaatcccgacggcagtctatacattggcgctgtctggcctggctatactgtctaccccgactggcatcatcctaaggcctccgatttctgggctaatgagctggtcacctggtggaacaagctgcattatgatggggtctggtacgacatggctgaagtttcttccttctgcgtagggagctgcggaactggcaatctgtcaatgaacccggctcatccaccgttcgctctccccggcgaaccagggaacgtcgtctatgattatccagagggctttaacatcaccaatgctacggaagcagcctcagcatccgctggggcggcaagccaatccgcagcggcatcatccacaactacatcagccccctacctgcgtacaacacctacccccggagttcgtaatgttgaccaccctccttatgttatcaaccatgtccaacctggccacgacctgagcgttcacgccatctcaccaaattctactcacttcgatggngtccaggagtatgatgtacacagtctttacgggcaccaagggcatanatgcaacctatcacggattgctcaagggtgtggagaacaaacgcccct

SEQ ID NO: 6136 - DNA, 933 bp, Aspergillus oryzae
gagactggcgctcggactcgagacggacgcgggggaagacttcttgataatgtttccctcagaaccaacgacaacacgaaatagcaacatcgcacttattcccaaagaatacgcccaccagggagatctagaagccataatcacacgatacagaacccttcgcctaagaggcctgaaagagaacccagactccttctcatctaagtacgaggacgaagttgatctcccatacgagaaatggctagctcgagttaccaacccacaagcgcgttcctttgtcgcttatgacgcccaggggaacaacaacatggaatctttagcgctccttttgagtcgagaatggttgggtacagtcaccatagtagggcctaggttgctgcctgaagataacgaggctctgtcaaaagcaccatgggatatgtttcttccgctagaagagcgggagctgtctgagagagagactcgtgatgcgactttggtgtatatgcttgggggcatgttcgttctcgagacgggaagacgaaaggggaacggtcgtcggctgattgaacgggctgttagtgaagcacggacggaagctattgaggtgggggcaagtcgtgtcttagtggtgtctgtcgcggaacgaaagaatgatgctgcgcgacggttgtatgaaaattgctcgtttgatgtggtggatgataacctggttttgagaatccaacggaaccagaatggtgttgccatggttttggatcttaaggttgaaggcaggaatcccctgatatttaaaaacgatgaccaacacgggatggttccttttggcatgccttcatgggggtaatatttggctatcggtatttcggaaccggggaaatctttggaaaaagaagtgcccctccccttcgcaatgggtccaccacccagtccaatgggtacaattggcccccc

SEQ ID NO: 6137 - DNA, 664 bp, Aspergillus oryzae
  misc_feature (1)...(664): n = A,T,C or G
gtcgctggacatattttctcccatcgagttcgaggaaatcctcgaggtttccgcccgcactatcattaattgattcccacttcatctccgtctttcacattactacaacatggcggcgcccggccagccgtctccccagcagattgccgccatgcagcaacagttcgctgctgaggccgcaaggcgtggtatgactccggaggaattcgctaaacaacagcgcgaacagctgaatgctgaagctgcgaagcatggcatgtccacggagcaatacgtccaacaactgagaatgcgagctctcgctgctcaccagaagcangtcgaggcccaacgacagggcccaaagatcgccacagccaggacagccaggacaaccaggccagcaaggccagcaagacgagncaaggcagcagacaccacaacagcctcacccacaacagactacgcatcaagtccctggtgacccatcgaattcccccgacccctaaagcatccgggttgcgcaagtcttgcgatctcagaacctgaagccgagacgtgtttcatggatggacagaggaaagacaatgtcaaagtggaacgtgccattcgcgctctggaagtcgcccggtacgcttaaaccacccgcaagaaagatctctttacttcctctccgaaacgaacg

SEQ ID NO: 6138 - DNA, 716 bp, Aspergillus oryzae
  misc_feature (1)...(716): n = A,T,C or G
cctcatccagtacgaagaagcacatgcagatcaccccacctcctcggtttgacttgcctccgattgaagcaccagcccagctcactgcggcgccgcgcctgcgcagaggccggtctgcttcccccagcaaaaagctcgcttccccacaaaagctcgcttccccgcggaagcccaggagcacgagggccagggaatccaaggaagctcaggaggtcaaggaggtgaaagaggcgagcattgtggcgaccagtgaggcaaatgcaaaccttcagtctgccttggatgctacagccgaggccggatcggtcaatggcaccatccaacccagcgtggaacacgatgaagagagagtggctcctactcctaagaagtctgcttcgacaccaaagtccacgaagacacccagagctgcccgggcgaaggagcttaaagagcttaaggagctcaaagagattgaggaggtcgaggagaccaaggagaccaaggaggagaatgtcaaagtggatgttgaaactaatgccgacgaagccaaggatgtacaaacgaccaagaccaccgtctcggtggaattgcctgtttccttccttcctgatgctccatctgccgaagacaccgaanagatgattgctaaggctaggaaatgtagaagaggctgnncagctcagagcacagaggaggaacccgtaccatcgtcacaaaggctgctaagagcgcaa

SEQ ID NO: 6139 - DNA, 605 bp, Aspergillus oryzae
ctcccctccagcctctccatctgtaccacgattatttgtggcaggctctggtattgttccatcccctgaactcggaactggcgactggagctggaaagagggagcagagcggcgcaaaaaagcatctcgcatccgagccccatggtccagtaccctcggtgaccgtaccaactcatactctgaaccttccacgcctaccactcccacaccgaacgcgtcaacttcacctcgctttccacccgatggtggtattggtcttgttgttcacgcgctgtggccgtggtatcctgagaatggtgtcaaagacgagctgatgtttccacgtggcgcggaaattactgaggcggaaaatatcaatgatgattggtattgggggtgttatgctggatctactgggctgttcccgggaacacatgtctttgttgttggagagatcgcctaatccctttttacagcgtttaactacctttatggaaagccatgacgacttacgattgatgtataaatagatgatgacgttgagaagatctgatggacgggatgtacgtactgcattatggtacggaatattagtggggggttcgaatttgattgctgcttggatc

SEQ ID NO: 6140 - DNA, 574 bp, Aspergillus oryzae
  misc_feature (1)...(574): n = A,T,C or G
cgaggcccacccgacaggtgatttctctacacccacgacgggccccactgtttcccccagtgaacctcctatcgccttccctgaaacaataccgttctcattcgccgaccctcccgttccgacccagaccgaggactttcaattattttcaaacagccccacttcgcttggtggttctccctaccataacatgagtgatgcccaggggtttccacctggcgcaaacttcgacctgaaccagccccaagtgcccggtattggaagtcctgcctccggatcgagcgagtttctcacaccaccctctggaagcactcactccccctacgatcctatcaatccattccccgacagctcgatgttctcatttgagccgtacatgcagcctaagaccgaggagagcttgttgttcgtgagcggcggatttggcgatgtgcctagtatgttcgagcagaatcccatggattttctgaccgacccgatgtacaactcaaactttatgggctatgagactgtccagccgcagcttgaggccaatccanatgcgcnagttggactggatggttgggatgatttt

SEQ ID NO: 6141 - DNA, 751 bp, Aspergillus oryzae
tgtgtgctcgatcgattcggcacgaggcctcagactctctatactactaagatcccgcccgagtctatggggtatgagaggactaagcgggccgtggagagtagtctccgggaggcgggggtggagtatattgagctaatcccactgcctgctcgctatcgtttgaaacaagacatcctagtcccctgtatcgcactcctaatactgtcgaaactgggcatgacgttttctcaccctccgtcccctctatttgttttcttcttcttccccgaattcgaggttgctcttctcttttggctgcttcgcgtcctccgacggtttttcatttctttttttcatttcacgtttttatcgtttccgaccgggggggtgggctcttcttgtcgccttgtcaaaatcaatatttcatttcttcctctttcccggctctgttaatatacttgcttactcttatatcgtttttcgtgtggtgtttatttacctatgtttccatttatgtttcttagtctcagttgatgttgtcgttttttctcgtgtatctctctgctggtatttgttcgcactcatcgtgcctgcatttgtgctctctttctattatagttcgtgaatgtcgttgtttctatctttgttattctgttacatctcatgtcgatagttcttttgttgtcctgacactctcctgagactgagtttacgtttctatttgagattatcactgtgcatcttctctcttttctctcttctctcttcg

SEQ ID NO: 6142 - DNA, 731 bp, Aspergillus oryzae
  misc_feature (1)...(731): n = A,T,C or G
nggtgttactcgatctccaatcagacgtggataaagtagcctctgcatgatgtttgcaacgtgtcctgtttctaaacttgaatctctgatccatcttaaacattcgattccctatactcacctagattcaatggatcgtttttggtctgcgccccctgtgacaaggactctaactgcccttactttcgttcagtccgccttggtttatggtggcctactaagtggtagatatgttatatttcgaccgggactagttttcaagctgcttcctgaggcgtggaggttattgtcgtcattccttctgacagggccgcgcctcgacttcatacttgatctctacttcagtgagaatccgcgatagcctagtctcaccgcggcactaacatacagtagtgttcaagtatggcagtgctttggagacgggatcaccacggttcaacttaccaggtgacttcttcacgtacgtgttctttggagctactggtattacggtaagtaatgggacagctttgtttatcagtgccttggcaaccctttcccccttccgtttttttgggaccaacttctgccttaataacctcgcatatctgccccgccagcctttatttagcctgagcggttcctgggaagtgagggngattggcccctgcatctcataccagacccggattcgcattataatttagggctggattccaagtaaggattgcggcgacggccttttaaaaacg

SEQ ID NO: 6143 - DNA, 684 bp, Aspergillus oryzae
actgatacacaaccgcttcttactttcccctttagactcaattgactggctagtttcagtgaatcctcaaagacagccaccatggttcagccagggacgtcacagtcctcctgggtggacttcatcaaacaccctttcgtgggcaccttcacctttttctatctcctgtgtcaagcggatctcaactggttctttgctcctgcccctccgccgcccggttcactcgtcaatggccttcccaagaagcaagtggctgtcattggtgctgggttaacgggcgtgtgcgccgcagctcactgtgtcggtcatggattcaacgtgcagatctttgaggcgcgttccaaggcgaacggattgggcggtatctggagtctggtgaacttgacctcctccttgcagattcatagtatcatgtaccgattccatccgacggtgaaataccataatgcgtatccgacgcagggagagattactgagcaaattgtatacgtgtggaatcgctatggcctgcacaaacattctgaatcataaacccccggactctcgtaagcaagcaaagatggcaatggattatcatgatgataaaacaaatccgccgctttgatggctaaggggcaacgttagagttgcgaaaaccccacatgcccccgatgcccacccaaaaccgtttaaaggtgatccttt

SEQ ID NO: 6144 - DNA, 519 bp, Aspergillus oryzae
cactgctcttctgggcgcacataattattctcgcggtgatggctcggcttttctctacgccgcgtaggcttgcctttgcgctggctgctggattggttcttttcagtgtactagcggttgccaaagatgtgattcccgttggtgagctctctgtaagccagatcgaggatgaattgcagaattgccctctcgtggaattttttattgagcacaagcgtgccaccaacccgctgaccatcagcctgacctcgaagatcttcgccgtccttttccctgtgcgcccagctgtaaacgcaattctggccactgcgtatatctccggacccccaaacttcctcctggcactatgcccccccaacatcgacccctgatccttggacgcgatggtagctttcgccgtgggtgggctgatgggcgacacattattccacctcctacctgagatcttcgcttgcgaagacagtccctaccacgtgcggtttggtattgggacaccgatcagaaacttcctcttgggct

SEQ ID NO: 6145 - DNA, 732 bp, Aspergillus oryzae
ggctggcccatttaccccagagcacaaacccaacatctattcgagcgcacgctcaccataatcgcaggaacaatgggatctgtcaaggttaccgacttggacacataccacaatgtagtcagcggagctaattacgcggtcttcaacttccgtgactctcggcgtcgctcgtctgataccgatctggcctacgatgacctcgcctcctatgcatatagtgacaccgtcgcattctatgaagtcgacgtcggcgatcagaagcatatttcagattttgcgaaagtggaacgtcctacactcatcttatacaaggacgggaaagaagtcgagcgttactcgaaacctctgccgaggcaactagagtacctagtctcgagggccttgtgtgggctgactgagattggtggccgtttttaataactgggtggtgacgccggtgggtaatgatgatgtgcacctatgtcctcgaggttgtctatatcttaatgtcttggacatattctacgacgaggcttgaccaggcgttatctttgcccttgagttgagtgggtgcatgctggcataatcctctgtctttcctttctttgcatagctatggatgtctacttgggatggtgtttgatttggttgggtgcatataagcagaatgtccttttttacttaggtcatcgattttgatgactttcattggtaatgtatgaccggtttggaattaaccaaagttataccccc

SEQ ID NO: 6146 - DNA, 628 bp, Aspergillus oryzae
gtcagtacggaaagtctttggatggaagcaagcccgcgtacaaggaggacgagacagtccctcaggattctcgctgccccactttctgcgccctgatcgcatacatcaagaatgagcggtgggacggtgttcctttcattatgaaggctggcaaagccctcaatgagcagaagaccgagatccgtatccaattccgcgacgtgacttcgggcatcttcaaggacattcctcgcaacgagctcgtcatccgtgttcagcccaacgagtccgtgtacattaagatgaactcgaagcttcctggcctgtccatgcagactgtcgtgaccgagcttgacctcacctaccgccgtcgcttctccgaccttaagatccccgaagcttatgagtccttgatccttgacgccctgaagggcgatcactcgaacttcgttcgtgatgacgagcttgatgccagctggagaattttcacacctcttctgcactaccttgatgataacaaggagatcatccctatggaatatccctacggctctcgtggacctgccgttcttgatgacttcactgcctcgttcggttacaagttcaacgatgctgctggataccactggcccttgacttgcacccccaa

SEQ ID NO: 6147 - DNA, 1453 bp, Aspergillus oryzae
gcagcgcaacaataactatcactccacatcattaagaaacatggttgccacatctgtgaatcgcactgctctgcaccctggtggtgtccagcctggcaagggtcacactgagctggaggaagagcttcacgagcacgctcacattgattacgagcgtgtcgctattatcgctaaccctgccgtccctgctctttacgaagatgctcttgtctatgagactggtactgctatcacatcgtcaggtgctctgactgcatactctggtgccaaaactggtcgttccccttcggataagcgtatcgtgaaggaggaatcttctgagcaggatatttggtggggacccgttaacaagcctatgactcccgatgtctggcgtatcaaccgtgagcgtgctgtcgactacctcaacacccgcaaccgtatctatgtcattgatggtttcgccggctgggatgagagataccgcatcagcgtccgtgttgtctgcgctcgtgcctaccatgccctcttcatgaggaacatgcttatccgcccttcccaagaggagctcaagcacttccaccccgactatgtcatctacaacgccggttctttccctgccaaccgtttcactgagggtatgacctctgctacctccgtcgccatcaactttgccgagaaggaaatggttatcctgggtaccgagtatgctggagagatgaagaagggtgttttcaccgtcctgttctacgagatgcccgtcaagcacaacgtcctgaccctccactcttctgccaacgagggtaagaatggtgatgttaccgttttcttcggtctttccggaactggcaagactactctttctgccgaccctaaccgtgccctgattggtgacgacgagcactgctggaccgaccgtggtgtcttcaacattgagggtggttgctacgccaagtgcattggtctctccgccgagaaggagcccgatattttcaacgccatccgcttcggatccgtcctcgagaacgttgttttcgaccccatcagccgtgttgtcaactacgatgactcgactttgactgagaacgacggtgtgactgagccccaggccactttctcctcttgcttcgcccagcctttcttggctctccaccccatgcgctacgctaccatgctggctgagaagatctcgcagcacaaggccaatgcttggttgctcaacaccggctgggttggcgctggcgccaccactggcggtaagcgttgccctctcaagtacacccgtgccatcttggacgccatccacagcggcgagttggccaacgccgagtacgaggtctacgatgttttcaaccttcacgtgcccaagagctgccccaacgttccctctgagcttctgaaccccaagaacagctggactgcattcaccagcttcaaggacgaagtcaacaaagctaggcaagttgttcaacga

SEQ ID NO: 6148 - DNA, 717 bp, Aspergillus oryzae
cgacattctctcatctacatacggaaacattcttcgcactatcatctctgtttctctttctaaacatttctttgttctatacatccgccaaaatgcttcgtgtctctgctatcttcatggcctgcctccttctggctaccgctgcccccaccgctcctgagaagagcaacgcttgtctctccatgtgtctgcaggagagacctgcttgtgctagtgatgaacgtccaactggctctgagggctgctggggttgctgccagaaaatcgaagcagtagctgcacctgtccagcgcgcgtcatgtctctccatgtgtcaacaggagaagcctaattgtgctagcgatgagaaacccgctggctctgagggatgctggggctgctgccagaaaatcgagccagtcgtccctgtcaagaaggagatgtgtctctccatgtgtttgcaagagaagcctacttgtgccagtgatgaacacccaactggctctgagggctgctggggctgctgccaaaagaactgaacaacaagcatctaaagactgatcatgggatcgtcacatcaaaagtattaattctctgtctaaatttgttcaaaagcaaaagcaaaaaatgcctatctccaatttttatctcttaattggcggatgtccactgtgcattgcaatgtggacacccgttccatgtacgtactaatgataagtcactcttttatatatgtgt

SEQ ID NO: 6149 - DNA, 657 bp, Aspergillus oryzae
ctggcccgaactccaactcaacatctggatcctcatcgtcttatcggcttccgctatctgtatgggcatctttgcctggcttatgtctgtacaatctgagatgcgtctcgggactccatggctcttcccattcatggtcgtctccggcgccctcggcatcttcttcatcattctcattctcatcctcgccgcccagcgtttcctgctccccggcattatcatgctgggcagtttcatcctcttcgtcctctggttgacggggttgattgagacctcgttgcagttgtacggcgtggtcgggaacgtcgatgataattgtcagatctatattgttgataatcgcgccggggggaataatatgcagaccttggcttggttgacccagaagactatttgtgattgctggaagacagcttttgcgtttgagctggtgaataccatcttcttcctttggatgatgatcatgtcgtggcaggttaatcgcgatgtatatgattgattttcttggtcttttttgtttttcgttgtgtttctatgaccggatatgatgttgatgactaattatgcgatggtttctgatcgattctgtatgtatgaagatatgggcgttgtatggtatatgatatccaaaatttgagattcctttttttgtcaaaa

SEQ ID NO: 6150 - DNA, 634 bp, Aspergillus oryzae
  misc_feature (1)...(634): n = A,T,C or G
gtaatccgacctaacgacactgtccaagagatcgagcctttctgccagaaggacatcaagaccaatggtatttatgtcttagataccttcttcgagatctatgtcattgtcggtgcacaagcgtccaaccgaccggcagatttcgtatcggccgtggtattcgcacatgaatatggcattttacctgcttcgctccaaaaccggccattcattcctaaaagttttgtgtcgcttgccggcgttccgggtaggtgctgtccagctttccgcaggtggaaccagcccaccttgcggatgccccacacaggttttccctggaacgcagcctataaaacccttcgctcctaaaaaccggtgttaaatctgcggttatcttgtggtaaaattctttttttctgctatagattttggcatggagagggccatatacgggggctggaccaaaatgttgcacccggcctggataaaacgaagggggcttaaggaccatatcaaggacccttggcggggggatttggcaattcccttcctttggggggttttgggccccccccggcccagggggggatttttccaaaccggggttcctttaaaaaaaaaatttaggggcgccaaccccttttaaagccccccn

SEQ ID NO: 6151 - DNA, 679 bp, Aspergillus oryzae
caggagcgagagctccacgggtagctccaacgacatcctcacagtctggaacaacaagacgggtgaaaccacccagatccacgctcggcgacttctactggcgatcgagcctaccgcggctaacatggctccgttcgacctggaccgtaatgagaagaacgtcctctccagattcacctacaccaatgaatacaccggtattgtgaacaacgccgcctttgcattcaaccaatcctatttcaacctgccccggacagccgcgccggacaactacctcgccctgcccgaagcgtctttcacagctcgcattgactacatcggcggcggcgacctcttcagggtgaccattgtcggtaacagcacgctcgacacagccggtgccaagagactcgtccagaacgacttcaacacactgctgcgttcgggccgtttggcgaagacaagcaacggggagccgctcagctgggtggactttgcgacccacggtcccatgcatgcccgtgtttctgtcgccgatgtcaaggccggcttcttccagaagctgaacgctttgcagggtggtcggtcaacctggtggactggcggtgctttctcggataacttccagacaacgttgtgggagtgtgacgagctccttttcccggaacttcttaatgggctgaactagggctacttggga

SEQ ID NO: 6152 - DNA, 520 bp, Aspergillus oryzae
cagctagttatatgccatcatcacaaccaagccgcatggcaatcgatgccctgtatccccacgataacctatcaaatacaccaaacatgtcattcctcctcacccgcacctcagccgtgctaggcgtcggcctcggcctctccctcagtccgctctcccccttccgttccgccccaatgcaatgccaatacagcgccccgtactaccgacccgagtcgcaagcctccccggactcaggctggaccgttgaccgcaacgaccccgtgctcctcaaacagggggctacgaagagcgggtggttgacggcgtcgaatatgcgacaggtgagtctggggagtgtccttgggctggttgtgggggtgggattgagggcgttttcgagggttttggttgtgcttttgggtatgggggttgtttttgttgagtgggctgctgcgaaggggtataatgtgattcctgtggatcggttgcagaggcttgttaagggggttaatttgcagaaggctgtgtcgcagcataa

SEQ ID NO: 6153 - DNA, 675 bp, Aspergillus oryzae
  misc_feature (1)...(675): n = A,T,C or G
cccccgaaatcctgcgcgcgcttgatcatcccacctcccacactctccccccttgctctaaatttcaccccgtcgcatggtcattcctcgcgcatcatgtctgccgcattgccttatttacagaaactgcgcaagtcccaactgacggactgggcggaagctactgatcttcacaattatgaggaatacaataaaccggaacttgccacgctgttggatcaacatctccaagctaaccagtccatcttcgcgaaggatgcgcgactaacggattactaccgacgcctgtcgcaaaccccgcgcaaggggtcgccggtcaagagagacccccgcgtggaaatctcgccacttgcgaaagaaacaccgcggtcggtgctacggtcggcgcgtcgcagacagacgagagccttggaggaagaggtgaaggaagacgaggccaaggaagaggcgaatgaggaacccaaggaggaactcaaggaggaaccaagcgcggaacctaaagaggaggctgagcaactccaagaggaatccgacgcgtncccaccacctgtcttccagactcctgggccgtcgccgctgaactttcaatcggccctgcccgcatcgccggccctcatcgctgatgtggtcgaccgggagtccgtcccgtggcgcaagaaagctagcgattggtgg

SEQ ID NO: 6154 - DNA, 671 bp, Aspergillus oryzae
  misc_feature (1)...(671): n = A,T,C or G
taagagctttttcgtgatatttatttatatccattcctcttcccccctggtgatatcagatttcgatctacatctctatctaccacaactatactatcttgtcgactttcgactactacaacatcaacgtcaactacaccatcaatggcatacactagaactgatccttcgttcaccttgagtgacgacgaacgcatgtatatgagccaccacagtcccatgcatcgtccttacgataccttcgccgcccccaagggtcccgatcccttatcggccaactggaactatgatagtgctattgatctgttctcgctcaacaccatgatgcccgagaacttcgctctcgatgtgcccaatgagcctatgggagtggaccccaaggatttccccgcggatttcttcgcgccccctcctgatatcagtggattcaccatctccaaccactcgggcgaagatgccggttctatcacttcggatcttgaaagtgatgatcagtcgtggtctcccacctacgctgctcccgctgagatgcttnctgccccncgaagacaatccacccgccgcaagaccaccccagctgtgaaacgcgagacgacatggtcctcgagtccagaactcgcaccccaagataccccgccacacctnccctagacgactctacatggcctccc

SEQ ID NO: 6155 - DNA, 677 bp, Aspergillus oryzae
  misc_feature (1)...(677): n = A,T,C or G
ttaatccatacgcgattttactccaacgtctttactcctccaccctctagtgattaatccccacggggaaggaccactgatttttaactcgtgcctagctcaccctggacaaacttggggctggctccatttttccggactcgaccttctccacatctcgcatttcaaaggccgaccgctcagcttcggttacccgccgacttttcggagacacaagcgtactgaacgtcgtccctctcaccaaacccagacggtgccttgattcagtgcgtccgacttgaaaacctggtctgttgaacccgttcagcttggcagatggcatgccgacccgaccgcgtttgcgtttgcatcactgacagtcgtgcagtaacgcagtcgaaactcctgccacggataccattttccggctcaacgtcatttcacagtgcaaagttgcaaacccctgtctcagacacggaatgcgtctcccttgccttttccccgccagtaacccggcccgaagcataatcaggaattatgggctcatttgtggaggatctttgggctagcgtctttaccccgggtcccactcccaccttgctcgtcgctgctaacgccactttcgccgcactccaactggtcctcttgctgctcctgctcgcgagctacaggatncacttcatcggtctctccgtccn

SEQ ID NO: 6156 - DNA, 670 bp, Aspergillus oryzae
  misc_feature (1)...(670): n = A,T,C or G
tcgttattggtgattattggccgtctcaaaggactgttatctggactaggaacactcaaatcacggcgatgaccaggtttaaagcctctcggtggagatgtactctccggctcttcctcaatcgttggtgtcttctcgtttgtgccacgaggagggataatcgggcttattatcgacgtgctattgctatccgaccgtgtaatgctatcgatgatagtgctcggtgtctccggaacgtcaaaagcttgattaaccacagaccgaaatccgacggaggggttatggtgtaattgaggttcttgctgctgtggttcggcgggttggtctttctgagcgtcagacgaaggtgcagccgtgagatctgcgccgaatcctgacagacgcctgatatctgggagcccaatgataggaacatcattctgaggtcttgaaggaacactctggttctcggattgctttccttttgcttcctgtcctgccgggctagttgtaggtactggatctgtggaggcccgactcaagcttggagggcttcctggccccactgtctgctcgcgtaaccggctatagatgtcggctgagcgtaatgggaggttgtgattctgttcttctgcgttgcggtcggctgagtgactacngctatccgccacagggccggtccctagcgtan

SEQ ID NO: 6157 - DNA, 693 bp, Aspergillus oryzae
  misc_feature (1)...(693): n = A,T,C or G
ggcgagctctgatggatgccctcgagaacggtgtaagccaattgcccgccctggagggtcggtttccacaggtgtcaaatattacgttcagttataatgcatccgctccgcccggctcgcgcatcaactgggcgaagatcggagggcacccgatcgagtacgaccggacgtactcccttgccacacgaggatacatgggccgcggaaaggacggcttcgcgtcgttgctggtgcagtctgctggcggcgaggtagaggaggttgtcgacgaggaaagcggaatcttggtcagcaccctccttcgtcagtattttctgagtttgaaggtgatgggcaggtggcagcgctggagtaagagcttggcacgtcactgggacaccgtgcaccagaacctccattgcaatggctggttgaagccagcatctggccaaacctccccggtaaccgagaaggctccggtacggccccagcgaccgaccctccaacggagcanacagtactatcaatacggccgcttcacggagattgacacggaagagagtccggagaaagaggcccagagccatgaggacatggattcaaattctgactcggatccagaaattttgacttctncgcaacctaccacgaactatgtgaccctgcccgcacagtccgccgcagaagaagagcgttgacttcgactagcccgaa

SEQ ID NO: 6158 - DNA, 664 bp, Aspergillus oryzae
  misc_feature (1)...(664): n = A,T,C or G
gcccctgngggttgccattgacccatcatggttcgtcttttggcaacagttcttcgatcctctcgggctgctgtgccttcagctcgccctctctattcccgtggttactccgttgcgagcggtgccgccgaagatgctgcttccctcggaccgaccccaaaaaaagggcccccagggggtctacatgaacctatccgaaatttaatggatcccccagagccccaagctcgcaatacccagccctccacaccctcaatagggcgtcaaggcatcagaatccgaaccgggaagggggatgtctcggccatgcattatctgctacgcgacggctgcaaatgcccgcaatgtgtagaccagcactcgaagcaacgcaacttccgcatgtccgacatccccacggatatcaaaccacgctccacagagtgggacggcagcgtcctgaaagtgaaatgggagaacgacatccccggattcgacgagtcgcacacctccacgtacaccctgaatcaactacgaaacccctccgcaaactactcctaccatagcaccggccggaagagaaagcgtctgctgtggcacaactggttccagcaccgcttcgtctnctacgaagagtacatgcacgacgacgaagcgttctccagcgccatgcgcaatctcgccc

SEQ ID NO: 6159 - DNA, 708 bp, Aspergillus oryzae
cccatgcgcctgctttccggagacagtacgaggaagcgttgcatcgcatcgacgccgcagacacaaacgaaggaattcttccctccaccaaatgcgcctcacatcaaggaggtagagacggcttgggcccaccctgtttataccgaagaacagatgcgccgggtcacagttgctcaccgggaaacgaaggactgggcagactgggtagctctcggcaccgttcgattgcttcgatggggcatggactttgtaaccgggtaccgacatcctcctccgggcaaagaacatgaggccaagttccagatgaccgagcagaaatggctcactcgattcgtcttcctggagagtgttgctggtgtgccaggaatggttggaggcatgttgagacatctaaggagcctgagacggatgaagagggacaatggatggatcgaaactttgctcgaggaggcatacaatgaacgcatgcatctgctcactttcttgaaactcgccgagccagggtggtttatgcgactcatggtccttggcgcacaaggcgtcttcttcaacggcttcttcctctcctacctcatgtcgccccgcatctgccaccgattcgttggctaccttgaagaagaggcagtgctcacctacactcgagcaattcaagatatcgaacacggcaaacttcccaagtggaccaagctggaagccccggagattgcg

SEQ ID NO: 6160 - DNA, 1071 bp, Aspergillus oryzae
caagtggttcctccctcgttcgcttgggcatgcacaccatattttagtgcgatccacgcacatggcacaaccatagtcgcatcctgaggtcctggatgatacgatccctgtagcccgccccagaaactgggatgtatcacattcatctctccgatgtttatgcttgtcatccccaaggacgcactgcccccctccctcggacactcactcggttactatagcaagcacatgatggcttccattccagacccccagcctaagaaacgagagtcccgtgctgggacgcgaaaggtgacgtctctctcagctgaacaactcgaaataaagcgcgccaacgatcgggaggcccaaaggactattcgtcagcggacaaaggagcacatcgaacgtctggagcaccaagtagcggagttaaaatcgaaaggggaacaatatgatcatgtcgtccgaagaaacactgctttagaaaacgagatcagggctttaaaacaacagctatctctggcaagaagcggacaagcctattcaggcccagccgagggctcatacaatactccttccggaccagtgcttccttctcaattcacagagcccttgagtgtaaacccagtttccaggaccccatcggctctttcaacctctagccaggtctccgttgcgcctgactggcaacagtacggttccacagggtcaccatctatctgtgaatcgtcggacgcagattactcgaacagggtagaaccttttatgttcgaaggacagttacaaacgtcgaacccgatgactgttgcagcaccccaagctagcttcaatccccctagcggccatcctcctgagcccggtctccactcatattcacacttatacgcaggaagcggtcccaacaaagtgcgccgaggggagcattcacacaaccctcaacacgtcgtgcaatgtgcgacgagtcaacgctcaatgtccgtgcccactattccgtcaaaaaggaaacttcgtgggacccccgtttttcacccccgcccactattttaacaaggtcggggaacttccccaaagaaacaatttccggttttt

SEQ ID NO: 6161 - DNA, 1151 bp, Aspergillus oryzae
  misc_feature (1)...(1151): n = A,T,C or G
cgtttcctcacattgcctcttttcttccccatacgagatacgattgtccaccagcaaactccaggtagaagacggtcattgcgacgttcttccacgatgcctgccccagtcgaagtcgtcgatcccgtcttgcccgtccgcgatctcgaggctgacgaggaatacgtgatggtcgcctttgagcgtcatgcgagccactgcactcgatgcgcagatcccctcagagcgcgcaaagatgaccgctctctttgtgagcgtggacaccaatacgccgtcgacgtcgccgactacctttacagcaagaacggaaagtcatactcgaccctcgaccgtgagcgcaaccagcctactctcgtcaagataccccgcgactgccgggctgtccgcgcactgctcctcgccattgaagatggtatgcgcctgaaccgcanagaacagggtgctgtccagccccctcggtcaccgtcacctatcatcacctacgaccgaacctaccccgttcctccccgccgatcgacaagcccacaacagcagcctgtctcatacactgaaatcattgagcgcgagccccgtgacgcgatgcgtcgtcgggtcatcgtctactcctctcctcgtagctcccctagccggagctctcccagccggggatcgctgtacgagtctgatgcggcggagcgcagacgtttcagggagtcctcgcggatctacagacccactgaataccaccgttgagcggttcaccgtccagcttctggtttatcttttcagtctacctctatacggaccatcatatagccgtgctgcacgcagtgctattcgaactctgtcgtctttgcacacacacacactctcgactcacccgggcagggcccagctcatgcgcgaatccattacacgcacaatgtgcccatccgactcccatcttaattggtacccgatgttcgcgccgattggcgtctttcccggggtttcttttctcccagaaaaagggtttctatgtgaataacccttcttatttggaaacattggctctaccaagtccgaagggacacctttgaaaatcccaaacaaaccggggaaattccagaagaggattataataaagggggcgtgttcaacaaaacggccatttagatgggtgggatattccc

SEQ ID NO: 6162 - DNA, 654 bp, Aspergillus oryzae
ccagtattagtccacgttatcaagctctcccctcaaaaaacctttcatatgtctttgaaagctacctgcctctttgaatcgtcatgagacaattctcatccatcgtacgaatgctccggggaaaatggccctgaagtgtcgtgatattgtcatactgggcactggcgttttcattgcttgggggttggctgtacgctgcctgccagttttgcggtaccttgggtatgccgtcggattaggcattctgcttgcttcagtcgccttctttggtcttgtactcttcacaacccggagccctaacgatgcagacaactcccgatctcaatgtttgcctgtcgcgtttctcactccccccaactggcaggttgagactcaaggtctaaagaagcgctccatctacaatcccgtgtccctctacccgcaatcctttatggtgtccgaaggtatcgacgagcttctggcgctggttacccgggatttcatagcgtcatggtaccttggtatcagtccgaacccagcattcgtgactgaagtagaccgagtgtttcgggcagccattgtaaacctacgtgatcggttacttgcggaagatcttatatcgcttatcgtctccccgatatttcctattctgaccacacatcttaaagagttcgg

SEQ ID NO: 6163 - DNA, 836 bp, Aspergillus oryzae
gccctcctcccagctctgttggttcctacaagcgcccggctgaacacgactcttacttctcgtactcgcgcgccccgcaagcccctctttccccgccagtcgaggaccagcccaagtgctctcttccctctatctcgactctcttggaaggcgccgacagcgcatcgacatatgctgcaaagcgtcaaagaaccagcccacccccgcgcagggagtctgagttccgttcaccttatgactcagtctcaacaccaaatggccctcctactccacctttgcgccctgaatcgggcttccacagcggccaccactctccctctgcttcgtccgtgactagtggaaaggccatcaagctcgagtcgtactcgcaaacccccatgacactgactagcccgtccgatagatcctcgatctccagccagggctctgtccaccacgttttcgctgcttcctacgctttttctgccccagtgtggcctcgtactcttcgccggtgaatcctcggttcgtccgcctgtactacagagaccttcggttctacagaccccggtactgggctacccctccgtgttctatgccggctttgccaccaccacaaatgatactccggtactcgggcctgcacacaacactacttcccgtttcgacttggcccctaccaaagaacccgaccggtattttgccggacttgcacagggcctttaaacacaatcaggtgggattctttataaagcaattgggggaaaccctttccgtgccccaacccggttgaagaaggggttccgctacaaacaaataaaccccagaaccgggtgcaccaccgaacccccgtccct

SEQ ID NO: 6164 - DNA, 642 bp, Aspergillus oryzae
tcaagtagaagaggccgtgtgccccctcccctccttattttttcggaccaacttgtttgaccaccgcttcactctttcagcgggcactcattcgtttgcacacaaaaacaccatatacccaaatccatccttgaatttccattctatccaacatgaggggtgctttcttggccgctgcggctgccgtcgccggtacggcgatggctgatgtcgcgcacatgcgtcgtcatggccatgattctttccaccacaaccgcgcctatcagcctgaggttcctgccgagggtgatgagaactgcgaatgtaccaccaaggtcatcaccatcactggccctcctaccctggtccccatcaacaccccggctcctgagcccagcagcagcagcagctctgaggtccccagcgttcccagcagcgaaagcagcgtcgtgacctccgaggctgtcaccaccctccactccaccagcccctcctccgcctggtagtggcgctggcggtgctggtagaagtccgtttgatggtggaatgccaggcggcttttcattcggaggcatgcctggaggaagtggtgctcggacctttccgttttcgactgggccccgcggtggcagtggcttccaattcaactccgcagatgatatt

SEQ ID NO: 6165 - DNA, 751 bp, Aspergillus oryzae
  misc_feature (1)...(751): n = A,T,C or G
caccactcttctatacctttcaaccaccaaaatgtcgtcaattgctgctatggcctcccgccaggcctttgctcgccagtctgttttccgtgcccccgcccgccgtttctacagctccaagttggaggaggctagcctcgacaaggctcctcgtcgtgaccctgagctttacgtcctgctcggtgtgatgtccggtgctttccttgctgctggatggtagacgcccttttccgcacccactttacaacccacgaccggccgcaaaaattccccaattgcacgtggaagcgaaacaaattactaacaattctttcctcataacaggtacttcggcaagaagcccacctccgtgacctccgagagcaacgtgcgcattggcgacagcgccatgccttgggagcgtgaggacgacggcaaggtctacaagtaccagtaccaccctcacggtgacaagagccagcctctcagaaacgcccccagcgctctgaacaccgttattgtgcccaacgttactctgccggctgatctccatgagcgctacaacaagtatggcaaggaggagtgggattactaaatggtcatacagctacatagaaggctattagggggttggttgaggggcatctcaacactggtcgctgtatactaaaattgctgtgaagagtagagaagcgttgtgcatagtacatcttgacgggaatcaaatggagactgcttttttgcattacacaaaanaaaaaaaaaaattcct

SEQ ID NO: 6166 - DNA, 718 bp, Aspergillus oryzae
  misc_feature (1)...(718): n = A,T,C or G
cgaggcttcttatctccgtacaatcttcaatctcaacggctccatcaaccttcaatcgcattaccccacaaccaaatctaccaatctgacatatcaatcacatcaatcgagcctcccagccctgtcggaacccgtcacacagcgagacacatacactgcatggccgatcaccaccgctaaacccaatcaatccttccagtcctccacctcacctcaccaatccaccaacctcaaggacaaaccaaacccggaaaaatgggaaacatttgctcccgctccaaaaaccaacccgaggccttttccagccccggtcgcgtcttgggctccgccaatcctcccccgggagacacagggaaatccagctncggtccgcgcgccccgctccccgcaaacgccagtacggggaggaccctgggcggcgcgggggctccaggtgctggcgcggatacagctgatgcgcgggcgaatgcagcgattgcggcgcaaaaacgggctgagtctactacggcgggcaacaagggcaagttanggtcaaagttagccgctcagaaggcccagacacaggcccagacgtngggggaggctagccgtaatgagaggtctgctanagatgcggataatgctgctgaggccanaanaatggagtgatggatgtacaaattactcggntataacttaattctggctgtgaatcgccggtgtttcactttttctttct

SEQ ID NO: 6167 - DNA, 560 bp, Aspergillus oryzae
  misc_feature (1)...(560): n = A,T,C or G
cgaggcggaatcttgtataacctcaaatcccaagcaaaatgcctgccgcgttcacctacttcgccaaagcccagtctacctacaagccacctcacatcgcaaacggcaatgccttcctgggggacatagtctcgagcgaacacaatgatcccgagaagcccatctcgggcggtttctaccgcctggagaaaggcgtccctctagtctacgagtaccacttcgatgagacgaagatcatcctcgagggtgaatttgagatctcggatgagaccggacagaaggttacggcgggtccgggggatgtcttttattttccgaagggatcgaagatcaccttcacgacgccgtcgtacggcttggcgtttttcactggacaacgggccaagctgtaactgttaactttaacatgcatacagcaaaacccgctataagcgaccccgatagagggaatctacgcgttataagcaatctaattgagtgtctgaatntaactaccatacaaaattccttaaaacctcaatatacggaaaattttatcgttctgaaaaaaaaaaaannnn

SEQ ID NO: 6168 - DNA, 662 bp, Aspergillus oryzae
ggtccctcaccactttctcaattttcccaaataatagaaacatctctttctccttgatactcgcaggaagatctcaaaagatggcctccggaatcttcaactccacctactacggcaaagactaccgcgctggtgctgctcttctgcgcgcccgtcgtccctacctcgtcaagaatgccttgaccggactcggcctcgtcgcgttcactatcagcgtctacgcctacaccatccgtgcagtcggccaggatgaattctccgatgtgaaggtccccgagacgcccgcgaagccccagcagaagcaatgagtgcgaatcgagcgttttactcgacctgttggtgtgtgacttccgcttttgatttggttatgacggactctcggttggtcagggttagaattgcacaccaatggtcaaggacaatggttcgattcgatcattgatcggataatgtatcgggtaccggagtaacgtggcgaatcgtgtttcctttgcttggcactacatgcctgtgggcttcgaatgggaagaggtttttcaatgtgcgataatcgtgggagatgtaggttttctattggaagtctgcaaatttggaatgatggtgagagcgggagccgtgcaagacccaacgccgcggcaatgctgcgcaatggggatgtgaaa

SEQ ID NO: 6169 - DNA, 959 bp, Aspergillus oryzae
ggaagaataggtcgatcaacgacttgcgatcgctccacattccccagcgtctattgtgtctatttttgggttgaatgagcaacattgccgggccattcggggactatcgattgttccatgactccgtggaagcccagacattggtgactcaaccccaaggccttctcctctcgcagggtccctgttctccatccaactccggtccccggggcttccctctcactcttaataatcccttccacctcgttcctgccttttctgctaagtggcggcaacaaccttcaccattcaatttgacagcttgatctgccgaccttaatatcaacctcaccccatcggttcactcacgtctcttcctccgtatcgtcgttatcagtcatctacacctcgttgaactacacagtcatcatgtctgactccaacgaccttcgtcataacggtaccgcggccaagagggtctataaccacaagtccaaatgggcctacggtggccgagcggcgctcccgcatcgcgatgtctctctctctgacccagtgactcgtccagcggcacctcagactcactccctgaagtattcccgtcttttgcagcttgaccgaaaggccaagtccaaccagctagcgaccaccgccaagtccaccctgcgacgtgacattcgggaggccctggacagcggcccatccgactcctccgccgcggaagacgttgaggaaccctcagccgcaaaggatattctaggacaccttcaggaggaggatctgttagaaccataccaagtgtcgggacagacaatcctctctgatgcgataagcaaggctgtagagaaatttgagacacgagaaaccgagaagctggtcgaggaatacgaaatcattactcgggagagtgagatcgctacgggctatctcgccgatgatgatttcgagctagtcgaccatgatcaccgcagggctgtgaa

SEQ ID NO: 6170 - DNA, 666 bp, Aspergillus oryzae
  misc_feature (1)...(666): n = A,T,C or G
cttggtctctattcagtcctgccaaagttaccttgtcgatcttagggaagattggtctaaaatgccgtcaccacccccgggaatgtcagccttacatgaattatttgaggatagttctaccgagcataccgaagatgctgatcctgaggttctggtggcaaacaaaaagaaacgcaagtttttaaagaagatcggtggtccctgggctgagcgatacagcgtatcattggtatctgccagtgtagttcccaattactttccatcgcttcgggtcgttgaatataacatctctggtttagtagatgccacgacttgggccgagtctcgggatcaagatactgcagtggcctcgccatcctccgatgtgatagatgatgatgatgatgatgatgatgcattcatcgagaaaaagaagaaggggaagaagaagaagaagcagccccacttcaaggtccccaaacccccgtcgtcatctgctccaccaggaccggcgtactcgaaccaaccgtttacatggttgggttacactcaatatttcgccaacctaagcaagattaacgagcacatgaccaacagctgggaagttgcgggtgactccatcaatcctacagacaccgaagttaacgaagttcgtgaaacgagccataatgataatgctttcgtctn

SEQ ID NO: 6171 - DNA, 697 bp, Aspergillus oryzae
  misc_feature (1)...(697): n = A,T,C or G
tggagatatccacagcatcttatcgccgactaaaagcgcaaccaaaggcacatgaatccgatctcggatattccacactcctgcagaaaatgaaccgttgcaacgaacttcttgactcaatcctagttcacgaaagtcacacacgaactactacttactagttttgacaagcgttcgatcaatcaaagtaagaaagtgacatcaggatctcgtatctgcttagctagtcaagatgtactccaaattctggccaaagggcggtcttcccggtatcctgcatcattataccgaaaccctcgtcacattcgaatacacaacctccacagtcagaaaaccacacagtctcctcttcgtcggcggtctaggcgatggcctcgcaacaacatcctacatggcggacctcgcgcacgccctccaaccaacagaatggtccctcttcaccctgaacctcacatcgtcataccaatcatggggcctcggccatctggaccgcgacacgaacgaaatcgcccaatgcttaaactacattaaagaatataagaccgagaaattcggcaacggaaagaacgtcctcatggggcctttcgacaggtagccagtgcgttgtgcactacctnttcccggcctaacccgcacaccaatacttccttatttcgacccgaacgctgagcatatttaagcgcattgtcctttgacg

SEQ ID NO: 6172 - DNA, 698 bp, Aspergillus oryzae
  misc_feature (1)...(698): n = A,T,C or G
gctacatcaacagttctaagntccaactcccacatctataaaccgccattacccatagatgactctccaagccaaactaatccccaccccgggcacacccccaaacgtccacaaggacgccctgaaagtcttccaaaccctccaagaaggcggcatagccatcgtccccacagaagtaggctacggattaatcgcctcctccagtgaagccatcacccgcgcctttcacgccaaaacgcgccgtccaggccacacacaaggcataatcggcaactacgatgtccataaagcgctgcacattctccccgaggagagattcaatatcaccaaggtcctaacgcacgatctagacatgtcgcttgggatcattgcgccatataaatccgaccatacgcttttgcaaggcatgtcggcggagacgttggaacagacgactaaggatgggaatatggctattcatgtaggtggagggtcacttctgttggaggttgtgagattgcattatgaggtgggaaaggtggttgtgggttccagtgcgaatgtgacccgtaagggacagaagttccgggtgcaggatatcgaggagaagatctntgaggcggcggatattgtggttgattatgggttgcagcggtatcatatgtattggaaggcgagtatattatttgattntgnngagatgaangttgtgaggatgg

SEQ ID NO: 6173 - DNA, 799 bp, Aspergillus oryzae
  misc_feature (1)...(799): n = A,T,C or G
ccgataatcccgatgagtatgactcctatcccgtctctccctggacaggatcgtcgaggattaaaccgtctagttcctttcatcaaaccacttgcccacaaggggctacgctcagtcatcctgtttggcgtcccactacacccctctgcgaaggatgcactaggtaccgctgcagacgatccatctggaccggtaattcaagctattcgcttgcttaggtcgcggtttcctcaactttatatcgtgacagatgtgtgcctttgcgagtatacttcgcatggccactgtgggatactgcgagaagatgggactcttgataatacacagtctgtggatcggatttcggatgttgctctggcttatgctgccgccggagcccattgtgtcgctccgtctgatatgaatgatgngcgagtgcgtgctataaaactgaagcttattgaagccgngatggcccaccgtgtcctactgatgtcctacagcgccaaatttagcggnntgttgacggccctttcgtgatgcagcgnngtcctgcccattcattcgggatcgcagatgctaccagttaccacccngagcccgngacttgctcggngcgctatacagagagatatagccgaagggcagacatcataatggtaaggccgcgagcagttacttgacattatcagggacgcaaaagaaatgccaaagccatcccattgctgcttacaggtcagcggtgagattcctatgaacatgctggngccaaggccgncgtttttgacttggaaccactggccttgaaagacctgaaggn

SEQ ID NO: 6174 - DNA, 699 bp, Aspergillus oryzae
caaggacggcaaggtcgctcctatccagaatgtttaagattactcctacaacttggccaaccagctcggctttggtaacaacaatgacttcgttgagctcatgcgtttgtacctgaccatccactctgaccatgagggtggaaacgtcagcgctcacaccacccaccttgttggtagtgctctgagctcccctatgctgtctttgtctgctggtctgaacggattggctggcccccttcacggattggcaaaccaggaagtgcttaactggctcacaaagatgaaggctgccattggtaacgacctcagtgaccaggccatcaaggactacttgtggtccactctcaacgctggccaggttgttcccggatacggtcacgctgtcctgcgtaagactgatcctcgttacgtttctcagcgcgagtttgcacttcgcaagctccctgatgaccaaatgttcaatctcgtcagccaagtctacaagattgctcctggcgtgctgactgagcatggcaagaccaaaaaccccttccccaatgttgatgctcactctggtgtccttctttcatactatggcctgactgaagccaactattacaccgtcctgttcggtgtcttttgtgctctaagtgtctgcctaactgatcattgaccgcgcccttggggccccattgagcgccccaagtcttcaacaacgag

SEQ ID NO: 6175 - DNA, 636 bp, Aspergillus oryzae
ctaaaatcaacaagattgtccaagaatggagagtgccgaccgaggtggccatggacattataaaattgtccctcttcgatatcattctttacgtggatgacagtggatctatcgaatttgaggaaagaggcgtgagaaaagaacaactgaggcagatcattggcatcgttgcgaccgctgcatctaccttcgacgaggacggcatctctgtgcggtttatgaactccatggaaagaggtgacggcatccgcaatgcggatgatgtcaacatgttggtctcacgtgtccgtttccaaggtctgacgccgctggggacaggtctgaagaataaggttctggatcctcaggtcgtgggacctgcccgggcaggccgcttacagaagccggtactgatcattaccattacggacgggcagccagctggtgaaccccttgactgcgtggctaactcgattccctatgctgttgacgaagtatcgcggactccatttgggcgaagtgctgtttctttccagttctcgcaggtgggcaatgatttcaaagcacgtgaattcctatccaagttggacgaagacccaagcattggaaatctgattgactgcacttcaaattccagggtcgaccaagacaagatgt

SEQ ID NO: 6176 - DNA, 672 bp, Aspergillus oryzae
  misc_feature (1)...(672): n = A,T,C or G
tgctggtcgtgtcttctccgccgccccagctctcgaaaacaagcaagttaacgacgctgccgacccggcagaagccgtcagccgcataacgcaaaacccgtcccacattgaaaaggtcggcaaaggcgaggctgagcagcaagttctccagcccgcggacgcccgtattcctcacccccaccttgtcgcgcacgagcgcttccgtcagtctaggccaactgaataccgcgagatcttcaaggcatacaacgaacgtctccgtcaggaggaaaccgcagaaaaggagcggaagcgcctcgccaaggagcgtcaagatcagcaactaacaaaggtccagcccgagtcttcgcgcttcgaattccgctttaaggacgtcgtcgtcagcaaggagacaaccggcacagacggtcgtggctccaaggcccccggtctcagatacggtgtccctagctacgagcggaagaagggccaggttaagatccccacgcgtgtggaggtctaaggtccgggttatcaccgctagtcgggatactcttccggtctctgtctctataacaatacctcttatctttcttacgttcttggatttctatgctcctctgtacaaatatggatgtgatgggtcagcgttcgcttgtactataattgaatcgaattgacgtcgtnaagact

SEQ ID NO: 6177 - DNA, 702 bp, Aspergillus oryzae
cggcacgaggctgtcctccgtctgcactgtgcttggccttctctgtcaatctcatacccaacctgaacatcttcatctggatcgatctatccataactgtgaaatcgctattctcgtcttcttctcctgctccttgcttttatagtcattcgttgaaattcattatcttacgaacgcatcacgatggttctcctgagttccttggccgtcgttgccactgtagcaagtctcgctacatgccagaacactagcactatcgacccaagcactgttttagattcgacgagaaagcaatggtgcgaatcgcaaacctcagcttgtcctctcatctgtctgcaactgccaggggcttcgggcagccccaaggagaacaaatgcgacttcaaatcccttgtatactcgtgtatctgcagcaacaaccagtctcccaacgcatctgaatactcccagacaatcccctactttgagtgcacagagaaaaacaaccaatgcgttaaaaactgcgacggtgaacaacagtgccagtatgactgccgctctaagaacccttgtggtgctcaggaccccaagcgtgtcaacactaccacttctgcaactaccagcaccgctcaagcgaccacttcgctgcctcctttcactggcgtccctgacaagaatggggtcgcctccaggccatcggcagatctgaatcatatctacggt

SEQ ID NO: 6178 - DNA, 516 bp, Aspergillus oryzae
  misc_feature (1)...(516): n = A,T,C or G
cgaggcggagctgccatctccccgaacactgcaaagcctagtgccctgcctactatgtcgggcgcctctcgtcctacggaagagtcccctgcttctccagccaccaacggtgtcacagccacggccaccgaacaagctacacagccgtcgtccactgtttcaacgcagtcgaaccagaccactcctgccgctagcagtagccctctgtcacagttcagccgatccgcttccattcctgcctggcagatggccgctgccaaccgctcgaagaatgcatccccatctactcctacttcctctaccggggataactctaccaagcctgccgacgagcaaactgctccggccagctaagaccttcgccgcttctttcatgctcttcatgtagatttcttcatctttacttttctactgggttttcttctcatacctgtgattgtattcaccatggagataatgatttggttgtcgcattgggaaannaannnnnnnnnnnnnnnnnnnaaannntttcct

SEQ ID NO: 6179 - DNA, 686 bp, Aspergillus oryzae
  misc_feature (1)...(686): n = A,T,C or G
gactatcgctcccgctgccacccatgcctcgtacggtatctgaagctcgcgacaagcttgctggctctgctgccaagcctgcgccccccaaacccaccccagctcctgttgaaatgccagaagaaaaggaggagaacaagatcttcacggtcaaagggcttggtggcccgcgcaaacggaagagcgaagaagctccgtcgccagagggtgacgattctagcgatgtgatacacatcggggagaaaccgtctaagaaacaacgccggaaggaaaagaagaacaaatccgcgtcgcagactccacagcccgaggagaagaaggaagaagctgagccctttaattatgaggccgctgactccgtcctacacgcacagncagcccagaccgccacacttcacaagaaacggccattcaacccatacaagaaggcgcttgaggcacccagtggagtgcgcaagcagaagcgtgagacccccggcaagtcattcactttcaggtgattacattagaaatagatctctttgtctggtcttatgtacaagagattggttgcgctggtacaaaatgttttgagtacataacgatacccgattaattggagaagtaacgaatcgaaggcattcattatagtcntcgnnnnnnnnnnnnnnnnnnnnnnnnnnnnnnnnnnnaaaattcctgcggcn

SEQ ID NO: 6180 - DNA, 306 bp, Aspergillus oryzae
ccctacctttccaccagaaaccaaaaaaagggagaaaaagaagaaaaagaaagaggcaaaatggccttccgcaacgggtccttcgcgacctttctcatcgtctgcccaacggccttcttcctgggaatcatcttctccctcctcccctacgactacccaattctctggtccaaccaccccaccccacccacccactacgactacttcgaagcccacctccgcttcctgcacgcctcgccccccctaatcccccgcatcctccacatcgtcatcttcctcggcctactcggcctaatcctcaagctc

SEQ ID NO: 6181 - DNA, 689 bp, Aspergillus oryzae
  misc_feature (1)...(689): n = A,T,C or G
cgcacatctggagtcacgaccaactctcccggctttacttcgtcggtcctgtcgttcacttcttcttcncctcctgtcacggggtcatcgtctttcgttacgactactactactctcgcttcctccacttccacttctacttcaacctctctaccttcgtttactagcacactcgtttctgtcagcactcccgtgagtggctccagcacaatggtcccaattccttctccttcggcgagtaacaatccttccggaacaacttccggttccggcaatggcaatgggaatgtcgcgggtaacatcctggtgattgccaagggcaccgctgctgcgaatgtggctacctcggggctcaatgggtatgggattccctttacaccctgccggttcggaatctggggttactccggcaaaactttaatggaacttccggggggaaattttgggggggtccgcgggttctgaaccgaggtcaagtatgagtaataggggccaaaagggtccaaaagggcggcctgggtaacggggcaacaggggatcataatcctcaggccgcataaacacctcgtacaagtggtttcccctgggtggaatattaagattgttgcccgggggacacaaaaagggggcccgcccgtggggggcgggttgttgttgatcaccggggggggaaacatttttcttttttt

SEQ ID NO: 6182 - DNA, 678 bp, Aspergillus oryzae
  misc_feature (1)...(678): n = A,T,C or G
ctgaatcttccaaatcaaattcttccaactcgccaaaatgcagcccagcgccaacatgatccaccccgaaggccccgtggtcatctccatcccggagagtgcaaagatccacatcgtcggcaagacaaacgcagacttccgccaaagggtcaccgtcgaggagattggcaaagacaagtacatattcgaaggcagcggtgaaggcaagctcatgacccttgcgggaggaaacgagagcgtcgaccttgagcctatcaagggcactggattccgcacatggaaaatcgacttccagaactccagttccggcgcagaggactcctttagaatgtcgaaagtgctgcgtccagtctacaacaccgtttacgatgagaactacaaggttcgaaaaatggagtgggagattgcgagtgaagataacattgatgatgattacaacgatgcgatcatcactgtcagcgccgacatttgagtggcttcaatttgggtttggcgaagctttaaggacataccgattgaactctagagtgttggactttcttgtctctagcattcggtcatccagtgagcttgcctccatatggctntcctggatgaaacgcttctgagggtagcgtttgtggatatgacgtgatgtcaaatacatactcaatgatatataccantgccccttactat

SEQ ID NO: 6183 - DNA, 718 bp, Aspergillus oryzae
ctcagctgaggccggtctggactggtcggattaacgttcattttgaaaatgtttttgcagtctgtcttagcgctgtccctggcgctgccctctctttcgaccgctgcacgactctttgcaacccactacgatggcaacgtatactctctcaacttggaggagaagggcgataaattctcgctcacgaagacccacaatttgaccacatgcggcggtgccggctcgacgagtgcgctgacagtagactctgcccgcgggctcgtatggtgcgttggggaaggcactcccggtgcattaaccgccttgaaggtctggaaagacgggaagatgttcgaggaagtcgtgacggtagagacacctcctggcggagtggacagtgtcacatacgggatagataaacagttcctcgcgatagcgcattatggcaactcctccatctcactcttcaacatcccctttgcggacaagcagcaagtgaagcccttcgacgtggtgaagttgcccccgcccaaaaatgtcaccgaaaaacagcccaagtcgcaaccccatcaagtccttctcgaccccaccgaatcgttcatcctgtcgcctgatctgggatccgatgtgatgcacgtgttgcgattgaccacaagtcgggtaaactaaacaagtgcgggtccaactcgacgatctactatgataaggggaagcgggccacgtcatggagtgtttgtga

SEQ ID NO: 6184 - DNA, 738 bp, Aspergillus oryzae
  misc_feature (1)...(738): n = A,T,C or G
gcctagggatggttcttctccggcgacaagcgactcccaagttccaggtgttatgactcgggaaacactcaacggctcaaacaaccgtggaatgccaactgccaaagccgctaatggagtctccaacaacccctctcctaaggttccatcggtgtacaatatcagacagtccgcatcatcacatgattcctccaattcttgttctccatcatcctcatcggactcacaccaaagtcagatgctgtcttcgaatggcacatcgccggaaccgtcatcaaattcgcctgctacgaagcttaatgacagtgttcaaaatcatcatgcttgtacctatagcaccattgatggtgaggcctccttctgcgcacaactcggcatggcgtgcggcaatatcaataaccctattccagctgtgagaggcaaaagcgagagcgtgtcgaatacccccagccaacccaacaacaactacgaacaaacacccggacctggactggaccttctggcgcagcagaatgggggtcagttcgatccagtgctgttcggagactggcgagaacctcaagatgcaattttgtcgcaggacttcggtaccttctttgacgatgccttccccttgccggatctgggaagtccatctcacaattttaatgaggtggctaacccgcagccaccgaagaaggatttgattgctgaaatcgacaacanattggatgaagaggtggttgcctgggaggacaa

SEQ ID NO: 6185 - DNA, 1345 bp, Aspergillus oryzae
ggggttgacttcccttactcttaacatttttattcccccctatactatcagtctatagctcctcactcccctcttgatcctctcctccatatctctttctagtcctttacccctccaatatgtccgccaagtcgattctcgaggctgatggcaaggccatcctcaactaccacctcactcgtgcccccgtcatcaagccgactcctcttcctccttcctccactcacaaccctcccgctcgtctcgcctctctctacttccctgaagaccgtgccgtcaaggatgtcctcgaccaggccgaggtgacctacccgtggctgttggcctccggtgctaagttcgttgctaagcccgaccaattgatcaagaggcgtggcaagagcggtctcctcgctctgaacaagacctgggctgaggctagagaatggattgaggctcgcgccgctaaggacgtccaggttgaaaccgtcactggcgttttccgtcagttcctgggtgaagcctttcgttccccaccctcaggaaactgagtactacatcaacattcactccgtgcgtaagggtgactggatcctctttacccacgaaagtggtgtcaatgttggcgatgttgaagcccaaggccagaaacttcttatttcttgtcaacccggagaactacccctcgaatgaggagatcgctgccactctcttgaagaaggtgcccagcggtgtccacaatgtcctcgtggacttcatctctcgtctgtacgccgtctatgtcgactgccagttcacctacctcgagatcaaccctctcgtggtcatccctaacgctgatgccacctccgctgaggtccacttcctggatttggctgccaagctggaccagaccgctgagttcgagtgcggcaccaagtgggctattgcccgtagccccgccaacctgggtattgccgttgctcctcaggagggcaaggtcaacattgacgctggcccgcccatggagttccccgctcctttcggccgtgagatgagcaaggaagagaagttcatcgctgagttggatgccaagaccggtgcctctctcaagctcaccgtcctcaaccccaagggccgtgtctggaccctggttgctggtggtggtgcctccgtcgtgtacgccgatgctattgcctccgctggcttcgtcagtgagctcgccaactacggtgagtactccggtgctcccaccgagactcagacctacaactacgctcacaccgtcctggacctgatgctacgtgctcctattcaccccgacggcaaggttctcttcattggtggtggtaatggcaaactcaacaacgttgcttcgaccttcagg

SEQ ID NO: 6186 - DNA, 707 bp, Aspergillus oryzae
gtcaatacgagcgtcaggccaacaagtacctggtccaacagtcgatcatgcaaaacgaggtcattttcagccgagaaggcctcacgctgctcaatgtcgaccgaatctacacattcaaacgccggctgtgcatcctttccaaccaaggcaaaaatcccgaagcgtcctgcgtcacatcctgcgtgcagctcctgcatcgcactattggggattttcagggtcgcccgttcagtaaagcattcttccaccgcgtatatgaacagctcgacgtgcgggacgaactcctgacccacatcgcccaaacttataagaagcagttcggtcaggaagggatcatcctgccgccgcgcgcgcgggcagagcacagcagccggaactccccgaagcgcaccgttcgggcgcgcatggaggccaatccgccgagatatagggctgctccggctaagcggggacccaagaccccacagtctgcttctgatgttaccccgattacgaggaacgagtggaacatcctcaattccaatctgcagcagactaagccctccgtcactaaatggacgcccgtcgccgactgttctcgccgccgcttgatctatgaagtagacagctagatgtcgaccggcatcgcatgcttaatccttactttcctatccccaagttgacagattaccgagcgtgctgcttcgttgcggctagaacattccaag

SEQ ID NO: 6187 - DNA, 604 bp, Aspergillus oryzae
cgagtgaagcttttcggtatcagtgatagctgttgttagcgatggcgagacgtacacgccctttgtttcacaaagacgagatgtgctgcggacgggtgatgggcagattccgatgcaggactgatcgcaacggtaatagacatcggtattaccgcttctgtagtggatgcaaatggctttgtgcagatgattgggaaggatggcgacacaacaaccctcgttgtaggtgtggtgagcgtagtcggaaacaacatgagcggtcggtgaagcatttcacttatcgatgtcttcgggagcggtgcagataccggggataagaggggtctatacagctgggttgtgttgctgctattgggaagtggcatgagtgacgaggtggagaaagggttcccacggtatggaacaggatggtaggtatgccatacagtgattccatgtttttgtcctgtgtgccattgcgcttgtcaatgctggggttggcttttatagcaagggaaacagaaggtggaggggagggtctatattgataaattgctggttgtgcttgtttctcaattttagtggatgcttcatctacttagctgcataatgtatttcgcacagc

SEQ ID NO: 6188 - DNA, 696 bp, Aspergillus oryzae
cgatcacagtccccaattctaatccaacctcagatccaagtgccggtatgtcggagaaggatagtagcggctcagggttaagtggaggcgcaattgctggcgtggttgtcggctcgattggcggcttggctgctattatagccatcttcttcttgatattcttcaagaaacgtcagcagcgttcaacaagcccaagtccgagcgtctccaatggcttgctagatggtaggaacagcaaaggttctcagatgagcgtcgcgaaccgagcgttctcggacaaccacagccatacgttatctgccggatcctcaagattaccaacgtttaccgatactcgcttgaagacggatactgtactgttcgcaggcggccgtcgtgacagtgacgtgtcactccaggacaacgaagactattctcggccagttcttcggcttacgaatcccgactgatccgttccaacaagagattctggcttctttcttttgtcttccctttttcgttggcaactcgattgtgcgttcggcgattatagcggcttatgatacccattttcacatatcccatctaccggatccgggacttgacagctcggactcctcgggccgttcatgcttggaggggcttacgggtctccccgtagtgcatggttttataattctcgccatggaaacaaccagaacgctatgaatgtcatat

SEQ ID NO: 6189 - DNA, 695 bp, Aspergillus oryzae
  misc_feature (1)...(695): n = A,T,C or G
gaataataaacggcctctttttaattgcccacagtacaccaccataaagaggaaaattccaacactataccataaaccgaacattcaaaccgtcacaatggctacaggcccctcgcccctccccccaacattcattctcaattcgaagtccatctcccaatcagcggcgcatgactttctcgctgcctacatcgacctcgccgctacagaccccgcatatcaacccaacgccggaatcagcgagcatggcccggtttcgcgtaccacagccgctgcgcctaacctcacgatacacaacttgaagcgcgtgaaggccggcctggcgggcgaggtcctaggacgcgatttggcgctcgctaagctggaagagggagatgcgcagcaacagcagcaagtgggggcgaatggagactgggaggatgcgaagaagttccaggagggtgagaatggcgatgccgtgcaggacgagaacgatgcgcangggcagatggaggtagacgatgcggaacaggatgctggtgctcttgataaggaggaaaggaagcggaagaagaaagagaggagattggcagagaagaaggcgaaagcgaaggctgagactcaagccgaagagtaaatccggcggcaaagggaaagacagtgagtaaaaaatagaaaaagaaaaggcttgtatggntctatgatttgaaggattg

SEQ ID NO: 6190 - DNA, 929 bp, Aspergillus oryzae
gcctggcctgatactgtcgaatttttgagatacccatacgttgactctgcatttgaagccttttttttttttcgattttgactgtcgctacctctttcgataaccggcagcttgcctagtgatacatcgctgcatccgctcattctatgaactcgccatcaccttgcattattcgaccgcctgtcccggatacagtgtcatcgacatccctgcagcatgtcccgcccaagtctcagtattggaagtgactccctgcgaagttgtctagcgccccgtgatcaatcgtccgactccggatccgacatctgttacgacacagccctgccacccatcacttccaagcagttgattctcaactctcgatcgtgccgcggctccgatccgtccatcgtggtaggaagttttcgtggaaaccaaaaagccgcagcagccctcggtttcgccccggacatgtcgagcatgacgcgggggcccaatgcccatcgccggaccggaagcaccttgaaaaccgtcatgagaaaaatattcacccgcaaagcacggggtcaggcggacggttgtgaggaggtttctccggactttcggctcaacaattcccaggaatcgcggccagagaaggacacaacgaattacgccgcgctctcgaattcattgaaatcaaaatacagcaacccggcccgggacgagctcaaagatccgaaagcttttgaagatacattattaaagctcgaaatgaggccaccccgaacccgccgagccacgttgcccagcttaatcttctcggaagatgaccagtcccgtgatgccctggatgcgttgattcattcagaccccgccgacagtcgaaagtaaaaccccccgcctcggcgaacatgatgaactgacagggccgagcttcctgcgcagctagggaacgctctacggagtgc

SEQ ID NO: 6191 - DNA, 711 bp, Aspergillus oryzae
  misc_feature (1)...(711): n = A,T,C or G
tggggnttatgctcgatcccaatttcggacgaagcgccgagacagccatcaattaactcaagggtgtcagacaccgttgaaaggaacaatgtagacgcgacacaaaaccctatgagtgacaccatctttcctgtggcaaatggtcaggatctccgggccctagggtacctttcggatagcttgagtgccccaaaagagagcattggtaatgctgattcccatgtcatctcgcaaactccacatggggttacatccgccgagatggaggatgccctacggctcatccctgcgaaaccttacacagatatactagtgcagcattttctcaatgaaacgaactatcagtactacagtatataccccccaacattctcccgtgattactctacatggtggttgggcaaggtaaaggggcagccgttgactgctgagttcacatgtcttttgttacgtgtctgtgcatgttctgctcttgtcctttttccaggggagcgacagaaactagaatctgaattaggagaaaatattcaaagcctttcagagcgttaccaccatgctgccaggcgactaagcagcactatccctccagggaaagggggcctgacacaggtgcggcaactattcctcacgggctcgtggttcaagaccgaggctctgnntcgtgagtcgtggcatgctcttaactctgccatccacgaagcccaagaacta

SEQ ID NO: 6192 - DNA, 522 bp, Aspergillus oryzae
gtcgcctacctcggctccatcccggctgattatcccgccacccagcaagcccggtttgataagcttgcccacctcgacctgagcaacatcaagatcgccgcaccgcccaagcccgctgagccacagccagtggccgaggagccagtcgctagacctccaccaactacctccgtagccgtctcgatctccctggctactgtcctgtccgtccagaagaagatccaagagactttgggtgttaacgtacctcttgcgacattcctcgcccgtgctaccgacctggccaacgacgaccttccccgttcgtctcgcgagaagcagtccgccgacgagctgttcgatgaggttctcggcgcaaagcccatccagacatcccggggcgattacgttcctgagttgaacgtagttgaggcgccctccgccgttcagccggccaagcctgttaaggaagacatcatcgatattctcagcggcaaggtcttcaaagcttgtcccccgcccttgggggtggaggctccggcg

SEQ ID NO: 6193 - DNA, 584 bp, Aspergillus oryzae
  misc_feature (1)...(584): n = A,T,C or G
tgaagacgctggcctctcctcttttgatgtgaagcaactaccggttgagcttcttgtcaagattgtggttcctgttttagctcgtgtagaccaatctgccctgcagcaggccgttgatggtgtacgaatgcggtatcagacgctccagaagcagcaagctgcgcagcctcctccaccggcaacgggtgaagaagaagacgatgactatgagcccgaatatcaacccatggacgtgcccgaacaggcggcagagcaggaagacgcactgtcggctgaaccggccgatcttcagcccgacttggtgtcactcggtccttttgtgctcccacaaccttccccactatcagaaaatgaggctgcagagatcggccgaagtgccgtgggaagagtgtttgacatgcttgcatcgagcggtgtggcgccaaatactgganaaggaaagagccagcaacacctaggtttctcgaggctggctggcagcacctttgatcgggacgcctgngtaacactactcacncgactcgcgacgcgggcgcctgctggttagaggtagaccacaagaagaccgatcaagacccgtcgtt

SEQ ID NO: 6194 - DNA, 520 bp, Aspergillus oryzae
gatgactatttcgatccaatggatactttgccgatcccatcaatcgatccggatcaagtggacatgttgagtatcacatcgagacggacgaagaaatcagcccccagtgccagccagcttcgtaagaacccggaaatcactttgaacaatggtggtggtagcaggcccgggtcgtcctttagccgatacttcagaggaaggaaacgtaccagcgatcgcatcatgcaggaaatccctggccttcacgattctctcatggacaatcctatgatggcgtactcatcgaatcgatatggagcggtcgacagaaaccacattcaggcggggtcgcgtgctaactcgctgacggccagccgaatgggtgactatccaccacatccttacccagccagtaggaggaacagccagtctccggcgactcctccctacggtccgcctggccctcgaatgggccgaccaggaacatctcaagatccaagcctatggccaacggaccggcccccgggggggccaacctttc

SEQ ID NO: 6195 - DNA, 658 bp, Aspergillus oryzae
  misc_feature (1)...(658): n = A,T,C or G
aatgatatcgacaggcgggctcacgagcatcttccgaaatgcttgacatatttgatgtttgatgcattccagaagccatgccgaagccgacattcccttagaaggcgtctgaaggagttcccactgttaaactatgcctctatgacctggggacagtattgtggcttacaggcccctgctggtttcgtgctcgggaactctgaattggacgagataatggatttctttgcaacatgtgctctacacagtggcggtaactttaggtcctgggtccaggtcctgatccctgaggctgctaccgaagaagcttggtcaacagagccattgtactatgcggcttcatttggaatgacgctcgtcgtggaaaggcttatcaaaagcggcatcaatttggactcccctggtggccgtcacgatgctactgcccttacagtcgcgtcatacagaggccagctcgcagtggtcaagatgctacttgaggcangtgcagatccgaacttgaagattgcatgggatacaggtctcggtgggcaaagagaaaggcaccgcaaggtgaacgctttatggcatttgtcgtaagtcatttgaacaatcaagtactcggtaggaattgacacaggccgtaccaacaggaactcaggtcataaaaggcttatta

SEQ ID NO: 6196 - DNA, 690 bp, Aspergillus oryzae
  misc_feature (1)...(690): n = A,T,C or G
ccccagtacaatcaccacctctgcctcctgttcctacgtcgcccgaaaggcgtagctcagtggcgcctccaccacctcccagcatgcctccccctagcgctgcccctcaacctccatccacatcacggagcaatcgtgcatccttggatgttccgagaggcccatccaacctgcggaggtctatggacataaaccgtccttctgttgatcagggttacattgccatggatgttgatttggcggaacacacgctgtggtgggcgcaaccgaataatcctcctcctgccttccaaaacaggaaagatgttctgttcgaatttgaagattccggccctgcaaatcgtagcggaagtagcacggttaccaaagaagtctatattctattcatcgactactctcaaactataatcaccgtgaacttcgatgctcggaatccttccgatgcgactctggagcaacgccatgaagctncccctcttcaacctcgccaggaccaactcgaaaatgcacatctccaaatcggaacccgcatcgccactgctgtgaacggcatncaaaatacaactgttgcagatggcactccgattcgtgctattgaagaccctgctaggcccattacagatgccctacacactgtccggacacgtgcctaccgtgctttagttattccaatctggcaacccctcccgt

SEQ ID NO: 6197 - DNA, 739 bp, Aspergillus oryzae
ccccttatcatcgcccattcacccctccggctgagattaggcctatccgtgatgaacgaccctcgtctcctggttccacttacccacatcagcagtttcatcatggtcctagtgtgcctcctgtacagggtgctggcagcactggaattgcgggcggtgcccccgcgcctccatctgccatcactgccgccgaggccgctgctcgtgaacgtgaagatcgtcccgcatctgcaatgaagcgtggccgcgagtgggaagccgagtccgcaccggttaagaagatcgccaatgaggaaagccgtgctcgtctcgatgaacagcttcctcgtcgtgtcactcccccaaaccgcatgccttcccccggcgagatgcagcgtcgtagctcgtctgaagttcggcgcgaagaccaacgtcgtatcaatgaaagttatcatccttccgaggcggctcatcaccctccgacgctgccatccattcagcacatgccaccacacgcctctggctctggtcttcctccaatggctgaagggtctactcccgcagccaacggtccacagcccggaccttctgctcctgtgcaggttaaggaagagccggcccgcggcgagcaacctccggctcatgaaccagctgcacggaagatggacgtggatgagaactatgatgacgatggtgatgatgattaaagagccagcactgctgtaaagggcagcccatctgccaccggatcgggcaatgc

SEQ ID NO: 6198 - DNA, 671 bp, Aspergillus oryzae
  misc_feature (1)...(671): n = A,T,C or G
gtcaaaactctaccaattttttacccaccacacaaacaaccacttcaaccacaaacaaccatcacaatgtctgacaacggtgcttccactctcaagtcctacgtcgactctgccgctggcatggtccagagcgctgtcggtgccgtgactggcaactccgctactaaggccgaaggcgatgcctcccagcaaaaggccgccgccgaacacgatgccagccacaccaccgccaagctaggccccttctctgccgaccccaacactggcgcgacagccaaggaccgtgagcagcgctccaccggcgcctgggatcagactgtcggctccgcgaaggagtctctgggaaacctcatcggtaacgagaacctgcgcaagcagggcgaagaccagaacctgcgtggcaagggtgccgaagctgagggacagctgaaggattttggtgagggcgctgccgatcgtctgcagggtggtcttgaaaaggcgctgctgctgctactggtgatcgcagcgaggaggcgaagtggactcagattcttgatgaaggcaagggtaaccanaggggggctgaacttggattgcaaaaccatgcttagaatggactttaccgtcaatattttggatacccttgcaactgggatgaatataatgggttacggaattgatgggtttgg

SEQ ID NO: 6199 - DNA, 712 bp, Aspergillus oryzae
  misc_feature (1)...(712): n = A,T,C or G
cgagggctttacgactcgctccgattcagtacggcgcgaggagccgcaaagcatggctcataatgtgatctgctgtcacagaatcatacattgagaggaatatcgacgcccagcttatatagagctctgtccctgtcgggcttctcgtgcttcgtttgcacagtaactcttgctgaactcaccaacaacaaacaagccccaagcgcactaccgccccaatgtattctcgcaaccaggttctagcagctcttgccaccgtcggcatcacatcggtgaacgccgccatgggtcccgcacttagtactggccctgttgcgtccaactcgttcatccgcgaagctacttcgacccttatcctgccaaaaggacccagcggaggatctacggacgccatcacctccctatgggtgggtatgggcacctcgaacggtgacttgatccagtccattgccgacaattggcaacagagtgactggacgatgtatgcctacacgctcatgaagaccagcgacacctcacagatgccaatttatggtgatggccangagaatgctggcgagggggacaaggtgacgatgcactacaaattcgacgatgcccagtggaactacacacagaccgtncaaatcaacggcgagactgtctcgacgctcttcaacaatgatgggcaggctcangggctgggcaacttttgttgaatgtcccgagaaca

SEQ ID NO: 6200 - DNA, 622 bp, Aspergillus oryzae
gacatataacaacttcctgattcttcttcatcggccacatccaagagcttccgcatattcagacgactacggtccgcatgacgcagaaatctgcagtgcagccgctggagtcatcgcttccatattcgaggaactccgcctcaacgaccggctgaagtttttgtggtactctggagtgcatacgctcttcacagcaatgattcaagttcgggtggaacttcgattctcaaatcctgtcctcgcaatcaacgccttgcgccgcttcgactcggcctcatattctctccgtgaacttgcggagtattggtctcacgccaacaccatcttaaggttatttcaagactctaaacgactccaggaggacttgcgaatggctaccagcgaaagaccaagacgattcagcacacatgatcaaaataaaaacacaactaatccctctaatcctcatcccacccccaccccgaatctcaattcaaataccactatacagagcgcccagaccgagccgcgacctccatacgaagttcctacccctgaatctccgcgtatgcccccaaccaccatgagtccacatcagaaccagccattcgacagctggatcccgtctagccatctggcttcc

SEQ ID NO: 6201 - DNA, 817 bp, Aspergillus oryzae
  misc_feature (1)...(817): n = A,T,C or G
gtctccggctcttgaccacaccgccattggactcttttgtcctccgtctgccacttctaaaagtctttctctccttttacagtcttttttcttttctgtggtcttcaagatgcccgctaccgcgtcccgtgccgttcttcggcaatcgcagttcctgacccggaggaccgctgtcagatacgcctcctccaccccggagtctgctcagaaggctagcgaggctgcatcctctgctgcctccaaggcatctgaaggtctctctcgtgtcacatccaccgctggtcccgctctttcgaatgccgcccagggcgtcggcagtgctctgaggaaggttggtggaaggaccggaaaagtcatcgctttcgtcgattctatgataccccctaccctctactacggaaaggtcggccttgaactcgccaagctcgttttccgtggacagaacatgactcctcccaacctggctaccttccagtccttctaccagcctctgatcaacgctttccgcagccctgccgcccttaagaacgccaacttcgtctctcccggagacatcgccgcccgtgtccgcaatgccagccctaaggaactcgccctggccggtgttactctcgcggaggttatcggattctttaccgttggtgagatgatcggtagaatgaacattgtcggctacaggggccaccctgagcaccacggagaccactagatcacccgcaagcactaatgcatggcctgtnctttttatatttccttttatcactgcgttctgtactattgtatgatagacgatggaanttaactgttgtctgaggta

SEQ ID NO: 6202 - DNA, 669 bp, Aspergillus oryzae
gaaaaaagaaaagaagcatacaacatggaagtttgacgatctagcaatgcaaccgaatcatccaccgggggcgaaaagcacattgaacatgggttgacagcgacctcaccaccgatgccatgctgaatgcccgattacgtggtatgagccggattcgaatgtgctattctgccccttttcttttaggcgctcgttgcccattgctgtccgggcaccggcctatcaattgctttgttcctatggctgggatcacaccatatactactcaccaccaggacctaaaacttttcacacctggagcaaatggccctatcagagaccaaattcccacgggtaatatatgacccgtgggttgaaagggcgcccgtggccctggtggagccgactgtccgttaccccttttcagacctaattccatacagggcgaagggaaacagtctctttatatcccgtggaacataactgcgatgattctgggtggtgactatttttggttctgcaatccgctccgatatgcaaactgcagcttgctgtcacctggagatgtacctgaaagcctcgtattggttgagggtcgggcccatcatttctatcatacatgtgtatgtgggcttttaattcgatcctgcagataaactaattgctggctgttcaactgccaatgcaact

SEQ ID NO: 6203 - DNA, 682 bp, Aspergillus oryzae
gagactctcaaatatccaccctttactgtttatcgccagccacctgatcgacaatgtccacttccactcccacactgactgtctacgacatcctgatgcgcgagcccgtatcggagaacgcctgttcccccaacccaacaaaaacccgccagactctaaacttcaagtccgtcccctacaaaacaacatggatcgacatgccagacatcgccaaaacccgcaaatcgctgggtatccccgcaagccgcaaattcgccgacgggagcgaattctacaccctccctgtactggttgacaccgccacaaactccaaaatcggcgactctttcgatattgcggtgtacatgcacgagacgtaccccagtgtgggcggagaccttgttcctcacggtgtagagctggatttccggactagcaataccgccctgctagttccgctttctgagcttattgaggttgcgagacgggagaggtacatccgctacctgaattcaatacgcatggtgaaccccggtttcccgtccacaccaacctaaacgtttgggggtaccgttaaacccgacactgcgaagcctcaaaggcggattttgtgggggggggggagccctcttttgggggttataatgtccccgtgaggaaaaaggggtatatgaatcttttaaaaaacctcggggaatttccg

SEQ ID NO: 6204 - DNA, 479 bp, Aspergillus oryzae
tgatggccgctcactatacggcgaatggtgcacgcgcactggtggacaccacagctcggtttcttcgatgtccacgccgaacgttgggaactccgcggacgatataggtacaccgtcgtccctcatgggtcaggacctttcagcagacgaccacatgcttgcgtccctacgtgttcgactccgagatctgtctgccgagtttcggtcacggttgaatacgctcctgggcgacctagcataccaaccagatgtagacatgcggttcctcgctgtagtaatgaacttcaacgacttctacgaaccggtacgaaagcgaaggacagcgacgagctctcgagacaaggaaagactccgccgcaaagcagcagaggggaatgcacaaaaggaaatgaagaaagagagaagagatccaaccgggccagaaagcgccagtggctcaggtgcccaagcaccataatgtacttttcacctgaatggtg

SEQ ID NO: 6205 - DNA, 691 bp, Aspergillus oryzae
caactggctcactcggggtctctacgctggccaccgtcgcgtcaacctgaacacccagattgatgatatgttcctcgaaactgatatctactaccccaatggaacgaccttccgtattaccaccgctgatatggatggtatctcgagctggctcccgaccatcaacggcaagatgaacgccggtagctcatactttgttgaggtcggacacaacggtaacggtgtcatcgaagccgctgccggcaaggatgccgatgcctgcaacggaggtggcattgaatacgactcgcccgctgatactcctctggagttcaagaagcctctgggcaccggtactgacctttggcccaaggacctgaccgagtacaactggactactgagtgcaccaagttggacgatcttttcgtctggtggaccaccccggctaaccgcgacaagtatggtcacatctctcacactttcactcatgaagagcagaacaatgccacctacaacgacgtgaagagggagatctctttcaaccaggcttggttgagacagagtggtttctatgatgccaaatatttcacaatccacggtatcatcccttccgccattactgggttgcacaacggcgatgcctttgcggcctggtacgaaaacggattcaccaactgtgttggtgataacaatgcacaacggttctcaacc

SEQ ID NO: 6206 - DNA, 687 bp, Aspergillus oryzae
ttattcattcttacgactttgcgacactacctatgtaacaggcgactgaagctattagaagaatcttggcattgacggactttgtctgtttccttcaagctctccctcttcaatactccattgataggcggaggacagaagaattcaagcactactctatttctttgcatgaatattacactgtcgcggtagcgatatttcccttgttattttgtctggcggaatctaaactaacagtttactgcgggacaattaaaatatgtccttcaagtcaaagaacctcgaatatgaggcgaaagaaccagcattcttgcagcgacttcgaaaccaatacggagatacctccggtcgccttgagcgcccaattgctcgaccccgaaaactaaaagatgccgacgatgatgatgaacctacttatgttgacgaagagagcaacgaagtaatatccaaagaagaatatgaagctctcgttcgcgacagcaataaggaagtcgaggacacaggaaaaggagaaccagaccaggaacaacccacatcacaagataaaggagaggataaggcaagtactgcgcaagaagtgcccatatcaaaacagaacatggcagagataggaggacctaagaagcgaaagcaggcgaaggttattggcgaagaagagccttcagcagagaaagaagaaacactgcg

SEQ ID NO: 6207 - DNA, 224 bp, Aspergillus oryzae
aagggattttgataccaaagaggatgacaagcagcgtccgaaggataagaagaaagcggtattcgactgtgcgatatgcatgcaggaaattgaggtgcccgttctcgccgcgcccggtggtgctggaggcagcagcatgacagatggagccacgagtatccttagccgtcgggcgtatatggtcactccttgtcgacatatctttcacagcacatgcttagaga

SEQ ID NO: 6208 - DNA, 674 bp, Aspergillus oryzae
  misc_feature (1)...(674): n = A,T,C or G
tcgccacatactatcaaaaacagctacaatggcacagctacaatatctattcgcttttatcctggtacagctccagcttgctggtgcccaggatagcacagctaccagcaatacttctagctccaccacaagtacagcaatgggcaccgcgagcccgtcagctgtacaaacagttgatgttggtgaacatggcttcagcttcgaccctgatactcttaaagttgctccaggcggcaaagttgagttccacttttatcctggtaaccattcagtggcgcaggcctcttttagcaagccatgtcaccctatgaatgatagcagttttttctctggatttattgcgccaactactggtgaatcggacactgtcttcacggtcactgtgaatgacacaaaacctatttggtattactgtggccaggtcggtcattgccaggcgggtatggttggggtgataaacccaccggcctccggctcagacactttagaggcatttaaatcggcagcctcgaatgcaaatggagacagcgtgccatccaaggtccaaggtggtactctcagtacatcgagccccaaatcctcctcgacctctaccagtgagacgagcactcacagtagcacagccaccacgagcgcgtcacccactaccaccaatagcccaagccctaccgnca

SEQ ID NO: 6209 - DNA, 687 bp, Aspergillus oryzae
  misc_feature (1)...(687): n = A,T,C or G
cgagcactgcgatcggggttggggtcagaattcggggcatacgcaagcgatgcgcacgaattcaacaacgccaggaatggacaatcttggccctgccgccgtgggcggtggtatcagtgacggacgcaacctgcctgctgaacgaggctacaacaccaccggatccgacaacccatacgttccaacccccccaggcggcggatcgcacggaagcgccgagaacttgcggccccgagactcttacggttcgaacgttgcattgggtgccgctgccgctcccgcaggccagctgacccccggtggctccaatccgtcccaacgcagtttatttgatagtccgtatcagggtgtgggagctatggatgcgggcccatatcaacgacagtccgcctacagtgctgcgggcgactatccccttgtcataaaccctgatgagatcgccgatgatggggatgatggcttcacgcctgtcccgaatggcaagtctgcgaattctaatgcaagagcaattccggcagccgccgctgggggagctgccgggggtgggttatttggctttgttcaagtcgaagaaagccgacaatccgttctattggcctgtgccangggcaggattgggaggttggaaaaaagaaccgtgggtcaaacctacaccccggggaaggaagttccaaacgtgggtggatt

SEQ ID NO: 6210 - DNA, 524 bp, Aspergillus oryzae
  misc_feature (1)...(524): n = A,T,C or G
gaaacaactccttcctccccgccgtgcgcagcgtcacgaaacgcttagaggcgccgcgacatgaagaggcgatgattaaactgggagacgacgcggcggacattatcaagcgtcgttgtggtccgctactgcatggcggcgatctttgttcggactcggagacgttggcgggcttcggaaattgtttcaagacgaatttcgtccgggcggcggtaatgaatttgccgacattgttgcctatggttagtgaggaggtctgtcgggagcagtatgaatatcttaagaccgacaggttgtgggaagagattatccccaacaatatgaaggaatatgccagcgtgtgccagactctgggagatggagcgccggagcttgaccatgggagagtgcatgaggaattataggctacgaatgtgtatatatactcgatggacctttagatattcctggacatgttgcaaacgatgtttgatatcacgggattaagggatcgagattccgcggacataaatgaatcatttctn

SEQ ID NO: 6211 - DNA, 815 bp, Aspergillus oryzae
gccctggaacggattcgacgcgcgcaaatgctgggacagaaaaatgtacgattatcgaaacgagaactcgaggcactggaacgcaagcgaatgcagaccggtggcaagagagattctacacgtggaaaccccaccactaagggttctaggtcgagggatagccccgcgtcagacgtacagcgacgcggatccagtatatcgcagggcgaacagaccacaccatatcgacttgccggtagcagttgggcccgcagctccgatgctccgtctcgtcaatctcaaccacctgttccgtcccctaagtcctcacttcgatattctgagcggcattccactagatccccgcaagcgtccttaagaggtacagcctccgcatatcctctcccggatgaccccggctgggtgccttcgtatcagcttccttcttcaagagatcggcatttgcatgcaaggcgtagctcagtggatcctctgcagggagcctcacggcgaccatcgtcctacatgtcaacataccaagccgtcgctagccccagtgtccggggctcattcacccctcgaaagactgcattgcgatctacggtgggggggtcacacgacgacgatgacgaggaaagcgattcagacgacaatgaccgagtacatatcgtggatgtggttgggcgcaaagtgccgacgggtcgcacagcagtcggcagaggaagccgtcaacgccgccgccgttcttagattctgaagtttcccagtggtgtgctccttgttgatgtctagtgggaattatctctttggttttgcttgggttactgcttgggtgg

SEQ ID NO: 6212 - DNA, 685 bp, Aspergillus oryzae
gggttgactgttgatcctcgtcgcgatacgcgtcggttgacattagggttgcgtcctctgccgccagaggatccgtcagacaacccagagcaacgggctaaccgtatccgatcgttctataaggaatatttcgacgagaacaagaatgggagggagacttactatggtcccgaatcttatcacgacgttgactatatctacgattcggctactggagattactacgacagtgtcccagcaccgtttgctgagccaatacaccgtcgggctatgacccctcctccgcgcctccccccgcggtttcaagggggaggtagacatatgccttcgggctctatcggtggctttagcgatcgaatcaactccccaggcccacgtgccttctcatcagcttctggcaggctgccaggtgccccgaaaatccgcaagcctgcaccttcaccagccccactccagcttctacctacaccccacatgttgaaagatgactctataatgggagctatcgactacgcccccgggaaaagttatagagaccagagggaaggccgtccggagacacctcttggaaggttggaaccgttcagttcaccgatgccagcccccactccacttgtctcaatttttaatagaactggtggcataccgagcccccatgcattgcgggaggtcgggtcataataat

SEQ ID NO: 6213 - DNA, 670 bp, Aspergillus oryzae
  misc_feature (1)...(670): n = A,T,C or G
gtcaacagctttgtttcgtctttcacttcacagctcttagttgttgagtatagcatcatgactcggatcttcctaactggcgcatcgggctacatcggcggtgatgttttgtatgtcttgagcgaaaagcaccccgactacgacattactgtccttgttcgagaggccgacaagggcgcaaagatctcccaggcttaccctaaagtccgcgtcgtgcagggagagcttgattcggctgtagttgaagaagaggcgcaaaatgccgatgtggtagttaatgcggccagcgcgcagaacaataaaggtgcggaggcagtcttccgaggattgactagctccaagcgcacgaagccaggctactggatccaagtatccggcgctactctcctctccgcagttgatatcgaaaaaggcgtttacggagagccctccgacaagatctacagcgacatcgatgacgaggaagatatcaaggctctaattcacaagttcgcagccaagcgtctcatcgaccatttcatcctcaacctgcccgagactgcactttcaccaaagacagacgtcggctatcctctcatcatctacggtcgcgggagagggcccatcacgcagcgaagtgtgcacatccccgaactcggacgctttaccctccataacagatccggatccn

SEQ ID NO: 6214 - DNA, 1093 bp, Aspergillus oryzae
cagataacgtgacacaatggaggccttcaatctacacaacttcctttcttccctctacattcttttaccttttgttattctcgcgaacccagttcatgcggctccttatcagaatcgtattcttgagaccggcagtactttcggtgctccggatccatatggcccatggcaaatgatccccagcattcccaccgaagacctggtctacatcaaaactaccaacaccggaactgggagggtagaagttcacatcgcctcgggttcatcgggattcaggactcgcagccttgaagtcggaacatcatttgtctctgaggataacggaacttggcaattaattgatgcagacggtgacggcagacctgatcttgtttacatcaaaactaggaataccggaaccggtagggtggaggtacacattgcgtccgcatcatccaactatcagacacgtatcttggaaactggaaccactttttacccggaggataatggagtttggcagatggcagacttcgatcacgatggcaaactcgatctggtttatatcaaaacccgtaatacgggcacagggaaggtcgaagtgcacgtggcttctggagcgtcaaactaccagaggcgaatccaggaggtcgggacgacattctacccagaagataacggcgtctggcagatggtcgacttcgacagggatggaaaattggaccttgcttacatcaaaactcgggatacgggaactggaaaagtcgaggtgcatgttgcgtcgggctcgtccacttacaatactcgcgtccaggaagtcggcacgaccttctatccagaaagtaatgggttctgggaactgagtgactttaatcatgatggtgtcctggatctagtgtatatcaagacgcaaaacactggaactggtagcgttgaggtccatgtggcgtcggggaaatcatagtccacacaataatgtatgcccgattgatagtgtcattcgatgtgggagctattgttgttgaaacggtggttactactatcgcaattttactttggaatcggtcaaataaatttggaactgaatttggaaaaaaaaaaaaaaaaaattcct

SEQ ID NO: 6215 - DNA, 905 bp, Aspergillus oryzae
ccaacctccttcccttatacccgtccatgcaaacgatgatatcacagtctctccgtaattacgactgtcgcttgtgcctgcacgctctccctcgcgtccattcccttctcgggaacggtctgctgtgagttgctgactggatctgacgcttgttcccatacatcgaactatacaaaccggtccaacaatttgattgtacacacgggaaataggagggatcttgggtacttctcgccaacatgagtcttcgcgaaaaggttcgcagagtgtttcgtcgctcgcctagcggttccaaatcgaaggacaattccaactccatcaagatcgagtattacaagcgccatgagatcccgccgtccaagttcaagggcccatttgaccgcgagcaccaaaagagactggccgcgtggtcctttgacgacgcccaggccgaacgaccccgttccccggatctttctttgtccccttgcgcatctttgcccgactatttgaggcctcgtgtccaggaggatagtgtggctcctgatgaggttccctcgcttgccccagagggtctgtctgatgcatccgccacgatctccgacaacgagcgcgcggagcgccaggatgacagtggatccacctcctcgaccgcttatgacccggacagctacagcagctcgatgatgaccctcttcgatgaagctatccgtcaggactcgatcgcccaatttaaggagacgatccggtacacgtcacccgtggtccgggccatcttccccgcccccgctgggccccaaagggcgcttcatgccggttgcccccgaaaaattgacaccgggcgttgaatggccgggcaaatttgtggttaaaaccactttctggccaaagcaatttaactcttccattctaacgttccgtgaccc

SEQ ID NO: 6216 - DNA, 701 bp, Aspergillus oryzae
  misc_feature (1)...(701): n = A,T,C or G
ccgtcctctcgccagattctctatcttcataaaccgctcttagtgagccctcaccgcacacgcgacaacaccactgtttcacaacctacccctctccaacccaccatctcgcgcacaatgtccgacgacgcctacatgagcttcctgaacaaagccaacgcggacctggacaccgcgcgagctcaacaagcccaggactcccccaccgtccgtaccgaaacagtcgaaacaggcgtcagcgtcccagctccactgacatcagtcgacgcctactacatctctgaaaccgatgaaccgttcgaacccgtcgcactgcgatgggatggcgcatctagaggaatcttccccgatgcttcgcatctatcgaatctgatctcgccgaatgcggatctttcatcctcgattactacgctatcaccatcttcttttgatcccaggaatcagtacccgtctgcgttgcgcgcggttcgcgccgctgctgcggaatcctctgggggtgatgagtcggcggtggatgtgaaggtttttcgggttgaggttgggccgtcgcggattgagtattatattcttgcggtggatgctgagaagtcgttggttgtggggttgaggacgaaggctgttgagacttagtgatgncttgtgggtgaggtagatatnctaattttggctgggtnnannanannnnnnnnnnnnnnattcct

SEQ ID NO: 6217 - DNA, 678 bp, Aspergillus oryzae
  misc_feature (1)...(678): n = A,T,C or G
gtgaaaatgggaaaggatctataaatagctggctacaccgtcttgccacttcgtttaccccccgccgagtccaagcgtgcaaagcccgcaacacattatctctacctccgacctcatgaaccacgcattcccgatgctgatacaccccgctcgctattcgtagtcaatgttcccatcgacacgacagaactacacttgcgtcacttattcgggagccagctagccgccggccgtgtagagcgagtccacttcgaagccgtaccgacgaagaagaagggaggaatgaccacggcgcatagcatggtcgcgaatgtttcgaagagcaaaaagagaaagagagtgacagtcgatgagctacagaatcagctggatgatgtcgcgttaccgtctacgtgggaccgggaacttcaaaaaagcggtgcgcatgccgtcgtcgtctttgtcgataagcccagtatggtggccagtgtgaaagcggccaagaaagcangcaaaaggaaggatggggaaattgtttggggcgaaggcctcgaggaccgtcttcctcagctgggcttacagcgttatctcaaccatgaagaggttcggtatcctccccgcgcggagttgctgcgcacggtgaacgatttcatgacgatggttggagctgttgcccaggccaggaggaaagancngccc

SEQ ID NO: 6218 - DNA, 1171 bp, Aspergillus oryzae
  misc_feature (1)...(1171): n = A,T,C or G
gagagcatttccctttgcgtcgattatgtcgatctggcgcctctgttgaatcggaaaccgcctctaccactgctgtccgggccccgagggctgcggatgggctgccggagaggttgttggtcgtttccaatttggtcactggtcggttgtttctctttcctctgtacataacttggctttggggattcgggatcgtagagctgtttagatttcccggatgccgccgaagaatctctcttatcccgattgttgtctcttccactaccacggcttctcccttttcctctaccctcgtgctttggtggggtcccactgcgtggcgacgatgcgcctgacgtagtgccagaggggctcccgaacaatctttcacgtacttcttcgtacttgcgttgcttctcttcccgattccgcagcgcaatggcttggcgttcctcgggagtaggctctggtggtttgttgtcatcgtcggaatcgtcgtcattgtcactgttcagagccagtcgtccaagnacagcggctgtggcgttgacggatgacgattgccgggaagagtgtggattgcgactcagaagagtcacagtcggtttgaactcctgtttgagagggacattggagcgcgattccaggaaatgaaacgtttgcggagtttcgctgttcgtgaaagaacggtcagaatgcgattgctcaggacatagacagcacaagagaccagttgtgaagaagaagaagaagaagaagaagaagaagaagatatacgtacgcttccgcccatagttgccggttgaattccgcttgctgcgccctgcgctgcgctttggtcactttggaggatactttcttttccggtggaggcggggtggggtcggacgctaaggtctgcagaggagttcgaggtcaaatcagtggattatagaaagtgaatccagagcggttgattcgattctagaatacggctatgtatagtgagaaggaaggcatacatcggcttgtctttccagtcttcttccaggcatcgggtgtttcagcggagggctttgcgctcattggtacacgattagtctatgggcaaaagaggaaaatgcagatgcagaaggaaacaggggttttcagatgcaaatattgtttataagataagaaatgcgaccaaactctcttcaaaataaaaaaaaaa

SEQ ID NO: 6219 - DNA, 630 bp, Aspergillus oryzae
  misc_feature (1)...(630): n = A,T,C or G
gttgatctatgggattcggatgttacaattccagactcatctggtcaataacaccatgtacctgtgccacagcagctgcgagctgctcaacgtggggaccctcgaggcatatctgaccagagtgaccaagtggatgaaagcccatccgtacgatgtggtcaccattttgatgggcaactcggactacgtcgatccgggcaatttcaccgcgcccgtccagaactccggtctgatggacttggtgtatacccccgccaagattcccatggccttggacgactggccgacgctgtctaacatgatcttctccggcaagcgtgcggtcatgttcctagactaccaggccaatcagacggcgtacccatggctcatggatgaattttcccagctgtgggagacgccgttctcgcccacggaccgagactttccctgcgacgtccagcgtcccccggatctggcggcgaatgacgccaagaaccggctgtatatggcgaaccacaacctcaacatccagatggacgtgctgaatctcgacctgctcatcccgaacacggctctcttgaatgagacgaacaacgtgaccggatacngcagtctcggcctgatggcgagcaatngtaccaaaatctg

SEQ ID NO: 6220 - DNA, 707 bp, Aspergillus oryzae
  misc_feature (1)...(707): n = A,T,C or G
gaccttaaaacttcaagagctatttcatacagcatgcctcaatcattcgctacctttcgcaatcgccgcagcgacgaattggctcgcctagccgatgaacaccttcagcaggacttgcgacaggaagaccgcgatactttgaagtcggctgcttcaaaagtctccttttggactgggattggttccgcagtaggaattggtatgggtctctatgtcgccttcagactgcgcagctcgcgcaaggctttcttcgatgtttttcgcgcgcaggagagacctacacaagtggtcttcgccgatggtcggacagaatctatcccggatattacccccttgctgaagccaaccacgcttggtgatttcgcaacatatttctttgcttctgctggtggactctttttgggtggagagctaggcttcttgggaggagcagctagtggcagtcgcaccatcactgccgacccggagcagaagaagaggattgagaccgctttccggcgattccgggccgatgtactgcgcaaagaagccgacgcgttggatcgcggagtgagcgttgaggataagatgttttgatatcggtgtttgatgtggtggtaatggtgtngcatggttcggcgtatacctaatctgtctatctcgaagtgcttagcacttcgtatggtatttgtataaaacgtccatggcgtaatgccagaatctncaaa

SEQ ID NO: 6221 - DNA, 699 bp, Aspergillus oryzae
  misc_feature (1)...(699): n = A,T,C or G
ctgaaggaacaacattatattcattgaatcctaaacgccggacgctcgatatggccctagagcaatggacaacggagcaatccgaattgcgaaaaaggcaagaagaagtagatcatgagatacaggcacttgaggcaggagggggagtctggaaacaggttgttttagaagtttgtcgattcgaaagacggttaaaggtagagatgcgccgctccctacaaaatcagtcgcaagttttagaatcttctagggctgctgagaacaactccgaactcgaccatgttcgtgggattttggaagacctacacaagacaacagagcacgtggaacactatctgggaattgcagaggacaaagactggaaactgcttgtctgttgcattgctgctgaactcgaagcattgcgggaagcacgagcaatgctccttgatgccttcgatattccggatgaaggcccgtcgcagtcttcagaacgaanggtgcctgacaagtccggagaaaataatctgcataatacccatcaagatccacttggagttgacaaccccgacccttcagctgatctattacaagatgccgaaaaacatcattcttgacccatatctataacggaagaatgagaatgatgagccggatcctgcgtggctgctttccaaaaaccttaggaaaatccttaacctcctatgataatgaacaaan

SEQ ID NO: 6222 - DNA, 691 bp, Aspergillus oryzae
  misc_feature (1)...(691): n = A,T,C or G
caataagccagaaatcaaccagcgaaacaccgacaaaccaagaaaaggaggagagaagaaacagagaaacaaaatgcccccaaaatccaaatccaaaaaggacatcgctccccccaaacaacagcagcaacgacaacaaacccccaaaccaaattggcctcctctccgccccctcatcccctcatccgacctcaccctcgatcctctcctccccgaccaaatctacctcatcccaaacttcttcaccgcaaacctctgcaaaacctacgtctcattcctctcctccctgcccctaaccactacccctgggaagccgaaaaagggcgatgccgttcgcgtcaacgatcggttccagatccaggatgagcggtttgcggagtcgttgtggagcgggacagcgctgaaggacctggtgatgaatggggatggggagggggagaggtcgatgaaagagatctggggcggggagcctttggggttgaatgcgaatattcggatctatcggtattcgaaggggcagttttttgcccagcattacgacgactccaacaccctcactttctcttccccttcccatccctctcaacctgctcgcaccacgtggacccttcttatctacttgactacctgctcagggggcgaaactatcttctacccggaatcgactcgcgggaatcgcaaccccgagccn

SEQ ID NO: 6223 - DNA, 1213 bp, Aspergillus oryzae
  misc_feature (1)...(1213): n = A,T,C or G
cggagagcgattggtctccgtgtccgtgaaacgaaagaagtgtacgaaggcgaagtcaccgagcttacgcctgaggaaactgaaaatccattgggaggctatggacgcacaatcagtcacttgattattggattgaagtctgcaaagggaaccaagaagctgcgccttgatcccagcatttatgaggctattcaaaaagaacgagtcactgttggagatgtcatctacatcgaagcgaacactggtgcttgtaagagagttggccgatccgatgcctatgcgaccgagttcgaccttgaagcagaagaatacgttcctgtacccaagggagaggttcacaagaagaaggaaatcgtacaggacgtgacgctacatgacctggacatggccaacgctcggccacaaggtggacaggacgttatgagcatgatgggacaactgatgaagcccaagaagaccgagatcacggataagctacgtcaggagatcgacaaggttgttagccggtatatcgaccaaggagttgctgaactggttcctggtgtcctctntattgatgaggtccacatgttggatattgaatgtttcacctatctcaaccgggcacttgaatcctcaatctcccccattgttatcctcgcctccaaccgcggccacactgtcatccgcggcaccgacgacatcagcgccgcacacggcattccctctgacctcctcgctcgcctcctcatcatccccacccacccttactcttccgacgagatcaagaccatcattcgccttcgcgccaagacagaaggtctcaacattaccgatcccgccctcgacaagatctccgagcacggcagcaacgtcagcctgcggtacgcactgcaattactgaccccagctaggactccttgtcaggacgctcgtctttatatgcgattccgaactgacggcatacactgtcgcttttacatagtctaatatttacgaagagagaggcgataacaattccgttaatacgccaatgatgattcccaatttccatattgtcttaactcaaatgaattaacatgctatcaagagaacaaagattagagctcagcatcaaaacaatggctacccagataaaaatatcctgcgggccgttcaacttgcattctgagggccgaataatgtaattagtcttggcacgcttaatttaagcccttccccacattccgtttac

SEQ ID NO: 6224 - DNA, 767 bp, Aspergillus oryzae
tgaacttttttttttctctttcccacttcaacgttcatctttaattgaactcattattctacatacataaccaacacaatacatctacttgagtatacataaataaggaaaagaaaaagaaaaagaaacaaaaaaaatgacagtccaatcaaccccccacctcgacgccctccaacgcgacggcttcgtggtggtccgctccatcctctcccccgaagaagtcgcccaattccgtaccgtatcaacaaaagccaccacactcacccgaacaggccactggcctcacttccgcaccgtcccgaagcaattcccgccctggccgaccacaccccctcccgcctcggagggcggcatctggggcgtgcagcacctcctccacccctcgatgccgggccgcgccgaattcgcgcgcttttacttctccgagaaagtgctcgccgtggccgaggagctgctcggcgtgacgcgcaccgagggcaacgaggaggagcctctggtcatggaactattcaatctactggttgcgccggagacgaaggatttcgagctgcggtggcatcgcgatgatatccccgagacggtgggaccggaagaggagctgaagttgttggagtcgaagagtccgcaaggaaagcaaagtcatgcgcagtataatttggcactttgtcctgatgcgtcgctgaatgttgttccgggggtcgcatcgacgggtgaggactggagcgggaaagaatgctgggccttattagccggatatgccgggttac

SEQ ID NO: 6225 - DNA, 664 bp, Aspergillus oryzae
  misc_feature (1)...(664): n = A,T,C or G
gtttttaaaatgcttaccgtttgtatccttcttcaggctcttctttgcaaatcagttattgcgtggaccaatggcgccagtgcgaccggaccgactgatccatccgttgttgatcactgcgagtactgggtgaacaacattggattaagcgacagctgcgagttgattgaagactactttgggatcacgaggcggcagtttcgactttggaacccatctctgtcaccttcatgtgtcatgactcgtggatggagctattgtgtcgcagcgccgtcttcggcgacaacgtccaccacatccaccacatccatcactgctacccgaccctctgatcctacaggcactatcacgtactccggcacagcggctcccacgcanagtggcgtcagctcatcctgcgccaagtatcatctagtgcatccaggagatacatgctataccatccaggatgaatatggggactttactcttgaacagttttattcatggaatccctgcatcggcaagggttgcattggtatacagccaggttattatgtctgcgtgggcactggatccaagtctacctctatttctatgacgcccactaccgggtcttctactgcaatttcgagccaagaccagtgaaggatcgtccgcattcaaatcttaaccacaccaaacg

SEQ ID NO: 6226 - DNA, 689 bp, Aspergillus oryzae
atcatatataaggggcagttgctcgtttccctctgctattcttccctcacagcctttatctgccaaagatgcaccgatcaagcagtcacacctaccaaacaaccagctcaagaggctcgtcgagtcatgccagcagcagtgcctttagtccgaatgccaatcccaacgaagactggaccaaaatatcagatcttgccgagcggcggcgtattcagaaccgaattgcgcagcgcaattatcgtaaaaagctcaagcgccgcctagaggaccttgagaagagggctgcttcagcttcagagtccccagaacggtccaacgagaggactgaagcgccgaaaagttcgcatcccgccaagcctcgtgctaggaactctcgcgcttctaagtcgaacggggatgccactagacgggctacagcagagaggacccccgcctatgatggttatgcagcacaggatgacaggggcgcgatgttctcccatcatgtacgcgccaagttttcggataacccccgccgggggaatctgatccctcataattcccacttgaaaccctacgggcagtccccctatgggccatccgaatccctattaattcaattcccaagtaccctccatggatttggttaaatggaaaagaaccgggggggcaggggcatctattttttccccggtacaaagaactacaag

SEQ ID NO: 6227 - DNA, 703 bp, Aspergillus oryzae
gcagatgatattatccaatgttgcgaatgcttcgctttttatgtaaatgcgggccgtcatcatgctcgtcaatgcgagtaaggccgccagggagcgtagtctgttgggacttggcgagttccaacctttccattagccctccaatggttagatagtcttgggctcccaggccggtgggttggtgctcaaaatagttcatcaccaactccaatgccctcctagcttcatcctgggtcggcgagccaggtgaacttataggcgaaaccgtggttgacttcggaaataatggtggataaatggattttgccttgatttctgggttgctgcggttacgcttgattgtgctggatgaggtatcgagactaggaatagcctttgggttgtactaatccataaatggagatctttgtaaagggcgtggttgaatcccatttttcggggggggttaaacgaccttctgtttcccccattatgaaaggaatctttggctttttccttatatcactatatttacgagggcctccccccattgttgttagcctctatacaaaacgaggacgtttccctttcttttctcctcatatatcccataaagagtcccatcatttttactttgccttttttcaaaaaataattttttcccctaaaaacagtatggtgtatatcaacccggtggcggatattcccccctattactacatct

SEQ ID NO: 6228 - DNA, 269 bp, Aspergillus oryzae
tcagagtatgtacgctaagtactgtgaaatcactactgccttctccagtttatccctacgcaagatacgatggctatctggtacacccttggcgtggcttttttcgccgcaatcggcactttccttttcggctttgatactggaattgcgaccacaacaatcgcccatcagagttggattgattatatgaaaaacccttctgatggacttactggggctgtggtcgctgtctatattgctggcgaagcagtcggtgctcttacgcagac

SEQ ID NO: 6229 - DNA, 682 bp, Aspergillus oryzae
  misc_feature (1)...(682): n = A,T,C or G
cccctcaggatcgacctgcgtgactgcgttacagtaatgccatcttccgtcgacatgctgagcgacatgaccggattaccagaagcagtggccagtgcttacattccaaccgatttgccacgattggcggactgttgggtgacgatgattcatttgagcaaactcctaggtgacgtcctcagtttaagctaccggcctcttgggcctcacccatcgcttcagcaggtagaagcaaccgagacagaaatcctactatttcaattcccggacaactccgacgcagaccgaagtcgcctggccactttttatatgtatcatctacagttgcactaccaagctttactcattacattctatcgcccttatatcaccaaggtgccagaagggctaccagtggcccagcaacaggcgtggcgaagtcaaatacgaaacaaaatggacgccgctgccctacaaacgaattctattgtcgataacctggctcgtgaaaagctgctagaattcggcggtccaatgacacctncattactggtaccagctatgcaagttcatctcctcaactgcaagtcgtccgatggttntattcggcgactgggccttaacaagctggaattgtgtatgatgatcttagagcagatgcagcacacatatncatctgcctncatatttcgaagcatcttcn

SEQ ID NO: 6230 - DNA, 679 bp, Aspergillus oryzae
  misc_feature (1)...(679): n = A,T,C or G
acaaaacccgccttcagcgtttacttcacagtagtgcggctcgtcatgctgcgctcttctgttgcaccgggtcggcagttgctgttgtcttccgttcgccaacggacggcttcgcaatggctgtctagagctggggcaagcagccggctctctggtcagagattctttgccgatgccaaacctcctaccagtgcccctacccctgtctccccatcatccgaaacacccatccccccggagactattcctaagccatcgcctagtgagcaagattctcagactcctccaccacccccacccgccccggctcgtaaaacgggacgtttccgaagattccttctctacctgattctcacatctggtttcgcctacggtggaggtgtcttccttgccttgaagtctgacaacttccatgacttcttcaccgaatacattccgtacggtgaagaggccgttctttacttcgaggaacgggacttctatcgtcgtttcccgaacaccctgaagggccaggcccgcatctctggacacaaggatgagagcaagaaggttacaatccccaagagagagtggcctgacttcnaaggctgcanaagagcanggttctggaancgatctttcccaaaaaaggccccatatgaatgctgtcaaggtgaccaaacccaaatcaagaccgaag

SEQ ID NO: 6231 - DNA, 671 bp, Aspergillus oryzae
  misc_feature (1)...(671): n = A,T,C or G
caacgactgcgatcaatgacctgggaggggtggaggggcagacaattcattcaactcgtccacttagctaatccttcttggacgttggggagggaaattgccgggtgcgggttgcggaggagggacgcccgtgactccggatgcaaccactctctctctcccttaaatactccccgatcgctcttcctctacttctctctcttcccccattgacttcgtaactctcttcgttatcgatacaagctcactttctcaattctatgggaatcactgtctacaaggcgtgctcgccaaaaaccgccaaaattatcggcacacttcttaactcgcgtcacgcacccgttcaacggccggcgctcatcctctcgtggagggacatcggcctacgaattacacacccattaaatcattcaccaaacatcccactttcgccatccgagtcaattgtctgctctgtgaacgcaatggctccccacgctaattcggatgttgctgccaatggcgccgtgaacgggtcggctcaatcctctctgtttactgtcaattccaccaatgtcgagtacaccgacaatgagatcaagagcaagtatgcctaccacactaccgacatcactcgtaccgccgacaacaagctggtcgccactcccaaggcgactacctaccactnatag

SEQ ID NO: 6232 - DNA, 688 bp, Aspergillus oryzae
  misc_feature (1)...(688): n = A,T,C or G
taaatacataaccttccaatcttcagtctacttgacgcctcaaacatgtcttatgctgaagtagccgccaagggcccggagcaatctgcagaggaggcccgtgccccgagcgttggtgggatctataaggatgaatccgagagcaccgcctcgttagtcgacgtagattcacaacacgtcaccgtcgtggactcgaatttcctggatcaagacatcaagaccactactcaagccgagcggatagagcaggaagagtccgaggaaaataagaaagcgaaggaagagcggaaagctaaggccaaggccaaggctaaggcttctggcgtatgccgcaactcggataatccggtctatatcggcaatgctgtgctcctgagcttagtgggcgcagggctggggttcggtgcataccggaaacatgctcaaggcaaactctcctgggagctgatcggactctggtccggagctgttggagcatttggtgcggttgattattttgtcaacaagtggtttcttcaaaacaagtaccctcccaaatagatagcgggtatcgctgatcgtggcgttcagtctccgagcctatctctatatgaatggttnttgattgtcatatttcatcatagctctggtacccacacttcccaaaggcttggactcngcgcggggatggttttaattgtgtatcaan

SEQ ID NO: 6233 - DNA, 1185 bp, Aspergillus oryzae
  misc_feature (1)...(1185): n = A,T,C or G
ccaggataagttgaccccggctctgggctaccacgaccagatcaccaaggagacgctggaggaacccagctcagagcacttaccggtcaagtccgatgatatcaactactatggctatgccgataccgaactacgggattacattcgccatgcgattgatgatgcagaggctagccacacccgacacttgctcacccacctgaccggaaccacgcatcatccatggggaaggccacatgatgagtacgaggagctcatgggatcgtcatggaccggacacaacaatgacgtttaccgctacctgaatgcaactggattctgacacaactggatcgctgagattatcagcattctggaagagaacggcattgccgatgagacgtagactgtcatggccggtgatcacggtctgtcgctgccgaacgacggctgcgtcacgccctactacaacccgcaagtctgcaggtaccacgttgccattgagcttgcgcattcgaaactgccttcggtcgacgattctacccctgtggacaatgatcatattgtgccgaccattttggacttgctgtattgagtcgcggtcgttgagcgaaggcagcggccgtgcggcgcgcgacatcctatccctgtatgaagggcagtccatgctccgccccttggttcaagaagaggacggaaaacagaactggcagttcaccgtcatgaacactggcggtacttggctcgcggtgcgctcggcggcgcgaccggcgttccgtttggtcattccattggttgacgatctggaatggcgattcaccgacctggagaaggatccgatcgaactcaaacccatcaaacacttcagtctcatggatatggccaacgaacttgaccagaagtacggacaggacgtcgtggactggcttcgcgatgccgcacatgtcactgagtggtgggtgctcgataattggcaccgctatcggtacattccgcagatcaagatctcganagacggcaaaatttccaagggccanggactcggtgacaagggctcanacgacaaggactccgatgatacggattctgacgactcccaggactcgaagcgttgagtgagcttcttcanagaatgagatcaggaagtctacacaggaactttcatatcatttattatatgactagatgagcctatgggcgcatcac

SEQ ID NO: 6234 - DNA, 677 bp, Aspergillus oryzae
  misc_feature (1)...(677): n = A,T,C or G
caaagaccggctggcagcctggcatgttcggaagaacataaaagccaaagaagttcatgtgatgattcgaaaacaacaaaaacgagctgcccgaggaaagcaaactggctttcgagttgccggtcaagaagtggattcgaaacgtatcgctcgtttcgtccgtagatacggcactaactgggacaacaaaggtcgcgccgagtctcagtcccaatctccacctcaacttcaacttcagtctcaacccgaaacccaaccgcagacccatcggtcaagcccagagcctggtaggtcgcttctacgtgatcaaatatctgttgcatcagctgtttatacagagccagatactccgtctgatatgagttgctatacgccggagcccgatgctagagatagaagttcgactttgtctcccttgccagagacgatgtcacctcgcagtgagatgaccccatccttttcgctagcctgtacaactcaaggaagcttcactgagcactatgagttttggctctattaaaaacccttggttaatcaaagcgcaggtcacgacaagcttaagatagaacaaactcctgcttcagagattgatgatactcaatctttgccgacaacaacttataaccccagcttaccaaacgagacacctanaaccacagatgatgtgtcatggaang

SEQ ID NO: 6235 - DNA, 748 bp, Aspergillus oryzae
ggacctcaagtccatgggtaagctcaagcgcgaagtcgagaaggccaagcgtactctctcttcccagatgtctactcgcattgaaatcgagtctttccacaacggcgaggacttctctgagaccctcacccgtgctaagttcgaagagctgaacatggatctgttcaagaagaccctcaagcccgttgagcaggtgctcaaggacgccaaggttaagaagtccgaggttgacgacattgtccttgttggtggatctacccgtattcccaaggtccaggctcttctcgaggagttcttcggtggcaagaaggccagcaagggtattaaccctgatgaggctgttgctttcggtgctgccgtccagggtggtgtcctttccggtgaggccggtaccgaggatgtcgttctgatggacgtcaaccctcttaccctcggtatcgagaccactggcggtgtcatgactaagctcatcccccgtaacaccgttatccctactcgcaagtcccagatcttctccaccgccgctgataatcagcctaccgttcttatccaagtttatgagggcgagcgttccttgaccaaggataacaacctcctcggcaagttcgagcttaccagcattccccccgctccccgtggtgttccccagatagaggtctccttcgatttggacgcccacggtatcctgaaggtcagcgccagcgacaaggggacttgccaaggctgagtccatcaactttcccaacga

SEQ ID NO: 6236 - DNA, 713 bp, Aspergillus oryzae
gtataagctcgtccgattcggacgaggcgtctacagtgggacgtcgcccaatacacccgcacttgggcaattcccagggccgttggttactggcgatcgctttccaattaaatttggctcacttaaacatcgctgaaagtatcttgcactcgcgatcgttcataccatctctcattatggctcccgagccagatagcagcgtcaacgcaccaccaaccccagaagctagtaatatatctggagctggcacgaacacaaacacgaccgatgctgctcccaagcaaaccaatggtgagagcactccgcccaagtctgtggatgcgaacgaccagcccgagaagaataagtctcctgaagcggctggatcttctaaggaacacaaacctgctgaagaagccaagtctggtgggcatgcctccatctcgcaacacgatggactcaaagagtcaaccgcggagaatggcatcgcgcaacctagtgcaggcgataaacgagagcatgacccgacttctaccacccccaacgcgggtaagggctaatgttgagaactcggcggaacctacaaacaaaaagcggaggactactggaacgcggactcgagatggcaatactacagcccctgctacgaatggggggaaaccaaaggcaagtcgttctaaaaagacgaaggatgatgtgaagaaggtgattcctacggatggtattggtagtca

SEQ ID NO: 6237 - DNA, 685 bp, Aspergillus oryzae
aatatcttccataaacaatggcaccttcggggtacactatcagactacagaagggtatccgaggaggcttcgcgccccctaccccaaccgcaattctcagcttagccaaagatgccgacaactcgtacatcagcatctacgaatctattcgtccagatggcggatcaggcctggaagataaacctgagagaacagtcgactcatcggacgaggtagaaggtcttgtcactgaactttatgagattctgcaagatttgcccttggagagtccaccggggtcagaggatatttatggaaaggatatttctatttcgtggagcagtgatgatttcgcgtggtgtaatggcggtcagcaggggtgtgtgggaggggacagtgatgtacgtccatctgagacggagcggcacaagttcactagggctgttgaaattgtgaataaactggttgatatggcggtttgagtggatgttaggggacgttgtccatgatggtatgggcgggtattgcagactcttgtgggcattgttgtcttgttgcttggggatagtttatgggtgatgcactagtatcacaggttcatagctgagggtcattgatggatatttaatgatctgaaagcatggctagcatcttgcatattgccagacttgctttcatgctgcatgaatggtggtcttaatcatgt

SEQ ID NO: 6238 - DNA, 687 bp, Aspergillus oryzae
  misc_feature (1)...(687): n = A,T,C or G
cggaatctggacgtcttagctccgaacgttcaaggcgccgagcctagagaaacaggatccgactcgaggagctcagatgacccttctacaaaagagctgggtgtgtatgaaacattaagatcaagtctggcggctctcatttcaaatttgcctccgtatgcggttgcaaagctaaatggcgatcagctggatgagctgaacataagccagaaaatcgtcatcgagaacccggactatcggggaaccatggagaaggatgacttcacagcgcatcaggagcgaagcgcggccatggccccaatgagtggtgccgcgaatcggacttcaacgccatcccggtacaattcgcgggcatatagttctggctctcgagcccaatcgcaaggtggcttcgctcaacagccatactatagtggaaggcaacccttcacttncgggccatacactccaggccatacacaacagtacgccggacctcggccaccagtaacaccttcacaacgaccagggtatctttcaggatactctcaacccacttctcaattcaatcagcagttccagcgaccaggacnaaatgggtacgctttctacctcggccaacaagggccagccngccaaactttgncacaagcctacacgccgngccccgacaaacaggggcattacatgctccttacgcaactggcg

SEQ ID NO: 6239 - DNA, 975 bp, Aspergillus oryzae
cgactcttacagtgaccgtttctactatcgcggtcgtggtgaatgccgcggtgactaccgggattaccgccgtgactaccgggacgactacggctgctaccgtggaatctatcgttatgcttcgggaggactggacgatcggtgcagtcccgatgaacgccgcgatgaccgccgggaagagcgccgtggctataatgatcgcgatgctgaccctactagctacagccatggtggtgctgctgctcctgctcgtgaggctaattccggcggaggatgtggccgtggcggacgctcgtatgaacctcgtgaagaccgatatggtagcaggtaggtgcagggttgggcagttatcgacgattaaaaatcagggtcatggcacgtaattcttttcccccgtctctagtctctgtctaggcttccccttttcgtttcttttgttaccccctgtccttgttttgtgtgacattccaacgcccatccacattccttggaatggtttcttaattcaatacccgctgcctatggggaatgagctcgacggtccacggtggaatgtcggtttatgttgttcttgatttcatcggaaaaagtcgtctgcgctattactacttgtcatctcggcgacattcggtacgccatcagttatgcgaccatcttaaccctgtcagaaaaccaaaagagaaaaaaagaaagaaaaaaaaagggaagaacaagttactcttgttgtcgtcggtctgcggtcgctagctggatttttcttttgttgattcgctcgaaacaccggacaaattggcggcagggaaggaaaagacatgatatttaccttaacgttgtaattcctcggattatcagatgggtctcagcacttctacattgcaactcttccggaaattggtcgttatctcgctagtcagcttgttcgccttgttgcgtcttattcaacattttctacgtaacgactgttcgatctgtatc

SEQ ID NO: 6240 - DNA, 616 bp, Aspergillus oryzae
cgactgttctttgtatggtgggaaatacttcggttttgtggtatcttgattcaagcctaccatggcgggcgatatcgaggatccaaacctagcttcggatagcgactgggcctcggcggatgaggggtcgctagatgtaactacattggcatcgagtgttctcaattacgagtacaagaatggccgacgatatcacgcctaccgctcaggcgcatatttaatgccaaacgacgaggaggagcaggaccgcatggacctcctccatcacatatacaccctgattctcgatggcgagctgcatatggcgccgatcaagtcccatccagagcgagtcttggatttgggaacgggaaccgggatttgggcgatggattttgctgatcagtataaatccgcggaagtgttaggaaacgatctcagtcccattcaaccaagctggatccccccaaatctccaatttgaaatcgatgactacgaagcagactgggtctattcacggcccttcgactacatccacggtcgcgagctagcaggcgctgtcagtaacttcgaccgactcttccgacaagcctttaaccatctaaaacccgggggataccctgagatgcaaacttcg

SEQ ID NO: 6241 - DNA, 655 bp, Aspergillus oryzae
  misc_feature (1)...(655): n = A,T,C or G
cctctgcggcttcacccttttcttgtctcttatcctcaaccgcacctacaccatgatccttgaggttcttcgccttgaagacaaggtcaagatcctcgagggcgacaagaaggctggtggaaaggattcggcccgccttgccgaggctggaaacgccggcgagatcggacgtctgaagaaggagctcgatgcgaaggaccgtgacattgagaccctgaagaagcagtgtgagggtcttacccgcgaataccacagtctgggtgacaaggttgccggtaagaccgatgatgacactaagaaggatctgtgaattcaatcgtggagtccaaacttggaaaggaattctgtgttgtctcaagtggaagtattccatgagatagggcaggatctccgagcagctcttatggtatcaaaatgatgttcgtggaaatcaagcgtcccgcttactactcgctttcagttgtgataacacaagtgaaaagcagtgcagcaaagcagtaagtcaatgagcatgtgtggtggatttatggttccctgctttcacggatatggatgttgtttgttcgcggagatattcaaacgcgtggtgacaaggaaggtgtatacacattgtgagatattgattccctagtggttgacatatcanacaaaaacg

SEQ ID NO: 6242 - DNA, 1077 bp, Aspergillus oryzae
  misc_feature (1)...(1077): n = A,T,C or G
cgaggataccattgggttgcacttctacacagtcaagaagttactcctgaaactgccaactacaccgtccaggcctattacaagaaaactatcaaccaccactactctcaccaccaacaccatatcaacctcaattcacaatgccttccatcggtggctctacttctcagttccctccttgccctggtcctcctcccaagggtccgcttcctcctcttcccaagtaaaccttgggctttgtgatgaaatgacgacccggcgtactcgagcggttcattcaccccgtcgtgcgaaagcatcaacacgaaccgactcgtgacgctcacgaaacggcgttgcatttggcatatggatatcacgattttcgatttcggaactgcaaaatggctttgatctaccccgaacgcattctcatatacaacctttattcgacgttatcttctcttatcttcttcgcttctaccatttcggatttttcactccattgggatctcaactggcttcagataggagctgcgcgatgacgttacttgcgggagtttatctttcttcacactccgattctacggacaggcgccggcgccacgcttttttcttcttctttccttctgcaacggcgctttggcattgcgacatcaggccaccagtgatgcatgcggtcatttgatttgaccaacggcgtcatgcaaggcaggcacctgacaacacaaatgatatcaaagttatcggggttcgcgatctccccacccacgttgtcacttatctctcacatcggtggtttccaacggctcgttatcggcacaaaccccgcaaagctatgggacaccaggggggcgtttggaggcttanagcctgacaacatctcacctttcagccaaccaaacgtcgctacgaagcatgggatttacctgaccattcgcgatgtcaaagcgttattggaactccccattttgatttgcggggactttttctcgaagcttatttaatcatgggtcttttctcttttctggaccatctcttggttattacctttttcttttctccctctcttttttttttaagggggcttttaatttt

SEQ ID NO: 6243 - DNA, 663 bp, Aspergillus oryzae
  misc_feature (1)...(663): n = A,T,C or G
tcaaaaccatttcgttgttggtcggctcgcttccgaagaaaagttcctttggatcttactcgcttcaccatgtcattatttgtgtcgcctcgtatggttatatgttctctttttccgtttccttttttctttcttataacagcttgccattccattcttctggggctcggtttcgcatgtatacattttattgttgggtttaccttcttatttgtgtttgccttccctagcctatatggtaaactggggaaggcctttcttacttcgggatgtgcgagacactgatccattgcttgtacatatatttgcattgatggcacgtctatatttggctttctgtcaccttgcccttggttcctctatgtttcccctattgccgctttgtcgggaagcctacgaaagacgctaggcattcgctttttctccttcgatgcaatttccatctgcgccttttgcgtctatatatacttctgttcggtttggtgcatcaaggctcggngcatcagtgatntttctttgtatgtaatgcccgcatgaggaggacacagtgtgggataaggatacacagagcggtcggtttcattaaagacccgcaagactcatgaccatgtcttttctatttgtgtgagttgaatgatggtgaagacttacaaacggggcccn

SEQ ID NO: 6244 - DNA, 659 bp, Aspergillus oryzae
ccttttagctcgtggctcgactcctggagcacccgctggaaccccaaggtcttcgccgaccagggatacgtagtcgtcgcacccaacccaaccggaagcagtggcttcggcgatgccctccaggacgccatccaaaaccaatggggaggctacccctacgaagacctcgtcaaaggctgggaatacgtcaacgagaacttcgacttcattgacaccgacaacggtgtcgccgccggtgccagctacggtggcttcatgatcaactggatccaaggcagcgatctgggccgcaagttcaaggccctggtcagccacgacggcacattcgtcgcagatgcaaaggtctcaaccgaagaactgtggttcatgcaacacgagttcaacggcacattctgggataaccgcgaaaactaccgtcgctgggacccctctgcccccgaacggatcctcaaattcagcacccccatgctcatcatccacagcgatctggactaccgtctccccgtctcagagggtctttctctcttcaacatcctccaagaacgcggtgtccctagtcgatttcttaacttccccgatgaaaaccactgggtccaaaacaaagaaaacagcctggtcttgcaccaacaggtcctgggctggttgaacaaatactcagg

SEQ ID NO: 6245 - DNA, 762 bp, Aspergillus oryzae
  misc_feature (1)...(762): n = A,T,C or G
ngacattgctttccgtatacggccaaggcgacgaagtatctgccgtcctcgcggagaaattctcgaagcccttgaagaagcaaatctctggtctcattcgccgtcagcgcgaggaaatgctacaccccgaacttgcatcagactaccttttccccgtccttcctggagtcttgtcggaccctaacgaggagaagcgcaaccccgtattagaattggtcaaaatgttgatgcaggtccttagtctttccaagacgacaagtttggagaatcgacttctacgtcgcgaactcctggccatgtttgaggtgcgagagttcagtaaagagggtcgatttgagaacccggctgccagcctgaaacttcccgagcttacctgcagcgcttgctgcttgattcgagatctagacctgtgccgcgatgaagatgtcctcccggatcctggatctgacccaagcaaggccgtgacgaagccctggcgctgtcctttctgtcagacagaatatgatagactggctcaggaagagatccttatcggccaggtccatggactgatcgttggctggcagacacaggatttaaaatgctccaaatgtggagggctgaaggttagcgagttcatggagcattgttcgtgcagtggcaaatgggtggaaaccatggaccgtgcagaggcggaaaagaaacttggagtgctcaacagtgtcgcgaagtttatgggcttaagctttngagaatgttgggaacgagttctagacaaatatn

SEQ ID NO: 6246 - DNA, 718 bp, Aspergillus oryzae
  misc_feature (1)...(718): n = A,T,C or G
gagaagccgaagacacctgagccagctccacctccggatcctcctgtaccagaggctgccgctgcccctgaagctctaccagcacccgaagacgtggctgtcgctgttcctgctgaggagcctaagaagaaatctgactcaacaggagcaaaaaagccgcgaacaagagcgcccgacccgggtgcgtttgccatgtggatggcgggtggtaaccgtaggttcaacaaagctttaaaagtgggaaaaaagcctagagtagtcctgcaacacgggcttgcttctcgtgttatgtgataggatctaagcttttagctactgcctctagtctgcgcattgcgataggtatagcgtgcatcactacttttttcgagctaggcctaaagcttagatcgcgatgggaagtgaacgcagaacatgtcaatgggttttgtatgttctgcgatatctatcgctgattaaggcagcctgtggcgaatgctagaagtttgaacttgatctatctaagcttctctgggggggcatggcttttcctctcgcatagccgagattggtttctcatgcctcagggtggcatcgcgcgcccaaatccatttacattttgtttttgtttttagcttccccttcccttcccttctttgatagcggngaaacaaggagcacgggaggcatctgtggtattaaaaaaaagtcgtggcatgcttctatcaaaaaaaaaaaa

SEQ ID NO: 6247 - DNA, 685 bp, Aspergillus oryzae
gagcacctgaggcgccaagagatgggcatggatgccccgagtttctgctctcaccaccgccattcttgctccgatcaagacaaggagtccttccgtctgcatcgcgatatcatccacaccctcttacttcctttgtttctgctccaccaccaagcctcccgtgtcgccgctagggcgctgcccagccgcaaagcagcggaatcggaacgggcatttcgaggggaagcacgcagtgcgtatgcctggcttcagtgtatcctcaccgaggagcatgattggtacctgaccgaacgatgccccgcttgcatcgtcctgcacgtcttacattccgaaccgactattcgttttgtagccgtggcttgccttctgtccgaccacctgcaaggtctggacttgctccacgggaaaaatcggttgcccagtttcgaattctggcttgaggcattagaaacagctgttcgcgaggatcctttctggggccatgacctctggcccgatattgagtaccgcgcgtgtgctttgaccgacggtgtcaagcagctggtgctgcagtgcctggaactccgatctgcgttggatcggcaaagccaccaatcccaggcatacgattccagtgctcactttcgtcgtgagtcattgcggcaatcaaaccacccaattatgaagccatctgccgctacattag

SEQ ID NO: 6248 - DNA, 619 bp, Aspergillus oryzae
cgagggatctttctctcccaatctacctcattacaaaccaaaaaccaccatgtctttccatcaatcttgcgacctcatccggatcgaagtccgtggcgatcatactgtcctccttgccgcagctaagaatggtgatggggatgaaacagttcccgcggagattgtccttgacgaacagattggcaacggtgatggttggttcgttcgcgggggtgagaatttcacagaaaccgctcatgaaatcgaattggagttccgggaggacggtccttggttgactgcattcctcaccgaagtcgatggagaagatagagagcgtcagggaattaatctggctgaccatattgggaatgactgtggccgacttgtatgggcttaactggactggagcaataatcttgtaaggttcacggcggcagcggcagcggtagcggcagcggcggcttccgctctttctgacgacttcccgtctgtgtcttggcgcttgcctcaggcagtttttaccccgcgcctagagcccgaatggctgcctgatgcctatacggttagattctagggactcaaaacctcaagcgattcgttctgttccaattccaatatattcttcctttggttcctg

SEQ ID NO: 6249 - DNA, 650 bp, Aspergillus oryzae
  misc_feature (1)...(650): n = A,T,C or G
gcccaccatcccagacccaggtgaagcaggacccagagtttttccctcccctgccaaaggagcccgtccggcagcgatccaccaaggaatccactgaactgcgcaatccccgggatcatccatactattctttgcctactcacaatgatggaaagtactactgcccttttgccaacggagacaagccttgcaaccacgctcccaccacccagaagtgtgcttatcataaatatctggattcccacctgaagccataccgttgcaaggtgcctgcctgcatggatgcccagttgcaattctcttccaatgcatgcctcttccgccacgagcgcgaagctcatggattccatggccatggagacaaccctcacctttgcctttttgaaggatgcgaccgttcgattcccggatatggatttccccgtcggtggaacctctttgaccacatgaggcgcgtccacgattatgcttcttctgaccgacccagctccccagatgcttccccaactaccggccaggctgctaagaagaaangagccgttggacgcaagcgtcgggtgactggcgtttctggagcgcagaccatgaagcgcactcgctccacccagtcccagaccacccgctcaaaagcggccagcagacctccgccn

SEQ ID NO: 6250 - DNA, 529 bp, Aspergillus oryzae
  misc_feature (1)...(529): n = A,T,C or G
cgcccttttcgcaggattctggagatacagcggaccatgacagcgaccttgactcggcttcggaggcttccagttatcgtgacaatcatcgcgcaagtttgacatcaagcgaactgttgaaccgggacaccctgttgctcctcttaacatatcttgttttctccctgtgcaacgttgcctacaatgcgctcttcccgatcttctcgcaggctgctcctcccactgggcgaggtcttacaccctcagaaattggtcttgcgcaaggattttctggtttcgtaacgatcatctttcagatctgtatctttggaaagttgagagataagatgggaaatcggtggtcctatcgcgccggtctntttggctttgtggtttcctttatcctgatgcccttcattggctacaagggtaacgactccggaggcctgtctggtaaaaccgcgctcttagccgctgagctatgcttcgtgttactggtaaagaacaattgcacttgggggnggaataaccagccccactggtactattn

SEQ ID NO: 6251 - DNA, 682 bp, Aspergillus oryzae
  misc_feature (1)...(682): n = A,T,C or G
gtatgctgacaatccggcacgagggagtcgtcggcagagtactcgtgccgcaagccgtcggtccagttttgcaaacccgagcttcaatacccccagcgaaaataataaagaggttaactggggtaatgatacaacattcgatgccaaacagacgcaatctcctggttcttcacttcccacaagccgactaagccgactcgcgtctttacgggcccaaagactgcaaaccgacgatgaacctgccgagcaccgaagccctcacggccggtcaatatcaagaagcatgacggatatcagtaaccaaagctccgcatatcgtgcacccccgcgccagcgattttcccagggattcgctgcatctcaagcaccacagcctcagcaagaccagactcccaggtactcagcacaatctcagcagtcgcagttgccgcaaccccgtacgccaactgcttcgcagtcctgcattccactgcgcagaaccgtgatgactccggctacatctcngtcaacatncaacccggtctcgtcggatggtttgccttcgggattctacccccgaaaagccacgacgatgcactttctccctcgacagatcaatttaaacaggatattggccatcggcaactagcagcagtattcccctatttcggcgaaacgaccgtttgaacccccggagttggat

SEQ ID NO: 6252 - DNA, 701 bp, Aspergillus oryzae
  misc_feature (1)...(701): n = A,T,C or G
ctggcttgtcgtcctcgacgccaatgcagaagagatacaactcctcagcgtcggggggagacaactcggagcggcccaaggctcccacagaggacccgttacctcacgttagcgaggaggccgcggagataagcaagatcatggacaagaaatgcgatggcactcccgcgagtccggagttggagcaaggaacgcctatctcagagatcctccaacgggacaaagaagcccagaaacatatgcccaaggtcatgcaagaccagatcaaatcatcgactggtactcgctcgttctcgacatccactcgccggagccaggcagaattacatggccaaggaaagagcttcgatgagcaaacggccgcagtgatggccagcatgatctctcaggtcaaccagcaggctgaggaatttcatgatgggatcaagtttgacccagtcgagacccttcccaagacagagaacttccgcacgagatatgactcgctgctcgaacaatttaccaaactcttaatgacggatggcaagctgagtagggcgcanaaggatatggcgttcattctggaccacctccggactgctcctccgcctcagcccaaccccaagcggcctctgctttctgggacccccgccccacagcttccactgaaccctgttctatatctcaccttgattgccgactccgttgctcctctgatcaaa

SEQ ID NO: 6253 - DNA, 1262 bp, Aspergillus oryzae
  misc_feature (1)...(1262): n = A,T,C or G
cttccctaatcgtcacaatgcctggtcaggtcgctggttccaaggttctcctcctgggctcgggtttcgttaccaagcccaccgttgaggttctgagcaaggccgatgttcacgtcactgtcgcctgccgtaccctcgaaagcgcccaaaagcttgctgagggtttcaagaacaccacggccattgccttagatgtcaacgatgccgacgctctcgacaaggccctcgagcaggtcgaccttgctatctccttgatcccttacaccttccacgcccttgttatcaagtccgctatccgcaccaagaagcatgttgttactacttcttacgtctctcncgcaatgctcgagttggacgaagagtgcaagaaggccggtatcacagtcatgaacgagattggcttggaccctggtattgaccacttgtacgccgtcaagactattgacgaggttcatagggaaggtggtaaaatcacctccttcctctcctactgtggtggtctccccgcccctgaatgctccgacaaccctctgggctacaagttctcctggtctagccgtggtgtccttctcgctctccgtaacgccgccaagttctacaaggacggccaggaagtcagcgtcgccggtcccgaccttatggctaccgccaagccctactacatctaccctggcttcgccttcgtcgcgtaccccaaccgtgactcgactccctacagcgagcgctacaacatccccgaagccaagaccatcgtccgtggtactctccgctatcagggcttccctgagatgatcaaggtgctggtcgacatcggcttcctgagcgatgagcccgccgacttcctcaactcccccatctcctggaaggacgccaccaaacagatcttgggtgccacaaccgccgccgagaaggacctcgagtgggccatcgcctccaagacctccttcgcgaacaacgaggagcgcaaccgcctcatcgcgggtctccgctggatcggcatcttctctgacgtgcaggtcatcccccgcggtaaccctctcgataccctctgtgccacactcgagaagaagatgcagtacggccccgaggagcgtgacatggttatgctgcagcacaagttcgaaatcgagcacaaggatggctccanggagacacgcaccagcaccatgtgcgagtatggtgtgatcggtggttactcttgcatggctaaaactgtcggtgtcccatgtggngttggtggccaaattggggcttgatggcac

SEQ ID NO: 6254 - DNA, 680 bp, Aspergillus oryzae
cttctacattcgaacagcttataagctgcagcgaactgctcggtggatcgagaatctccctggggggatcaattacctccgggaagtcgtcatcgacgacaaactgggaatctgcgctgagatggagcagcaaatgcaggagttggtagacagctatttctgcgagtggaccgagactatccgcaacccgaagcgccgcaaatacttccagcagtttgccaacaccgatgaaacggttgacacggtggaacttgtcaaagaacgtgatcaagagcggcccacctactggccgagcgagggcgcaaaggaggacttcaagggacatcagtggtcggctctctcatggcagccgatcatcaaagctgatcacttctccgatggacctcctgcgatctcttccgccaatgtcaagcggggcgatactcagctggcaatcttcaaggtcaagggcaagtactacgcaacgcaacagatgtgtcctcacaaacgtgcctttgttctgtccgatggcctgattggcgaccatgacgccggcgaatactgggtattctgttcataccacaagcggaatttcgaactcaatggccaaccaacccggccgtgttcaaacgatgaagctattaatattccaacctttcccgttgaaggaacggaccaatgcttggtcctctttgaaattt

SEQ ID NO: 6255 - DNA, 682 bp, Aspergillus oryzae
  misc_feature (1)...(682): n = A,T,C or G
gtttctcccgtcgcaatagcaacggagcgagcgccttgcgctatcgacttacttcactgtctacgacacatacacgcgctacacacccacataatctgagccaacatgtcggccagtccagagatcaaaccggtcgaggaagaccccgtgcaagcgcctacccccggcgccggcgatgacaaagcccagggcgtcgaggaaacagccgctgccgacttggacgcagcagatgaaaaggacaacgggtccgatgacgagtcgattctgtcggaggtagacaaggcgcagttcgaggactttgatcctgaaaatgtcgacgtctaggaccggccgcanttggcgatagatgaggataatctgaagcttattggacggcataaacggaaaaggactgaggatggggagcggccccacccaagaaggagggggggggggagaaaaaaatccccggatgaaggaattggaggaggggggttaatcatccccatattatcatgaactttacggtgagctcacgagaggtaaagatgggggtactacgatgacaagataaggagaggacgaatgcgtgtaaatcatatatagtatattcgaatataaggagattatgccgatgctcatcataaggaggatgtgggatgattccgaggatttattgtggttgatgttctctaatgtagcc

SEQ ID NO: 6256 - DNA, 696 bp, Aspergillus oryzae
ccggacactctgagcgtttaacaagtctaccgaagccaaaggtcgcgaataagttcggagcgaaccagtcgttcgttgggaccaaacctcctctgcctagtggatccatgccaaaaccaacttcagcagttgcgcccgtcggtagcgcaagcagaacttttgcagatgagggaggaaagactcccgcacaactttgggcagagagaaaagcgaaggaacggggacaagctactgcatctgatgtaccaccattggggcacgaggagccctcgcttcaaacacagcacagcggcagagccgagtggaagagctcatacagcggtagaacgtggacccctgttcagaccacacacactggaaagtctctcggcagcaatacatctcaccaggctacggaccctactgcaaacgatgccacggcaacagagcctcaagtcccccaaagtgtcagtgctcttcgagaccaatttgcggacaagtcacttgatgactcggctcccgaggctaggtccgatgagccgtgggatacaagacgttctgtacctcttgcccgcttaccaacgggacctgttgcaccagaagctagccaggagcccgaagctcaccaagtggctccgagcccttctggcaagctcggtcccctacttcaacccctccagtacgggaagcattcgctatccgtgttgccatgcctgt

SEQ ID NO: 6257 - DNA, 737 bp, Aspergillus oryzae
  misc_feature (1)...(737): n = A,T,C or G
ggtctgctcttccgcacgaggtcgagtagagatggaggatttaaggggctggaggttgttctcttgcttggagcaataactattcgtgatgtgtatttcactacgatgaaggatgctttcaaacttgatgcgacatcggttcccgtaggacctacccctgctgctgttgcgaatagtccaaacggtcataccactgctcccgcagctggcaaggataaacagcctgtctcagctggatctggggcgctcaacgcaaacacgacaccaaccattcctgaggagcctacagttgagaatcctccacgacgcaaacaggaacaagataaagaggaggaacgccgcaccaagaaacttcttgaagaggaagagaaggcccgccgcaaacgccaagccgagatcgacaaagaaacccgtcgtcttcagagactttacggtgaggaagaacagagagtccgccactccactccgtcgcttccgccaaggccattacaatcgcctccgccatcagagcggccagctgctgctggacgtggggccccggctcagcggtactaccatactcaccaccattcaccctccgtgccgcatatcggacatacgccgtacctncagacccctggaggtaatccacacaggcagtcagtagcgttccttgcgacacagccacaaccagtggcggtatcaaagccgcaanaatgcaacagaagaagagtttcttcggctccagaagtcatccc

SEQ ID NO: 6258 - DNA, 1257 bp, Aspergillus oryzae
aacagaagagattataaggaattaggaaaaagaaaacattttttcttagttcacttcccacttctgtcttttcttctcgtgaactcatctcgacttcttaattgcactttgtaccgttgcattccggtccatcgtttacgatactgctatatatccagcgacccgcttgatatctgctatcattgagtcatcgagcctagatcggctgggtagatacaccgcccacagtcatacagcaattatgccagcaaccgtgaattaccgggtcgttgagccccatccttccgtttcgcgcccagctcttcatacagctcgcggcggcgcaggcaacatcatcagcctgaagaacaccaagaccaccccttcacagacggccaccggtcccccatccttgacacgtctggactctcacgtccctcccgtctacaagtccggccgtggcggtgctggaaacgtccacagcagcagtgagcgcgccatcttcagcttcgacgaggaactcgaacgggaccttcgtcgcgccgctccagtctaccacgtcggccgcggtggtgccggaaatatggtctacagcgacaatggaagcaccctgagccgcaagttctccgccagtagcaatgccacgtcgagtagcacggggtcgaccagctctactcgggagaaggccctgcgcggcttagagaagggctggggcaagttgagaggaatggcatagagacgctttgcaagacacattcgcatacggcctgccgtcctttggttcgagcgttctcgcattcgcatttcgaacatgaaacatcacgacttacgaccacaccaaaaaaagtttttattttccacattttttcaatctcctttttccaattaaaattcatttgggattttggaaaccccctaattcaaaatccctttttaatttcgccaattggctttttccaaagaaaaaagcaaatttgtttaacttggtgtttttttgggccatttttggactcccatgtggatattgaaacccccaattgccaaccggcactttacttttttgactgcctattcagggtcaattaaaccttgtttcaaaaaattttcactttccaagttttcattattaaaaagtacgcccggttttggaaccggcaaaagggcttttcacgtcctttaccttttaaaaaaaaaatttccgaaatggaaaccgttgctttagtccctgaaaaaatgaaccggaacaaaaaagtttgaacacccattgttatttccttt

SEQ ID NO: 6259 - DNA, 682 bp, Aspergillus oryzae
  misc_feature (1)...(682): n = A,T,C or G
ccagaccgtccacggcgtaaccaagggctccccatctgaaccccgccacatccaatgggcagaaagcgtggtggaggatcccgaagagaactgggatgcggaagatgtttccgactccgacctgagtgacgattctgacttggaggaaaacgactatgaacctgcctacacacccgttcgtcgacgtgccccgtcgccggtggccattgttcgagaganagaaatcgaggaggactacgactccgactccgaactggacttttgaatagaataacccgaaggcttggaaggaactggttttaacccgtcggcattaacaacaaattccgcttgacctgccgtttgattccaagaaggatccgaaggaggattaatggcttccttccccccggaaaccaaggttgaaaattttttttgaaaagcaggccgaacttaccgactttcaatggtcggaaatggatttggaggccggtatttactattgaaacactctcgaatacaaatattgtgggctctttaaccttctctctgtttgagcaatgtgtctatgtgcctatcctctttgtgagaaccctcctacactcttgtgtgtgggttggagattggttcaagaacacttatttttacgggtttggcgcgttgggtctgaaaaaaaaaacatatttattggtggggaaatttt

SEQ ID NO: 6260 - DNA, 700 bp, Aspergillus oryzae
gctgcagaaccaccatagtctaaatgcctcacaaacataagcggaaacgaaatgatacggatatctacgacctcccacctactatgatcgcaaaggctctcccggtccgcgatcccaattccaagaacaagaaatcaaaaaagaatgtcaaggacaacaagccccaagataaactccaagcccgtcagaaagctgctacagacgatgatacccccaaagcatttcgccggttgatgcaattccagacacaaggaaagcaggcgccatcgaaaccaaatactggcgagagtaagaagcggaaaagaggggcggaaaacaccgataatgcgaaacaaactacgcgcaagaagtctgcccctgtggcgatagtggaccagagtaccgatgtcgaaccccaagtgaagccgaagatccttccgggagagaagctgtcagatttcgcggcgcgagtagatcgcgaaatgcccattgctggaatgaaaagatctggttaacccgcaaagtcggatctcgctgatatccgtgagcattaagtaaccaaacatgagaaacatttactccgactacaatcaatgtggggggaggaagaagcagaaattcaagaacgtgaagctgttgaccgtgaaaagccagaggcataactggtagaccattagaattattggaaggatgggaaagttgaggcccgcccatgcaaagt

SEQ ID NO: 6261 - DNA, 692 bp, Aspergillus oryzae
  misc_feature (1)...(692): n = A,T,C or G
cgggcagctcaaacatagaaacacagccaagcattacactcagttggactgcttcgccctccgagatacagacgatcgtatccgacactcgtaagggtgctgccgactcgacaagtgatcatagatccagtggtaacgaaacgggcgtaggaagtcggaattatgggactttatgtcgcccatccgccacttttgactattccgcgacccctgtagactcaataccacggccatgggaccatcagcgatcccgttccgggcacaggcatacagagagacaggacaacccagctggtacccgacacgaacctttacgtatatcaaacacggaactaagaaccaacgtggcaacagaacgccttcgacgacaaagacaggttgtcaacgaaacacataatcgaaaccacccgcggtatcgacagcagatattaggcatcgacaacacccgctcgcctcgctggattagaagtatcttanacgagcttccagaccgcagtttgggagttgggcaaagatatcaggagccagggactgctgctggaattgggtggtgtgcaaacagcagaacattgtacgtcgcgactgtcgatggtatattcgaataccagcttaacattgcggactcggaaacattccccgttggtaattaccgctagatcatcattctgtttcaagggtttgtttcacagata

SEQ ID NO: 6262 - DNA, 637 bp, Aspergillus oryzae
cgacatggacttagccttcaatttaaacgacgagccacgagtttctgtgccctgggagaagatgtctgttttgagggctcaagccagatctcaagcacctcctcctagtgagggtttaacaaatgggtggtcgagcgaccggagtaaaggatgggcgcctattgagccggcagatcagacgacagagaccatgttcacggacagctcctttgtgaatatatttgatcgctatgtaggcgctctttgtcctcactcgtcaaaggctcgatctcgacgaatgtgggaccgacaccacatatgcataggctgtattcgaccccactccatgggacaatttccttcgaactggacggtggctactgatatatgccaccaacctgaccttgcatcctttcacggattctttgtgtcgcctgcatcattcaaggtcacccaagatcttgccccagtatttagccagagcacaatttctggatttggcgacatcattttccctagtccgtggaactacgtggataagataaaatacgagccttctgaagagcacccggatctggactatgtggaaaaagaaaaccgccttttttggattggcggcacgtcggaaggcgtgagtcgcgacggtcaatggcaaggg

SEQ ID NO: 6263 - DNA, 888 bp, Aspergillus oryzae
gtttttagtttcggtcggagacgtcttttgtgcttgttgatcactctgccacgtttcttcccaactttctctgtgtgcaattgtggagttgagagttgtgaagcccgccccctcgagcaaaacaagcgagacaagtctctgccgggactaaaactcgagaagcaacttgggctgcctgtgtgacaggccttagcatcagttcaattcggtcaaccttatcgaggtctagcgacacaagatgtcgagcgacaagcctgaagttactgaagtaggcatggtggcctcacccgctgccacaaaacctagcttcaaatctcgcgtggcggcccactttaagaaatggtggtgggcgcacctcatcgcattcgttgtagtggtgctcgtcgtggcccttccggtggtatatgtcggctatccgaacatcgcacaggacaacattaacgactcgaaattggaagtcaagtcgatggttatcagtgagccgacaccgaattcgttccatgtggaccagcagcaggtcatctggacggatagcgtgtttcacccaaccatctatagctttaacgcaagtgttggtctactgggcgcagctgcattcggtgtcgcgactattccgcaacttaagtctagggacggggtcgaggtgcatgtagatcagcgccttgacttgactgatgtgtccgcatttggcgacttcgctacggccgtgatgcagaatgaatatgtcgacctcaatgtttacgggaagccggatttgaagcagggagctttgccgaagatcaccgtgacgtacaaccacaccgctactatgaagggcctaaacaagcttaaaggattctcgctgtctggcatgcatcttaccacgaaggcatccgacggaacgaacac

SEQ ID NO: 6264 - DNA, 642 bp, Aspergillus oryzae
ggacatttctctcagatgatatctgtgcactcgcctacatttgctcctattaagaaggtcatgagggagtgtactatccaattagctcttggggtatatctaaataaagcttggcaataaacagtgtacgaagacttacagttgtgaaggaaccgtgcctcctgtattctataatggcagtggcgagtacccactgggcctgtacccttccatcggaccgaaggcgtaccatagcagccacacgttttcgacacaaggcgacccggatataccgacaaagtcttcagcaacccatcggccgagataacatggacatgctcatcacaagctgcatcctgctcggaatgttctccttccctgccgagacgacaagtccgctcgattcctgggttttctcagatgacccgatcagtatgaactggctctccgtccaatgtggccttcgctgtctcctggagatcaccaaaccatggatggacgacagcatctggaatgaaccatgccaggaatcgagcaactacgaatatgccgatgatcaccgagtgggccgggaggatctcgatcccgaactggcggacttatgccatatcacggacaccacaacggaagagacaaacccctaccattgggccttttctattc

SEQ ID NO: 6265 - DNA, 738 bp, Aspergillus oryzae
  misc_feature (1)...(738): n = A,T,C or G
gcgcaacacttttcagagaatatcgggtgcctgacgtcatggtaaaggaaatgcaaagcgccgtagaagaagcatacgaggacgtcgggttccaccaggaccccgattacctctccaccacaagcaaaagcagtccagcagattcaatcaggcgacgaaactccccagggctgaaggctaaagaagctgcagagcacaaacccagttcctcctccatcaccatccaagaagcttcctctccaacaccagagcatgatcaaccaaacagcacccgcgaagcagcaacagatgatgccatcagcaagaagcgccgagcatatcccatgctcgccctaagcccagcccagatcgccataatcgagtcgctcaactccgtgggattccgcaaatacccggtctacattcacaatcaccgacatagccatgcagcgatcatcgtgcgggcccccaaaccgggcttcgacaaaggcaaagtagtcatcaggcattggctcgataccgaatttcagatctaaacggggacccatcgaaaatgcggggtgcggaaatagtcgcatggttgcaccccatcgagtcctcgtataggcaacatcgaaagagcacacggttactaataagcgttctgaatggatccggtacctcgcgcttcaacgacgccggntcctgtccggntctcggcatgagggggtcatgtttcatcctcgtcgatatcaaccctactagtagagtatgttcatg

SEQ ID NO: 6266 - DNA, 756 bp, Aspergillus oryzae
  misc_feature (1)...(756): n = A,T,C or G
atggccaatatgggcgaggattcgctgccgcacgaatgatcctttatagtttattttgttgttggaggggatcgacaaataaatagagtcagttatatagattactcgacgagctgccatttaatcttcatctttccgtctgaacccgctccaaaacgcctgcatactgatgcataatcctaacgacaatcgccaagcaatgcgatggtatcataacttctcctcaatccaagtatatataaaatcaaaaaagagcagaggtcataagataagagctcttttcccccagcctagatctacttgcccagcatcacacccgcgcccctcatcaagacgatggtgtgtccagactgcaccttcccggctccgattgcgtccgagaactccaggaactcgcccgactcaacatggaagatccggagtcgttccttttcgtccgcacgattgttcacgttctccacccgcagtcgccgcgccgcatcgtccagaactcgcccgaccttccaccggctatcgaagtagaagtcgccattcggtgggtccaccctctgcgtatccgatgtgccgaccacatgtagatagagccgtttgtcggcgggaacattggcgtcgcccttggcagacttcttgagtgtattcagctggacagcccgcgccgncggactattcggtttcgggaaacaacgggtaactattttttgcgggccggagtcatctgttctgcgttgggatggaatgtggcgaccaagatcggan

SEQ ID NO: 6267 - DNA, 658 bp, Aspergillus oryzae
gaataagaagacgcattgctaagcgcatttgtaacggtcagggtgcgaaggacaatttggtatatatagactatatcattagtgaacgcttttggatcttgaacatcaactgtgcgggagtcttacgctctctttcctttcttctaccttcggactctcttcatctcattctgtttcctcgtatattcttttcatttttggggggtatagaaaagtcatagcaagcgtccatggataactatcgggattacagcagtatcgtccattcaccgccattcactttcctggtcggcgccaaccacaccaagttaaccgttcaatcgggacttgcccgtcatgtctcccagccgctggaccacttgatgaacagtggggaaacccgcgaatcgaaacatcatatcgccgtcttggaggaggaagatgttgagacctttgtcgccttctgcgagtatgcctatacaggtgactacagcgtccctggcccggacaaccgagaggaataccaagaacaggtcgtgaacaacccattcaagggtgtgttctctggagagcctgtcctggcgcagcctgaccccaaacccagcgacgagaccgacaagggcagagcaagccaagcgaggaagtttcaccacagccggaacaagcgccgtcgactccg

SEQ ID NO: 6268 - DNA, 1315 bp, Aspergillus oryzae
cttcccttccctttctttctctttttgtttttcttcccttggttttcattccaccctcaatccattcttgctccttccttcctcgtcacgttctttcgatccaaaagcaggtgtcggcttcactctttcagctgttcacctcgctgtccattcgttctcctttaccagcccggtccattgtgtcctgcgaccccgtctcttcagaccgcccgaccgacctgatacattccctctttttgtcttgaataaactacgacttttacaagatagttaccctggttattgttatattcttctccttccagtaaaacacttggctggaaagttgatacgacctggatccctattgaattatacttcttcacctgtcttgtcgatacgaatagctttacagtatatacctttcgaaaaccgaaaccgagaaccgtatcctaccggaaaacttgactattcaaaaatgatgcacctgttcaagagactcgtcgcccgtgacgatgaaaaaaagcaacgatgatagacttactccggccatgatcgatcttttgatcgctcttctagttctcgtcctagtcggtatcgccctgggtggtgcccttcttgttttgcgccgcaagccgccaaaatcggaaacgatctgaactcccggtccataacggtcagtgcacgactcatcatcgcagcctcacgatttctgcgccgccatatgccaagaccgagtccgttcttgtctacgatgagaagaagagactcatggagaactcgtcaagccccccacccagcccagtcccagagatccgcattacgttccccgaggaagaggatgaatctggaaagcgcaaatctggacgcatggtggttgtaagaattagtgatgctggtggtgttggactagagccatgccatgacgaactgccaccatatcagtccagtgatgcggagcgtttccagtccttggacattgagcgcatgggcgggctcaaggaaaaagaggatgtaaaaagatggtcttaaacgaaccgttgataactagataccagcggccgtctattctatccgtgatacccctttcaaacctcttactcttcgacgatctcaaaaggcatgacgacatcccggcgaagatttttttccgtttcttacatatcgccacttgcgtttcgttgtaactttctgacttgcacatacgcggactgatacctcccgtctgaccactgcactcctaatattcggtgattcggtgtttcactcttgtcctgctgggcaatattcgcctgactcacccaaagacggaacttaaggcataccttaactgaat

SEQ ID NO: 6269 - DNA, 854 bp, Aspergillus oryzae
ttttttttttttttttttttaaaagagaaaatacgcagtaagctactttcgtccccccatcggccagttatcagtgctgctacctggaaccggcgccgctgtgcccaaaccatcactcggtccgggataagcaggcggagggacatcaggggtttcggggataggataattctccaatggagctgtcggtaccctagccattgttctgcgtttattaccagaacaacagcaaaagtatataccaatcgcaaatccaataacggcagccgaaacttcaataccaatgcccaccttttcacgcttgtacagataccccctcggaagcttcagagacgcagtcgggattggcacgatcgtggattcggccgccttaaagcggatttggatcggggttgccgttatggcgtattcggttcgtgtggttgtccgtgtggcatcggtcatggtaaggggaatcctagtgttcaatgggcgagtacagcggccttgaccgttacatgcgaaattgtctggacaacacatagcagtcgtctcgatacgttgtttggaggttggcagtgtacaggtctggtatcctgccgggcacatcccaggactgtagtaaacatcgtctcgccaatttggtgggcaacactcgtttcctccgggtccttcacatcccatttcgagcttagggatgatgtcatagaaggctctcgtgcgaatatcggaacatgaggctggaggggtaaagcgtgtcgtgagcgggccgatgtttgtcgccgtggtatctagcctcgtagcatagttggatgctgctacggggcccgctaggaaagtagaaaacaaaagaagcgccatttgagatattatca

SEQ ID NO: 6270 - DNA, 673 bp, Aspergillus oryzae
  misc_feature (1)...(673): n = A,T,C or G
ggcgtcggccccaaccaccggtgcatcgcccaggagatgaaggacatgaaggacaagctcgatgaggagaaggctgccggacaggctggcatcttcgaagtcttcactggtccccgtatgttctaccgtgttatgctgggaattgctttgcagtcactgcagcagctcactggcgccaatttcctcttctactatggtaacaccatcttcacttctaccggtctgaacaacagctacgtcacccagattattctgggtgccgttaacttcggcatgacccttcctggtctctatgttgttgagcacttcggccgtcgtaatagtctgatggtcggtgcctcctggatgtttatctgctttatgatctgggcctccattggtcacttcgccttggacttggagaaccctcccaacacccctcaggctggtactgccatgattgtcttcacttgcttcttcatcgtcggcttcgccaccacctggggacctattgtgtgggctatctgtggtgagatgtaccctgctcgctaccgtgctgtctgcattggtcttgccactgccgccaattggacctgggaactcctgatctctttcttcacccccttcatcttcagcgctatcgactttgcctacgggtacgtctttgcaggctgctgcttcgncgncgtgcttg

SEQ ID NO: 6271 - DNA, 1031 bp, Aspergillus oryzae
  misc_feature (1)...(1031): n = A,T,C or G
cgaggcctctttggacaagaaggtcattgagacggacgataatctgcggacgttgatcatcatcaccagtatttgggtggcattcagagaaggctggtcgcataatttcacttatgacgattcagccgtgacttttaacgcggggctctccccgtctcgacagccatctccatctgcagccagagccgagaatgaaccgatacccgctggacgggataatcgttcggaacggctggtatcgaatggctcgaagaaccgtgcatcggtgccaaatggctcatcctcccaaccaaatgcaccctcagaccggtccatagcatatggtagtctgactaagcgctcgaattcaaccggcgcagcttttatggagcgaaccaaccggcgtgcttctggaatcactggccgacccanaagacatagtttgcgttccagtcctcgcgaattggaccagaatgganacagcccagtggaacaaagtattagaagtcccacaaggcagtctgcatccccagatccgccactggatagctcgcgaggtaacgatggttatcaactacaccagcttgaaccgtccgatctaaaggctaaacagctgagtcgaagcagctccacaaggagatgccgacgccggctgagcagtatttttgacttcctgacccgaaagcaccactaatgaagcccggtgtttctacgctggctggtggaccaggtttcatacggttacatgacacttaattcgattctacgctccctctagtagaggtgaggaggagcccccttatgggctcatttttgaacatactttctttcccggtggccaggtgctatgaagggattttagggaaaagctcaaaacaatttgctcacggtctccgtggtttctgtctttacacaatactctcacctcttcgcagcgctgtgatctttgacgatcaagagcgactgggcccttcattttcgaccaaatcagcatttgtatatagaaagatcaccaccagtggtaaatacactcgagaattaggccttttact

SEQ ID NO: 6272 - DNA, 552 bp, Aspergillus oryzae
  misc_feature (1)...(552): n = A,T,C or G
ctgagtncgccactccttctgttaccggagtcattgcacgcaacctgctgcgtctcgccaacctgctcgaagacgaagattaccgcctgctctgtcgccaaacatgtcattctttcgcagtcgagatcctgcagcacccattcctctttgtcggactgcttgatgcaattgccggactggaagctggttcacggaacttcacaggcgttctttctacaacgcttcttcctcagaccgggcccggatcttcagacagccttagcagcggatccgacgagccaacatccgtgcgcgagctcattgtgcagagacttcgtgcagaagccggtcaggcgatctccacctcaacaaccaccgtttccctcattgacatccggccttcccacgtgggagacttcgtcggtaatcagtcattctggctgcggactcggaataagctatacaaagatttgaagccgaccgaaccggcgaaaaattatatacttgtatgcgaaggtggtagttgcaagatggtggatctatgatgctgcagggttttgctactgcgaccga

SEQ ID NO: 6273 - DNA, 670 bp, Aspergillus oryzae
catttatgcttagctcgaatgcagatggccaaccaggcagcatggctcaactattttacgagaacgataatccctacagtagcgaagttgggaaccaccactccaacgggattgttgtcttaatctcattctgctgtgcacttggcgctgtgttcttgattgtcatcgccggggttatcttcaataagatccagcggcgtcgtcagggctacatgccgggaccgcaggcgtacgggaccgatcggtcttcgagcatgcggcggctgcctccggagtacctgttcagcactctgaaatcactgaacccgggcacgccggcgatctgaacgcctgagtgccgatccgtccatcgcatcgcatctaaattggacttctttttgaccactcagaccggcgttcttgggcagaaaaccgtcttatacccgtaatttaatcctgttttacgttttgcatctctactattctagttttacctctccgggttatcccggacgatgcgctgttcacttcttttgcctcgaggtgcttcgacatcctcgcgtgtttgatctctacctttgacccgacctggacttgtctatataaaccttggtcggccgcgtcgtttcttttcatgaacccccttggttgttgatgtttggaccatagtctttccctgacaccaggaggg

SEQ ID NO: 6274 - DNA, 638 bp, Aspergillus oryzae
  misc_feature (1)...(638): n = A,T,C or G
tggcatctctatgttcttctcttgttgatgtttttgttggattgtgtgggtcgaagagggacaacgcaatgaccaataacactagcaatgagacgacactcccatccaagaccaacagacctaacaaacggccaaacattgacgagcgctctgtcaacgaacgggccaataaacaggctaggacagccgagagagattcgacctatgtgcctgaggaagacccagaatctccggataacggagatattcatgaggatggctcatcgagccccatgcatggtcgaacgagaagttcggtgaactccttggcaaagcttagagcccaaacagtcgcaacacagccgatatctcaaagttccagaaataccacaagcttacagacaagtgcatcggataaaacagcttcggagtcccctagccaggctaaacaaaccaggggcactgagagggtcatgggctctgctcacaataacaagcctgtgccgaccactacagcgatgcagggtatcagtctgcccaaagccaatccaggcaattccccttctaaagcttcgcagccggagcgggccagtgcgcanatagaatgcatgagttttggcacggcgcacgaactatttgccagcttggtgaaaaccatt

SEQ ID NO: 6275 - DNA, 675 bp, Aspergillus oryzae
  misc_feature (1)...(675): n = A,T,C or G
gacatactcgtcacccagtttctgggctatgcgacgtcggaaaatgctgtcatcttcgatacgccgggctgcatgggctcctattgcccccatcaccggcatcgctcgctcgtccagtcaagctcttccagcttcctctaataccctcttaggcgcggcacagcatgtccgtcagcgccgttactcctcatcttcttcttcaaagcccagcgacggttccagaaaagtcgacgcttcttctcagacccccgcaaagggcgtgaatgcaagcgaaaagcgtgagggtaaggcttccagacgaaggggaaaagatagcagtggccgcaacggctccaagtcgaaccagcatacggtcttctcgagactgcctagcgttccctccacccaacaccttcaaccccatgatgttcatgtagcttcattcttttctatccatcgacctatctccgtttcgaccactgttcctcctccttctagccctgaagcatttgatgccatattcaccgcgaagaaatccacgaaacatgaatcggatgatgtgattttcactctatcctctaccgtcaactccatggagaaccctgcctatcacctaggtgaacaagaaggctctctgaaccacttcgatatggagggtaaccagctcgacggaatgaacatgggcggaactgaang

SEQ ID NO: 6276 - DNA, 684 bp, Aspergillus oryzae
  misc_feature (1)...(684): n = A,T,C or G
gacacctacgtcgcaattgttccaccccgtccagcttggtctgtttcaagtgtctatctctcaatcaggatgcagttgtggaatactgtcctccagctcagtttgctggcttttactgccgccccgaccgcagcggcatccgcgtgggggtttactgatgccaccgtgtcagttcaaaccaagggcgctggagtcggttctggattgaaggaaaatatccccgacaacaaggccctcaccaagcccgtctccctcggaagtgccgacaccttgaaggtgactctcacagcccgcgaaggcagctccggaaaacgcgcgcaccaggttttcctcctcctccaagacccggagaccggactagacatctcttatcccttcaatgtgaaggaaaatggcaaatcgagggttgagctgactcaaaaggaccttcctgttcaatttctctccttggctgagcctctcgacgcanagctcttgatcgggtcttttggcagcgcggaggcctacaatggcgctgcgttcaagttggccgttacccggaaccccgatcagccagtcccgacagttgaggtctcgagatacggaaagcttcctgagatccaccacattntcaaggaggatgcccgaagcccaccgattgtcatcactctcgcgtttgtggcaatggtgcttggcacttctccc

SEQ ID NO: 6277 - DNA, 670 bp, Aspergillus oryzae
  misc_feature (1)...(670): n = A,T,C or G
ccggagaagccagcgggcccgaatgaggctggacacccatccgataccactttgaggccatatgggtcacgcactccgtcaatgaactcgcggtcatcattcaccgatctatctgatgctgaccccattgacgacgcctctcgcgcagagcgcaaggagcatcggcggagctggaggtttcctcggtctgcaaaacggagtaatgagcaaattggactcggactagggtccccgccgctcttggcttctaacccaggagctgaccgcagtacaagctcgtttggcagctggcatcactccagcaaaagctcgccgtctgatctccagcagtttgccagcgagcattcgtttcagccgctcagcctggacgctgaagtgaacaacaatggtaaggactcgtccgagccggagaagcgcagcttgtttggaaagttcaaggccaaggttgcgcaggttcgggacggagtcatggacaccgaaagggaccggacaaggagtcctcccgtacattcagacgcagagaaatctgtctcaagccagacgctctctcccgcccctaaggaaagcagtcacgtgcgacctgctccgncggcgccaattgatgtgacaagagagctccaggaaatcaacagcacgccagtgtctcctctccctgggtcaggtatgccgg

SEQ ID NO: 6278 - DNA, 649 bp, Aspergillus oryzae
gtgacctaaatcagtatgtcgtgctattcgctccatttaggcaggatatcttccaactttgatgcagatgcgccctgcggcattccaaacgcaacttatccccacgtgcaatgttgtgtaaagggtgactattgtatgagcaatggcatctgccactattccaagaacaattcggtcaatggatactatacggcggattgcacggatccaacactccaggacccggcatgcatgaaccgatgtggcaatcaacctggatcaatcatagactatgacgaagatacagggctttgggcctgttgcacatataccagtgatggaaaggccgattgctcaagcctttctgttgagaaattccctgctccagcacccagcaaactggttacaattcaatatctgcccgcaaccggcacaccgctatatgcgactccgactgatgttgtgtctccaccggttgtgaattctaccggcagtcagataggagccggtgctgcggctgggattggggtaggggttggtgttggtgtatttttgcttgcaatggcttgtgcattcttctatattcgacggaggaagtcatcgcaacatagtgttgtaccgtcgaagtcttggaccgagtcaatggctacagtacagcagccgcaaacag

SEQ ID NO: 6279 - DNA, 674 bp, Aspergillus oryzae
ctctctccttctttctctctcttgttctctgtctccatcggtcggtccttcgctccctctcgacctaattaatttaattgattgattctatgctttgattgatttcgtttcatccatcaatctctcacgttgcttcgtccctgttcatttgctaccgtcccgtgtgggtgagctgtcgatcgtattaatattatttattattcttcttctatttagtatctcacttgacatcgtgactgtccttcgattttctcacccacctgagatgactcactggtgatcccttaatccattcatttggccattactttgcgatctacacctgcatccgtcaatcattcagattcagtctacgtgtcacaacgcatggcccatgcgaaccagcaactagtgagggccattttcgcccttcatttgaaagcttatcgaccatgcctaaactcaatatcgcctgccccgctcaagacgaggcagatgatcccggagttcatcaaccttaagagtctcaccgtaccagtcgattcttctacccatcacatttgaccgaacccattcatctggaaaaactaatatcgtggtcccaccagaatacatgcgtcccaacctgaactcgactgccggactttctctgcacacgtcgttccaaccttctgaagaccgcgtgtgcaccgatc

SEQ ID NO: 6280 - DNA, 654 bp, Aspergillus oryzae
gattttacggccatgctagcaacggtgtagaaagcaacggtcatgtcgaatcagggcaaagcaccaagcagacgtcccagtacccgtatcccacagagccagagccaggtaatcccactgtgatgcccaaggaacttctctccaagttccactttgccttcctcatccgcgatccccacttcagtgtcccttcatactaccgctgtaccatccctcccctggacgacgtcaccgggttctattattatgatccggccgaggccgggtacgacgaaacccgtcggactttcgactacctgcgaagcgtccgcctgatcgggcctcatatcgcgacgaaggagcaggacgcggacgagatcgacaacaagctcaggcccgttctcaacggggtcggtgaggcacacgaatcggcaggagatctgcgtcgtcgatgcggacgatatgctcgagaagccgggcccaatgatcgaagcgttctgccgtagcgtgggtatcgactttgacccgtctatgcttgagtgggacgacgagtccgaacagaagcatgtgtgcgaagcattcgagaagtggagaggatttcacaacgacgccatctaattcagaaggctacaggccggaaacatggccgtcccgtgaaaaccgaaaaggatttct

SEQ ID NO: 6281 - DNA, 706 bp, Aspergillus oryzae
tgaaatggtcatacacagacattacgatccattcctacaacccatctttcacacgtttcctgatttggacgagtatcatacgaaggatgtgtacacgcggcatccaaccaaatccaacctgtggaagctgcgcggacgtctagatgacgttgtatcgctcagtaacggagagaagttcaacccagtcacgatggagaagatcatcgagggacatgccttagttgcgagagctgttgttgtaggcaatggcaaatttcaaccagccctacttgttgaacccaattggaatcaatggagtgaggatgatccacctagggacttgatcgcccaaatttggcctacagttcaagatgcgaaccgtatcaacccagcccatggacggattatgaaaaacaaaatcggggtagcattgaagaacaaaccgttccagactacacccaaagggagtacgcagggacggcttgtcactcgagactatgagaaggagatcgaggatatttatacaaaacaggacgatggatttacggaatatcaaataccagatacggctgatttgtctggcattcaggaatttgtccgaaatgtggtttcagacgctctcgggttctcctctttctcagaccagacagacttttatagtttgggggttcgattctttgcagacaatgcagcttaacccgactttttcagggctaaaatggtcggg

SEQ ID NO: 6282 - DNA, 681 bp, Aspergillus oryzae
  misc_feature (1)...(681): n = A,T,C or G
ctcccttatatccctttataaatgacacgaacatttctgctgagagtatccgcgagaaacaaaagacaaacaaccgaaggcctcataaaacgccgtaagctatcaaaagtccacccatgggtcaacggtatcgtacgggtagagatttcattataaccaagatagcaatcatgaaaggggaatatagtgattgaggatacacggagaggaatgcaagagaggtagtttgttggtttgttgattgagatatacagcattggggagatgggcgaggctcagccagtccgtgcagcctgtacagggttgaccatcgcttgaggttggggcgcatatacacgctgtcgcttggcgagattggggttctcggcagcactggccatgtcggagacctgccgtcgtggttgcggccgcgctgcagctgcagccgcagccgtgagcgccacaggagcggtcggatactgcaccccattttggtctaccgcatatgcagcggcagtagcaggagttgcaggtacgtattggccttgtacctgctgcaggttagggtgaaccgcggccatgccctgnaattggccgggtgtttgccaattgtttatggacgtaactggcgactggctgggagaactatcctctttgacagactgggctgccgagctctgcgcagccattgtaaccgccgcc

SEQ ID NO: 6283 - DNA, 759 bp, Aspergillus oryzae
cgactggacatatcttgtctataatacgcaactatttgccactgtcaacgcttccgagaactatatctcccacactatcttcctttccaaacccaatatacttcccgccgaacaaactccccacactttcgggacattcacagcgtcatcgatctgggttgccacttgcaataattcagtggttcacttcaaccttacgccattcaccactccagatctaaagattcacttgtgattgccattgtcagactaataatatccacgatacctcgattacgacgactttctgctgctctctccacctgcgatcttatttatcgatctttctctccctccaccactcttgaacaacaaccacaacttgatatctcgtgatctgaccgaaacgttaacatggctactcacgttctcaccgccaccacaactcctgccaacccgatctcggtgtatggcaacccgtccccggtgaacaccgccagtaactctcctacttccccccgtcagcagtatctgcccttgcagacccgtcaactgcgtccacccaagggacctctctatgttcccgctgccctgcgcccgaccgagcgccctcagaaggcttctcctccttccccccctcgcagtgttcatggttccctcgacagctcgaatgacggcagcgaggaaccccagccggccttgacccgtcgttccaccatcgagagtgcggtgagcgatggaatcagcaagttagcccaggatgaatggatgaaacatgac

SEQ ID NO: 6284 - DNA, 685 bp, Aspergillus oryzae
  misc_feature (1)...(685): n = A,T,C or G
gttcgacaacagggttcggtcaccggcatctcagccagttccctgtcgccgcttatcgaaaaattcagaacactctccgtcccgtcacgagcatgcaacattgagcaaaaacaagccgaataaagacgacgcaggacgtgattctccgctcatggatggagcaggttgctcttcagagaaaggaccggaatttgatacttcgggtcgggttccttccctcgaaacacaggggaaagactctagtgaattaaatcaagcacactctggcagagttccaagctacccaagggcatatagcgcagcacaggaccattcaccgccatctggtccctcccacgggcccaagtctttgtcctcgcaaactcgcagctcaaatatctcgctattatcggctcccactcgtcctcgcggagggccgagcttcaaggaaaacgtttggaccggtgctcccgcccgccgtgggcccatgtcagctgggtcctatgggccgccgactggcccgcgcagcggccatactctgatgccagggcctggtgtggatacccatcgtcattctacttaccggcaagggagtggtacgggagtctcttatcctcgcaccccgaggtacatgaatcaccttacgggccttncttcgattatatcaagggggagattgcctncatctgacctanatgccctcacg

SEQ ID NO: 6285 - DNA, 694 bp, Aspergillus oryzae
  misc_feature (1)...(694): n = A,T,C or G
ccgactttcatccgtttacaaccgcgttcccggttttgatacgtgctgttgaagaatccctccatgttattttactaagcgatactcacgacgcaaaactaaagagccgcggctcaccgagcaacgctctccccccaggatcagggcctggcagacgtgtagatggttcgtatctgcatttcaattttctgtgttgccctgattagcgaaggtctattttaccattgtggtataatatactgacgggactctcttactctgtacagcaccagaaccgtctaccttctccgtcctgaactggttttcttttcttcttctcttatttcgttatgccgtctttcttcgcgccaggccttcaaggcctaccacccactcccccccacatcatgagcggtggcagaatggactccgagcacccattttacgtggttggccactccgcctttccccctcgctactcgcagagcggttgtgaatttattgagcagtactcccaatcgtcctgctactccaagcccgccccgatgaacatgcacccgtcgtcgatgcgcagtggcagagatatggccatgatgaaccagcccatgttcggtccgatgcctactgcgaatgtgctgcctncccttcgaaacaacgtccagttaccccctatggacagcgcgatcccgcctcagtaccgncgacaagacatcat

SEQ ID NO: 6286 - DNA, 737 bp, Aspergillus oryzae
  misc_feature (1)...(737): n = A,T,C or G
gagcgccgattcggacgagggtcgccttgaaagcggccgaaaaacccgaagaagccccgccacttcggggatcagttcagcaactgattaagtacactcgggtctcaaattgggttgaaagccttccgccacccgcagagatggaccctttaccaacgaaattcggcattccttcattgagctggtgcccgcctttctcgagtcaccagtcattttcccatacccagtctccgagccaatcaccggtgctcaacgagatctctatgtaccgtcagcgggcgggcgctcctcgtggcattcatctcgcaccgtctaacactccctcctacagaggccagcctacggagcaacaggagaggccgaaactctccccattaaccaatggtgccgttcaacctcaggcttctccaggcgttgtccctgagacatctcacaacactcaggccggcaacaaacgacctcgtgacgacgatgacaacgatgacgcagcccatgatcgtcccgctcatcgtctccgtcaagacgagcccagccatccatcggccaccataactctgaaccaggaatctgctttgaacggcacgacagccgtagacagttctgtcgagaacacgtttggcanactctgggagcgagttgcaccactcttcaaggatcctgttctggcccangggccccgcggcattgaaatccgaatccatcatgcgcgaattattcagcgaaattggaccgctcta

SEQ ID NO: 6287 - DNA, 647 bp, Aspergillus oryzae
  misc_feature (1)...(647): n = A,T,C or G
accgaggcgcatcaggaccacgacccgccgctgcgcatcagacaacagcaagccgcgagtcctagaacagcccgacaaattccggccgccatcgcaccccgcgcgcagggtcgtgcaaacgcgcaatggaagagtcgtcggtcgagagccggtgaactacggtcccaagctcacggagaaagagagggaggagcagaaccgcaagcagtatccgaatatgttcccgccggagggcacggttatgtataagtttttgacgaatcggtggattcatatctggattgctatgagcgtacttacgactttggctacgtttactttcactacgaactttaagcgctcgtcgccgtttgcgcacttgcttccgtcttggtcggatcttctttggcaccccgttgataccgtttctcaggcgttgtctgttntacgcatgcatgtgcagcatacctccgtgcagactatggagaagcggcgttatcgatcgaggatgcngagatgagactgcagtaccgggttgctcatgggcttgaggagctcgctgaaagcagggcagactgagactgaggtggtgatgatcagctccgtagctgcgatcggagacaagcaggaggtggggatatgtgattggagggaagaaagactgtaaa

SEQ ID NO: 6288 - DNA, 613 bp, Aspergillus oryzae
ggtgcgccgggcgcccaagggtcacctcatctgggcggttcggcccatccaagcccggcgcaaagccaccttgctggccctccaggtatggtgccacagggtcaaatgcaacctaatgttggccagggcacgagcgctagtgctagcccgaatgttagtcataaacgacgccgggcaagtacggtcaagatggaaaacgatgacggcgctccggaggttaacggcaccgctcccccgggaccaaagacggtaaaagccagcccacgtgtgggtggtaaaagacagaaaggcactgctaattagaggagttattgcaatgggctttgttcgcacttttttcttttttcttttcttttcttttttttttttacattttcatttctctcaagagacggggaactggcgtaccgtttttggataccttttgcgatgctgatcttctcttttttctggggcccctatccattgaacatatcggattatcgttgtcattgcaattatgcgcggtcttttgtcggtgtagtgtgatggatacggtatggctgttcgttacgatttctgttggcggtgcgaggcaccggcctccttgaagtctaaatcgcctactacgaat

SEQ ID NO: 6289 - DNA, 752 bp, Aspergillus oryzae
  misc_feature (1)...(752): n = A,T,C or G
gctcaccgtccaatcgacgagggattttaagtcgacataatctcgtgaacgtctcctcccgcttaatccatccacattgattacccaaattttgacacaacatgaatccagtcttgcgctctcgctccatactgagggtagccaattcgtcgatcccttcactctaccgttcccagaaggtgtctcctatgtcatggcggacttacgctcatagttcctatggcggagaaggggagactgaagctcaacagccgaataattctcggaataccccaacccgggacattgaacatccagggccatctgccccagatgtcagcaagggctcgacagcatcttcaagctctcagcctcgatcttcttccacttcccaagaagatcgagataaggaagattcagaaggcaacgtgaagtcagatgttcccaacgatgtaaaaaagcataacgaagagatggagcaccggtatgatcgaccctacaatcaactcgggaacgaagggaaacccccgaagggcttttgagaaaggccacaagcttggacgagtggtgtggttcgtggcgatatcccttatggtcgggtggagttgggaaagttactatatgatcgattaaatggaacgagctcagaaataaacgcattcggaaatgtcatctggcccattatgatagttaggcttctagttacgatgtagacccgagcgcaataaagtttacgccccagggtcttngatatatccttaaaaaaaaaaaaa

SEQ ID NO: 6290 - DNA, 632 bp, Aspergillus oryzae
gaggataaagagaattctcacacgcgctaattttagcaagacttggcgtgtattaagactttcggctaaaagcaagctcgcggcgttcgacaagattgaggatggcaaaaatctaaagctgctttttgaggccccacagccttccgaaggcactccccaagttcttgaaggcacccctcaggcccatgagacgatgacgaaagcctcaaccgagggcgagtctggtggttcggggcatgatcatgggtctaatagctccgaacaaggaaatgtcactgttgccaccgagaaaggttcagcggactcgaaggacgcagcagcagcagcaacaacaacagacacatgaagaacgccacgcaggcggccagagaacgcgttatcatgattggctctctgtggcgccggaaaacgaacccctacgatcctgatcgatgctgaattcgctacaccaattgatgatttcatgtgcttgtatgcgtcactgtcacaacgctatgcgggagtcctgcagtaccgtaaaatatgaaaggggcattagtatgcggactgagttttctgggaagagttggggcgtgttccttatgacgagacgtgatgggagattacggcgggggattttaccccttttgatg

SEQ ID NO: 6291 - DNA, 1310 bp, Aspergillus oryzae
  misc_feature (1)...(1310): n = A,T,C or G
tttgatcccccgctgggatttgggtccagatgcaggcgcgttcattcgcatacaatttccggctattgggagcggccctgataaggtatctcaggaagatgtggatacttttgagaccattctagcacaatgtaccgcatttctggagcgtgcagccccaccgaaagaacatgctccgtacaacccagcagactttgcgccaggtgcaggttatgtctcgtctacgagccctgatcagaaggaccctcatggacggatagtgctcgttgatgaagaagatggcagtgttgttggtgaaatggaagggtatgatgtggttgagaaacctggcgtgaagcccggctctaagaggcctgtggaggtagaacttcctacagaaggtgaaggtaacaaagtcagcgtcagcaacgtgtctgaggaatacttgcagatggcccggcaccctgcgtataaggactcaacattggtccaaacttctgctactgcctctcgtctgatcgtgactggttcttcatatgttgccaatctgatgaccagtggggcggnaacctttactaagaagacaaacctaaccgaagccaatgacgttctctgaggctactcactcaagggttcgtaaaggttggaaatctcacgcatggtgccgctggcatctcagccaagactgtcggccaggtcggtaaggttgcacagaacttcggtgcttcattaacccgtcgcaacccggacgcaaagcgcaagggcgacaaggcagtgaacggcgactacaagccgggcatactaaacaaatcaatgatcgcattctcgacactggcggatggtattgagcagagtgcccgcaccgtactaacccatggctctgctgctgccagtacgatgatcggacatcggtatggagctgaggctggcgctgtggcgagcgatttgactgggggcgtgaaaaatgtgggactagtctacatcgatgccacaggggtcagccgtaaggcagtcctcaaatccgtagctaagggtatggttgtcgggcgcatgcgcaacggacaacaagttctggtcggtagtggtgatggcggtgatgttcccccggctgcaggaggccggagcaatatcacctcagggtcaggtggacgtggttccgttgcaagacgtccatctncgacccctacaccaccgnccgcctatggtgcgccgaacacaacgtcgctcggaggaataagcatgtcagggggaaagcattaaataatgcatgatatacangggattggggatatttctggactttggattgttttcctttcttcctttggttt

SEQ ID NO: 6292 - DNA, 575 bp, Aspergillus oryzae
  misc_feature (1)...(575): n = A,T,C or G
cgaggcggcacgaggcaagcagccttctaccaaaaccgcaatcgggaatcccgcatcttcgccaacgagcccaatgccgtttatcttccgctagctccatccatggtctacctgcgcgatagtagcaaagggcttgtcattggctttgcaaaggcagaggatgccgatctatggtgtcggacatccatcctgggccagaaacatggccactatgaagtgcacatcggacgcggatggacagacgagcagctgaaccaagctctccaggtccaacatcagccctacgttccgaaaagcaacagccgacctcagagtatacagtccaatatagaacccactccgccgtcgagttcagggtcggacaccaatatgaaatcctcgtccagtgctcaaggactatcgcttccccgggacgaatctccgtcttccagtcagtcttctcgagcttcgtatataccgtcttcactagctattggttccagcaagaatacgcaacggtcaaaatctcctggtcgtactttaccgcccgcattgcttcagggaacgcctatncctcgctattcagctcaggactn

SEQ ID NO: 6293 - DNA, 689 bp, Aspergillus oryzae
  misc_feature (1)...(689): n = A,T,C or G
cgcgacgggtctaatacccgggaagaactgtccaacctgaggccaggacacaactctagtacaagagcacgccgatgaccagaggaggatcaaggaattggaggggcagatcagcttcttgagtgtacatgctgcacaaagagccgagaaactcgccgagtacgagcatgaagtgcgtagtctccggacccaggcctcatatgcttctcgaaatggctcctacatatcatctacgtactgcaacgaaatgaaccggtctctatcacctccctctaattcgcaaggacgtctatcgactcttacattctttctccattcccacggacctagcaacacatcctgcgatccagacacgcgcgcaacccatctaccaacctgcgtcgcggcaacccagcccagaccacacagccgagctgcacagtgcgctagatcgcgaacagagcctgcgccgagcagcagaatcgcaattatcgcatgccagttccgagctggaagagctaaccgcgcaattattcattcaggccaacgaaatggtggcccaagaacgcaatgcccgtgcgcggcttgacgagcgagtaacggtgttagaacgtcgggacgtcgagaagaggacccgtcttgagcgcctcgagaaggcgatgganagggtcnagcgcatncgggcactcgntggtcantgattcgcgccc

SEQ ID NO: 6294 - DNA, 704 bp, Aspergillus oryzae
  misc_feature (1)...(704): n = A,T,C or G
tttagtttctatagacgacgatgagacaagtgatctggataagaaggaggagaccgcgcccacctcggatgctagtacctcctcgatctttgacaagaagactgactcatcagccaagcccaacaacatcttcggtcatttgtcagcaacaccttctgaggctgaagagaacgacgatgctgatgacaccgaggaagcgtctgccgctggtgatgagccaaaggatatgtccaaggatacatcccttgcgcccgctagcgaagacgaaagcaacgaatatgtggatgccaaaaccggtgcccgcagtggtgctgagaactctgctaacgacagtggtgtcaccacggagatcttaccagcgctctgaaaaagtcaacgcaagagaagaccgccacaaacgagctatccgacagagatacacgcgcgagtggtcatatcttgtttgaccgtgtcgagtacaaacaagacggcacgctgaagcgtgaggacgacgaggagcanacgcccctttctacgttttaaaatcctccaaatatgcgtcctctttcaactcaccgggaacgccaaacccatttgctccgactccctctaagtctgatgccgagaaaaacgatgctcccaccttgaaacccgcaccgccgaaacccctttgccagcctgtgtggttctccctcgcctacccctgttgcaagcactctatttan

SEQ ID NO: 6295 - DNA, 680 bp, Aspergillus oryzae
  misc_feature (1)...(680): n = A,T,C or G
cgaaccgggatccaaaacagggagaaaagaactcgagaccttgggaacgcgagtcgacgaggagtttctcattctcctccctgaatcttctccaaccgactcctcgagcaaccaaggagaatctgaaaagtacatcctggaagcatacacaaccttcttcccttccggcttcgacacccgtaagaagctcggcctccgtcttgcatccatccacaccccggtcccggggtataaggagaagcttgagcgcagtatggaccgattttttgcacgggtcgaggtcggtcagttcgtgcagagggtcaactggagtattactactgattcggagttgttcgctgcgtttggtggtgtgcacggcgacaagggagagagtgggaagactttggatcttggggaactggacgtggattccacagttttaaggtgcgaacggcagacgttgcatcgccttcctcagagcaaggggctagtgtttgcgtttcatacgtatacgtatccgatccagatgatcaaggatgaagggctaggggaggatctggcggctgctattgatgggttgaaagaagggaatgtgcctgaaatgcattggtacaaacggngacctgtttngggcgaggctgtgaaggagtttctacgctcgtaatcatttttcgtgttggtcttcaanaaaaaaaaaa

SEQ ID NO: 6296 - DNA, 653 bp, Aspergillus oryzae
  misc_feature (1)...(653): n = A,T,C or G
gcggaaggtctcaccggccaggagatattagaagacgatggaacgggcgcgctcgtcgtcccgccgtcccgccctgctcggcaatatcatcaccatacctatatctgtctgttctatatcttagattgtcaccacaccttcgacgatgtcgagcaatggaagactcacgttctgagccacttccgaacccacgaaccaccgcgaacagcccgatgccctctatgtccgggtgagcggttcagcgacacccccgaacagaaaggatgggatcgcatgctcgaccatgtcgatgtagcacattatcaacggggccagaccctagctggaagccgaccggactttcaactgatgcagtatctctaccgcttgcggatcatcagcgttgaccagttcaaggtgatgcagctgccaccgncgncgtctagcccttgctatcatcgatcgcaagaacccgtccgggcaaatatnagggcggccgatgaaccatactgtgcttcgtattatcgaccgcgagaacaaaggatgcgaagacagccgtcaagggtcaacggcngatgaagtcctgggccttttaataatccaccaaactgggtgggggggattattgcgatgagagggctggctccaaagggaacccatggggaccttggttc

SEQ ID NO: 6297 - DNA, 723 bp, Aspergillus oryzae
  misc_feature (1)...(723): n = A,T,C or G
ggctcgtcgagtacgatcaccacgacagtgactactcagacaactgcttcttctttcctgaagactgttcctggtcaccgcctcgtgactggaccctcgaaaacgaagagtcagaagacgatatctcaaacagcgacgaccacgacaccatgattcccggtcttcccgatatcaaaatgctcgacgcggaggccctcagcgacttgctggaggataacctctcgccccctgagatcaccacgattctagtatttggtactaatggtgccatatttgcctacgcctcatctcttccatcccggcagctgcggaatctgaccgccacatacggagccgcttacacagcctacgcaaagaacgcctcaagtggtaacctaacgggagtaaatcccgccagtcacccatcatcatatgtgacagcccaatccgtctctcttggcgacgtagggtccatcgtctttgaactcgatgagcttgtcgctgtagtcactagaatagcggatagagtgctccttgccgccgttggaccgtccaaattggagcccgaaggagagacgggcccttcaaatggtgcgcagaatggctctntaaacgccagtgcggacgagttccccctgcatgagcctagaacaggcgccaacggtacctncaccaaccaaactcccaccaacggaaccccccacagtatcagccgaactcacagcgaggccaacatgctatcaa

SEQ ID NO: 6298 - DNA, 649 bp, Aspergillus oryzae
  misc_feature (1)...(649): n = A,T,C or G
caacagcccccgcgtagatacccgcatgagtcagtacagcagaggaccaagcagaggaccaagcccgagcccaagcacatatcaatccagcagcatgagaagtcggttcagtcagtcaccgactgtatctaccccgccccagcggccagctgatgtagcatactcgccccatgagtacccaaggcgaacttctccaaatcccatgagccgtggcgtttcaccgcagccacagttcaggcaacaggcccgtccctcgagtgctggaggtatggagttgcagctcgccaatcaagtcgacatgtacggaggtgaccacggttcgccaaggcaagctggaaaaccaggatccttttatgacgcaggaagccatagaagcaggtccaggagcaggaccctggccgttgcggatcctggcagacagttcagccgggatggtcgccccattctccacttcggtaagccaacggaacccttgccattacgtgatgaggcttttagctaactttttgattacagnccgagccatgtacagctataccgctgccattccagaagaactgggtttaccaaaagtgatgttctatcgggcattcgacttcagacgacggctggtgggaagctgaagtactacccacccggggacgggacg

SEQ ID NO: 6299 - DNA, 664 bp, Aspergillus oryzae
  misc_feature (1)...(664): n = A,T,C or G
ccatttggatttgtccggcctcgatggtgtttccggaccagttttcctcatggagaagctgcccgtagagattcttgctaagataattgactatctcacgccgcatgagcaggtgcagctccagtctgtctcgaagagattcttcggcctcgcgcgggacaataacctatggagactccattgttatgaacaatcatgggccgccgcaaacgcctnctactcgggcaacagggcctcggcacgccgtgtcacagattccactactccccttaactcattgggccagacttctcttcggtcccttattcaaccagatatttcgctcttcaaccgggatcaaaatggggcatttggccaaccggccagaaccaccacgacacgggaatcgccctatgaaggggaaaatatcgactggtattcggagtatattgctcgcaatggaccgatattcttcaattggcttcaacagccctttacaaaagaaagaccaagggaaaaagacaccccgcgaaggccaggtgtggggttgctcccggattggagctctgtgccacacaacaaagctatctcacccttttaacaaaagcggtgtgttgcgtttgggacccaaaatatttcccatttaaagggggttcaaattctaaaaagggggatatttgagatg

SEQ ID NO: 6300 - DNA, 684 bp, Aspergillus oryzae
  misc_feature (1)...(684): n = A,T,C or G
ggtccctttccagggggacggtggcctaaggccaccacgggtcacggggggccacacctctttttttggctggccctcttcctttcccctcctcttcctctgtcaatgtccttccaacctttaaaccttttaaataacagtcttctggggcctctccagcttcgtgctgtaggcgtttattctcctaccttgtcacgggggcaacctttgtcactctcgtcctccgtgtacattacaattagttaccgcacatgactccacaatctgcttcacctgtaccttccgcagtctcctccgccgcagcgtcacagatatcgtacgatcctcgagatggagagccctcggtaacacgcgctcttgcgggcatgaatttgtgcgcagcgaacggggatattctgcccacgcgccctccgcctgcgaaaactgccaggccgactatggcgaatcgcatctctcgtatgttgtccaacacagggaagacaacttcgaaggagccggatgcccatcgtgacttttcagacagcagcacagacagcgtgaagccatctagcaatggcagcgggaggcaatctaagcccacttctagaccctcttctagagctccatcgcgacagacttctaccagggaagacaatgagaganagccaaagtctatcagtggggaaggacaaaaagactcatctn

SEQ ID NO: 6301 - DNA, 682 bp, Aspergillus oryzae
  misc_feature (1)...(682): n = A,T,C or G
ccatgtgccaatgcaaatcgtcgactacactgatttctacgccggcctgaaccacgcttacaatgtcggtgtactgttccgtggaccagagaatgccttgcaacccaactataagcatctgcccgtcgcataccacagtcgtgcctcgtctgtcgtgccttcgggcacacctatccaccgtcccaatggccagatcctggccaacccagccgctacacctaagctccccaccttttccccatgcaagaaattggacatcgaactggaactggctgcattcgtcagcaagcccaacgatctcggaaacccattaacatcaatgaagccgaagatcatatctttggattggtgctcatgaacgactggtcggcccgtgacattcaagcctgggaatacattcctcttgggccattcaacgcaaagaactttgccaccacgatcaccccctgagtagttttgttggacgcattggagcccttccgcgccacgggtctggaacctggtgaccgggactctctgctcccctacttgcgtgagaagcgcgcagncaacgtttacgatatccctctcgaagtcgaaatcaccagacgcggcggaaagccaactatcatctncaactgcaacgcaaaagacctnctatactcgttcccccagatgttggctcaccataccatcacaggct

SEQ ID NO: 6302 - DNA, 675 bp, Aspergillus oryzae
ggaaggtattctattgacggtgaattggtttgtggcaggattcattcatcgggtgacgggtggaatcttgcacgtgttggcctggccgatccgtgctttggtggagcgcctgcgaccctgttttcatcgcgtctacggtagtgtccggcggcagccccttccggacccggagacttacgagcagattgcggtcgatgattacctggacgataagagtgatgatggagaatcggaccatctgttgcacaccgggaccgcgaccggaagcacggccccaacggagcgcaggcggacggatacccccatgcgtcgatttgtcgtgttgggtttgttcgccttgttcctgctcctccgtttccttcgtccgtgggcgccggcgtacttgtatctctcaggcaccctgccgttgacaccgttctttgagggtggacaccggaagtctcccgtcgacacgacggccttgccgggggattatggctggctggaagagcggtcatccttgcaccccgcaccgggttgggactggatgccgcagaaggggctccccggattctctgattgggataagaccgaccgtttcgccttgcactacacgccgagtatggacccattgcacatctccaaccgggataaccctgtcctcgattccatccgtcccgtgctggaggacaacag

SEQ ID NO: 6303 - DNA, 674 bp, Aspergillus oryzae
  misc_feature (1)...(674): n = A,T,C or G
gtattcttcacctctttacattgtacatgactatatatacttgactttcccagcctgacaagataaactaccgtcgtcaacattttcattacctctcccaacaccaacgatattccagctacaaaaaatggacacccccaagccaacagttctcgtaatctccggagcatggcacaccccaaagtcctacaccaaactcgccaatgccctcaaaaaagagggctacgaagtccacgtccctcgcctccccagcatgaacggcgcaaacccacccaacgcagatctaacaaccgacacagacctaatccacagctacgtcgaaagcctcgcctccgccggtcgcacaatagtagtaattatgcactcctacggcggccaagtcggaactaacgccctccacaatcttggtcgaaacgaacgtaagaaacaaggactggtcggcggaatcagccatctgatctacatgtgcgcttctcttttcacagaaggggcctgtatattagatatcgccagggaatttggtaccgcggatcagattgctaatgcatctgatattctgggtatngttccgaaagaagaagtgaaaaagctcatggctgggcctggggtggatgatgcggatgctgangagctgngttcgtccgtgacgaagtggaatggggatgccatgttta

SEQ ID NO: 6304 - DNA, 572 bp, Aspergillus oryzae
tttcctgtgtgaagaaggcttcgaaaaaagacatgcggaggttggacctcgccatcccctatgtcgacccgcctgccaacaaggatgatgccgatatgtctggcgcaatgaccagcaccatgcccatggccgcgatgttcacccgtaacaggatgatcggatgggtctcattcgtcttttcacttcaaaaatgggctcggtgaaacaactgagcagaaaaagacggcatctactcctgcgtatatgtctgtcttcatgtccttgatggcattggttgttccgtatttccctatattcatgcctccgccggcggttccagcaggtgctgccactgctaccccttctcataaacaatgccaactgtgtggcctgtttgaggaaattgaattgtgatcctataccaccttgtatatctattacctaaaaagggggtaggaggcttctgaagttaggatgatacccaaacgtccacgtccatgcggtcatcgatttgccactgaagtgcatggtgatcacgtgggattgaatcaatagttagtctaatacaagtcttgatctttttcttctgtgtc

SEQ ID NO: 6305 - DNA, 671 bp, Aspergillus oryzae
cggccatcatggcattacttgtgatggatctctttgggatccagaaggcattcgccctgggaacaagtcagggaggatggatggtgacccggatggcacttctcgcaccagacaggatcctcggtctcatgcccctgggaacatccatggattacgaatcagctgattctcggtccaagggatgctgggaccccgcagccagtttgacagccttctatgacaagtggacgagccctttggccacacctgactttgttgtcgatgatgtttggtgcggtctggtaggaggcattggcttcggggctgcggccaccgcggagaaatctgccttctggacccaaaccctgaaagaggtgtacaagggtgatgagggacgaaagaaggtgcgcatggcgctcaattgcctcctggagcgagacggactgttgctccgactgagggacatcaaatgtcctgtttattggctacagggcactgaggatacaccatttggaaccgtcgttcctgcggagcaaatcaaacttttcactgcttcccccgaggccaaattggtcatgatcgaaggcggggcgcactatctgacgccaccaatccgaaagaggtgaatgaggcactcttggaaatgtcaccaagtatcaatgaagtgttcttgtgaaagtcttgcaaatagg

SEQ ID NO: 6306 - DNA, 1045 bp, Aspergillus oryzae
  misc_feature (1)...(1045): n = A,T,C or G
ctgaactcagactcgctcttctgcattgctcagcaccctatccacaactctattgttctcactggctccggcgacgataccgcatacatcttcgattccacaccaaacaccgagcgtcctcttctcccacaaagttacgagtcgaaccctcaaccgaaaaaggagcgcgaatctctgcagcctattgcaaagattgaaggccacaaggatactgttaacgcagttgcgtttaccggacccaagggtgaatatgccgtgaccgcaggtttggatggccagctgcgtgtatggcgcgatactactccccagttgactggccaggcttgggagtttgtcgcagaggcgcaggaggtagaggaaattaactggattgctgtttgcccgtgcgagaagggtgacgaggagaatagcaatgtcattgctattggagcaaatgacgggagcgcttgggtattccgcattgaccacaacgacaccgctcagcccattacgatcatgcagacgttcttccagcacaccggatcctgtaccgcaggtgcctggacgcccgatggaaagctgctcgcgactgtctcggaggatggcagcttttacgtgtatgacgtctttggtgccgccgccgccgccggtatctcttactctgctggtaccagtgccgtcgttggattgaccccggaggaccagcggtttgcagttgatggaggactttattcggtcgcgattgcgccagatggtgcattcgctgctgttggtggtgcggaaggtcacatcagaattgtcggtcttcctcgtcttgcgtctggtggcgctgcagcatctaaagcgaagggtaagggggccgcctctcagtcaaccggtgctgctgctggtactatcttggcctctcttcaggctcagtctgacggcattgagactntgtcattctcttcccctcctttgagtctcctcgctgcgggctcggtagatggatcaattgccctgttcgacaccgcccaccgcttcgctctccgccgccatatcaaggaggcgcatgagggtgccgtaa

SEQ ID NO: 6307 - DNA, 671 bp, Aspergillus oryzae
cttattttgtagtcccgttgaagtgttcgaaaaatgtctcagcttcaagactaccgtctcctgacatttgatgtctacggcaccctggtcgactgggaaggacgcattttggctgctctccaaacgtctcttcatagaaacgacactcaattgccccgtgagcatattcttcacgtcttccatgagctggagcgggatccaacatgcccgaacaccagatatgcagtacttcgaacttttccttaccatcccaccctacactgttgaaacagctaggtctcaccacttcccactgctgaaaaaagaaaacttttgggcaactgagggcccttggcaacctttcagaaaccgtatagcacttgaaccaattttagaacctaccagctagaggtctaatcaatggttcactatacctgctcgcccaaacaaatgctggcaaccataagacttcccttcgtctacttattcttcgacccagattttcgatcattccatcccgtatacaccacaattgtcccctccttatcccactccaaagcaacctatggcgtgccgccacatgtggttcactaccacggcatcaagcactatctataccttctcccttaccctcagtagcaagacaacccttctgcgcgtattcgcccccctatcatcctcttcatcgaccc

SEQ ID NO: 6308 - DNA, 559 bp, Aspergillus oryzae
  misc_feature (1)...(559): n = A,T,C or G
canaactgctggcgctggaacgtgaaatcagcgtgggctccttagatcaggatgtgcggcttgggtctactgcaagtgtcattgtcaatgcaatggcgcctctatgcggacagcaggtcaccacggggtctcctggtagtacatttctcgctgcttggggtgatcgtcgaatcagacttcatgacgttcgctcaaaccgggcatccgagtccacttataaagacccaaccgaccaaagccaaatctactcccttcacccttttggccatgacagatttctcgcaggagccggcgcagacgccgttgtgaagatcttcgatctccggatgccaaaaacctacagttacacagattccagggcttcttccatttaccagcacaatgtgccccgtcgaaaagcctctggaggagagatcgcacccccagtagagagcatcaggtacccccgcaaagatttctccatgttcctattctacgcaccaccattgtatccaaatgcacctcggaggcgccaacgtgaatccactccttaccgcggngccatatactccctgtgttc

SEQ ID NO: 6309 - DNA, 580 bp, Aspergillus oryzae
gtccagccgttcaattcgacagggtctcagcgttttttgacccggcccctgccacaggtggccgttcgttataacgccccccgcgccttcttctctcaaggcaggactctcgcggctgcagagcttgatgatcctttgcagaatggtaattaccagaaccctcctcgcgttaagcgtgctttcagagaccctcatggcgactggtgggacaagcaagagagacggaattttggagaaccagtccacgaagaaaacgaaattctcggtgttttcagtcctgaacagtatacgcatgttacgtcccgtaagggcttcttccacctgggcgtgtttgttgcaaccttccttggattttgtggtctcgtgagcttctactatccagacaagcctagtgttcccagaacatacccggaaggcttggagaaggaacttggaggacccaatgctgttaaggcccgcaaatccggcgaggactcttggagattgattgacgtttgctttttttttttctcctgttggggaaataagtacagtacgattctcttttccgcgtcaatcgaaggtcttgtttcaagtgtga

SEQ ID NO: 6310 - DNA, 687 bp, Aspergillus oryzae
atccaagctcagtaatacgccaatgacctccacctcaatctccctctgggagagggtagatctcatgcatggtcaattgaccgttctaggcacagctctctataacgccatcacaggtatcttccgaggccaaagcggtgcatcaggatacgggctccacatcggcaacgcagcgttgagaaaactatgcaatagactgagcgcagaacagttccaatacatgaacggccccacaaggtccgtctacgagacagccttgcagaaaaaaggacttcaacccgaaacagtccctctcaaacacggtgcacaaggccactggatcggaaacaagaatgccaaaaatgtggtcatctattaccatggcggcggattcgctgtgcccggtgcagcaggccatatgaccttctacggcagcgtgatcgataccctcaacgcagaaggccacgacatagccctcttcctgataacctacagcctaaccccgcacgccgtttacccgactcaactccggcaggccgtggaggccctccgctatatcctcaccgagacaaaccgtgacccgccaacgtgatcgtcggcggcgactcgcaagcggaaacctaaccgtaacccgccttcttgatctgtcacacccggattcccagaatgaacctctgtccgaaataacgcccttaacggggttgttgc

SEQ ID NO: 6311 - DNA, 701 bp, Aspergillus oryzae
  misc_feature (1)...(701): n = A,T,C or G
ctggatcacgtcgcaagatgtccctgtttcgacgccaatcagcgctctttcaccaaaaccgcctttcctcatatctgaagtacttgtcccgccgccaattctattcatctcctgcctcttccactccaaaggactctacatctcgtctccgcaagctgaatgatcgcctcccgtccttccttcgcgcttatacaaccccgttactgggggccccgggaacacatattacctcctttttgatcctacatgaaatcaccgccattgtgcccctattcggacttgtgacggcttttcactacggaaactggctaccaaacttaacttctaatagcgcctttgaagaaagaaacccgcgattccggcgatggttgcggaaaaaaggctggtagaagatgttgatatggacgccattgaggtagtccgaggtggaaaccactatgaccctgttagaaatgatcaaatgccggagagtgataggaaaggtgtacccctggtgctggaatttgcgacggcctagccggcacccaaagcattactggccgttccgaattgccgcaagtgtcttggccacgcctgggtttgccgcaatcatcttgttcccacctgaaaaagggttaanaaactctgtgggaaaaaagaaaaatttgacggtccctggtattactaccaattccggaccggtgaagaaaatgcaccaaact

SEQ ID NO: 6312 - DNA, 647 bp, Aspergillus oryzae
ggcagaactcggctctcttcatcaagcagcccccagaactatcgaggcaattgctgatatgccttatctacgcgagaaattccagggtgtcttgctccgacgtcgtcaggaacaaggagacaagaaggaagatatggacggtcgtgagcatttcgtctggactggcggcatccttggagttggcggtcaacggagaccattcctgggaattgatgaaacgactggtgagccaaccaagccgtatgatatggctgaagaacgagcgcagcgagacgtcaagtctcaaggagcctcagaagatcaaaccgaagtacatgcagccgatggtgtacagattgccgagggtgcatctacacctccagtgaagaccattgactacgaagatgagtacgatattgaggccgaatcgctcttagagacaagacgcaatgcgcagcaagccaacgatgacttgttggacaatgagcatcgcgaaaacatcgacagtaacctcgcaaatgattcctccaccttgactgaggatctactcgccatggacgaagatgtttcaaatgatgactatgaccaatggtttgaagaaagtattgatgaagaagctatgtctttcgagaagtggaggaacgtattagtaggaaaggagaagttgt

SEQ ID NO: 6313 - DNA, 695 bp, Aspergillus oryzae
  misc_feature (1)...(695): n = A,T,C or G
tccaagcgtgatgagcttcttgcaaaggttagactaaacaagcacaaagcagccactggctggagcgcttggactttcgacacttgggacactgagcacttgaagaaatacctgtcttcaatgaatgcaaaggcagctcaccgcgcagatctgactcgggatgagctggtgaagcaagctcaagatacttacgctaaagcctccaaggctggaggggcaaacctggcatcagctacgtcatacatggcgcaggctactgacgctgccaagtcttccaccttcgacacctggtctcattctgaacttaaggcttaccttgactcatatggtattccggtctaccaaggctctagccccaacgaattacgcgctgcagtacgtcgcaacgccgagtactttaggtacggtactagtactcctcaaggaacaatctatgccaagctccaggatgctaccaactggctcctggatcagttgaagatcggagcggccagtggccgggctcagggtcagcgggctgctgagaaggcgcaagagaaggctgcggatgctgcggaagaaatgcgagcggaactgtgaatttggggagtctagggagtttttaatctcggtcacgatttgatgactnngtacagtaccttttgattcttcgtcgttttctcttgatttattttaaacatgncatgataataacc

SEQ ID NO: 6314 - DNA, 462 bp, Aspergillus oryzae
cgaggccaagatgttctctcagacccttcgccgtgctgcggcccagactgctggtgcctaccgctctcctttcgctcccaagtacactactcctcttaacttccacggtgtgaccgttggcgctgccaccaagtatgcccagattgccgccactttcggcgccagcgctggtgtcttcgctctcttcttcttcggtgaagttccccgtgtccgcaacgatatcctgcgtcagcttcctttcttcgaccagtacttcgaccgcaccattgcccccgaggacaaccccttctaaacctttccttacgaagtacgatccatcaaccatatcctactcgcagggatttcttatgtttgcgcatatgctccctatcagctatatagtggaggaaggagtcggttctgtactgtgtagaatagcagcgatgaattgtgacagcacatagacacgcctccttaattatc

SEQ ID NO: 6315 - DNA, 776 bp, Aspergillus oryzae
ccggattcgtgcgttgttcgctgccgccaaggcccgtatgctcggagttatgggccccaagccacagtgcggtcgtcctcgtcctcctcatccccaccacgatggtatgccattcccgccccaggccgaaggccacgtgggacgtcccggccaccctcaccaccaccatatgcaccatggccctcacggtaactgggagcgcactgcctctcgcgttgtccgctttattgtcatcccggctgcgctgggcgttctggcaggattggctgccagtgctgtgggtatgttggtcggtcaggtggtagtgttcttgtggcagcgctatcgccgttctgaccgcgaagagtctctggagcaaggcactacttctgagaagcagggcttgatgaccgagtctactgatgaccttcctcctgcctacagtgacgaggaggagccagctgaggccgcagccgaccacaagaactgaacgaattttacttttttcgggcgttgagatagaaggaatctttcttctgggaaggacaaaggatcggcgggaagctatctcagctctgtcaaacaggaataggatctaggaatttttattggttgccagtgacttttagggaagattgacttgaagcctgctttctttcatttatcatcaccgtttccttctacttggtctgctatctccttcatccgtccttttgttattactatatttgtatactctgcccttccgggaatgtgcttcgcccgcgcatctcaacaatcccagagagctgttgtgt

SEQ ID NO: 6316 - DNA, 1274 bp, Aspergillus oryzae
ctctttccatctgataaggccctacacatcggtatctattggtaagacaattgcaagcgagccagtcgccctttgagcacaagtctgtaaacactatgaattcgacgctactgtcggctcccccggagacttactggggccagtttgaagagatatctaaatacaatacccatttaaatgtcctcgagaggctttggacagcatggtatgcatggatgcaaaacgatgtcctggcgactggcatcatgtcttttgttatgcacgagatagtttattttgggcgctccctgccctggatcttcatagacagtttgggcctactcaagggttataaaatccagagtaataaaattccttcattgcgcgagcaatgggattgcgcgaaatttgtactactgagccattttacagttgaactacctcagatctggctattccatcccatggctcaattctttggcctttcgacgtcggttcctttccccactttttggacaatggcctaccaaattgcaatattcttcgtgcttgaggatacatggcactacttctcgcaccgagcacttcattggggtcccctctacaaggctattcacaaaattcaccatcagtattcagccccctttggcatggcagctgaatatgcttctccgatcgaggtcatgattctcggtttcggtactgttggctgtccgatcctctggtgcgcagtaaccggcgatctgcacattttcaccatgtacgtttggattgtactacggctgttccaagctatcgatgcacacagcggttatgagtttccttggagtctccatcatttccttccattctgggcgggcgctgaccaccatgatctccaccacgagaaatttgtcggtaactactctagcagcttcaggtggtgggattaccttctagataccgagtacagcccagaggcaatcaaacgacggagggagaacaaggctggaggagacgctcggaaagaccagtgatattcctctcgcaattactggcgacctcctcgatcttgttttttgtttatttttattttgatctgtcctccacttcttcatccctttctttgagttcatggatggcttatcccggaatttgatatcgagcaaccttgtctatacatcctcaaccacctgcctgatgtacagcaggctttcggtcctgttgagggaaaggcggaggtatctattttattgccattggattatggctatggtgtggttccatgtattaatttgagtaataacattgcctaa

SEQ ID NO: 6317 - DNA, 737 bp, Aspergillus oryzae
  misc_feature (1)...(737): n = A,T,C or G
ggaatagctctccgccgaggcacactggcaagatgcgcttgctctccggcttcgtttctgttctgtcctcagtggccctgttgggttacgcttacccaacggcaattgatgttagagacatccctactacccagctcgaagacttcaagttctgggtgcaatatgcggctgccacctactgccccaataactacgttgccaaagacggcgaaaagctgaattgctctgtgggcaactgccctgatgtcgaggcggccggttctactgtcaagctcagcttctccgatgataccatcaccgacactgccggcttcgtggccgtagacaacaccaacaaggccatcgtcgtcgctttccgtggctcctactctatccgcaactgggtcaccgacgcaaccttcccccaaaccgacccaggactgtgcgacggctgcaaggccgaactgggcttctggaccgcctggaaggtcgtccgcgaccgaatcatcaagaccctggatgagctgaagcccgaacacagcgactacaaaatcgttgtcgtgggccacagtctcggcgccgtcatcgcctcgctcgcagctgcggacctgcgcacgaagaaatacgacgcgatcctgtacgcctacgccgcgccgcgtgtggccaacaagcctcntgccgangtcatcaccaaccaggggcacaactaccgcttcactcacaatgacgaccccgtgccaagctgccgctcttgactt

SEQ ID NO: 6318 - DNA, 639 bp, Aspergillus oryzae
ccatacagtctccgctctccaattctcaactgatggtaaacactcactcgtagtgagaacgagaattagcgacacaagatgcctccgaagtccgcgaaaccaaccagcgatgagcttctcgctcaatttgacgacctaggggtcgactcgaccgcggaccagcctacctccaagccagctacaacagctaccacggcgcaaactgaagacgatattcttgccgaacttgataacctagcctcccagcgtcctagcagtggacccggtaccccacgtctatcgacaaatgagcccaggccggccatcaaatcccctaaacctgctgcaactaccccctcaactgggcgttctagtgaggacaaacccgcgccccgtaagtccacggagagtgcccgggtttcatttgcagtaaacaaagatacggatgtacagccatccaagaccgagaaaccagcagccaaagagcccgcctcaagcggtggtggtggtggatggtggggaggccttttcgcaactgcgactgcgaccgccagtgctgcaatgaagcaggccgaggcggccgtgaaagaaattcaacaagaatgaagaagcacagaaatgggctcagcaggtgaaaggaaatgtccgtgcactgaaaga

SEQ ID NO: 6319 - DNA, 670 bp, Aspergillus oryzae
  misc_feature (1)...(670): n = A,T,C or G
ctcgcagcggtttgcttcctctcctggacctagtgcagggaacgccgcttcttcagacttcttcagttttgacaagaatgttgcccattcatcccctgggggtgctgcatccccatctaactccaatgagaagccccagacccacgactgggaagcgctatttgcgccacttgacaatgtccagagccctggtgctgccaatggcactaacactgctacagcaacgtcaccaaccggccatgatggaaaggcaccaggctgggctctccagaccggcacagaagatgaccaaattcttcagcgcttgaccggcatgggtttccctcgcgaagaatcacttgctgcattggaaaagttcgattacaaccttgacaaggcagtagatcacctgacatcgaaatcttaatactctccttctcttttcttttcctctctaccatgcacatagcttccctttacccactcgctcgacactttatcttctttccttttgccttttcttttccttactctggatttgatctattgggtggcttgcatatccgtactgctgtcatgtatattccccaancggtaccctcacccctacccatgntatgtaaccccacatgcttgtttgacagaaaggatatgaattcngagggatgatggacagatatactatggacct

SEQ ID NO: 6320 - DNA, 622 bp, Aspergillus oryzae
  misc_feature (1)...(622): n = A,T,C or G
ccgtctataacgaaagcttcgtcgaaggcaacaccccgaaggggccgaccgagccaagagacattggacgctatgnagccacaaccatcgaagacgagcggacattgaacaagatggtctatgcatacaacaccgttaagacacagaacgagatctacgacttattggaggagatcagcgaagagaaaatccaaaggaatcacattcccgaggaaagcgtctacactcgtgtactcgccgccagacagtctagtgagacttatcccttccaaccccgtcaaattatcccccgggatttggcccagacccagttggttggggtattcggggggtacacccccggaaacgcagaaaccttcgatatctgatcgccaagaaccttaccggacctcaggcccggggcctcagggagttcttgaaaccgcgtcgagcacagcgaagggggatccccgaccgttgggttcgaaagtcattacgggctttccaccccaaaatcaccgattcgtgatacctcgaattcccaaaactgagtccacgactccctttcatgcggagggcccccgataacactttgacctttggcacggaggtattttcccacttttggaaaggggttaagagg

SEQ ID NO: 6321 - DNA, 691 bp, Aspergillus oryzae
  misc_feature (1)...(691): n = A,T,C or G
gtatatagttagcttagcaactatttgagtcatcaagttagtgtctgcacctgtcagagaccataaatagcactgctttcggccaggttctcacgatcccaaccttatcaaccaacgtcttccaattcaatatgtcctccccatcacccgtggatgcaccgccccatgtgctccaacttttatcaaaactccataaattgtcgttggagcaggaagctaccatcgctaaaactggcaaggtcttctcggccacggtcataggtgacttcgaggacaagctccctgagaaggatgcgacagccgagttcgacaagctgatgctcgataaatttattgctctcgatgaggataaatgtcagtttgtatatcaattaatcaacgcgatgggagccacgaatgtggtggaggcgggaaccagtttcggcgtcagcactatctatctagctctcgcggtagctaaaacgaaagctgcgacaggaaagcccggtgtggtcatcgccacagagaaagagccagagaaggcaaagattgcacgagtctactggaagcaatgtggccccncggttggagattgagaatgactttcgcgaaggcgatctccttgaaacgcttgaggagaacctgccagaggtcgacttactcttactgggaatntggccgaaacttgcccttccaacttttaaaacagtcc

SEQ ID NO: 6322 - DNA, 560 bp, Aspergillus oryzae
  misc_feature (1)...(560): n = A,T,C or G
cgaggcgcaatctactgctgtgcagcaagccacgggatctgttgtcaataacccgacaccgacactcggatcggtgccgttagtcacagcaacgcattcatcacaaccaccaactctgccacttactacgccgccgcagacaccgatgtcagccgtctcccaaagcgggacaagcactattagcaatagtgttctaggcaagcgagccagcgagtctgaaaaagaggaaattaaggatcagaattctgtcccacaagtacaacagccgaagaaaagacgagtagcaccgactctcgtttctaccggcaacggcccttcgtcaaaagatggcccccagaataccgacgttggcggctaatgttccttgttcaaccaagcttcataaaaaacttcccagacggatgtataaaactctgttctcttgtctactgagtcgactgcggatgactcgagtgcctatgatatctttgttatgagtaatgtgtccttttttccgccgctccacaagactncgcataatgtttacgtcctgtgggatttacctaccgtgctctgggatn

SEQ ID NO: 6323 - DNA, 1130 bp, Aspergillus oryzae
cttccagtctttcgaccactgtatataatactctcgttgcatctccgagaccttttcgaagacaattccaggagactgtcaaaattagattatactcaacggcacaactttaataattacctatcttggtcgcgtcgggcaatagcggaaccccccaattctcgcgcaatctcttcgcctcaaccaaaattttttccttctgaacaatcttgatctctctcttacaccatatattcaaaatgcacgccactgctgctctccgctccgctgcccggactcctcttattcggttccttggccgtcgctcggtgcctcaatctattgaccacactcctcgccctcaccccgcctctccttcaggcgccctccccgactcgttcgctgcttaccgtgtcaaggcccagcagcacggccctctgagccgtggctcgttcgttgagggcgcgatcggccgtagctcgggctcctctctgggccccgttcagcccaagcagggagaatacttcgaccgtgccgagctccctcctcggttccagcgtcttccgtggagccaggctgagattgaagctatcgagaccggtggtgctagtctcttcgcttaagccctcttttgtgtacatgaatgagggatgatgcaatgaagacgattacaacgataaaagtgagatgattggggtactcgcttgcttggagggtcactgttgaacggagacacgacgcaagtagctctccgatgtcttcgatgcgatacgaagaacatccggatagcccgtggggctgggttaatctcacgtcgtcgtggaccctaacatcattagtcgacgggggtgggaagctttgcacctgatgggtccaggagaatctacatcaggggaatctcgggccgacccctgctatttttctttgatatcatttattcgtaccatggcgctggtggttgttacttcttccttagcgggttttattttttctggcgtggtatatggggtgttatcgtcttgacgtcgggttgcggaatgttcaggtttacaaacattcgtgcatagatggtttcatttgttgctagactttggcctcaaggaagacaaaatggtaaatggattcttaaatcataaatcccaataaccttc

SEQ ID NO: 6324 - DNA, 773 bp, Aspergillus oryzae
  misc_feature (1)...(773): n = A,T,C or G
ggggaaactggcgatcgacgaggataatgcactcgctaaacgccttctattctccaccgccatctcgctaccagtccacggcatccacgccgcagcccacctacgacggggaccattccgtttatttcgatatgccgtcgggcgacgcgcgcacccagcgccgcattccgaactatatttcgcatcggtccaacttgtctgcttcgctgcagcctcggtatatgttcaaccagaacaaccatgaacaggccagttcgtcgacggtgcattcgccgagctaccccattccccagccgcaacatgtggaccccactcaggtgttgaacgccaccaattactcgaccggcaactcccaccataccggcgccatgttttcatttggagccgattcagataacgaggatgacgatggtcatcagctgtccgagcgggctggtctggcgatgccgactgaatatggggacgaggacgggttctcgtcgggcatgcagtgggatgggcagttcccgggctccttccattcgctgccgggctttgggcctcaacatcgcaagcatggtaccatcgggtccacggacctgatggacacccccgaggagtggattcacggtgggcagttggggtcggactcatggttcngtggctttnggtcaatggggtgcnccacccganagcaggaatcttnngccgggagaagaattggccngaaccaaggttcaccccccaataccggcccaacttttgcgcgcaaagcatgcactcttaataccaan

SEQ ID NO: 6325 - DNA, 996 bp, Aspergillus oryzae
  misc_feature (1)...(996): n = A,T,C or G
gtattactatagacacaaaatctcttaagtcaaagcataacaagaacaagaaaacaacagccatggcccctatctccaccagcccccctcccaccgaccgaaactccctcgccagctacagaggctacgaccatgtgcactggtacgtaggcaacgccaaacaagccgctacctactacatcacacgcatgggctttaagcgcgtcgcctaccgtggtctcgaaacaggcaaccgaagcatctgctctcacgtcgtccgcaacggagatatcactttcatcctcacttcgcctctgcgctctatcgaccagatcgaccgtttctccagcgaggaacaggagcaactgagagaaatccaccaccacctggagcagcacggcgatggcgtcaaagatgttgcgttcgaagttgactctgtcgatgccgtcttcaacgcggcagtaagcaacggcgcaaaggccgtgtcaaacccgcagacgttgaaggatgagaacggcgaggtcagggtggctactatccagacctatggccagaccacacatacactgcttgagaggagcaactaccgcggtgctttcatcccgggctaccgcctcgagactgcagaggaccctgtctctaaattcttgcccggtgtgcacctcaaccgcattgaccactgtgttggaaaccaggactgggatgagatggacaaggtttgcgaatactacgagaaagccctcggattccaccgtttctggtccgtcgacgacaagcaaatctgcactgaattctccgctctgaagagtatcgtgatggccctcgccaacgagatcgtcaagatgctcattcacgaacctagctagggctagaagcagtctcagatcgaggaatatgtcgacttctacaacggtgcggtgtgcagcacttngctcttctgactgacgacattatccgagacatcacaaacctcaggctngcggtgtgaantcattaaggtctcagcacttactacga

SEQ ID NO: 6326 - DNA, 1079 bp, Aspergillus oryzae
  misc_feature (1)...(1079): n = A,T,C or G
tctcgtcgctgccgctggctggctgttcatttggttgacttgaccgcccctctcctctctctattgacgactgccaccctcttttcctccatctcctccgcctctccccgctttttatccaattttcatcccatttcctctttttgcgcgtcaagtgtcctttcgtccgccatggctgctcttcgctcaacctcgcgccttgtcgcatcctcgaagcctcttttccgcccagctgtcttcgctcgctcctatgcgactgtcgatgcggctgcccaggatcccaacccgtccgagacgccacgcactaaaactttccatatctaccgctggaaccccgaccagccgaccgagaagcccaagatgcagtcctactccctggacctcaacaagaccggacccatgatgctcgacgccctcattcgcatcaagaacgagatggaccccaccctgaccttccggagaagttgccgtgagggtatctgtggaagctgtgctatgaacatcgatggtgtcaacactctggcctgcttgtgtcgcattcctaccgacaccgcaaaggagtctcgcatctaccctctgcctcacacctacgttgtcaaggatctggtgcccgatctgacccagttctacaagcaatacaagtcgatcaagccttacctgcagcgcgaaaccaagaccgaggatggccttgaataccgccaaagtcccgaagagcgcaagaagctggatggtctctacgagtgcattctgtgtgcctgctgctccacctcctgcccctcgtactggtggaacagtgaggagtacctcggacctgctatcctcctccagtcgtaccgttggttggccgattcccgtgacgagaagaccgctgagcgcaagcacgccttggataacagcatgagcgtctaccgttgccacaccattcttaactgctcgcggacttgccccaagggtctcaaccccgcccgtgcaatcgccgagatcaagaagttgatggccgctcattaaggagtaatggatgaaaagtaaaggagtgtttttatatattctgagatatgtcntcctttgtggttctcttt

SEQ ID NO: 6327 - DNA, 636 bp, Aspergillus oryzae
caatgccgacggagagaaggagagagagattgatggaaagcttgaggcttacgatctcaggatcaagaaagctgacccgagcgctctcggtatcgacccgaatgtgaagcaatacactggttatctcgacgataacggtaatgacaagcatctgttctactggttcttcgaatctcgcaatgatcctaagaacgaccccgtcgtgctctggctgaatggtggccccggttgctcttccctcactggtctatttatggagctgggacctagcagcatcgatgagaacattaagcccgtctacaatgacttctcgtggaactctaacgcctccgtcattttccttgatcagcccgtgaacgtcggctattcctacagtggctccgctgttagcgacactgttgctgctggcaaggatgtctacgctctgctctctcttttcttcaaacaattccccgaatatgcggaacaggacttccatattgccggcgagtcctacgccgggcattacattccagtctttgcatccgagatcttggctcacaagaaccgcaacatcaacctcaagtcagtcctgatcggcaacggtctcacggacgggctcactcagtacgggtactaccgcccatgggatgtggc

SEQ ID NO: 6328 - DNA, 681 bp, Aspergillus oryzae
  misc_feature (1)...(681): n = A,T,C or G
ccatccctatctactcaattccatctcaacaacagagaaccaatcccttcaactgagaatagcaagaaaacatcaatcatgccgcccctgcgcacattctccctccgcctcctccgtccctcccggaccatcaccgcaacccccatccgcaacctccgaccactatcaacatgtcttccaaaacacccttcaccagtcaggatcacgacaaccaagcccctctctctatctcctccccagttaacgactcaagcacgatggggatcaacccaaacctccagcggtaaaagccaagccgacctaatggtcgaggaactccaagaactctacgagactgctaaggatgaattcgaaatcgcaaccgacagcacaaacggcacgaccatctacgcggcctcagaccgggagtcggcgcgcgacgcattgaatcagctgagcgcggtgtttgcgctctatacgaccgagatgccctcatatgacgagtcgcatcagccgcagcagacgcagccggatgattccgggagtcaaatggtgtcgacgtattttgatccgggggacattgcacctgaggtccgccaggaagtcaaaangaaggtttggcaacgggtgaaggagcttgcgaatgcngtgganngcgtngangaaanggctaangattgattattttcttggatcaacnta

SEQ ID NO: 6329 - DNA, 293 bp, Aspergillus oryzae
agaaggatcgcagcgcggcgatggttcctgggtctgccaacgaaacatccgcagcttcagcaggtggcggtgccgcccagggtggtatggcaggcgctcttaaagccgctctggacaagagaaagcagaaagttagcggtagcgatgacgaaaaggaggacgacgatgattggtaaactcggtggctacttctcaatttttctttatgtgttgctgtgggttagatcggtctagtttcgcttgatacctacatattgcagcgttcttcgtttcaatattcagcattattcttc

SEQ ID NO: 6330 - DNA, 1017 bp, Aspergillus oryzae
  misc_feature (1)...(1017): n = A,T,C or G
cagacaactctccgcttctcatcctttcactacccatggctccagtaccgccggaaaccacaaacccactcccactcccactcagatcccgcccaacgccgatggaccatttacagaccccagaaacggtgattatgttgcctggaacagcagccgagaaccaccggtgctccaaacacatcatgaccgtaacgatcgcgaaaacgcttcaggggcgcctcgagaaaaacatcaccgccatttggcctttgaccctgccagcttagatcctaccaaattcaggccacgtcataagcataaacatagcaaatcccgtgacgggcggttccctcgaataatgaaccccatcgcctcctccgctagtaccaggggcttgttgcccccatggtctggtggtcgcgagaaggaaagcgatctcgacgatggactcgcattacttagacccgtgacaagggagacaactcggtcgcgctggggatctgaatctactacgggactgggtactggtagcaggaattctcgctctcgccgtagctcttattgtccaaaactggattatttcagagtcgccggagtctgacatgacctcgcaagcagcgaccgtgacaaacagctctactgaggcccttgtgcacgagcaagaaagtgggatccattggctggccacagatattcctgaagatagatatgcgctgtctcaatattcatcgaagctaatctctcgtcacgatacccgctacgctactgacccggtaacctggacgtctgctaatcccgaggatgcgagggctactgaccaagatcggttgagaattttcgacgaactctgacaaggcgatattcccagagtcctagagcgcaacgggatacacatttcttgtcaaggccagcctttgattcctttgacaacctatcgagacttttngtatatattgacacgatacccaatatgncatacttgacttgtacatttatgcgcctacgctgtcaaaccaaagatagttcatcggtggcctt

SEQ ID NO: 6331 - DNA, 580 bp, Aspergillus oryzae
  misc_feature (1)...(580): n = A,T,C or G
gtatagccgtatcttgccacgagggagccgagaattggcacgagcatcggtcgacccagcgagggacaatcttcagagcacgccgacagaacatattcaaacatttcagacttctcgagggtggcaggccatccatctcgcggcaccatcgacaaccatccgagccatccaagcactgggcgtgaatccccggaaaagtcgagttctgcatcgaaccagagtcgggagacatggagccgacctaacagtaccgtgatctcccatgaacgccggtcttctgattcattttcaactgcccatacgacgatctcacaacggcaagcagaaggcgaacatctactgccaaatgaccctgaaccttcctctccgattgacctgataccacggcctctctccatctccaaaccgaaggctgagtggatcggcaacgtccgacgagtgctctctatgactcgaaagcggcctcagtcatctggggatggcagtgtcgcttctacagcttcgggcatcgacaggaggagtgccgtgcttggatccgcanggcctctgttcgattatgaactggagtccaagctgcctn

SEQ ID NO: 6332 - DNA, 619 bp, Aspergillus oryzae
  misc_feature (1)...(619): n = A,T,C or G
cgtaccaacatccgcgtacggacgctcctcagcagtctatgcgaaaggcgaaacgcccatcacttagccccaagtcgcatccagagccccgcatggcaacacccattcgacccaagccaatgccgaaaaaacggtcatcgcaagacagcaccgcatcacagcgtaggcggtcaatatcgtcagacagcaaggatgatgatcccaacatctgcatgctgaggaagaaggcacataaccaggtggagaagtgttatcgtgcaaacttgaatgcagggtttaaacagctcgaagatgtcactaagcaagactccacgaccgcaacgagtgataccaagatggcgaagggcttgagaccgggccgcaaagctttgattctgcaacacgcctatgagcacatcgtctgtcttcaggctgagcttcggtcgttgcagaagaggcttggtgaacggtaacgctaggtttagatattgcattatacactcattctatgctatataccacactcgctggtatcgtccaatttactgtaccgttaatcatgtgttaaaatcatactgtacctaatcatcatgcttacatggttttgagtgaaaaaaaaannnnnaaaaaaaaaattcct

SEQ ID NO: 6333 - DNA, 696 bp, Aspergillus oryzae
  misc_feature (1)...(696): n = A,T,C or G
ccccaactagcaatatgcttaagaaccgcatccgtcgtctttgcaccgcctgtcagacagcaccactagccgatcttcttgctttgtctcccccgagtctgtctgcctatgatacccagcctttgtcatccgagcagcctagctttacaaccgaagcttttcagcgttctccctgctcctgtgcagactctgtttggctctgtcatcagtgtggtatgttcgtacgcaacagtgacacaacgtaccgccgagtatggacatggcgaaccaggtacagtacctatctgggagggctaggcactggaattggcgaaggctgtcagggagtcaaatgcggtcgtggagaaacttgcttggcagctcaagaaatcgagctagaagtagaatgtgaagcagacgagtcttcgggcagtctacaggggacgggatatggaaatgaggaagcacataaccatcctaacgaccgtcgggacagccgtgaagaagaagagccgggttatttccgacaagagatcatcggaattggaggcgttgtcaaacataaagccaagaaacgggtcatggtgggggcctgtgtagttgagcacgaagatgagagagaaacgggccagtacttggctcgtgaagaggctggacaacatcgaanctggtgtggatggtgttggagagtgattccatccaagagcgacttacaaa

SEQ ID NO: 6334 - DNA, 636 bp, Aspergillus oryzae
  misc_feature (1)...(636): n = A,T,C or G
gcgaagtgatattcgttcaagtgccacatttacgacacagctcggacatgtatttacgacgaggcataggccctttcatctcgatttgatacgatatcgttgtttatgggaacttgcccatcgtgttcgaatatcacttgcaaagatcgttggacttcaagttttgaagtgaaaagtcacgacattcatgatgttttcccgtttttatatcgtcagccttttttcttttcttttcgatttcccctttccccattcttctcatttttccttcttcttttcttatttgttttggttgggcatatctactggcggatgtcactcatagattgcgtttcttgacgttggttgactttggaccttggtttccctttttaccacttttccttctactcagcttcttgccttgagtaccatggcgttaatacctcgtttcattcgattcccttgccggcttgttgcattgttttggttggcagaagctgtcatattcttctcttcactttaattggagtcttcctcgatgctacgacgtcacaccccgagatttcattcggcctgctctgaccccgggatcgaggattatttctctcggntgtagtttattttctttttgaacactcaacctttggtatttat

SEQ ID NO: 6335 - DNA, 694 bp, Aspergillus oryzae
cacaagagtctcatttcaaaccaagcctccaactatcataattctctcacctatttccttagaatcatccatccccatcaactcgctctcaaaatgaagaccacattcgccgtcatcatctccgtcctcacggcatctatctcggccgctcctcttgaggcccgtcagtccaaccaagtgactctggccctgtctaacgaccagagcggtgcctatgccggcgttgccttcgccgctgacggaaccgacaagagcatcaaagctctctacggcggcacctctgttggagcgagcggctccgttctcgcttcttccgctcagctggcatcattccctcagacaatccactgcgttatcaagaacaacggcgcagtcattgcaaatctcgatgctcagcatacctttgctgatttggacggaaacccggcttctgctactcctgtcaacctcgaccacggtattgtcaactgcagtgcttgatgggattttaacagaaccatccatcttcacacgggactatggccgttagattaatgagtgtaatgagggggtttcatgatcggtgaatgaattgagcttaatgattgatttatgtgcctgaaagcgggttaatgtgcaagagttcggtttctgataatcaagcgcaagaccatatatgtacgcactaatagaaacctgatttcactgctgagaa

SEQ ID NO: 6336 - DNA, 553 bp, Aspergillus oryzae
cggcgcatgatgccactgatgcattcgaaatataggaagtataagcgcgggaccccgcattgggcccgaggcggtcgtcccccaaaaccactatggaccattgaaaagaaaggcgaaaagcaggaccgaaaaaaaaatcttttcttttcttcctaatacgcaaatttatcctccattcctctccttttattcctccatccatagtatactcgcaacaacagacaacctacacagacaaacagaagcaacgccgcgttggtccagtggccggtcggataacccctcttcgcttcgttagctttataaatccacacacccacgatctgccccggagctccgaccgatacgtttagggcgatcgcgaggcccgttccggctgttgagcggaggttggaggagagccagccgagaagaggggggatacaggcgaaggcaccgctcgtggctactatcagacagccgtagcgatgctagcataaattagtacgagccacagaagctggcaagatagcgcggtcaacgtacgaagtatgcgtccggtggaagaacgtcc

SEQ ID NO: 6337 - DNA, 659 bp, Aspergillus oryzae
  misc_feature (1)...(659): n = A,T,C or G
caaggagagacgaatcctcagtctcagcaacgtgaccggtaaccgtggacccaccgatcgtcagtctagtgtcagcagtgggtttgccagcttgaagcgcagccactccgtgaagtccaacgtctccgatcggaagtcatcttggggtggcagaagctctgtagtgaacaaagagaacgaggtgttccccgaggaggatgagaaccgcagtgacattgaaagtgatgtgggtacagagcgcaaaacaagctacgccggtagtatgatgtacgaggcaggtagcactgtgtctaatgatcgacggctaagtggctccagcaccgccactgagatcgttggcaagggctctcactcagttgccgatgacggggacggtgcttcggatacacatgacgatcctaaggccgacgatccagagctagactcagagtcgtctaaattggtactctacggacaacatagcgacagtgggattggtgttgcgagtgtcncaggataccttcaggtgatgacctgattgatgtttaattggtgatcatgtgcagcctgatatggattcttgagataccaccgatggacggttccaccggataattccagcagtgttgggaattgttctacactcgcctcttttggactttccctttggagagagttcg

SEQ ID NO: 6338 - DNA, 678 bp, Aspergillus oryzae
  misc_feature (1)...(678): n = A,T,C or G
gtgtacagcatcaaattgaaattggaattcgccgtgctgggcaagctggtgcatctcgtccgcagccatgtctggaagaccgagtcggtcgcccgccccacgtcggacttccccgatttcgtcgacgcaagtcgggttacatccgatctcacacatgcaatgccagccgcacgccaccgctcccacccctggatggacacggacgatgtttcaatcgccatgttcgagcatgccgggctttcccgagatcatgagaccggccactcagaggtgtcccattcatggagcggcgaaacccacgcaaatcatccgtatcccgatcgagaacttagtccggtggactntacctccctacatcaccagaggagcctcccgtcgaaaacgtcgacagaaagtccggggtgacaccctagattctttttccctttggatcccttaccctcggaaccccccatcttcgtcggttcctttacctgaattttaacccctgagtggcctttttcaccgattgacgattattggaatcccgaattgcaaaagccttttaaattccgggcgttttcccttatccgggacggaaactatcgggagaattcggtatggccaaacattctttccgatctcccttgggaaggaatctttgtgcaccaaggttctcaaggttccccctttcccccg

SEQ ID NO: 6339 - DNA, 481 bp, Aspergillus oryzae
ggtgatcagagccagctgagctggtctgagatcccgctccccctccttacaacttccctgccaggcaggtcgtctcgctgtgcctcgtcgccaaaggtacccgctcgtcgggcctcgcgtgaggaaacggggacgcccgcccaccccagccgcgcttatacccgccgaggccgtgaaacgtctcggtggtgcggtctggggtgaccgaagcccggtggccgtttggtcgccggcaccgttggggtctgtggatcgttggccgctggccatcatcgaaaagcagattccaggggggagccgccctgcggtagccgccgttcgtcggcgtgtccgcagggtctggtccccccacccgagggccgtatgccgcaggcctgtctccgccctttggggtggtcacgacgggaacaaccttgcgtgcggaccggatcctgaggggttccagtgggggcaattggatggtcgcatgtgtgccgccgga

SEQ ID NO: 6340 - DNA, 1209 bp, Aspergillus oryzae
cctcagagtcaacgacaattgctccgcccgcgttcatcctctctccctctcgcggtcccctaccatcgtcatcatggctgagcagctggtccttcgcggtaccctcgagggtcacaatggctgggttacttccctggctacctctttggagaaccccaacatgctgctctctggcagtcgcgacaagaccctgatcatctggaaccttacccgcgacgagcaggcctacggttaccccaagcgcagcctcgagggtcactctcacatcgtctctgactgtgtgatctcctccgacggtgcctacgctctgtctgcctcctgggacaagtctctccgcctctgggagctcgctaccggcgagaccacccgtaccttcgttggccacaccaacgacgtcctctccgtctccttctccgccgacaaccgccagattgtctccgcttctcgtgaccgcagcatcaagctctggaacaccctcggtgactgcaagttcaccatcaccgacaagggccacaccgactgggtctcctgcgtccgcttcagccccaacccccagaaccctgtcatcgtctccgctggttgggacaagctcgtcaaggtttgggagctcgcctcctgccgcctccagaccgaccacatcggtcacaccggctacatcaacaccgtcaccatctcccccgatggatccctctgcgcctccggtggcaaggacggtaccaccatgctctgggatctcaacgagtccaagcacctctactctctccacgctggcgatgagatccacgctctcgtcttctcccccaaccgctactggctctgcgctgccaccgccagcagcatcaccatcttcgacctcgagaagaagagcaaggttgatgagctcaagcccgagtacatcgagaagggcaagaagagccgcgagcccgagtgtgtcagcttggcctggagcgctgacggccagactctcttcgctggttacactgacaacaagatccgtgcctggggtgtcatgtcgagggcataaatgatgaatacccatcggtgagggacatgagaggaagataactattttgttttttatttttccttaacaaaaaagggcaggcattggttgggatgtatgagccacgagccattaagccctttgggggtcccttagcgggactcggaggttataccctcgtgcgtaattcggcgagagcgggattt

SEQ ID NO: 6341 - DNA, 1363 bp, Aspergillus oryzae
ccgtagagatctggttcgccgggtaaatagaatcctcgacgaggtatgttgtccatttgttgaggatgggatagtgctgtgaaagatagtcgttgtccttggccttctgggcgtaggcaagggccatgataaccatgtttccacactcctcgagtggcattttctcgtcgtcgcccttaggatggcccgtggcgttcgggtagtgggttccaatatcgtgcatggcgtatgtgttgggatactttccgttctcttgaatctcatagattggcttcagaatcagtttgaggagctcgggattggtgtacaaaaagatcgggtgagcggggaagatgacgtccacagtgttcatgttgccattggacgagatctccttcatgaagatgtaggggtcttcgggcgtgccggtcaattgctcggcagcaaagacttgtcggaccgtgagggaggtgattgtcaggtagtcttggccatcggcatcaatggaatcgttggatatcgggtcatcgagatccttcgatagtgcagctgcagcagcataatcatgatgcaaggtctcgagcgcaacagtcccagtgagtcagtagctcgtccacagtaaggcatcacagtagtcgcgcgtggtgataagtatgccgagatggatcctgaagtcctgatattcttaaagcgccgtatttcgacctttctcaccctgctgcattttgaaatcagacccctgctcctctcggctacttatcagtacgcgcaactacgatgtttttctaccgggtaactgacaaagactccgttgctgcatttgaaccgggacaaggttttatcgcagggaatacttcttcccgagtaacactggatccccttatacaagacgatgctatagagctcgtggaatatatccagcgacatctgaactggaagaacagatacccgacaccgttcatttccgcatatcttgatttcgacacggccaaaaccgaagcactgcgccgggtgaacgatggcaagaagagtgtcgttctctggaaaatctgcttggatgaggatgacgatcttgaatgggcaacaatatacgacctaaaaagagaactggggttttggattcaagataacgcattccacaatgccaagtacgaagccctgtttgtgcgtaaaatcccacgagactacgttgtcggaggcgaaaggtacacgaatcggcaaggaaagtggaccggcggaaagtggttccatatcaaccatccctttcactgaaagatgtgacagtctatgtaccgcggcaatggatttattattcaccatctttgccctgaagtgattcagacgggtttaggacgggattagagttcaaatcgaaagcgattat

SEQ ID NO: 6342 - DNA, 677 bp, Aspergillus oryzae
gatgaatattcacatctgaggaccaccaccgatccatttctttccaactctatgcagatagagatcaagaattcggcctcatgtccatccccacagtgagacgagcctttggctcgattccgaaacaaagaacgctccaatccattcgagggctattacaaatccagactctcggtctgttactccgaatcgccatctgattcatccttctaccgctggataacgccattctttgcgctacgtgccttggcggccatttttctgttttcctctcgcattctaatccagtccatcgccggcaggccgcgcgacgtgatgttcatttctatccgaaaaccattttcatcaccggcattgacaccccttacgggctggccttggcacgatgtctatactatcacggccatcgggtggtgggcgccgacatcacagatctcccattcgcatcgggtgaaggcatgtcgaaaacactagcgacttactatcgcatcccgaggtcgcactatgtgtcccgcctactcgacatcatccagagggagaaagctgatatctggattccttgttcgtcgcgggcgagcgtcctggaagacgcaatggccaaacaggcaattgaaagccgaactgcgtgtaaatgtatccacctggacacggaattagtcaatcagtttagcgacaca

SEQ ID NO: 6343 - DNA, 569 bp, Aspergillus oryzae
  misc_feature (1)...(569): n = A,T,C or G
cgaggctgaactcgtcgagttcctgttgtccttaggagctgatcggttgcaactggactggttcggtcgatcctccatagactgggccgctcgacatccgccgacgctggagaaactaacaggagatgcccctctatccgctccttcattcgatgaagagagccggacatcagccctaagggaaggcatcaccatgcttgccacccgagccctaacggagggaaagtcggtttcgtaccggctgggaaagtgcctgctctacatgaatgatgtctccgcggcccgtatggcatttctgtacgatgcganagtcgatcctggctctcaagatagtgcctgtgtcgtgtgcgatctctgtaaaggggaaccgacagtcacagaatgaccatttgtgtgtcaaacctgtcccgatatcgaattttgtgtcaatgtatggaccactactacccggagagctttaaatccggtgtgtgatgacatcatntttagaggtcaggcctatgggacggtgtggttgctatgatttgtttggggtaaccccggggnccctttcgcttttgtgaaaaggg

SEQ ID NO: 6344 - DNA, 678 bp, Aspergillus oryzae
cgctcgatggacctgtccgatatgagagatgctttgccagagtacagttatcgacggtcatcccgggagaccgtgattcctgcgcgaacccgcagcattcgagacagtcgacgctctacatcctatcatgagtcttcgcgccctgcacgggttgcggtcgagaactcccgtcgccgacggccaaccgtctatgagtacgattacgttgacgatgatgacgaggatgaggaggaggacggtgatgagatcgaggagaagcaacggtcggccgaggagtaccaggcgtctcgttccggcaaagtagtgccaacgccattgacggaggatgccctgtacaagtctaaggcgtctcgtgcggagagcgacagcggaagccaaaaaagccgctcgaacagcagccgtggtagcgacgcacggacccaaaatggcagcggcagcgtggcccagccggaggaagacaacaaatatcgttatgacgatgaatggcgttacgaagagctttacacaaaagtctgttggcgggaaaaagatcagtctccgaacaggtgacgcgggtgcagtcgaactgacatcggagggaaaccacccaagaagtcctgccagggggtctgactcccgggaagcgggggccagaaacagttagaagaaccccggtgggctcgccccaccgacggtccc

SEQ ID NO: 6345 - DNA, 695 bp, Aspergillus oryzae
  misc_feature (1)...(695): n = A,T,C or G
cgtcgttggacgcggaatttgagtcgccattcggctctcccataccctccacaccttctagccaacgaagtccgtgtgaaagacgatacctacgcctatcgcaatatgaaagttgtgcttccgatcatcctttattagaggaggacgaattatcggacaccgaatgggaacctgtgcaacagcctgccttcttggacagcactccaacgaagtcttcaccctctcgatccttcccacggctaggatctactttcaagtccaatcttacggcgtcactgcgagcaataaaatctgcggcacagacagtttcaacgtttgctacgccctccgttcagccggatgattttcttactcggtctcttcttacgattacaccgaagatgacggacgaccgtcggcctccgcccatgaacgaaccaccttctccggcgctccggcgctatttcaaccccgttacggtttcacccgcagaaatttatgcttatcaggatcacccgcatgaaaaccttgacactaacaattgccccgtttccgttcagatgcagacctatcaccggtctgggaaacggggttctcgaaagagtcgattccacctgtcgggctctaagggtcgtggtcgatattctcctttcgatccggaggtccccccgatgtcccgccagcgtgaaccccggaanaacagtgactntttgcgc

SEQ ID NO: 6346 - DNA, 574 bp, Aspergillus oryzae
  misc_feature (1)...(574): n = A,T,C or G
cgaggcatgtttggcacccgcagagccctacaatcccggttacgcagcctaggaactcagtctcagctgtcattgcgattcaacccccacatctctagaagcaccagcactgtagccgatcaatctgcacctgaaagatcgaaatgggggagacgactgatttatgccggaatttttggtggcctcggagtcgcggcaggaaaatggatggacaataaggtttctgcaccggtcgaacccgaaacgacagaggatgtcctaaaactggaggagattcgtcgagtatacgaaaccgggctacctatcgcgcaggagctcccaaacaatccggactacttggaagcggacgtgtatgggaactattccgaggaggacaagaagcagaggtttacgtctggtccactgaaagggagtcggggattagcgctacagaaagtcttttggaacgacaaggagcggaaggccgttagcattgtntatttngggaatggcctggaanggatgccgacttgttgtcacggcggaagctttgccactgtcattgatgagaatctaagccgggtcgcaatccgct

SEQ ID NO: 6347 - DNA, 270 bp, Aspergillus oryzae
ggtttttttttgttttttttttttttttttttccccgggcccaaaatgggaccccacccggggccccccttaaaaaccccctaaggggggggtttaaaacgggggcgaggccccccccggggggtttttccccgggggggaaaaaaaaagggggtttaaaaaaattttggggggacccttttaaaaccttggaaaaaaaagattcccccccccaaaaggggaaaagttttaaaaaaggggggatccccatttggggatataaaaatgggg

SEQ ID NO: 6348 - DNA, 703 bp, Aspergillus oryzae
ggattggctcgaccgccagcgccacgcggtttatttaatactacgcttgacgttcctttgagatttcttattgtgtctttgctttgaagaatcacgttctttgcatcgatataaacataatagcgctccttcagccggctcttctcttattcttttgttgaaatatcccgatatacatacagtcattacatcctgtcttgcggatataaacgaccatctaccatgcctaaatacggtgccctcggtgcaactttcatgatcgcccggatcatccaggcttgctgtcttattgctatcatcgggttgacggccaacttcatcgcagagatcgtgaacagtgacctcactcctcccagtatctttatcggaacaatcacagtgacctgcatagcagtaatctactgcataatcacttggattcttttcttcgacaatatcctccccttcctagcttccgccatcgcagacttcctccttctcatcgctgtcattgtcgtggctgttataatcggaaagccactctcgtatctccaatgtgataagatcgctgaggtcgccgacaacatttccagtgcgtatgccttcgccacgaaactgagcagctacctatccaacctggacggaaagttgcagtacgggactttgattggtgccagtaagggggtttgtctggaggcgaagagtatctgggggttgagtattg

SEQ ID NO: 6349 - DNA, 666 bp, Aspergillus oryzae
  misc_feature (1)...(666): n = A,T,C or G
cgcgcaactactacgtagnattgctctatatactttggtcgcaattcccgggtaaccacctaaactcgttcgcgaaagctccttccaactcttattgaccacagcccctcggggcatcaacgtgggttgctcctgccatcgccgccatcgtcacgactccgccagggacagcagctacgaacaatggcacctccccgccgcaatctactttccaaagagcgattcgcattctcatttgggagcctcaagactcagaactatcatgaccctattgcgcgaacgcccggatctcatacaatccgaacgatatcatggaaccctaccgggcaacttatagctacaagctcagcggaacgtacccttttgatatggaaccctgagcgcgcgcgaagcaaatactctactgagcctcccggggacacccggggattgaaaaatcttatattaacccattttagacactgagatctcccactgtttttttatgggggcccgccctctttggaaagttccctctaaaaactggtgacaccctttaaattgggggcgaaaaattaccctttgttgtgaggtgatgggggaaaaaaaggggggggggggagagaggaaaaactttaaccccactcttttagaacccttttacccccaagggtgctaaaaaggata

SEQ ID NO: 6350 - DNA, 619 bp, Aspergillus oryzae
  misc_feature (1)...(619): n = A,T,C or G
gggggcattgggaattaaaatatatggctctcgtatacatgcaataatctccggggctgtacccccaaaacatttgaaaattaacattataattggacataacatgatagcctttttttaaactgcccggtcacaaatgatgtcggtttctggtcttcggcaaccttcattggcaggtttcaggaatgaatcttccgacgttgacttggtgccaggtcaagtatttcgaatggcctctttgacaaattatctctcggtataaacaaaggaaaagtgggtatatagtctcagtcacttaacgttcctcattggggcgcattatcgagtaaaaactgggttgcttcactccagccaaatgcattcaccatttggatcacagtcttaccagtctcatcttccttttcaagatcgacaccttcgcccttttctacccgaagaccaagaaacttcatggctctattctcgaaggcctgcattatcgcattccactcccgaaagggcttggtcggatctgcgcccttcttgagcagcaactcaatcatcttgaagtccccattgttgcatttacggaccgnctttacaatgggaaaaatcttccccggcccatttggaatcttcc

SEQ ID NO: 6351 - DNA, 728 bp, Aspergillus oryzae
ccaggttcatcatcaagggtatcaggcctctggagactgcctacactttccaaggcttcccttatctgttctgcaagtggacggacaattcgaaaccatccaaaacctgccaacgcgccttcaaaactcctacagatcttcgcaaccatgttatctcacatcatatgaaccttgccacaatccgcagacaaacctatctacataccttatggaacccatacgattttacctatacacaccatctctttgccataacattactttactcacaacttctcgacccactactccaaacatcgcgatcgcactacacctcttactcaccctataacgctatctacaatcacactacgctgacaaaaccttcttaacatctcactctccatcaacaatcatccaatatcaatccgcataaccataaatccatcgtctaaataccttctagttacaaactccaacgacactactccatctccacaccaaacccttctatctaacccactccacaattcacctctgtataatgctctctaccactatcgaatacaagcgtcacatatcaccgatctacatcactcaccacacttatacccgcaaatccacatcctacgctcaatcgttactgattacccttgacacacatccaaatctcctcacctatcaccccgcatcttaccttaccaccttcacattcactacaactaattcccacaataaatatatcctac

SEQ ID NO: 6352 - DNA, 657 bp, Aspergillus oryzae
  misc_feature (1)...(657): n = A,T,C or G
ctgcgacactgtttataatgacgagcttgcagacggaaagattcatgaactcggagacaatgaaagccatcaggccagtccagggtttgacacgggggatatgtcacccgaagcaactccgaccatttctacaggtctctggatgtcgatatccaaggacaaacggacactgctgagaggatggtatccgaaattctccatgcaaggcgaaacccaggaaccagtggaaagagaagtgaactctcacgctgtcaagtctgtagctaatgctgcaggtatcgatcttgatctcagcgtagagaacccattagaacagtgggctactaatgtcaagtccaacaaggcttccggcccttaccgtgtagtggacatgtatgactcgcangtgcgagtgtacaaacgtncaccgctgagtgacttgctggatcaagcangctgcaaggtggaagacattgactactctatgctggatcgattccctggcacaaacaacggcctcagccttgtcaaggttcaggacggcgacaagtgcgccaaatgcgctcaaggtcgtgtgaaaacccangtcgcggttgaactgggccataccttncatcttggcactagatacagtgaagttctacaagcctctgtcatggtggaccaatcctcatctgg

SEQ ID NO: 6353 - DNA, 644 bp, Aspergillus oryzae
  misc_feature (1)...(644): n = A,T,C or G
ccccaagaccaaaacaatgccaatcctaccacatctccccacccactcccaaacacccccgatccacacggcccgacttctcctccgaccgtttcgggccgcggatcttcccgcccttcatgtcctccgaaccactcccgacgtgatgcgctggacccgccagggccgcatcgacgccaccacagaagaaacaagtaaatggatgcaacgcttcacccaagacaccgaaccaggcgaacaaccaaactacaatttcgccgtcctacgcaaaccaatctcgggcgcagtccatgctacggagtccgaggaaggcgatgttatcggcgttatgggcatcgtgtctatttccccggaggacggtccggaggtagggtatctatttctgcctgagacgtggggcatggggtatgcgacggaggctctganggggtttgccgaagcgtggtggaggttgccggttccgggggatggcgtctctaagaacggtgagggagctgaagaagggggaccttgcgcgctgtcaccgataagacgaaacttgggagtgcgangggtgttgaccaaatgtggttggactgttgtgggggaaaggggttaaggtgaagattataaaaaggtggaattggtgatttggaatttcgccc

SEQ ID NO: 6354 - DNA, 647 bp, Aspergillus oryzae
  misc_feature (1)...(647): n = A,T,C or G
caagcagtccggccgccttgaacggccatgcccatatcgtcaacaggctccgtctggctggagcaaatgtcaataaccgtagcattcgcggttttactcccgctgacattgcttctaccctacccgctcatcaagctgctttggtcccagcgcagcatcgccgctcacgaagcgttgggtcattggcatcgtcgcgacgcagacacagtagctctgcctcccttcattcgctgtgggagtcttcctcgggttcgttcgatgaagccatcgatgactcgtctgatctggatgaggacgacagtgacgacctcgagtttacggtgtcacggcggtcaagcatgcatcacgacgtgccggcaccgctcccgaatgccgaccaagcctcggcgcctgaggacgcgcgaccattatctccgcccgcccgccttgtcgcttggcggaatcagttacagactcaaatcaatcagttccagcaaagcgtggccaatgcgttccctaatctttccgcaatgccacccatgccggcttttgctgactatcaaacgcacccgatgatgcgtngcaataccaaccttgntccacaccgggctttcaacgccggtcgggtaatgaaagctggagggaccctctgaccggcaattcttgcc

SEQ ID NO: 6355 - DNA, 676 bp, Aspergillus oryzae
cttgttcctcctacctaccagacacaacccaccagaaccgacccttcaatatgcctttcattcctatccctgagcccgggttttacgatcacgtcatcaacagacccccgcccatcgtcgtccatttctgggactcagcagcaggtccacctacccaagaattcgaaatcttggagtctggaaaccaccctgctagcgatcgtgtgacattccgggttgatgtttcccaattccccgttctaaacgccccgagcgacgtgcctgtgacgatcctcttcagtggaggcctacagttggacactgccaacggtggcgatattggcatattcttccatcttcttgagcaagctgagtgacggctttgaaatcatacatcggcggtcttaccatgaatgatgcatatagcatgttacggcaccgggccgtatggacccggcgagggttagaaaggacctcacatgttgtatctagcttctttcccagggatcagtcgtgttcccaatcaagttgtcagctttgatccagtataccttatctagtcgacatgctgacacaccctgcgttgtatgtcgtaaccagttagaccattatcgaagataaggtttagtttccgtttaatcgaccatttgatgatcttaaaaattcctgcggccgtcctagcatgacatcaagaggg

SEQ ID NO: 6356 - DNA, 674 bp, Aspergillus oryzae
  misc_feature (1)...(674): n = A,T,C or G
aggatatgnctagatttaattgacggcgaaccaagattgcctccgaggcatgtgactccgcactgaacggcgtcgagggctacgagcacaccaaggtcggcgaatggaactctcagatcattaacaccatcctcaaagcactcatcagcgctaccgccccctctaccccctcggcagcagccccataccggttcaccgtgaacagcaccatcgtgcaacaaggtctgatcgacaagtctgccgccgcagaaggtgccgccagcaacactggcaagcgcggtatgcactccggctctggtgctttctgggacgttaaccgcgatggaatgtggacattctaataccccggtgctgacgtactgggtctggaactcttctttagtgaaacctggtttatcgacactaatattatctactatccctatccttgtttatactatatatctttagtattttatattatgttgtacttactaacttttttaaacatattcgttgatatttttattaagatcttacttcattatttaatctcaataattcataatctactttactcttttctttataagatcctgtattcctaaataacttttatcgtttactcatatttcttactgaaagtcatcgtctttatctacatgtctataattattatctcattcctctattcg

SEQ ID NO: 6357 - DNA, 673 bp, Aspergillus oryzae
  misc_feature (1)...(673): n = A,T,C or G
gattcgatagctatgcgactggacgaacgtcattcccgtcgtatctaaatcagatctcatgtcatccagtcgaatctcggccctcaaatccacatttcataagcaagcccaagaggccaacattaaacctttcctctttggggatgcttccctcggcgaagtcgacaggctcaatgttaagtgtccttttgcagtttcgtccgccaagtccgacgatgacgacgtgatggaggccagcaccttgatgagtccagactacatccagcctttaatggcgtccgaattaatgtacttagtacagatgttatttgaccgagaaaatatagcctggatgcgacatttatctgctaagaagcttgctctacggcaacaagagcagtcatattggcagcaggacgatttaccaaatggtatccttcccggtgttcatactttacggngtggctcctccagttacaccatggctcgaatatccgactatactcgtcacgaagagaggctggcccgggtgcagctggccaagtgggcatctgaccttcaacaaagcctacgtaatgaacgagaaagatacgccccataacaaggggggacgtgcttgttgcttacaaaccaatagcgagggattgaaaaggtctgtggcctaattaaaaaactctgcttttggggttccggg

SEQ ID NO: 6358 - DNA, 1205 bp, Aspergillus oryzae
  misc_feature (1)...(1205): n = A,T,C or G
cggtccgtgaggacatgaaggctctcggagaaggccccgaggtggttgtcggtacccccggtcgtgtccacgatatgatccagcgccgtgtcctgaaaaccgaccatctgaagcaattcatccttgatgaggctgatgagatgttgtctcgtggtttcaccgagcagatctacgacatcttccagctcctcccccagtctacccaggttgtcctgctctctgccaccatgccccaggatgtccttgaggtcaccaccaagttcatgcgcgaccccgtccgtatcctggtcaagaagcaggaacttacccttgaaggtatcaagcagttctacattgccgtcgagaaggaggagtggaagcttgacaccctctccgatctctacgagactgtcaccatcacccaggccgtcatcttctgcaacacccgccgcaaggtcgactggctcactgacaagctcactgcccgtgacttcactgtctccgccatgcacggcgatatggagcagtctcagcgtgatgttatcatgaaggagttccgctctggttcttctcgtgtcctgatcgccactgaccttttggcccgtggtatcgacgtccagcaggtgtcccttgtcatcaactacgacctgcctgccaaccgtgagaactacattcaccgtatcggtcgtggtggtcgtttcggtcgtaagggtgttgccatcaacttcgtcactgctgacgatgtccgcatgatgcgtgagatcgagcagttctacagcacccagatcgaggagatgcccatgaacgttgctgacctcatctaaacacccccacctttatacctcacgatgcggattacggtcgcagttgccaatagcggtccaagggtaagctgcggtggaaaaggcgttatgacatcgttgtgcttctcttggcaaaggagaatccttcaaaagtggctttctgtgtctccagcatttattattactcgcggccgctagtggagggacacctctgctcgttgcttgttatgggttcctatgttttccttgctattgagatgcgacatgtttgtgcgattaattgcctgtattcattggttctcttnccgcttnttccaactttttttttcnccctttttgtacctagctcgctctggttgggtaagatgctgcacatactaaatcgaaaggtgggctcaaaaatgatttgtcatttcggcagtg

SEQ ID NO: 6359 - DNA, 651 bp, Aspergillus oryzae
  misc_feature (1)...(651): n = A,T,C or G
gttcgagccaaaagcttttatccagaagctactgggcatgggcgatatggcaggattagtcgagcacgttcaggccgtgaccaaggactcagtagcagccaaggagacgtacaagcacatctcggaaggtatctatacggtgcgtgatttccgagagaacatttcctcgatcatgaaaatgggtcccctgtcaaaactttctggcatgatccctggcttgtccaatctcactgctgggctggatgatgaagatggctcgcttaaactccgccgcatgatctacatttttgacagtatgactacggcagagcttgacagcgatggcaaggtctttgtggagcagcctagccggatggtccgcatcgcctgtggtagcggcacgaccgtgcgcgaggtcgaagaccttctgtcgcagcaccgcatgatggccggtatggccaagcgcgtcggtgggcagaagaagcagatgcaacgagcccagaatatgctcaagggtggcaataaagaacagcagctcgccgcgatgcagaagcgcatggcctccatgggtggcgcangtggcgcangttttcctggaatgcccggtatgggcgatatgggccagatgatgcaaatgctccanggacaaaggcggcggtggtggtcttgcat

SEQ ID NO: 6360 - DNA, 688 bp, Aspergillus oryzae
  misc_feature (1)...(688): n = A,T,C or G
gaagcaacacgaagttgcggtattccgctccgtcggccactctaggcttcgacctgtttcctatttcataatggcgttagacggcccagatccacagagcttgaattcatggcaggatgcattccagtatccaattccgacagtgcgccgtgtggaacaggagctccgccgggacattgccagcaataaggagaagctccgagctctcgttgggacgagatatcgagagcttgttggaaccgccgaaacgatcgtatcgatgaaccgcgagatgcaggaggtggatgcgaccctagcggatatcggacgaagatgcaacccacgattaatggagaagaaagttacccatttcagtcaaatcaagggtgatgttcacgacaaaggcgcaactaaacgagccgttggggcccagcttgctttacttcatcngtgtgagacggctatatctcgactattgaggagacgtgattctcttcttctaggagctaaactgtggttgnttccccacttctgcataaagcactgtccaaccaaaagacgtggccggatttttttgaaagcctacggaatcaaataagcttacttgaggcaaaccctttttaagaagggtaacaagtgcctaaccttaactcattaacagcggatgaattattggagtcctactcttttactggctactatcaacctc

SEQ ID NO: 6361 - DNA, 672 bp, Aspergillus oryzae
cacaaattttactgcacctcgccacgcttcagctacattgtaaatattaacgacgcccgagaaacttcgctatcggctccaaaacgttttgatcttccaaaatatccacatccacagtaaatcgttcaccatgggccttacaatccacaccgtcggaacctccaccctccaccgtcaggccgaacgcgccgtcatttacctcgacgtttccagcgacggaagtgaccagtctacagtatctcaagacgtgactcgcacctccaaccgccttcaatccctcctgaaagaaatcgcgccgaagcaggactccggcgaccccacccccgaagctcccgttacattctggagcatgagctccattagcaccggcagttatctgccttgggatcacgacaagcaggaacacagagcacgagtctacaccgcccggaccaacttcgaggtcaaattccgggacttcagcaaactgggcgagttcgtgtcggacgtggcgaaagaccctcttgtttcggtgcgggacgtcgactggcagttgacggatgatacaaagcagcagctgggacaggaatgcaggaagctagcggtcttggacgcgctcgccaaggctaaagaatatgctgggtgcgctgacattgattatcttccaccccgttgggaacgatgattctgagg

SEQ ID NO: 6362 - DNA, 664 bp, Aspergillus oryzae
gaacgctcctcaggctcgcagtggacgggatagccctcaaccgggaccatttggctattcctttctttcgcccatggatactccttacgaacctgcacctgcgcctcctcccgggccagctcttcttgatgataatgagtctaatatgcttgataattttttcacgacaatgaattccaaccatttcacgaacgacttctggctccagggccaacagaataagtcacttgggccgccaaattttgaatggtcagatgaactacctccgacattcgaaggctccaccacctctctctcacaaccctcacttcctcaccgcggcctagataaatccggaatggatattttacctaaccattcgaattcggatatcttcgcggctgcttccatgctctatcaaaacggcatgaatggggctggacttgttgctccttttgcacatcacccgttctcctctttctcaaatatggactacaataatacccatatgaatggtcgagtaaaaccccatcaaccacaatcagtgccatccaagcagtcgaacacgttgactggtgcacgtgcaccgttggcttatcacacgtcggaaatgctctttgatgtgcgagatccaatatcagcagagcaacaagccactgccaaagtacggcctcttcattggggg

SEQ ID NO: 6363 - DNA, 701 bp, Aspergillus oryzae
  misc_feature (1)...(701): n = A,T,C or G
ggggccctgcgacttcccccaggttaatgattaaaatgtgtgccaactttgagcgagtagcccgggcagtcgttgagcgagaacagaagacattcaaatcaagcgatagacatccccagcccgtgacaccatccgtcaccacccagggacagaatgaaaggagctccccgtccaaggagcaagcatcccattcgtcttgtaccggcaatgttgacattccccaaatcgaaggcctcccacgtataaactcgtcaggctatgttgttcctgaaagccctagcgctgcctcagaagacgccccctctggggacctacccgctgtgagcgatccgctcctaggcgggttctcagtgagccagccacatgaaagcacaagtgcaagcatccagcagagctaccagtatccaatggatgacacttttccggcccctatggcccacaacatacaacagccagaattgtggcaaattccaatgacggctgactgggagtttggcggtcagtttctgagtcttttcggtccacaattcttagatcaagggggtagcgatgtcatgtcggcaatggccgggatgacagcaccaccaatgccttcggcgccaatgaatatggggttcaactgcgaggattctgataatgtggacgactatcctgcgtggatgccccgaggatttatgaacctcttctaaacaatngaccaa

SEQ ID NO: 6364 - DNA, 690 bp, Aspergillus oryzae
gcctgccacagtacgagagttcgactcctatatacttcggtccatccaccactccaactgtactatttatcgatacatacgtatatacatctatatacaaatcaacataacaatatgctctcgagtacgctcacacgtccactgcagctcgtcacccgagtgctgcagtggtctagtgctgtcattgtgatgggtatcacttcctacttcatcaacaaggggtccccgtggattgtctatcacgtaccaagaaatcatttctaccatgtcggtcgtattcttcctgccagccttcgtctctccgttcatgcccacggctcttggcaagttcgtactgctcatcgatgtcatcttctcgtatctgtggctcactgcatttatctttgccgcccaagattacaaccgccatgactgccgcctcaacgctcccccaggaatctcctgctccaagaagagggccaacgaagcattcatcttcctgactttcatctttaccttcttcggcatgttcctcgaggtccttggtctctgggcttaccgccgcgagaatgtcccagtccgcgaaaagaccggcggtgctcacggcggtcccgctgatgccccagtcgccacagcctaagcgtcaactactctgtcgtcctcttatcaggcacggatagggcaggcggaccagacaatccacgagacgat

SEQ ID NO: 6365 - DNA, 889 bp, Aspergillus oryzae
ccaaggcggggacaaagttggggtcattgacctcaaatttccatttcaaccccaccctggcaccctgtgcttaactctgattgcacgtcttgaaccctgtggatccatcattccaccattttgatttcaaagcatcccgacagcttgagctgttgctattacgtattctcagcaaagctataaaaacctcaagatgcccctccttgatacccctcatcggctcgacctcatttgaaagcttgtcagcaacacttacctacctttgagagaatggctccccctaaggtcttcctcaccggtgccaccggttacattggcggagatgtcttttatgccgtacatcaggcacatcctgactggcaatactccctcttagttcgaagcaaggataaggcagcccaggtcactagtaaataccccaatgtgagaatcgtccttggagatctcgactcgtccaatattattgaggaagaggttaagaacgccgacatcgtactccattgtgccgactgtgatcatgtagcatcagccgaggcaatcgcaaagggtgccgcccaccacacgcccgagaatccagtctgggtgatccacacctctggcactggcattctgaccgttgaggatttccgcaccaacacctggggcttctaccgttctaaggagcacaacgactgggaaggcgttgacgaactccttaacctccctgatgactctttccaccgcaacgttgacaagatcatcatcgaggctagccagcggaaccctgaaagtgtgaagacggccatcgtctgccctcctactatttacggccctggccgtggacctggtaaccagaagagcgttcaggcatactggctcgccgccgctgtgttgaagagaaagaagggat

SEQ ID NO: 6366 - DNA, 443 bp, Aspergillus oryzae
cgaggtatacgatgtccctgatcccctgggagaagtaccagggcgcctcgcagtgtccgttccgtggtgggaataagtgtactatgattcgggatgattatatgccctggatgggtatcccggagggtgttatgacccagatcgacccgagatggacggaatgtgatcgggaatggtatattccgcctgtgagtatggtgcctcttgtgggcgatctggagtccctgcctactggggctgcggaggcgagggttcccacgcctacgccggcggtgcctgagtcgggggttgctgtgcctacgccagaggctactttatggtagtttttgttgcttcgctgatcctagcgatgtacataacgtccgtagttgtacatctccaatacgataccccaatgagcaaaacagaacacatcataaataaaatatcaatatattaaatat

SEQ ID NO: 6367 - DNA, 687 bp, Aspergillus oryzae
  misc_feature (1)...(687): n = A,T,C or G
gatgaccaatatcaagcttaccccggacgactccgcagcacttcggaatcttctcatcagcggctagagactatgcatgaatctgatgcccgctctgatgacggcgcttctttgtggtgcgagatttgtgaaaccggaggtcacgatatcctgagctgcacgaatatgtttggcgctgagcaaaagaacaagagcaacactgataccaaggagccctctcaagaggactcaactgatgaaaagttcacaccagagacgtcaccggctcccgagtctgcgcaatccaatcatgaggatagcacgactcctcagaaaaccggccgagatgtcgttttggaagggctgaaaggggtcgcgacgacatcttccatggctcccgtggcaggcaaggcgagtggagccgttgatgagtcgaagtggtgtgcactctgtgaaagggatggccatgaaagcatcgactggccatttgatgattaatggggttcgctggttgaaatgttggtgtacgatgtatatgacccacggatcagttctatctgtggcttgatacgctncttgcaatatgatgtgagatgacgttcttattcggtagcggagtcgctcccgaattatttttaataatggggtggacccaatttcttttttggaagccctatacactgtatttttccgggcttttgtttccct

SEQ ID NO: 6368 - DNA, 654 bp, Aspergillus oryzae
  misc_feature (1)...(654): n = A,T,C or G
ctgaaacagtggtgtgtcttgcccggctaagagctcacctagcccctcaaccatatccgacacgctccctgtcacactcccttccaaattatcaactctgttgaataacctcacgggattgttcaccaaggtctcgatagaatgtcaggcggtcgttcgacttctcccatctctgttcctccatcatcgcgacagcgtcgagcttccttggcatcaggccttggcttagctgattatctgtcgaaatccgggaatcaagggaccacctcaagcgttccaaccggtccaatggctagtgccgtagccaacgcacagtcgcaccatgggcgacggctatccattaccacgctggggctttcaggctcaccaactcaaacttcaccgtttgggggaagaaacttgcgacatggtagtgtgtccagttccatgggatctaaccccgcgagcctcgaggacgcggtcatagaggataatgagaatggccctcctagtgtcacgccgacctctccgttcgcacggagggtttcctttggcgcacaagcattgcgagatgtccgcggaggaagcacaggcaatggtagatatccctctccttggtcacccgtggctggacggcgctcaaatgcgtcnncagccaacaacacttctatcaat

SEQ ID NO: 6369 - DNA, 977 bp, Aspergillus oryzae
cttcctcgctgcctgctgtccgtactttggcctttctaatcgttcatcttacacccaaagtgcgtttgtcttttcaatagccaacccagcgtcatgcgcttcatccagctccttcccatcctaccagcgcttgctgcggcgcaagagcaggttcccatcgcggatcgtgtccagggttggttcaacaaagccaagtcttatttgcccacggctactccggtgatccccgctgctgtcgagaaggtggtcgaacagaagattcaagaaaagactgtcacccctttcaacctgtccaactggcaatcccttctggcgccatccgatgagcctaaggactggtttgtcttcatcaccggtggaaacaagacatgctttggacgttgtcaccaagcggagaaatcgtttaatgaatccgttctcctgttttctgctgacccgacctcgcccaacctgggttacctcgactgtgaatcgaacagggtcctatgctctgcttgggccgctggttctccgtctgtttcgtacttcaaggtccctgctcaggtcggcgaggagcgccctgccaccgctcaatacaatgtgtacttcaacgcgacaactgtaacgcccgagtccctttacaagattcactctgagaagacctatgagaagaggggcgcgtacgagggctccttccacgctacggatagctggcttgcgcagaggggacttttgatccctgcaggctatgtcatctatgccttcagcgcaatcccgagctggcttttcatgatcttcatcagcttcttcagccggaccatgatgggccgccgaatgggaaacacgggagcccccgctgctcgctaaacaaacatcgctgctcatgaggatgatgatgtcggcttcgatgtttatggtcagggatgtatataatgaactagcagtatctgagataaaccttagataacttttgggcctcggtcacattccctattctt

SEQ ID NO: 6370 - DNA, 641 bp, Aspergillus oryzae
  misc_feature (1)...(641): n = A,T,C or G
tatcctcatattaccaaacacttgaagcactatcaccgcataactaatcaaggacattggtctcggcacaatgaatctgttcagcatcctcaccctttctgcccttctcggcatggccaacgcagtagctgtcacccgggataccagctctgctactcccaaggagttcagagtcctcaacagatgtcataacatctgcaccggacacaacgactgcccagagagctgtccctgtgacatgcacaacatatgtgcccctaaataaccgctacgcgcaactaaagcctgctccgtcatacttctttgtcaaagctcaaatgactgccctcgagtcagcactccgacttatactgatacttcttctgaaaacactggactggattcatcgaaatatcaccgatgacccggataatgctgtctggttggcgacggttgcttctacctggctttggctagaacctgccttgatggtcatggtcgcttggatgggcggtttgtactggctntagtttacatcaggtagttagtttattgggtctactttattattgtgcgtagtgataataggacagacaatggtaccgcattaaacatttgctaaagnanaannnnnnnnnnnnnnnnnnnnnnnnaaaattcct

SEQ ID NO: 6371 - DNA, 658 bp, Aspergillus oryzae
  misc_feature (1)...(658): n = A,T,C or G
tgttttccatgtcttccaacgcatcaccagcgtccctggcggacactgatcgccacaagccctatcgcccgcggaggcgcccgtcgacccgcagtggtgcttctgtctcccctccatctgcgcaggatgtgccgtcattgacccgcgtggatacagtaccttcgttgagctcgcgcgcatctagcattgcgccaagttcccggaatgccaccccggctagtctgcgcccatccagctcaatcaccagtatggaagctgatattcgagtggttgacggagcgcgtagcccgtctctcagctgcggatacgttcccgtatcttcgatgatggcgcctaaccccaagatggaagaaactcagcagcctaccaagaaggtccgaacgaacggacatgctgggcacactggattcgtcgctcgattcctggcctctgccgcgggttcttacatgggtggccgcatgcgctctcacgtttaactataatatctccctgctgagctggtctccgctgtgattaataccttcttttccctcccatcctagcaccctgctggtacctagaatgataatctgcttctcatgtcttgccagaaaagtgtccccctgatgttcagcaatacccccgggaggtctacgttcggttattattgctttgcacn

SEQ ID NO: 6372 - DNA, 1133 bp, Aspergillus oryzae
gatcgctcaaaatggctcctaagtctcttttctacactcttttctcctccctcaccgttgccctcgcggcatccgtccctcaaaccgactatgaagtgatcgtcgtgggaggcggtcccgctggtctcactgcgcttagcggtttatcccgtgtaagacgcaagacggctctcttcgactcccatgagtatcgcaacgctgctacgcggaacatgcacgatgtgatcggcaatgatggcaccgtacccagtgaattccgcggtctggcccgcgagcagatctcccggtacgacaccgcaaccttcatcgacaagagagtcaacacaattgagactgtctctgatgaggccacgaacacctcatactttcgggcccaaaacaccgatggcaaggcgtacaccgcccgcaaagtcgtcctgtgcacgggtctcgtaaacattctccccgacgtaccgggtctgcaagaaacctggggcaagggcgtgtactggtgcccgtggtgcgatggatatgatcaccgggaccagccattcggtatcctgagtgcgctcccggatgtcgcctgcagcgtgttggaagtatacaccctgaacacggatatcattgctttcttgaacggcactcacacgccggaccagtacggctgattggcgaacaagtacctcctctgggaggctcagatggaggcgtaccatgtgcacatgcagatcgaaacacttgtgtccttcgagcgcattcaagatggcagctgggtgaaggacatgaacggcaccacacagattgatatgctgcgagttcatttaaccactggcatggcggtttgatcgaatgcctttattaccaactacctaagggatcagctgtcggatcttaccaaacagctgggtctggcgatgctcagcaacaagaatgatgcacctaccaaccctggtctgatgactaaacattctggtgtctgggctataggcgactgcggaaacgatgctagcagcaatgggccttacgctgtgtttaggggcagaaatggctgatgtttttgcctcatgctaaatggctgaagagggagttatcaaggtcattggacaaacgcgatgactttgtaaaagaggttgtaaaaactgttggccattact

SEQ ID NO: 6373 - DNA, 692 bp, Aspergillus oryzae
tcgacgccggatctaaagtgtgttatcaccaccgacgagggcaagcgtggcggcaaggtgattggcaccaagcgtattgttgacgaggctttgaagcagtgccccgacgttacaagcgtgttggtctacaagcgcaccggtactgaggtcccctggacccaaggtcgtgatgtctggtggcacgaggaggtggagaagtaccccaattacttccctcccgagtccgtgagctccgaagaccccctgttcctgctttacacttctggttcgacaggaaagcccaagggtgttatgcacaccaccgctggatatctcctgggtgccgctatgaccggcaagtatgtctttgatatccacgacgacgatcgctttttctgtggtggtgacgtcggttggatcactggtcatacctatgttgtgtatgctcctttgctcctgggatgcttcaccgtcgtctttgagagtaccccagcgtaccccaacttttctcgctactgggatgttattgagaaacaccaggtgactcatttttacgtcgctcctacagcattgcgggtgttgaaacccccttggataccaccccatttaccacaagatgggctacctgcgtattctgggcttccgctgggaaccttacccttgagagggttggaaatgggtttttttagaaagtcggaaagggataaggccac

SEQ ID NO: 6374 - DNA, 1006 bp, Aspergillus oryzae
tttcaactctcattccgccgacccagcagcgtcaatcccatcgactccctccaccagaccgcgtggtgtgatatatttgtctgtcttcgaccactgcaagatagacctgagtcgcagctatggctgttggaaagaacaagcgcttgtcgaagggcaagaagggtatcaagaagaggaccgttgatcctttctctaggaaggatgagtactctgtgaaggcaccgtccactttccagatcagagatgtgggaaagactttggtgaaccgcaccagtggtctcaagaatgcgaatgactcgctcaagggccggattttcgaggtttcccttgccgacttgcagaacgacgaagaccacgctttccgtaaggtcaagcttcgtgtggacgagatccaaggaaagaactgtttgaccaacttccacggcctcgacttcactactgataaactgcgatccctggtccgcaagtggcagtcgctcatcgaagccaacgtcaccgtgaagacgaccgacgactacctccttcgtctgtttgccatcgctttcaccaagaggcgtcccaaccagatcaagaagaccacatacgcccgctcctctcaaatccgtgccattcggaagaagatgaccgagatcatgcaacgggaggccgccagttgcaccctctcccaactcaccacgaagcttatccctgaggttatcggccgcgagattgagaaggcgacgcaaggaatctatcctcttcagaatgtccatatccgcaaggtcaagcttcttaaggcccctaagtttgatttgggcgctttgctgaacctacatggcgaatctaccaccgatgacaagggtcacaaggttgagagggaattcaaggagcaggttcttgagagcgtctagaccttccgttgctcactgtggaagtaaatgcagaatcctctctagaatcaaaactgtcgctgcctctcgatcgaagataaaaggaggagggggaatattccaacttttgtctccga

SEQ ID NO: 6375 - DNA, 1006 bp, Aspergillus oryzae
  misc_feature (1)...(1006): n = A,T,C or G
ctcacccgcaattgccatccacaatggcctctgctcgttccctgatgcggttgggcaccggccgctcactggcttcggccgcgcggtcgtcccggatgtgccgtcctttctcgacgacccctctgctgaaggagtcgatccccgagcctcctaacatgcgccaggctcagcgtcctcctgagggtgccctccgtgcccccatcgtcaaccctgccgacaagtaccaggacaaggccgatgctctgcaccagtacggccagtacgtcatgtcctgtctgcccaaatacgtccaacagttcaccgtatggaaggacgaactggtcatttacgttcccccctccggcgttgtcccattgatgagcttcctcaagtaccacaccgccgccgaattcacccagatctccgatatcacggccgtcgacttccccacgaaggatcagcgttttgaggttgtctacaacttgctgagtgtccgtcacaactcccgtattcgtgtgaagacgtacgccgatgaggccaccccggtccccagtgtcactggtctgtttgagggagctctctggtacgaacgtgaagtgtacgatatgttcggtgtcttcttcaccggacatcctgacctgcgccgtatcatgaccgactacggtttcgacggccatcctctgcgcaaagacttccccttgaccggatacactgaactccgatatgacgaagagaagaagcgcattgtcatcgagcctcttgagcttacacaggcattccggaacttcgagggtggtacggccgcctgggagcctgttggaacgggtgtggacagaacccncgagtcgttcaagcttcctacccccaagcccgaggagaagcccgaggaanagaaatagagcagtgtattcgtatttcctttcctgttgatgtacatacgtctanagtgaagccttttccgagaagctcctagttatacatttggcacccaattcgggggacccgggggccggtttaaagaaacccc

SEQ ID NO: 6376 - DNA, 683 bp, Aspergillus oryzae
gtttcttctcttcagcggtcgtggagtactcatcagaatgttccgatttcccttccgcggtacacagatggttacgatgggtctcatgcggcacatccggagcgtgataatatctctgttgcttcccacccatggatcagtaagccttctgcaactggccatctgtcgcctaacagcggaacaggctcaactcgaactcgagctgtgtccgctgatgatgttacgggtttaaagttagacactagcatgttcgcttccggtgcaaagcgaccgcgcgttgctatcactcggccctcggtcgatgatccaactgcatttgttcagacacagactcatcaaaccaataagaatggcgagtcaggattctcgtcgttgtcgtccaagcaagcatggcgaagtcccagcccaaaaggaagtgcgcgtccgcggactccacaattacttgcacccccttgtattttccacccttcaaactaccaaagctgaaacgcccgaaccaagatctccttttgaggtttccccacgagaaaacacatccggctctgggttccgtgatgctccatggagagtcctcttgtccattccctcctttcttggtcaatttaatccggccccctccaagggccctttatacgcctccaccctgttttatcctacccagggctggagggccttgaaaaatt

SEQ ID NO: 6377 - DNA, 667 bp, Aspergillus oryzae
  misc_feature (1)...(667): n = A,T,C or G
ccctcctggggcgatgatctctcctccagagtccgccccaaactctagtgatgaagaaaccaattacggtcacaaggatgggcttcgcctgcaggagttggagctagccgtgaggtctatcgagcaaaggcgcgtttcttctccggagcgagaaacccaagagaagaaaccatcgtctagcgtaacgcaattaactaatcctactaagaagcaacctcatccacctctttctaaggaagcgcgcaagatttctcattcacgctcgatcacggagcacgccattgatctgaagcaagaggaggcagtgacgagctcccccgatgagagcgatggagatgacgacccacgggcgaaacaacccatggtgcgtaagaagtcgggggagcttgttagaccagctcttcgtccgccttcggcgcgacggcgcccatcgagcatgcctgggacgccaacatatgctaaggccgtgcactttgatgcccagctagagcacattcgccactttttgcagttggataagccccaggctgtgagtgccggtggatctccagtagacgactacgaatctgaagcaagttttccgttcagcanggaccanccggaaatgacttcctatgaatgggatattagactcccaaatttcctagggatgtttcaacccgagccc

SEQ ID NO: 6378 - DNA, 678 bp, Aspergillus oryzae
tcgatctcagccaatcggttattatccagatgcgtgaacacggtttccccgatgcagaagaccgggacgaagatctggatacgttgctgagcacccagcataatacccccttcgagctccccttgccattctggagaatattcgtgttaactgatgatgccgatgataccgaaagacggtttaccgtcgtctttgtcttccatcatgctatttctgacggcacttcgggaaaggtcttccacagatccttcctgcaggcattacagtccttgtcatcgttggctgtagacgacgtcaaggaggttattccatcgcctgattcatcgcttctgccgcctggggagggcgttcaccctaagccagtgtcgtacactttacctggctgttcaactcttttaaagcaaagatctaccatccccgggaccccggcttatggacaggctcggaggttaaacgtccccttggaaagaaacttaaacacttggtgtccccatgcacttatattcccattcaaaaaccggggtcgggaaaataaaacacccattccagccgttcttaaaacaattattgggtcggtccctttttaacccatctccctggattcctccccgaaagtgataatgtcttcgcgccgatgttcaaaccgcacttgttttcccggcccccacaaaaaaaatt

SEQ ID NO: 6379 - DNA, 639 bp, Aspergillus oryzae
  misc_feature (1)...(639): n = A,T,C or G
caaagccacctctgttccgcaacttatttcccccaccaccaccgccaaatgccgacaaaagtagcgtcggcagccctcctagtagttctgggatgaacggtcgaccgggctccatccgtgcggcccgtccgcctcgcctcgacttggaccgaccgggtgcccaccctcccggatgcagagttgatacaacaccggagaagccacgaatcgggacgacgcgcacagcatcggagccgcgggggccaccccagctacaccaccgctcatctcaaggcgaattcacagtctaccgagaaatggggcatcgacggggagcgagtgacgcangcttcccagccccatcgaagaagatgtatggagaagaagtgtacagcgggtactctcgcccgaccgtggtcgtcaatggaggccggagagccatgccccgtcagcgggagcggtacattgatgaagaagaagagtatgccagcgaagcaaaggaaggcggngcatacggtgactttgaaattgtcgaatcacgacgccgaacacggtcaccgaaccgagggtcaagaagagccaactcgcgccggccagaggtacgcangtttcnggtcaaggtacatgccgtggaggacacacggtacatcattatcgggc

SEQ ID NO: 6380 - DNA, 677 bp, Aspergillus oryzae
ccggagtccatcgtagcgcttggataagaaacacttcagagacattggcccaaggggatacagaaagtaaaggcatactacgagagtacagagttcaagctacggggaaatccgttcgaacatggcgacgacgatgaaaaggttgcgcttcgtaatgccatattagggcttctggatgcgttggcaagagaaggttggggtgtacaccctgctgccgggggcttggggaggatagggaattataagtcgcttgggcagaaggatagcctgattttcaaacgccaggccccccagcaactctcctggatgtgtatctcctttgactccgacgacctcatgcaccttatcaacgctccccccgagttagccttatccctggttgcagtcttcggggacaggattaaaaactgtaatcaggaccttgtgaccggcgcgtttgaggtgaaattccaaagcaagttatgggccaagtattcggaggaaggagcagtgctgagtagagtggccatactggatgtgcttcagtgtctggagggtcaggggtttacgttgtgttcgagtctggatatcgactatggcaacgggggcgaggtgtataagagtagtggggagacgtggttttattatcgttgagggggtggcaatgtttacggtcgtatgtggactgtactgaatat

SEQ ID NO: 6381 - DNA, 695 bp, Aspergillus oryzae
  misc_feature (1)...(695): n = A,T,C or G
ggggggcgcgctttggttccccgatctactagcaggcgacacaacgggtattctcccagccgcattaacgatgtctatcctactcaacatcagcgccggttggaaagccaagaagttctcggagatggccgatttgccgaagatagagctgtatagggctttgactgtgcgcggaattagagctttcatccaggtcctcgccctgaatgtcggtctttcgtcttattactatgaaatgccggcggcgcttttgctttactggactactagtacgaatattgccacgatgcaaactgttttcttggataaatgcatgttcaggaaggaaccgctgaagccctggaagcagatgcatatcgggtacactgcaaacaaagaatgtgctccagaggaatcgatttacaaagctaccatgaaggacgcaaagggcttcaagggactccattagggtgatgactggataattaagtgctagatgcacctcttaccaaatcggccgatgatagccgaggcccagaaataattntgctccgccagcactcacatgctacatggggttcagacctactcttcatgatgttcgaagaggcatcggtgaaagtcacacgagtcagacacaggagcggtcatgtncgcatcacgaagccccggtcgagtcaatacacctgtgcacaggatgatacacttagccctan

SEQ ID NO: 6382 - DNA, 664 bp, Aspergillus oryzae
  misc_feature (1)...(664): n = A,T,C or G
ctcctctggagtccaccatgaacggcaagccctggacagctagccgttttgcatcttccctacgtcgctacctgttccgcaagcaccttggtcttctaccgccacaggactacgagcgccccgatgctaatttcgagccggtcggtgtgcctaacgagttcaactttgacgctcctgagagccggcttgtggccgacccattggcggatactcttcataacctgtggaacagccgggcgcacacgaacactgaggtattccgcaaggtgttccactcagtcccagatgactgcgtacgcaactggtccacgtataaggaattctatggctacttcttcgacaaggcggacaagcaagcgtacggcgaagaaaaggattcgccaccctcccgttatcggtatggacacgttgtgcgcgatgacttcccgggcggtcctgagggcgttcgacaggtcaaggagctgctcantaaggtcaagggcacgctggtggagatgccattgatgttcttgattgaagaggacgttgcgaagtcgggattggcattgaacgatattacggagccgattacacatgattctagctaatgtcgctgtnttggtagtttgcctggattcttgcctttgagttttaactaaatggaattaaaatttttttttttggg

SEQ ID NO: 6383 - DNA, 644 bp, Aspergillus oryzae
ctgctgatggtctagctgaccaggaataccaagttctcgaggcagggtttgccgaagggcctgatggttcaggcttggccgttatctttcagcgtgatctcctcgcagaaggtccatggaacggggatcgcgaaaccgatgattacttcaacaacagctactgcgtaacccttggatcgggtgagacagtatacggagggctggagcaagtcgccttctcggggaagcgggcaactttcgacttcgccgaatccatggccggcattctcggcatagaaccacagttcattggtgatttcgaggtgtgcgatcaagaactggagctctttcaaaaaacactttagaagatagtaacatggggggtgtcctaatcaagtccctcaactgaatggattcagttaacccgcctgtgcagatgacacactatatatctaaactcatgaccgccggcttatcggactatcgccatccctaaagcactctttcgtgtgctgtggggtccggtcccgggcgtaccccgggttatcgatacgcaacatttgctggatgataagcgggggaatatctagatggtgtaatattttaccacccccactactaatggagtaatggggtatttttttttttcccgccaaaaaacgcga

SEQ ID NO: 6384 - DNA, 654 bp, Aspergillus oryzae
  misc_feature (1)...(654): n = A,T,C or G
ttttctttgtcttcatttcttttcggaacgtttctctttctcctttccctcttcttctccacattggactctcggaccggtcagaatggctcgtttcagtttcctgtcattggctttgctctctgtccaagccttgatcggtggcagtctcgcggcagatgctgctgaaaaggcagaagagaccgtggctcccaagctcgctctgacggcgcaggctactttccctgcttccgagatcttcggtgtcaagattgttaacggttacccaacccaggcgcttgtcgctttcaccaatgatgagcctgcccccgtgaaggtgaacttcatcggtggcaccttgtccaccctagatgaggagaacagcgtgatcgtgcggaacttgactgcaactggatacagtgtggaaattcccgctggcgagacggagaccctgagctaccagattaccaccgagatgcatccccaggacctcagacttagccttgcttccataatctccgacaatgagggcagattctacacagtctacgcctacaatggcaccgtcagtgttgtggagcccgaaactagcttcttcgaccccagattcttttcctgtatttcttcctnctggcctgcttctccggtgtntgctacttcttctacactgtctgg

SEQ ID NO: 6385 - DNA, 689 bp, Aspergillus oryzae
  misc_feature (1)...(689): n = A,T,C or G
atgaccgttgcggatgccttgtgataataccgaggcccctgaggcagcaaaggaggaatctgacaagacgacctgcaaggccgacgaaccagccgtcgaaaagaccacagaggaaaagggctctgaggagaagacaacagaggagaaacctgccggagagaaaacagaggaaaagactgcagaagcttctgcgtaagtctcggtcaaaactcgtgttttatctcaaattctttctgctctggtgtccttggttctcgttgctgtctcacatgcgctgcttttaccatggtcttggttttttagccgctctgctagtgtttccatctcctttctcttactcccagttcttcattttggaaatgagccttgaacctgtgaatttcaagaatattcataataagcttgatgacttccctttcttcgcttcttttctatacctcctacccctcctttnggacctctctcacatcgcccctgtacatctaacctcttcaatggacacccgacccggtgtcaccgactaaaaccttgaattaaaaactagcgacggaaccaaaccccatggatattttgaccgaaaagccctggacagagaacaatccttcataaagaggtccgagcttgatttgaccaattgggatttcggataacaaaagctcaacatgaggttggaggtatccccccggcct

SEQ ID NO: 6386 - DNA, 687 bp, Aspergillus oryzae
ggacactacgggtggtaaccctcctcttgattcgcctcaatctggtcgcagcgacgacctgttacacacccgatggatacgcagtcaccgacccccggtatatcccgtgcattgcgatagagggcgagaactccatgtgctgtaaactcaacgatacaatgccagacacgtgtcacagcacgggtctctgctattcaagtcagacgggatattggagggacttttgtaccgataagaactgggattctccgaattgcttgaagaagactttttgtgatgatgcggcaggaggaaaatcaaactggacgacgagagtcacatcatgcggagatggatcatggtgttgtggcgataccaacaactgctgcacgaacggcggagggttcaccctcgattcacccctagtcgcaattggtaacaatgcgactgttaccaccaccgtaacagcaacaccgaaagatagcaacaagggatcctcagattcatccaccaaggtcgcgattggagtcggggtcccaatgccattggcgtgtctggcatgcggaatgttaagaagtgggtttctctggggcaaaagaagtgcaaggcaagcgctgtcccaacccagaatttcaaaggggcagttcagggtcccgcgataccattggaaaaccccgcaggcaaaacttgggccaccaaccagaaaat

SEQ ID NO: 6387 - DNA, 734 bp, Aspergillus oryzae
cgaggctcccatgatcttgaacaacaactacaacaaccccattttcactctcagatcgtcgtctgacctagctattttactttggctaattttctcccgagttagctttctctcagttacttaccagtaatgtatgaatcctaccgcccgcatccactcctggcgcaagtccctttgaccgtctctcctttcatcaacctcccttcctcagtcacccttccctacacctacaaatcacttccttccacactcccggcatccgtaacagtcgaccccaacaaccccgacactaagccccgctatgtggtctccgcgagcggtgagcacgccgcatccgccgaagaaatcctagcatcgtgcaagtctcttgaggaactgctcaataaaaaccgcaccgatgcggagaaggccattcagaattgggaggagtccattgtgcagcgcgatctcgcagagaagagacgggttgcgcccgggtggttggaccgcgaagagaagctactacaaccgagtagatctatggcaggtcccagaccgtcagggcaaccagaacacagcttgctagatagcttgtcttcggatccagatgcgtcgaaactaccatcgatgaagccgcgcgacgagggtgaggagctggatagagtgttcggtgggctaaacgtaaaatgagtggtctcgatcaactgagcgtcaggtacaatcatccccctcgacgtggcagcgtcatttagctt

SEQ ID NO: 6388 - DNA, 676 bp, Aspergillus oryzae
  misc_feature (1)...(676): n = A,T,C or G
gtagctacgcctgtggtgtttatccctggctgttggtgtatcactccatattgctcaaattctccatttgaatcttttcatcaccattcaaatagatcgtgtctgtcacaggcacacataagtgcaaagatgtcgcagaagcccatcttcgtcgctactcacccccgcgcatgctcaacagcatttgaacgagtcttcatgactcgtcgggataccatccagtgtatccatgagccatttggcgatgctttctactatggccccnaaaagactgggtacaaggtttattggacgacgaaaaaggcccgcctagagaacgggtttagtccagccaactaccaaaaggggattggttaaattaaacgtggaaccttttaaggccagaaaagttttattaaaggacctattcaatattttctttcttccaaccggaaggctggccacaattggccattccttactaaaatggaaccgtggtggctggacccaaagccaccggcctgccttccaccgtggtaaaagcaaccggcctgtgcaaattaggcaaaggccccaaccacacgccaataacccggttcccacagacccagacccgggattccctgtgtggtgcccaggaaattttttccaagttactttttggttttcttatccgaaaaccccatttaagtggccc

SEQ ID NO: 6389 - DNA, 725 bp, Aspergillus oryzae
  misc_feature (1)...(725): n = A,T,C or G
cccaagtaatagtcactaggatcgatgattccgccgatccacgctgttctgcgttgagttgctgatggcgagacggagggccgcagtcaatcaacacgtagtcggcttgctctagtcccccagggtttgaagtatcacgggttcgctctcttcgtctttctctgttgcctttacagtgctaaatctaaaacgcgcgccacatcgagatctgttttactttcattaacttcccctactccgagtctcatagcgccccaatctcttttgccagcctcagaatctgatcaatgagaggattgacatcggcactttttaccggcacccgatgtgcgccatcccactccagaacccgaacgctgtcgatgctacagtagtcgtcgagaagctcccggtgaaagtaaagacctggatctgccaacccatggacatgtatggtgggtaatttgaggacgtgttcctcttccatgaaggcggctacgttccggagccctgacacattaatttgtgacacggtggttcacaatcgaaaacttgaaaacttccggatcaaggttactatcggcctggtccgcccataccacggngaactcccagtcggaccagttggcgccgtctagttnctcgctggacttgttgcggactatagctcgcgcagcttgcgcttgctgaacccacatccaccatgactgtgcactgacgacgtcttgtatgcagcttgacgatgg

SEQ ID NO: 6390 - DNA, 719 bp, Aspergillus oryzae
  misc_feature (1)...(719): n = A,T,C or G
ccattaccgccattacgatcccagaaagctcgagaagtcacatcgaggagaccggaattgattaccctcctatattcgacgtgaaaagccttccctcggcgcctcaatcacaatggagatgcgctccctaacccgctgcctccgttcgaggccgacatctcttctctacaagcaacaaccaagcctccttgcgacccaatatatgaacagatcctccatccgcagctacgctagcaaaccctcgggacccacgaaggctcagaccccaaccgcaacgcaagccccctccgactttgacgagatcctttccaaactaaacatcaacaaccgcgaatccgccgccgaaggctcactgcggaaccgtccttctgaagaccccctctcgctctcccgcgcggtcggcatgtctgcagaaacagaaaactaccggactcctgtgcggcgggtggagctgaagttgggacctactcttggtcgtcaggtgcatgttgagccggagaagggcacagatttggcctctgcgctgaggatattgcaggcgacatgcacggcgaataaggttcggtaccaagccaatggtcagagttccacatcagacggggacaagtgangaagaacttgangatggagagtggagggagctggtcaagttctcgttccagaagaactgtaagtcggatcgagaagatgagaactcagggattgtaaatgtggttggg

SEQ ID NO: 6391 - DNA, 672 bp, Aspergillus oryzae
  misc_feature (1)...(672): n = A,T,C or G
ttcaatgatcgctttcattttcgtacagcaaagttcgtctgggaaaatccgctaggaaatagcgctgcattattggcagcacagacacctacactgccaagaaaaccaatgggcttatacaccccattgccctcgggcaggtccgaggcaaagaccacgtctgaagaacaccagcaggagcaggtagacgagagtaacgaagcaagcaaggaagattttgaagaattaagtgccaatgatgggacaactgaattcgatgatgacattgataccgacgagctgttcagtttccgaggccgagaccagcatgccgaggacggtgagcttgaagggctggagcgccagattgagaatggagtatttttaggccgccggatgattatcatcatccttcgagcattcggtgcctgctgcggacctaaggaagtcatggaggtctggctgcatatcgaacgactttggcaaccaaaaaggcgcaaagcgctngacgtcatggccgtgaaagaagagctggagaagcagataaacaaaggcagtaggagacactgaagtctgactgaaagaaatcagtgcatgtacattataaacctgttatatatacccctcaagtgcataccatttgatgacagctttttganaaaanannnnnnnnnnnnnnnnnnnnnnnnanaa

SEQ ID NO: 6392 - DNA, 674 bp, Aspergillus oryzae
  misc_feature (1)...(674): n = A,T,C or G
ctcccaagctctaccctgaaccctttcaaccaccatggacgaaaagacatccctcggggcgactgcacacaatgagaccctgactcaggcgacaaagtcaggactggcggaccccgctgaccgccgcgagtcctttgctctcaatctcgttgagaatccgctgacgcgcagctctccagagcaggctgttctcgatgcccgagctttcgccgagtcgcaccagatggcggagcacgcagatctgtttggtcgcgccgctctggtcgcgcgggacccccaacgcttcgagatgattactgagctctctgaggatgagcgcgccgccctcatatatgagcgcgatcacaaatggcacggccccttcatgctctggtactcgatcgctttgtgcgccgtcggagccgctacccagggatgggatcagacgggatcgaacggtgccaacctgtccttcccgcaggaatttggcctggttggaacagcgagagctgaatggatcgtgggagttatcaatgcgatcatctttttgactgctggtcttattggtgcctttatcgtcgatccactganacactacttaggccgacgaagagagatttttgtcacggcttgctgtctcacggncaccccaattggctcggccttttgcanatcatggcagggacttttcgccg

SEQ ID NO: 6393 - DNA, 723 bp, Aspergillus oryzae
  misc_feature (1)...(723): n = A,T,C or G
gcgtccagcggatcgattctgacgaggcttggcgttgggcttagaaacggtttatggacatactgaaatcggtcccgatggtctgactaagagggagcgcaaacttcaggaggattctatcgcatacgacaaaatgatggatgacatgatcttaaaacaggtcgagagcattagtttcgaagatccgagtgacagcgaccagaatgagccttgtgtggatgaagcaccgccgcgtcgctatgaaacgcgtcgtacccgcgccatgagctcccgggagaagcataccagcaacatcccaaccgttcgtgctcgtgatgcagccgctgctctttctggcaccgaacgcacactccgacctaggcctgtctcaattccaaagcccaagccgagagttgcgtcgtccttattttcgtcgagaaagcccaggacgccaactaacccatcatctatgcatcatgccgcggccgtggttaactctaaaacaacagtcgggtataccaagggccgggacgtgtcgtgcaagctacatggcaaacctgccaacactacgaaaggactaacatttcccanggattttctttgcgacactacggcgactttccgaccctcttttgaaccgatcgggctntgccatgagcggatactaacgcncatttgagaatgctcctgggttaagaaatgagggagctaattccagtgaccttggacgagggtatgagccgg

SEQ ID NO: 6394 - DNA, 653 bp, Aspergillus oryzae
  misc_feature (1)...(653): n = A,T,C or G
ctcaccggtcacaacgcacagcccggacagcccacgttcccacgaggttattgatagtagccatctatctttggttactgtcggctcgttttcttgccccgggtccagattcagcgccttcagtgtggtaccgttcagttaccgaaatcaaaagcacggcctcctgggctaattagttttcttaatcggattatcatcatgtcagcgttccagaaatggacggtcactgagccgtacatcgatatcgcagggaccttgttggagggaccgttctatgatgagcccagaaatgagttccgctttgttgatatctgggagcagaagttctatgtggtggacttagccaaaggcccagactcattgaagactattgatacgtctgcttccatcggggtaactgccaacatcaaagattctggcgatgcctacaacggccagataattgtagccgcaaaacatggatatgctcttctcgnacgcgccacgggtcagctctcgtatatctctaaggttttgggatgacagaagganccagagagagcccgcatatgcgtttcaacgacggggcagtcgacaggcatgggcgattctgggcgggttcaatgaatgnacccaaagtgcagtccccggtcaacgaggccgtcntttccaga

SEQ ID NO: 6395 - DNA, 684 bp, Aspergillus oryzae
ctcacaaatcccttttccgattttcgcctctttgcgccgttctacttggtctacaattttcctttctttgccggccatgtcctccacggtatcggccactccggctgatcccacaaagggtatgcgtaaaaacggaaaaaactggcacgataacaaaaagccgttccgtcctaacgctggtctgacctcgtacgaaaagcgactggaggctcgcaagcacccagaaagctgttaagacacgaaagagacctcaaggagaagagggaggccaaccggaagggcattatcagaaattaaaggaccttaggctcaaaagaagaaaaaggacccctccaaaaaaatggcggaaaaaaacctatcaaacctttgaaccaatggacccttaaggaaaccgcacaaaatggttaactctgaattgtgggggggaaaaattcttcctgggtcctcttttccctttcttttgggtttcccttttaccccccctataaccactataaatttattttgcgcccattttatatattctcaccgcatttttttttattttccgggtgtattgggggggaaaagccccttttcctttttatttcccccgctttataaattgctcttgggggaataaaaaacaagagtgtcaaaagagagatttgggggaaaaaaaaaaaggagggtgggggatataag

SEQ ID NO: 6396 - DNA, 688 bp, Aspergillus oryzae
ggagttttcggcaccaacggaagttttctccttctccgccatgccagacccagcatcgatgcaacagtcctctttcctagacatgagcggctcccaaatcgatccagtcacgtgggataacagtgcccccaacatgaccaccatggctcaaccaatgtccgataactggcccttcgatatgatgtctatgaacaatagcatcccatcggcagatgttgaggcttcggggtatgcaagtgcaccgtcgtcgggctatttgactggaccatccactcccgactttcttcccattcagcatccagacagtacctctaagtcactccacgaatcgacctccgatgagccagctggggatgaacttgttggaatgggtctttacaatcaccctgaccctttcctggatacctcattccatgaggtgtctggcaagggtctcaagctggaggagactttcacaccctcgtcggacgatgaagcagatgacagcaaagatgccgagagcgaagacgacaaccaagagactacggaacaagccagcgccttcagctctgctcctgtccagaaacagccggccaacccaccgaccaacatgatgcacaagtcattcttctttgacgatgacgacattcgacagcagaccatgtctgcaccccagcagctctttaaacttaggagtcaacctttgcat

SEQ ID NO: 6397 - DNA, 658 bp, Aspergillus oryzae
ctctttcgtgttttttgtttcttttttcgagccagcgttagcgtttcgtctctccttgattctttcggtttttttctcttgcatgaagaagcggcgggtcggctatctgttttgttttgtttatgagaatatcccattgttcagatcccgttttatatgtcatgaaagacctggttagcctcgcggcttgggatatgatttggatgagaaacgctcgctctgtttcctttcgtcgccgcatccgtccaggatagcttgatcgatggtgttatggctgggcctagacccctccttctctgtcctggacatcctctttctggtacaggctaccggactggtcatctgctaggtcagattgaagaggtattgattgcggcgctgcgggtcgtgttatcttgacgctcgcagttatttctggcaacacagaccatgttggcgacgatagaacactggaggctggattactcgtgggctcgggaaggctgtccgtgacaggcgcccggtgtagctgagaaccgtcgggtctgtgaccttgatgggactcggtcctccgagtgaaccaaattccctttgcctgttggcgcgatgtggactgtgttcgtctatagggtcatctcctatcttccaggctgggttctgaatacctggataagctcgt

SEQ ID NO: 6398 - DNA, 682 bp, Aspergillus oryzae
  misc_feature (1)...(682): n = A,T,C or G
tttccctgaccttactcaatacccagaccgggtgggattagaagagcatctaccagacacgcagcaatgtgacagcagccagccgtcaccgaggccacgcgagtctcttcccggaaacgcagactcgcagcccgaacaccatgtgaatggcagtcagtcgcaaccgaaaacacaaccacccgtgcctcttttcgatgaatccacaaagccgtcatctcatccgccagttaatctccattcgatactgaacgatgaggaccactcaccaaagctaatcgtggactctgagtatgtccagaatctgcacgagcagctcacccagcggaccagtggctgctcggtggagcagcttgagcagatcaacactagcctaatggactacctgtggcgcacgcgtggtgaatggaaccgcagcaaagtggccgctggaattcgggactcattcaatgagatcctcgaagacatgcaggcgatgcaggaaattggtcctatcagtcaaaggacgaaggaacagttgggttcatcattcgaacacctgtaactatgctgcagccctcgtcaagagaacccttaattctctctttttccnttgcctncaccccctcatctctcttcttcacccctctntctttntttcgttcctttctttcctacccaatattttctcttcgcctggtataag

SEQ ID NO: 6399 - DNA, 700 bp, Aspergillus oryzae
aaaaccatgtatctccgcgcagttcacgcagaaacatcgatcaaggctctcttcgagttgatccaaaagaaccctcttggtgtactcactaccgctatcccttcgactactcaacatttcatacagtctagtcatatcccatgggtactagacattatctccgatgaccccgatgcgccagtgaaaggtcgtctgcgcggccatatggcccgccaaaaccctcacagcaagacattcatcgaagccctgaatgctgcgggcctaccatctgcttcgccattgcagcaagaagttcaagttctcttcacggccaatccgcaccactatgtgactcctaagttctacactgagactaagccagccacggcaaaagtggtccccacctggaactacgctgctgtccaggttcatggtaaggccacgatctaccacgatagctcctctcctgagagcgcggagtatctccagaagcagattcaagatctctctgagctttgtgaaacgtctgtcatgggctacaccggagagggaaggccggccgaattttgggaagggactggagccgccgaacgggcttttgtacctattaaacaaaccatctgtcgtcctgagaacctccatctgctactgcgaggccgatctcatataacgcacttcctttcactcaaactcatgactacatctgttctcgtcacccccg

SEQ ID NO: 6400 - DNA, 1154 bp, Aspergillus oryzae
  misc_feature (1)...(1154): n = A,T,C or G
gtatctcgcattcgcacgaggctctagcactctgaaaggaactgcctacgcgacatgctggaccaatatggtatcgtaggacaacccgctggcccacgaattgggtacagcggaagaagtctggacgcacacgcatgggccaaattaaggctatcgtcgccggtgcaggaactggtggaacaatcactggactgtctcggggcctgaagaagcataaccccgctatcaaggttattgcggctgatccccatggttccatcttagctttgccgccttcactaaatgaagatcatgtaaacgaaccatacaaggtcgaaggaattggatatgatttcattccccaagtgctcgaccagcaggccgtggaccagtggtacaaaactggagataaggattcattccagtacgctcggcggttaattgctgaagatggcctccttgtangaggaagcagtgggagcgccatatcggctctggcgcaagcggcaaaggactacaacttcgggaaggatgatgtggttgttgtcattttgcctgatagcatcagaagctatttaactaagtttgctgacgatgactggcttgctgctaatggacttttgacatcgcctccggtcgaaactgcggacctgccctcaacactgcagccacacgaacaaaaggatgccttcgctggatcaagggtcaggtcgctgaggttgaagcctattacaaccgtccagtccaataccccttgtgaaactgccatcgaaatgatgcgagaccgcggattcgaccaactaccagtgcttgcaccttctggcaagaagctcgtaggactagtgactctagggaatgttctaagtcgactcacccacggacgtgctactgggaagagccctgtgtcagatgttatgttcaacttcagtaaaatctccgaggtggtcactgacccaagagatatgggattgaccagtgcgacgctaggaaaagcggataactcggagtcccggattaaagaccggaaatntgtggagaatactatggacacgcctctcggcgtattgaatcgcttcttcgaatggaacagtgctgcggtcgttactgagagggatgaancaggagtgatgagaccaggtgcagtntgcacanaggtcgatctacttacatggatg

SEQ ID NO: 6401 - DNA, 662 bp, Aspergillus oryzae
gctgcgcgctgtcacagagatgaagggctattcgaagatcatcgcatcacaccacgaccctaagggagaattgtcatgggcgaacatgtcttggatgaagtactacaacagggctcttgaatacggcgacatcatcaagcttgtcggtgttgcaaagaatctagatgataacacggcgctcaggaaatttaagagctgggcagaggaagcacacgagactccattaatcgctatcaacatgggcgacaatggacaactcagtcgtatcctaaatggtttcatgaccccagtgtctcaccctagcctacctttcaaagctgctcctggtcaactctctgcgaccgaaatccgcaaggggttgtccctgatgggagagataaagcaaaagaagtttgcagtgtttggcacccccgtctcaggctctcgctccccggtcctccataacaccctcttctcccaggcgggccttcctcatgagtatggtcgtttggagacggcgaacgttgaagacgtcaaggacttcattcggtcccctgattttgggggcgcttctgtaacaatccctttgaagttggacatcatgcccttactagaccacatcacaccagaagccgaaatcattggcgccgtgaacactatcatccctgtcgctgatggagaca

SEQ ID NO: 6402 - DNA, 682 bp, Aspergillus oryzae
  misc_feature (1)...(682): n = A,T,C or G
ctaaggtcgtggtggctcccgtcctatactataccattaccaagtcagcccgcaacgcgcagctctctgccacccgatccactcaaatcttacaatgaggctggggattaatccattactaccagactcgtgagcagatcttcaccgaaaagtcccagaacggtcttctcagcaccaccaaactcgcgtgctttgcctaagcttccggggcaaccccatgactatcagtcgacggaatagacaccgagaggtggggtgagcgtaatctgagattttagaccctctggaagctgctgccgatcaaaagtccctttcgatatatttctaaccttgtggcgggtccacgaatgagcacggtaccgtcggaggcccagattgacacggtcctcttgctaccctgcaatagaaggataaatagaatcttattgtccgggggttggagtcttaggctcggggaggaagaaaaagagtgaaagcgtcattttctagcactggctacaagtcaagacttgatgcacggtctttcaatcagcgtgcattgtgcagccaatgttatgtcactcttcttgtcatcgacggtcatggaatgtcgctgagcactgactttggttgccttctttgattcacgcctcctcaaaagacctcactttgggaggggctntcgctntctcttccacttgtc

SEQ ID NO: 6403 - DNA, 671 bp, Aspergillus oryzae
  misc_feature (1)...(671): n = A,T,C or G
cacttttatcactctgttcgccagcatcactgttgtggtacagtgctttccagtccagaagacttggaacccaactctagaaggaacgtgttggctcgacttttctaaagtgggttacacggttggttgtgagtgctgcatgatcttggattcatgaatgaaaaagtctgactttttccagcgtggttcgtcgcggccgacttctccttcgcgattcttccatggttcatcatctgggatctcaacatgaagcaaaaggagaagatcaccgttgcctgcggtctcagccttggaatctttgctggagtatgtggcatcgttcgcactgtagccctgtccggcctgaatgcatctgagtacatctatgataccgtgccaatgctcatctggtccgcaaccgaaagttgcgtgacgatcatgtgctcgtccattcccgtcctccgtcctctctacgttcgcgttaggtacggcacgaaggatgaaggcagctctggcaacacttcctacaaactgccattgtacgggagcggtcgcaagtacggcagactttcgaaatccggacttgaccctttcgtcgtcgaaacgatcggcggatccctttcggcacctgctggagattatcacanaagcaatatcaggcacgagcatatncttctcggcgctgcaggcat

SEQ ID NO: 6404 - DNA, 629 bp, Aspergillus oryzae
  misc_feature (1)...(629): n = A,T,C or G
ccctgcataccgagcaatagcagagtatgatagagcaatgacccctcccaaatccgcaattattatcggcggctcaatctccggcctcctccaagcccttcaactcaaacgcgccggcactgatgtcttaatcctcgaacaagatccgtccccaacgcgagcaagccatgaatctggcgtctccattggaccgagcgtgctcgcccttctcaagaaatacgacgccacaggcacaccacccgctattccagcagggtttctcagtgttgcgtggcaaacgcgcccgcgtgtgctgaacacagcctggcaccatgatatgagtaattggggcagtctctacttgatcctcagggcgaatgttgatgggttcgcttcggatgtcgtaccgtatccgcccccagggaggaagggggatgggacggcggagtacaaagccggaaggagggtagtgggggtggagtttgatcggngagacggngctatgaatgttttacatgtggaagctgaagcgagcangggctcaaggcangggatggaggtcaagaaagagcgtgctgaaatggtgattgccgcggacggcgtgcattcgacaatccgacgattcctacaggtccctacgacatggactt

SEQ ID NO: 6405 - DNA, 811 bp, Aspergillus oryzae
gttttctttagtctccctttctgttctattttcgtcttctagtggttcgtttggctggtccagacgagtgctattttttgagtcttcctatttttggatcttgcattacgtcaaataatagtatcattttacacgccctgcgtctaagaagcccttcgttgaccgaagtgaatcactggcgcctttaatatcctttcccattactttaaatctccttcgctccccccaaagctgtgtccagcctccacctccacaatgatccccactgcccgtgctgccgcaagacccaagttgagcctgagcatttctgctgcgcagaatacctcacggcctacattgtcgctcaagtccccaggtcctcttccccggactccaatctccccgtctgccgccagtcccagttccgcccggttctcatctcttcaagtgccgagttatggctacgtcaactcatgttcctcgaagagcattctcaagaaacagtcgacagcggtcgcagctggcaccgttaacaaacgaatccagtttaaatgcacaccgaccgtccactgcgtgacgcctattgagaatcctgaggagtactacggtacgcacaccaagatgtcgcgtgaagagcggcgttggatggtgcgcgaatgaaggatcgccgagaaaactcggagagaaaacctacgcagacggaacgagaggactcctcagagttcagggtctcgtcatccgttgagagcctatttcccgcgaccgtgcccggccctaatcctggatcgacaatgcaacttgcagcacagatgccagaagaagcctgtgagga

SEQ ID NO: 6406 - DNA, 634 bp, Aspergillus oryzae
  misc_feature (1)...(634): n = A,T,C or G
gttaatattcactcattgctgtcccccattgacgcctgtgacgaaatagacgcatacgcaaggatactatctccacattctctttcagctccattgaacgatcaattgttccgtttcatcgaaccaccaaacaaacggcatcatggccgccgctcgagatgcgccgaaaccccaaatcgaccgtcagtctacaacacccttccatctgaagcttttctaccgcatgaacaacttccaccacctgtcagactttgctccccagtcgtcgcctgcatcatacgggggtcctgtcagcggccccaatgccatccgggcgcgctcccctcccccgccgccgctccctgcccaccttcaaatttacacctggcagtcctgctcactgcgcgagttgtcacagctcctcacatccgccttgccgtcactactaccggacccgcccgtagggacgagactatgctttcgcctcatttaccccgacacanagaccgcagcacaaatgggacccgaggcgcgaggccgataccttagcaaggacatangcagtgtggtgattgggccaaaggacagcccgtaccgcgatgagaacgacgaagaaacagtgctcctacgggaccnctgaaccgacctctacggg

SEQ ID NO: 6407 - DNA, 667 bp, Aspergillus oryzae
  misc_feature (1)...(667): n = A,T,C or G
tgactctcgatgtggaggtcagtgtaaaagactttgctcgaagtctggaggatactctgaaggatgcgagtgagaattcaacgcgcgagcacgaaaggcggcggatgcaagatgctctgggagacgaggatgtgattcgagactttatttacgatctgaaacgtaacagtcgaaccgcatatgttcggaaggaagaggcatcgcgagccatgcacgaggagcatgagcgatcccgatacgatgaagcgcccgctactcggacatctactaccccttccactggctccacggggtcattgcctggntctacccacgaggatcgtgttgccgctgcaagggaacgtgcgcagaagcgcatcgctgaacgaatggcagctgctggcctcaagcctcacaantacaccgcgtaaacccttctcagcgtcaggaacgcgagaaaaagaacgcgaggcccggtgaaagcaagcggagaagaagatccaggcgcgagcaagaaagcagcgtcgactggccgaagaacaggtggntcaatggcgcaccctgctaaaccagcgtctagaaaccctcaccggttcaacttcgagacggggcggactgacaagcccggacagccgaagctaaaaggcaanncgagatcaccatagtnnacaagccgcccagagcaacc

SEQ ID NO: 6408 - DNA, 683 bp, Aspergillus oryzae
  misc_feature (1)...(683): n = A,T,C or G
atggcatgctccacgagatgaagaagctggtgcagccattcgaggacacccttgaggacgagcgccagcaagctctggctgaagagctcgctcagaagcgcgctgaggaagaagccaagcgcgcggctgaagagcaggccaagaaggccgcggccgctgctatgaactttgaagagagaaatgagacgatgcctgatgctcctgctcaggaggaagcccccgctggcgacaagcagtaaacgcctcgctcctgttgcatcggtcattcctctcatccttaatatcctatattatcattgaacacagctctcgcatttgcagactgatgccaatacctatgaaccaaattcaatgatgttgtgcgcgaggttgcttttttctatcattacgatgccccacttggntttctttctttcttcttttcgattgtcgacatgacctggcaaaattcatgtagaacgagatttcttttggttctcgtgtgtcgccgatggcgtttctgtttccccctggttgccctgcgaggatgctggcgaagtcgtgcaccactgctgaatctcggcaccgttgtcggcgcatccccttncattcgctggcgaccggacctacataagggcgcatcatggcacgcgagacggtaccgaacatagatatgacatgtgtggatagactttgggctgcgc

SEQ ID NO: 6409 - DNA, 692 bp, Aspergillus oryzae
tttttttggttctttaagccaccccgtgatccactctttttctcccgctcagccctacgccttatttgatttaagaaggcggcgcgaaccattttatcttgtctttctcgctcagtcactgagtcgaatactctgcgcaaattaaccagttcaacgtatttcgaaataaccacacctttcaaaccccaagtcaaccactcaaccacccaaaaccgagaacagaaagaaagaaagaaacaaacagaatgtcccgcggcagcctcgtccccctcatcgtcctcgtggtcatcgtcaccatcctcgccgtaatcggctacatcacttattcgatcgtgcaagaagtaacccggaacacgaagtccaagatggagaagaagaatgtcctatggacaaaggacggcatgaaggtcggggtgaaggagataaataatgaggattatcaggatcggactcagagtgttctcgtgaatatgtggaatcatacttcgtttccggcttataagagtcggttgtggaatatgacgcagccggcggctgaggtgcagcaggctgagaagaggaagggtaaagtgattgatttccttacctttttctgtggggggtggggttcgcatactttctggggtgtggtggcttaattatacctctcttggtaatttatctcgttcatgctttctggtgggaaacctggg

SEQ ID NO: 6410 - DNA, 695 bp, Aspergillus oryzae
  misc_feature (1)...(695): n = A,T,C or G
gttgtttgtctgcgactgacaatcagtctgttgggatgacctcgtttactgttgcctcacctttgggccgaagcgacaaaacaaacatgaatcgtttatcatccgtttccagcctaatgtcgcccccagagtccaaaccgttcgatagttttaaccctgcattttcaccccatcaactgtcacagaatccctcatacagccatgacatgaaacttcctcccatctccgttgaccggaagcgaacacaatcggagatggacttgccgtcgccacctgtcactccctacacaggcaacaaaaaaaggaagtcaaatgcatcaaagcaggtcgagggagatgcggtagttggctcttcaagggatcctgtccttttccctcgccacgattcgctcacagaggttgccactgatgagccgttgttcggtcctatgcttccgacagagacggaagcattggttgagcaacacattaattcccacatggcaagatttgaaaataaattaaataaaccgacacgcgatgaatatcttctagctctttcgtgtgtgccaatcgtttcagctcaatataatcgcaacccaagagcatggggctaaagaggagcgagaaacgctcgagcgcaactaattatgatgaatcgctgccgtccgccacgttggaagnaaaattaagaaaatcgccccgggccgctaaaa

SEQ ID NO: 6411 - DNA, 674 bp, Aspergillus oryzae
  misc_feature (1)...(674): n = A,T,C or G
gctcagcaaagggaggcagaagatcagcgcgagcgccaggagaggcaagaaaaacaggccgcacctgctgcgactcctgcacctcgcccagtacctgtacctgctaagcccagctacaatctctcctcactcgaatcagaacgccgtctacttggcacggagtggaacaaacatcagaccgaagaatgaattgctgaagcggccaacccccctacttccctaccaccccggctccagtcaaggtgcccatacaccctgtcggccccttccggacccaacgctctatgcctcgaaacccgccaatcaagaaagccgcgtagaccgcttcctcgcatacaatcgacctcgcgtagcgctcaagccggacactcatcgcccacgagactacacaacaactgccgaggttgacgcataatatagccggcgcgcagcggcacgagcaaagaccaaagcacgctgatgggcctacaagtcattgctcgaacgtgaaatggagcgcgagcgcaagcgccancgtcagtgggaggagaaccaaaagcaactcaccaggccgttgccaacggctataagatggaattctggtgttgggcagggacagggaccttggatgtgcaccatacggctataggtcggggcaaccagattcgggccgccatggcctggatttgaggccc

SEQ ID NO: 6412 - DNA, 664 bp, Aspergillus oryzae
ggaatgtgggcctctcactatgaggttggcgatgcaacttctcccaggaccccaccaggtcttgggcaacacccgattcaacattccggtcattttatgccaggaagcatcagtagcccaagccatcacctacctcaggactcggctgtgaacgatctaatgcttcgtcagagtctaatgcaccaatcccagctgcaaaaccccctgaatggatccagctctatatcctcgtggataccctcgtcaaaccccacatcgcaccaccgtctttctggcttggggtgggacagcagaggaccactggatgctgcaagctctccaccacccctgagtgcacccagccagaccattccaagtggcttggccaatgcctcgtgggcaaatgatgcgttcctcgctaacacgctctcctcaggcgcaagttaccccaactctgggtccggtggcagtcgcaagtccgctacccagtacggtgccattggtcaaacacctccctgcggacatggagggtgacaccgatctcttgatgatctgaagttggggaacaagtctccgagagtcttttgagacaaaagcacacacgccagaaacccgggtgtaagctttgggtacttggcttccgaattgtgagcgttcgaaagcccaacggcgaagattttgcact

SEQ ID NO: 6413 - DNA, 1112 bp, Aspergillus oryzae
cagctagttatatgccatcatcacgaaaaagccgcatggcaatcgatgccctgctgaacccgtcaggagagtctgacaattctcctcagctgcattacgcccatcaaggatcgcagtattcacctatctacccccctagtcctagtcatcactacttctaccacccctacgcagagagccaccatcaccaccaccatccttaccgggaaagttcgggctcctcgcaagaccaggcattcttgccatatcgaccacggtcgacggagtcctcgccaggtgcgtactctcgggaccggtacgattcggtctcaagcagttctagcaacgccccagaacggcgacgcccccctcgaccaaagtacgaggaagaggaaatgtacttcatttggtatcaccgcgtggatctgtgccaagagtggaaagaagtgcgtgagagctttaaccgacaatttcctagccggcaacgacgcggattccaaggaatccaatgcaagttctaccgattcatcaaggagaagaagtgtccaacgctgcgagagcagagacgcatgcgcgatggcgagttcctacgagaggggtccgggctagttgagtcggctgcaccacgatttggcgtcgtggaatggatgggagcgtggtatccttggatgcgagagaccaaagaacaagttctaagtcgacgtattccacgttgaatttcctcctcttcttttcttgtctaaaaattcttacctccttcattcctcgacttcctacggatcctcctcccaccttgaaaaatccccttccttacggccgtcaagatacctctgaagtttctcatctactttattcacttattttaaccttatgttcctttaccgacagggctatcattctgacacgttgctgcgttcttttctctcatttacattgtgttatgattctcactgggaggctgtctgatctttagcatgcatacatcacatcatcattgtttttattctggattggaaggaaatccatggagactgtcatttgtactggagtggatgagattattagtctcgaccggatttactttgagaagacaacatactagttccttcaaaaaaaaaaaaaaaaaaattcct

SEQ ID NO: 6414 - DNA, 655 bp, Aspergillus oryzae
caacagatggaaacggagctatcaactgacattcctcaaatcaacgaggtcatgaacatgcctcgagctattgaagtcagcactgagtctcttacaactgatgatgtttctgctccttcaatggagccagaacccgcgttaccggtggaccatgtgtattatttcatccaaatcttcgatgtggatgcacaggccttgcggaccgtcgggtcatttttctctcagaaggaggagactatcaaggctgcaatacggaagcacttgcaatggcccgtgaccaaggatttccaggtctggcagcgtgtcgatggcactacggtgacaactatgtcctctgccgagacctttgaggtgttcgtgcccgatggcacttgcttcattgtcggagacaagctgaacaaggacaaacgtttaaaactcaaccagcaagggttacttgccaaccctgatcagctggtgcggtatctgtgggctaaaatcccgaacccacccacccaagcattcaccgggtttcagaccatcgaagcgtcattcaccaatgaatttatagcggtgagttaaacaaggttactatcatggtaaaggaaacccctttttgattcaaccgcttactacaagggagatttcgtccttggaaagcgcattgtaaaagaat

SEQ ID NO: 6415 - DNA, 680 bp, Aspergillus oryzae
ggatgctgggagttctagacttgattcactggaagatccaagtgggagctcaatagctccgagtacggtttcagggccccgtgatcaacctgaagcaatccctgatgctccttcagatgtagaagctgatcaaatatggaaacacgagtcctgggtccagatcgacggcttctctgcgcctgtagagattggccgcgtcccgcgcagggcgttaggcttctttccgcgctcaaggcggaagtctgtttcctatactgattctgagattccttcattctctggacgcgagagaaccccgacattatcctcgacttcatcaagcattgaacctcagtcttcgcgcgatacacctatatccggaaatagacctcacgccgactcgtcagggtcacgagcatcagccaaatccaagcctgccgtgcgccatcaacgccaacgcagcaatatacaattagccgggccgggagttggcacccttgatccgtgacacaaatggctcctgagccggctctcgacggtttgaataaattctttgcccagcatctaccgaaccttggccccactcccactccaccgaaaattccaagactccactgagtatacctcaaatgctgtgtccaacactcccaccggcttggttatataagcggtgcaatcgagggctgggtcaaaaagaagat

SEQ ID NO: 6416 - DNA, 570 bp, Aspergillus oryzae
  misc_feature (1)...(570): n = A,T,C or G
agtccaggacgagggcaaaatctctgtatctctccgttatcacgattcgaattactctatcacgcctttcacaaagaccaaattaaagaacccttcatcatgagcactctcgacaagatccactccgacaacaaccctaagcagggtttccatcctagcgctggtaactcccagccgctcacagacaagggccatcaacccggccgcaaggtctctcctaaagactatgcccctgagttccacgcagagacatatcctcctggaacggctcccgctagcaactctttacactcccaacacccggtcggaggtgggaagccaggctcagaatcccaatgttgagcgatctcacggaaaggagtctgtaagaacgaccgcggaccagagtctgcagggagctacctcccaggatgtgcacaccggtctaggtcaccctggaggcggccagacgagcgcagaacttcgccatgacggacaaaagcaccggaagaaccccggtggtggcctcgagggtgtcggagcaagccangagcccccggtacgaccgtcagattccccggcctgcgcggn

SEQ ID NO: 6417 - DNA, 664 bp, Aspergillus oryzae
  misc_feature (1)...(664): n = A,T,C or G
tacactcttgactagtcatggcgcccgaacggtgggacgatgaggaggacagtgtctcccctcctcctgtggctcctcgtcgcagattcgacgatgaagaaaaagaataaggccttgacttctgggaccgccgttgaggactccgaagaaaaccggaaaaagccagccaaagcggccgaagccaaggttaaggccgacgccgaagctgccgcaaggaagaggagcaggtcgcagcgattccaggaccacaggaagaaccgcaaaaggaaggccgagaagaaggattccgacagcaagaagaaggccgatgccgacaggagagcccgtttgcgccgcgcccagaaggatgccgatctcaggcacgtctgaaatctgttcggagatatcgacctaaaccgaaaccgcggcgcccccaaggttatcgatataagagactcngccaaccagacacaggccgtagatctttgtgccatgcctatattcaagcataccacttaggagcatttcgctcgtgagacttacacctttatccgcgtcgtgactcccaattcaaagagcctcactatnccgtggggcacagaattcgcttaacattttgtaaggacttcaacgcccaattgccaaaaaatccctgggtttaagcctattatgaccgggagaagta

SEQ ID NO: 6418 - DNA, 729 bp, Aspergillus oryzae
taaatcaggccccgggccatatcaatttatcacctgataagcgcaccaaatactataagagagttaaaagagatttccatatcggcatatctgtattgttttcatccaactggaccaaaagagagcgtctcccgatattacactatcgagcatcgccattctgatattgcgatagaagattgtgcagagaatacccgtgtgcttggtatcgaggaaatacttttatggaggaactggcgcgtttcttacggacggctcactggcaacagacgggtcacaatacatatttctgtgatgatcccagattagagactttatgggttgatctggtcaaggagctgccagcctcactgaaaggctacggtctccaagcgtggaaattaaatggaacaacgaagatactagaaccagaaggttacatacaaccattgccttctattcctggcgaaacgacctcaactgataccaacgagccccgaatcttagggggacctaaattgacacctgaatcaggcccaatcgcttttacgagtgaagtcattctcaccggatcactttattttatagtagctctccccccaagaaaaagtaaatgatatgacgctttacatgacgtggcgggttgattgacgattttttgacttattgacaattcttcaacacctttcagttgttgaacaaattgcccatttccgactctttgtgaagttctggaataaattgtggata

SEQ ID NO: 6419 - DNA, 716 bp, Aspergillus oryzae
cgaggctctctcctaaacctctctttcaacgaattgcatcacatcccacacctcaccctccacaatcaccatgctccgtcaatccatcagacctctcactaccgctaaccgcgccctcgtctcccggtctttttcagctctcgcccccaagatggccgcaggtgataccggtgctccccgtcccggtggttcccagcatgcgtacgtcgctctttaacttccccctgttgttttgagccggtaaaagaggtcgtcatccgaccgcaggataatgacatcatcgttgatgaatgggacgatggcactaacgcatgcatccagcgaccaattcaccaagcgcgaagccgcacaggagaacctctacattcacgagaaggagcgtgagaagtatgtattcatcatttcttctgttatctaaaccccccccccccccccccctcttcgagccgtttccattggcccaattctgtctggcattggcacggttcggaattgtccggttgcaaatagatgctgacttgtctctgtaggcttttggccctccgcaacaaggtcaaggaacagcgcaagcacctcgatgagctggacaagcacattgaggagttgaccaagaaccagggcggtgaacagaactagatccttcatatttgatgatcttttttacatcggatgacgcagtttttttagctcacagtttccgatcacggtagcatatt

SEQ ID NO: 6420 - DNA, 684 bp, Aspergillus oryzae
  misc_feature (1)...(684): n = A,T,C or G
cgcaatggccgaggccacccttcataacgcccccattgtcatcgacagtggcagcgggacaatccgcgccggtttcgcaggagaggaagtcccctcatgtttcttcccgtcgttcgtcggtcggccaaaacacccgcgggtgatggccggcggtctagaaggagatgtcttcatcggatcgcgagcacaggagctgcgcggcctgttgaagatccggtacccgctggaacacggcatcgtaacggactgggacgacatggagaaaatctggcactacgtctacgagaacgagttgaaaacgctgcccgaagagcaccccgtcctcctgactgagccgccgctcaatccccgcaggaaccgcgatacagcggcccanattatgttcgagacgttcaatgtgccggctctctatacgtcgattcaggccgtgctgtcgctgtacgcgtncggcccgacgaccggtgtggtcttggattcaggggatggtgtctcccattgcgtgccggtgtatgaaggttttgcgatcccgaacagtataccngcgattgatgtcgcggggcgagatgtaccgnacagttgcaagtggtgctccgcangaatggacatgtactggatacaagtgctgaaaanggaggttgtcggaaggatcaanggaggagtgtgctatgtttncgttggaatccc

SEQ ID NO: 6421 - DNA, 1410 bp, Aspergillus oryzae
ttactttttattccccgttataaaactcttcctccattttctcaccctcccaactcttttttaaatctccatctaccatcccctaaataaatcccccaacttatcagaatcctatcacaatgggtcacgaagatgctgtttatctggccaagctcgccgagcaggccgagcgctacgaagagatggtcgagaacatgaaggttgtcgcctctgccgatgtagagcttaccgttgaggagcgcaatctcctgtccgtcgcctacaagaacgtcatcggtgcccgccgtgcttcctggagaatcgtcacctctattgagcaaaaagaagagtccaagggcaacgagtcccaggtcaccctcattaaggagtaccgtcagaagatcgagtctgagctcgctaagatctgcgatgatatcctcgaggttctcgacaagcacctgatcccctctgcccagagcggcgagtctaaggtcttctaccacaagatgaagggtgactaccaccgttatcttgccgagttcgccatcggtgaccgccgtaagggcgctgccgatgcctctcttgaggcctataaggccgccactgaagttgcccagactgaccttgctcctacccaccccatccgtcttggtctggctcttaacttctccgtcttctactacgagatcctcaactcccctgaccaggcttgccacctggccaagcttgctttcgatgatgccattgctgagcttgacaccctgagcgaggagagctacaaggactctaccctgatcatgcagcttctcagagacaacctgaccctctggacctcgtctgaggccgagccggctgctgagaacgcctccaccgagaagaaggaggaggcccccgctgctgagggcgagaagcccgccgctgagtaaagaagagatgaaggactcgcgtccgatcatggatggagcaatcggacgacgggactgttgattcacgcgaaagagctagagcgctgaagaggaaaaggaagcgaggcgcctttcacgttttcgtatcatacaatctagggcaagatggaggctttctggcgccacagcccgcggatggagattcgggttcttgatgattttcgggtcctctgctttctgtctctaacgcagttcactttggggcgtggtcggcttctgcccgtgcaccgattctccatctgtggttcaacttttcgtttctcgcatgatttttaccttatttcccttttaaatttttttgcctattggctcaactacccaaagaatacctttccctgttacagactcgtgccccctcaaacatcagtgaaattattttccctttgcaaggcctggactataacctgaacattggctttgggttcctttcgtgcccacgcaatggggtttggattggcccggctgt

SEQ ID NO: 6422 - DNA, 1141 bp, Aspergillus oryzae
  misc_feature (1)...(1141): n = A,T,C or G
cgaggccttctccccttccccccgagttgctcattcggcttcgaccgtaacaactcgtgcagctttaatttctcgacacctttcttcgtccgctaccccgccgcagtcgcccaccatgtcttacaccgttcgcaagatcggccaggccaacaccctggagcaccgtgtctacatcgagaaggatggccagcccgtctctcccttccacgatattcctctctacgccaacgaggagcagactatccttaacatggtcgttgagatcccccgctggaccaacgccaagcaggagatctccaaggaggagttcctcaaccccatcaagcaggatgtcaagaagggcaagctccgttacgtccgtaactgcttcccccacaagggttacctctggaactacggtgccttccctcagacctgggaggaccccaacactgtccaccctgagaccaaggccaagggtgacaacgaccctctcgatgtctgcgagatcggtgagcttgtcggctaccccggtcaggtcaagcaggtcaaggtccttggtgtgatggcccttcttgatgaggaagagaccgactggaaggtcatcgtcatcgacgtcaacgaccctctggctcctaagctcaacgacgttgaggatgttgagcgccacctgcctggcctcctccgcgccaccaacgagtggttccgtatctacaagatccccgatggcaagcccgagaaccagttcgctttctccggcgagtgcaagaacaagaagtacgctcttgaggttatccgcgagtgcgctgatgcttgggagaagctcatgactggaaagtcttccaagggcgagatcagcaccaagaacgtctccgtttgcaactccaccgaccgtgctgaacccaacgagcttggcggcattccttaaggccagaaccttccccctgcccctttttgttgcagcgttgacaagttggtctttaatttccgggctgctgtgtaaattggtcccactaaaggaaattaaaatcccccacatcttggattctacttatgaaccgaagtccccttattttttcgtttttttggcgnagaaaaaaacaatacaaataatattttttctgggggccgtctcaacttgtctttataagggcgccttttt

SEQ ID NO: 6423 - DNA, 580 bp, Aspergillus oryzae
  misc_feature (1)...(580): n = A,T,C or G
ggctaccgctccgattcggacgaggcctccttctttcctcgttcccccctccgccatcctctccgcaccttccccaaagctcgtgacatcctattccggccgactagtacttttatagcccttgtgaattttttccaatcgacgaatcgccatcttcaacttactcttctcaattcagtgtcatatttttttttttgtaaaatacatcacacgtctcttgacgtcgattctgaaacgttgcatcttgagttcagttcatcctgtgggagctttggatagcttgcccgcactacagctcagacaccatgcgtatcactgtcagtgtcatccgaccggaccaagccgatgctgatatcatatagcttgaggtggggggggacatgaccggtgagcttctcaaagctatcgtcgagagcgaaacctccgttcccccgagcgcccaacgaatcgtctacaacaatcagttactcggagatgatgcacgtacccttgaacaggttggaatcggggaaggagatatgttgggtgtccatgtacgcttgggaagtcttaagggcccacccgactggtggcggccttn

SEQ ID NO: 6424 - DNA, 706 bp, Aspergillus oryzae
gagtggatttagggggttgtttgaagacggaggttagttgattaaggataatctagaaagtacatgacagggatatttttggacggagggggccaatgggggccataatgtgatctcgcttttcgtattgcattcaagatcttattctgtttctcttctattcatactttaattcttcaaggatgtttcacaccccgctcgctgggttttgcctttgatgttctgtccatgcctgataatctcttttactcaccactatgcttcgactctaaagattccttttacccaccgccgctcgatccttcacgctctactactattcacctaccctcccccccactttgttcgcaattattcactcttcattattcatcttattccacttttctcgctttatctctctatgctcgtctctctctcttacatacacttactcttattcattcgatgattctacttttatactactttctctcccctttctctccatccatacacctcattagtatctactcaactacatgtcactaacttatcgatctcacatgaccgttccctctctatctcatctccaccaattctcggtcctatatcgaacgtacgcccttaccatgcttccaccaccactataacctcacttttatcttaattaatcttctctattactaccgtctctctcctccttcatcgtttttcgtcgtactcg

SEQ ID NO: 6425 - DNA, 640 bp, Aspergillus oryzae
  misc_feature (1)...(640): n = A,T,C or G
gtgaattcaatctatgtggagtctattagatcatctacgtgatttattgctctcttttcctccttaattctgcctaaaccgtcaccgacgtagcccacctcatttcctggttcacattgcattgcaactccagctgatgaaagagtagcatccaatccaccttgaatgataccatcgaagcggctgattccgtctttaattaccacaccacccaaaaggcgtcttcaaggtaccaaatcgagaatggactttccacctttccttacatgggacaactaaccgccaaaactgaacaaacccaaccttcttctttcgccggggccacggtggaacaatggcgctgcaacgtccattaaccgagccaacgccgatgtactgaaccaaccccttcaggatatggaaaggggccgatgtaccttcgtgccgcctcgtgccagaaaaatannntnntnnnnnntnngtnnggttattnnnttnttattttatatatataaaagaagaaaaaatnntttntnnnntnntaagggggnntgnngnnngtnnnnnnnggaatatttgggggggctttatatccttaagggggcctttttttttatatgttgtccccctacccaccccccctctccaaaagccatagaag

SEQ ID NO: 6426 - DNA, 657 bp, Aspergillus oryzae
aacaattcattgactttgcacaacccctgttctactgtcactggctctagtagttcgtcactcgcaagccatcatgtccggatttcccacccttaagcctgccttcaccgttcgggtgaacatagatgctcctctagcagttggcagcgcctctcggtccaaccctctgcaggttgtgccaatgaccggaggtaccgtcaagggtgactctggtttctcccccgcgctcgacgccgaattcgtcggtgtaggcaatgactacatccacgctgatgccgatggcaagcacctgcgattgaatgcgcatggagttcttaagaccaaggatgatgctctcctctacctgaactacaccggtgttgtcaccctcacccccgcagagcaggctgtcttcgccggcaccgcctcagagggttcaacgcctttcggcaatatcttcacccattttaccttcgagaccggcgacgagcgttacaaggacctcgagaaccgtgttttcgtcggccagggacgcttcaacatcgagagcggcaagccggtcgtcgagtacagagtcagccaggttcaccatggttaagtcagattctttcacaatatcacggtaggacgagcgtcaatcgatgtatccactccaagcggaatattaaacatatcctc

SEQ ID NO: 6427 - DNA, 625 bp, Aspergillus oryzae
tggagatcaactaccgccgcgcgtgtgctatgaaaattcctctggtgcggctgtgtatcgacccccagaacctactttgggtcattctcgagccccatctctggccctggctcgatcgacttcctatcaactggggtaattttggtcgctactctcggcgcggctggtactttgccgaccgaggcgagtcgcatcgccgctacggtccgatctgggcgcttgtcactcccaaggaaatttacatcaatgtcgccgactcaaaagcaatccatgacatctttcaacgacggacggattttattcgccccgtggaacagtataccgtgctcgaagtctattgaccatgtatcttcacggcaaatacaaccgactggccacgtcatctaaaagtgcttgcttcttctttaaacgagagtgtgatgtcctttgtatgggatgaaagtgtggagcacacccgccacatgattgacatctgggcctctccagacctcgataagatatccaacgtcgccgaagataccccgacacctattgtgaaagtctccctgctataagaattcaaaaaaagattccttttttccctgggaatgggaacaatcacccggagcaaaatgacttttgttat

SEQ ID NO: 6428 - DNA, 666 bp, Aspergillus oryzae
  misc_feature (1)...(666): n = A,T,C or G
cggaaagagaacacccgaagagaggatgtcgagactcgattggccgaactcgaaaaatccgaaaaagccgcccgagaagctcttctggcagtggagaaagagcttctagcacagaaggcaaagcatggcgggctgtcgaaatcgtcacctagaattctgccccgcgaggtctgggacgtcgagagacaacaggaaacagagcaggtcgaagagcaaggctggtgggcttggatcacatcctatctaccagttggtcagacgccagaacagcaagcagaatcagtcatcaaggaaagtaagaagacaattccaaaggcacccatgcctgttggcgaggcagtaccagcacaggctccctccaaagcacgacagagtttggagtcgaaaaaggcttgagggattatctactcatggatagattctttgcgtttcttttgtacagatattattatagaactcattgttgaaggcgtgtgttggtcttttatattttgaatatccgggatgcgacatttagatanccttctctgttacaagggagaagaagcagatgacttgaactcctctcctaacaatgacatgtgatacaagtgtacataactctgacttcctaaatgtgctacaaacacactctacacaactatgaatacccaaatcagtttttct

SEQ ID NO: 6429 - DNA, 689 bp, Aspergillus oryzae
gggacgccattcctctaacatggataattttaaactcccaatccccggcttcgaatagatcgcctgtttcccgatgacttcacccgccagtgttcggctatctggtcggcagtcaatcggcctcgccctgatccggggatgcgcccacggcgatacaaaatgatattttccccgcgatcctggtcaacccctcccttccagacaggtcacggacgttgatttgaattggatcatcatacacagtgagaaatcattcaccatggcgacccccggccttctttacgtgacgatgcaaccccgcgattccctccccgcggcccagttccacgactggtacaacaccgaacacggccccctacgtctccgactgccctttgtcactaatggcttccgctaccgtgcccgcgacggcatctatcctgagtgggtggctccgtacgacattaccgacatggtggaactgacacgcgagacttacttggctcttccggggggatggtgtgaaaccccacttaaaaaggtttccttggccaaaatgacgttaatcgccaccttatgatcttttcactgaccataaagcccccactccaaccctggccgggatatccccaccctgaagcccccggctgggacttgtctctgctgggtccccgtcccgccgccacggagaaggacctcctagttggtct

SEQ ID NO: 6430 - DNA, 682 bp, Aspergillus oryzae
  misc_feature (1)...(682): n = A,T,C or G
cccaccacgccattactctgcaacgacttacgtaacttacctttacacgaacatttcacaatgaaggcctcaaccgtccttctgtgtctcttcgccgctttcgcggccgccactgaaggtgatcccacagtggctgacgagactcctacacccacccaatccctgcggacagtcgcccctacacgtcctataaagttgtacgacctcactccggaggagcagcgatttgtcttccagtacatgagggatcatggatttggaccgtatccgggtacagtaatgcccggaggttggcggtggccagacaagcgcgacggttcccttcagcctgagaccgagtttaaccctgacctgtcgaaactcatgcacatcatggacaccatgcccaagccacaaggaaagatcaaccattacattggggaaaaatcgaaaggcaaggacgactcgaatgaagacgatgaggaggatgaggatgaggacgatggcagtgatgacgaggacacctctcctgctagcccccttggaaagcggaagcagaacccctgcaagcgaggttgccgagctgatgttcattgttgtcctggtgacaagtgcttctatggggtttgcttgggtcctcagattccgcctaaagagtcanagcgtgagatctacgaacgggatgcaccggcggatgaagcgg

SEQ ID NO: 6431 - DNA, 680 bp, Aspergillus oryzae
  misc_feature (1)...(680): n = A,T,C or G
ccataaattacaatgacacaacacctgagcgatataactacctgccaccaaacaggcgctaagcaccctgtgtatgactcccctagtgaccgcgaaccggacaggcctatcaagaaacggcagatccgggggaggactatgttaaaaagtggtgactgccggcggaagaaaattaagggtgacaatagatctatctaccagtcatgtccatcgaatagacaaggctgttgtaagaaaacagttggcgtgtgccgccggcggactaccaggggcccttgtccatcaacggtgttaacggaaagtgaagggcaaangagtgatagaacaaccaaggaagaactatcaaaacgattggatcgacttgagcggcgcttgcacttcatgttcccggagctatttcctgacccggatagaacaangagactctgatggactcgggcgaacactctgagactgttcgctcagaaaatgatatctatccggtggcatgtaaagcgggtgctatcgagaacagatggctatctcantcagcgaacttctccgatgagattcctatccaacctacccttgctatatctaaaaattgtctacccgaggtgacagacacatgtagtgtgggcgacattgcgccttcatttcaggcgtcttcgtctccattaaagtccccgttatcttcgggg

SEQ ID NO: 6432 - DNA, 668 bp, Aspergillus oryzae
ccggcgcagccactcagtatgaggaataacgagctttcggagcattcgctgccggggagacatagacaaatattggccagccccgatgagagccacggtctccaccatcgccgctcagctaccacatcggttttgtcgagcctaaacatgcgcactccgaactcattatcactgtctctatcgattcgggcggagaattctgcatctgaatcccggtcaagagcggtatcgccacactcacagcctcgacaatcaataggagacattcattccattatgctgagctcctccaataccaacaactacgttgttagcccggctgatggctctggcggttacttcagtttacgacctagcagtggggttagtagtagaaccacaacgccggggagtacgacaccaattgaagaaaacaggtcttcgagagctatgggtagaaccatggtgcactaccctggtggtgtgagataccgtcggaggagcatatctggtccaaattcaagcgctcgaatcgtgaggtctttctatggcttgagccgggttatgatgggaagcgatttgttgtgatcatataccgagggtttctttagggagaatcatccgaagagagcataggagtctcttaaattccgcgaattttacaatgagaaaaaaaaataaaaaaaaat

SEQ ID NO: 6433 - DNA, 860 bp, Aspergillus oryzae
gccgtctcgatctgccgcgtttttggcccgatctgcctattggtttatctggtcttccctatcgtgcctgggtttccgcgatcgaacactcgaatgcgtactcggaaacattacaatcgatttgcacctgggaagtcctaggtagaaagaacaaaacgcaattactgtggctattttacgtcatccctcctcggttgtcatgtttgtgcaggatctctaagccatctttgaaaccgaccgggagggttagaccgaaggagatgcaaaacgaaattcttctgtctgtcggcagaacgaggggtatctttcagttgatgtttgccactgaagaccttcggacatatcattcgttgttttgtttcattttccctgcccttactctgcaattgtcttttgatctcctgttttgcacattccagcactccagactgttattatttgattattgacgcaacattggggacgatgagtatgaaggtatgacacgtgaagaggtgtgggggtggttattttctgatgtccaagagtcaaggttcaagacttaaacatgcagtacgagaactggatggcacgggtggtagtactgcacacgatgatttggacattaagaaagcacgtctctacgatcggtaactggcgacggaaaatggctagggtcgcttcccgggaggttttgcgtcatgcgagattgtttcctttgggggatttatggtttcttgtgctctcgctcctctcttgttatgagaagaagactggacaacattcgaaggtcaccgggcttgcaggggaccctggaacacctaaaccccaccgcgccgggttgcataaaggaggaaccgttggggtttctttcaatgccc

SEQ ID NO: 6434 - DNA, 683 bp, Aspergillus oryzae
  misc_feature (1)...(683): n = A,T,C or G
cttcttagtatttttctcgcattgtgcttacacatcgctggcctgtttttcttgtcccgtcgtgtgagacccctataccaaccggatccgatgtcattccttttctgattcgcctcaatgccgaccccgagtgacaacacaccaagcctgaatgccacatcgatcgctgaagaaatatccactcggacaacatgtccgcctgaaatagagaggctgtcttcctggcgagactcacctgaatctaccgtggcggagagcgatgctcccgataacgccctctcccccaccattgcatcggcgcagtccgtgctgactcggtcggatgatgctataactcgtaccaacccagatgcattaaaagccagtgctgtacctggtgcttctgcccagagtatggaaaaatccgacgaagatgctgctgcgggaagattgagtcctgctggggaatcgncaagctcctacaaccagtcgtcttctgttactacaccttccactagtgcgcttttgagctatgaattctcaaatatacgggcttttgccatattacacatagtactttctgcgacctgtgagtaaattcaccggcacgcaggantcacaaccgtcagatatactatgtctatgtggagatcaagcatgtcgatatggttgaaatagatctttgtgggaatcgtagaaatcca

SEQ ID NO: 6435 - DNA, 572 bp, Aspergillus oryzae
agaccggggcttgcgaggccgccttggggcatgttctgattggcgttgtgagcgttagcattctttccctgtccgtcgttggagcgggcacgacgatatttccgagcatcgtcaagcgcaatacggttgttcacagtcgagagagcagccagcttcatcgccgtcgcattggcgaccatatcagcctgcgagttttgttgctgctgctgctgctgctgcgcgaaagtagctgtcatcggtgtgttggtcatggaagcccagctggcattaccaacattgtatggcgacaaaagaggagcctcaatttcgggtgcaggaatcgtggcagtctgcgggaggggagaacggaggccagaagacgcctggctgaactgccccatgggctgatggccagaggacgacttgggtcgagcaattggaggctgactatcgggaccccgttgggcccacggagatacagggggctgacctaggttgtccgtgtatattgtctggagcggagatggtaggtgcaacgaacgaagtccgatcgccgaatacagcgccctcgtgccggattgtctacgcatata

SEQ ID NO: 6436 - DNA, 1653 bp, Aspergillus oryzae
cggcgtttgggccactactactgtcgttactacttcgggaacctaacctggataccaatctcgcacgaggcctcctccatctccttggatcccatattatccatttcgtagatggtttctccatctttgcgtctaccttagaccatctctcctcataaacgtcaggatgccgccttccagcgggcacctgctgctcccaaagttttggagagcagctaggtttgcctacgagaaggcctgcaaaaccataaggacaaagttcccagaacaagtccaacatggaagccttcgatttcagccagcctttgcacgtataaccccgaatcagccgatcaaccgcgctgcagcaattcgccaggcccgtcgccgtcactactccactcgtgcgagagccttcgtttcttatctccggactggactgcagggtgaccgcgctgcctataagacatcccgtgttgcgtcgaacatcagccgtcttaccactcaagcaccctttgcatcaactcttcgtccaaacttgaccggcgggactctcggccgtacggcgggaggctatactataggagccggccggattgggggtgcccggtatttctcacatggcccagctgcacccgctcaggtcattcaaaatgtgtccatgggtgtccgggcattcttcctgtctggacagaaggtccggtttgatggcatcgacgaagttagcggaaacaagaagtacaaagccgtgagcgcacttcaagatcaggccgagcggaagatgaccggaatccctcggactgcaccgggatcatttgttgacttccagctctcccctaccatcactgcctttggtctgcagaagaagtttgatccatccggagccttcgcttctgataccatcaactcagacggtcttttggacttcctctctgccgactttgcgcgtgctcttaaggacttggccgctgtactcaacgacctcaaacgcctgtcaaccctaggtgatcttcctatcttacttcacgacaagtcgacgctccgggtgagatttcctggttgtgacgcagtcactgtcgaacgactctgtgacgaggttggagttcaacgagggaagatcatgcaagacgaggacttcgatgctcgtacaggtgctgaccttgccctcctgttcccctttgctcccagtgttcccgcgtctccagagacagtggattacctcttctcgaaggggccctatgagccacaagctcccgaagaagttgattggcaggctatgatgtcttcagagaccaactcagaggcttcacctgagtttcgaggaaaccctgggtcgaagctcagtttcgaggacgtaaccctgttcggcgagaatccgtggcagcaatcctcatcgtcatctggatattcaagtatcaacatcagcgaactcggcgaccgcgcatacttcaatgagatctcgagcaccgggctccctgaaagtgcttcagaatatgaaggatcggacgggttgcaccgatttcttgccgaatgtaaccgtgctcctccaatttcttagctacttgcgcttccatgttgttccatacaggctttgacagtcttttcccataatttcttttggtcatgtttgttcgaagcagacaccataattgaggtgtgctcaactcttgtgct

SEQ ID NO: 6437 - DNA, 613 bp, Aspergillus oryzae
gttccaatggctcaattgctatgatcaactgatgcggctatgggtaaatgttcgtcttactgtacatgtccctctcacactccttgaaagcaatgccgatgatgcatcgtcaagactccccacaagacaaggtgtgctctcgattaacacattttccactacgcacgtcgtgaattagcaaggtcacgcttgtatctggtcaatctggagaatcaacaggtcacatacttgctcatgtctgagcattgtaaccccgtggctctgttggatcctgctggagatttccgttcgtacagttggtggaagatcacatacggttcggtagggcaatcacgaacataacaagccacaatagacatgattgcatcagctctgtgattctgcaacacatgtcggatcccatctcgcatgaattactgtcgtccaatgcatttagctatgaatgccatcagtcatgctagtaattctgcgtgttgatcatttgacatttgtcgactatattctcatatccaaagcgtcctctgttcaacttcagttcacgcatcggacttcgtccaatagtcggaccgtggacctggctagctcctgggaaatcaattgcctccagattcct

SEQ ID NO: 6438 - DNA, 651 bp, Aspergillus oryzae
tcgacaacaggagaaccgataatctctcaccagcgcccgacagccttgccattgcagcaatccgttagtcagtttgattcctggacatcatcataccgacagagcatgttcaaccctatggagtatagctctgcgcccgctcagaacattccccaacatatgccttaccatatgccggtcgctaccccttcgcacgcagcagagctggctcatactcctcacggcctgccgaaaggaaaccccttccgcacgggatccttaagtcaccctcatatgatacctcaccatgcataaacacttccggcacatcttctattcaggtatcaaagctgcgacctcagtctgagctcgaatgacacgcacgatttgtatgaactttcaatagacttctgctgcttcgcgatttcacacaacctccccttcagacaaatttgtcaccacttggtgacttttcgcttctttgattcatatttcaggctccatatatatgttatgcctcttatacattttttcccttgttgatttcaatctttgcaaatacacgttatgcattgaacagaaatgttttcgatggcgccttgggacggatgtatgctgcaaatatttttcttttttgcttttttctttttggttatttttactttttgggtg

SEQ ID NO: 6439 - DNA, 677 bp, Aspergillus oryzae
ctatcgtttaaaccaccatgatcgtgaaattgcttatgggcctggctatggccggcctcgtctcagcgagttccagcgtaacttccatgtttctcctgggctttgacccacaatccttacaagcttctattgttggtaacgacgccactgcgacgacctatagcattacctgtgctccgagtccgaccgcgagcgcgagcgatgacgatgatgactatgagtgtggcttggggcctggtttcactctcacagatgcgtcgccgactactatcatggagatgaatgacaagccaaacttttccatgaccatcaactgctccgtggccgggaccacctctgccgtctgcactggaattggcgatgggcctgaagccaacttccccggaactataatctcaactatccagcagagtgaaatgtcctacttgccagttactatcaccgctgggtctgttactagcgtggctgcgaccgcttcggctaccaccacgaccgagtcgggcagtaaggccactacctcagcggctcagactgcttcgaagtcttctgctttctctttcggctcgagctccagcttttcagctgtcagtacccggtggattgcccaaaattactggagatgcccgtatgctgttccgaagtgctggcatggcgttggccgcttgtgttctgtgaat

SEQ ID NO: 6440 - DNA, 1003 bp, Aspergillus oryzae
ccgggttcaagtcgacaaagcagtcaagatgcctcgcggacctaccaagcaccagaagcgccttagtgcgccttcgcactggctcctggacaaaatgtccggaacctatgctcccaaggcctcccccggtcctcacaagctccgcgactgccttcccctcatcgttttcatccgtaaccgtctcaagtacgccctgaacggtcgtgaggttaaggccatcatgatgcagcgtctcatccaggtcgacggcaaggtccgcactgaccctaccttccccgctggtttcatggacgtcatcggcatcgagaagaccggcgagaacttccgtctcatctacgacaccaagggccgtttcaccgtccaccgtatccaggctgaggaggccgaatacaagctgtgcaaggtcaagcgtgttcagctcggcaagggcgggatcccattcttggttacgcacgatgcgagaaccatccgctaccccgaccctgccatcaaggtcaacgacaccgtgaaggttgacgttgccactggcaagatcactgacttcgcccgcttcgacactggtgttgtcatcatggttaccggtggtcgtaacatgggtcgtgttggtgttgtcactcaccgtgagcgccacgacggaggtttcaacattgtccacgtcaaggacgctgttgacaacaccttcgccacccgtgagtccaacgttttcgtcattggccaggacaagccctggatctccctccccaagggcaagggtgtcaagctctccatcgctgaggagcgtgaccgccgtcgtgctgccgccattgccaactaaatgtatcctggtaggtgacattagatgctgcggcaaaatcaaaagacttgaaaaaatccgccagagacgacctcttgtcttgctttgtggacctgtatgatgccggttatgattctatgatgcgtttctacgactaacctaagctgtctacacgacgagatagtaataaccgtgtaaaccaaatttcct

SEQ ID NO: 6441 - DNA, 1243 bp, Aspergillus oryzae
ctgattctatatagctaagccttcagtcttcctctgtgttgcgcgcttgaaccggtgaggaagtcctagacgataatgtctcataccgaggccgctcgtacggattccttgggtgaacaggaaactcggggtgatgtcgagagcgataaaaaggccaaaaacaggcgacctgcaaatactgcttttcggcaacagcgcttgaaagcctggcagcctatcttgacgccgaggagtgtactgcctttgtttttcgtcgttggtgtcatttttgcacccattgggggccttcttttatgggcaagctctgaggtacaagaaattgtgatagactactctgaatgtgctgataaagcacaacggacccctgtcccaatcccagacaaagtccaatcgtctttcaaatcttccaatcagcagcctaatccgacctggatgaaatatagagatgaacagacgaacgagaccatttgtcgcttgagtttcaagatcccggagagcatcgaacctcctgtgtttatgtactatcgtctgacaaatttctaccaaaaccatcggcgatacgtgaaatcgctagacatagaccaacttaaaggaaagccagtcgacaataaaaccattgatggcggttcatgtgaccccctaaagcttgatgacagcggcaaagcatactatccatgtggacttatcgccaactccatgttcaacgatacaatcaaaagccccgagctcttgaacgacggaaacgacgatgatcctgtagtatacgtcatgactaacaagggcatcgcatgggatagcgacaagcaactcattaagaccacacagtacaaaccaggacaggttgtccctcccccgaactggcaggcccgctatccgcataattataccactgagattcctgaccttcacgataatgaggaatttatggtttggatgagaacagctgcattgcctaacttcagcaaactgtcccggaggaatgataccacggcaatgtcaccaggcacttaccaattggacatcgctgaccactttcccgttacagagtacgggggaacaaagtcaatactcatatcttctcggaccgttatcggtgggcagaacccttttatgggtattgcgtatgtggttgttggcggtctatgcgtccttcttggtgcgcttttcaccatcgttcacttatggcggccaaggaaccttgaaaacccccatcctggccctgaaatcccgaccagaaatttcc

SEQ ID NO: 6442 - DNA, 716 bp, Aspergillus oryzae
cgcatcggctcgtccgattcgcgcaggcgctacaagaagatgactgagaacttgcaaatcggtcgcaagcgtctgagccgtgctattacgtacgccgagaagatcctctactctcaccttgacaaccctcatgagcaggatatcgagcgtggtgtttcctacctgaagctccgccccgaccgtgttgcttgccaggatgccaccgtccaaatggccatccttcagttcatgtcggctggcatgcctgccgtcgctaccgctaccaccgtgcactgtgaccacttgattgacgctcacgttggaggtgaaaaggatttggctcgtgccaatgagatcaacaaggaggtctacgactttcttgcctccgctactgccaagtacaacattggtttctggaagcctggctccggtatcatccaccagatcgttctggagaattacgctttccccggtggtctgatgatcggtaccgactctcacactcctaacggcggtggtctcggtatggctgccattggtgtcggtggtgctgatgccgtcgatgtgatggctggtctcccctgggaacttaaggctcctaaggtcattggtgtcaagctcactggtgagctgtccggatggaccactcctaaggatatcatccttaaggtcgctggcctcctcactgtcaagggtggtactggtgctatcggtgagtaccacgggacctggtgtca

SEQ ID NO: 6443 - DNA, 663 bp, Aspergillus oryzae
gatccttctcccgccctgcgctcggtgtactcattacccgtatcgcagaggctggaagctacacagtcgaggagaaacttttggagatcgaatttaacggcaagaagtccgagtttggtatgatgcagacctggcccgtccgtgtaccccgaccagtcaacgataaggttccatccgacgcacccttcatcgtcggccagagagtgctggactctctgttccctagtgtgcagggtggtactgtttgtattcccggtgctttcggatgcggtaagactgtcatttctcagtctgtatccaagttctccaacagtgatatcatcgtctacgttggttgtggtgagcgtggtaacgagatggctgaagtgttgatggacttccccgagctttcgatcgaaatcgatggtcgcaaagagcctatcatgaagcgtacatgtcttatcgccaatacatccaacatgcctgtcgccgcgcgtgaagcctccatttacaccggtatcaccatcgccgagtacttccgtgaccagggtaagaacgtggctatgatggccgattccagttctcgttgggccgaagcgcttcgtgaacttttcggtcgtctgggagagatgccttgaaaacaggggttccccgcctacctggttgccaagctcgctttctttt

SEQ ID NO: 6444 - DNA, 1276 bp, Aspergillus oryzae
ggctgaataactcaactctttcttgtttcccttcttcccccctttaatcccaccaatcttctttattaccggccgccgatatgtcttctcttccgccggtctatattgtttcctctgcccgcaccccagtcggctctttcttggggtcgctctcaagtctcactgccccgcagttaggctctcatgctattaaagctgcgctcagcaaagcggatggaatcaagccgtctgatatccaggaggtcttctttggcaatgtcatctccgcaaacgttggacaaaatcctgctagacagtgtgctctcggcgctggtctcaatgaatcaactgtctgtactacggttaataaggtgtgcgcgtctggcttgaaagcggttattctcggtgcacagaccatcatgactggcaatgcggatattgtcgtagcaggcggtgctgaatccatgtctaacgcccctcattaccttccaaaccttcgcgtcggtgcgaaatacggcaaccagagtctggtggacggtattatgaaggatggcttgacagacgcaggaaagcaggaactcatgggcttgcaagccgaggagtgtgctcaggatcatggctttagcagggaacaacaggatgattatgccattcgcacttacgaaaaagcacaggcggctcaaaaggctggcctttttgacgaagaaattgcgcctattgaacttcctggctttaggggcaagccaggtgtgactgtgtcacaagacgaagaaccaaagaatcttaacccggataagcttcgagctatcaagcctgcatttatccccggatccggcacggtcacagccccgaattcctcacctcttaacgacggtgctgctgctgttatcctcgtctcagaagctaaactgaaagagcttaacctaaagcctgttgcaaagattcttggctggggagatgccgcccagcagccaagcaaattcacaactgccccagctctagcaacttgactacattgctcggtgtattgaaagcgagaaagggtaagattggttgtgccgggatttgtaatggaggaggtggtgctagcgctattgttgtcgaatctctcgtctgagtcatgccgagtcgcccttgatcttggtatggaatataggaatactcagaccagtagcatctgaaggaaaacctggagtacatagacatcctttgattgccacggtctgctgtgtggggcgaagcatcatcaatgtaaataaaatgcttgaagttctgttcaaaagcaatgaacttgttt

SEQ ID NO: 6445 - DNA, 1105 bp, Aspergillus oryzae
ctcgtaccctctacgctcgcaaccttcaattgcccaatggagatctattagctacctgggaaaactactcgcccgagccaccagcggtctatttcccaatctatcgctcaaccgatagcggtaagacttggagcgaactgtctcgcgtagaagatacagccaatggactgggcctgcgctaccagccgttcctctactacctggaagagtcaattggttcatacgaggccggtaccatcctgctagctgggagcagcatcccaacagacctcgcgaccacacagatcgatctttatgcttctcgcgactctggcgtcacatgggagttcgtgagccatatcgctgctggcggtgaagcacttcctaacaacggattgaccccagtctggggaacattccttcttgctcacaatggaaagttgatctgcttctactcggaccagagacaaaacgaaacctatggccagaaactcgttcaccaaaccactaccgacctgaagaattggggtgatgtaattgacgatgtcacgtatcctacctacactgatcgcccgggcatgcccgttgtcaccaagctgccaaccggtgaattcatcatgacatatgaatatgggtcattcttcggcacctccgactattccttccctgtttattaccggatctcagcggaccccgagaacttcctcgcggccccacaccagaagctcgtcgtttcaagtggcactcagcccacaggttccccttacaatgtgtggactcccttcggcggtgacaatggcacccttgttgtcagctgcggcaacttgggctctgtctttgtcaaccaggccctgggtgagggcgagtggacggagatctccaccccagaaagcgcaagctatactcggtcgctgcgcatcctgcaagagaaggagaactatctcttgctgaacggtggtggtgtgcttcagggagagtcaaacaaggttactgttagtgtgatggatctggaagctgcgttggcatagatgtccgctttctggagatatggttgtgctgccttctttgtgacgatttagcatgtagatggtcatcgaattctaaatttatgttgctcttccaaaaa

SEQ ID NO: 6446 - DNA, 306 bp, Aspergillus oryzae
aaagggaaaaacccccaaattaaagccaccttttttcccttgggaaatttttccaaattttttccaagcccccccttttaaagttcccaaaaaaaaattaaaaaaaatttttttttgtgggcccaaacccctttgcaaaaaaaaaaaacccccaaccaagggggaaatttgggtccccaaggggccccacccccggggaaatttaaaaattcccctggcccccttaaaaaccggggggtttaattcccccccctttttcccccgggggggaaataaaattttccgttgccaaaaattttggttcgg

SEQ ID NO: 6447 - DNA, 493 bp, Aspergillus oryzae
agttatctcgaaacataagatcgagtcgtcgtcaaatgtacttcttgcaccagctttatcaccagtttcaacctcgtattttgaatgcctaatcccggaatatatgcatttctttggtccgtaccaacccccttggacaagagggccggggtccagaatgaaggtgctattttacgtaagggacggagagacattacgtgctgccctctggtcgcaacacgcattgatatgacgcgccccgtcgtgactacacagtatcttgtgctgatgacattagtcgacagtgtcttcacgagttgatcaggatgagtcgatgtgatcgtgtcgatgatgctgcgcttatgagaagttcaccacgaatgatgacatgactcacgacgacttctttactttcacgatgatcgacagtgctaccgtcgttacgatcattattacctcataggttgtgaccgtaatccccgaccgattatcatcgtcgaacttcgacgactcc

SEQ ID NO: 6448 - DNA, 673 bp, Aspergillus oryzae
  misc_feature (1)...(673): n = A,T,C or G
ccgcgaccatggccaacatcccattcccaaccgtgccctatccgccaatggagccaccggctcaccgtgagaagaagatgaaggtgcttgcgctgggcatgtcacgcaccgggaccatgtcattatacgttgcactgaagaagctaggatacaacagctatcatatggcagaatgttccctagaccaacacaatgggtcgctaggcctctggacgaaagccatcaacgcaaaattccatggcaacggtcggaagttttcgggcgcagattttgaccgaatgctttggcgctatgatgctgtgaccgatattccctgcattctgttcgccgaagaactcatggatgcatatcccgacgcgcaaatcgttttgactacgcggccggttgattcctggttgccgtctatgcagcagacgttttatgcaatcttaagttggaagcgctgggctttgcttgagttcattgatagatcctacataggcctatacatccctctcctccggtcctctctatctgtatggaccggcggaaactggcaggatacaagccgtctccctaccggctntgaagcccactatgaccaagtccatgctgccgcgcgggcacgtggacgtaaagtgcttgagttcaaggtccangatggctgggatcctctctgccagtttctaggaaa

SEQ ID NO: 6449 - DNA, 683 bp, Aspergillus oryzae
  misc_feature (1)...(683): n = A,T,C or G
cgacaattcgctttccctctctactagatcacctcagatttcatgagaacttagcgctttgttacttctatcattgcatagagtctttgaacaccccatattcatatctacaatcaccatgtccttcagcagagttacggttcgctctccagtgacatcatccgccacgatgttgcgctgtgtgagaagcccctacaagacccccgcccatcgtctgttctcctcatatggaaatgcacaccggtcttccaagcgcgacatgcagaccgctactgcgtatcgcccgcattccttgccgaccgcttttccacctccccggagcggcggaagttacgacacctctatcttagcagaatttcctccgcttcgaaagacagcgacacagcaaccaagaatctttcccaatggtagtcttagaaaaaaagatgcgccaaagttcaagcccgtcgaattcacttcttcaagcccgaaacccgcggaaaagctaagaaggagcttcctgcaccgaaagccgcttttaaaattacaccccgagcttttgttaaaatccgaaactatgtggttaacgggccccaaattgatccagtggggcaaaaaaaccggggtgtgtcgggtttccctaccccctaaaacatggagaaaccgggcccttttataaatgggggaaaagaagggttaagggn

SEQ ID NO: 6450 - DNA, 653 bp, Aspergillus oryzae
  misc_feature (1)...(653): n = A,T,C or G
gtttggcggagctacttcggcatctttaaccattgccctgtacccgtcttcccagttaactgctccgcggacgcctttcacataagcatcggcaaggatattgtcggcattggaaccaccctgtgttctcccgttgtagttcgacgagcgagcgtccgggagataaccttcaaaccgccagatgtcgattaaagaacggatctgttcttcatatgctgcgggctgcaggacttgcatgagagcagtagagcaacggaaaagatcctgaacaatttgttagtctgcagaggattattgtcgttgtgggcaaggtttcctgaatcacacttacccagtaagtgaaaatgtcttgataatatggctcagaagatgcccagccagggttctccccggtctggttggttgggatcagatgcatgaagtagagggatgtgtacaacaaggtgagacttgtttcattcgtgctcgtcgtagtcaccttagacaagaccttagagctccattcagtctgggcgtcgtgaacaacagatgtgagttctgttccttctgggatttcctcatcgacattttggcatgctttctccgtggacaaccacgagatgccgacgcgcgacgtgactacagtttgttggaaagtgaacaaacctncgatt

SEQ ID NO: 6451 - DNA, 679 bp, Aspergillus oryzae
  misc_feature (1)...(679): n = A,T,C or G
tatctacatcccgtatagattttaaccaccggtctatcccactcaaccgcccccaacgcaacgactatccaccatcatacatccacaatggactcaagagtacaaatcccagacaacagcaacaaccacgccaataacaacatgagcacaacgcaacaagcgctcctcaccacctcacctcagcctcacaacccgctcagcctcgcatccaagcaaccaatcccaacttccggagccagcatacacgagcgatcagcatcgcaccacccccacacgcagcccaccgaatactcccaacagcggctgtcccaattgccagaagccagcggtcaacagccgaatgccctggaaagctatccgcaccaagtgtccgggtctgggggcccgaccgctacggctccattcctgcgggacttcagcctcgtagcggaggcggccaaacgcgcccagatgtcagttgtgatgcgtgatttggaggcggtaacgttatagatccgatgcagtgcgctactgcaggaggtgtggggtttatacngggtcttgtgtgacgtgggcagttcaaatagccgaagtgcgtctatggnggattcgtggtcggttttgttaggcgatggtgatgtgatggtatanagggcancgtctcgtctcggctcggctatggtatctctctaggatgaac

SEQ ID NO: 6452 - DNA, 635 bp, Aspergillus oryzae
  misc_feature (1)...(635): n = A,T,C or G
gccatcggtctctgcaccttcaacacccctcgcacgaggcccgtgccgatgtcccctagtgtaccccccgtccctccattgccaagtcgcttccttgaccaggccggtgcgagtggtaacgagagccagagcctggatcagtcggcaaccaaggaggcagatgctcttttcccgaactctactccaaaccttttcctctcgctctcgtataacccttccctgtcgtacaaggtgtcagacgagcgagaagtgaagatgggcgatgcggatcgcaccacacggcagagtcgcaatgcaaacgttgattttgggcaccggcccactgcggctgatgaagacgacgatggcgtttttggtcggatggaggagtaaacaacccggccttcttataccttcttggatcatctttttgtgtgattctcacgaacttctncttggccatggaaatcacccgattggactgctgcgctgcaacagtaattttttatgacatgtacgaactcgcgcggattttggggaacattgcttttttgtgggtacctgggctggttgaacaacccctttttgcgggattacaggttcctaaggaatggattacccgccgggccttctggtgacctgggcccccgggattc

SEQ ID NO: 6453 - DNA, 629 bp, Aspergillus oryzae
ctataccttgctcagctgcgtcttcagtctgcgcccggtacgcctggatggtctctctctcaaaagacgcctataatatctacaactgttccacaagatccctattcaatggctgagaacggtgaagcctgctccacccagtttgccacgccccgttctccaacaaagccccagccgaccttccaattgcaagcacctcccatccgtgtacaacaagcgactcctaagacagaccagatggagtttctcggccctatttccgctcctacggcttctggtccggcatcaaatgttaatcaacacatggctgctgcgcctggcgaacggacctacgatgctgtgccgatccccaacgcgtattcgagtccaatgtcgcccacgttccctcgtgcctcccgttaatgattttgacgtttaaatagcactaatcaatgattagaatgtgtatatgcgcctgcacacaaaggcatggaatgcaaagattgacgcaatgtactttttctcgatgactatcttattgcccgttcccttgttttcaaatggctgcttggtattcgattttctcgaaagtttcaatcgctctcatataataactcatgagattgtgtgtgtgcctgccgtgtgttctc

SEQ ID NO: 6454 - DNA, 581 bp, Aspergillus oryzae
cgaggggtacttagcgacaatgcagagggcaggaatgtcacgttgagctcaggtgaaactctcgcgtgcgattacttggtgaaatgtgttggccaaagtcccaactcgaagttaatacaggcgctgtcacccgaatcgatctctgagacaggccatgttaaagttcgccccacccttcagttatcggacacatcgttcaagaatatttatgctgccggggatatcgtagatatggacaatatcaagaatgggagagcagcagtggaacaggctcaggctgtcgcacagaatatcgtgcgatccatcaagtcgcagaatcagctcgagtaccgtccgcagtggtgggagggaatgacgaagctacacgtaggactaggtaaagccttggtttggatgggcgatggctcggccgaaataatcatgtccatgaagtgccgagcggaggagttggacagcgcgaaggtgtggaagttcttcggagtgaagccatacatggatgagggcaattggttatatgatcatgtatgtagtgggtgtgcataatagtagtgaaatggaagccaagtcatgtgattgtaaat

SEQ ID NO: 6455 - DNA, 639 bp, Aspergillus oryzae
gcgtctttggatgttgcgcacccgatccgcttttctcacatgcttgacattgccttggctaccggacttcaaatggatccctacactactcgcgtcgtcgaccaggcggtcgggaagctattcaacagccgtcctgacatggtgaggaggtggcacgaccaccttgggctcacctccagcccttcttcgttcttgtccgatcgccacactccggtctctgagatgtcgacgatgacctccgcgcccagcgaagactcgttcgatccgtacgcatatgccaccgatttcaaaggatccgcgatgattgccgaacagttggaaagcaccagcggtcgccccgattcccacctcaacgatgctttgactcggcttcggaacatgcgccgctctggccgtcatcctcgctacatcacgtatgccaaactgatcaccgctgccgccaagtgtcatcgcaacgatttggtccatgaaattctgagcatggctcgccgcgatgtccctctcctgcaccagtatcacgctgtcaagtacggttgggtgtcaattcttgacgccatggtagcctcctgccttacccttaatgatcgcagtctcgcttccaagtatcaccaggagctttccgaactcggctccgctccg

SEQ ID NO: 6456 - DNA, 785 bp, Aspergillus oryzae
gccgggatcggactactagccccggatcggactactagccccgggtcgggctactagccccgggtcggactactagccccggatcggactactagccccgggtcggcctactagccccgggtacgactaatagcccccgatcggactactattaccggatcggtttactcattgcgggatacgattactggcccagtcagcgtgaccaaccacctcaggaatggactgcgccggaagggccgtcaaatgcccatttgcgcatgttcgttgctgtagtcagccgcgcgcattcttatgtttgtcgcagccgcttaaggaatgtgttatcagccgtattcctcatggcaggtggtcttctcgtgacttcgttcgatgaaggcagacaatcgacatacatctgccctatcatctctggactacatccacggttccgggcctatatgtctctcggcgttacattagataccttgattctaatcggtgctgctgagctttgtcgggagggtaacagatcccgggatggtaggaaaaagcaagcgttggtttcatggggctacagctttcttggggtagctgtgatctgtacaatcgcggcgttcatcctcagaaaagtggcgcctggtgaaggctggttttgtcaactctcattatttacgaagcgcagcatggcaagggaaattagttgcttttaaagtactgtgcgcattccaactaatggcctttttagggggcggttgggatctctataattggaagctccggtatccattaatttcaggctgttg

SEQ ID NO: 6457 - DNA, 752 bp, Aspergillus oryzae
caattacgtctcttctcgattataattattgacgtttcaatatctgatcgttccgaccataaatatacttaataaatcgtgacttctgagagaggttgcatccctttaaccatggtccatatcatgcttacgggagatcatttccccataaaatgaaattatggtagagtgacacatcatatttaccgatattatgtagagcctctagagacaatatccacgggtgaggtcaggactggtagtgccatgagactgactatttgatttgatgggacttaaacctgaaaatgttaaggatatgctacgagaacctgtcaagcccatatatccctatggtaacgggtttttagaaccccttcaaacccccacgtgaacataacctcacactacgctgttaacacatgattacggtgacataatgatgtaaccaaaatattcgcaattatcattatttagttaaacgatactgaagatgatgatgccaaaatatatactgaatattacgtgatctataatgatgctgaatgtaatgttcatgttgtagaatatgatcgttctagtattagatcgatgatgaaatattacttcaatgatcaaaattatgatcatgtacgtatggtcgatgattaacgtattagttctgtcaacgatacttgatgatgatggatggtcagtcattaatgattgtgaatgtcaaatttcaaacggccttctttttacataattatgatgtgatagatataataaacgcg

SEQ ID NO: 6458 - DNA, 589 bp, Aspergillus oryzae
  misc_feature (1)...(589): n = A,T,C or G
cgagggctacccgctcattcctgcactcgacgaagaatttgaagatattgccgatgacgaagacgaggatgaaaataaggacgttcgcatttcgccccgtcaagtcgacatgctcattgaacacgagggcgagcttagcgatgacgaggaaatgagccagatcagtaatctcctgaacgcgatcaagaagcgaaatcagattaaccatggagaagtgctttcgactgtctctacgacggaggccgaagccgcagcatcgaaaacatcggatgatccaggagccgatgggtccgtcaacagccaagacaccccgatgaccgacgctgaggtaattttcgacgatgctcaggccgtgagcccgtagttatttcttgtctgctttcttttgtgttttctttctttgctggtccacctattctggaagtgatctttgatatcctgttgctagccatgtcgttgtttgcctggtgattctttgtgccttctcccactgggtttgttttatcttcgttaatttatccattttcgttcagcttgatgtggggatntaacaattctgatgtcacattacacatagcgcaaacccctt

SEQ ID NO: 6459 - DNA, 636 bp, Aspergillus oryzae
tgtcttcgcctctgacccagtgcttcctattacaccccgtgccgccacttactttgctcccctaaaggaaaatgaaacaatgccggcccgggaccccaagcccgaacaatcagtgacgaagcctaaggaagcctttgagaaacgatcacgagcttccaggcgagcggagacagtatgggatgttgatgattctccccactatcatttttcacggaaggagcgcgcgcggctgttcggtcttcctcgtattctcgagcagaaggccaaggaagcccatcattccgaggagagtactgatgcgcagcttgtcgctgatcaaaactgttcagaagccacatcacttcccacggaacaacatgttgaagcttctagagacgagccatcagaggatctcatcgaaaatagcaccgctagaggtgactcggtccctgatggcgatgtcgcaattgcactaaatcaggttcttgcagcctggagtggaacaaagcgtgcattttaccctgcaacctgttttggaagaccattggggacttcacagtcccgttatttggtcaaattcgaagacagtgctcccgttgaagttcccattggagctgtgaaacggctcgagctacgggttggagacgctgtgaaggt

SEQ ID NO: 6460 - DNA, 666 bp, Aspergillus oryzae
  misc_feature (1)...(666): n = A,T,C or G
gaaggtcggttcgtggacttggataaggatcgcttaacgtctttgttcactccgtttggcaaggttgaaagtgttgttgtgctcaaggataagcggcaacgtattggagataagcgtgagaaaaagactgtcgcaacgggcgttgtggtctttacttccatcgtgggtgcgcatgctgccgttctcgacagtgagaagaagatacgccaaagcgctgggccagcaggtagcgactggggcttaatcgactctgtattctgggcatctggcaatcaacctgatctaggggcagggtctgacaaccgtcctctttctcctgcggagaaaagtgagccaacgatgccagctgcgcctcccaagccttcattcggtttccctggggtcaagacgacgggctcagatggaaaaaagcccggtaaagcgccatctttcggttcattcgcgtctgctgcagccgcagctggttcagctaagtcgacctctagttcgtcgactaacggtccaagtgcccctagcatggaagaaataacattaatgcgactaaagactgcgcancgggagaaagagcgcaaagctcttgaaagcaagcttcgaaagagatgangctgcannatgccgcgagccgcngccgctgaaaccatgctaattagcatgttgtttgttttt

SEQ ID NO: 6461 - DNA, 657 bp, Aspergillus oryzae
ggcaactgggcacgggctgcagtgaaacatactcatatatgctgactacccgtattgataatctgcacccctccgttgtacggagtaggcctgacattattgcttatcttgctatttgaaactgcgttgggaaagaagcgaacagaacagagaaggggaggggagaagatgaaagcggaaccacacgaggaattggattttgaatccctgcccccagctttgcaacgaaagttcttctccaatgtcgaacgccttcgtctagctcatggtgatcgctgggatggttttccctatcaacgccgcttggctaaagtgcctcgccgcctccccttttgtacccttcagggtcgctcttatccaacatccgcaataaaacccctcaacaagaacaagaagtgccacccgcataagtcttcctttccaaacacgactaagaagctccgcaaagtcaactcgctacagttggtccatctttgccgccaagtggactcgcgatgctttcaatcatttgccgcctaaattcaccagaaaactttcttgaaagaggaacaagatttgttttacacgagcgcacagttgaagctcggttctttcatgcctgccgtgaaacgccctaaccggttgtaaaaagcaagacaattgttcccggcttctact

SEQ ID NO: 6462 - DNA, 673 bp, Aspergillus oryzae
  misc_feature (1)...(673): n = A,T,C or G
ggggaaaatccacaagagctctactatgcgacttctcacgtctgatctttcttgttttctgtttcatcttctttccgatcttcctcactctcttttctgttcttacatcatcgtctcgtgtgaccacccccagttcgttcgctggtcgagcgacgggacttcatgcgctcttttccttcaacataccctcgtcactgttcccaccgtctgctatcatcagcctgaccgatgataactcgacattcttcctggcccggcccgcagcgtttggcccgctccttcctgacaaggggctcagcggtcagctatggatcggcagcggatttggagatagaaccactgccggagcggaaggcgaattanggtgttcagatattccanggtggggtgagggcgacggccacaggcaggatatacccgcggcgtcggatgccctgctcgggaagcctgtgcctggtggagctgacccggcgacttccaatatccatcgtacggatcctaagccagacatcgactcacaagccagcccaaatgacggtgtggtgaacccgtccacgaacgatggcacggatgaacacctgcaccacccactcccccgaatttaaagtacggaagtcggtgtctcggagcagcgcgggggttgccccccgaacaagcaaactggccatgcccc

SEQ ID NO: 6463 - DNA, 656 bp, Aspergillus oryzae
ccgtcttatacagtgtctcgtcgatgtcttccgtgggactggactgcgaggccgattgcaagaacaccttcgcgcccacggaatcgatcacgtgcagtgatttcgttgagccgctgctgatgcctttcccacaacctatcccagtctctgcctactaagcagcggacccctcaaaatttatttaacgcaggtttatgatttaacggcaatacctttcgaattcccagggatatacctgatcattccttcgactatttctaggttacatcgccttgcatttctgaagcgacaagtgtattatttcacggcgcagaaagccttggagagcaggttttttggacatatgccttaatttctttctttgcaccctttcctggatttgtggataatacccggatggttacccgctggacactggccggtgagccggagttgccttcttggacaggttttcgccaactcgctccgcgaagtttttggatgtcggaaacgtgaattctgttttattttaaatacgtttttttttcccttggtatttgatacatcgctctctttttgggggggaattgtggggctttatgatacacttgctgtcatgaagggtgattgttggcgttaattccccttgatccttgtgggtttcttaacctgggaac

SEQ ID NO: 6464 - DNA, 743 bp, Aspergillus oryzae
  misc_feature (1)...(743): n = A,T,C or G
gcgancatgacggctctgtacatctggacaaggctgaaaaatccatattcgggtagctatgggtaccggtaccgatgtagctaagctggctgctgatatggtgctggcagatgacaactttgcaaccatcactgttgccgttgaggaacgatgatctattcacagcaacactcagcagttcatccggtatcttatctcttctaacattggagaagtggtgtcgatcttcttgacggcggctttgggtatgcctgaagcgttggtacccgtgcagtagctgcgggtgaactagctcaccgaccgtatgcctgcgactgctatatcattcaacccacctgatcatgatgagatgagacgccccccacgtaaacgtgatgagccccttgtcggtggctggctactgttcacatacatggttatcggcacatacgtcggtgctgccaccgtctttggctacgtttggtggttcctctacaacccagaagggccccagatttcgttctggcaactgtcccatttccacaagtgctccgcacagttccccgaaattggttgtgagatgtttacgaacgacatgtcgcgagctgcttctacagtttcattggccatcttggtagtaatcgagatgctgaacgctatgaatgccctttcgtctagcgaatcccttgtcactttcgctctctggaacaacatgatgctgggctatggctataatctttcgatgacattgcactttgccattn

SEQ ID NO: 6465 - DNA, 683 bp, Aspergillus oryzae
ttctctatctcagatttgaattccaaaagtcctcggacgaaactgaacaattcccaaaccaaccgacaattcattgcaacttgaaacatgtctcctccagctgccatctacgaacccactgtggccgctaccggcctcaagggtaaggtcgtggtttctgagaccgcccccgttgagggagcttctcagaccaagctgttggaccatttcggtggcaagtgggacgagttcaagttcgcccctatccgcgaaagccaggtctctcgtgccatgaccagacgttactttgaggacctggacaagtacgctgaaagtgacgttgtcattgttggtgctggttcctgcggtctgagcactgcgtacgtcttggccaaggctcgtccggacctgaagattgctatcgtcgaggccagcgtctctcctggtggcggtgcctggttgggtggccaactcttttctgctatggtcatgcgccgtcccgcggaagtcttcctgaacgagctgggtgttccttacgaagaggacgcaaaccccaactacgttgtcgtcaagcacgcctccctgtttacctcgacactcatgttcaaagttctcttcttccccaatgtcaagctcttcaatgctaccgctgttgaagacttgatcacccgtccgaccgagaacggcaacccccagattgcttg

SEQ ID NO: 6466 - DNA, 663 bp, Aspergillus oryzae
  misc_feature (1)...(663): n = A,T,C or G
gtattaaattgtgtggatggtctcatgtaatgtttttcgtttatatcatatataaagtcgtgcccaatgctcannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncn

SEQ ID NO: 6467 - DNA, 723 bp, Aspergillus oryzae
tcgagctctatacaccaggattattatccgaaaaccggataatattaccttagcctctaatttgaacactttacacctcctaaagaagtgacaaatgtcagaatactacgaagtcttccttatcaggaccacactcgccatgcaagatcctgacctccctggaccaaggtttcatactaccattttcgtgaaaacggggccgaacggtaacggtacaattcacgaagtcactggcgatatcacctcatcggaggggatgtactatactcgaactccaagtgaagccccagagctttccccggagtttcatacaagccagaagttgggcgtcacccaagcatgcaatcatcctggtgactggaaacgggttttagatggtgtaccaacgccgcctcagcagaaagcatgtaatgtgaagacaatgaagacggagccgtttaagacgaaagatccattgactttctatgagcctggtgagcctagacggcaattgatgaagtgtactgagtggacgatggagagggcaattcctgctctaaaggcgaatggacttatcatcgaggggtagggtgttttggacaatggaatctgcgatctattgtgctacaagcactgcttattgtgtctatcaataaatgatgatatattgacctacccgccgcttaaaaaataatcccatctttgactgtgcttgccaagctttgtggaaaggcaattcttgtt

SEQ ID NO: 6468 - DNA, 633 bp, Aspergillus oryzae
atcgtattgctaattttgcgctgcttcttgtctcttttcgtctgttttgcctctctttcacttcatacgctcccttgcgactcctttttctgaactcactcgcgagctgctattgtttcttacaatccattttccttcactttttctcctcatagtccatacagctcttcccttcccctgccgtgtcttttgaggccgaggaaaggtgagctacaatagacggagtgagcgagaggactgagtggtcctaacgctttccttgtgtatgcctctcttttgaaagcctcaacttttttcgctcaaccttcccctccttctccccaatccttttccctgtcttttgatgctcttcatcttcgcgttgggattgctttcttcgaaatagttctatatacgattgtttctattctacacgggttgaccctgtggtatttctgattctcggccggtccggttgctatcagctcgatcacttggagtttgcaccatctttaatcatttaatcgccttcaaaaattcgtctcgatcgcctatcgaaccgaagaactttcaattgggatttcctgcttgtgagccaccgacacctgaacaacaacgttgatggtggcacttgaacttaagtatagaaaagaa

SEQ ID NO: 6469 - DNA, 651 bp, Aspergillus oryzae
agctgatagattcttgtattgcattaccaacacctgtattaccataagatccttccatagcgccagataataaatcgtaaaaaaaccgccggcataaaccaccttaagggggtttccaatagaaaaccaaaccgaaaattaaaaggaccaacccccggtttttatgacaatcaattggcaccaagctgaacgccggaagaagaaagccataagccgtaaagtgaaaaccagatccgaactccgtgcaagtaaccgaaaggctaaatccaaacggaaccccaaaccaaagcccagatggtctaaaacccctgtgtggtaaaccagtgtgccaaagccgataccgcgaaagaatgggataccaagcgcccaaatgcatatacagcgtgtgtcaataggttgagaccattataaggtgctccacatttcaaccccaggggaactctgagcaaaatcagagcgctggggccaaatatgcaagagagcctttcgagagatcccgtcgatgtggtgcacatgctctggggggtcctctggcgcattctcagactttgcgtgcttgtgcgcgtaaatcgggctgggaaacgttgaagacactctctgtgcgaatatttctcaaagctgtagggggacccccacacggggcttttccct

SEQ ID NO: 6470 - DNA, 682 bp, Aspergillus oryzae
  misc_feature (1)...(682): n = A,T,C or G
gtatatctcgcataaccccgtcttaatggtgtcaaaaccccttctcacccagctcctgcttctcttctctatcttcgggagcgggtccctagccagacgaggcggaggaggcgataatgacagcaacaacgacagcgacagcagtgatggaagcggcagcagttcaggttcatccggatgcggaaccacaaacaacctcctaacaacaacatacattgtccccaacaacgcctggaactggacatcccaaggcagtagatccgccgacgccagcccaacaatatacgacggcagttatttccagggcgaaggatatatatcctacaacatcaccggcggatcacgatgtcgtgacgcaaacggngagcttcggatcctaggatacgcctgggttggaccacaaccgccctatcctaccgggcccttgaacccctttatcgttgggttcaaggcgtgggaatccgacaagccggttaatgagatccacacgtcttataatccgattaaatggacagaggatagtgtttgtcctatggagccggatctcgttcgcatcgctacgactagaggttggattgacttgacggctcatacgtctggtgcctcggatgtgatgatcatgaatgtttctatggattcagcgaagtcaaccgncgtgagtttcaatgctactactgcttct

SEQ ID NO: 6471 - DNA, 669 bp, Aspergillus oryzae
ttttttttttaaaataaaaagaattgcgtagacgcgcatcccattcattcatggtacatacagtaattcattgacaacatacatattatccatatcacataatgaaatcattttttcgtcccaaaccccgtcataatcatatcttcctgctggcgtagtcattacggtcataacagtgtgtcgtacaagaaagggagaaagaagaagaaagggaaagaagaaaggaaaagaaaagtaagaaaaaaatatggtgttcctaccccaaaacaccacaatcccataggccaaccataaaacagctataaaccgccgtgtttccggttctggagacacccatgatctctatatactttaaacagtgaccatgtttcataccccaggttcagtgccggatcgaagcacggatatcataaaagtactgtaagtaatgaacgcagggaagacgtgagaggatcgggttcggcacgacaatcgacgacagtctgtatcgatctagaattcctaagcctcaacttcctctgcgctgcgtcgggatgcagagtatgtatttgccccactggcccggcccagaggagctgttgttcgtcttttgcgctcaaggaatctccgttttccggctcgggtctcaaagtgtcggggaatttgcagtcgcttctggcccgcagccag

SEQ ID NO: 6472 - DNA, 1088 bp, Aspergillus oryzae
ttcaatacttttggattcctccattttttcttactgaatcgtcttacgtatattttctacgttttatattttcatactctataattcactttatctactctaatagtatcaaataccataacccttccggataacacagttttaaggacctttgccttcttcttttcgtgaacataacacccaccaaccacgctactattttcccaatggcagctcctcgctctacttctttgcgcgcccttcgcgtgctctctcaacagcatgctgctacaccctgcctccgccggggcctgcacatcaccggggtcaattctgcacagcctgtcaacgtttcggatcgtacgtctttgtacgcgactcgcagcttggcagacctccagagagagtgctcccagaggaaactgggagccagcggcagccagaatgagctcgttgagcgccttgccaaccatgactttcttcaatcccgtgctttcagcattgccatgagaagaatcaatggcagctctgcagcagataaatctgtttccacccgccaattcaacacatctcgcgcctcgaaggccgtcaatgactcatccactgtggattttgcatacctaccgtccatggacgagattgatgcccctactcgccccgccgatactcgcattccgatcctttccgatgtctacaccaactacaactcgagccagccctcgaaccctcccatgaagccccaggtacacactgtgtccgggggcggggccgatatcgcagtcagccccatggccgaagttgttgacaacacctcggtggatatcgacccattctcgctaaccgaggcggttggaaaatcccgcttcggcgaagaggttctggaagtcccagaacgggctccaagggaacccggtgttgtaaaggagctgtggaccggattcttggaagacattttaggtcccagcagcagagtaccagaagcacactgatttgactcgcgttggttgcttggtctactttagcgataattggtttccactggaagtgggctttgattttcctatactaatctatcatcatgatgctccatgatgctatccattcacaat

SEQ ID NO: 6473 - DNA, 681 bp, Aspergillus oryzae
  misc_feature (1)...(681): n = A,T,C or G
cccttatccgctgattgatgatcaactcatgtcgcaaacacacatttcctgcagtcatcgtcacacacgatgagcgcagcagcgtctttccccggacaatattaacatgacaccttccatcgaacactccggtttactgaaccattacctcccccattagtatttccagccgctacattcccagcacttcgcaatgccggtctacatgctatacggctttaagtggccgcgcgccggcttcactggtatccgagtgtatattgtcctgcacaacctggaagatgcgacagcagagtatctccaagccccagtcaccacccagctgctcttagagtcgttcgcaaagacagaatcgggtatcgtatcccgtctcccggacctccgatttattgagcagtatgaccccgacgataccagcgatgaggccgtcagcaagccatatgcctatgtcgcggctaaagtgatcacgatgccagagtcgggggcacttagtttggatgctgaggagctggttaaggaatcagggctagatgaaaatgccatggcggcgttgacagagatgcgagataaatatgccgctggtgagaagattgctggtatatngtgtataacggggatccggagagatggttcccccaattgatgaggacgacgatgaaagtatgatgtacgatgatgaaa

SEQ ID NO: 6474 - DNA, 824 bp, Aspergillus oryzae
  misc_feature (1)...(824): n = A,T,C or G
cggtggaacgctcctgtcccgcagttttcaggtctcttccatttgggtgttgcaaaggtgcttttttttctcgcaggcaatagtctttatcaagacagaatgcaactgtaatcataatgtcgaactcgagttcgaatcacttcacctgcccgtccggcggcacctggtacgtgtgcccggacgcgccgcacttcgtcggctgctgctcctcggacccatgcacaaacgtcgacgcaaacagcaccacgccatgccccaacctccatcccgcctcctttgacacctccatcttcgacgagatcctgcccaacttggtgcatcgctccgccaacgcgcactggtatacctgcaacaccacggacccaccctttctcggctgctgctcgagccctgcttnngtcaaagacgggtgtccggccgatgatttacttgccgctgcgnngagctcgtcccgtcgnggtcaattcgccctgtnccaggacgagggcacccgcgatgacgatattaaggtaagcgcnggaggtggtgggttatccggcggcgcgatcgccggatatcgggtttggngttgttgcgccgcttgngattggcggccccctcgggggggccctcattggggagagggaccaggaaggcttgttgcatnaaggccaccccggccacacgccgtttggtgccgaggcccggtttccaaagcgccgttaaatctccgggtatcggcggcccaagggttcaaatttcccacccggtgtgcaacaaattgggacaagaaaggcccccataaccagtggaattttctaaagggtaaaaccgccctctccgcc

SEQ ID NO: 6475 - DNA, 649 bp, Aspergillus oryzae
  misc_feature (1)...(649): n = A,T,C or G
cggacctggatgaatttgatgatgtgctcgatgacttcaacaagccgaaaccggcccccgcccccgcccctgcccctagcgcttcatctcaacctgcgattgcgccagaagccaacgacttcgacgaagaaaccttcatgaaattgcttgagaaagacatggcgaacatgatgggccacgctgccaaggagtccgggacatcggacgacaagggcttcgaaacaccatcaaccagggcgcggacgccttcacgaagcaactggaggagagcgggattccgcccggtgacttcatcaagcagctcctggcggatgtgatggctgaagaagagggtggagatgccaccgctaaagccgcaggagctgcaccatctaccggcagtgctgggtcttcatctggtggagctggagctagggcgccgccgcctgagtcgtttaatgatgctatccagcagacgatgaaccgtatgaaggagtccggagacaaagctacggcggcagcgtcagaagatgatccgaacgatctcatggcgcagctgatgaaggccgttgcacttaatgtaaatggtgaggaggaggacnngaggtttatgaatctagtttcttcgttgaggggacagttgtcnaacaaggaaatgctgtatgagccn

SEQ ID NO: 6476 - DNA, 693 bp, Aspergillus oryzae
  misc_feature (1)...(693): n = A,T,C or G
gcggaactgaaggtttccgtggaggagctcacaagacgacttcgtccattccaccccccgccgccaccggttcccttcgatgaagcgaaagatgccggtgccgtggagtcggaaaacttctctccccgcgaaaccagttactccaccgttttgaccatccatgagtccacacatgcggacggtcgcaagacgtacgaagcccatacgggtcctttcgtccgctctccggatatggacgctcctggcgccggtgagaatgaagccatcatcgacgtaccgtcccagcccggaaccacctacattgagcgcctacgcaacaaccgtaccatgcaagcgatcagcaccaagagacggcgtaagctgaagatgaagaagcacaagtacaagaagcttttgcggaatacgaggaccttgcgtcgcaagcttgacaaggcttaatcgggatttccctattacaatctccttcctcctgcactgccaccttctgatcgccttccctcaagtctcatggcattttggagttgaacatcgccatattgtcggacttgaaaccggttggtgattccctgggtgtttttttcgtgtccgtcctcatggctcccacggcatattcatatccttgaatattgcacttttcctatgcattggccactctatagacagtatcatttacatagctatcttttatatcan

SEQ ID NO: 6477 - DNA, 667 bp, Aspergillus oryzae
  misc_feature (1)...(667): n = A,T,C or G
ggattcctttctgtgtttattatcttcgcgatatttcgttacatcttcatcctgtcacatcctttcacccctttgaccgcgtaaccatatcttcttaccccatacataaacatgactgcaatccaccgtgatggcgatgccaaagagggcacacctttcgttgcttttaatactccagttcctgttgccaccgccaagtaccaattcccttacccgaagctgcagccagaagagcacatagtgactgcgactcctactacctctactaaacctgctgctattgctctgactgcacccggcgcaactcctgctcaaggtgactaccagtgctgccctggacccaagtttcacccaagctgctattccagcggaccatacgttggcgttttccctactcccgcttactgccccaaggctgcaggatatcctggccactgtctttgccgccctgtagatgtgtctaaccctgttgtacctaagccttatcaccccgatgtgtttgaagtgaacaagccgatggctgtttctgccgcatctagctccggaaagctgatgtaccangtcccataccttgtgaggaaaaccgcaagttctggtttcatgcaccaaatggtgattgtatgcacctcactgtcaagcagatagctgagaagcaatgtgccggcct

SEQ ID NO: 6478 - DNA, 686 bp, Aspergillus oryzae
gggcttggattactgtttaatgttgcaacgggctggcctgtgccaaatagactaccaggtctggatctccttcgtttatctgcggctgcaacgcccgtgactgctaccgcaaactacaacggccaagaccttgtaactgggatcctatcaagcggcacatttgatacttcttcaaatgtcaacaatgcaatgctttcagttcgaatgctggccaacctctttgaaaccgatcctggccgacagctggttatgaatagggtcgatcagatcataccaactgtaaaatcggcactgaatagcaacggtgcaacaccaaaccgcaaccttactattgcagttgcaactctgtacattaatgtcgctgtttatctcacctctgaaggtagggggtctgccccaaagtcttctgaacgaggtcttgtgctcctcgccgaactggtgcaaatgatcctcggtgagagagacttcgaaacggtttatcggagccttgtcgccttatgcacatttgatcagggggcttagtgaaaaagtcaaaaatgctgctccagaagtctacgatattaacccatcattagggacgtgttgttcttcggtccccggaaggaacccagggtcaagggcgtccttgggaaaacaaggagttctttcataatggaaaaggtaaacgggtttttttcaacatatag

SEQ ID NO: 6479 - DNA, 622 bp, Aspergillus oryzae
cgaggggagaccgaagtttgtcaatgagactcagggcttgattgatggcatttcgcccgtcctcacacctgaattgctcacgcaagtcggcagtcttcttaataacgctggcaagctcctgacgagcgagttcattgatgaaacgaagagcctgatcggcaatgtggcacctgtcattacccccgacctgctggaggatgtcggcttccttctcggcaatgcaacgaacctgcttacacccaagttcgtcaacgagacgagagatctcattgacgatgtcgcgcctgttatcaccccagagctactcggcgaagttggtggccttctcggcaacgccaacgatttgttgaccaagaaattcgtcaacgaaacacagattctgatcgaagacgcttcggagttgctccctgtcgtggtgaagatcttgggcacgctgtgaaggatctgagccacagttcaagggcttatgtataacggacaacgaatttacttttaataatgcgaggaaattatcacgtgttcttatgtcgataagatccatgtttgtgatgcttttgggtgcccaagatataaccgccccaattacaatgatgtgtgatgtctaataagaaaccctccctag

SEQ ID NO: 6480 - DNA, 665 bp, Aspergillus oryzae
ggagccaagcaccttatcatcctccttgtcccgttgccgttaaccctgggtctacaactcccaacgaagaagaagatgcgagtcatgggtattctgggcgcaggaggtctcgctgttgcatcgagtatcatccgactgatattgatcgcatacacgggccaatcggaggatggcaccatggcgtttatgcggattaacatgttcggaaacgccgaaatcgccatcggcgtcatctgcgcctgtctccccgccctctctgcgatcctctcccgcgtctatcacgaatactccagcagcaacaaagccaccggcggaacctccggccacgagttaagcaagatgaagaaccaaagccgcagcatgaaaaccgacaaaagccgaagccgcatgagttatctcgagatgacctcagaccaggacgttctgatgcataatgctcaaagcgagccataggtcgaaacgaccgttcacggagatcgaaattactatggagagaaccctggtggatcgctcggcatctttaagacgggtgatgttgagacttccgtgtcgaagaaggcgtgaagctttgcattccttgtttggattatgaagataaaaggttgctactttgcgagagatttaatggccccctcttttggtctttatgatggctactataatga

SEQ ID NO: 6481 - DNA, 970 bp, Aspergillus oryzae
gcagcagctacagaataccgtcgcccatcagcgcatggccgtgtcgcgtacagtgctggacgacaacgagtatgctaaccgattcggtcgtctggacggcgccattaaggatttggcgtttgcgttccgaaaagactggaaaagccttcccaagtggctgatgggttacgtgaacgacgatgcacacatcactggcacgaaagagatgactgcgattggccgcgcagtaattagtcggtggcttgtggacgagttgtttgagcgcttctttcacccggcactggatcccaccttcagtcgacagttgaagagcattgagatgaacctgcgccggcagcaggccaatactctcaccgacgaggataaagaaaatgcgatcgcacgcatttccaattggcgacgcaccaccttggatggtctcacagatgcattacatggaccagctgccgaagaacaccggtgtcagctaattgaccatctggtggatagtctggttgccaacctcgtgtcatatttgggtgatcctccgccgcccgggctggacaatggcgcacgcatgattgtggagaatgctgtaggtattgcggacaaggttcccttggagtcgcgcgacgtttgtatcgagtacatccatcctggcactctcctacacgagccgaacatgaaagtcgaggcgggtcttccaccactcacgaacgtgagtgctgaatctgccgccgcccgaaggtccggcgatcaggaacaacttgaagggccgccagatgaggctgacagagagtcatccggctcaacgagccaggagggtgcgccgggaggaccgcatcccggccgtgaaccgcgcatgcggtccgtaatcagcaaggtgatgggacggagacccaaccaaggcgcggctccgaaccccggtggcaatggggacatgcgccctcccacggctatggaagagcggaacagcatgggagcggggcgg

SEQ ID NO: 6482 - DNA, 666 bp, Aspergillus oryzae
  misc_feature (1)...(666): n = A,T,C or G
ggacattttcccttccatcattcaagatggacaaacgatcagcagaaagtccgatggacttcgaatggcagacaagggcgccaggcgatgtgacttcacccttctatcagctcagcatgcagcatgacaaccagaagaaacgaccccatcgcgtcttcgaatcccccggaaagaaacagatgccggccttgcgcgaacccaattcacagcctttcctcttctcccagccgcgatcgcaggaccctcctggcaccccgaaatccctctttggccagtccgcattcatgacgccgcgcaagtttgatgtcgatttctcgtccggcgcagaaaatatgtcgtcccctgagaacgcggacaatgaggatacgccagagccgcccatgaagtcgggccatcgaaattcattattcaacatgtacggacgtttcgcaccgagccccggacggggcgagattcctcgtctgaaccattattccaatgcgttggctcgccgggtgcagaagagaaggcggagggacaaggcattagatatgcagtttcncagggagagtgatgatgagagtgatgaccagcatgtgtcaggcaacaagcagaaccagaaacaggggcacgttcanggggaaggctcacccgcatcgcgtatgaattctttctcggattttttcg

SEQ ID NO: 6483 - DNA, 791 bp, Aspergillus oryzae
cacagtagaccgaggatgttgagaccgatggacatagactgagggagggcaaaggggcccttcatgtgtgtcttatgaccagttatgaagccggctattcaagcaaagcatcactccttgagcttcactcctttacaataatttgcttcaaagcatctaaccagcccaacccaaccatcaaaatgaagttcttcgctgtcgctgctctcttcgccaccgccgccatggccgctcctggttccgctcctgtgcccggtgctgctgctgctgccggcaacggtaacgccccggttatcaaccagacccagcagaaggccttcacagacgcttgcagtgctaagggcaaccaccccgtctgctgcgaccagatcgacacctccaagaccacaactgtgaacgagggacttctcggtggcctcctcggtgagggcctgggtggcgttcttaacaaccttgttggtggcgagcctggcgcttgcagtggtcttgtttctgccctcaacaagcaatgccagaccagcatcggttgctgccagcagaacgccaagggcgacaactaccagagcggcctcctcaacctcaacctccaggctccttgccttctcagcaatggtctgtaatcgcctcgccatttggctacgaaatcccgcgcagcattggacataatgtcgctcttctggtcctcgccgctggaccaagatcgtcagcgttttcgcgatttgtgcacaaatgatttgagatatatggcttgtttcgcctattctgtacactctagcttgttatctttgtgc

SEQ ID NO: 6484 - DNA, 650 bp, Aspergillus oryzae
  misc_feature (1)...(650): n = A,T,C or G
gccgaccaaggccaagaccgagagggaagcgagcattcaaacatcctgagccggttccagagctcccagcagaggtggatatggcagatgccgctgacccacccacgattccccggttctctaaccattcgcggaagcgcagcaatacgactcctcggattcccatgatccgcagcttttccaatcagggtaccgtgccattaatgcctccaacgcaaggcgcgttggaagcatatgctcctccccctacgaacagtggccgtacctccgaggccagcgtgaggactggtaattacttcgatgccattggtaccgtccgcatggaggcgttcattgaccagaccgaatccaaccaaaaccatgctacatatccaaggcatgtgcggaaaccttcgagtccttggagctcggaaagccagcgaatttatgatcttgatcacccaaggtatgacgatcttggatcttttcgccatgatgatccttttggaggaatttaacgcattgtgattataatattgggggtgtggcattattctccagggaaatgcataccccctgacgaatcaccaagttcgacaatcagcaactgtatatcctaatatatgtcacctgtataagtgcccggttacgttcattattcgacccttgtn

SEQ ID NO: 6485 - DNA, 650 bp, Aspergillus oryzae
ggggtgtacatgcgacttccttcaaggctgggtagtctggctaacataattgggctatcgctgaattagcgccccacactgcgaacaagaaagatattggctatttcaagggactacagggttgaacaaccgggtgttataccacaatgctgtttataatcctggcagcatgcattgctgtgttgctctacctttaccatgttaatcgtgctataatggccgttcccgaggaagctcgtcgtctgtgccctcaccgctggacagtcgatgagatcaaggctgctttcgaaaaggttcaggactctcccaccgatgtagccaaaagccttcccccaaagcaatctagacgctatatcgttgttggtggatccggactcgttggaaactggattgtatcgcaccttatcatgcgtggcgaagacccatccgctattcggattttggatcttcaaactcccgaccttgaattctcgatcagggggtcaacttcataaaacgaacattaccgatgaacaaggcgttctgagcgcctttttacaaacattgggcctattaatcgctgaccctgcctttgccggatttcacaacgcccgcatggattccaaccggagaacagcctcaggcttttctggctctgtggcgcaacgtat

SEQ ID NO: 6486 - DNA, 501 bp, Aspergillus oryzae
  misc_feature (1)...(501): n = A,T,C or G
ttccaactcaacacattttacatctttccttccatccgctactccgaaaatgcggntcattccagttgccctcggccttatggccaccactagcgtcatggctaatcctgccaacgtccaatccgtgactgtccagctggccaacgatcagtctggggccaacgccaacgttgatatccctgccgacggcaatcaacgctccgtccaggctctctgggttaaaacctctgtgtccacgaacggcattgtttctgcctcgagcgcccagctcaataaattccagcaaacgacccattgccgaattactcagaaccccaatgtgaacgctgagctcgatgcgcagcgcacctggacacagcttgaccagngaaaggtggtccagctcactcacgcattcattgtctgcaaggactagtcatacacggcctgtggatatcgaagtgtaatgtttgcgaggttttgagtctttggaagactatnacttgcgatggaaactgtgcg

SEQ ID NO: 6487 - DNA, 683 bp, Aspergillus oryzae
  misc_feature (1)...(683): n = A,T,C or G
cagaagcccagtcaggaatacatcgattgtatgcgccgactgcaggccaatctggcatacctggcaactatcgccgaccgcgccaagaaatctggaggagtgcctcctacagcaccaagtatcatgacgccgcccccacacatgccgtccatgaacgaaatgtataagaagctcgctgagctgttcccacgcacggcgccaggcaccactggaacgccccagccaagtcctcagggcaatggaaagcccagcccctctccagctactgagaccgtcgtctgagcaaagtcaatggtttggaatgatccgataattcacacgtgcgcgcagtccccattgtcgagaaattgggcgattccggctcagcgcaatgttggggaacaaagctccataggcgctatctcttcagttgagactcacattcaacgccacagctggacgccaacatactcacaaaatcatctgtctatgacccggaactgtccttgctaatgtggcttgcaaatcaatccgcggattaatcctgatggagttcagcttggcaaaggtcggatatcaagggtatatgagaaagcctcttccgcaaggaacctgttggnggaatgccgtgtgcccccaggtgtgagactcaaaagtccacctgtggaaccagctggggtttctactaaaattatgtccggaac

SEQ ID NO: 6488 - DNA, 671 bp, Aspergillus oryzae
ctctatcagttcaaagctctttcagtatttcaaagacttcaaagccatctacacttccactttatctcttctcaaaagacaaaccagataccgatctaccttcttcaagatgtacacctacactcctacccacaagttcctcgttctctctcccatccactctggtcccatgaatgaccaggctgagagcaaggagccaactcaagtccgtgaacgctccagcagccagtcttccacagcctctgccggatcgcagctgaggggtgccttctcccctctccccggtggcttcctttacctgggacacgagcaagacagaaactaaattctgacgccacataagcttgcgcacgccatcccacttcaccaatcgcgctggacacgatacatctgcaagcgcctcagcccaaattcaccctgcaccggacgaagggaaggagcactagcggtttcatttctttattgttttcaaacatcagtttctttacgagatggttccttatctctttgaatgatttttctgtttcggtgtttacctcttcaccacatcaatgataccacactgccagggaaaaagggggttgaaagtgaagaatgaagtgaatgtttgccaaggagatgttgatacttgccaagccctgtgcagtgaaattcaaattcaataggctgtc

SEQ ID NO: 6489 - DNA, 851 bp, Aspergillus oryzae
ggtcagctcaactctgatcttcgcaagttggccgtcaacatggttcctttccctcgtcttcacttcttcatggttggcttcgctcctctgaccagccgcggtgcccactctttccgtgccgtctccgttcctgagttgacccagcagatgttcgaccccaagaacatgatggctgcttctgacttccgtaacggtcgttacctcacctgctctgctatcttccgcggaaaggtctccatgaaggaggttgaggaccagatgcgcaacatccagagcaagaaccagacctacttcgtcgagtggatccccaacaacatccagaccgccctgtgctccattcctccccgtggtctcaagatgtcctccaccttcattggaaactccacctccatccaggagctcttcaagcgtgtcggcgaccagttcactgctatgttccgtcgcaaggctttcttgcattggtacactggtaagggtatggacgagatggagttcactgaggctgagagcaacatgaacgaccttgtcttcgagtaccagcagtaccaggatgcctccatctccgagggcgaggaggaatacctcgaggaggaggagccccttgagcacgaggagtaaatagcttccagtcactaaagactcggattgatatctggcagcaaaacccttgataagtccacgttctctgtggctttggcctggttcacgggtcatggtcattacattattttgtcagagcgtttttaataactttcctgttcttaatttcgaaaggcctgtagagcccttgagactattgaaatccaacagcacatagttcaaaagcaatcaactggtgcagtatcctgtcc

SEQ ID NO: 6490 - DNA, 691 bp, Aspergillus oryzae
cttttcctagaatagtcaactgccaacgcatctattagcaccatggctgctaatactagatatgagccagctcctcagcgggactcgtttgaggagcgcggatacactcagcccccgccatcttatcaggcaacggccgaatactcacaagcgcctcgcagtgaggacgacaatgttcccgatgacttcaaattcggtggaatggtcgcagaaggaacgctacctatccggatgcaatttgtccggaaggtctatgccatcctaactgcacagctcctgttgaccaccatcatgagctcgatctccttcttcagcgacagctaccgcctatggattcagtccaacttctggctgatgatcgtctcagtcttcggtgccttgggttttatgctcgtaacatactggaagcgcaagagctacccggccaaccttcttttcctgactgctttcacggttctcgaggcctactccatcagtgtcgtgacatccttctatgacgcgcgcatcgtagtgcaagcccttatcctgacgctcggcatgttcgtcgcgctcacgctcttcgcatgccagacgaagtacgatttcacgaactggatgccatacctgtttggtgcgctctggttcttgatcctgttcggcttcgtcgctgcgttccttcccaacagctctaccgttgagcttatctacagcg

SEQ ID NO: 6491 - DNA, 750 bp, Aspergillus oryzae
  misc_feature (1)...(750): n = A,T,C or G
agaaagannnnnnnngnnccctgaagccattgtnatgacnggctttgtagctacgaccgcattaggatgcgaatcggtacgaggcgannctttacgagggtcctcttttgacgacgtttttaaaanagacggcaaggcagcgaacaccggcatttaggaacacagacgtcatacactgtcaatgatgcaattcaaccatatcctggcccaatattacagtgacacacgcatcagcccattgagcccttgttcccagctttcacattaactcgccacagaacatctccaccgctgccgtatcgaatgtcttatccaattctgcccgaagttgcgtaccatcctcgccatcgtcagagccgcccaccaccaaatcaaccaaagatccgagaactcccggctcagagatagctgattttagcgcacgggcattggccctaagactttcatagacttggcgcgtcgaatcggctaatctttgtatgcgatccttggggagttttgcagccttggtggttttcttcgatgcaatggatgttatgagcgagagcgccttgagcgactccatgatcaggtacaagtcgtggaaggacctccaggttggagcaaatgcttcatgccgccgcaagggaactgctgtttctgatacaagctgggagatctttgggccgttcatgtcaagatcctttgatttggacacagccattcctccaccttgggtaaagcagcttgtcgacctttttaagcgggaag

SEQ ID NO: 6492 - DNA, 665 bp, Aspergillus oryzae
atccctctcaatcactttccccgcagacggaccctagtttgcagaatgcaacggcacgtagaagctcgtcactaaccgcgagatcggtagcgtcgcgaggtgcgggtcctgctgaatctaaaccggacgtaccggcggagaccgaccgtgagatcatgtttctattgaggcacttctccgagtcgccagggctctggatggacttattcgaccttgggacatattttgcatcgtacgtgccggccaaagcacggtccaatcccctgctgcgatacgctgcgtgtgcgtacgccgcgaagcaattgggccgggtcaaaggcgcgaggccccctaccggtgaattcgcctcaacacagtctctgatgcgacgagggccggatgcgaagaacgtagactggatctggcatggcgcaaagtattatgaaaaagccattcagctgctgatgaaggagttacagccggacaaaggccccgcgccgctcatcacccccgaggcatttggccagtggcaggcggccgaactgtcggagaataatgaccccaataacccgcgaaagcgccgaaaggcgttcttcgaaagtcaattttcgaatggggtacactcggatgaagttcttgcgggaacgggcatcttgtctgtatataaatccgggatgcactgggcg

SEQ ID NO: 6493 - DNA, 648 bp, Aspergillus oryzae
  misc_feature (1)...(648): n = A,T,C or G
cacgaccctatgcagcagcctgtgtcgatggacacgtggaaagtactgccatccagcccagccacggccagcacaggagattctaatccgaatatatggaccagcatgaacaacatgaatgagttctcgtatgcttctccgacaccgtcttacagccaaccatacactacttcgccttacaatgcgacgcagtattatagcaccgctgccacgtccgccgcacttgccgcgctcccattgccaagcatgttggtacagccctgcagcacagcggcgaatatgatcggatttgggtggggggaccgataccaagactttgcgctgccgtacgggacaaccatgtaatacgcccatggaaccagacacttgacgttgatggtctcccctgacttcgcgtattttggtttagatcccggagtccctgtcgaaaagctctacctagctcgtttgtacccttcgagcccgagacacacccacaagaacgaccgggagcaatatccccgctatacagacaacagactaattggcatcagtgacggcgttaccattgacgattctgcggacatgatactccacttcgtttgcatgaccatcanagaacataatatcttctctctttgctantgtgactactccttcgtgtttgtt

SEQ ID NO: 6494 - DNA, 717 bp, Aspergillus oryzae
  misc_feature (1)...(717): n = A,T,C or G
cgaggctggcagtaacaccgcttgggacttgacggccgaaaggtggccggtgctgttctttgctttggtacagctccaccactcacatttgtctggttgtcttctgattccagtctattaaatttttaccctaaaactttttttctgtcccctctttattttaccttcattaatttgtgtgtgtgtgtgcgtcagaggcctgtcaggacccaagaggcgacttttgttgacccatcgttcagctacggtctatcaattaggcggtgctcaatcccgcgccactcgctgctcgccttaggtttttttttttgattttttttttagtcatttctatatttgnactttttctttttcttccttgcttaatttttttttttcaacatcaagatcaacgtctattggatgatctaaacagcacggtcggagagcagttttttcactgatatttttcgtttttttcctcctcgaagggtgactttgaaaaggttgcatttcatcatctgatccgcttcgaagaccagaaaagggaaattnnngaananannnnnnnnnnnnnnnnnnnnnnnnnnnnnnnnnnnnnnnnanannnanananannnnnannnnnnnnnnnnnttttcttgggggcctttaaccttgcatttaaaggccccatttccccctatagggaagcgtttaaaaaattcctgggcccgggtttacaacgtgggaactggt

SEQ ID NO: 6495 - DNA, 659 bp, Aspergillus oryzae
ggaaaatttttgttagtggatcctctgcaagaaaagccaaaagccaaatcctcatctcgtgtgcacttgtcgaggagttcctctcaattaagaggtcgagagagcccatcgcccagtggcgcataccttggtggttatccttccgtcgtcacgactatcacgggtggtgaagcaaacacgaaggttccggagatgtatgtgccaagcaagaatatccaccgaacagtgtttgaagacccgacccctcctgcgactagcgcaagcagccgtgctccgccacgcgtcaatctaccggaacctgatctcaccaatacccttgctgatttaaaactcaccaacgaagaagactttcgcctggcttcgagccgtttcagtgttactacctacgaacctacaaaaccagcagttcaccgcgacaagaagttccgaaggaatttaaccctgttcccatctaccaatttaatctttcttatgtcaaaaaactcccttcccaccccgtacttcgggaagaaaccttaaggaacccccctgtttaaaaaaaaaaactttttgctgccccccaaaaaatcccaaatatatttttattttgaaaccgggaaactcccttccgccccaaaagacctttttcttttatttcgagttggcccagtttctccccc

SEQ ID NO: 6496 - DNA, 748 bp, Aspergillus oryzae
cacaccacagccatgcgtccttcattgcggttgttaaacctggaggtatcgtccctccagggctctcggactctctacgtctgctcagtttgtagacaagaagcacgcccacgcccattggtcgcccggcaattcctgcgcaatgcgtccaacgcaaccccgatcaccgaacgagtgcgccgcaagatttggggtacagacaacccgcccggcctgaaggatccctacggtggagaaggtgttctggaacggaaattcaagaaagaccagcctgctaggcaggaggaggagccggagaatctcgcccagacctcagaacagactcaggtcgagaatgaagcggagctcgcttccgctgaggcgtatgagcctgcaactacatgggaaggacttcagcgtgtgggtcacttgggcaggtggtccgacttgcctccctctgaggccgacgcttatgaatcgtttatgctcaagaagaaagtcaccaagaagggccaactgtcgttagccgcccaccaagcggcagtcgaagttagcctgatgcacagtctgaacaagcctttgtcgaaggtctgcgatgtcgtcgagcacgataaatcagttttcaagatgctctggaagtgcaagatccagcccggcgagtggaaacaggccgtggtctatcctagcaaggaagccgagaaggctctcgtttatatcttcgaacagatcggcggtcaacccgagtcttgccgtgccgaagagacaccgg

SEQ ID NO: 6497 - DNA, 378 bp, Aspergillus oryzae
ctcaagtaaaagataccgtttctttagttgcgtcgcaccaggaacagctggcagaactcaagtctgttttgcaggagatgaacattactaaagatgacatcgaagccggtacgattggctctaccgcaccggcgtctccagcgaagcagcagcagcagactccagcaataatcaaacacagtgcggaaacccccgtgcttgcagaaccagcccccatccaagaagaattagtcccaggtccatctactagtttcccgcatctgatccggcctatatgccgaacagatattcatgcattcgaagagttcaaggaattattcaccttgtccagtgtctccaaaccgcccagtcgtgccacgagtggatcgtataccggct

SEQ ID NO: 6498 - DNA, 662 bp, Aspergillus oryzae
gggaagggtggagagacgattcagggaaggggaaaacacgagagaggatgaggagccaacagcgaaccacgggatgggaaggagagagagagagaaagaaaaacgcgtgaaaaagaggctgacgggaagcagatgatttgcctggacgtttcggagcttcttttctggatgcgatgcggagaaggatttgctcgcctcgttaccgttccatacacaaccggtcggccattttacctgcaatgtgcaggtgctgcataccataccttactgtactgctagtcttctccaccgactccagatcgaccagcaaggatgctgccattattggacgattggcctatcgctccgggcaaccaccctgtgggaccctgaccttcaacgatcccccgattggctcatttctcaagccccgtccgcgcgtccggtcgttccaggaaccctgtcaccaccgttcatggcccccattcgccagttggccacgagtgggcctgcagtttgacgaaagtccatgccaattgggtcaacggctgctccacttggtctgggcaagtcaatgacgatttgggaaagcctggaagccttgcatgtgtggcctgaggaagcaaggcgcatggtcgacgctcaggcacccccccccttcgcactcaagcgagtccggagtt

SEQ ID NO: 6499 - DNA, 671 bp, Aspergillus oryzae
ggctcgcacgctcgcagaagccgccaaagctgcaaagactaccaaagatgaagtcccggaagtcgccccagttgctgtcattaaattccgtgccctgtctgctgatctagggccctctactatgaatcttatgctcctaacatcctctcgcgatgcctctgggaatccggctcccttgtccccggctcagcttcgatcgcaccccgtcatgggtgcgctagtgaagttccgcaagctttgggagtctgtcaaggaccttactgcccccgaagtgtcggatgtcgaggaggatatggacagcgaaggtgaggaatctgacgcacctgtctccaagaagcagagcgaaaataaggaggtgcaagttcccaagaaaaagaaggagaaggtctccaaagcacaacgcgcggccgaagcagcccaggcagaggcagaagctcgtagggcacagagactgcgggagacggaggctaatcttgcggatctctcgaatctcgtcaccaagtctggcaagaagaaatccactcaaaaggctaaacaatccttctaggctgctgatgactccgatttcggtgatgaagatgctcttactgctaacgaggccgaggagaaagctaaccagaagcgctctcttcgtttctatacttcccaactcgcacaaaagggcaaacagg

SEQ ID NO: 6500 - DNA, 671 bp, Aspergillus oryzae
  misc_feature (1)...(671): n = A,T,C or G
ctctcaacaccaccgaaagagttgtctgaagaaggacaagctcttattggagacgttcgcgacgtcattgagcaggcgaagcgcctcattcttagcaagaatgacggccaattgattcaagagttcatctgggaggcccagagcatcactggtgaacatgttggagagaagccagatgtccctttgagtagggaatcggctcagcaggatggtagggaggctctagagggcttgaagacccttggaaacctcctgattaccaatggagagtttaggaagctcctgaacgatgcctggatccttgtccgcgatattgctggcgatgcgtcgcagaaagctgccaaccaggtccggccgtcagaggaacaactagcacaggttgaccagcctgccgaggataacacctggcatgagaagcctgactatgcaaagcataaagagcagttcacttctcgtttcaggaagaacaaggccactgccgagcagcaagcgaacgaagtcaccgacaccgcagctcaggctgcaactggtgaccaaccggcaggactctgctggggaaatngatggccgtactggcgctgccgcaagtgctgaaaagaccaaggaaaagctttccgaaacatccntgaagagcagaagtctcgtgctcgggatctcgctggcngacaaag

SEQ ID NO: 6501 - DNA, 658 bp, Aspergillus oryzae
  misc_feature (1)...(658): n = A,T,C or G
ccgccgccgagatccgccgccagggtcagcttgccatagctggcgaccctaagaaccaatatgaagagcttgtcaaaggatttgtggataatattcgcatcctggcacgagcagtgcctccataaattcattcgatgccccttggaactgttgttgatgcgaatttacatcgcacactacgccatggaatggctttttgctttcacgtaatatagaaagacgaaggccctgaagatcctaaagaagaaagggatctatgagagctgcatatggaaaacaaaagtcaagtttatatgttacattctctgccgggttgatttactttttacccatatgttttaataaccgtccactacatatatccttctcatggaaagagatgatgaatgatgcgtcacgccctttctggtttctcttcgtcaaaatttttcttttcctttctttttcacttctgcattctttccttctccctacccccatcttttttggtcttcatccagctgttcagaattganatggatttctcatgggtaggaacatattctatttctcccccatcacctaaccttctcttgtgacattatttacgacttgtataatctacatgaatacagtgcctcgtattcaacagaagggttattaatatatttggtatgaa

SEQ ID NO: 6502 - DNA, 681 bp, Aspergillus oryzae
gccttgctgaggtggcaagttctgcaatgacacgcagacttcccacaatcctgaacgctctgatggacaacatcatatcaactacagacgatgcgatccgcgacgagctgtgcaacgcattcgacactgtcttggtctcagtagatgaatttcatgacctgaaaggtgactgactgacatgcctgcactcccgacgctatatgacgatacgagtcgacatctgacgttacagactcggcgtcgtgacatgtggtagcgcttgagacatgacctgacacatcgcttgtcacacacacaacatcgacgcgtacatatgacgacgacgacgcacacgtggtcagcccacgtgactcgagacgacatcacgagacgacacgaaagcaagcgacgcgacgtgacgacacaacgtcacgcgtcgcgatatcaactctgcgacgtccgtcaatatgagcgtcgatcgcgcacgaaatcacatgatcgtgaaagcactacgacattcacacatcgatgccacgataagacacggagaccgccatatcccataacgatgatcacatcgacgcactatcgtggaggcgacgatgacgtcgacgtctgactacgatgacgccatctacgatcaggacgaccccgtcgtcgacagcttcgactgacatcttcgacgaccgactgtgttgtacc

SEQ ID NO: 6503 - DNA, 641 bp, Aspergillus oryzae
ggacagaggtacctctcttgaaacagagtggggtacgtgtcatgggaatgctacgaggagccgctcaaggttccttccgctgtttggacggtgaccaggacaaattcgaacggtactacctgcctctcctagccatgattcggcgtcatcaactggaagggctggatttagacgtggaggaggagatgtcgctttcaggtatcattagacttattgatcgactcaaatcggacctgcgagatggcttcatcataacgctggccccagtggcagcggcgcttctagggattggtaatctttccgggtttgactaccgggagcttgagcgacaacgagcatcgaaaattaggtggtataatacacagttctacaaccgcttgggcccagcggatgaatctcggatgtattgccgcgatcgtcgcgcaaagattgtcaccgaaacgcgtcgttttccgactgttgacgaaccccggccatggaatccacgggctcgtttccttcggagaacattgggcctttattatgcccactggtaggagcagttccccacttttgcggagatttgggccggagtattttaaagccaaaccctggagcgggagaaaccctggcaatggccggcggagaatgtgctttccttt

SEQ ID NO: 6504 - DNA, 653 bp, Aspergillus oryzae
tttctttgccctcctgtagtggtttctcgatatgaacccattttttccccatatcacggacctttacacaaaataaccgaagaattaggaatatggaaggacccttacgcccattcaccgatccggccagtaaggcctcggacagggcattcccgctggatgataaagacatcacttgcgtctccgatgagtctcttatcgacctcttaaagtcttctccgatcctttacgatttcggccaaacgacggtggtgcgattgtctaagaatctcgttttaaaaggcggcggcaatgtgctgccttgcgaggcaaagattcttcaactaggcgcatcaaagtctaatattcgagctcctcgtgtccatcggtctctccacttcatggacgatacgaaatattttggcaacatgggatatattgtgatggattatatcgacggcgagccgcttgatggctgctggagagaactcaatgatgaacaaaaaatggatgtcgcgaaacagaccgcccaaatgatcattgaaatgcagtccatcaagctgttggaaccaggttcgatcggcgggggcccatgtcgtggtcgcttttttacgcactacagcgccggggcctttcaagacggggccgaatttcagggctgggttaaccacaag

SEQ ID NO: 6505 - DNA, 256 bp, Aspergillus oryzae
cccgcgacgcccagattcgctggctggaggagcagcttgaaatgtcgctgaatagaaaccaccagtcctcctatgactcttcatcacgctggagacgttacaataggtatgacggtaggcagtccgaggtatcggaatatacgcctgagccgcgtcgccgtcggcgagcagttcatagagaacgagtctgggacaactagactggcagctgggttactgccagaagggtttactaaatctactcacggcctgtgct

SEQ ID NO: 6506 - DNA, 1044 bp, Aspergillus oryzae
  misc_feature (1)...(1044): n = A,T,C or G
gttcgtcgctgaccccggggatctctcacaatgtttgccactaggaacttcgctctccctgcccgccaatgcttgcggagcactcgtgtctccccacgcattgcttcgcccttgtcgcagctccgtggttatgccgctgctaccgacgagcgtgtcgctaagttcaagggccagaaggacaccgatggaaagtacactgtcactctgattgaaggtgatggcattggtcctgagatctcgcagtccgttaaggacatcttcgctgccgcaaacgcccccatcaagtgggagccagtcgatgttactcctatcttgaaggatggaaagaccgccattcccgatgaagccattgagagcgtgaagaggaactacgtcgccctcaagggaccccttgctactcccgttggcaagggacacgtttctctgaaccttactctccgccgcaccttcaaccttttcgccaacgtgcgtccttgccgttccgttgctggctacgagaccccctacgacaacgtcgataccgtcctgatccgtgagaacaccgagggtgaatactctggcattgagcacgtcgttgtcgatggcgttgtgcagagcattaagctcatcacaaaggaggcctctgagagagttctgcgctttgccttccaatacgctcgttccatcaacaagaagaaggtccgcgtcgtgcacaaggctaccatcatgaagatgtccgatggtctcttcttgaacctcgcccgtgatattgccaaggagttccccgatatcgaattcgacgcagagctgctggacaactcttgcctcaagatcgtcactgaccccacgccttacaacgacaagggtcttgtcatgcctacctctacggngacattctttncgacatgtgcgccggnctgatcggnggtctnggtctcactccctccggtacatcggnaacgaggtgctcattttcgaggctgtcacggntctgcctcgacattgccggcaggggctcgctaccccactgcttgctttgacagntcatgatgctgcgcacatgac

SEQ ID NO: 6507 - DNA, 674 bp, Aspergillus oryzae
tgagaccgaagagattggtgacctgaaccaagcttgggatctctactacaccgtgttccggaagataagcagacagcttccgcaattgtctacacttgacttgaaatatgtctctcctaaacttaaagactgtgtcgaccttgatcttgctgttccgggcacctaccagagtggccgaccgatcatccgtatcatgagcttcgatcctatacttcatgtccttcaaaccaagaaacgaccacgcagaatgaccctgaaaggtagcgatggtaattcatacatgtacgcacttaagggacatgaagatattagacaagatgagcgagtcatgcagctctttggcctcgtgaatacgctccttgacaatgacagtgagagctttaaacgccatctttcagtgcaacgattcccagccattccattgtctcagagctctggtatcctaggctgggtctcgaacagtgacactctacacgcattgatcaaagaataccgtgagagccgccgaattctcctgaacattgaacaccgcatcatgttgcagatggcgccagattatgacaaccttactctcatgcagaaagtggaagtctttggatatgctatggataacaccacaggaaaagatctgtaccgggtcttgtggctcaagagtaaaagctcagaagcgtggt

SEQ ID NO: 6508 - DNA, 709 bp, Aspergillus oryzae
tgatactagcctgtcctactactgcacgacgccgcttgtaccgatccgacactacacatcaccttgttactggattgggacgatcgctattgcctcctctgatcaaatatggctcccctttcggaccaggccataaacagggatgagaagctccatgagtcgggggcttcctcctcatctcaggtcgatggacgattagaaaaagaggctgagcctcccctgcacaaaccccagctgggtttagcaaatgaccctgcggctgctggaactaccttccatcagctggaaaacaccgccttggacggggggaagatcgagttgacagaagaagaatgctacgatcagctgggctactctttcccaagttggagaaaatggatgattatctcaggtatcttccttgtccatgtttctatgaatgtcaacaccacattgtattctaatgctctggcgggtatttcaagagaatttagggttagcatgcaaccgtgatctggaggaccaatgatcctccttagactctaagcgtaaggttgcgatctatagtctcactggaacgagtaactgcatctctaaccgagcttgtaggcaagctgaggtctgcgtcatgcctggtataggctctttcgctgtcttcggagacctgcctctatatgctgtgggacggacgctacgatgccatacctgcgtgcgctgagcgattacttat

SEQ ID NO: 6509 - DNA, 659 bp, Aspergillus oryzae
  misc_feature (1)...(659): n = A,T,C or G
ctgagatctgggccgcactgtctgcggcgatatcactcatgcatacgggtgatctcaccacagctcagagcatcattgacgctgctggagtcacggtgcctacgggtgacctgtgtcagggcgcctacgatgagcaaggggtcctttataggttaccacaatgcatcgtgagcgatccagagaacttggtgaagtcgaacctcggagaggatgatttcgacaccgacgacggcaagttatcattggacgaggaatcgggagacgaacttatcgcagacgatgccgaacgtcgcagagatgagaagggcaaggtcagcgagcgagacttaatccgcgtgaaagcacgactcagcgataggggcgggcctgacatggtcgtgactgtcggcaaaacacagaatgttgcttatatcgcccgcaaattgcaacaggaggccgaaattcccaaaacacagcgagtaaaaatcgcctacctangcaaaatactcaaagaacatgtacccctagtcgnacaaggatggaaacaaggcaatgtgatcaacgcattggttgtcgcacgaccatctcccatcatgctaaccccattccatcgatttctanaatcccatggagatctttctagtcganattacaaagcggggattgacagcaatctgcga

SEQ ID NO: 6510 - DNA, 660 bp, Aspergillus oryzae
  misc_feature (1)...(660): n = A,T,C or G
tgaaaactttccattattgttcgtgtataaatccggtctcctaattctgtctttttttgtcgagtgcgccaaagcaaattccacagccttgtcgtgcgatgagccgaggacgctcccccagtataacccccaatcaggttattgagggcaaatatatgaatccgaagaagctcgttaaattgttaagaaatgaatatgggcaagctaattttcgggccgaggtgtgttgaatttctcactgatcccgaccgtgcccgaggaaaaaaatctaatggctcccaggttacaccaccagatataatgcctcgtccgcccgaacaatcacggtatttccagagacattacgcttcctcaaactgcatggacacagatcctacgggttatgcccctattacgacaggacctaccacacggcgacaaatctctacgcatcaaaaaaagacccttgggatttctccacaccatatggggaggcgccacaacaacataccagggtttacgcgtgaaaagaccagactctacgtcgccaataaaggacacctaggccccacgaggccaatatgcgcccaaaactaaaccacatcgtcctcccctgaccatnattgggtcacaactatcccaccttggccgtgtcagcaccaccgtgtgctgctcccatcg

SEQ ID NO: 6511 - DNA, 579 bp, Aspergillus oryzae
  misc_feature (1)...(579): n = A,T,C or G
cgaggtcaacatctcgccatagcattatccttacgattcctatcgaagaccgcgttgcaacagtggttatatctataccccgtgaagacgctatccgattcggctacgagtccactttgcctgtgatcttcaattcgaaccccctctctgcgtgatgagcttcacttcaaccagcatcgcctcaaactgacagtcaactggtatgagccccatgtataaaccactcttccgcattatctcccattcaaccgcgttttgtggacttcgaaccctgatacaattgaagaatctggacgacggaggtgggcggaatattaccaactgttttttgggagatgcctcgaaaagtctgatagtataggctgttcaggtatcttcgatatctatctttgacgcttcaaaatcacttccaaactgaactgcgattagctaattcaggtaacggaaacgggaagtattgataacgaacgttattcatagcctncgttactaacttgttattgtcatccgcnnnnnnnnnnnnnnnnnnnnnnnnnnnnnnnnnnnnnnnnnnnnnnnnnnnnnnnnttcctgcggccg

SEQ ID NO: 6512 - DNA, 640 bp, Aspergillus oryzae
tcaaattgcagctttctcgaaggcaagcgatttcgtgtcgaagcaaagggtatccgtgcactccgcccacccatgcccatgagacagaatgaaatccccatctacaccgccgacggctccctagcatatacagctaccaaagcaaaggccatgtcgagtcacaccatcctcgcttcccccaaacacggagacctcttctccattgattttaaaccaggttgctgtccctggatccgctttttgaatcccatcgaaggggacgtcatcccggagattgccttggaggggaaattgaccacccgggccatgtcatttacacctccggagggggggtgtaaatgggaatggaagtactcgataattgactctccgagtgggggtaagcttaaggctttgtgtttggagaagatagatgggtcagaatgtggaaaagctacacggatcgcctatcttctccgaagtccagatacgcgtgcgacaggttcgtcttgttgttccgctgggaatgggggtcaacttgtaattaattccggatgttgacctaagcattgtggaggaagctctggtaattgcaacttgtttggtcatgttgcgcaaggaaagagaatcgtcccaggtttattcaaggctatggtaatgg

SEQ ID NO: 6513 - DNA, 650 bp, Aspergillus oryzae
  misc_feature (1)...(650): n = A,T,C or G
gttcaccgatttctacgtgccgttcgtcagatctattcaacctcattgtccttggggtcgctgttcaactccgctccagacttctcgctagaccgcctcccccacttgttgctgtgactcgctcgtccgacgccggcccctatcgttcgacctgaaattgctgcggtcgtgatttccagacaccttgattcggggcggttccgcttcaggaccccatgttgaagagaaggagagaacgaacccggtccccgactcctctctctcctgccactgctctgtctccagcgtcgctgaccctcactttctccgaaactccccctcaagcaaataactcacggtctcatctgccacggtaaatggcagatggtacctacaggttccagcagcctggggccgggcagttcttctttcaaacgcaacaacaacaaccttctcatcaacgacaccttgtccggaacgggacgaattctccgactggaagactgaaatttagtcacgacacaccatcaccttcacgatctcctccccttggccaagcagctgcgctcaatccattcactatgtacagtcagacacaccaagggcagcatgtcctgatgaatggcgggcaggctcaccaacgcttcngcatgcagatgcccgagtttcan

SEQ ID NO: 6514 - DNA, 656 bp, Aspergillus oryzae
gatttctgttttccggagcgtgctggacaagggtagtggcaagaagtagcagaggaggcggtctattattatgtaggtttgttggttttgccaacagtgtctggtggcagtatggcagaacatatcgtcgattgccctactcgttgaacttcacaactagacaccaggaacaccttggatgttagtcgatctgttagcttcgcccatgaccccttgcatgagcgcgtcttcgttggttagacggtatcaagaccgtcgttgttcttgctgctttcgtcaccgaatattggcgctgggtccccatttcattgcaaagactgttttagaattgcaaacatcttctccatgctcaaaaagtcccctttacactctcccctctctcacccactgaccatccacattgcgtaaccgtacctgcagtactgttggttgacaacatgtcggccactggaacgtacaggggaactactactggccacaagactgtgggcagaggtaggctggccgacttcaatggttcggcttcccacattccccgttctcggtctgaaaccgcttttttaacttccaacccttacacttcctctaacgacattggaagttcaaccatgaatgctgcaagctgacaaaaacataatcattcgatacgagatgag

SEQ ID NO: 6515 - DNA, 341 bp, Aspergillus oryzae
tcggacgaggcctcatattctgcacctgatttatgatggagtcaatatgtccgtcctcggaggaactgacactgtatctggcagcataaggcgatgaggcggtggcagctaccgaagcgggtgaggtgagcacggttttcggggaaatagcttccggggctagggctgatgcctgcttcttcttcttcttcttcttcttcttcctagaatagaacgcagcactcacttcccggagagcgcggagagaggatgccaaatgcctggccgaatctgtccgggtgttgtggtttacatttccatctccagtcacatgctcggcgatgacggcctctaatttctca

SEQ ID NO: 6516 - DNA, 680 bp, Aspergillus oryzae
  misc_feature (1)...(680): n = A,T,C or G
ctgcgacgtcgtggcgaacttcggggagaatatcccgtctaaggtggaccgcggattccaactaaccttttcattcaacaacccggagcctagtgtttacatgcaactcttcaagatctgggagaagggcttaagcaagatcgcgaaagtggaaggcatattcgtcgagttcttggttcagcctcatcccgttacgaacggcaccaacatgttcggcctgacgcccggaaagacggacgacgtgatggtcgatatgactgctgcctacactaacacggcagacgatgcgctagttaaggctgttatcacggacattgtgaaccaacaacgcgctcttttgaaggcgcacggacatctgatcgactttatctacctcaattacgcggacatctcacagaaggtgctccagagctggggcgcggataatgtggcgaagctcagagctgtcagcaagagatatgatcccaagggcgtgttccagatacagggttcctgtgggtaccaaaattcccatgtaggcctgttgtattcgttgattagaactacggtctttgccattaggagggttgtcaccacgtgtaaagcanaagttggcattcctctcggngaccatacgtcgataccatctgcatatctgctgcatatattacgtnatatagatctattaatagcagaaaatg

SEQ ID NO: 6517 - DNA, 668 bp, Aspergillus oryzae
cgcccagatcccacgtccgtcccgcgcgacgagatcacaacattccatacctcattcgacagggcgctatcgcattgctcctcagcaaacatccaggtttgattgcgagtccttagtaccgatatacactgcaatactaaatttgtgactcggcgcggccgctagacctgcaaagaatggcttctcgagtacgttgtctcatcgtcaaatcgagtgaatgtttgggcaaaatacctggttgcgctgtctggttcgttcagcgaagacaggcagcaaccgccagccaagccacagcaaacccggcccatttctacgaagaggaaaaggttgcacatactatacctgctgaatgacctgtttcatcataccaagtatcatttggattcgactgccgccttttccaccttgaccggttcattacagccgtacattgtggaattactgggctacgctgcttcctacgaccgagagaagcaccccaagcaccatagacgactagatacactgttggatatatgggagcaacatggctactacggcagcgactatgtcaacaagttgccggaggtggtcaagaactcggcgttgtcgggtcctgtcaagacctctattgacgtccaagagagtaacacggactctgcccactggcttccgagcaaggatgtact

SEQ ID NO: 6518 - DNA, 734 bp, Aspergillus oryzae
  misc_feature (1)...(734): n = A,T,C or G
ccgtcatcctccnacaaactccccagccctgagaagccgggcggaacatcgtcactcaatctaccctggtctagaagcacttccgctaccagctggtgttgccccgattgacccacctgccaggcccatcagcaggttcaatcccaacatgagttttgatgacattttgaagcaggttccaaaccagaaagggaagaaataaggactatgaactggcgtgtacagtgtctggttgaagccctttccataactgggatacgggctcatctctttccctccttctgttttctctccctccccttttctccttttttctcttacctcaaaacctctctctctctctccctctcttttccttctgacatcagggccacggatcttttctcctatcttgcatttttaactgcacgccttttcagctctcatgtcttttcctcgtcgccattggctcttcttaatacttcatcctcttcctcctcttgttcgtatttaacgtcggttattaaccattatgggcgcacataaatctatttggaccaaaaggctggaatggcgtaattacaaatctatttgaatcccagacctgaantnganngaggannnnnnnnnnnnnnnnnnnnnnnnnnnnnnnnnnnnnnnnnnnnnnnnnnnnnnnnnntttcttgcggccggtcgagcattcttttaaaggccccattttgtaattagttattgcccgcttactttcacccccg

SEQ ID NO: 6519 - DNA, 689 bp, Aspergillus oryzae
tggatctttcgtttagccttgtgcatgcccccgaccagcggcaccttggccaggaacagttcacagggtccgcagaactcggattggattcctgcctctatcatcagccatgacttcacctctgcggaaagacttgaccatgatgcacgctctctccttgatagacacaacgtgcacgatgctgttatcctgactgctctagggggatgcttacagagctccattcctgattggccgaagaagcgcccttcccacgaccagtttgagaaatgcgtgcagccggccattagcggtgtagtaaaatatgaccagcctatatctatctcgcctagcattctggtagcagacggaaacacaggcagcggcatttgctcggtccctggaaggttgctgcctaaccttcttacggggagagatatgaaagacctggccggttctatctgcgacacgatggtcaccgtgggacaggggattgtcaccaaggatgcaggcgcaagttcctctgccctcacagatcggggaggtcatacgaaaggtttttcaattacccacaaacattgcaatctgcagattataggtacggtggccaatgtaggcggtatcaacgacaaagccgagctggttgatctctgcgtgcacgcgattaagtccccggcagagacgtgtttagccgttttgaagcatgggaa

SEQ ID NO: 6520 - DNA, 1717 bp, Aspergillus oryzae
  misc_feature (1)...(1717): n = A,T,C or G
gtatgcctcgatctattcgcacacgggcggtggattcgctctggcccggccggttgggccgttttctccatgtgccttcccctctcgtctagacccaaggcacaatgacgacgctccctagcttgttttgccgagaattacaccggtgtttccatacattccacccctgggcattctccccataaattttggcgttctcccagcgttttctcacccaatctttctctgggttctaccatcgcaaaacgtgcattatttctatgccacaaaacgctctatttcgttcctgatatccttgaaaaaacacaattcacaccacatatacggcctcggaaaatgaattcacagagatgtgccgcggtcgtcgtgggagccggccccgccggtctcgccgttattggaaatctattggagaagcaactaggggggaagatcgcctggattgatccatactttcaggctggtcgggtgaatcgcaagtaccgcgaagtgcctagtaacaccaaagtcgccctgttccaagcgtatgccacagcagtccagcccttccgctccgtaatcaacagcacccgtatccctagtccattctcaacgatggccaaactcgatcaagagaagacctgccacctgcatcatgcggcagacatggttcgtgccttgacagagggcatcactaagatggaccaggtttatgcgtgtcgggggtatgtcacggctgccaacctggtagagaaaacttcgtcttggaccgttcggatccaacgtgcggaccacctcgacgaagttgaggtcattacccctagactcatcttgtgtacgggatcgtcgccgacagaggtgccgatcccggtgtgtggacagcacatcgagaggctggatctagatgtagtactcaaacctagtgacctcgtctcgtatcttccccgcaatgagccccagactgtgggggttgttggagcttcccatagtgccattctggcgctcctcaacctggtagatctggcccgcagtacccaccctcagctccgcattaagtggtttactcggcatccgctgaggtatgccgagtacatggatggctggattctgcgggacaacaccggcctgaagggttccgccgccgactttgcacgacaacagctggaggaggacaaactccctcagtccgaagccggccggttcatcaccaaggtggactgcggaggcggccaggaagcagcgcagtatgagcggcatctgccgtcgtgcacccacctggtgcaagctgtaggatttactcgggatccccttcccgagctgtcagtgaatggccgtcttctcgatcctgaatttgactcggtgtcaggtggcttccatgatgcgacaggccgtgtcgtcccgggtttgcatggagcaggaatcgcattcccggaacgagtggtcgatccctacggcaatgttgaacatgccgttgggttctggaagttcatgaagtttatcaagagagtcagtccccagtggacagcatgatggtggttttctttaaatagtgattcccctttgctttgcgttgatttcttggtattattagcgtcatcaactgtggatagaattcccattctaatatgcaaagtatgtttatactggaanaaaannnnnnnannnnnnnnnnnnnnnnnnnnnnnnnnannnnnnnnnnnnnnnnnnnannnnaaaanttttcctgcggccccctccc

SEQ ID NO: 6521 - DNA, 685 bp, Aspergillus oryzae
  misc_feature (1)...(685): n = A,T,C or G
ttttcccgtccttctttaattttaaatagtgaaggtagaactctcttctttgttctccataatttacgattataacccactagattattcctcggcgcctcttatctctctctctccctctccccctcagcacactttctttcccgttatcctttcgccatttacacccctcccccttttcgctggctccccgcatcctttgtttgcttcaagcttgcgtgtggggtttgagaacgggcgatacttgctcaggaaaaagcaacagtttgaatcacattaccactcttaggccctgatacggtcttctctcacatatcgtcatggcgagtgatcagagcaagaagccagccgtgctgatcgttggaggactcggattcatcggtcgtcatctggcactttacatacatgaaaataacctggcctcggaagtgagactcgtcgacaaagtccttcctcaactggcttggttagcccctgagttccaggaggcttgctccaaagataagttcgttcaagcggacgctagccgggaacagcacnttccgcgtgtcttcgatcgggccaacggcgaacaatttgactacgtatttcactgcggaggcgagacaagacactcacaacccgacgatgtatatgagcttcgtattaccacctcaccggggccttagctcgtgaggtggcccgt

SEQ ID NO: 6522 - DNA, 658 bp, Aspergillus oryzae
catacacaatctacaacctacctaacacagccaccccgtcaccggctagtccaatatcagtctagccgtctcgtgacacggttcgagcgcgccaacccgaaggaatatctttgttccgtgtcccgtgtcagctggcgttgccctaagttctcccaaccccaaacgcgtcaaaacggctcgattggctcgactcgccaatgtttcacacaccatccttgtctctttgacatcggaggtttgcctagagtttgagtggcaatattacctaaaaagaaagctgctattcagctcgtgtcacgactcacaaaggaaaccaagacacatggaagtagtcccgtttcgtccgtatacactaactgtcatcctggctgccactgattaggattgtaccactgaacctagtctaggattcgaaaaataacacctgatatcttctacacgaatcagaacacagccataaaccaaaatgagcgaatctctcatcccaatattctgtctccacgacatctcactccaagtacatacataacccaccatacctctgtgaaacacacacagtaacgccaactaaattacccaagatcctcaactcaatcctcacaaaagcctacgcacacgccattagaaatacaatcacccccaaacgctcctcttgttt

SEQ ID NO: 6523 - DNA, 675 bp, Aspergillus oryzae
  misc_feature (1)...(675): n = A,T,C or G
gcggagctcatattcatgatcgggactaccactctcacattcatcaccaactggttcgtggtgccgcggataatgggtaaatcggagaaatccagaacgctcttctcctatctagcagggctgcaattcggcatgggcctcttcttcaccggaatggcaaacccatcaaaggttttgcgtttcttcgcttttccaaccgacttattccgtttcgatccttcgctcgcgcttgtaattctctttggaatcggaccgtcgctcattacctttttgacagcgaaaccgggacagaagaccgacaaactggatggcaagccggaactgcccacattggcagacagttggaggctcccaacagccactatggcggacattgactggaggtttgtcgccggtgcagcggcctttggggttgcctgggggttaccgggagtgtgtccgggtcccgcngtgcttcgtgcagctctgcagccggcatggggcctagtcgaaatgacagggtacatgctaggcaacctggtataaatggcatgaaactgttcccgtatcttgaaaatttctacggatgtcaatgagaaacgtgtcccgttgatctatcaaagaccgggagaaaggatccgctaaaaggcaaccgccattgagagccatgcgacacgaacgttcacacgggtcacc

SEQ ID NO: 6524 - DNA, 687 bp, Aspergillus oryzae
  misc_feature (1)...(687): n = A,T,C or G
ctcaatcaagcatcactgatccatcttctttctgcaccgttctgcaccactctacccttcagcccaccatgaagttccaatctctctgcatgtctctcttctgcgccgccacgctggcggctgcgcttcccgtcgagccttccgcggagtctgcgcctcagccctgcattcccgccgagttggcgaaggttctcacctctgtgccgaaagactcacccttgtattgtaagggtgattctcagcctgaaaagcgcgacggcgagccttccattgaggagtgcggggatgcgctgaaggcttacgatgccggggaagaagatgaagcatttgtcggggacctactggatgcttgtgaggcagcatacggaccgactgggaataaaaagcgccgggcgaaagaaccatccatcctgagcggaaccgttggcagtgttatcggcgatgttagccgcgttgccgggcgttgattctggttcgcatagtcgaaaacgtcacatctctgttttgtggaatctgcctcgcgcttcgtatcaggattgaacggttaatggngtcttgtgttggtggtggttatggntcgtgtattatttggttgctttctgagagaattaccctgtatctcctgaaatcttgtacagaaactcatacatatgctctatacaatgtctaacgcagataatggacata

SEQ ID NO: 6525 - DNA, 1041 bp, Aspergillus oryzae
  misc_feature (1)...(1041): n = A,T,C or G
cgcagactactaagtacagtgtgatatcagacttacactccgcatacgtccttattaggcacccttgtttcgtacctgcatctttgtcctcaccattcacaccgctactcgagactcacacattacactgtcatcatgcctgtcgtctcacgtctcgtgtcgattgttctccgcgtggtagaaatcatctgcggtgcgatcgtcgccggtatcatcggttactaccttggttcgttggacgaccttgaggcttggcctcaagcacgatggatctataccgaagtaattgccggtttatccattctactgggcctgatatggctgatacctttctcatccggcttcttttcgtggccctttgatgtcattatctctctcgcttggtttgctgccttcggtatcctcgttgacgctatccacaaatttaactgcggaagtatctgggcatggggcggtatcgttcataacgacgtgtgtggtcggtggaaagccgcagaggcattcagcttcatctctgcctgcgtctggcttgtttcggcgcttgtgggtatctggttcaccttccgggtccgtggtactaccagtgacgcagttagcaatcgccgtggcttctttaggcggtccgctgtttaaatttgaaacgctatgctttacgatcttgtctggttttctcggctgccgactagccccgggtatggccggctatcagcgagaatcagaccggtgattcaaagagagacatctatcaacccacacgacactctntataccccaatcctgacacgatattctgcgtcgtgattcagtattggtgcaatacagcgccgccacttgttatagtcgcgtcaagttctgctggatgttcatggctcgccatcagcgggatgcatgaccattgacacgggaaacgacctaatgactctntnttattacaattaatactaatacagataccccgtcggcgtgttgatgagctcatgtggcatgttggtggcanactatatcgctcattacgtttagaccctgatctttaatctttag

SEQ ID NO: 6526 - DNA, 675 bp, Aspergillus oryzae
tttcacctccgacctccttggtaatctcacttataggatcttcaataatttttgactgcgcaattgttgggattgcaacagcatcccacttcttgggttggttacccaatatggcttcccggcctaacggaccaatattaaatatcgaaaccaccaataggctttacacaatcctgcccacattttttgcaagattaaatcattaatcttactacccgtcccgtcctacgctttaagccttaacaagccccaaatatacccactagtttttgaatattaacatgacaggcacccacccccggaaactgaaaccctaaccatgccccaaaaataccatatctgggtaaacctatatatgcgcccgaagacacggaaaaaaggacacccaatgaattttaccccactttgagaaactctttggctttttttttacccaggcacaaaaattggcctcgggtgcgggcccccttaaaaggccgttttctcccccttgaaaaaatgaaccaataaatgctgctaaaacttgttaaatcgtgcctgggcccgtaacaaagaaatacctatctctttgtgaacatattctccataagaattaaaaagattctctttatgggattatcttggggaggtatctctcttaaaaacaatacatataaggtagtccgaaataacccc

SEQ ID NO: 6527 - DNA, 621 bp, Aspergillus oryzae
ccaaaactcgctccatttgcgccgtcattcttggtcatgcgctgccctaccaggataccaggctgcgttccatccttcgtcttctccgtcaagccaaacgaatgcaggtccctcacacgacacctgtggttattgcggtgaagaattttctaatttccctcagcctgactgggaccgcaggttcgagcatttgacgacagtgcataaatttggggagtgcaacaatgcgaagaaattctaccgcgcggaccattttagacaacacttgaagcacagtcatgctggaaccagtggaaagtggaccaacatcctggagaacgcctgtatgaaagaggaagcgcctcctgaacccagaaacgccactagcaacggcggacccggccctgcaatgggaacgactgcgacacttacgtcaaataacattaacgaggtcctcagcggctgctgacaaccattgcgctggtgtacactactggatcagggtttctgtggagttacaatgctctgacgcgctgtagacgactacaagtttgtgtttttcctgggcacgtgctgcatttatttctctgcctttatattccttttctaaggttaaaatacccactttccgtcgtcaggatc

SEQ ID NO: 6528 - DNA, 657 bp, Aspergillus oryzae
  misc_feature (1)...(657): n = A,T,C or G
cccggcaatagtggcacaagccagaccagggccatggtgagtgagcttcttgccattaagttgttgagagagtataccacaagagagttgattgatgctctctcctacgagtttttccctctccagggccagtcgctgcccgggggctcccaacagcccccgggctggacccctaccgcagggaacaagcggctgcctggggtagcccgcatttcgtgcctcgaggtagcgatccgcgcccaggcgaagcggttcctgtcccacccgcttgtcgtacaacagctggaggcaatttgggcgggcacaatcgttttccattcggctgcagactatctccaccgctcaccgacacgagtcagtcacagcgcagggccgacgtatggtactaccgtcaccgctaccacacccaacccgtttgccggcaagttaagccccagatcggctgagctgcgccgctcagtcaccctatatgacccgagagatgcctccctgttcaaactctctaggttgagggttcctcgctataggcagtttctctcgacgctgtcgtttgcggtattactggcattgttcctcgcagttctagaccagcggcgtgtgcatattagcgcccttgaggttgtcttctggttctggagcgcaggcttcatgcctgan

SEQ ID NO: 6529 - DNA, 702 bp, Aspergillus oryzae
gatcacttgtcaatcgacgaggctatgtaagggccttgccttcaaccgttttgtgaatatctggttggaaaacacggactatgagtctgctgcaaatgatcctcatctttccaagctggccgagaagggtctccttctcactaactactgggcaatcacacatccttcggagcccaactactgcgcttctgctggaggtgataccttcggtatggataatgataacttcaaccaagttcctgccaatgtgtccaccattgccgatatgttcgacgtgaaaaacatcgcctggggcgagtaccaggagcacttgccttatcccggttaccagggcaaaaactactctaaccaagaaacgggcgccaatgactacgtccggaaacataatcccatggtcttctacgactctgttaccaaggatgctacccgtctgcgccagattaagaatttcaccactttctatgatgatttgaagcacgagcgtttacctcaatacagctttatcaccccgaacatgaccaacgacgcccatgacaccaacattacctttgctggctcttggacctggcgtttcctctccgagcttctggaggatgagtacttcaccaaggacaccctcattctcttgaccttcgacgagaatgatacctatgagattggagacaagatctacagctttcttcttggaggtgctgttccaga

SEQ ID NO: 6530 - DNA, 649 bp, Aspergillus oryzae
  misc_feature (1)...(649): n = A,T,C or G
caatatgcttacccacatgatgagctccaccccatctcgaacggtgtcggcgattcacggaacggctggggtgcgtccgccgtggatgcactatcgacggccgtcattatgggtaatgaaaccatcgtcaaccagatcttggatcatattgccacaattgactactcgaaaaccgatgatcaagtgagcctgtttgagacgacgatccggtacctgggtggcatgctgtctggctatgacctgttgaagggtccggcctcgaacctcgtcaaggaccaagcgaaggttaagacccttttggatcagtcgcaaaacctggcggacgtcctcaagtttgctttcgatactcccagtggaatcccctacaacaacatcaacattacttcacacggaaatgacggtgcaacaaccaacggattggccgtgacgggtacattggtgctcgaatggacccggctctcagacctgactggtgatacggagtatgctcagctcagccagaaagcagaggattatctgctaaacccctcaccaaagagtgcagagccatttgaaggattggtcggaagccatatcaacatctcaaacggagcgttcgccgacggacaggtgagctggaatggaggcgacgactcngtctatgaatacc

SEQ ID NO: 6531 - DNA, 655 bp, Aspergillus oryzae
  misc_feature (1)...(655): n = A,T,C or G
ngtacactcgatcacatatagggcgaggccgaggcttgtatggctcggtcgatctctagtgcgtcttcgccagattcgatggtttcagatgtctcgactctgtctgctaactcgtctcggtcctcttcgatgtcgtcgactacatcgggccctgtcttgcctcggctggccattcaggctacccttagatgtactaacaattcgatgaaggagagccggaaggctgcggccattgcttcccccatcgatgagagttcttacaacgacatttatcaatcccccgaaagctttactgggtctactggacatgtttcggagctgtctaaattttcactgggaattccttgtgatatgacatccgctcatgaggctggccagaagctttgtggcgttgctgggtccgctcctcgtgctccccagacgaaataacagagcggaaatcatcgccagtgatcgaacacagacatcccgatctgacgattagagggcaaaacacgntcgcatctgatgcaggccatccattactgaggcactgtgttcccgatgaaacatgaaaggtctgttatgacgctggactcagccacgtcatattacgctgcccactgccgcagtattacacgttcacttttgaccggagctgacgatcctgctggtt

SEQ ID NO: 6532 - DNA, 1097 bp, Aspergillus oryzae
tatagtcctggatgcctggtaaccatcatcttcccaaccaattgcttctcaccggcaacactaaaataccacgtggttacttcctcaattcaacctgaccctcacttcccgtcccccggactttttttttttttcttttgttgaaaaggagtgtccgtactttcaggggcaaatttgatcaagaaagcgcccgtaacctccagcttctctgaagtggcaccttttcccccccttcaatcccttcgtcgcagacaacgaatattgcattgcgatcatgacattctttctctggatcccagcctctttcgcccgttggattcggttgaaaatatatcaatatgaggtgacttttgctgtatatatgctcaccccaaccgaaaagttcatctttaattccctccttcttactctgatttcaatgatcatcaccgcgatttatgtctacctccccgaccacatcagatccatctacggccacctctactattactgggctggcgaacgtcccttcatatcctccgccttgcccgcgatcagctcggtattccgcgaggccggcactcagacactagaggtcatgtacgagacagcaaaaaataatgctgctgctgccaccgatacaatccgcgaactataagtttcttggctactggcaatggcgggcaaccctttccttcttcccttctcctgactcggccgcggcggatcttggctatctggtttctgtgttactcaggcgtgataccgtaggcgccatcgcttgcgtggtgcgcttatcaagatacctttgaataatggatacctttccacctcttacgcatctctggtccttgagcatggattgaggtgtcagcttagctacactgactgcgatgcttggacgcatctgttccatgttggcgttgcgatgttgctcatacggagttagagcgatatgttgctgagcaagccggcgcatactatgagttcttgtgacctttcttcgctcttgctagcgtctggccttcagggttctgaacactcatagcatctaagtctcgatacttactgcgaccatgaaatacccttaacagcgaagaatagaaccgaaaaattct

SEQ ID NO: 6533 - DNA, 666 bp, Aspergillus oryzae
  misc_feature (1)...(666): n = A,T,C or G
cggggcactgcagtcagngtccctcagacggctgttgagccgtccgtagatggagtggaccccttagatgaccctgtggacgaagagcgcataccgccaaatgtcggtacattggtcagcgctatgcaacacgacgagagtatatcattggagcagcgattgaccaccttggaggtgaagttgattgacctcgaatttgctattgcccgcatgcagaccgaacgcagtgaaccttctcccacggcgtcggcaggaaggaaacaatcacagaattcgaccgagcacaagcgcaaaaagtctacggctcagtctccaccatccggcagtgaagctacgttcagcgtcggatcggcaggagatcgaaccttgagcaccgttactattcgccccaacgcacaacaacctgattgtttaaaaaccttacaaaggcccttcttaagctcactcagngacccatacccccgaattttcggaaaacaatacaggctttggtcatgcttttacaaaaaaaacaaacgccccgccgagactctaaaaagaaggttttgggccaaccttcggttttcacaaggtggaccagttacccaggaattttttgggttttaaaaccaaggaccccatttggaaggggtgattttaggatttatttccccgggatataaaaag

SEQ ID NO: 6534 - DNA, 1187 bp, Aspergillus oryzae
gggtagtggagttcttggtcactcatccggctgtgtgcgagtcgttggtttccttgaatttgatgacggaccctacgcggaaccgactcctggaagaagatgacgtccatgcgctacttcccaaattgccttccactcttcgctccctcaacattggaggtgcgaaggtcacctcagcccacacgcaagcgctgatccccttgaccaaacatctggaagagctcggactcggttcggccgaactatctgctcaggacatcaacctattctttaaaccgccaccccgggctaacatggacgtggatggatcggcggaagtgaaagaagaggactgggtcccgccgacgctttgctatctggacctcaccaaagctcctcagctgtcgctgggaacagtcttcaaccctagctcgtgcttgctactttcgcagcaaagctatccgctgcaggtcatcgagttccacgagaagcttattgctcctttgcgcgagagaaccaagaatgcccggacatccctcggctggaccgttcgtgagctcggtcggcggggatggtacgttcgtgatccggcttccatgccccttcaggtgcccgatgacggttctcgctcctggaaaatgggtgccaggtggtggggagcgagaaagattcccgttgccattggggaggtcggcggcatctacggccactacatgttcaaaaaatgaaggcagaaactacctttgctgtcccaatccttcatgggatgaatgattataccctactgtgttacaatttttgtttgttggtggcgcgctttgttcatctatttcctctcctatcatgggcgcttcttgtttggctatatccgggcaaattgtacagggaagcatgagcgatcaaaagtcggtggattcgatgttatgcctcatgtttagcttttgcttgagttgtctgcatagcgggagcgatgttcttttgagcgttaggatttgtctgagtgtggtcttgtgtttacgtattttctggtgttggcgatatccccattcttctggttgcgtttgggtatcacttgcttttgctcatttgtttcattgtttggcaaggcgaagtatggctgtttctgatattactgtattctggtcgcgtcgattcaataatgcattcaggttataattagtcgtaaaaaaaaaaaaaaaaaaattcct

SEQ ID NO: 6535 - DNA, 722 bp, Aspergillus oryzae
  misc_feature (1)...(722): n = A,T,C or G
gtatcaacctttattctccgggctggaagctctcgacctgtccttagtggattcaaaactcgccatattccaccctcgagacctgtcattaattcttcccgatcggtcggtcgccgcgattgctcaacggttactccctctgtcgtcattcctatatataccacccccacgatggattttcatctagtaccgcgcggcgaagatcgaaactacacaggctttctaacgaagaccatcgtctacacatcatccttggttgtttttctagcttcattcggcttaaccgtatcctccattgtggttccaaaatggatcagctatcgcaacgatcagatctggtattcatacggcctccatcggcgctgttcctcagtcaccgatgcctgcgttagtttcccccagcaggacgattgcagtggccgaggccgctatttctgttccatgtggcgctccgtgggcttncttatgtnctttngccgccgtcttgaaggcatgagtatccgcccatacctgatcatattggcttgtgggaaccaacttgcgaatattggtggaagggtttaatttggtagatcggtatcggctgtggccaagcggcagcttgtcttggggcttattattacacattaacgcggttttccccgctggaactgacaatcctgatnattgacctatactgggcattactggtttgccggtgccttattgtgccgccgggctcn

SEQ ID NO: 6536 - DNA, 801 bp, Aspergillus oryzae
  misc_feature (1)...(801): n = A,T,C or G
gagggccaccgaggaggattatggacgcgaggcaccaccccttcgatgtgttcaccggctcgcttctgggcattggctgtgcctacatcgcataccgccagtactttccctcaatcacagagccttggaaaaagggacgagcgtatccgattcggtcttggggtagggatccggtcgtcccaagcgaagctgcccctcttgtgaccaccaacgaaagcactgtggctctgcggaatcccgaggaggaacgactcaatgcatctggtgtacctgacactagagaccctactcaattacgcgcatcaaggtatatgcctccagctaacaacccatacgccactaatatgtatggccgcgatgacgacggacattggtcgtcttcaagtgaggatgttgccgatggatatgaaatgcaacatggttacgctcggacacagaatccgacatacggcggacagcttcctcgctacgagactgatacatcatatcactcccagatgcaacccccagttacaggagtcagcgtgtcccatccaccggcgataacgaccattcgctctgatggtgaaagggatttgacggacgtgccaccgcgagcattttaagaataaaccttaattntaagaaacatttttggctacagccagtggcacgaacattatgacttttttttgatcagacatgggggattaggaggacctaccaattttattactgggtgggttaggtattggcattattgatacccctggaacttgcttggatattggttaggagagaaaattccgattttttaactcc

SEQ ID NO: 6537 - DNA, 664 bp, Aspergillus oryzae
cgtgactgcacctagcccggtgaagaaaaagcttagcttgggggactatctcatccggagaggcactctcactactcccacctccgaaaagtcccaaactcaggccactccgatgcctccgcccaaatcacccacaacgcaaccccacatgaaccgcgagttatccacagttggtaacaacgaacatgcacaaccccgggccatcggagaaggcggaagtactaagtcctcggatgtcccgatgaaggatgtctctgggccgacacaggcttcccagctatcctcgctttcctgagatgccagaccaatccctcatccaagctgcctcctgccggtggtgatggtagtgacagtgggcaatgtgttatctttatttattatttgaatctgtacacgatgggaattggcgttcaaccggggatatgtggtggctttttgggcctaactcttttttctgggtcttttttcccggtttgtgacggcgtatcaagcgtggggatgggaaggttgggaaatatactctgggatatgaacggcaaaaggttgtatgggggttaagtcaccaacactcgccacttatgtgccccatcttgcttccgaaaatctggataaaccgggcgaattgggttccatacccatttttttattatccccaaaaaaaaaa

SEQ ID NO: 6538 - DNA, 663 bp, Aspergillus oryzae
ctggatctgcaaagtatcaacttgcggaacgtgaagcagctatcttatctggcattcataacaatgccaaaagaacggaccacctgtggcattcattgcacagtaagacggctgaggctcggatatttttatgccgtgaagccgcctacctttataatctacagcagaaagtcaaaaagagagatggtgaagttaaagaggcatatacaattggtggcatacctatcatagatcttagggacatgaatggtgctacaccgtcgcaaatttcaacgtcattctcctatattgctcaactcctagtacttgtttcacattacttgtccctaaggcttcctgcagaaatcacacttcctcaccggaattaccctgcgcctaccatatacgcaccctctgggtcttatctcttgcgtgaaatgttacccgcatcaagtacgttgcagccctcgccttctagtttaacaccatcacgaacagcggatccgcggtcttgctttccccgaccccgaccactctccattgacagaagtctcccaaaactagccagggaagatccccgtacatacgctctctttatagagggggcgacgctattggcttggaatatttcctggctttgccggactcaaggactccatataacgtcagaatctttgggaagag

SEQ ID NO: 6539 - DNA, 577 bp, Aspergillus oryzae
cgggggcaaattccctttcaatcaaactgccgacccaagggaaaaaattctgtgcaaacccagtttacttagggcaaaaaaaatcaaaaaacaaaacccaggtaacttttttgacccatttcccaatccatccccaaatccaacccaaacccacttttaaaatccaatccaaaaaaaccaaaggggtttcctgcccaaacaaccaaaagggaaactttcccaataacaaaaacccccccccttttggtccaaacaaactatttaaactcgctccaaaaaaagtccagcaaaaacaatttttttaaaagaacccaaaatgtccaaaacaggctgccaaattaaaagttatgtcggatcagtcattaatttccccaaactccctggggaacaaaggaaagtggattgaatgtaaggacctcttgaatgcattcaaaaaccattccagggattttggttcactgaccataggctggcggggggttttcctcatggtaaggaaggccccaaaaggcccccccccaaaaactggtgggcttaaattttttgtcccgattgcaaaaaacaatttcccttttcg

SEQ ID NO: 6540 - DNA, 660 bp, Aspergillus oryzae
  misc_feature (1)...(660): n = A,T,C or G
acgaatttttttttttttttttttatatatttttaacattccattcacagctatcattccaacatacatgtatctgcgagtgtcactctgaaagtgacggctgccacatccgatgactgtcctgtctgctgttctcactcgcgagaacagagtgccgtccatcagttcatggaccacttgaccttcagtccgaacgagaccatggtcgggacaaagacaaggatgagcgccagggaagaagagaagaaaaggtggggggttgtccggaaacgaaaggaatgggaggacaccgttgagggatatggaaacatccgagcgtggtgaaacactgggaaattgggggggtatcaaacaaggggcatgacgtgtataggattatagaaacaggacttgctcgggaattttggaaatatggcttttttcttttttttgcttcttttgaatctctagcgtacgggaggtccgcagtccagggcgaaagtaggcccagtatcttcgaggaaaagtcgaagtcccgaaattccacaagggaaagcaaagggggagcggacagggacaaagcaaagattgacagaggggggaagtaaggaagtgaggaatgacggggaatgatgggaggtttcgncaataccaaggcgggcgggtcttcttgggcgggta

SEQ ID NO: 6541 - DNA, 707 bp, Aspergillus oryzae
tggtatggcacgactgccagtgccaagctgcataaactctatgatgcattctatgctctgcccaccacgccaaactgagaacccacgctcacctttattatcttctgtggctccctcccgagactctctcgtcagcaacacactctccactcttgctatattggagctcaacctactacaactgaccatcactgccgctgtgactgctaacctcatctgtgcatgccatgagagcacacacaatgaacaagaccaaatcatcagcgatacgcaatgtatgcacttcaggcctggagtggcaacgcggccagtctcagatcctcccccagtgaggcatcggccaacaccgacccggtcgccttcagcttcgatactacttgggacggtggctcgcccatttccaccccggcagcccctccaccaactcctcaggactctctgcttgatattacccctcgcaagtgctctttctctaccgcctttggcatgagcaacgcttgtgctttcccctcctggcccaaccgaccggctttgatcagcacggacaccgaggtttctactggaagcgcctacatctcggacgaggaactttgcttcgatttgggaccccagtccgaatccgccgtggaagaagagtcggccgtggaagatgccgtccgacctggtgacctgacgactgaacagcagatccagatgctgcgcgccgc

SEQ ID NO: 6542 - DNA, 673 bp, Aspergillus oryzae
  misc_feature (1)...(673): n = A,T,C or G
ggagaagttcgcagtccatgccgagtatggaaaactattcatcttggtcacgccggcgacatgtgagctgtacgtggcagatgtggatgccgcaaagcaagtgctttcacggtggagagactttccaaaaccaagtagtctcctagaaaaaatgaatgtctttggcaaaaacctagcaacggggccgactggcagcgtcaccggaaattgaccgcgcgtgcattcaatgaaaaactacacgaggcagtttgggccgaatcgacgagaaatgcgacaaaagtgatgacgaaatggaacaacaccaagcctgtctacagtacacggtccgatatgatggcactaagcctggctgtgctttttaaagcctgtcttaatattgatggagatgataaagacgatactaggatattagcaggtgatgttgctgcctgtcaatggcatctggatgtggtattaaaggggatatcgaacccaatggctctaggccgaggatttgagggaataaagaaactcaagaggagccataaagccttgggggagttactgaccgagtttgtggaagcccgaacgatacgaccaanactgtcggcgcatgcagacctnctctcttcgatccttgctccaacagatcatcgtgggctatcgagcgatgaagttacgggaaatctctttt

SEQ ID NO: 6543 - DNA, 705 bp, Aspergillus oryzae
  misc_feature (1)...(705): n = A,T,C or G
taggtcaataggagaggtaggggaacctgagcgcgttacggatgcttaagaccgccgctccattcctctttactacgctgagtcctaaaactctggcgctggaatactgcattcgtaaatcggatgacaaaattacccatgaagactttattccatctactgatcctatttgcagaatgttgatcggttgcccaattaatccttctctccgccatatacttttgtttggccctcagctaagccagcgtgatgtacagccacaggtaggaaattcgtctcggggagaaagagaaatctgcgtgggagcaagcacgaactatacgatgcaggaactttagtcagcctgtatgaaaattgcatcccacaggacgatgaccggctggatggactcaccgaaaacaatcatagcaacggcaaatcagccgagcggngaggatccaaggctctggggcgacaagatacctgcaagatgcaaatgaaaatggggctagcctggacaaggttatccttgactaagtgagctttgcatgaaaacttccaatcctccctcacaagattagcgatctcttttatcgccccccccaacaacctttagaaagatgacaggggttaatcactgatcattggaacgggtatacccaccctgatatttttcttcaaccaaaaaccggggatccccattggagaccaatccccaatttgccg

SEQ ID NO: 6544 - DNA, 560 bp, Aspergillus oryzae
  misc_feature (1)...(560): n = A,T,C or G
tgggagtacgactctgtccctagtagcgggcgggagtgtgctggaaagggtttaattcgcacccgttattagtgttttctcttttttctgcaagcctcaccaaaagagagatgctgccaaattattccgcccaacgccttttttttcaatcatgatttctaactactaaatttcactttctacagatcaattgaaaaataaaaacaaagaaaacctacccatttcgctaaatttccagaccaaaaaaaaaaaccaaaccaaatccatcccagcccctcgccaattgccccccaagtttcgctaattcgcgttgaaagctggccagttcagccagtcaaagttgttcatgtcctcccacgacatgttgctgccaaaggatggctcaaacacattgcctggctggttcagcacctgcgcaatctggtcgtccgacatggtggaaaactgaaccatattcggccacagcattctgtgggtcattgaagcttctcggcagggcttgggggcgtgtcctgcatcagctccgatgacgatggcgttgncctttgtgcttttggcgg

SEQ ID NO: 6545 - DNA, 665 bp, Aspergillus oryzae
  misc_feature (1)...(665): n = A,T,C or G
tcggaacagcctcctcacgggccagcactacaacaacctgacccaatgcgaaacaatagatgatgtcaaactccagctcgcccccgcatacggagacttcctcgccgcgcttcctcccaacccctctacctcagcccttgccggcaagatgacggataagctggtcgctgaattccgctatgtgctcacccaggccacagggtcgacggccagattcctcgagtacctgacttacggctatatgatcgataacattgctcttcttatcaccggtactttacatgagcgtgatactcgtgagcttctggagcgatgccaccccttgggctggtttgagactttgcccgtactgtgtgtgggcacgaacatcgaggaactttataactcggtcttgattgaaacaccattggctggctacttcaagggcagcctcagccaccaggatctggacgaattgaacatcgagatcgtgcgcaacaacctctacaagaactatctcgaggactttctacagtttgtgaacacacacccagactttaagggcactcctacacaagaggttatgtctgaacttctgggggtcgaggcagaccgccgtgcantcaacatcaccctgaactcgttcgggacagagctttcgaagcaggaacggagaaagctgtacc

SEQ ID NO: 6546 - DNA, 680 bp, Aspergillus oryzae
cggcgttcgggagtagctgtgctagccttcgaagccttttgaaataatgttccgacaaagtattcggcgcttcggcaccactgcgctccgcgcagcagaaggatcgaccgcctatagcgtccgggtgtcgcaagctcagggctacgttaacggtcttacagaagcaattggaaacacaccacttatccgattgaagcgcctctccgaggagactggctgcaacatcctcggtaaagctgagttccagaaccccggaggcagtgtgaaggaccgtgcagcattgttcgtcgtcaaggatgccgaggagaagggacttttgaagcctggtggtacagtggttgagggaacagctggtaacactggaattgggttggcgcacgtgtgtaggtcaaatggctacaagcttgtcatctacatgcccaacacgcagtcccagagtaagattgacttgttgcggctgttgggagccgatgtctaccctgtgccggccgtcgctttcgacaacccgcagaactacaaccaccaggcaaggagacatgccgagtccctggataacgccgtatggacgaaccagttcgacaacactgccaatcgccatgcccacattgagatgaccgggccggaaatctgggcccagactggcggacaagtcgatgctttcacctgtgctactgggaccg

SEQ ID NO: 6547 - DNA, 645 bp, Aspergillus oryzae
  misc_feature (1)...(645): n = A,T,C or G
ccaaggccattcaagatggtctttcatccttgaacccctttcgctcgcagggctttcactgctcagctcctccgccgcaggggaggcttttgaaaagctgtctgccgttccaaagggatggcactattctagtacccctaaaggcaacactgaggtttgtctgaagatcgccctcgcgcagaaggatgctgctgggttcgaaaagaccgtcttggagatgtcggatcccgaccaccccagctacggccagcacttcaccacccacgacgagatgaagcgcatgcttcttcccagagatgacaccgttgatgccgttcgacaatggctcgaaaacggcggcgtgaccgactntacccaggatgccgactggatcaacttctgtactaccgtcgataccgcgaacaaactcttgaatgcccagttcaaatggtacgtcagcgatgtgaagcacatccgccgtctcagaacactgcagtacgacgtccccgagtcggtcacccctcacatcaacaccatccaaccgaccacccgttntggcaagattagccccaaagaaggccgttacccacagcaagccctcccagttggacgtgaccgcccttgctgncgctgtcgttgcaaagaacatctcgcactgtgattctn

SEQ ID NO: 6548 - DNA, 596 bp, Aspergillus oryzae
cgaggcgatttcggccacgatctcatctcccatatctacgcggctgacggcagcgccgacgtaatgcgcgatatcagtgcatccggcgagccggcgattccaaatatcacagacctactgaacccgaacatcaaagctgttaacatgaacgagctctgggacacgcatctccagaagtggaattaccagatggagtaccttgagaaatggcgggaggctgaagaaaaggccgggaaggaactggacgccatcatcgcgccgattacgcctaccgctgcagtacggcatgaccagttccggtactatgggtatgcctctgtgatcaacctgctggatttcacgagcgtggctgttccggttacctttgcggataagaacatcgatgagaagaatgagagtttcaaggcggttagtgagcttgatgccctcgtgcacgaagagtatgatccggaggcgtaccatggtgcaccggttgcagtgcaggttatcggacggagactcagtgaatagaggaccttggccattgcagaggaagtggtgaagttgcttggatatgtggtgactccataactaataagtgtcagatagcaatttgc

SEQ ID NO: 6549 - DNA, 1112 bp, Aspergillus oryzae
cctctccttcttcctggctattgtgccttcctgattatccattgatcagagggttcttgatatcatcagtatgctggcacgtactgtctcgcgcagcgtgcccttccggggtatcgcacggcagtccttgaacagagcatccacgcgtgcgtcttcttccgccgccggtgccgaatccgccagctcccccttccacctcacagtcactgcgtccgtcgcaaccgccgtcgccgtcggatccgccgcctatctctatggacaggaagcttttgcatcgacccctgctgaagaagggttgcaccctaccaactacccttgggaacatgccaagtggaacaagaccttcgatcatgcggccctccgtcgtggtttccaggtctaccgtgaagtctgcgcttcctgccactccttgactcgtgttccctggcgttcgttcgttggtgtcatgcacaccgtcgatgagatgaaggccatggctgaggagaacgaatacgacaccgagcccaacgaccagggcgagatcgagaagcgtcccggaaagctgtcggactacatccctgctccttacaagaacgaggaggctgcccgggctgccaacggtggtgctctgccccctgatcttagcttgatcgtcaagggccgtcacggtggctgcaactacatcttcagtctgttgactggttaccccgacgagcccccagctggtgccactgtccaggagggcatgaacttcaacccttacttccctggaaccgctattgccatgggtcgtgtcctcttcgatggtgttgttgagtacgaggacggcactcctgccaccacctcccagatggctaaggacgttgttgaattcctcaactgggctgccgagcctgagatggacgaccgtaagaagatgggtgtcaaggccattgccctccttaccggtctcttcgctgtcagcgtctgggttaagcgttacaagtggtcttcgatcaagacaaggaagattgtgtacagcccccctgtctcccggcgcttaatgatacaacggactatatgaattgcaaaagggagagatcggcggccagagaaccttgaaaataatcgacccccgccttatatggttgggg

SEQ ID NO: 6550 - DNA, 673 bp, Aspergillus oryzae
  misc_feature (1)...(673): n = A,T,C or G
cgacacatgcagttgatttctctgccatttacgaccaagaagcgcaggcgagagcgaaggctatggaagagagtcgcaaggccaaggagaagaagaaagcagagatcgagcaggccaaagtactcagatacgcgcagggtgtcggtaggcagtatcccggctccgcggctccccaggttgttccgagcccgtcggcggagtatcaggtctacctcaacgatatacctttccgtgtctcacgaggtggtagtaaattgattagagtgtctgatgatccgaatactgtcaataacaccccaaagagagtaaccattgccggcgttacctttgttcggagcananatgggaacctccatcgcctttgtgcggttacttcgaanaggaagcccaacgcaactaagaagaatgagcttttgccgcagattcactacgaacggtacctgctacaaaaggcctttctggctatatgttcatgaaccaaataaaggtcgcgctgggccaagactttctccaaactggggattgccccgcaggtttaaattgggatcttttccatgaaccttcgccccacaagatcccttctttgattgcttttccttcgagggggcttgttcaacccggagggcgcgaatgccccaattcggttgataccttggggaccccttttcaaaat

SEQ ID NO: 6551 - DNA, 662 bp, Aspergillus oryzae
ccatgatccaactaaaagaccttccccctccacctccatattcagggacgcaaccgtcttccttctcagattgcccctacgatgaagaagccgcctctgagtcaacagagcctgaaggctagaattcgacccacgaaatactattcgccctggcgacacccagcgttggtggtcacgcaacgtaaagcgccagatcttttgtttgttctgtgtggtcttggtggtagcggcgacaccatatgtggtttttatggttttaatgagccagtggaggttctaggtcccggaagacgtctcttacggtatcttcaaagcacgccgggaggtgctggtctggggctagggagagctgtgatacgttacaggtttatggtcgacttgtggcgacccatgagattctttctatggtcgcattttatggattaggtgcgcgcagccaagattgcaggaaccccgatggtgggagatagacacataccttatgcggtacttcaacaccagcctctcccaatgctgttggttttcgggtgatttgtggtcccggttctcccctgacagggttaaaaagaggtcattcggatgacaaggaggaccaggagcaaaccagtgcggagagttcatactggagacggttaaatagagcttcatcaggaatttttcga

SEQ ID NO: 6552 - DNA, 745 bp, Aspergillus oryzae
cctgtctggttcgaaccctctgaagatccaacttcagaagtgcagcacagtatacagatcgcacatgcttatcgctgggcaacgattctatatctccatcaagctgttccagagatgccttgtgagccggcgtcagaactcgccaagcgagtattactgctgctggccaccgttccaccgagctcccggacaacaatcattcaaatgtttcctctcttagccgctggatgtgaagctgatcaggaggaagaccggcaatgggtgctaggtcgatggagatccattcagactcgtctcatgctgggttccatcgatcgctgcatagacgtggtccatgaagtttggactcgtcgagaccagtttgaggccgaaaagcagcggcggcagttccgaggggcgggtcgttccaattcccttgacgatcgggaaccggtgggaagagatggattaccctacaaaaaacatggtacacggggatctaaataatcccgccatgtttgctaaagagtcatacagaagacccgcagctgatgaccgggcgatatccttcaggggaactgggaaccccacgggggagttctgcggttttttcccttgaaaacatcgaatttgaaaaaccgttaggggggatttacattgggtcagtgttttgcaagaaggggactgggaaatattttttggggaaaaaatccccgaacgaaagaaacatggctttattcttcacaccctgtaataaacaaccctg

SEQ ID NO: 6553 - DNA, 675 bp, Aspergillus oryzae
  misc_feature (1)...(675): n = A,T,C or G
cgcaacgacaaacccttcccgactacattactgcacaccccccctgccctgacctgaccggacctgccgtgcaactaaattaaagcggcattgtccaccggtgatatttctcattccactacagactgtgtctccgcattgactcaacaccaccatggggtcttacagtgtatcgtcgcgacagcacagtgcgcggacgggaggaagttcgagctccacttacagtgatgcttccgatcgttcgaaaagcactgcccctacgatctatagcgagcggcccacatcaaagcggagagagaacatggacccgaaagattcagtatcgacctacgcctcgacgaaccacgacgacgaactaccgaagaagccgcgctatgaggtggttactcgcggggccgagtcagatattttcccttcggatgcgattccctcgaattcctccacttttgggaagttgttcccatcttcgcgacggctgcttatcgggcatgatgatacgaccctcgatgggaacatgaacctttgtgtgcacacncctgcgccacggagagatggctatcagcangccgttatactttttcatctccgcatgtacgatttgtactcaagagacttttcgtttcgccgctactgtcgcaattccgagcgcgaggtgtgtcactcagcacgaagacc

SEQ ID NO: 6554 - DNA, 520 bp, Aspergillus oryzae
  misc_feature (1)...(520): n = A,T,C or G
caacgtgacgccgcccgccacgctcattacatgaagagcacaatggtccagtcgcagctgcaggatctcgaggagcccaagggcgaatgggatgcgctgaccattgatgctcatgtgccacaggagcaggttatgcgggaggttctggaagcggtgagggataagcttgctgagtatcagtagcttgcgttccctctctctctcttttgcccgtttctttgagtctcccccgctgttctttgtgagcgttctttactactgctcttgactttggttatgcttcgagaagctttggttatgcatggatgacctcccggtctggtgtctgtggagtttattatcttgccgtggttctacgtgttggaaaatgtttcgttgaaactatggatggagttacttgttggattcgcttttcctcttgtcatggtttataaatattatacctattgtatttgntagatctacatatgccttgtcgtcttgttttgggacagagcttccattatttttggaataagtt

SEQ ID NO: 6555 - DNA, 629 bp, Aspergillus oryzae
  misc_feature (1)...(629): n = A,T,C or G
ccgccgaccctcacggccgtcgagccaggcggcgtcgcctagtctccgaccgctgtctgatgcaccccgcgggccggagggacctgagtggatcgcgggcaccagtgagagcccagcacgacggagcagccgcgacgaaggtgcgttctaccaggccgaagccgcaatgctcgcgagggagaatcaaattttgcgacagcgcatccgggatttagaacgccaggtgagtgagttgagcacttcgcccactcgaggtggtgtgcggtcgggcgagatcgccgcaactcctgccacagaaggcggcgcaactgccgatccccatgcgactgttggagtgagatcgaccaatgaacccgcggataagacctgattggacaaatgcaatacctgcatcgggggacggagtatttcacggtgtgcttctccagatttcaggacgatcaatacggagtacatatctcttacagcgggcaaccgcagttcaaggttatatgcattgtctctttatgagctggctcccgctctggtcgtatgcgtgccatctaaagttgtctatacgaaccagcgatccgagcgcgagcctacaggcatcccgccggatatgaacaatcttcacacctaatcacaan

SEQ ID NO: 6556 - DNA, 643 bp, Aspergillus oryzae
  misc_feature (1)...(643): n = A,T,C or G
caatatcaagatatagtactttcttgaagacgtcctgattctcatctgtttaatatacgccatcatggccgacagcgaaatatcaccagaaactatactatcggagctctccacgactccatatgtctgctcatctgttgagcaattaagcggtgggaccgccaacttcgtctttcgtggcactctgcttcgtccacgtcaagatggaaccacaaccgttgtcatcaagcatacagaggactatatagcatcaaatcgcgaatttaaattatccgcccaacgctgtctcatcgaaaaatccattttaacctcacttaataacttccccagctcgaaaatcacgaacgatgaagacgcaaccagccaattcacggcaaaaacaccccatatatactcattcaatccgctcacccacacccnaagtatggaagaatcttctgacntcgtagatctaaaatcattttttgtgtcgcccagctcagctcgaactgtgcccccgtgaatgggcggtgtctcttggccgggcattgnggcactgggctgagtccttcattcatggcccaggagccacacaggctgatgtgctctggaataaagcanaacccactcttncggatttgaagtcagcataactatgataatt

SEQ ID NO: 6557 - DNA, 664 bp, Aspergillus oryzae
ttttgcgatttactgcattatgacttgcacaatgttacatttggtcgcgataacctctcctgacccgaacttccacacagatgcgcgtgattattttgctcgacacatgcgcatcctcgagaggtgctcttctgcttggccgatgccagaaatgcaagcacagatcgactccttgcggctagcattctcggccgatgtgaatagacccttcgagcttaagcccacatttccttatggaagtccttcagagccataccatccgagcccgccgcctctcgactcacaataccaacctcatgtaagtcaggtttctggcggcgtccggggtcgggtgggttacaacccttatccgatcaccccaccaatatcagctagtactgaagattcaaagtccgattgctcccagctccattctctggggatgatgccgccccagcctgtctcgagtcaatcattgaacgcgcctctcgttgacgagaacagctgggatcccacccgtataattactcagtgggacatggcattttccatggcgccttccacagtgaatacaaactcttccccaatggctatggatcattcagttcaagcgcctttggcaggacaatacactgtccagtatggacaaacaacaaaggttacgccagtcacgccttctcaggtt

SEQ ID NO: 6558 - DNA, 653 bp, Aspergillus oryzae
caaatcttttcagtcaattataagtacttaaccagggagacccgagcgaaaatgaagaccttcttgcccctcgtttcgcttctgatgggcgtagggatgacttctgctgcccccgctctaaaggtcgctgctgaacgcgacgtcaacccggaaagcgcacactcatttaagataaacgcctacagttctcctccctctgatggtcaggttaatgatgccttgcaccgcagggaggtgaccccggaaggtgcaaatttattcatcattcattcttatggcaatccatcggaacacaaagtcgatgatgcgttagagcgccgaaacgaggacagtgtcgacggcgcacgtatcttcaatgccatcgagtcctatgggtcttaaccatgtcgaaacttgattatttttatgcagcgcctggaagagtgatggaccttcggactacccggtttattctcttgcgagtgactcctggggacagatatatgtttatcggggttcctgggcctcggcctttattttggaactgcaagccgggacccatagttatcttaattttgcgggcgtgttgaactcttgatttggaatttatagccgaccaaggcgacttaagcttatctttcctgggggtatataatggtataaaatcgctaccg

SEQ ID NO: 6559 - DNA, 582 bp, Aspergillus oryzae
  misc_feature (1)...(582): n = A,T,C or G
cgagggcgactgagcttcttcacccgaagaagaaataaatgtcatactcaatacctgacaaggcatagtgggcattccggcggagatgacggggccgactgtgtacagccactgtaagctcctgttatttccgacacggtcgcaacgcggggtgaaccaaaagattattaatagcgtttaagtcttggctggtggagtcgggcttcaccctgtgatggccttggttttgattgaccaaggaactgctggtgtttgtatggactacgcgacgtggttaaaggaggacctgacaaaaattgactagcaaacgaggcttgaccatccagtcgtttcgaaaacgtcattgcagtctcttgattgtatgccgtgacgagcgtcaagaatggatactacgtctacagatgtagattgcggtagcatgttggtaaagaaataatactgttggaccctgctctttcgactccaccagagcggctaatgtgcctgcgccttctggcattaagtttggagattctcaatctaagtgccctactttttgtgctactcgnaaaggaattaatatgggtgaaaatttcctgctga

SEQ ID NO: 6560 - DNA, 661 bp, Aspergillus oryzae
  misc_feature (1)...(661): n = A,T,C or G
cggtttattatcgggttcctagtttaaacggcaaaaatcgctgcaagtccacgcgacagatctttgtgcaaaagggtgagagagtgaagattggggagccggtcaaggttagctttttccgacaggttgcgccgggagcaaccctgatgtatgaggatattctgtacgcctgcgacgaggatgtctgccctgaatacacgaaagacccccggatcaaggaggtcgtgacacttacttcggatctctcgcgcaagaacctggaaaccgatttcgagcgcatggatacccctcagggagtcttctaccgtgtatacttcgacatctacctcacactcgatggcagtgaattcagcgccgaactcgtctgccagggcgaggttatgggccgatgccgagccaaattccggtaaatcagacacattcagattctgatgctgggtatataaaaaatcttaaagccaaccgacggactcggttggccggcaactgcacagggcgggcgtttataccatctttctcatccattccccttcgaagccgctgggcaatgttgtccagaggtccaccatggagtttacctcttattcttaccttatgttccctcatgtttgatgtttcctggatacctttatatgagctcaccttgatgattggttgattn

SEQ ID NO: 6561 - DNA, 665 bp, Aspergillus oryzae
  misc_feature (1)...(665): n = A,T,C or G
taatacgttatcccctttccaatcgcattgcacggcgttttcggttttgtgtgttcgagtttaccctttctgatatccattatcgtcactccttttctaagccgcggcgctgggtcaattatcatgtcttacgtgctgggactattgtgagttggcttcagcgtttttttgtttgatgatcattcgtatgatccgatgtctctccttttcaatattcttcatgtcttaatgccccatcttttcgtcatttaaaacctgttgacatgacgcatcttagacgatctgttgtccgttccctttagcatttgcattatatatgggcattgggatttcactcctttccggcagttgtacaattattttggcatagcatggcgctgctgtccttccttttggtttcgcaggtctgggtatttgggatttctgggtgggatggcgaaggaaaagtgtgcaatgtgttctgtttcaatttccgatgcactgtggttcacttgtgctcaagcacactgagactccaggcagacttttgtgttctttacttaattgggcgacctcgatcgggagaatcactatatatgcttagctttgcgtttgggataccggttcttgattggtggtggttgatgatccctccaaccctgggtacggatgattggaaaggcttn

SEQ ID NO: 6562 - DNA, 687 bp, Aspergillus oryzae
  misc_feature (1)...(687): n = A,T,C or G
ccgatcatgctccctccaacccgcccgcccagcctgcctcgaagcaagcgccaacgcagacagccttatcgacaatggagaagctgaaggtggtcggcaacaaaattcgtcgtccttctcgggcctctgaatcccacggtgtaaagacgggtcagccgcacaggaaagcgttagacaaaataagtggcttcttcaaccgtcgagcggaacatggccggcccaaatcaagagctgccgaaagctacgttccaccgggacgcccaaatccggcgagaggcccattcaatggaccggctttatcccgtctcatcacagcgcacgtccacctcagaccactctcatcttccctccgccgagtatgatcggccccgatcaaatatcgagaaccactccttccagggccaacctcctcccgtggaaggatacttcgcgccggagtccttctcgcggcttaacgatccccaagacctcgtaccccctggacgcaacagatcactgtccgagactgtggccgcgattaccatcacgagtaatcgcattccggggccgaccgataatttccggcatcgacacagggggcagtggaagcggaaatgggcgactcacttccccaatcacccgctcttccgaccacccacaaacccccaaaccccccatataaacaaccaccgatcgcatcccccgggn

SEQ ID NO: 6563 - DNA, 584 bp, Aspergillus oryzae
cgaggcaaccctgatagtgcggcagtcacgatatccgacaaaagtcagacgagccaagactcgaacagcgagtactcagagtcacagtcgcagaggtctgttcattccggaagctctcgactcgttcgttcgaattctttagggtccagtatgctcagtattgatcaaagcggcctaatgtctgatgctcgatctggaagtgaagtcgacgtggatgctcgttgggagcaatctcgtaggattgtgaatcctccatcccggcctatgacttcaggcaccgcaattgcccgttccgaaactaagcgctgggacggggctgatgagggtcacaaaatgacgatccgtaactttggccgcaaattgatgccgtcccgaaagtaactgtccaacagaaaggacgtgcatatggctttacaaccatgtcagatcggtgaaataagctgagctttcctgaccatttatcctttttatcctacattttctatatcacactctcgtgacctgccattttctgctacatgataccccagatgctatgggtcgtatataggcgtcatctgtttcactggcttcatattataaaa

SEQ ID NO: 6564 - DNA, 661 bp, Aspergillus oryzae
ggaggtagactccataggaatcgcgacaccctctacgtgtttttctccgccaacctttacacgactcatcacccccagactccgagcgtgtcttgcgcgatggccatccacccgacgttgagtcctcaatcgaatgcccagggaactttgtccccgcagcaagcccgggcgatatcggcttggtcagaacaggcggctgcgcatctgggaaatctgaccatctcggattccgttcctgcggccgaccagcatcgtgctggtccggagtccccttccacacgcggtgccttgcgagggaccacggttacactatcaattccactggatgacccggtccccagcacggggaatacatctgctccgatggtcaaactcctgggtcagccttctgcccaaaacagcaagtcccttcggtcagtttccggcgccgagaaccactccggcctgatagtttgaagatgcgccaggcgctgttgaagggcaagatggaagtcgtcgcagcaacgctgggagaccggacgtcttgaccgactggtggcgttacccaaaaatgcttttaccgaatttatgcccctgaaattcccggtgggcgaacatttttcaacagggttgccctggacgggcccctttccaaaagaacgcttcctgaacaaccctgggg

SEQ ID NO: 6565 - DNA, 662 bp, Aspergillus oryzae
  misc_feature (1)...(662): n = A,T,C or G
cgaatattcaggctccattgtggcgaccccaaagcccaaatttggtgctcgctggggaaccaaacaagcacagaagccggccggtctcagcccagcagagcaagcgatgcgagatgctttattagcaaagaaggccgcagaagaacaagagcaacgacgactgcaagaaaaagagctacgtgcatcacagcgtagagcggaatcgcgggccgattggaaccgacctccaaggcgacagaacaagcgacgtcctttcgacgatggggagagccgatcactgcagcctgataaagatctagaggtaaataccagacatgtaccgagaagtctgcgtgcttcagactggatctgcccggactgtcaatataactgttttgggaagcatcagacttgcccatgctgtaaagctgtccgaccagatttggcgtggccgtcgtggccttccaagaatccggcgcagaaaatggagagaacccgcagggctgaaacgcgcaaagctggcgcttcagaagaanaccctaaagattcggagactgggtcatgagatgctgttcgaaattgaccaagaacaaggtgggtttcgcagccattactagaccggaaaatggctttatgacatttatgactaattaggaaaaccacttggaacgccggtttgtgtn

SEQ ID NO: 6566 - DNA, 943 bp, Aspergillus oryzae
  misc_feature (1)...(943): n = A,T,C or G
gtttccttcttttaaatcaagcctttaccctcagaaactctttctttctcatttctctcgtatacttactttcccttcaatcttgggagttatccttcgttcctccattactagaccttcatcttttgaagacccaccgtctcttgaatacacattataatacaatctatatatacccatctacgaacctcatttgtccatcaatcagcatgtctttgacctactcggacaatcttgctcctcagccctggaccgatgtcttcacagacgacacatgtattgacaggcgcaagtgccaccggaccgtgcccatgaaggtgctggcactcggcgttggaagaacgggaacagcatctctccgcatcgctctggagcgcctcggatacctgaagtgctaccatatgatgtccgctagtgtggagaaccctcctgactgcttgatgtggcacgatgccctactcgccaagtatgatggtgtgggtgagtttggaaggaaggaatgggaccagttgctgggagagtgtcaggctgtctgcgattggcccgcctgtgcttttgctaaagagttgattgaagcctaccctaatgctaaggttattctgactactcgtgatgtggactcgtggcatgcatccgtcatgaagactgtcttttggcgtgtgagcgatcctgaacacagctttgtttcgaacttcagctgggctgccagcatgtactaccctatgttgaacaagtttttcgagaccttcttccgcggggacttccccaacaagggcaagcaggtgtaccangatcacgtcgacgaagtccgcagcctggtcccacctgagcgcctgttggagtacaagatcagcgatggctggagccctctgtgtgaatttctgggagaagatgtccccgacactccattttccgtggaaatgacatggccgaattcttcagg

SEQ ID NO: 6567 - DNA, 728 bp, Aspergillus oryzae
cttggcctcagcgacaagccctctctcctctatctgctcaatttctcactttaatcctttcccagacctttgatttagttctaggtcgccccgcgatacattgtactaggggtcagagtctcactctgtattttaagactgctacctgggtagtttagcactcgtttgcctactcttgattctcaaccacagccactcattgttttcggtggtcggcctacaaggacccttgtcacagtaccaatattatcatggctagacatcactcgcttgattctgagagaccgatcatggccccttccactcgagcgtcgaaaagattttcgaccgtaagcgggaacccttcgattgcttcgtcaggcaccattggaagcctaccaagcggcgatcctcgtttggctgaattccatcacttgcgtgacggactggagcgcctggagaataaacctcttcagaagcaacgcttcgtccctactcccgaaaagagcgataacttgagcaagctggcgctgagtgcgaaggtggaacgagcacttgaccggagaatgactggccaggatgctatcatgcgcaagccagttttgaacgagaaggccgctgctgaatctacaagctcgtagacgatctgtggtctacccgataagtttcgtataaacgccttgagttgatatctatgtttggtccttaaatcttttcattttcattttttcttttctgagcacctggtt

SEQ ID NO: 6568 - DNA, 689 bp, Aspergillus oryzae
  misc_feature (1)...(689): n = A,T,C or G
tggacaagcagtgagatcgctgagccacatgcttgcccgcggtcctctggctatgctgacccccatacccatcagccaacatcccaatcatactagacgaaacatagaagaaatcactcgccggccgataccccgtcatagaccaattgagatccgagtagtccgcgcgatcccagtgcttcatcaacgcaaatagaacatcaaacgcataacccggattcatgtgaaaatcccgctgaccccgagtacaaagatacgactggacctgcaagccgcggacatactgatcgtccttggtatactgtgccttcgcgacacccggctgcatccagcgcttgtggtcgcctcgggcgtaaaaccgggccaccatatccaggaacccttcttcatctgccgaaaccccgaggatgtattccatgttctggacggttatgagcagacgctgcattgtggttgatgcgccccaggatgggtatttctgatgctgttggcatatccagcagtcggtgtcgatgagcgctgtggttgcggtctgttctttgtggtttcgggcctcttcgaatgcgcaggtcatataggagacgatcaggtgggtgcaggcgtgccagaatacgaccatctgacacatttgtgctgtggtgaggagggtatnncgctatgtgctgttccagtatttaggggagctggtg

SEQ ID NO: 6569 - DNA, 655 bp, Aspergillus oryzae
cagcattttgtcattgcaagcgctttacattgcagaatttttccccctcggcttccccttacttcaaaggttccttctttggatgttctgttgcggaacgtcgcattgagtcagtgttgtgatctcacccttcgttcactgagatctctggcgcgtccctcccccacacttatcttggtcctattttaattccagcgtccctcatccctcccgacgctgtctccgaacgccccgaatcggcttctttcgttacacatcccgtctccacggcttctcacatccccgccggttctcattggcaagcgcctgctccggctgagtcaacctaggctgaaacctcccccctcgccattgacccttcatttccggtcagggacacaagccctatcagtacctgcaaagccgtgaggaacaaaccgtgggctctccccgaatctcgaatcatcccaaactggggaggaatcagggtggctcaacgtactttgaaacgttccaaaaaacctcgcacgctgtacgcgatgcttaaaaagaagactctatacccccctctccacttctggcacagtactcctacatccactcctgaactctctcccacatcatcgtcttcggacagtgagtcaaacgaggacatggacctatctggctcacgtcc

SEQ ID NO: 6570 - DNA, 684 bp, Aspergillus oryzae
acgtcccaggttagggtcaagccagtgcggcgtgtgagggatttgtcacttccttctccggagaagctctcacgaagacggttgatgagacggggaacctccagacccatcagggcattgttaatactgttgcgagagaagatattgccaaagcttcccgacacaacgagcgggatcttctttgccagaatggcggtcgctgcctgctctctggagcttccacagccaaagttgaaaccagtgactagaatgtcaccttctttggcgatcgacgagaactgagcatcgtagttggacatgcagacctgagccattgtctcttgggaaacatcatcttggtaggtatatttgccaggatagataccatcggtgttgatgttgtctgcatcgcagaaaacaatttcacccgagacacgctctggaaatccagggtatacctccgtcagagaatcaccggatgactcctcactctcttctggagcaaactgcttctcaccatcggcaaccagattatcaatctggccgatcaatttctccaaggcttgttcggcggtaagcatgcgatcctcctcccgaattccgtctccttctccacgcacaacttcagtcaaaccttccggggcctggtaccagccgggcccgctgagctttcccctcgtgccgaattcggacagagctgattcg

SEQ ID NO: 6571 - DNA, 645 bp, Aspergillus oryzae
  misc_feature (1)...(645): n = A,T,C or G
gaggccgcgcagccagaatgaccttctgggtcgtttcgctatgggttaatttaaccacacgggtcaagagctcttgacctcaaattgtgccaagatgtctactgacaagattaccttcctcaccaactggcacgcgacgccgtaccacgctcccctgtacctcgctcagagcaagggttacttcaaggaagaaggcctgaaggttgctctgctggagcccaatgacccctctgatgtcactgagataattggtagcggtaaggttgacatgggcttcaaggccatgatccatactctggctgccaaggctcgtaacttccctgtcacctcgattggctctcttcttgacgagcctttcaccggtgttgtgtacctcaaggatagcggaatcactgaagacttccgctccctgaagggcaagaanaatggctatgttggagagttcggaaagattcanatcgacgagctcaccaagtactatggcatgactgcggacgactacactgccgtncgttgcggcatgaacgttaccaaggccatcattcgcggtgacattgatgccggcattggcctggaaaatgtgcaaattggtgaactggccgagtggctgcattccanaaccgtccccgggacgacgttagatgg

SEQ ID NO: 6572 - DNA, 664 bp, Aspergillus oryzae
ggtggtactcatataatttggactcgatttcccatctcatcgtgatccgatcccgagcagtttgacaaatcctcgcaatcatgaagttcttatcaactgccgcagcgcttctcgtctgcctcgcccccgtttccaccacagctcgaagcctcgacttcttcaagtcatcccaatcccctatccaagcacaagccaaatccgtcccaggaaacaaccctctggagtattgtaatgacccgtcgggcgatatcctagatatcaaacaggtggacttgtcacctaacccacctcttcctggcaaaactcttgccatcacggcctcgggcaccttgcgtgaaaagatcgaggatggtgcttatgtgcttttggaggtcaaatatggcttgatcactcttgtcaggcagacagccgatctctgtgaacagctcgtcaacgtagaacttaaatgtcctctgggaccaggtgacatgacattgaccaagcaggtcgatttgccaaaacagattcctccgggcaaatacactgttcaagccgatgtcttcaatagtgatggtgagcatatcacttgcctgaaggcccttaacattgaatttaagggtcccttctgagaggttgggaatatgtacgccctggacttagatatcgatatgctcaacctaagttt

SEQ ID NO: 6573 - DNA, 1028 bp, Aspergillus oryzae
  misc_feature (1)...(1028): n = A,T,C or G
gatattctcaagcgtggtgttggcatgcccgtcaacgaaatcgccgaagtcttcgacaagtggaacaagggtgtcttggactccttcttgatcgaaatcacccgcgatgtcctccgcttcaacgatgacgacggcactcccctcgttgagaagatccttgacaaggccggccagaagggaaccggcaagtggaccgccatcaacgctcttgaccttggtatgcctgtcaccctgatcggtgaggctgtcttctctcgttgcctcagtgcccttaaggacgagcgtgtccgcgctagcagcctcctcccaggccccactcctcaattcaccggtgacaagcaggctttcgtcgatgatctggagcaggccctttatgcttctaagatcatctcctatgcccagggcttcatgctcatgcaggaggctgccaaggagtacggctggaagcttaacaagccttccatcgcccttatgtggcgtggtggctgcatcatccgctctgtcttcctgaaggacatcaccaacgcctaccgccagaaccccgaccttgagaacctcctcttcgacaagttcttcaacgaagccatcgtcaaggcccaaaacggctggagaaacgttgtcagcaagggtgctctctggggtatccctactcccgctttcagcactgctctcagcttctacgacagataccgnactcgggacctngccgccaacctgctgcaggctcagcgggactaccttcgtgcccacaccttccgggttgagcccgagcacgccacgagacctaccctgagggccaggacattcacgttaactggacatggacctggtggtaatgagctcccctttaccttcattggttaaattaaacgaagatacgacactgggctggacgggaaactttcccttgggcccggatggtatatagaaaaagaanaaatgggaaggcttattaagctctcgggcgcattgaaagagttccatataattaaacggaagtcggtccttacccctgtattaaaaggaag

SEQ ID NO: 6574 - DNA, 740 bp, Aspergillus oryzae
  misc_feature (1)...(740): n = A,T,C or G
tgcctcgattcggacgaggcttcttgtacaatacctacatacaacgccaaaccccctctcaaagtatacttcacttccagaatacctaaatcgagttcaacaataacaaccaccaacaatgctcggtaagatcgctctcgaggaagccttcgcgcttccccgcttcgaagaaaagacccgctggtgggcaagtctcttctccacggacgccgaaacccacgtcaaagaaatcaccgacatcaacaagatccgtatcgagcacgcagacaagcacggtgtcggctaccaaatcctctcatacacagcacccggtgtacaagacatctgggaccccgtagaagcgcaagcgctcgccgtcgagatcaatgactacatcgccgaacaggtgcgcgtgaaccccgaccgattcggcgctttcgccacactatcaatgcacaaccccaaagaagcagccgacgaactccgccgctgcgtcgagaaatacggctttaaaggcgccctagtaaacgatacccaacgcgctggcccagacggcgacgacatgatcttctacgacaacgcagactgggatatcttctggcaaacctgcacagagctcgacgtccccttctacatgcacccccggaaccccacaggcacaatctacgagaagctctgggctgaccgcaaatggctcgtgggtccacctcttagcttcgcgcatggcgtcagtctacacgtgctccgaatggtcacaaatn

SEQ ID NO: 6575 - DNA, 679 bp, Aspergillus oryzae
  misc_feature (1)...(679): n = A,T,C or G
ccattcttcaattatactcagccgctcaataaaggttgtttgattcgacatggcttcttccttgagaatcggaacttctgttcttcgatccacctctctcgccggtaagccggtcgtgcagtccgttgccttcaatggtttgcgctgctactctaccggcaaggccaagtccttgaaggagacattcgccgacaatctccctggcgagattgagaaggtcaagaagctcaggaaggactatggcaacaaggtcatcggcgaggtcaccctcgaccaggcctacggcggtgctcgtggtgtgaagtgcctcgtgtgggaaggttctgttttggattccgaagaaggtatccgtttccgtggatacaccatccccgaatgccagaagctgttacccaaggctcccggtggcgaggagcctcttcccgaaggtctcttctggctgctgttgaccggcgaaattccctctgagcagcaggttcgcgatctgtctgccgagtgggcctgctcgttctgacctccccaaattcatcgaggagctcattgaccgctgtcccagcactcttcaccccatgggctcattctctctggctgacactgcccttgagcacgagtccgctttcgccaagggcctacgctnaggtatcaacaagaaggactactggaactacaccctcgagga

SEQ ID NO: 6576 - DNA, 1202 bp, Aspergillus oryzae
ggccgacttcatcgaacttaacacttccaggcaacgcttcttttcctctccccctctctctatctgctgctaccgccgcttgacctttcatctggtagacgactcctgtttctttcgtcttttctttcgtctcccctccttgaagagccttgcatttgtcaacagttccccctacaccgtccatcatgaaccctgaatacgactatctcttcaagctccttcttatcggagattccggtgttggaaaatcttgcttgctacttcggtttgcagacgacacctacacagagagctatatctccactattggtgttgattttaaaatccgaacaatcgaacttgatggcaagacagtgaagcttcagatttgggacactgcgggccaggagcggttccgcaccatcacgtcgtcttactatcgaggtgctcatggtatctgtgtcgtgtatgatgttactgatatggattccttcaacaatgtgaagcagtggctccaggagatcgatcgctatgccactgagggtgtcaacaagctgcttgtgggtaacaagagtgacatggaagataaaaaggtcgtggagtacacggtggcaaaggagttcgctgatagccttggaataccattcctggagacctctgctaagaatgcctcgaacgtcgagcaagccttcttgacaatggcaaggcagatcaaggagcgtatgggtaccgccactgtcaacaacaagccgactgtgcaggttggccagggccagggtgtccagtctgggtccgcaggtggttgctgctaatcgaatcaatgagtcgtgttgcacagtactacgttagccacctcggtatggagcagggaggtgggtttgccaactgcgccttggcactggacagttctatctgaaaagtggaacggcgcagacgacactgcggagatttttgctattttcaagctcgggatgattattgggaatcatttcagatccttcacacaatgctttagacggcctgcgattgtctttatatgtgctcatattgctggtacccttgttgccccttccccctttgttacacgctacttgttttgtgatttcctttacagcatttccctagtttcttccatatcttattagtaggttggattccttgcgattttgtcaggaacaaattaatggaaaagaccctgaacgttcggaaaaaaaaaaaaaaaa

SEQ ID NO: 6577 - DNA, 627 bp, Aspergillus oryzae
  misc_feature (1)...(627): n = A,T,C or G
ccaaagcgagaataatatcacttgaatagggggcgaaaataccactctcgcgtgttctttttaacacgccgcctcctacttactccacatcatgacattcccactgacttattccattctttccttgattccggtcaacgtctcttgaacttacgccggcggcggttccacagccaattgaaagtcgttctacggcctttccgcgcggaacgttaaggacgttccccacgaactgttccattcgatttgccccccagtggttcggtggttcctattcaggagagagccgttaaaaaaattaaaataaaaaaaagagaaaaaagaaaatctcgcagattggccaccggggtctagtggccttatatctgcctagaacgcgctctggtgtctttcacacccaaccctatgtccccatccgagcggcattgatataccacactgtggcctgccaccaatcaaggctacaacattgaatgctgggagagacaatagtccttacaagtcaccgcgtctgattcttcgaaataacacttgggatctcatatatattctnctagtgctttcgagtcaccttgggactacagtacttcacaatggtcgaggacttctctttctcaatctcctcgt

SEQ ID NO: 6578 - DNA, 694 bp, Aspergillus oryzae
  misc_feature (1)...(694): n = A,T,C or G
ttggaagaattcccggccgtaggaattttttttttttttttttnnnnatctttagaacacaggctctattgcctagttggggaagcgggctatctgacatgatttgattctcgaaagtcaagacacgacacaagaccatgcgcggtgctgctgcactttctcatgtggttgaggttcttgggcgaggccattcatgcttggtcgcactttatcctgacagattcgagcgacaccgacatcgacgccgccggaatgttcgcccccaaatggagtcagcgacataagtctgaatggttcgggtcgtccatgtgtctgtcctgccttttgcggtaatgcgataggtatgtcgtcgtcattaaagagagcctggtgatacggatgtaacaagaccggcttatgcttgcctgcagatcgctgtttgcagattgtgtagaaatcatccttctgcacgacaagtgcagggatgtacctgacccaagcaaatttttcgtccgagcgccgcttggctcgttatctggtcatacatttttcgattggtcggggagtgaagctcccgtcactacgtcgcaaagatcgatttgccattttcaaccaggggatgggttgtgcaataaccttcaagccttttacatgggcctacaggcgaagggcatgttcattgtcactataaatcggatcaagagggttgtggtgg

SEQ ID NO: 6579 - DNA, 903 bp, Aspergillus oryzae
tcggaattgtgacttgttctcaaggactgaatcctatttctttgaactttactgcgtccaaccactcctacgaggctttaacataatgaaggtcttcgccccattactctccctcagtttagctacctccgtagcaggccatggctacatgtacatcccttctagccgaacccgtcttggtcacgaggccggtatcgactcatgccctgagtgtgcgatcctcgagcccgtttcctcctggccagacctcgatgcggcaccagttggccgcagtggaccctgcggttacaacgcccgtgacagtatcgactacaaccagccaaccaccaactggggctccgacgctgtgcaaagctacagccccggcgaagagatcgaagtacagtggtgtgttgaccacaacggtgaccatggtggcatgttcacgtaccggatctgtcaagaccagagcattgtcgacaagtttctcgacccgtcttacctgcccaccaacgacgagaagcaggctgctgaggattgtttcgacgcaggtctgctaccctgcacggatgtcagtggccaggagtgtgggtacagtgcggattgtaccgagggcgaggcctgctggcgtaatgattggtttacgtgcaatggcttcgaggcttctgaccggcctaagtgccagggtgttgacaatgcagagttgaactcctgctataccagtattgctggtggatacacggtgaccaagaaggtcaagctgccggagtacacttccaaccataccttgatttcgttcaagtggaactcgttccagactggccaaaaattacctgtcttgtgctgatattgccattcaaagagcgtgtcctcttttgtgagcatggcatttcgtcactggtgcttgctatgactggtcttact

SEQ ID NO: 6580 - DNA, 655 bp, Aspergillus oryzae
ccgtgctgacacgctacttaactagacccctcgtcagccgcggacattcacaagctgcacaacttaatacaggcatgtcttaccttggaccttcgagtgtattactacgccgaggactagcacgcgatcctaacaggagggggaagtggccgcagacgtatgatggcccacacgctcgacgcgaacggagcatgtaagataatgataataggacgtcgacaagaaggcgtgaaagagaccatatctcagaggacgaacagcaggcgaagcgccataatcacgattaaagcggacatatgatcagaagcatccctagaagcagacgaccataccatttccgcgcagacatgatcacgttgatatcctgatcgctaacagaaggattctcagcccaaattctagtgccgccgctgctatgacacacggatacgtccccaatgtcgctgatgctcgctatgacctctggtacgtgccatggatgactagactataggggtggacggtaatgggaccggcgcttattatacagcagtggctcgtctcaccgctgatgtaagcggggaataaacagagggcgggcgcctgagaagaatgagaactgctacgcctactagcgcagttactattactagctttaatggcggttgttaataga

SEQ ID NO: 6581 - DNA, 699 bp, Aspergillus oryzae
ggggtacggatcagacagatctctcgacgactttctatgtcagttggaatggtgccaccgacatcgccgggtggaacttctacgcgcgggctgcgaagaatggccaccctatccttatcggaaacgctaccaagacggattttgagacgatgttcatcgcccgtgggtacctggactgggtgaccgccgaagcggttgaccacgaaggccgggtcctgggcacttctcgggtccagagaagcaagatccctgataactgggccgcggctggattcaagggcgatctcaagacccttaaaccggatgaccccaaggcccccaagtcgaacggtggtaagcaaacaactgctgacgcagaggccgataacaaaaacaacaacaacttgcaatccccgcgcccggctgatgcaaaagtgaaggagatcgctcagctggcacatgaaacgtacgatctcgttcgaaacgtcagtggtgttttcgtcctcatcgtactttgcggtatagtgaggggtatcgcagccagcatctatctcttgtttcggggtccgataacacagcctttccaacatggtccatttgatgacatcccagagaagagaatccgcctcaattctgttgagggaatctggtggatacccctatttacagttaaaaaccttttggctttgggtgaaattatggataccatacccttgggac

SEQ ID NO: 6582 - DNA, 698 bp, Aspergillus oryzae
  misc_feature (1)...(698): n = A,T,C or G
gtggaatgtatcgtacccgagatcaaggaatgggaagaatctcacggagaagaccttaggggactaagttccctgttcaagaagctgattggtttagtgaagggaaacggagggacggccattctccgatatgataccaggaacgatagattggaactctggacggctgctaagaggaagatgctacctgatgacctttacttcaggctggatcatcatgacacagaaggcgtaacttgtgaaaaagcgcctgtgggatcgggtccctcgaaaactctgctgaagatcgggaatactctttacaacgttgacctctcaatgatcccatacctagcgtcatttgtcagcttcgagcgcaatcgtcagccacaaggatcggagtttactcacggtgatatacccctcttcgatactgcactacaaggacttgagtcaggctaccgattctgctttcggtctctgccggttgacttagctcagtatcacacactttgcgagacatacgacttcctcggggtggatgtactangcggtcagaccatcgacaacattttcgccgatcttagagcctgtaaaaccgactacgagcttgattataagcgttatcgagcttttaaaggttgattagaccttggcggcggacccaacggttccgacttttggttctgatacttagaagggaagttaagggatgaaat

SEQ ID NO: 6583 - DNA, 744 bp, Aspergillus oryzae
  misc_feature (1)...(744): n = A,T,C or G
ggaccttctgccttcacagcggcggtgctggccgagatgagcatcaatgcggggcacgaggtaacatggaagaccttccatgatattcccgagtccaagcttgtcggagggtttctcgtcctcaccgtcgaggcatttgcagctggtcaaggccactccgatagtgggaatcataactcccgcaacgccttgatcaagcaccattaccacgcctccggatggccctctaagcatccacgacataaccacccggtttacggagaggttgagcagtgcaattggaacaaggagtgcgtagcgcaatgggacgccaataccgccgcatttgctgcgctttcgccggaagaacaagaacatcagatcgctctgaaaagagctttagacgccgaagcaaacccggtccaagaccagacggcctggattaaccctgaccccgatccagaatggcgggaaccggagtggcagccagagtggcaatgagaccgtctatgatattgactctatgctccacgacactaagggcatggctgactgacatcaagcataacggtcattgtctgagcaacggcgtcttanggaggaacatgggtatatgacagtggattgagccctaggtaggctagcaataatgcactggcggtaatcctattcttcatggagaagaaaacgtttgagcattgaaatgggatctggagccttttatggggcggccgttacagtattggggcaccaaactacatggtt

SEQ ID NO: 6584 - DNA, 674 bp, Aspergillus oryzae
  misc_feature (1)...(674): n = A,T,C or G
catgtcctggcgctctccgttcggtaatctcttccgtcgctctccacagtgattccactgtctccaacacgccgcaagtcagcgatagcgattacagttatatcgtcgacggtgcggcaggcacatatgggaatcaagacgacaatgcgccagacacgcttctccttaaacacaaaaggaacgcatatgagctcaatttcccagcatacgccattaatgatgggacgctcagcgttcgcgagttgaggcgacgagctgcggaagcgacaggcgctcccgacccaaagcgggtcaagctactttacaagggcaagcttttggacgacgatgaactgtcctgtcgggatgagggactcaaacaacagtcggaggtgctttgcgtggtatcggaagtgggagaaagcacccctagcgaggggtccgacgcggaagataaggccagcgactcggcggctccggatgatgcgccccgcccgaagagggttcgcaaccggaataagaacaagaagaacaagaataagaaaaagaacaaagatggtgctgacactctcgggccgncagccgatcagaaaccctctgcgtcccccagcagatcgacacttccagcgccggcttccaacctcaaaggctcaacaccccatttgagcaagcacaggcactttcagcgtactttn

SEQ ID NO: 6585 - DNA, 371 bp, Aspergillus oryzae
gagacctaaaggacgccgagatcaacctcgatgagttcctcggaaatgacgacggacacttccagtggggcggcgagaacttctcccacacggccgatgatgtccattttgcgatcgaaggagacgacgaagtgccagttctacgtgcagtcctgctcaatggcgagggagagcccgttgagagcaatgtaaatctttctgagcgaatcaacaatgacgacggtgcctttgtcttcgcgtgatgtctgtctaatgagttgaataacgatacatgtacactggagggaggtagttcaattgacgattctcaagccatcctctgtggaaacgatatctagtgagataataaagcatgccattaaggcctgacg

SEQ ID NO: 6586 - DNA, 707 bp, Aspergillus oryzae
ggatatactctatctcctaatgccgacgacggatctactttgcactgccaagtccaccactgccttcctttgactccacctgcgcaacaaaggaataggcctcttgtcacagccttgctctcctttcactggttttttttttggctcccaaacagtggtcctattcgacacataaggggatcggtgagcgaatcaagtatatcagttcaattatgatgacagaaaaacactgctgcttatcaaggatgacatgaaacacggcaatgtgcttcccatatttctaggggaccagggtatatatgcccacgagtctcacctaaaacggccgatcgagtgtatctgtaccgcgtctgaaaatggctgaaacatggatggctcttccgctctttaaccgtcaaaattctccagaatcatcgcgtgatgttctgtcgatggcgagccccgggctgctacctatagatccttctccagaacacgacgaaacgaacaagttcggtccctttgatcttcttgacaacctcccgggtgagctacaacttcccgcggatttgaatcctgcaagggtgggtccgaccactcacttacctgacttgacggatagggccgacccggagccccgatggatgcagatcagcgacctttgaattgtaagacccggggctgggacatgcccgtttcctgggtgccaatcgacactgcgggtaacc

SEQ ID NO: 6587 - DNA, 623 bp, Aspergillus oryzae
  misc_feature (1)...(623): n = A,T,C or G
aggtacctatagcaattgcccttctatgtatgtacagtacatcatgacttctacaacgatcctcgacaatgcttggccttgaccatctctaattcaacgggcataaaacggagattacggcatatataaccataggaaacatgccatgtcatggtttttaattcactcattcctcatcgtcctcatcttcctcgtcatcgtcatcgtcatcttcggcttcggatacttcctgtccaaggcctttcaggcgttcctggccttcgtccctctaagcctccaagtttccgaacccattcaggaggccctcaantccgaatggggcctgacttcgcgcgctttttctctcttttaaccctgagattaaagctttccaaactcttcgcgaatcatataaatctctgggggggatttgtgcacaacaaatgctttcccctgtcctttgagagttttttggccgagaccttgggttaacattagcctgtccaacactctctggtgcacctgaaattctggtttggggggagtatcgaaacccctcttttttccttgacgctaaacagggctttttcaacgatttttgccaaaatccttgcttcgaaaattggcgacctggctgaacagcc

SEQ ID NO: 6588 - DNA, 693 bp, Aspergillus oryzae
  misc_feature (1)...(693): n = A,T,C or G
ttgacaaagctccagtctgagatgagcatgctagaaagcagtcctacaaatccatccgacgccgcagcgatccatcacctactcttagaagtcaatgcagtttctggcaactctcctgggcccgtgacgcttgctgtgaatttgtgctctcaatcggagaccggtggcctcaaccctctgtccgaaacatacatcttagacatcccatcgccggagaaatttgcaagcatggggcagagcagcaagctcaagactcttttcaccgaattgtgtgccacagatatcggcgatggatctgcgaacgggcccaagctatacttggtcgtcgcagtccgagcaccagagactgcttcgacaggcgccccgtctcaaccaagatcttcggtttctagagagggatcctccgcttccaaaacatcaacgggggccaatcaacaaggaaaaagcagcttgaagacccgccgcagcatgatgtggacgtcgaaaccacgtggcattccaagcgctgagcagggtaaagagaattccaaaggcccgcctgaatctgcggagagcacgtncagcaacagcaaagaaccagccaatagccagcccgcaaaggaaaccactcagatccgcacaataggcgtgggtatcttagaaatatcacagatcngtggccaagacaggatacttgacaagtataaacatctg

SEQ ID NO: 6589 - DNA, 699 bp, Aspergillus oryzae
  misc_feature (1)...(699): n = A,T,C or G
gagcgattcattgttaatgatgagcgggattacccctttgctgtccgtaccgtttgcagacatccttttttattttatgttttctttcccctttctgaatcagcgacacccgtgaaaaagaatcgaattactctcagtcaagtgaacggctttataaaggaactaaagtagggtagcgaggggggagaggtgtattatatacaaaaggggaagaagggcgggagagcaaaggatgatcacagaccgacggcgccaccataaaagccataaaagacagacggttcgcaataagcatacccgttggagacacttctgcagctgctaaagtgaggggagagaatttcggtaactttcccggcagtggagccgagcctgtgcaactcccggtcaagggagacgacgatctggagccttcttcggggctcgttgtgggtgttacagccttctcattcgctcctgggtgtggtacactttgcagcccaattgggaatttgaaagttcgtctacctcgcggaacgtgatggtcactacttgtctttgttcatttcgtcttctccaatgcagataagattcacagggatgcaggaagacagccaatccaactccactcttcgggacgatcctggctgtttatgcatgacaacaccatcaagttatcaacactggccgactatgactcgtttctttttgttccgatcn

SEQ ID NO: 6590 - DNA, 877 bp, Aspergillus oryzae
ctccagcagcagaatcagtccgctcagcaacagatcaagtccttgaagcaagaaaaccagctattggaggagcgtaaccaggcgcttgagctccagctgaaatcctatgaacacatgttccgatcgcccaagaccgaacagccaagtccccagcctcttacccagttttccgattcgaggccgcgcaacatgttgcctggcctacgtgttttctgcgacgagatcgctgtgaatggcacggaggcctcccgcttcgacccgccacacaccgggtcttcccagtccttttcgcagagcttccttagccattcacccccaatgaccgggccttcgtccccggtcttcacacaatcgactttttcggttcccgcgtcgcggcgccagtccattattccgtcaccatgagctggtggcagggcatgttgcttctgcttggccttgtaatgaatttccttgtccttgggcatagagctgtgatttggagccgattctgctgttttgattgtgttttgtggcatagcgtggcattgtaccatttggttttcgaacgggactgattattgacaccgggatgccttggtgttctcatcagggtctgtcttcttgttttcactggatcctggcgaactggagcaagtgggttgtacatcaaaaactgggtcgggaattgcgagttgcacggattttcttttctttctcatgttgaaatacataatttctttcctttggtcatattgggatgggttgccttcatcttcttggctatcctgtggggattcggagtggaaggcgaattttcttatctctctatgtatacatatatacgggagattgcggatctaggccattatttacattgggtgtatccatgttcagg

SEQ ID NO: 6591 - DNA, 698 bp, Aspergillus oryzae
cgaatcaatctcagcaagcgttgaaaaccctgcgtcagaagatgaagacctttggagaggaatatacatcgacacgcactcattttgacgttgacacgcttcagtgggtgagcaaggccctcttaagatcagactctctcaccaaggaaaagtccgacatcttgaaggattttatgctcaacaaggctgttgcccaggaggtggcggatgttttgaacatgcgtcttgcgaccctggacaattggcactggccgcccgagggtcttcctcaggaaatgcgtcgtcaactgaacggcaagtaccgggtcttccaagatgaggatctgctggacagtcttctgctccagtatctcgggctccactgggcggtgactttccgggctgcatttgtcaattttcagaagacctgggcctggaaaagcctgcgccagcctatctcgaagtcggagcgggcacggcgtcagcacttcctcggtagggaccacgcgcggtgtatcagatccgtgaacgaggagagacgcgatgtatatagaaccgagtatttcatgactcaattgcctcgctcgttaactgcaggtgggctggggtacgatgatgataataacgaccccgacgacattggaggagagaaccggcagaacgcccttgaagacaaacactcgcttcttcaatctctgattgccgagtctattctgcat

SEQ ID NO: 6592 - DNA, 413 bp, Aspergillus oryzae
  misc_feature (1)...(413): n = A,T,C or G
cgagggtgcattagacggtcggaagcagcagatacaacaggtcacccgaaagagccttacgatatgcagagcgtcatttcctcccccgcataccacctccagcgactccgagtgatntcttttcctttgcgctgaatatgtnattttccctatctctttatatggaaggtacttgtgctcccgtcggggtcggtgttttactcntttcttctttttctttactttccatttccttgtttatcttcacttcctccntttctttncttttaactcttgtcttgtccgaattatttacagagggaggaaacacaacggtctaaatctggtgttctccgttcgcgctttttagaaaatttccctgagagtgaaatgcccaccatatacgcagcaacacgtccatgtctttgcacttc

SEQ ID NO: 6593 - DNA, 661 bp, Aspergillus oryzae
  misc_feature (1)...(661): n = A,T,C or G
tccggtataaggtcaatttcgaacagcttgccgactttgaagacgaggacgaattttatgatgattgacggtccagcgacctcgcagggagcgaggatgaaaggccagaagtccccaaaatgggtcttttgacggctcgccctttgtggcatgaaggcagccttcatggtgaacacatcgcttcattagtagggaccatcatgctgcctggaccgaactccgtccagctgctcaaagggtcatccaagctccgtactattcagatttatgttacctatagggtctaggtggacacaaggtgtactttgcaaagggatggtggatgtgatacgatgcagctacccacaagaaattgtcagccctgtggcatttgagccagcgagttaggattgatttattccagaaaattatgccttgttggtgttactgtccaatttcgttcattgttcctacatgcgctctttatacatcattggccgagaaaaaaaaaatgataaagaaaggaagaaaaagcaaaacagggagagagaggaggggactctcatctggtctttttagaaaaaaanannnnnnnnnnnnnnnnnnnnnnnnnnnnnnnnaaaaaaaaaatctctggggggggccaaaaataatttaaagggggcccccctatttttttttt

SEQ ID NO: 6594 - DNA, 642 bp, Aspergillus oryzae
  misc_feature (1)...(642): n = A,T,C or G
ctaacaccaaccactcgtggtgaccactctacccataacatccttttatttcctgcatctccctttgaaaaggggtaaagaggaaaaaagaaaagaagaagaagtaaaaaaagatattttccaacacctcgaagaccgaggtgaatgtatggtcaatgttgtccatgcaaaaaagctctgcttttgtgtttactccgacggaacttgacagcagccaccgtcatcaaagcaactccacccgctcgggcagtttttcggaaaaccccgctctcgccgactgtcccttcatagacgactcttcggtctcccatcgtgccagtattagtaccgatggcctttccaatgagtctctcgaatcctgngacggcgacggtccgtctgccagctcacctgttccggaactggaggtgaagatccacgacgtgtcgcagacgctccactcgactttgccttccacaacaaccgccacatttactttcaacatggttacatctcacgagtctgatgtctccatggaccatgtgactcccaaaatcgaagagttggacgaagcagatgagctgcagaatattaaacctttgggggtggaaccgatggccaatgcgaactctgaggtcacggatactcccggaaaagttcacc

SEQ ID NO: 6595 - DNA, 662 bp, Aspergillus oryzae
  misc_feature (1)...(662): n = A,T,C or G
tgccattttccgggaaacatactgttgatatcctgggtgttggggttttcgaggccggacgcgccgttgcggtgaccagcgtaccagacatcgaaaccgtacttcttctcgccgtcgtggcgggccttgatatccttttcgaggttggtgctgcagatatgtcagatcctgttgcgggaattacggagtaaagtgtcttacttcaggacctcgccattcttgacatcctcagtcttctgaccgaggaactcagtggcggaagtgcgcagcatcatccaattctgcttgaagataccgaagttggtggcatcaccggtcttgccgtcacctgtttcctgttagattatctggcttatgagaagcgattcagctggatatggtcttaccgtangggtaggtgctggggtccatattgtcgctttaacgtttgcggatcagtataatttttgatgtctcattcaaaaagatcacagaatagaacctacttctccaacatggcaatgggccaggtccatgggtgttaccaccagcgctgacgatggcctgcttgcgctggcccaggcctggaacagagtaatttgccggggcgggccttatcacggatgccaatggcggcaccganagccatgggaaggagcanaaggttagggaaagcttcattt

SEQ ID NO: 6596 - DNA, 583 bp, Aspergillus oryzae
  misc_feature (1)...(583): n = A,T,C or G
cgagggcggatgagggctggtcctgtactttgggaaagtgggggattatcgtggctgatggcgccttctgttggttttacccggatggaggcgaggcgggtacttttccgtctaggtgtgacgcaggtctaaggtattgtggttatatcgatacctggtcgcgcgattatcatatgtattacacaaattggtcaatggacgatgtcgctggacaattgggctggggcaatatctggggattcagcggtagcgacgaatctgaatatatccatcagataatggagattttcccgcgtggggagccggaacacggtatcgggtttagacattgacatgtcccacaggacttctactataggacctgngacttcccgcagtagacaggagttaggactaatctctagtcccaaaagcagaactagaagagtcatagaacttttataaaaatactccgtcctatattaaataattaacaaaaagcactgaattaaaagctctaaatctagtngaaaanannaannngnaanaagnnntttannaaatanataaaaaaaaattttccgcggccgggttttntntttct

SEQ ID NO: 6597 - DNA, 681 bp, Aspergillus oryzae
  misc_feature (1)...(681): n = A,T,C or G
cattagccatatgcatgcatagacagcttaccatttacttcgactggatatatttaaccgactagctcttcattgacctcgtctcacaatttagcgatgtgtttatattttcgcgctccttcggaattttcggcgtatatatgatttaccgttttcttgggttgggtttgggaatgaatctcacggaaagtcagaaacatattgcatctatgtatactcaaacttcttgcgtcttcttctttcatgattttgtttatgagtttccggggaggcatgatcttatttaacgctggacgctgtttccagtctgaaaacagcaaaacggtcccacagaacgacctttttgatgagcattgcattgattatggtttaggaaatattgtttacttttgttatattttgcgtttggttgcattgcgagtgagctgaactgggctaagggtggttatcttgttacgattattattctgatatgactgatatgttctacgatgaaaaatgcctgttaatgttttatgttgatgatgctttctggacagttgggccacgacatatgggtggccctttttgcatgcctttgttctgtctttttatttcatttgtcaaatacttctatacnggtcttctctcaaagggcctttttttctgcacatggctttactggtgggcggttgccccggt

SEQ ID NO: 6598 - DNA, 794 bp, Aspergillus oryzae
cctcactggttcctattttctcgctccatttaattatctggaatcccatctgagaccctcccattgcctacaaactcacctgcgcaatcctactacccgatcgcaaccttcccccgccaacgccctttatacatccggctattccacgctcccctgatcagtcactcgcaacaatgagtcgctacgtatctcacggccgcggaggcgcaggcaatatcttctccggcgaaagccataccacgccgaaagatctcgtcacacccacgatcaaacaagacatttataccaccggtcgcggcggctcaggaaatatggtcgtaaacgatccccagcgcccagagattgcgcgcgagagtcaggacgtagaagcgccgccattgcgtgtcgaggaggctccccatcacactggacggggtggcgccgcaaatgcgtatattccatcccccgaagaagagaagaaggctcgtgaggaagaggaggaacaattgcgccgaattcgcactgcgtctagagaccgactgaaggatgccgagcgtgctgccgaaaagcgcagcgagtcatcgtcgagttgagaaactgtattttcaaatggcacatctcgagtcgcatctttttgtctggagtggtatcctgttttctcagttcagccttcgttagttttatcggtgggacattgaactgactttcgcgaatgcatcgatcgtgacatgttacgagcggagcgctgctggcagtgcatgatcttggctcgtggcttcgagagaagtgtcgccgatgaatattttttgtgccgg

SEQ ID NO: 6599 - DNA, 702 bp, Aspergillus oryzae
ggcatttcgtcactactttgtaacgtaactcaattctattgatacataaaaatcacatatcaactatggctgcctctcttatccgtacctctgcccgtaccgctcttcgcgctggagcttcggctactcctaaagctgcgggtgttgcgggtttgacctttgcccgtggcaaggccactctgcctgacctggcttatgactatggcgcccttgagccctctatctccggaaagatcatggagcttcaccacaagaaccaccaccagacctatgtcaacagctacaacaccgccatcgaacagctccaggaggccgtcgccaaggaggacatcaccactcagatcaacctcaagcccctgatcaacttccacggtggtggccacatcaaccacactcttttctgggagaaccttgcccctaagagccagggcggtggtgagcccccatctggagctttggccaaggccatcgacgaaagcttcggcagcttgggagagttccagagcaagatgaacgccgccctcgctggtattcatggaagcggatgggcttggctcgtcaaggacaagcagaccggaaacatcgggatcaagacctatgccaaccaggtaccctgtctttggtcaggttcagcctcttctctgtgaatgatgcttgggagcacgcctactaccttcaataccagaaccgcaaagctgagta

SEQ ID NO: 6600 - DNA, 1257 bp, Aspergillus oryzae
ctttctctcaccagagttaataataacttgacatacagaatacaccatggccacagatcgtttgaactctattctcagccacctcaagggaggaaacactggccttgccgccatcacccagaagaacccagacgatgtagtcattacgctcgctctgcgtactcctctggccaaggccgttaagggtggattcaaggacacacagttggattacatcgtatactccttgttgaaggaggttatcgacaagtctaagattgaccctgctttggtcgaggatgtctgcttgggtaatgtcaacgacggcaaggccccctatctcctccgtgccgcctcccttgcggccggcatccccaacacatccggcgcatcgtccgtcaaccgattctgttcctccggtctcaaggctgttcaggacatcgccaaccagattacattgggtcagatcgatgtcggtatcgcccttggtgctgagttgatgtcagccggcggtgatgcagtccaacctttcagcgaagaagtcctgatgaaccaggagtctgccgactgcctgcagcccatgggtcagacattcgagaacgtcggctcggacttaaacatcagccgtgaggttcaggacaagtatgccgccgagtcgtaccgccgcgctgaggaggcccagaaggctgggtggttcgatgatgagatcgtccccatcaccaccaaggtgaaggaccccaagaccggcgaggtcaagcaggttactttgaccaaggatgaaggtatccgttatggaacgacggccgagtctctcggcaagatccgaccggctttccccaagttcggtaaccggagcactggtggcaactccagccaggtgactgacggcgctgccgctgtcctcctcatgcgtcgctctagggctatcgaacttaaccagcctatcctggctaagttctgtggtgccaccgttgctggcgttccccctcgcatcatgggtatcggccctaccgctgccatccccaagctcctctccaagttcaacttgaacaaggatgacatcgatatctacgagatcaacgaggccttcgcttccatggccgtctactgtttgcagaaccttggcttggaccatgccaaggtcaacccccgcggcggtgccattgcactcggccatcccttgggcgccacgggtgctcgccagatctgcacaattctgagcgaggcaagacggacgaagaagaggtgctggtcacgagtatgtgcattggtaccgga

SEQ ID NO: 6601 - DNA, 689 bp, Aspergillus oryzae
cagcatgtggacagcattggccatggcacccacgtttccggcaccattgctggcaagacttatggtatcgccaagaaggccagcatcctttcggtcaaagttttccagggtgaatcgagcagcacttccgtcattcttgacggcttcaactgggctgccaacgacattgttagcaagaagcgtaccagcaaggctgcaatcaacatgagcttgggcggtggctactctaaggctttcaacgatgcggtcgagaacgcattcgagcagggtgttctctcggttgtcgctgccggtaacgagaactctgatgccggccaaaccagccctgcctctgcccctgatgccatcactgttgccgctatccagaagagcaacaaccgcgccagtttctccaactttggcaaggtcgttgacgtcttcgctcccggtcaagatatcctttctgcctggattggctcttcctctgccaccaacaccatctctggtacctccatggctactccccacattgtcggcctgtccctctacctcgctgcccttgagaacctcgatggccccgctgccgtgaccaagcgcatcaaggagttggccaccaaggacgtcgtcaaggatgttaagggcagccctaacctgcttgcctacaacggtaacgcttaagtaccaggagtacgtcgcaggattctaccatt

SEQ ID NO: 6602 - DNA, 688 bp, Aspergillus oryzae
  misc_feature (1)...(688): n = A,T,C or G
aagctatattctatacactcttaagagtctctattgcaacatgtccgagatattcgcacctgccccagagccctcgactgagctgggtcgctaccgcgtcctctcttcgactgccggcatccgcgtttcgccactgcaactgggtgctatgtctattggggattcatggtctcactttatgggatctatggacaaggaatcttctttcaaactgctggatgcctttgtcgaagctggaggcaattttatcgacactgccaacaactaccaaaatgagcaatcagaagcctggataggcgaatggatgacttcccggaagaatcgtgatcaacttgtcattgcgaccaagtttactacggactacaagtctcatgcactangaaagggaaacgcacctaaccactgcggtgaccaccgccgcagtctacacatgagcgtgcgcgactctctgcgtaagctccaaactgactggatcgatattctgtaccttcactggtgggatcataccacctctatcgaggaaatcatggacagccttcacattttggtggaacagggcaaagtgctctacctaggaatctcagattcccctgcgtgggttgtgagtgccgccaacacctatgctcgagctcatggcaagacgcccttcagtatctaccagggcccggtggaatgtgatgcttcgtga

SEQ ID NO: 6603 - DNA, 1048 bp, Aspergillus oryzae
actccccgatccctcaccttccaccacctctctacccttcccttaactactcttccttcattcacaatggctaccgagaagccccgtgtctgtcttgcctactctggcggtctggataccagctgcattcttcgctggttgatcgaggagggctacgaggttgtctgcttcctcggcaatgtcggccaggaggaagactgggccgctgttgaggagaaggccctcaagatcggtgccaagaagatggtgattgaggatctgcgccgggagttcgtcgaggagctctgcttccctgccatccagtgcaatgccatctatgagggtcgctacctcctgggaaccagcttggctcgtcccgttatcgcccgcgcccagatgcgtgtcgctcagcgtgaaggctgccagtttgtcagccacggtgctaccggcaagggtaacgaccaggtccgtttcgaactggctttctatgccatccagccctccatcaagatcatcgccccttggcgtgatcccaagttcttcaagcgtttcgctggccgtaacgatctcctcgactatgccgcccagaccggcatccctgttacctccactaaggccaagccctggtccatggacgccaactccgcccactgcagttacgaggccggtgttctggaggaccccaaccacacccctcccgctgacatgtggaccatgaccgccgaccctctgaacgcccctaacgagcctgccgacatcaccatccagttcgagcagggtatccccactaagctcgtcactcccgagaagacatacaccgactccgttgagctcttcaacgctctcaacaagctcggctacacccacggtgttggccgtattgatattgtcgagaaccgcttcatcggtctcaagagccgtggctgctatgactcccctgctatgaccatcctccgcgccgcccatttcgacctcgaaggtctcgtcctggacggccaggtccgctctctccgtgatcagttcgtcacccacaactgggccatcctcctctacaatggctactactttg

SEQ ID NO: 6604 - DNA, 637 bp, Aspergillus oryzae
gccaagaacgccgtctggttatgtgggaggacattgcgctgtccgcggataatgcacatgatgtgcccaagaacattgtaatgcagagctggaacaatggtctagagtacatctcaaacttgaccgctagaggctacgacgtcatcgtgtcttcctctgactttctgtacctggactgtggtcatggaggctttgtcaccaacgatccgcggtacaatgtgatggctaacccagatgcgaatacccctaacttcaactatgggggcaatggaggatcgtggtgcgccccttacaaaacctggcaacgtatctacgactacgacttcactctcaacctcactgagacgcaagctaagcatatcattggcgcaaccgctcctctttggggcgagcaagttgatgatatcaacgtctctagcatgttctggcctcgtgctgcagctctggcagagctagtctggtccggaaaccgcgacgctaatggcaacaagcgcaccacggagatgacacagcgtatcctcaacttccgtgaatacctcgttgcgaatggtgttcaggctcaagctctggttccgaagtactgcttgcaacatcctcatgcttgcgatctctaccgtaaccaaaccgcaattcaata

SEQ ID NO: 6605 - DNA, 1512 bp, Aspergillus oryzae
  misc_feature (1)...(1512): n = A,T,C or G
cgagggaaggcgcgagtcaacaaggatgatgtctttgccagtctcagccggatgtatgagagatgtcaaggcggctgggcatgcactgctatgctagctggctttggtctcgtcggcttccgtgactcctatggcatccgtcccttggttcttggttccaggccttccgccgaaggcgaaggcacggactacatgatggcctctgagtctgttgctctgcatcagcttgggttcactaacatccgtgacatccaacctggtgaagcagtcatcatagaaaagggcggcgagcctgtgttccgccaggtcgccccgaagaaggcatatgctcctgatatctttgagtatgtctacttcgcgcgtcctgattccgttatcgatggcatcagtgtgtaccgtagtcgtcaacggatgggtgatcgccttgcctctaggattctcgatgtccttggaccggaagtggtcaaggacattgatgtcgtcatccctatccctgagacttccacgacgtccgcagcgggcgncgctcggtatcttacattccgtactggcaaggttcgtaaagaaccgctacgtttttcggacattcatcatgcctgagcagaaaacccgacagaagggtgttcgccgcaagctgaatgctatgcaagcagaattcaaggaccgaaatgtcctcctggttgacgacagcatcgtgcgaggaaccactagtcgggaaattgtgaccatggcgagggaagctggcgctaagaaggtttacttcgccagttgcgcaccggaaatcacacatgctcatatctatggtatcgatctggcgtcgcctaacgagctggtcgcgcataaccgcgaccccgagcagatcgccaagcacattggtgccgacagcgtcatattccagaccttgtctgacctgaaaggtgcttgtgcggagattgcccaagagaatgggctggctgaaccgcagaacttcgaggtcggagtcttctgtggtgactacgtcactcctgtttccgatgggtacttcgatcatctggaaaagatcagaggcgaaggccgcaagatcaaggctttagatcgggctaaggaagccgtcactcatggcttcgctagtgaaaaggatttccagattgctgccaacggtgtcaaattggatgccagcggcaacatcattccagcgtcgaccccaggggagtctgaagtgccacaggtcagcatctgcagcactcgcaaacctgaggagagcgaagagcatcccaaggtcaaagaccggatggacattagcatccacaacatgggcgatcacccatgatcactgatgagtttatggacggtatatttatgtcagctggagtcctggagttggtaggcggtggataaagagaacggaaggctatctgcttggtgatggttatcgcattgcaatagcaaagggatccagataccctttttgtatgcacgacatgacctatagactttatttttatgaccaacaaagtttgcttttggcattgg

SEQ ID NO: 6606 - DNA, 674 bp, Aspergillus oryzae
  misc_feature (1)...(674): n = A,T,C or G
gttgtcacagtgttggagagacaatgggtctgtcgggaatgcaagcccgtgccgattaccattctccagccgacggttgttaggagcaatcctagtctcacggggccgtcattaggtcctcccgtgcatgcgccgttattaatgcccaagatggaagtaggaggggagggctcctcggcagacgagcgacggggctttctctcgggcttgtcgcatgcgactcttgttgaactactggtcactctgtcagaccaacacccggcgatacccatgtttcctaaaaacttaaagactttacagtcgaagttctcgttcaagccgaacaatgcggcgattcctactccaacctcaacctcctcgaataccccaactttcactaactcgataacccacgctttaactaatggtgtagacgcggcccagcaaaagtcaggtgttactcctgacttnctgcctactccctcttccgctccccaaacgcagcacgacctgtcggaagagtctgactatgaattctcagagcatcgtctgtacccgcgtgccgggaacggattccgtttgtcgacgaatgcggacgacattgacatcatgtttgaagacgtctcatgtcgcacgttcagctacgcattacacggaccggcacgggttcgagcgcaggcgaacgaagtcgcacc

SEQ ID NO: 6607 - DNA, 1074 bp, Aspergillus oryzae
  misc_feature (1)...(1074): n = A,T,C or G
cgtgctgcattgctgagcaatggtggaaacactgtagcttcgggtaaaagagctgatacgggtgcatacaatgtccttggcaaagttacgagctctgtggcgggtgtggttggcgcaaaagaagtggtaggttctgggtttgattccgtaaagcgtgctgtaggcaagtctggccttatgggaggcatattaagcccgttcggagagttcgacttgatggacgagctccgagatcagtggactcatgaatccaaggatctggagcgaacgtacctcattcgcactctacagggtattgcacatcaaaagtttcttcgtatgacgttcctttccggatctgtcaatgtgtgcggcgcaggcttggtccacgatccagcccatccctctgactacaagaccatgtatcanatcatttcgtccgctgtcgtgaacaatcccccgccttcatatgttatcaagcttcttcacagcagtaacaaaccgctctacgttccagcaaatgggcagcgctcctctccttcgcagcctactgatacgaaggaggacatgatggagatattccaaacagacgtcacggggcaggctcgcgaacaccgtaagctgatgggtcgccggaattacgctgccattgtagcctatgatcctgaaacggtcaatgcgatgtatggccaagcacccgtggtccatggaggcaggctgaatcttgccgtggattttatggtccagggtgacggatcctatggaacggttgtcaaatatgggccggtcattatcccaagcttaggacatgggaaatgaaaacaaggaccttctcctttcagtctcactttgccctattcttccttcgggtctgcatccctttatgcttactggacatgattatgacatatcttactagtcaccatcgtttacccttgaaactctcagatgtatatctcacgtatccacataatggttcaagttcgaattctgcgtttttaatggctcgccctatgaatacccagtctttacaacgtcacactgtctgcattttcttatctcatcaattcgctcgctggtccgatcaaaacacat

SEQ ID NO: 6608 - DNA, 697 bp, Aspergillus oryzae
tcaatgtgaatcttgctcaagggcctctagtttctctaccaatcaagccgcaatgcctccgaaacgaaagagctccggtgatggacatgatcaagacgacacgcgcaggaagcgatttgcttatctgaagccccaagttcgtcgggttgctgaaagaacgatcaaatctaaatggtccacgctaccagagccaatgcaagaaaaagttcgcgatatgtttcgagctctcgagcgcccggtcatagtgcgccagcagagtgagcgaaagcgcattgaagcgcaggcggccgttcaggccgtagtgaagaatctcggaaagcgcctccctagaatgccattcccacccgtaacgaaggattcggttttcgagtacgaggctgcactgaaagaacactgctccctggaggcgagcttggctaccgtcacggacagcactgatcttttgaaagccgaaatcgaaaaagaagaggcattacttgcgaaggaaacgaagcaactgcaggaaatggagaagaatgctaagcgggcggaagctgaacggaagaggcagctgaaaaatgaacaccccgtacttcgacagctcagcgttcctggacaacagagtcaggatcatactcaattcacactcgctggcgcaaacgatttgcaaactacgtttgatgagctcgaaaacgaccctgaggtcgtggacttgtta

SEQ ID NO: 6609 - DNA, 654 bp, Aspergillus oryzae
  misc_feature (1)...(654): n = A,T,C or G
ctcaagcccccgttagcctccgctatgagaggcggcaaccgtccccgaaaaggccatcgacgacagaactgtgtccggatagcgatccagccacctattacttttggaggaactatgtttgctccaatggttgaggagccggaagagctagatgagtttgacaggcacgcatcacaggtgtccgatttatcggcttccaatatctcgtctttgcgctcaagtgtgtccggtttctcgatgagccggaccggttctgaccagcagggggatgtatcacgcatcacagagatctctagtgacagtcgtccaccatcctaccgcaactcgacctacttggcttcatcgaagaagcggaagcatagtcgagatgattcgatagatagtgtactaagcacgctgaacactggcatggacaaaaccctccctgagattatcactacactgccccctagtctaggagatagcctgacagaaactccttcccccgacaagcctaatccagtttggatggctcctaagtacagcggttcgccaacaacctgtgataacgccccgagtccaggtaatcctcgccggtccgccgtcaagggaccacgcagncaacccagcagaccacgccgcaatagcggcagatcacatttactcgaaaacggg

SEQ ID NO: 6610 - DNA, 673 bp, Aspergillus oryzae
  misc_feature (1)...(673): n = A,T,C or G
catacttactagtaggtggtagtactagtagtagggctgacatgtctgtcttctttttggcctcttcttttcttccggagctagctgggtcggtctatgttcttggggtgggctgagtgggcgttattctacgagctgaaaagcgtgcaacggtgtaccttgctctctgagtctacgatgcttgcgtcgaagaaaatgtgattctggctgtgatggatggaatttggactgttggctatatttgagcattctatctggggtactatacctgggtagcttggatgccttgatacctcgcgatgtgtgatatttcgaccataaacagatcatgcgggtatatctgtttgaaacgtgacatgctcgtcccgctcattgaccaatgcctacaaccccttctgtactagctcctccatacagatcttactcgtgatcatagactgnggcttaaatgaccctatcctgcagcgtcatcagtctatccatgagatacgcggatgagcaaacatggcaatactgccgacatacctgaagcgaaggcatcaataacagcctcaagatcttcaccatcggatatcgacgacccggtgatatgcttcatcgacccaaccagcttccacgcatcaatcaccggcttctactcccacagtgacactaccgtcaccgtgccccgagc

SEQ ID NO: 6611 - DNA, 658 bp, Aspergillus oryzae
ccgtcttctgggtcgcgtttccatcatcattccttgttacctcctgcatcatagacgttatctgggagccaaaaaaaaaaagtatcacagccatcatgtcaacatttgcctttgccaactctagcgaaaaggtccctggtaatgggacccttcctgccgaattcataataaaagcctctccaggaacggacgtatggtcaaaacctccatccacggagagattcaacgctccgatcctataccagagcgtcccgctcaactcattcaagcgggctagagttgccttcaatgccttttggaaagacaaatacgaccaaggtggactcacccttgttttgaatagcgcaaatggtcctcggagatgggtcaagacgggtattgagctcactcatggtagaccccatttgagcaccgttacgaaggatagatttgcggactggagttaccaccggtccctcaggtggtggaccaccacgctagaatcgcagagagcaaacaacttctgggatcaattattgaagtggcaaaagataccctagtgaggaccttgttttttaaggacaggagtccaaatcttgggggggactatcccgcgaagaccctatcaaggggaagatattgtgtaaaaattaggctatatttatgtgctgggtcgacg

SEQ ID NO: 6612 - DNA, 415 bp, Aspergillus oryzae
  misc_feature (1)...(415): n = A,T,C or G
ggatgctctgagagacttgaaactgtgagttttccttgccaccaagagcgtcctagtaggatgctcaaaaaccctgtaggtgaaggaaatcgcagccgacctcctggctgaggccaagtccatagcagtgaaggctccctcaccaaccgagcctggtagtccagcatcacctggaggttctcagcctagagttccccagagactgcagcgggccaagattgcagatgcaatgaaaatggtggaacgagagtctgctgttattgaagcgatttcgtcacgtttggagcgattgaatgcaagtatatgaaagagcatgaaagagcatgaatacgtagtacttgaagttcatagttgataatacctnctgcaactaagatgcgatcatgaaaaanaaaannnaaaaaaaaaaattcct

SEQ ID NO: 6613 - DNA, 630 bp, Aspergillus oryzae
  misc_feature (1)...(630): n = A,T,C or G
cattccttcttctttttaggactatctcctggtgagagacattgtgtcctaggcgcggtcaattacacgcccgcccatcgtcacaatgaggccgattacagcattcaccgcgctctgtgggtttctcctgtcaagcagcagcttagtatgcgccgaatcctcggcggggacccattcctcctttcagcctccccagacattcaaaaatgtaaaatttgtccggaataccaaacttggagaaaggtatgctcgggagactgtcaacgtggtggtggaagaagtgggataaaaaaccgcaaacacctactacctaacccttccaatcggaggtattcaacaaggccgaagaatggaggtganaaaccaaaaaggncccggaaaaggggccttccatgtaaatgattggctgccaatccgccaatggcaccaatacctttgcaatgaccttccgaaactcttgccccaaaatgcaaggtaccttaagaatttcttactaacttcttttcttccttgaaccgggttctctgcggttataaacaagctgtgtaaccagtacttaattactcgttttcttggctaatatcactcaagcctacccaactgtgacccacaagaacaaaattgaacctn

SEQ ID NO: 6614 - DNA, 663 bp, Aspergillus oryzae
cgcaagttcccttatgtcccggtccttatcggctgcatacctgatggacttattggttgacgccgttcttcccgccttgatggatcaagccgctctggaagcccagcgcaactatgttggaacgtaccgttcctccaatgccggactaaactcgtccttgactttggccttgagtccgccgacgcggccctcacccggtctggtagtcacctcctgtatcagcaacggcaccgatatcatgccatatttggcgttatttctcgggggcaaggacacgagactggtacctaccatttttgccgttgggaccactgaaaaggtggctgtccgaccttacaccccgacgacggaaacagcatttggatcgccgcaaagactcgtatcgcgactgttcgatgtcaacgacctgtatctactcgatagtacactatacaggaggtgagagtctgtcactgctttgtgtgagacgttaaccaggattggcggggctactgaaagtgactgacccatgcttcggggtcacactggacagaacagtgatgcatgtcattttagtaactcctatttatgtgtactcgcgttttaatatttttccgaatgggttctgccacgtcaaaagggtggtcgggatgtttctaaactatgtgaacgagttttatactg

SEQ ID NO: 6615 - DNA, 672 bp, Aspergillus oryzae
cggacaaccaccgatttcactcaccacagaccaccccaccagacagcctgacagtcatcggcttgcccccctttaactatcacccgaccactccttatcttccctccctaccttagtgtcttgtcattcaccgtctgagggggaaattagattcactgctgtgggctggcgtcatcattcaatcttacgtcctttgccgtgggttacaagttccccacttcttctcagccagacgatcccactgctaccttgaagacttcttgcgtactttcctatcgagcttatctcaactaccactaaacttagaaggacagaagagtccaacaaatcttgttgatccatcggctcccgacactgtttcgaacctttaaacttgagtctttcctaaatcacgctgtcgttgaagttacggccaggtcgggttccccttgcaaaagaagaccaatcccaggcaaggcggggaactcgagaagaagacatcattcattgatcttgttctactcccttctgccacatctgatcttcataatagaccaaatccgattacccacctttgtcttgtcacgctcacattccaggacggatacctagctgccggaagtgggaaagaggagcttgagcagatcataatgggtctcgcgtataacgtctacctcacttccaataagatct

SEQ ID NO: 6616 - DNA, 667 bp, Aspergillus oryzae
  misc_feature (1)...(667): n = A,T,C or G
ttaaggaagaaaatgaacagagaacgcgctattaataacaatcaagtggccacacagtggggaatctaaacgtcgtaagctcgtaacggtctaagcacgccagagacggtggagaagatgccaaagaacaataggcatacgacatcaacggagcagggatgcagacaggagaattaagggctaagagtcgcgatgagtgctttggttttctgttgagctatgctcttcgcggtgggggttcgtaggtgttgtaggtgtgttattcacagggctggcgagctcgatttgaattgtaggcagaggagtgagctctcgcaactgtggcggatggctacctcgctctgcggtcggactttcgtacggaggcgcctctccccagtccaactgttcatagtccggaggggggatatgaagagcccccagatcaccttccccagaactcggaatcatggagtgagtggaagcagcgtgtgatttggaccggggtcaagctatcttgttccgataccccagtgtctgcggtatgagcagacgagtacgattcgcctcgtgaatgaacattcgtcagactcgacgtggatgaacgattgggcgttttccgtgctcatcgtatcgacattcgacaggaatgggcgagaatccgtatccggttcatcaagcgaagcan

SEQ ID NO: 6617 - DNA, 675 bp, Aspergillus oryzae
  misc_feature (1)...(675): n = A,T,C or G
ccagcagcttttacatttcttgaaccaacgaatactcaatatggccggaaatctagatgtcttacgggctgagaatgttttggatcttgctcagaaggctctacagggagacggaagtgtcgagtacagtctcaagactccttacgaagcggttgctctcatcggccatgcatgtatgctggctgtgaacttccgccttgtgggccttggtgaagaacacacgataggtttgtactttttagattattcttgtgctgttatttttcttgttttctctgctccttgctaatatttaaaccgccagaaggttcgtctgagaacccaactcttccgccaggatggaatgcgaacgataccgtctccttccgttacgctcattcgcagtcttcgatgcagtatctgctcaaagtcagccgtataggaaacaatgcccttattttcgccctagcactaggtgatgacaaaaccacttcctttgacattccagtcaaagacttcatttctgcgtccgctntgcctgcttcatcatcatcccagtcaaacgccaccctcagtgaagttttcatatctacaccacgattaaacgatttgatcgggctattcaagataaacgtgatccaaaagctcgcccctgggatatacaaggaaggatatgatgccacgagccagtcagta

SEQ ID NO: 6618 - DNA, 659 bp, Aspergillus oryzae
gtgtagatccagaaggctacgagcccgaaggacatgctggaacttcttcccccgaccattccgggtacttgctgtcaacttcttctcggccaatgccggaatctcgtggtaatggactgcggagagatttctgaacatcgtgtcagcactgttccagaagccgatgaggaaatggaactccaacgaccgtggaaggttcttgagccggacccggacaaacgaccaacaggacagggctggaccctcctcggcctccacaccacctcgggcacccatggcctctggcgctctcagtaatgaaacgtccccgaagacaaatgagaagtccaagaagcacaagtcaagcagctcctcgttctttcacaagatttcgcgtttggtctaaaaccacggtttcttccatgggagacaatatccgcattagcatccagccaggccgcaaggagccgccgtctttcgatgctttcgcgttcagggtccgatatccaggggacgtacaagggcgctgactggtacgatccgcaaggcgatgacagactgcggtcgacctaacactctggatgatcaacagcagggagaacgggcccccctcgcctttggttccttcaaaggttttccgaagctcggaattacaggagctcacggaggcagtctgggtt

SEQ ID NO: 6619 - DNA, 662 bp, Aspergillus oryzae
  misc_feature (1)...(662): n = A,T,C or G
gagacaacaatggccgatccgatcggtgtagccgggttagccctctccgggatttcgctattcttccaggtctacgcagggacggtgcaagggatccagctaatgcttgttgcacgtgatgtgcctgacaagtatcaacaattgcgacttcgtttggagatcgagcaagggaggctccttagttggggccatagctttggattattgcaggaagaatcggagaaggaggatacatcgaggatttcgatccccgaacaggtccggtatatggttcagggatacattgagccgctgtggcaaaaggtcctgcatttcacggcagagaccccgggcttcgttcccagggacaagagagaagaaacaccgagcgtgcatcatggaggcatggcgcgacggtttcggctggaccgcatgtatgcgaaggccaggcagggaactattaaattcaaagaccgtgtcaattgggcttattggcagatggacaagttggaagatttggtggaatgtatgagacatgtcaatggtagtgtcatcgccctggccgaggtgaaaacgcagcaggagatccaggaaaccgttaaagcgacgctgatgggcctgctcagtctacaagacactgntaatggactaaaggagctaattgtggctgtcgaggagaagcg

SEQ ID NO: 6620 - DNA, 672 bp, Aspergillus oryzae
gatttctgatctggttagattcggccagcagaccttgggatataggacttacttttctaggatggtgttggtgctcgtgataacctctccgtagacgatgctggagccgaactccctcgcaccctccctcatttgcgattggtattgtcggaggttagagtagaacgcgtggtggttgaaatagggggtcatctttgacaaaggtacgtcttcgtgaatcactaggtgttttacaatggcattgtaatcgacgatgccctcttcagccttacccgagtcctctttcgaatcgtccggaagggcctcttgaagcgattccatattccaagcctcaggcttctcgatgcggaacgtgtcattctcgtccttgagatactgatgctctccatcagtagtgatgagttcctgtaatgatgagaggatcgaagaagtatccgccgggtctagagaagagatatgcagcgaagagagcgaaggcacggtcgtcgtgttctgcgtgacttgcagtcccaacttagtcaaacaggccttcaaaaagtccgtccgggccctgtcatccgcagcttaagcgtctaccattttgccgtattccgggccaccggcgcttttatcgaggttcacggcagcggatctgacacattaacctctgttcaaacaccttgccagaaaaaa

SEQ ID NO: 6621 - DNA, 673 bp, Aspergillus oryzae
gtttggctcgaactgttgcgtgtccgtggatatgccttccttcaccgaccacaacggggactctggtcctgatattgaaggatttcaaccgatttacggtaccggtcttagcatcacctcactgcagaaggcccgtcacgcaaacggcaatgggaataccgcaattgcgcccgactccagaaagcatcatcctgccataagcaaaaaggcaaccgcacgcccaccactctaccccacagcgccattaagcagtcaatctagtgccataagcgagtcaggtgcacgggatgaacaagaaatgcagaacggcgaagaagatccgcagaatgcccttttccaccaggtcttggaatggcttcagcgtgaaaaatctaaacggaaatctcccaaagtaaaagcgcatgcacaaccagatggttcgggtagcgatggggatgatgaggatgatgaagacgctggtaatggggatggtggcaactcggagaggacaacttcccatggggccgacaatgtatttgccttaaacaagctggagaagatcctcatccagtacgctgcttcacgcagtgacggcgctgggcctgcttatcccgctcggcggtcaacccgccggcggtatgtgaaagggctacggaaggggtcttgctctgaatctgaatacctaaatggcgac

SEQ ID NO: 6622 - DNA, 698 bp, Aspergillus oryzae
ccctctgatcgacgacgaactcttgcccaacctaccttatcctttttttgtccagtcccgtcactcatcaagacccgcaacaccctctcactcgcccgatcttaaccccctctattcccttcagtcactcggctcgcagacatccgaaatcacactctctgtacaaagcttgagcgacactctctatgaagcgcgggagctaacagccaccgcctctcgaagactccgatctgcgcgcgaatgggtctccgaactccgccgtgaagaaaaacggtacgcaagaggggcccgcgatcggttcgaacaaactgtggcgacgacccagttctgaaccggccgttctaccctgaagaaaatggggaagccgaaaggtgcgaacgcaattccgcttcgggaacttggacccaaaaccccgtctggagggaaggcttacaaacggttttcgactccccatggctcgggggggcatgctggtctcacttcagtgcggcgacgtccgaagcgatctggggtgggggccctttggcgcctttccggggggaaaaggggggggagaggatgggtggacaccacggaaaggggacgtcccactaaaacatgaggacaaaaccactttgacgcccgacgcgaagccgtcgaagaacatcgagagcgcccatgctgcccgacaccgacatagatcgcggtggacaacgcca

SEQ ID NO: 6623 - DNA, 691 bp, Aspergillus oryzae
gatattacaggaaacacctcgtagaaacatgcccgcgtacgagtgacgggaatgcccggaaagcatgttcccacaggggtcattgagaaattgaacgatctagtctctgctatccccccaacgaatggctggatgattgagctaggctacagtgacggctcgtcaactacagatctcacggtcggatatcgcatttacatctccggcgacacactactgatcgacgacttgaaagaaatccccaggcgctatggtgatcaaaagatcgacttgatgttggcgcatcttggtgggacgactgttccattaccggcattgggcccattggcgatgatggtgaccatggacgccaaacacggagtgcacctgatgcccctgataccgcccgatgtgaccctttcaatccattatgacgactttgacgtgttcgccaggttattggaagactttttaaaacactgtcaagaggccgatatgggtatgggggggacatttaaacccccgagatgaagttttgtttctctgaaaaacttattttttttaccccccgccaatatcctcccataaaccctctgggggggggttgttcctccatgacaactccatattaacaccctttttttccgtcaatataataacataataaatttactttcctgggcgattacatcattattatataggggccccg

SEQ ID NO: 6624 - DNA, 681 bp, Aspergillus oryzae
cagatccaagtgtacgctttgacgcatccgtggcgcagtcgggtctacaatgaacattcccgcaattctcggtattgggcacgccgcccgctcgggaaccttcgatttcgcctacttccagtccttgggtcatgtcaatatcggggaagaggacttgcacaccctcttcgccgaagctatattatccggacgcccgtgtaccttgcgcgcgtcgtatggcaccccgcacgttgttatggggatagattatatcaccgcggccgcgaatctgaatagcccactgacgcaccgccgcgacgtgaaattcgctcacttcatcacgcctgatacccaagctggtcgagcgcatttcgctaacgaggcttattccactaagaaacttcgtgttcagctttaatctcacataccccgagaggccacgaccacattcaccggtgggtgggactccttcttcaagcatttaaaagcgttttgcttgttccaccacaccaccctgttcgaaaaggtcctaccttttgacgaaacaaaggggtggcttcccttgttggaaatggatatatccccgcgggtttcttcacggagctcaaggttgactccccccccccctgttaatatggggcggggggcgccttcgattttgtatgagtggcggtggagcaaagctcttgtataaacccggat

SEQ ID NO: 6625 - DNA, 1346 bp, Aspergillus oryzae
  misc_feature (1)...(1346): n = A,T,C or G
cttgtctgtttgctttctattccattgattttccaatgccaaattgcaccgattaccacactgagtaatcatttcgcacacctttctacttccctcccacgacctcctcatctgcggccagctagtataggcctgaactagccatggcttactcccctgcaccggcatcgcctgtgcctggtggccctggtccaagtttggtcaataacttacactccaggggtcgatcggcaagcccaccgaccagtgtacctctttctaagcgagacaagcggcgcagcgcgctgcaagagcgcctacaagaccttacggcctccttcagccaaaaccgagatacccagtttcgccagcagctccatgccttgcaatgtgatatgaccctcatcaacaatgccgatccatactcgcctggtcctctgccggactcgtcggaagagatcgcgcatttaatagagactactgtcggtgggggaaaatttgcaaaggagatgtcgagtctggctggcatgtggtattcccgctntgtgcaggaagttaatcaggctaaaaccgaaaaggatgcagatttggctatgctggtgcaccgncataataataacctagaacggttcaaaaggaatacgcttttcgcgttcattttgccgaagaagaatacaagcatctgtctgctacccttctatagcgccttgtacagacaataacgggcaagaggactcgcctgatgcgcgagaaggagcagctggatattgcagatactaatgctttgcttctgcatcccaatcagttcagcatcaccaatcccgctagtcctggcggaatccacgggaaccgcaaaacccgacacacccgccaccgtgtcgatctggtggacgagctgggcaatggtattctggcggacttcaataagagaaagcggaaggctcctgaggaggacgttggatctccagtacgggagggcggctacactaacccggctgaacgtgcgaaggcccaggtggtgcagcagcagcatgccccgtcctattctatacagtcacttttcacggagaaggagctgagcgcccatgctaattatgagcacgttgtgatggtttacttcttttatacctccaaatgagccgatatgcctatttgttctggagtcgacgtatactacacttatctctaggacttgttggcgtcgttctcgtcccttttaacgctgctattccgatatgcattacgctggttgtgatctcactgcacactgatgatggctcctgtcgactactatgacgaatgtccatgaccgtcagtcatcttcggttgtctgataccatcgatctaagacgtacatcttcttaccg

SEQ ID NO: 6626 - DNA, 676 bp, Aspergillus oryzae
  misc_feature (1)...(676): n = A,T,C or G
ccatttactcaccttcatacccttgacctttgagaatccctattcgccaccgccatcatgggtctcaccttctccaagttgttcgaccgcctatggggcaaaaaggagatgcgaattctgatggtcggtcttgacgcagccggaaagaccaccattctgtataagctgaagttgggtgaaattgtcaccaccatccccacaatcggtttcaacgtcgagactgtcgaatacaagaacattcagtttaccgtgtgggatgtcggtggtcaggacaagatccgtcctctctggagacattacttccagaacactcagggtattatcttcgtcgtggatagcaacgatcgcgatcgtattgtcgaggcccgggaagagttgcagcgcatgttgaacgaggatgaactccgtgatgctcttctccttgttttcgctaacaagcaagatttgccgaatgccatgagccccgccgaaattacccagcagcttggtctgcaaagtctcactcgccgtgcttggtacatccaatctacctgcgctaccaccggtgacggtctgtacgaaggtctcgagtggctcgccgatgctttgcggaaggccggcccgngattaaatgtgtataatgcgatgagtgaaaaaatacctggacgtttgacttgggaatggggataatggatgg

SEQ ID NO: 6627 - DNA, 964 bp, Aspergillus oryzae
  misc_feature (1)...(964): n = A,T,C or G
ccgtatacaccgcgttctttcatctatcatcagtcgcaaccgtttgtcgacttttgatacgcataatcttcttcccggacctcatcgtttttgagactttattccaccttttttttcacataaaatatcaccatggctgccccagtcccaacctttaagcttgtccttgtcggtgacggtggtactggaaagaccaccttcgtcaagcgccaccttactggcgaattcgagaagaagtatatcgcaactctcggtgtcgaagtgcaccctcttaatttcaccaccaaccttggacaaatccagttcgacgtgtgggatactgccggccaggagaagttcggtggtctgagagatggatactatatcaacggccagtgcggtatcatcatgttcgatgttacctcccgtatcacctacaagaacgttcccaactggcaccgtgatctcgtccgtgtctgcgagaatatccccatcgtgctgtgcggcaacaaggttgatgtcaaggagcgtaaggtgaaagccaagaccatcaccttccaccgcaagaagaacctccagtactacgatatctccgctaagtcgaactacaacttcgagaagcccttcctctggcttgctcggaagctggtcggcaacgccacactggatttcgttgctggccctgctcttggctcctcctgaggtctcggtcgacccggaagttttgaagcagtatgaggcggatatcgtaactggctcgggccaaactttgcccgatgatgatgatgccgatctgtagcctgagaacaataaatggatggggctggacaactgttatggttacggtccctcccaacatgttgggttcgttatgcaaagtctttgaatttccatccaacgatagcggtcggaggatgaatttgcggatgatggggaataatatgccttnttcatataactactaatagtcttaactcttcccaag

SEQ ID NO: 6628 - DNA, 688 bp, Aspergillus oryzae
  misc_feature (1)...(688): n = A,T,C or G
gtactctgcgtcgccgaggcgagtctccgcagttctcgcgtattcgaacaggcagaagataaggaagatattgacgcagcaaagaatgcccaaaaggagctggagcatgcagatgacggtgactttgaagaccgaagtgcctctcaaaatactcccgctcaaacacctgcccagacccaggttggaaccccattagccgccggcgatgaacttggaaatcatggacctggtgtggacgaatttgtggatgctgagccacaaactgctcacatcgatgattacctcttacggtttatggaatggaacttgaaggacgaaccgctcgttctacccccggacaagggtaagaagaagtctaagaagggcaaggagcatcgtcttcgcaaaagacgccgttaagacgagaaagaggtcatggtgaccacgacaatgttttcgatgaagagtttaagggccaaagcgtccaatgtaattgtacttgtgattgactgctaaagcttgtgtatctgactcagttccggcttcttcntcgactcaatggatgaccganaggccaanggaaggaatcctgctggagnttggaaggcgtccgcatggaagaaaaaaaatttcatggcattatggaatggacctgaaaggttcttcctttcattttgattcaggaaccgggggtagtgattgatggatn

SEQ ID NO: 6629 - DNA, 668 bp, Aspergillus oryzae
  misc_feature (1)...(668): n = A,T,C or G
cgcaactaaaagaaccgtttacccgacgatgctctaggtccgagaatcgaccgtacttctacccatttgtacagtacaagttcgatcccgaatgtggaagccttcggtattgagactcgccagtccagggggtcgaacttgacagccatcgattgtcatgaggggaaggtccattcgagtctccactgttcccaactcgtaccaccacaatccggccactccatgcaacgggcggacaagcgcctttgaccccaattctcccatcagagagtaattccagttgggggctggaatcaaatgggaaggaaaggtaaagagagagtgtggggaggaggggggagggggggtggaagaaangaatgaagagaaaaattccagttacagcaatattttggcgcagattgtattgttatgcccacccaccggactatctcttatatcgatggtccgaatgtttgacgctcatttttcaaagtgcgacgaatatccgtatattccttgacaaccccaacatattatgatgtgtgttgagttctaatggataaattgatatgactaccagggcatgccgattgggaaacctttgtgatattatgggcataacctcccatttaaaatcccatttataccaattttccccactttgacgacaataaaaaaaattaaga

SEQ ID NO: 6630 - DNA, 648 bp, Aspergillus oryzae
ggcctttgtatgtacatcttagaatgctcaattgaacgtcaaagatgtacatacaaaggccgaaggtactaacgagaatagagatgaaaatggtgtcgagctgaaaaaagaaatggaaaaaaacaaatggcaatatcttcggcgcaatagagaattttaaagtcaaaccttcaaatcgcatcataccatcgtacacgcctattctccatccttatacctcaacattcagtacaattttggtcgggcgtgtcccacaaaacagtgccgaataaggaagcccttgcgcgatcagcatatccatcaccagatgcagtcattcgtgggtggctgatcgagcaagacatgagatggccgaggcatcttaagccgccaggaggggctccttctccgcgttcaaagcaggatgctcaatcgactccgccacagccacgggctcctccttcacagcaacgggcttctctttaagtgcctctgggaaatccgtagtctttgatacgggctcggtgtcgatctcctttttgataacgggcctcggggtggagaccttgggcatctgcggagacacggagcgacgctgaccgatgtattcctgggccttggcgctgtaatcatcaacggacttgtttattaagcccgtcgcatgggagt

SEQ ID NO: 6631 - DNA, 690 bp, Aspergillus oryzae
  misc_feature (1)...(690): n = A,T,C or G
cggcacgaggcgcatattctccctgatggccgacgggttaatcgacccaaccctggtgtacgaatgggcggtagtcacctcaatctacgtggcagggttaatccccaagcgtatgtgaatcaagattcagctttgacgaattctgtcctttcgcaacagcgaatgaacggtcaagagccccgatatggccctcaagttcattcgcaagaggaatatgctaccacacactctccacaacaaccatatgacgccattcccaccatcgacgcgggcttggcttcagactccgggtctaagtacggttctccgattgatgacatgcgatttcccatgtctccaaatcaccgtcatttaaccgcacttgacgcacccctccctgcctcctttgatagccaaggaatatcgcacgccgctcgttatgggccagtagccgcttctatgccatcgaaattcggactgaaactatccccgcccgtccaaaggattggcgcccactccgatgcgctccgaagtctccgcgataccgcatatggatcggatttaaggaagccaccttctttcatgggctcttgcnctnctgagattcctgangatggcccgggacctcgatttttgcattcacagcgtttcgtgaaaccacgaatgctctctgcgagtgttccgcggcttaccgcttaaatgattgggatg

SEQ ID NO: 6632 - DNA, 304 bp, Aspergillus oryzae
ggagtgacccattgatatagcaatctccggacccctcgttggatacgccggacgtcaaagacaaagatgtcttccacagctatccccaagcgcatggcgctgaaccgcaacccgggcacggattcctccgtccccagcgtctcggtgtctccgtttgacagccctcgccattctccgtcctcgacttccctttcgtcgctggcgtccgagtctgagaacaagggcaagatgttggacacctatggaaatgagttcaagatccccgactacaccatcaagcagatccgtgacgccatccccgctc

SEQ ID NO: 6633 - DNA, 679 bp, Aspergillus oryzae
gcggcgtacatttgatcacttcgttacaattagtttcgatcgccgttaaaatcatgggcagcctttcccccttcgatgtccctttcgatgagcttcccaaccccaaacaagtgtgggtgggaaagcctggtagctatgaagaagggcttgggaagttagctatccttacctccgaagaggtggcaaaagccgcttagaccgaaatcaagactggtcggagagtcacgatggggtgggatttaacgaagttgaattattcaatcctaaaccgtcggccgggccagcacaagatcgttcctcttctgggcggagtggcctatgatgatatttacaccatgaatcctcaacaaagtagtcagtgggatggactgcgacacttatctgaaactgttcctggccagaccgagcgtgtattctacggcggtgtgacatctgaggagatcaacgaccgtagcaacaatcggattggcatgcagcactgggcgcgggaaggtattgcaagtcacggcgtattgattgactacgccgcatgggcggagaagaatggaatcacgttcagcgccttgtccactcatcacgtgcgactatcatacattctagaaatggcgacgagggggacatcacttttcaaaagggcgaaatcctgtttgtcctgttggattaccccaaaatgggaccc

SEQ ID NO: 6634 - DNA, 669 bp, Aspergillus oryzae
  misc_feature (1)...(669): n = A,T,C or G
ttgtatacaataacatactattcgactcttccgcgtgtctggattgtttctgtcgattttcttttttctttttttttttttttctccgcctcaaacccttggacaccacaaattctcaaccaaaccaaacagaaaaaataaaaaaaaagccccttctccaggctccaaatgatcggtggttctgtcagtcaaatgactgcgtaattgccggcgaagaataataaaaatcattaaaaagggaaacgaacctctcaacttctcctcccgcagcttgaggaaccgaccttaccttacctaacctaaccttttactcctcattcctcgtgattactggtattattattccttctcacccgcatctaatcggcactcccctatattcaaaccacccattcctatcgtccctcgttcgaccaccacccactttcgtttctgaattctcctttcccaccccttcttgattcttggggggttcagtcaacccatcagtcgcttttagttgacccatttccagccactcgctgagaagggtcctcgcctgactctgcatgtgctcagccttacaccagtcctgaacgatcaatcggagtgtgcctcttccgccaacacaccaactttcacccgtggctttggcaccatcaagcctncttctctggaaggagattccan

SEQ ID NO: 6635 - DNA, 687 bp, Aspergillus oryzae
  misc_feature (1)...(687): n = A,T,C or G
cattattaccaccattaccgttcctactattcacactttgttattccgttacaatcaaaaccgtctttcacaatgaagttcttcgccattactgttgcctccttggcttctatctctggggcatttgcctcggccaacggcggcaacgatgcatgcagcaagtacatctataacaccctttataacgatgccagcgtcgacgtgtaccactggagggaggtcatcgataaaacaaacccgaacccttgcaagtccgccagcggttcatgcggcgcggacctgtatggaattttcaagctagaccaaaaccaggatttttacaactgggggcaggacatgcgtaaattgagcacttgcacggccaccaacgatgcgtgcggcaagttcctctgggacacctttcacgaggcaaagagcaccgacatgaccaactggaagcagatcattcatgccaagggatcgaacccttgcgagtaagatcttctccttttcaagtattccactaagttgatttatccatccttgtcaagtttgttggatactctcgctntatcccttcagaatcgagcgcctgataattggttcggaggccganggagaaaatggggggatgctngttgaaactcttgatacaatagatcgcgttgggctagccagcttgtaattacaaagaaataatattgcttn

SEQ ID NO: 6636 - DNA, 704 bp, Aspergillus oryzae
  misc_feature (1)...(704): n = A,T,C or G
cgaaggcgttcactttttgggatcttgttggcccaatatagctttggtttcaaaatttttgcccacccacaccatcgggaggaaagtctattggtaaggctcctcaggatactaaatcgattaatactgtgagaccacgaccaagtcgaatcatatattcactttcttcattaggagtgcttggagctgtcctgctaagcgtccttcttttgttgcttattactgcaaaagaccagaagagaagagactgcaagagctggctctctacgcacctgaggttatcagttagcttactagcaagacttgttgtacatgccgtttggtcgacgctcgtgtcgaatgacaaccagacaaaatatccattgaattacggagtgactcangcaaatatagttcgtggacgcggccttcattcaatggcacctacacaacaaccgactgtagaggagcggagctcttcggacactacggcctcgtcaataaaaagccctcgaatggctcgctttgtggaagcaacgacggtgcaattcccgactggccctgctgacaccagcaagtcaccgtttgcagacccttccggtcagtctaaacgcaccctgatgtgttcgacgtaagctttggatatgttgccgcaaatgattcggtgcagcacgtattccattaccaaattgccgtttttaccactcaaaagggctttaaaaatt

SEQ ID NO: 6637 - DNA, 672 bp, Aspergillus oryzae
  misc_feature (1)...(672): n = A,T,C or G
caaccttcttacggtgcgattcatgatctatacggtcagctatatgtacatgtcaagcgtgagctagagacgttttgtaaacggctacataccctaaaccttaacgtatcgcttttcaagaaagatgcaatggatttgccagatacattagccacattgagggacaaagaaacattctatgacagaatcgagcttgccaacatcgccgacctcggatacctaggaccaccaaaaacccttgccttattcggaccccttctcaaaagcaagaagganaacccaaaagccacacttatcatggctattctcaacgctacgagagagatgtctacacccaaagatcaggtcgcgtgtatgtttcgtgccatggaaacactacagcgttttcggccattgagacccagacggggagatcttccaattaaatataatgccgaatttctgaaccagatgaatgctatggatttatttacggataatgatactctctttgagaggctcgttgaaaacgcgcggtttaaaatatgggccgtccccttggtctggagatgaaaactgggaatagccattgttgcgaaatgggccaatgcggttgggagggaatcccacaccgcatgagtttgaaatgcctttttggtctgggcatactgtttgcaaagggtatttgaaggn

SEQ ID NO: 6638 - DNA, 629 bp, Aspergillus oryzae
catttctccccgtatttcatcccatatcgagtaaaggattgatccacggttccatccgatctagaagatccaaggaatcgaacactctggttctggatcctctccgttgcgtcccctttccaggatttggttctcagcctcgttgtgtacgatcatcaagaactgactggagagaaaggacaaacagttcaggaagtaaaaatagaacacagcctgaaacatcaaagtccgagactaaaggacaaagactatttccgagtcattacaccggatcattcgctttaagcgccgttcgctatctctgttagtccaaagttttcaaatctcgcattcggggccgtttcagtcattgtcatatctgtaccgaaattcctacaatcctcgacgaatcgtttgacagcagacacaacgccatacctaccccgcattcaaccagaacgaatcccggaaactgtttctctatcagaatctccagggcgtacgaacttgcttaaagcgttccaaaagtatttatataaagggagccgttacgttgaacgaattttggacattccaccaatatggtgcgacaactttcttcccagggaagtgtacgaaaaaacttcttcaacgtttcgacacatattaaa

SEQ ID NO: 6639 - DNA, 714 bp, Aspergillus oryzae
  misc_feature (1)...(714): n = A,T,C or G
cagcatcccttaggacggactttgatgcggacggatcaacatcgcgattgactagaaagtcggtcgtgacctcgacattgatcaccattccaagaattaagcagtgctatactgctagtcaattataatggccccgttcggcgagaccattgccgtgattgataagtccggcaaggtagtgagtacgagcaagcaattgtttggtgttttcagcaatgccaagaatgcatatagcgcccgcaaggcccaattccaatcagagcggaatgctattatcgccgaaagagaagctctgaaggcgatacaaaattatacgattgacgatgcgccctccgtcgcctcttcgcggagaagtcgttcgcgacaccattcgggccgcagccaccatgcccggcactactacgacgacgactatgaatatgagcaggaccgcggttccgttgcgtcgcgcccggattcttactatgaccgcccacaggacctagtccgtcgacatacccatcatgatatcgccatgcggnggcccgaagctcgaccgacaactagtcgctcaaagtcagatgcacacatcgacatggacctggcgtacggcgactacaatcctcacgtgttgaccaaggctccgccacaacanaaccaactgcagaagattgaggacccagaacctagtggtctagtaaaccgcgcccaatggctcatggaggnagcccaatg

SEQ ID NO: 6640 - DNA, 649 bp, Aspergillus oryzae
gaaatctgagtgaattctccttcgtgagatagttaacgtcatctagcgccagtcatctctaaacccaaggaagtaacaagagccgtggaaggcgaagaaagatgcacaatgataacgagagaccaaagaacatcccaccctacacgccgatgtcctcgctcggccatgagttaggtgtgatgttcgcctttcttgcggcctgtttcgtgatcatgggattatacgtcttcttttggcgagcgttcgaacgccgggaggcacaaaaggaaaaggcccgcaaagagcggtttactaggagagacgtccaccatgagcgcagcggcatccccgagaaaatgtatgataatcggagagctatattgccggagatcagtagatatgaacttccacatgggatttaatatgggggagatttgcttttatgtgatggggtgtatttggtgattcgtgattatgacgacattatattgttgtgtatttatatttggatgttatgccgtcgcatttccgtcaggtgtcgacgaaatgttatcatgattatgttgatatcgctatgattacagagtagatcgccatggtgtcgattttaagattaagattatgatgataacgttgatgatacagttgaagatgatgtagtggtgttgcg

SEQ ID NO: 6641 - DNA, 585 bp, Aspergillus oryzae
  misc_feature (1)...(585): n = A,T,C or G
cgagggcgacatctgtcttggggcttcgccgcagccggtaaaggggagggcgcgaacgatcggtaatctattggcgcttccgacgacctgcaggcagatttattgcgaatctatctatatgctgtacaccatgaatacctttgaattcagtaatacttggtcactcacatacctccgtccgactatacccccgagcttttgggacgcaatccgccaagttgaactttgctgggccttcccaggccattggttacctagtaaggaccccgtcaagactgtctacttctccgctggccggcagcagtggattgagacctgtaaggcattgacgcggatggagagtcttcagtctttcactctccaactgagcggcagctggttctgcgaaccggtggagaagatcccggttttcctggaaccattgcgggagctgaacctaaagcaagggtggaagttgcagttacccaagcagccgtattatgtcaaggagatccgaantatcnnnngacgacggtggngaaaaccttttggggtttttaattttttccttttttttttttcccaactttttgagggaaggccccg

SEQ ID NO: 6642 - DNA, 651 bp, Aspergillus oryzae
cgtcgactccaccggtactgcatagagtacgcgtaccaattattcaccgatccgcgaacagatccccaggacatctatcgtgtcttccgactggtgagctgcgtgcgtcaagaggataaattggcccgctgtctttcgtccctcctcagtgcaggcccaaaagagtccttggaaagaccaaatgtgcctttctactgcatcggtggtgcgggtacccattatccgcatatgcagcccgatggaaagcctctgtatcccgagaacatgcggcttccgggtcgagtccttggttccattccgggtagtgctcaggagatggacaataaatcgtcgtcggagaagagacaggagcttcttaagttatacgggctggatggtacctggcttgattgtcgtgatgtccagggttatcttgaagaaaagggcttctgtcttgatggtgcgccgtgtatcttcgccactcctacgcttgagaaccagggagaattctccaaaggctgcgctggatcaatcgaaggacattcctatgaatctagatgatagtcataagctcacatcgtttgccttgccgtacgttgatggcacggatgagcgcaattctgaaaaagcaagcaatgcagcaagacaggcggcctgggtcctcaaaattgt

SEQ ID NO: 6643 - DNA, 666 bp, Aspergillus oryzae
  misc_feature (1)...(666): n = A,T,C or G
attttcctttacggccaggaacaatctgagcagaggcgacttgtcctctagtgcagcctcgatctcacagccagacggctatgtcctagctacgccggccatggatattcaagttgactggctctgtccaaatgtttttgccgctggcacatcccataatggcacaaacatcgatgtgataagggcatctactctccttggaaacgcagtggtatgcgattttgggcaggctccccaggggaacccaaatacaaaacctgttcattcagatacctggcttaacatcggggatagggtgcgtttccgggattcgatatctgcagctgccaggtatccttcgtatcagcatctgcccgctgaccaaacatttggctacgatataaacatcctccgtgttacttccatgaaaacagaggccactgttcagtggcaagatgggactaccaccaccgaagcagccacttctctgcacaaattctttggcgttgaggatgaagtctggccctgaaaatgtagtgtcttgaaagaagtatngagactatccgagaatcctgcangaaccatacggnngtccttncggcaccgtatgaaagagacattgcatgctaggagagtcggggtggttcaaaaatgtgatagccggaaaagattagcattgtcccgtgn

SEQ ID NO: 6644 - DNA, 642 bp, Aspergillus oryzae
cgttgttgactaccttctgatcgactgatttacttctttctttcggattcccttctttgtatctttctagccgtcgactttcggtttattcttatttcatttagtcgtttttttctcattccctttccattttccttccaccccctccggaaattacaaccaggccagcgattccgatgggcatctcttcatagctcctttttctggtggtcgaagactggatcacgcttccatattcaacgaaaccttttcccttgccatgtggtgatcgcttggactgctagattaacgtcatgaagctcgccaacaccctgcacgccctccgacagcggtgggttcccgtctttcacaaattgcgctcctcgcccggggaggcattcgatctcttctgggagtttgctcgccgatatttcttcttcctcgcgttcatctcgctctttggcgccaaattccttcatctcttcggtcacctacactcccttcccgtgagcaaattcctcctcttgggccgtgcatttttcttttaagatgtcatgatcctgctattgtttcgcaccctcccccacagggttccgtggcggtctttggctgtggtgggcgcgatcatcggcgttccgttccatttggtgatgtccgggatgt

SEQ ID NO: 6645 - DNA, 465 bp, Aspergillus oryzae
cgagggcgcactaaaactgcattgcatctttatctcttcaccttttcccccatcttctttttctttttaatctaccccttgatttccccttaatctctctagccgatgcttcaaatctattggatggagtgagaaacgacccttgtttttcttttcatttttgatcttctgtttatttcccatctatggcgtgttgatttctttcgttgtggcgatttcatgcctgggcctgcatagagtgagatctactgggcctgtacaaacaatcatgagcctgggatagcatatccaacgactatatacgagaaggtgaaggaatggacaatgatgacatgcataatggactgactcggcggatgagttctgtgtaccatttggttgatagattattactatagtaaattaacgtatcagatagaaatccatcaatgagcgtaaataaaaaaaataaaaaaaaaaattcct

SEQ ID NO: 6646 - DNA, 225 bp, Aspergillus oryzae
caagggttcacgatctcgaagcagttttggatcttcgtcgtggctgcagtaccgcttacgatgctcaccctgggatcttggtatatcatcaccaaacggcaggtgaaactgcggcagaagaggaaggaggagagagcaggaagcaagatgtgctgagatatttttccttcgtatctttcctttgtacttgtctatttgcttcctcttttcataagtatatatgtc

SEQ ID NO: 6647 - DNA, 658 bp, Aspergillus oryzae
  misc_feature (1)...(658): n = A,T,C or G
cgatttatcactgccttttctccccattgttgcccgaaacaaccttacagagagagagatattctgggtcgagtacagtacaacagttggaattgacgttgggtggcatcatcgagcatcaccccgtgacttcctatggaattttctccatcattatcgctcattatcactcagccctgactcaacgtggtgccagttcatctcattgcatttgaactattcccttcttgttgcttctatcttccaacttacgctgttctacttttagagtatcgtggcgcagtgtccttgggcctgagccttgggatttttctttatttttttattctatttattttatctattttattttatctaattatcttggatttttccccatttgcccctcggcttgcctctcccgcaagggaaaaccaaagtctctgatacggtggaaccgtgccttggtaccgtacgttaccgatctttggtgaaagtttaccttgcaaccaaacaacaatccaatccgctgtgcctgggaattgccggtcccatttttgcctcttggntcctgggctgacgggcagtacttcattacttagtacttacttgttccgctccctttctccgttttcttcctgaatctcctcaacccccttactgtctctccatcatcata

SEQ ID NO: 6648 - DNA, 599 bp, Aspergillus oryzae
aaaaccggaaagtttaattttctttgggggaaactaaatctttttttatttcctcccgggatcggaaattttgacctaaaaaaaattggtctttcccttgtaaaaaaaatctttaatttttaagggttttttttttttcccccccctgttttttggcaaactcttaattgtgtttttccaccttttaaaggggtttggccttttctttaaccttggttcccccaccccttcctttaaggttaccaacccccggagggtggacttttcccttggaaaaaaaattttttttcccccttttaaaatttgggttttatttttgttttcccgggggcgaaaaaagggttgggttgtgttttgacatccccggagccccccccaccagggttttacatttttccccctcaggagccttttttaaacaacttttctccccccgaattcaaacttttttttttttgttgaaaaaaaaccttgtttttttctccccaggggaggggggtgaaatttttttcttttttaaaagaatcaccccctctgtttccccccttataaaaaaatatatttttgggggttaatttttatcttcggaaaaaataata

SEQ ID NO: 6649 - DNA, 687 bp, Aspergillus oryzae
  misc_feature (1)...(687): n = A,T,C or G
cgcacatcgccttgccggcatcaagaatagaaaggatctgaaatcatctctggctggcggcctattcgcctcagagatcgccagtattgacggacaacgaagtttcagtatcatcacgaagcatgatgccaaagaggacatgcgggttgccgaagcgtccagccagatatcctggtggaaacctctcgcaatgtcgctgggttggcgaattcttactttagctgtccctcttcttgtcattgcgggcctagagaccacctaccagatctctcagaaacgaaatggcttggctgatatcacatccgatggttatattcgctacacctgggtatatatccctgcgtttatcatgctcttgatacaggctcttttcgaatgcagccacttctctactcaggtcattcagccatacctggagttgagacgaggaggattgaccgcacaggaaagcttgatggacaattacctgtcgaaactcaccatgcatgctctttggagcgcactcatcaaaagaaagtatgcaatttttactactgcattgactatgatcctggcaccttgtttgacaatcgccgcgagcgggttgtattctaccgaagctgctagctatgtgcgagcagtgtctatcttgagaaacgactcgttcaactcgaccgtggagcctcaagcttaccactcgggacagan

SEQ ID NO: 6650 - DNA, 758 bp, Aspergillus oryzae
  misc_feature (1)...(758): n = A,T,C or G
tgatggccgatcgatacggacgaggcgacatatgtcgccccatgccgacatacagtcccttctggggaaaataactggtggaaggaagccaccgtataccaggtctaccccgcctcatttaaagattccaatggagacggttggggggatatccccggactaatttccaaggtcccttacctgcactcactgggcgtggatgttgtctggctatcgcccatgtatgattctcctatgcatgacatgggctatgatgtgtccgattatgaaaatgtattgccagcttatggtactgtcgaagacgttgagagacttatagacgcctgtcatgagcggggcatgaaattgatcctggacctggtcatcaaccacactagcgatcagcataaatggtttcaagagagtcgcagcagcaaagataacgacaagagagattggtacttctggcgcccgcctcggtatgatgaacagggcaatagattgccccccactaactatcgcggatatttcgccggtagcacttggacatgggacgaacatacccaggagtattacctccatctatacgccaaagagcaacctgatctcaactgggacaacgaggctacacgaaaggcaatttatgacagtgcagtccgcttctggttgggacagggggttgatggattccgcgtcgataccgtcaacaagtacagcaagcacacggactttccagatgcgccggttactgatccnaaaagcatatncagccggcaatt

SEQ ID NO: 6651 - DNA, 814 bp, Aspergillus oryzae
gatattcagcgcagagccacaccataaggatttgattcttttggaagactgtcgccatcatgtctaagatcacagtcgccggagtgcgccagaatatccagcagctgctggactactctcagaatgagaagaagagaaacttcctcgagaccgtcgagctccagatcggtctgaagaactacgacccccagcgtgacaagcgtttctctggcaccatcaagctgccttccgttcctcgtcccaacatgaccatctgtattcttggtgaccagcacgatctcgaccgtgctaagcaccacggtattgatgccatgtctactgaggatctgaagaagcttaacaagaacaagaagctcatcaagaagcttgctcgcaagtacgatgccttccttgcttccgatggtctcatcaagcagatcccccgtctcttgggtcccggtctttccaaggctggtaaattccctacccccatctctcacgctgaggacatggccaacaaggtcaccgatgtcaagtctaccatcaagttccagcttaagaaggttctctgtctcggtgttgccgttggcaacgttggcatgactgaggatgagctgattgctaacgtcatgttggccatcaactacctcgtctctctcctcaagaagggatggcagaacgttggcagccttgtcctcaaggcttccatgtctcctcccaagcgtctctactaaattattgacgctctctggtcacgctgggggttttttaggagcttagaagtgggattgtatatgccatagtatcggaaatataactcgctacttcgttcctt

SEQ ID NO: 6652 - DNA, 682 bp, Aspergillus oryzae
  misc_feature (1)...(682): n = A,T,C or G
gatattcatatttctcccctcgaagacatctatctcgtaaccgagctcctgggtaccgacctccacagacttctcacatcaaggccgttggagaaacaattcatccagtatttcttataccagatcttgcgaggacttaaatatgtgcactcagcaggcgttgtgcatcgcgatcttaagccgagtaatatccttatcaacgaaaactgtgacctgaaaatttgcgattttggtctcgcccgtatccaagaccctcagatgacaggctacgtgtcgacgcgatactaccgtgcgcctgagattatgctcacatggcaaaagtatgatgtggaggtggacatctggagcgccgcctgtattttcgccgagatgctggaaggaaagcctctgttccccggcaaggatcatgtgaaccaattctccattatcacagagcttcttggtactccaccggacgacgtgattgagacaatttgtagtgagaatactttgcgattcgtcaagtctctccctaagcgcgaacgtcaacctctcgccaccaaattcaagaactgctgacccgatgcggntgaccttctcgagcggatgctggtatttgacccgaagaagagaaatcgcgcgggtgaaggcgctgcacacgagtaccttgctccgtaccacgaccccaccgatgagcctgtgg

SEQ ID NO: 6653 - DNA, 864 bp, Aspergillus oryzae
caaaacttctggtctggctcaggcttatgctcgtgcccgtgtttgccgaccgcatgtccagcttcggtgacatcctcgctctcagtgacgttgttgatgtacccactgccaagatcatctcgcgtgaggtttcggacggtgtcatcgccgcaggctactctcctgaggctcttgagatcctctccaagaagaagggtggcaagtacctcgtgctccagatggacgagtcctacgttcctccagccgaggagacccgtactttgtacggtgttcagctctctcagcaccgcaacgatgtggtgatctctccccagaagaccttcagcaccatcgtgactcctaaggacctccagagccttcctgactctgctttgcgggatctcactgtagccaccatcgctctgaagtacactcagtccaactctgtctgctacgccctcaacggccaggttgtgggtctgggtgctggccagcagagccgtatccactgcactcgcttggccggtgacaaggctgataactggtggatgcgcttgcacgaccgtgtcctcaacattaaatggaagaagggcactaagcgtgctgacaaggccaacgccattgacttgctctgctcgggtaacacccctcgcaacgatgcagagaaggccgagtacgagcgtgtcttcgaagaagtccctactccattcactcaggaggagcgggaatcctggctcgagaagctgagcgagggtgccaggctctccgatgcttgcttccctatcatcgacaatgttttccgagcagtccgctccggcgggaaatacatcgctgctcccagcggtagccacaacgattgccctgtctacagactgcggagagctt

SEQ ID NO: 6654 - DNA, 656 bp, Aspergillus oryzae
  misc_feature (1)...(656): n = A,T,C or G
catatcaagtcctttgagcagttccctaaggaaatctccggtccgaccgtttggaaggccgaggagtatcgcgatgctccggagaagtggactcatcggtttacggctgaggagatcgcggaattgagtgcgaccgcagatcaattcctggcgaacaagattcccttgactggtatttctaagagcaacttcccccttcccaacctctccaagcgcctcgccgaactgcgtgcagacctcatcgatggcaagggctttattctcttcaagggtttccccgtccaggaatggggtaaccacaagtctgcagttgcatacatgggtctgggcacgtacctgggttactttgtcagtcagaacagccgtggccatgtcttaggtcatgtgaaggatctgggtgaggatccgactcagattgactccgtgcgcatctaccggactaacgccagacaattcttccacgctgacgactcggatatcgtcggtctgctgtgcattgctcgtgcgcttgaaggaggcgagtccgacatcgtttcttcccaccatgtgtacaacacgctcgccaaggagcgtncggacgtnnctcaaactctcacagagcccatctggtacttcgacccgcagggtgagactagcangggacaggaggagtacat

SEQ ID NO: 6655 - DNA, 304 bp, Aspergillus oryzae
ctaaaaacgaaagacgaacgtacaatgagcgcgcctgtgctttctgagtctatacctatcacgatgaaaccccgcaagggctctaaaggagagctcgaaaggaataactcaagtgcctcgtacgccgctattgagaaattcggcagttcaccaccgcgtgccattcgatcccagacgttctccaacgccgccgatcccgtgcttacagcagataatgcaaagatcgacaaagtcgtgtatgacggcaaagatgcagaaaagagcagtgctgctagtgccatgattgaaatatcaaaccgctctc

SEQ ID NO: 6656 - DNA, 688 bp, Aspergillus oryzae
  misc_feature (1)...(688): n = A,T,C or G
cagtttcaaaagtccatctcatactatgcggcaccatctacgaggtctgcactgcaacatggagaggggtacggcaggatcgagcatctatttgtcatgttttatggacctgtacggcgaacccactttgtctactgttgctgacagacgctgctccctcttgccgccccaaacaaccgtctcatcgccaccgcttcccagcgccatggtgggatcaggcgacactggcgaagccaccattagtgccgtcagatctgacccaacaaatctcaagggccaccggagtcactcatatgagggtgacagtcatcaaagaaggatccaacgctgaaagtggcaacgccaccagcagcggtttaccaagcgatgaatccaaaatcgcgaagtacaacggcatttccgagagcgccaatagtaggggcgagtcagcctcgtagggttttagagaggctacagcaagagtatgtgcggacattgggccttctgggccagaccgagaggcaatgtcttacactagcagtttcaggctgaggccgaaaaatcacggcgatagcggcagcgggtgatatgcgcaatggcagataatagcccgtccaagggactcactcaggattcatncggtgttcggctggcgttgttctatgactgttngtacacgaaagtgaagaaatagcgctcctttatagct

SEQ ID NO: 6657 - DNA, 257 bp, Aspergillus oryzae
ggaagagatagaaggcgaacaaagaagaggactcgggcctagtgctgtgatggatcgatcttattgggatcttgacttgatgaatccacgttgaagtctttgtcagcggctcgaattttcaccgaacgcccgtcgagcgatcgtttcttcccccgtcccgcccacgccagtgtatgtcgtccttttgtccgtcacgatccgcagcggtccgtcatacgtctaaatcgctgtttaatatgaagacgattagcattccc

SEQ ID NO: 6658 - DNA, 663 bp, Aspergillus oryzae
gctgaagtcttcttgtcttttccgcccaatgacagcctgtcgagcaatccacttcctgtaccattcaggtgactcgtatatgaagaaactgcagcacctgtcatggagtttctaacccacttcccgaagtgtcgtagcggaagcatcaaacttgattttcttgtcccagctctaactcacaagtaaaccactacgatgaccatgaaaagcttctcgttgtcggaggttcttgccgtcgcgaataggcatcccttctataacccggaaattcaatatccattggacgagacagcattacaggcagtccgagactgggccgttaagaaccagacgggagttgaccttcggatcccagccattgcttcacaagaatgatatctataagactgtggaacgggtcacgcacgaatgcagccccgagaatgttgtacgttgaagcgcaataaatgagcaatcaagggcggcgggtccgggtggagtacaatgaagtttgcatccgaatgtcaatgaaaatccaaaagcaaagggtcaaatgggggaactcctaacggattggcgggggtttcaaggggttaagaacgggtaatggccgttgaaaatactaggggggttttaaaagggcccttgggcttgggaaaaaggggctttgggggaacacccggg

SEQ ID NO: 6659 - DNA, 638 bp, Aspergillus oryzae
gtcaagaaaagaagttcccttagtatcttctctttggcgacatctgttctaacggtccaactctctcgccctgtggcctgacttgtatggtctgctccatccattgcatgactcctactatgctgtctacttccacgcacgtgtaaaggtcaggcgcgtggtctacattgtcgtccgttacttgattctattcttctttctttctcactccttcactcgtctgaatttatcggtattcattttgatcagtcgatcttttccgcccaagatgccttctttcaaaccaactctccatccattgcaaacccctcggactatggtctttccatcagagcttcaagaggactcaggatcttccagcctttcagcaggcaatggtagaggggatgaaccactctcgacaccaatcacacctcccgcagcctacacagagttcctcaagaagtttcagcctatcttatcccctatcactggggagcctgacttttctaagatccacaccctgagggaaggccactccaccgcatcaaattcttcaatgtcccagcccgcatcacgcccgaccagtgcagtcagtggtacattcagcttcagtggtgactcgttcaggtcagccgccgcttcgctgccaccaccaa

SEQ ID NO: 6660 - DNA, 671 bp, Aspergillus oryzae
  misc_feature (1)...(671): n = A,T,C or G
ggtcactggaccgtcgctggagtcgaaatcgatagtttcggacgagtctgacaagcttggatggaatgcccactcagaagtatctgacgaggctatgagtaagctgcgaaacatcgtttccgaggaagtcggaaccctacttcgagctttagaacgtggtcgcatccgattgaagcctggtcgctctgagcgtgagaaaatgtctcccatcgaatccaaaaccagcatacgcaatggtcggtacggtggcgatggagcacaggacgatgatgcgcggacttttccgaacacggtcccaacagagatcctgtctctttcagataaaacggacaagacagaagaacatgaacctgaacttccggctaccgagtccgatgcgactagtccagagtgatactatcacgatgtcgtcaacacgatatagtaatagaatacggaggcttgtatcaaaggctcttgcctattacgtgactctagcatacaacttnctatgccaaagtcacttaataggcgtaagagcctttaatgctctaccctcattggactatccgtatcggcgtcgacgggtgtccttcactcaatctcgtgtagatgtatcggtggctagcacaagatgcagagaatgctnctattgtgaatnctttgactcaatggaaacattctctgtgtgt

SEQ ID NO: 6661 - DNA, 707 bp, Aspergillus oryzae
  misc_feature (1)...(707): n = A,T,C or G
tgcgatgtattacggagtacgatagaacggtattggttttgatgggtaaggcagagaggcacatacatactgtacatacagttctgacccacgatccgacccgatcgtcaaaaaagcccctgcgaccttccactccattgcccatttttgaccccctcctcctcctacttactcctcagtgacccccttcgagttccgctgattgtccccacaagttcaccgtttccaacgcgtcacaagttacaacgccgttacgcaagggttacaataatgtggacatgttccagagcccttgtccttcctttcgcatcctttcagccttgaccttcttctggttcaattttacccttaaggtttcagaaacggngaagtttgctttggtacagtaaggtagtgttttactcctcgatattgcgaattcatactccggacgcccattatcgtgtccttttgacatgatttgacaaggagagagatcaaaacggatgcgggcatctttcgtttctttttttccctcgcatagatcgatccttcggccttgccgggcgcttattccggcattctttattttatggacgggttaccctggttgtttctaaccaaacggtttaataatagggaattaatcttccctttttacacccccataggtgaggaggcgaaattgactcacctggggccctttttcatttcccacaaggggattt

SEQ ID NO: 6662 - DNA, 562 bp, Aspergillus oryzae
  misc_feature (1)...(562): n = A,T,C or G
cggattttttgttgggaggacaatcactccttttttttctcccctgaccatctccgagcggatcatcaattttcgccgcctccgttccgttgcgattcttgccggtgaatatgtcttactacgaacctcaaggttggcaggcgcccgctgcgcgccaggtatcttgggaacaacctgttcccccgtcgcgttcgggatcgagctctgtctctcaacgcgacgaagttcctgccttttcctctcagtttgacgaggtggatcgtgctatcgacaaccttgttaagagcggaaagttgtggtctgctccccggagggactcgatgcccatgatgatgggccgtccgtttcccgaatacgatccccgtgtgtccaatactatgtcccagcgtcaccactctattagcgacttcgacggagccaggatgcacccgaatcccaaccttcaggggttctatgcctcccagcgtttccagggacgctcaaatgaagtagagcacatgatgcaagcaaagcgtcggatggcggcacagcgtgaaagggagctncgcaactatcaccagga

SEQ ID NO: 6663 - DNA, 681 bp, Aspergillus oryzae
  misc_feature (1)...(681): n = A,T,C or G
caggttgcagcccatggcggagagcctttgatcaacttcgaacgctaccgcacgaccgccaagatagtgaaaagtcttcttcgcttgattgatgctagtactaagtacacattcgcgccggtgcagggcattatcgaacgctgtctttggattgcatcgctctcggaagaagaaatccaaactcatagcaagcagcttgagtaatcgatcatcattgcccggcaagaattcacgagattagatgaaacgggagaaaccagacgtcacatttgatcccttcgaagtatacccgatataatacccattcataatacccgagccttttgctttgtgcgattgatatttgttaacgactttgttatttgtgatcatgaactgcgaacacatgtacattatatacttgcatcggtctgcctgtctgcctgtctgcctgtctttttatttttcatttttcatttttgtgctgttttggtcgttaaaaccttgggggattgttgttatatgagtatttgatctgatattgggttcggccatgagntacttctgcgagcatttagcgttgttgatatgggattccaatgggtcgaaaacattaaccgtcaaacgccttttggttttgaaaaataataaaaaaaaattaccggtggacgcatgagcctgctattatagggctcgttaatg

SEQ ID NO: 6664 - DNA, 689 bp, Aspergillus oryzae
  misc_feature (1)...(689): n = A,T,C or G
gccggaggaaagcggctccaacgccgtattgagtttggtgaacgactatatcacgatctcgatcggttgagaacgatgtgcgatgaggtcaagaaacgtgagagggagaagttgaaggatgccgaaactcttcggagcattgtggacactgtctacttccctatattccccttgctgtggcctatttttgaaaaagctcaaggacttgacggcaagggcatcttcagacaggggttggtctcgatacgcaccaagctggaagagcgccggtacacatccgtttctgccttctccgctgatcttgctcgcgtgttcacctcggagattggagtccagcccgctggggacaccgccgagcttcaaatgcagatcagcggccgcgctccggagctcagcctagagcaacgcgagaaacggaaactggccaagcgcattatcaaattcattcagcctgccctggaggaagcgatcaagaaagagagcgagttgaatcgtaagcccttcgaacaggagcttaaggagttggatcttatgctcgagaacagcgttatgtcgcgaaggggctcacaagccgagtctctggcggctggtgatgaggggcanggaaaacgagaggttccncttgagaatgctgaanaggtcaatggagatngtgaggtcanctgctagtcggagccctctgatggcgn

SEQ ID NO: 6665 - DNA, 682 bp, Aspergillus oryzae
ccatctcatacttaaacgaatctatctctacaaaaaaccagtttaacctccacaattcaaacccatccaccaatacccaaaatgaagtttcaaaccctctgctccctcgccaccttaggccttgccttcgccaacccaatccaaaaccgcggtcaagatttcaccgactgcgtcacaggcgtcgtgaagaaaggcgttacccaaggctgcgcaacccttcccaaggcatgcggcgtgctggacgagttcacagcatgtactaccgacgctactgcccaagtcactgatatcacggatcttgaccagcgtcgctcagaatggctggcgtctttgaacagctgcggccagaccttatgggacgggctgaagaacgcgggagtctcggaggttgagttgaacacactgcaagtatcattcttggagatgacgagcgagagtttgactagctgctccaagtctgcgtaggaatatttggtttgaattgaggttggtgttttgttgtttactggttgttggctcttgtcagggggaggagtggtgcatgatgggtatgatgtttctgatattctattgaagttatcctgtgtcgggttttgggctacggctatctttgtatacttagccttttgtcttactttggatattatattaatctactacatttattgttccttcaaaaaaa

SEQ ID NO: 6666 - DNA, 662 bp, Aspergillus oryzae
  misc_feature (1)...(662): n = A,T,C or G
cattctcagccgcctggttaagccttctgatgctgttcattgattcttattttctatttttattcttctcacattttttggattcgaggccatcttatgatgcagtggcttttgtccccgagaaacccgatccagggactcggtagggcaaaggaaatcatgaggtcatctcacgacaaccaattcaatttcaacgagcagttttgaactaccacaaactagtactaacacggtcgaaacccagggcaaagggaaaaataaaccgaaagtgcgtcccaccagtttccgatgaggtcacattgacagtccaaactcgaaaagtaaaagaagaaatgaagaaggcaaaaacgcagatcacaccaggaacgagaaacgatgcacagcacccacccccgtccctcacagatggcgatgatcctcaagcacaacctaaactaaaccaaattcaagatgaagttccgattagtagtcaaccaaaaaacactctggtacacaagttccgatgacaaagcaaattccgagtccttcctagctactccgggtaagatactagatagtgctcaaactccacatggaacactccattcgatccggagaacgccgagccctaacgttgtgtatgggaatcctgatatagagtttggaacattggacttcccatn

SEQ ID NO: 6667 - DNA, 792 bp, Aspergillus oryzae
ggatgactcatatgggcgaggcgagctcgagcctccgctgtacctggagaaccaacggtacgcgggatgtactaataccccaatgatgacgggctaccagttccaagatgaggaccttgttagcctcgaccaaacgaccatagcccttcagaacgtccagaagcgcgttgctcacaaccccgaacactaccgtcggatcggagaactccttgaattcgtacgccatttcaggcgagatcttctgtccttaactccggaacaggcctttgagcgcatgcagcccctgcgaaggtggctcttttggcttcccccggccatgctccgaggtggagacgcagacctaggagccctcgccattttggctcaattctttggtattggcgtggttttggatagtttgttccctgacctaggaggcgcatacctcggcccgctatccgtcggccccatcgaagacatctatcgaatcattattactaggagcatgtcggagccgtacaacccagatctccagttagcctcgaccattatggaattacctcgacatatcgtcgcccaatataaaagccgccttcagtggtcgccgcggacctccctcgactactcgccgtctcccgcgagtccttaccattctatgcaagattacactctggcgtcatcatcctctccttcctctaacgctacatgcgcaccttacaccccgctgctccagtctcccccagccgtgacgatcgctagttctccattcgatgtaaatggaagctacgtcacagcaacaaggcggccagagtc

SEQ ID NO: 6668 - DNA, 713 bp, Aspergillus oryzae
  misc_feature (1)...(713): n = A,T,C or G
ccgatatgatgagggcaatgattatactgtatatcggacctataatcgtcccgacttcagcactgacttgctgctttactcggtgctagccccggaggctcttcttgcaaggtttccaaagacatacattgtcacaggtgagcgtgatccgctggaagatgacactgtaatcttcgctgggagactgcgacaagccaagctacatcaattccgcgaaagacaaaagtgggctcttgagaattttcaccgaacatttcaacgaaaaggaccacttggaagtgtaattactcccaggcatctccaacggattcctgcaaatggccggttttttccccgacagttggaaacacataaccaagtgcccaacatgaatccagaacttgtttgaggccgccgaaagacccaggtattaatccagttggttcaagccattcaagaacagggcacattattaccaggtccgaaaatcggccccaagtaccggtagccacaccattcacagccaaagcttgacggccaatatcgaagtgagaaagatataacctttagagtaaagcttcgacaggataacaccgtagaacccagataatccacacacaaagtcgcagtcgaatgcgtggcaccgtncaaccggacaagcatgttatnttcaaaggttatacgcgatggcgggacatttaaaggcaaacggaagccaggggaaaatccatccg

SEQ ID NO: 6669 - DNA, 729 bp, Aspergillus oryzae
gcctattctcccccacacctacgtccgacccgtctagccccgacgaagcggacaaaaggcccgccccttctctggctactgtcgacatgccgcacctggcgccgccgcacttccggtcgcacagcagtccaccggtactcaaccctgccgacgaggagagccagggcgaagagagcccggtatcgtatgaatcacggggatcatcttactatgattccccaggttcgactgagagcagcgagccgattttggcgagcgacggcagtatgcgacaagaaggatgaacatgtgcggagtatataacatcagccgctttggctatcattattcatattctatgtgaccatacgtgtatccgagcattgtttggccacccatgtcactgacgtcactctggaggaataggttttaatcactaagtgatcaattcattccttggcggaacagctggcctgccgccggtctgacagatgtccgggagacatggaaatcctcttctgaggaatatgcctcttgaagtatgattgcttataggcatgggtaatggacgctcggaatgatgggcactggtaaccgaggaggagagactgaatatggttgcatcataagacaagatgggggtgtgtgtgtatcggccgatgggaggtggactgtaacgacgtagagactctagcgattagcggaacatacttaacgatccttgatgatggaacgatgcactggaccggc

SEQ ID NO: 6670 - DNA, 587 bp, Aspergillus oryzae
cctcgctccgtcttatggcagtgtgaaccagtcaggataaggcggggaaaagtcttcccccggtccctacagccgcctggcgaaggatagaaaaatacaaacaaccctcaaacaaacaaaaatggggcgcagcgaccgagacgccatggcttccaccatgggtggtttctccatatcttttcctttgttcattatctggactctctgaattttttggtcccttgttctattcggggaacttgaatggaatacggtgcctttttccccaggttcttcggctttggttcaacttggactgcgacgcctaacacacaccagggttgcttatgattgcacacctggccagcgaggtcgacagaggcgatatccttaatgcgcgctcgcgcgatcgctatacaaaaatgcaaggagcagaactgcgaaatactatctggcattttgtgattgctagttcagtggtatcctgtgacacttcagtgttgtcgcaacacaagttagcccaccccagtaccgacgacacagcacgaagaaaaagatgatgccgaccctactggtggcaatcagtttccgaacaccgcgcttgttgc

SEQ ID NO: 6671 - DNA, 602 bp, Aspergillus oryzae
  misc_feature (1)...(602): n = A,T,C or G
cttccttttccgcttcgtcttccttctcaaagaacaacacacttctacacttctcgtcctcttccacgtcgaagtcgtcatctatcaaaatgcaattccgctccgttatcgcccttgtggctttcgctactgccgtcaccgctgctccctgtgacagctgtgatggtggcaactctggcgactctggtgactctggcaagtgcagccctaaccaagaactgaagtgctgcaccggtctcacccaaggcctgaacctcggcatcctgccggccctgtgtcttcgtaagttttgaatcttgataatttttatgttcatctataatcccatattagctcttcttgccaactgcaacaaccaggccgcctgctgcgaggccaatggaggactcctgaactgtctcaccatccagctctaagttcatcgcatttcaccaccgcgagtaacgatacacgggcgatgtccggtgggggagtgatgcgcgactcggtaaatggatatgtcttactacggttgggcggtgacagtcttcttccagcatctaggtgtacacggattgtcctangtccgaggtgtggaaattgaaatattagattacatcgct

SEQ ID NO: 6672 - DNA, 649 bp, Aspergillus oryzae
  misc_feature (1)...(649): n = A,T,C or G
ctttttgtcgcattgtcggttcaaccgccgttatcgaacgtgactacgcaacattggagaccttggtgtcgggtttcggcgaggcccccgagcgcaaggtcagaggatggaccaatggtggcggtgtatacgaggacttcctgcgcttagcgacagcaaagagcggcaagcgggatcccactaggttgaatcgcttagtgaatgcgctggttgcgatgggtagtcagatcagccaaggatcgggcgtcgagggattggaggaacgtgtagctttcaaggaaatgagccgggcgattgctagctggacagcgcacgaagatagcaaggcggtcgagttttctagcgtgctcagtttacctttgacgggcgatgcgcgaatcatgcaaaccgccgaattgagtcgacggtattacggtatcatcatggcgggtgcctattaagcgtcttttctctttcttttcgtttatgccgcgtttctttacttgtcatccctgtaacttagtgtanattcttcccccgttacaatccttcttgggttccgcattctgcagccctttcgtggtacttcatgatttctgtgtgggtaggtactttacgacagtgtgtcagtatgtgaaatgcatctaataagtctccaaaaaaaaaaaan

SEQ ID NO: 6673 - DNA, 682 bp, Aspergillus oryzae
cggcacgaggccgcaaactaacaccatgagcacatatccaactgcattttgcgccgcccaagtcgtgggcttgactggtgccgcctggctttctggcaaaatcctctccttgagcacaatcactgtgcccgcgcttatacaatcgacacgcgaagatagattgccgctcgacgctgctgtcaaattatggcggaacctgtataacagaggcaaaagccaagctcctcctatcgccgctgccacctccgcagcgtttctctattgtgcctgggccgttcgcgctagtacgacgctagccccgttggccccgactcatagctcttctttgtactgtgttgcagcggctttgacactgggtatcgtaccatacacccttggcatgatgcttggtaccaacaacaagttgatggacctcgccaactcgggtcgggtggtagatgagaagtcgagcgtggaagtcgagtcattgttgtcccggtggctgaagctcaacgccggtcggggattgttaccgctggtgggtggccttgttgctcttactgcagctattccttggccactggagatgatttaatttcgggccctcgctttggctttgggcttctttgggggggatttgcaatcgcgctgcatgatagtagaattgggtgtcggtgggactcttggcgtggtttgcatgctt

SEQ ID NO: 6674 - DNA, 698 bp, Aspergillus oryzae
caaacttggagattgattgatgcgtcgatcttactactgtattatcgacgtctaatcaacttattgtcgctccatagttctaattaataacagaagtacggagtacttgaagttctatcaatctccctacatcgttttgactggccttctctcttcggattatcgtcccttccttcgataccctcacacattctcttttgactacctaggctgtcaatggatattcctcaagtgcagatttccgggcttgataactctcatggtcctggggacgcgcaaaaagcggaaacgcgcgatgtggacatggattcgagtcaacacgcagcagcaacgaatgattctataacacaagaagtacccctatctagtgcaacaacagagctagaacagacatccatggaagaagtggcgcctccgaaaagaaaccctggacttcagtttctttgaatacttgacgtcgcctattgtggaacttactataggaaatggagaaaccaagaccaccttaaccgctcacccaagactacttcttggaatcgcccttccttgctggaggagattcaaaatttgaatagttcggggcctctccacatttgagctttcttgatgaaaagtaaaaggccttttggctcttttctgcagttccaattaaaccggcgactttagaaagttctctaaacgatgccctcaatggacag

SEQ ID NO: 6675 - DNA, 682 bp, Aspergillus oryzae
  misc_feature (1)...(682): n = A,T,C or G
cgctctgctaaaaacagggcattaaggaaggttgttttcaacgttccgaaaactttggaggacttgcccggcgtcctcaaccaggtttacaaccagaaggtcagcaggggcaacatccagcctcagcccgagcctgttccccctaagattcctatcgactactcctgggcccaggagctcggtctcgtccgtaagcccgctgctttcatctccactatctccgacgaccgtggtcaggagctcctttacgccggtatgcccatctccgatgtcttccgggaggacattggcattggtggtgtcatgtctcttctttggttccgccgccgccttcccgcctatgctagcaagttcttggagatggttctcatgcttaccgctgatcacggccctgccgtgtccggtgccatgaacaccatcatcaccacccgtgccggcaaggatctgatcagtgctctcgtttctggtcttctgaccattggttctcgtttcggtggtgcccttgacggtgctgctgaggagttcaccaaggccttcgacaagggtctgagcccccgtgacttcgttgacactatgaggaaggagaacaagctcattcctggcattggtcaccgtgtcaagtcccgtaacaaccctgatcttcgtgtcgagctggtcaaggagttcgccaagaagcacttcn

SEQ ID NO: 6676 - DNA, 728 bp, Aspergillus oryzae
caacaacaatcaccctcccacttcacaggttctctttctgatacccatccttctgtctctcatctactaccactactttcatatactctcttctatcctacttcatcaccatcacaaccttcttccccattcttgtttcaacccaacatcaatatattaccgttgtcaaccatccatcatgggtaaaaaggctatccagtttggcggtggaaacattggccgtggctttgtggctgagtttctccacgctgccggctatgaagtcgtcttcattgatgtcatggatagcgtcatcaactctttgcaacagaccccgtcgtacgacgtcacggaggtcagcgaagagggtgaaagcaccaagaccatcaccaactatcgcgccatcaactccaagacgcatgaggccgacgtcgttcaggagatcgcatcggcagatgtggttacctgtgctgtcggtcccaacatccttaagttcatcgcgccagtcattgccaaaggtattgatgcgcgcaccgaagagagacccgtggctgtgatcgcctgtgagaacgctatcggcgctacagataccttgcacggctacatcaagcagcacaccaaccctgaccgtctggagaccctctctgagcgtgcccgttttgccaactcggctatcgaccgcatcgtccccaaccagcccccgaacagtggtctcaatgttcgcatcgagaagttctacgagtgggccg

SEQ ID NO: 6677 - DNA, 669 bp, Aspergillus oryzae
  misc_feature (1)...(669): n = A,T,C or G
gcaattccttcgacattgctcgaaaaaaaacaacgtgtcgctctcacgtagaactgtgtgcgaccacttcaggtcagtatgaaacccacaacagctgcaattgctttagccgggttgctgtctggcgtgacagcggccccaggccctcatggagaaaggattgagaggattgatagaactgtgttggaacgtgcattgccaaatgctcccgatggatatgtaccgtccaacgtcagttgtcctgcgaatcgcccgacggtgcgtagcgcatcatccgggctctcgagcaatgagacctcgtggttgaaaacccgacgggagaagactcaatctgccatgaaagatttcttcaaccatgtcacgattaaggactttgatgctgtccaatatctcgacaaccactcgagtaacacgtccaatcttcccaatattggtattgcggtgtctggtggaggttatcgcgccctgatgaacggtgccggagcgatcaaagcgtttgatagccgaacggagaactctacngcgacgggacagttgggtggtctgctacaatcggcgacatatcttgctggtcttaatgggggtggattggttggggggtccatctatataacaattttaccaccatttancacttgtaaaccattaagaatgtgttgtctggcattt

SEQ ID NO: 6678 - DNA, 228 bp, Aspergillus oryzae
aaccgagaagcaagaggaggctgcgaagaagaagacagcccggactagcaccacgacggcggccatcctaacacgaggtggtggcgagtccggcgacgcctaggagtaggctggtttagtgaattagagctacacgcctcttgttgacgtcctacacacgtttttcctttataatatcggagatcttgccgaagcgactttacgacaataaagaactctttccccgtc

SEQ ID NO: 6679 - DNA, 669 bp, Aspergillus oryzae
  misc_feature (1)...(669): n = A,T,C or G
ccaacttcattttgcatgatctaagtatcggcgtcatcagctctggatctcatatcgaacccgtgctttggattgaacaccgaggcagccagctaccaaagcgtcgaagacaagaattcgtgcaaaggggacgcagggttgaactgatggggtcctccgtctcacaatgccgataggtgcgcgtcaaaatggcagaagccacaggcaagttcacctccagcatcgcagctggtttttccagcttctctcgggagctccaccagacacactctccttctcgatgtcaatgaagaaaccttccgcgttacgggaaggcagtcaaaggctgcaggatcgaattcccgcaccttgtacctcaggttgttcttccacggnccacanagatgagtagcagacaagtacagtaattgtagttctggggtttgtcttgtacctcgttccggttcagttagaatggggcagatatacatcaannnnnannnnnnnnnnnnnnnnnnnnnnnnnnnnnnnnnnnnnnnnnnnnnnnnnnnnnnnnnnnnnnnnnnnnnnnnnnnnnnaanannnntnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 6680 - DNA, 685 bp, Aspergillus oryzae
cggttattttcaaacctgtatggaacattgaggaacatcaggctagtgtcatcgttttctattcgttgaatccgtcattcacatcttccgtaccaagagaatcagtcacccttaagaatctgattctgacggtgaacctggatacatctcctgaggagggccgagaagtggcccatgctacgagtgccgtcatgtatcctaatacgggggcgtccttccgtcgcaagcactcggcggtgacctggaagttgcctgagttcgaagttacagctggatctgacggcaagctgctggttcgattctcaacggcaactagttggccaagaaaagggaaggtcgaggcaaaattcgaggtccatactcttgatgctggctcgcgactgggaatcagtgccgcgtcgccaacggaggagattacgccaaagggatctgatccttttgcggacgaagactccggcgcacctgacgatgctcaaccctccctaacatggaaagaagtccctactactcgcaagctggttggaggtaaatatgtctcatcttagcagactgttgtgctacattagagccgatggtccttaatgaggacctcagtgtcacgagaacagcacctttcttttgcaccttctacgaacaaatgatgaccacagcccgcccgaccggttccagtttcgagataccaccg

SEQ ID NO: 6681 - DNA, 652 bp, Aspergillus oryzae
tccctcggcgaatattttgtgcttagcgaaccaacgcttggcatactcgataatccagtagctctggtagcatctggatcaacaagcaatgctcctgtggtgctaagttctttccgcgatcgaactccgtctcattacaacaaacgatatctaccatggccagcgtatcacatactcacccgcacggggatctacgcgatgacgaatcaattcttgatgatgatgttattgaagccgatgacgctctcgacgctgatgacccgttacacgataccgataccactcctttgagaggcaatattcaagccgaggcatcgagctctcgaggcggaaatctttccggcaattatctgacctcttcaatccccggcgaggaccgccgcgccgctcagaacaccatcgatgaaacggtctgggaaacggtgtcgcgcgacctactggcaatctgggagaagatgcgccaggttctgtggcccaaatacctgatgggtgggatgctgcaccggggtggaggaagcatttgcggtgccgcccaacgaagaaaagccactgggtttggtagcggtggtggtctgaagaatctcgtgggccgctggcccggacgccgatactgtcttgcaaaggcggaatgagtgaaggtctccctgactgg

SEQ ID NO: 6682 - DNA, 670 bp, Aspergillus oryzae
  misc_feature (1)...(670): n = A,T,C or G
gcctgtacgagctacaaaacggcagcggggcataagatataggtctcaagagtttattatgaggagagtttagttcttcaaagcggtcatctatcctacgctcacttcttagaactcacttcaagctatcccgtacctcgaacatggcgcatacaacagcagtagtcgctcctttctcctctgtctgcttttcaacaggaaaaacgtccggatatttactaatttaattagtctgcacagattccgcaacatgtcacctctctcctttcgcatctaacatcgcgccccggagttcagtccactttcatcctttcccgcaaagatgggaccataattcagagcagtgggctgctagcgacgagaccagcgggcaacagtagtccaaatgtctctcaggtcgactcagctgccgaggaacaatcggtagagagtatgacacctgccgaatcacccaccccttcaacaccgtctagcgccactactcctaaccgtcagacctcctatcaaccgtcccaagcagaagcgctagcagctcgcatttttgctttttgttccagcgcgtcngatctaagtttgtcgctctcgcgacccctggacaaaaacgcccacgggtttcaaaacagactcgaacggcttacaagaaaggctngggcacggaacatcaccggan

SEQ ID NO: 6683 - DNA, 254 bp, Aspergillus oryzae
ctatgggttgggatgtatccacttgctccaagaagtttgaccgtcttgcgcggcgtatttttcgcgagcgccgacaacccgctatatcgtggctacttcgcttgattctccgtcgcgattctctcttaggcgacattcccaagtggttatcatggtttttccatgacagctgctatgatgcgaggctattcgacgactgcttacaggaggcattcggtggagacaggcgtatttttgagccagtcaaagataag

SEQ ID NO: 6684 - DNA, 655 bp, Aspergillus oryzae
ggcacgcaccaacaggctactcatgtggtagcgccagtaccaggtctatggttcaggcgagtctattgcatatcatatgggacacgcaggctcccacgatcgctaccctgctagagcagttttaagtctcctgatgcagaagactaacgttggtcaatatacatatcaatcattgacccgaatccttgtcgtactttttttttttgttttcctcagcttccacccttgtcggtggccactttttacacctgcatcgttcaacgccggctcccatggcgcgtttgatctagacagtacggccattggaagataatggctatcaaagtacctcctggtcaatcaccgccattcgaaacggttgacggtgaccaccatgcgggaattatcatcatagtgtccgctatttgtctggtgctgtcgttggtgtgtctggttatccggctctacgttcggttcttgcttagtcctccgttcggcatcgacgatgtgattcttctttgggcgactggttctgcggttgtggagtcaattattggttttcatgccgcattcatcggattcggaaccgcgattcaacctcttgacgatcatgtacgttggaagattcaaaaatccggtggcgcgagcgacgttttttacctaatacccttggacc

SEQ ID NO: 6685 - DNA, 865 bp, Aspergillus oryzae
cgaaacagatcctcctcgcctttctttaaacttgttattccaccttttactgcttgggactctccgacacatggtttgaagaatggcaaactttcatcccctcaattttataccaaagcaccgccaggcccagattctggagtcaccagtgcagtctctgattgctgtgccacacagcaaaaaggctaacacaaatcattggtgtctctacctcttgacatccgaccggagctctgtcagaatcgattgccagcctagctactccgtcccaagtaccattctccctggaggctccaaagcctatgtaatcatctctgagctgtcatatactgtgtccaaggatgctcaagcacaatttcttcttggagtcgcccccggcctgaaggtcaggcatttttacgatttgctgatcgagaatggacggcacaaatacgaattcgattcaaacggagttggttgcagattttggacgacggatcagatcaatctgctacaccagcatcggcttatcacggacacggcacaagttacagttgcaaagaacgggattcttaaactgtggcctgatcagacacccctcgaactcgaccggggagcctactactagtgcggatgtcagcaggcagatgtctgctttgttgttccttgggttatcaggtcacctagcttgcgaggaacaaatgcgggcaaggcagcatcttacgcatttctggcagtttggggatctcggacccgagcccaactcctgttcagatccacaataccgttgaagattcgttttatatgccatgctattttctgtgtcttctttttcgagtatcttgtcctggtttgttacgtttctacttgctgttagaaagataac

SEQ ID NO: 6686 - DNA, 716 bp, Aspergillus oryzae
  misc_feature (1)...(716): n = A,T,C or G
ttctgtctgtatcgatcgcctatataacaagcgtctttgagccttcagcgtcgtgtgctacttcatgttccggactgaccttaataattactcaatattgtttgcattcgctctctgcgaacgaccaaccacagtattacaggaatctaatcatccaggacaagaaagtaccaactgaaacgctctattacagtggaatacacaatgactccagtgcgcaccacaacatcacactctctacaagactcacggccgaagaccaactacgagcgatggctcgaagaaaaagacgaacattatcagattgcggaagatccagattaccatccgcccatccccggtatccatggccaaaacccgatattccatcatgtccccgacaacagtcctcctgaaacggttcactcgacgaagcccgatgcaacacatttacaaacgcatgggtttcatggagagtttctacacggactgaatgcacgacggccctcccttctgaacggtgctgccaccgacgttctccgggagccatgcgtatggcagctggcatcagtgttcgtcgtgattgttgctattttacacgccgggaagagtcttcgaaagcgacgtaatagtgtaagggccgcttcatcacctgcatcaactcagcctattgctccagctcttgatgaaaaagactagtttgagctgagacatggcgcannacgagtgcgcgccca

SEQ ID NO: 6687 - DNA, 696 bp, Aspergillus oryzae
  misc_feature (1)...(696): n = A,T,C or G
atcagtgcgatacgcacgaggctctgttacagcccaaggcttatcgctgcaacaacaacaacagcagcatcagcaattccacaccccttcgactatcagtgatacctcccgtcatgtctccccgtgctcatcaaccattccccgatgcctaatatatagctgcctccgtcgccccatcacgcgtgaacacatgggaccttccgggatattgcttgcaacagcccgtcgtagattgcgagctttcacaaacaggtgtatctcaaatggccggggcccatcttctggatggaatgcccaacgcattaatgacgctagataatcccggctcgtatgagattacgccggaggtctttgaagcattttcatatgctgagcctattacgactaatatgactcctggatgacagccacaaggacggtgcggaatgagtcaagagtagcggcaagcgaggattggacataatgcagggacaggagctgtccgcgaacggagctatcctgggtggccaatacctatagaagaagtatgaccatttgactaagactgtggtggaggagacaaaacatgactgtaggtggcataggtggaatctctaacttctaacggatacacatacatagaagcgggtattggacaaataaccctctcaggaccctgatntctgcgacggttcgaacgtcatgtgtagagtgccn

SEQ ID NO: 6688 - DNA, 683 bp, Aspergillus oryzae
  misc_feature (1)...(683): n = A,T,C or G
gactctggatcggtccaactgccccgggtcaccaaaagcattttgaaagcaacatccacgcgagtagttggcaatacacgctggatacttttgaggcggcacgaaccagaggtatggaaactttgggaatgtacaatgcaacgctacaagcagatagctgggatggtatgcactatggtgagaaggaggcattgattcaggcaatgatggtcattaactggttggcgatgctctaaacggtgggactggatcataatgttatagacgtgatgcggcatgctagatgacatgtcaaggacacatgacttctggtttccattctgttttgtatatggcgtggtgaggtatgcaatacctttccctctacgggttcaacttccttgaagtcctgcttcaggatccttctcttcctgttgaccatattgctaaaccatcttcacagtttacataaatttttcatcataaacgagattgacgcatttaacgacaacttcatttctgcatgcttgttgcatcacagcgctacttctctntcttttgattcccaacatgtgttttcaaataagttcgaacagaanaattgatagaaaagaaagaccagacccacacttcataatgagtcctacatgtatgttgcagatgcaacaatgnnnccccattatgaatcccaccnaaaaaaaaaa

SEQ ID NO: 6689 - DNA, 667 bp, Aspergillus oryzae
ccgctgtgtcgatcacttcgcaatagagtgtgagggagcgagtcattatcctatcctttcctggtcaaccgatccggaatttgtcagaacgccccaggatctacccgagtctttgtcttctccgcattgcctcatcagtcaggctgagactggctgcgacacttcacccgccgattcgcgacatatcaccttctcattccgggcgcaccctcttacctcaaaatgccgaacccatcgcagctctttctccttgcagaccatatcaaactctctctcttagaacgacaacgagcgatctcattggatttggaacccaacagccaagacggagagatctctcgctctttggaatcgttgcacgacggcatcgaggatgtggagagagacctctctcagttggagcggaccaacgatgatggcgccgccgagctgaaagatcagctattccatctgaaatcgcagtatcaagatttgtcgtctcagttcagcggacacagcacctcagccggcgccagcggctcctctccatcgcctgaattcgccaatgtcaaatcgtctcctgacctcaaacaaccagtcccgcagcaccctccttcaaagtcagttcggtttatgaactcggctactgaagaagccgatctcgagcgacaaaaccttttccagccat

SEQ ID NO: 6690 - DNA, 695 bp, Aspergillus oryzae
  misc_feature (1)...(695): n = A,T,C or G
gggagacatttacacacttttgacatggacacagtaagctcaaccgaaataatcaatcatcaacatgatcaattggtatatcgagtcatcctaaccactgccaaggctggtttcaaagcgtctgtcaacaagtgccatgaaaacagttggcctcgggaatctgaaatagaacaagccataatggaagacaaaaagcaaaagaccccacccatgctttatgatgcaccctctttaacaacgccggtcctgcccaaaatcacgataaacaacaaaacaagatcgtcatgaccgttccatatctcttttagataaaagcgaacgggtatatctcatacagtgagctaagaaaaaagcaggtggtaaggaatgatggagtagtgtgcaaggtgcangggtgtggagtatcggggaatgacttcaaggtanggagacgtaaggaatcccggtcatgttcacgcagtgaacacccggtctaattgtcggagggcccgcatgtcctctcctncgaatccaatcttctcgctggggatatcgcgtggtccttcggctcgtcccgatgatggcgcggtgatcgccggcaaagagccactagctggcgtgccgttcatcagagcctcaatgctgggcacggntgtgccaaagctngctgggtcttggcggtttaatggtagtggcttggaagaaagatgtgtccn

SEQ ID NO: 6691 - DNA, 655 bp, Aspergillus oryzae
  misc_feature (1)...(655): n = A,T,C or G
cgagagccaaacagaccgatctcatcacccagaaagcagggcatacggtcatgctcgtgatggggttgacagagaagctattaccaatcagatgggtgcgctgcgtaacgcatacacagagtcctatcaacctttcgggcagggtcttcgccagccggaatctggtttgggtgcgctcgctactggtgatcctttttctccctacccaccaacagcatatggtggcttagagtctagctatgttgattatgcgactagtcctggaacagctgctggtcctcgtattcaccagtctcctgcagattgggcgggccgcttccagggactgtctctaggttcttgaggctgaccctataccctgctattcgcatagtggtgtcgtatgagcttgagaagaagagtgttcgattatggaaacagtctagcctgatgatgcctttacatcctttcagtcttctccagagtgttacattgttgcgaccaaagcctcacctgttgcatacgttcattcctctatggggcttagttgacagaacganataacgtaagacaactggtcgttatgccattcgttccactttttttttttatacaccccttttcccccaggtcacaaatgctttctttcaaccagaacttgactaaattctcatcg

SEQ ID NO: 6692 - DNA, 627 bp, Aspergillus oryzae
  misc_feature (1)...(627): n = A,T,C or G
ccgattttcatcgttctaaacgatcaaaaatggttttcgctcgtgctaatctccttcgcgcatctgctcgcgctgtcagagctgcatctcgtagacctgcgcagcaagtcgctcgccgcacatacgcctccgagtcatcacacagtgtccagaaatccagtgacctgccatggttactaggatcggtcggcctaggcgtaccggctgcctattacttgctctcctccggtcctgaaaagaagccccacggcggccacggcgaccaccatgaggccgtgaaagaaacagagaagaaagaggaacaggcccctgcgggagaatccgagccccaacccgatcgggacgcggagcagaaggtcgacactgaggcttcttcatcttcatctggcgagaagggtggatcatttggggagccgccatctaatggtgatgaggctactgcccgcggcggaaccggaggaccagctactatctctggcaagcaggagggcgtctacaatgccgacacttncaacccgtatgtgaatgagccgggaaagagccacatgggcgagggagaaaccgagactgctaatgtgaagggcactgtggatcccgcacgcccccaggcctagaaaacggcattct

SEQ ID NO: 6693 - DNA, 853 bp, Aspergillus oryzae
tgacatgagctctatccgaattcggcacgaggcggagtgttcagaatagcatgctcaccaatctcaacattagtggtctcaaagttgaggtagctcgcgatacacatcgacatgtaaagaaaacactgcctccatcattgagtagcttccctcaaatggcagacatcaaatattacgtcaaagcgacagtagttaggccgcagttctacaaggaaaatataaggacgattaccaacataaactttcttcccatcgaaccaccgaggacgggcaatccgggtgaagaaacatatgcacgacgtcaacatggatttgcgaaatcccccagcacatcaaagatgaagagtttgttccaaaaaggctccagttcgtctctccgagattcttccggtgactcgcctcgcgtatccgcagatatcagactaccaaatccctcgatacttacatgtaacgaaccaatcccgctacgtatccttgtcagcaaaacttcggagtcatttgaaacgatattcttgcagacactgcaaattgagttaatcgcctataccaaaattcttgcccatgatctaaaacggaatgaaacaaacacttcagtcatcttcagccgcagtaatatggccattccacttgggagaggaggcgatccagtcggcactgaatggactatcgatgctagtatgtggagccacatacctctcccgagctcggtggcaccaacctttgaaacctgcaatatctcgaggacatatgagttagaagtgcgggttggtttgagtcatggcactgtcggcaatatgaaaccccaactcattgtactgccgttacggatgcctgtcaaagtttactctggaat

SEQ ID NO: 6694 - DNA, 646 bp, Aspergillus oryzae
cagacgaagtctatccgggtacaaactaaccatcaatgttgcccttaccgatgcaaacctccgcaaaagctccgccaatgccgaggccattgaaagctacaaggctctcatagagacgaccaaagctgatcttgaggcccacctggaagccatcgacgacaagctgcagctcattgtggggcaaaccgtgaccgcagaagactcagatgccctggaactgcggcgaatcaaggaagagcgcctgagcacagtgaaatgtcttcaaatatgtaaccagttatccgaccatattgctcagatccagctctcaaccaagagcaatgacacttccgggggatcatcgggttccgatgtttacccagaaagagtcaccgacgagagcttgcaggactgtaaaactaaactcgccgacacgatcacccaattggaaaagcatatgcaagccctgacggaccgattactagtcaagtcgaaagcagctatgacgtctgagcaagacattttggacctgaaaaggctacaggatgagtggcaaacgcccaacagtgcatggacatctgctccaaaggcgatacccgcctaaaggaaatatcagcaatatccataactacggcacgggggagccttgcaattcatggtttccaca

SEQ ID NO: 6695 - DNA, 665 bp, Aspergillus oryzae
  misc_feature (1)...(665): n = A,T,C or G
cctctcctgcgatcactatttcgagcgcaatgaatttcgctccttatcaggatgaatcgcccgaagttgaacgggcaatgtcgcctgccctcggcgatgccaatcgcgtgaaatcgcccattatcagatctcctgtcggctctcctccggttccaggtctcgcatgcaacgcgccttcgtcaccgagtcacttcggcggcaggggtcaaccaggaacaactgggtttggaaacagtggctattgcggagatgtccaaagtgggaaatggaatatgggagctttcgataccagcctacccatccgtatggattttgaagctatgctggcatatctgcttctgcctcctgcgggtggtggcttccctctgctagctgaacacaaaagcgattatgttcgctttcatgcatggaggtcaagcctgctttttaacgcgatggttatccctcatctcatatttgcttgggcaagcgtcttctcatggactctgtgtctatgcgatatggccatgaacgcgttnttgagcatgcgcgcttatatcgacggtgacacactctgtaactatgaaaattccgagatttgggccgctggggaactaccttttgtgtggagacgaatacacctaatctccttttaaaggggatgcgttcgttttatattacccccc

SEQ ID NO: 6696 - DNA, 671 bp, Aspergillus oryzae
ggaaaacgctgcccgtgggggtcccctttagctttgtacaagaatttctttgtaataagatgcttggcaaggggggtaggagcgactcaaggccttatattctcgttcagttcattacatatacaccgagggacatacggggcatcttctcgttttatgctactactttggagtggtcgagcgcgtgttgcatgtggtcatttgctttcactttactctccttttcttcgagcactctctattttaatgaaggcgagcacacagctcgatccgacaagtatgatttgacttctcgcaattataccacaaacatcatctccagtcacccacgactatcatttcctttttcttttcttttcttttttcttcgtgcatgaaagaatgttgtacactaccttccctgggcgtctcatttcgttgtatttcctacactgtcatctccactgttttgtgacatgcatgccctcctttgacacatttccttattttcttttcctctactcccttgtcctcagccattctgtctgcttttactattatgggctctggtgtggaacatcctagtagccccgaaatctctacgttcatggtctggtttctggcgcacaaaaagagcaggagtctgatttattcggttgattgagtgatctgagttggctgggttcgcgttt

SEQ ID NO: 6697 - DNA, 255 bp, Aspergillus oryzae
  misc_feature (1)...(255): n = A,T,C or G
tctccattcgttccatcattattcggtgacctcagtaaccatgagggtcgctacttcggttgcattcgcctctctcctggccatggcccaggcccatccctcgggcgcctggtggggcacggatgattgctatactagcccggataataccaataatgaatgctctgacgagatgcggggtggattcaactgggctggcctcgccgtcggttcttttgacttcttcgccggcttcgaattctctgggttctcttn

SEQ ID NO: 6698 - DNA, 669 bp, Aspergillus oryzae
catcccctttcccaccgtgccctatccacggatggagcctccggcccaccgcgagaagaagatgaaagtcctggcattaggcatgtcccgcactgggaccatgtctctttacgtcgcgctcaaggaactaggatacacgtgctaccacatggccgaatgtaatcttgatcagcagaataattcattatctctttggaaccgtgccattgacgcgatattcaacggaatcggtcgcaaattcgcaggtgccgactttgaccagatgctttggcgctatgatgtggcttcttacctcggcccgatgcacgtattattctgaccacccgccccgttgagccatggttggcctccatgcagcgcaccttctatgccattctgagttggaaacggtggggaattttggagttcattgatcctgtactggcgcccgcccctcatttgtttccctgctagcatggtccacaagactaacattgcccgatacatcccaattctacggtcagcaccgtctgtgtggactaaaggaaactggcgagacgcttgccgtctacggaatggcttcgctgcccattatgacctggttcgcatcgctgaaaaaaggcgaggccgcgaaggtctggagtttaaaggccaggatgggtggggccccctttgccagtttcttgtaaa

SEQ ID NO: 6699 - DNA, 459 bp, Aspergillus oryzae
aaacccaaagaatatttctggattttggttcacatgacttccgtttaacaaagcccccccctccaaatgggggttttgaaaaatttccccaaaaaggggtcccacccggaaaattattctacccttttcttgatttccccatgagtcccatcctgtcccggtccctgtccctggagctgaacctattaattgggccccctgggcttttaatgattccatgccgggagtaatcatgtcaactttttccccgttcaaagtttggggccccccaaaatcccccgtgggcttgggaataaacccttcccaaccggtaaagtcgaggggagtccccctccccgtttgatttaactgggaaaaaaacccctttttaaatgccccgaatgggccggcccccatactcatgtttactgggcttctaattttaaaaaagggttttgattgttgatgggtggtttggtt

SEQ ID NO: 6700 - DNA, 667 bp, Aspergillus oryzae
  misc_feature (1)...(667): n = A,T,C or G
gatgatgcgttcttagacaacattgccgctgaagttgtgtacaatgttcgtcgtgtcaaccaccatccttcgttggcattatgggcaggtggaaatgagattgagtcactgatgcttccaacggtcgaaaggaaggctcctgaagagtatgcgaagtatgttggggaatatgagaagctatatatcagtctcatcctgcctttggtttaccaaaacacccggtccattacatacagccctagcagcacaacagaaggctatctcgacgtcgacttgtctgctcccgtgcctatggtggaacgatatcacaatactacacctggatcctactacggcgacaccgacttttacaactatgacagcagcgtctctttcaactctcatgtctacccagtaggtcgcttcgccaatgaattcggataccacagcatgcctagcctgcaaacctggcagcaagccgttgaccccgaagacctccatttcaacagcaccactgtcatgctccggaatcaccactacccaaccggcggtaccttcaccgacaacttccacaatacatctctatgcatgggcgaaatgacaatcgcagtgcagcggtactaccctattcccaacanactgtactccgtcgccaactttaacgcctggtgtgacgccaaccaaactt

SEQ ID NO: 6701 - DNA, 675 bp, Aspergillus oryzae
cttgctcgttatcttcgaggtcatgttcttcctcgagggttggtcttggcctatgtgtgtgttgggtatgatctcggcggctgcaatccagcgtttcgtctacaaacttatcatctcacttgccttgacccgtgagttcaagcatgatcaatccaacatcgcctgatggactggaaagtggtacagcatgggctggcactcattttcccagccgggtcgtgaattcctgtgcaagatcaccgagctcggctatttcgctgccgacttcgtccttggccatctgcttcttttcatcatgctgcctgctctctgtgttccctacattgacaagtttcactctgtcattcttttctggctgcgcccaagtcgtcaaattcggcctccgatctactctttgaagcagtctaagctccgcaagagaagagtggtccgtttcgcaatcctctactttgcgatgttgctcctcttcctcattcttctgatcgcgccgctggtcgttcgcaaactgaacatcaatctgaccaacatttcaatgaacctcttacaaccccttgacgagaaacacaacaacacccattttacagtattaccggcaatggacttcccaggggctcagcgggatcccgcgtcggtctagcttccgtacaactaacgaacaatggttctgaattcccc

SEQ ID NO: 6702 - DNA, 597 bp, Aspergillus oryzae
tccttcatcaagaaattccgcaagcaccccaacttcgtccttcccgatcgttcggacgtcaccatgactgtgcccttcatggatgcctatgtgagactgttgatcaagacctgccaccgtcgtggtgttcacgctatgggtggtatggccgctcagatccccatcaaggacaaccaggctgccaacgacaaggccatggagagtgtgcgcgccgacaagctgcgtgaggttcgtgctggtcacgacggtacctgggtggctcacccggctctcgccgcgatcgcctccgaggtattcaacaagcacatgcccacgcccaaccagctcttcatccgccgcgaggacacccatgttaccgccaatgatctcttgaacaccaacgtgcccggcaagatcaccgaggagggtatccggaagaacttgaacatcggtctctcgtacatggaaggctggctccgtggagtcggatgcattccgatcaactacctgatggaggacgctgccaccgccgaagtgtctcgcagtcaactcttgcaatggacctaccacggcgtcaccacggccgagggcaagaaagtcgacaaggcatatgctctg

SEQ ID NO: 6703 - DNA, 707 bp, Aspergillus oryzae
  misc_feature (1)...(707): n = A,T,C or G
tcggttcctcctcacacctctccttattctcttcaccgcatcttcctcctttcgtttcatcgtcccctcgggtctagacacccttggaagattatctgcacagtcactttgcggagcctcaggtagttccaggtatacaatatggttgtcgccactatcaagtgtgttgtcgtcggtgacggtgctgtgggcaaaacatgtctcctgatttcgtacacaacaaacaagttcccctcggaatatgttcctaccgttttcgataactatgctgtcactgtcatgattggcgatgaaccgtacactctggggcttttcgatactgctggtcaggaagattatgaccgtcttcgtcccctttcatacccccagaccgacgttttcttggtctgcttctccgtgacatcccccgcttccttcgagaacgtgcgcgaanaatggttccccgaagttcattcacattgccctggtgtcccctgtctaatcgtgggcacccaaactgatttgcgcgacgattctgctgtgcccgaaaagctttctccggaagaagatgcagcccatttcgtaaggaagatggagaccggatgggcaatgaattggggcgcgtcaaatatgtccaatgctccgctctgacccaatataaactcaaggatgtctttgacgaggcaaatgttgccgccctcgagcctggtcctaaagaagtcaaagag

SEQ ID NO: 6704 - DNA, 1273 bp, Aspergillus oryzae
tggaagccgactgatcgtagcggcacgaggctttgttttccccttgtgccttgggtgttcctgtgtggtctctttcccccctgattatttgcccgtctggccactgtgcattccgagacgtgatcacgcccctcgttcaaccacatctccccattcgccgtcttctgaatccaagttttcaaccctatttctaccgcttccctctggttcaattctcagacgaccgagcgacatctcttttattcgcagtgcaactggtttcattccgtctaacatcgcattattcccagacctttgagaatccctattcgccaccgccatcatgggtctcaccttctccaagttgttcgaccgcctatggggcaaaaaggagatgcgaattctgatggtcggtcttgacgcagccggaaagaccaccattctgtataagctgaagttgggtgaaattgtcaccaccatccccacaatcggtttcaacgtcgagactgtcgaatacaagaacattcagtttaccgtgtgggatgtcggtggtcaggacaagatccgtcctctctggagacattacttccagaacactcagggtattatcttcgtcgtggatagcaacgatcgcgatcgtattgtcgaggcccgggaagagttgcagcgcatgttgaacgaggatgaactccgtgatgctcttctccttgttttcgctaacaagcaagatttgccgaatgccatgagccccgccgaaattacccagcagcttggtctgcaaagtctcactcgccgtgcttggtacatccaatctacctgcgctaccaccggtgacggtctgtacgagggtctcgagtggctcgccgatgctttgcggaaggcgggccgtgattaaattgttataatgcgatgagtgaaagaatacctggacgtgtgactgggagttggggatgatggatgggggccaaaccggaaaagacacctcgcgtagggatgggatatgctacttggtggtgcttgtatgttctctaacggctcttcattcttctatgctatttagcttttattgttctctttcatcccggcgtcgatcctaacgaaatactccttttgtgccctgaaacctcatatcttttcattttctttttggtctccatgggttctcttacagtcaagatttgatatttatgatcacggagaacgggtttaggctccagacgtcatatgtatgtcgacgcatcttatcagtttagctgaacatgtagattttgtggccagtaggctcttgctatcc

SEQ ID NO: 6705 - DNA, 621 bp, Aspergillus oryzae
  misc_feature (1)...(621): n = A,T,C or G
aatgaaaacaacattttgattccctagcacaacctgcaaaatatataccacgaatccccgcaaacttcgcaagctttaagaagtcgagcagctcgcaaagtatataatagcacgatatgatacaaagccatagcacactctcgacatgcgcatatgacgttttgccatctctattcttcagggaaaaattaatcccctctacaagcccttacgtataaaagtgaacgcgctcagctgaatcgattgcctcggggaggtcggaacggttgagcagcctcgtattttcctttctccagcacccggtctgcttcggattcgggctcgtgacgagttggggcaggatcgtggctggcctctgcgcttggtgaggctacatcgtctgctgcgctctggaactgcgccatgttggcccgtttcaagctaggggattcggacggggtcgggactttctcgttgtaagtcgactggcgtcggtactcggcttccatctgcgcgagcttcgatttgcgcttgttctctgcttcatatcgagcagctcggtccgcattaatcgatttcttagcgaaataataggctccgccgncagcgacgcagagagtaccccagcctacccaggtagat

SEQ ID NO: 6706 - DNA, 677 bp, Aspergillus oryzae
ggaaagaaaacaccaccaagtgtttacaaaacggcaccgcagtaatggctggcgtagcccctgattctacaacggctgcactggctggcgaagtccccaaagagactcgcagggatatcctgggcgacgctgccttctcgtccaccgctcctggatcgactacagcagagctcgccaaacatgcccctttcgagcagcgagcgaatgtgcctgggacgttcccagcgaccccaggatcggaagttgagcagttctctgtgaatcctatccctgcctcgagtggcctgggcaacccaatcaagctaaagccaggagagaaggtgcctgacccgagcacattcaataccaacacaatccactctacagcccggacagatcaagccggatacgaagcgaatgccagccatccattgactgggagccaatctaaagacaccagcgcatttgctgttcccccagtctcgaataatatgatccctgaatctagcctttccatgggccaagccagtcagggttcttacgaccctgccactattcagtccgcagcggccacatctactactggagctcttgccggtgctgttccctttgaatctcacaaaagacacaccgaaaatggggtttggggcccctgcgggtgatgtttccggaagaggtgaaggcctctatgttctagg

SEQ ID NO: 6707 - DNA, 681 bp, Aspergillus oryzae
  misc_feature (1)...(681): n = A,T,C or G
ggacgtgcaccaattagagaagggcgatggcctctgacatgagttctgtagcgtcgccgaacgcgtgtgaccaactcgaccggatcgtcacgggtgtagaggctcatgttcgctgtttgcgggaaccatccaactgaacctttatcaataatcgcgacgaattaacgccactgcgctcgaacgagctatacccgactttcaatcgcgcctgacaatttcttcgctctaaattatcctttcaactcgagttgttttacttgtgtttgtcaagatggacgtcgacttataaaccatccatcttgtcgttctttctcgatcgcaacgctttccattctcccgcaattaagcgtttcagttttgtgcatttttcagctatcttgcctcttcagccctcacctatctaggtgaaattacccgtcatacaacatccttaacgaggatcttgcatcatctcgacccgtcatggcgcccaaccttttcctctgcctccgaactgtcttctgccccacgtactggtttcaacgtggagagcgcatccagggttccatccataaagcagaacactgggaatctcctgtcccaggcatctacaaatacattcccggtcgtgggtggcaccttgtctacaaggatggcaatgagtacgacgaanaagtttctgtcccacttgtttactgccgg

SEQ ID NO: 6708 - DNA, 303 bp, Aspergillus oryzae
cccctctcggcccgagtcctgccccgaccgcaggtggcacgaccgattcagacccctgggcccagtacccggctcccacccggcagttctatccccccttgacgtcaacctaccaggatatcccagcctcgggatacccagatccttcggtaaatggcaacatggcaatgccgtggccggtgcaggggttcttcgtgccggagttgggaatgcaggtggggtttgagccggagaacctgtatgcgctggagaatatgttgggagacgggttcttcaacctgcctctcccaacggaggggagcg

SEQ ID NO: 6709 - DNA, 434 bp, Aspergillus oryzae
gctggcgtgaaggctccgacgacgccagagaccttcggataggtggtgagccggaacgatggcggtgtggctgggctgctacgagagactcatgtgatgatgaatgattttcctgcgagggctacggattgattgtttgattcttttgttgttattcaagcacagtggcgtcacggcttacttatttgtcatttagcgggcgttctattatgttttagatggttttgtttggcgtttattacaaagtacatggcatagggaaggaagtacttgatggataaaaaggggctttatttactacttgttcatgaaacttcttccttttcggatggagtataactatactacgatttacaagaattaggtccatgtctgtggttagcacagttatttggtattagagggtttgattgagatccatagttatattgtgc

SEQ ID NO: 6710 - DNA, 534 bp, Aspergillus oryzae
ccaacactgacacagaattttctccagcgatcttgtgagtatttctactcctgttccctaccgtacaccaaggcacagaggtagcagtcagtttcgcttccgggcgttttaaccatgaagtaatcttgtcctgtttgttcccctccgcacatgattttagccatggagtcacttctccctggctataacgagtacctgacttggtacccggacttgactatacccaccaccgaaatatcagacgaccccgtggcagctggagacccctttgcgtttccagatcttgaggtgcaatcaactatgatcagtacaacgctagcgcaattcccatacctttatcccgacccgaatctaatccaaatagagaactcccatcaaggcattacgtcccccgaagacgcacatcaagctccttagaggactgaatgctttgcctgacatgggggggctctttgggagccgctgggtcaaccaaaactggtggaggtaaaaggggtttttcctcttgctgccaaaatggggaactgggctctg

SEQ ID NO: 6711 - DNA, 666 bp, Aspergillus oryzae
  misc_feature (1)...(666): n = A,T,C or G
ccggcctatgtggctgctttaacaagaactcagctgaccctacagcggcttggaaagactggctccggcagatagtccggagtggtgttataggtggacctgccgatccagctggctccgtagcgtgctcggattcaccaagtttgctatccctagtccaagagatggaagcacgccaacgacagtggcatcttgagcggcacccagaggctcgtcccgataattctgacgcgggatccaagagaccggctgtaattggtcctgatccgcgtgatgaacagggctggctctgctttcgagtggctaagagtgccagagaagttatttccagattcgaatttgagccgcacgaatacccagatggcgtgatttcttgaacacatgtactggaagattcgtcgcgagagcaataacccccatttgacgatgatacacgtgacgattgatttggcgtttgacttgggctgaccgtgaatactcgantagttgctggtttgacggccgtaaggaagaggacgatctcacacgtactatgcgtatctggtggtctcatctatccttttgctttaaccccgatacattctatgcatagatccacgccttgtacatggaagcacccntgctttagtcgtaatagttgaggtcattatataaggcagtagtttg

SEQ ID NO: 6712 - DNA, 683 bp, Aspergillus oryzae
caaggagaggtctaaacggatgaccatcgagtgcccgaactatgtgtccatgtctagttctgtcaacctgttgcagcttgcactaccattttggttccaacaaggggagtgagacaagatcatcagttttgacgcctgaagtgggttcagagtccaacgacacaggattgttttcatcctccatgatcagcatctccaggcccaagctcgataatgatggatcaggtcctggggcgcgtcgatatgggacatgaagctgccaatgcttagtctgattaggagattttgcgttttggttgtcgtgttgcaaatagggtgaattcccgtgagagcacgcgagttacttgaaatgagatacaataaacctattatgaccagggttatatcttttttttccaagagaccgacgcaccctgcaccataggtgtatccctcctcaggctatagccgcatctgatgagtcctttcaatgttcaaaggttcatttggcttgcagattatccctgaatattccctccacccatttccaaaactgcccgacacaccttgatccggcaactgctacacacgtagcaaagcaaatccctatccctcttcatattccccaagtctttccccattcagcgccacattatctccttatcaatcccgtctctggcggatcagtgggtgaagaggtaaat

SEQ ID NO: 6713 - DNA, 674 bp, Aspergillus oryzae
gtgccatgcaaaccattggtggctctaaggggggagaggtcattcccctgtacactattcccatttctttgcagacaatgatgaacctcaccgctcccttgggcattgataccctcgacgacaactctctcacaaatcttgccaaccccgacgtgcttctcactcgtgccggcgattccagcagtcgtattcaggttcaagaccagatccgcaagggtgatgaatcaggcaccccgcttcagtacatctatgaagacgctgactgccgtatcttctacaccaccaagatgctgctcgaacctgaaagcgcatgggaagctgcatggtcagcctacacagatgacagcaagtgcgtcaaggattccgccaagaaatcatccagtattagcggcggatataagccgtttggtcctggtgatcttaacggtaagcagtcggagaatagcacctcctcgtcgtccgacaaggataaggagaatgctgcccctgcttggagacccagccttgctatctgtgccgcggctacagttatcagcttccttctttagattgttttcttttacggttttttaacgaccaaatgtgtccaacatttttgagttttgtgcatgatgatacctatatactacgatgaatattctgtgaacttacctttagacaatttaaaaattgta

SEQ ID NO: 6714 - DNA, 743 bp, Aspergillus oryzae
gatcctcacaactttcagctaactcaatctaaacctcctatcaaccttgtcatctgaaagtcagttggttatcgaatatgaagctcatttctgtcgtcgttgccgctcttgcagccaccagtgtacaggccggtgttttacagaaatggtgctccctgcctgctcagggctgctacatgctgaaacgtgccgccgatgccagtggagacgttcgacgttctgccgaggccctttctgaggccatgcctgatgcagaagccttggccaagtggtgtgccttgcctggtcagggatgcctcaaagctaagcgggctgctgaggctgttgaagaagccagacgttccgccgatgcccttgcggatgctatggcagatcttggagagtactagaagggtccctcccacgagccttatctttctaaagatatgtgtggcaggagcattgtacatggcagatatctatgcaggcttatggccgagtcactctttccaatgaactacttacggtcatcgttacttcgtcctttctggtgtttacatcgtttgagtgcccttggcccaaggcgcatgagtgagggaggctataaagggaatattacaaaaacagaaaaaagaaaggagtaggaagatggagaaaggggaggagacaagtgagatcagggccccatgatatgtgccccatgatatgggacagcagctatatatgagctgttacagcaatccagtactatcggtatatctgtt

SEQ ID NO: 6715 - DNA, 691 bp, Aspergillus oryzae
  misc_feature (1)...(691): n = A,T,C or G
gaagaaagagtccagatttgtcgtgacattcgttatcccacaattccttttcctgacgtttctgcattatcaagcaacgggggcccacgggttggaacccgtttggagagttctaattgctgatcatcttggattgagaaagtacctaaaatcctttactactcagatctggaaaagtcgattttcccgtttcttctgggacatcctgcaccggttgaagaacggtagccttttagaagcggtctagctcgagaaaccgtcgcatcccctgcttcgggccttttaacttggctagtaattagcaaaagcatgaggcttgggtacttttgatcaaggtctttgtatagtgtatggggagagggtgctttttctttcgtcccacgcctcaagaatcagcccactgtttcccattcaaatatcggtcgagtcctttgtcactctttcggcgaagtgtcatctatccgcgttgacaccaccacgtctcgtttagacgtacttccctctttcttttttaaacgtgatcagttagcctgccagggcttttatgctctagcagcgctgatgtatgtctgcgacgctggcggaatatcgagactatgccatngattatgctcaacatgccagctgcaagcccgaggaacatacaagtacgcttggttaccacacgcatcagccacaacttgcaacatcc

SEQ ID NO: 6716 - DNA, 654 bp, Aspergillus oryzae
ctcagttagatccggtcaaagattccccccagaatgcgagcttactaagtccctcctggtattcgcgctttacatgtttggcactcagcacgttctagctgtgcctgtcaatcccgagcctgatgctacgagcgtcgaaaatgttgcccttaaaacaggcagcggtgatagccagagcgatcccatcaaggcggacttggaggtcaaaggccaaagtgctttgcctttcgacgtcgactgctgggctatcctgtgcaagggcgccccgaatgtcctgcagcgcgtgaatgaaaagacgaaaaatagtaatcgcgatcggagcggtgcgaacaaagggcctttcaaagatcctcagaaatggggcatcaaagcccttccacctaagaattcatcctggagcgcacaagacttcaaatcacccgaagaatacgcatttgcgtctttccttcaaggcgggaccaatgccatcctatcgcccgtcaaccctccttttcagaacttccaaggcggcgtcttgaacgggttctactccgggaacaaagtagctacaatttgattcctagccaggccccaacagacaaaggggaacatgggtttcagatcccttaaattcacaggcgccaactgggcctcttggggaataatgaataaaaa

SEQ ID NO: 6717 - DNA, 514 bp, Aspergillus oryzae
  misc_feature (1)...(514): n = A,T,C or G
cgaggacttcttccaccaaggtttaaaattttgactccgtctcgtttgtactttttgaccacacccatgagctgtcgctgatctctttttgttttacgttacccctttgagtttttcttgctatccttttgatgcgtcctagagctagactttcagatctccctcctgctcggaaaagagttgctgtgtgttcctttcttcggtcttttacagcagtcgcatcgtgcatttaatggagttgtgagaaggggtctggcgcttgggttcttgcttcgttcacaaatcattcattgcttatcaatcattagcgatttctcccatgcgatcgatctaaggttcacctgttgggaaggatctttgctatctctacctctgatctcactcactcttttctttntcctttntgtcttttcccttcttgccatctatttgcatgtaaatatgggcgcataacagttgctgagcgagcacaatgcagttactagacgaannannanananaaaaaaccccnnn

SEQ ID NO: 6718 - DNA, 646 bp, Aspergillus oryzae
cccatcgttgactgaaatccattctttaatcacccaaccccaatggccaatgcctggagtgccgccgcacacttgccagctgagcggactcattctcgtaccttcacctaactatgtggccggtccgctagccaccatcccagcaacttcttgggctgatacagtcaacactcgactcttatctccaatattgactactcagctgtttcttcctcttcttaccgcccgcaacacaaatagcaccattgtcctaatttacccttcgatatcctcgtcattgtctgctccgtttactagcccagaagtcaccacagcacgtgccttgtcaggatttgccacctcgcttcggcgagagttatgtctcttgcaacatagcaacatcgatgttgtggagctgaaactcggaaacatcgaccttggtcctcaataccgaaacgcacaaagtcatatcacaggaaccgaggtgcttacatggaccacacagcagcgatccctctacggctctcagtatctttccagcattgaacagcgacccgttgcatctgcaggtcctagcatgatacgtggatccgctgctcggactcttcactacgcggtgctggacgccctggagccagcatccaaagatatctttggaagaaagaat

SEQ ID NO: 6719 - DNA, 561 bp, Aspergillus oryzae
cgaggctgacatcagcgcggtcaagaagctcgcgttacacgccgctgggcttggctcgataagggtggtcgtccatacagctggcgtggccatgaatcaagctcctcccagccgaatctatcacgttaacctacttggtacggcgaatctgatcgaggccttctaccccttagcgacagccggtacttctctagtcgccatatccagcgcagccgggcaccgcattcagggctccctctccccgggtttcgaacgacaccttgcgactgccccattgcaaactttgctgcagcatcccgacttccctgcaggagcttttgactccgtggctgagagtacagaccagcgttcccgcacgagtgcctacgcggtctcaaagcgagcaaatatcctgcgcgttcaggcgtctgcgcccttgtgggcaagcaaaggtgccaggatcaattcgggtagtcctggggtggtgttatccaacatgatgaaagaggagctgcaggggcctgcggcgtctatgctttcggagtctattgaccgaacgcctgctgggaagatgggaacgac

SEQ ID NO: 6720 - DNA, 605 bp, Aspergillus oryzae
  misc_feature (1)...(605): n = A,T,C or G
cgagggggtgtggcaagttcttcagaggagagagccacaaccttcttctgcatggcactaacaatattctcagtgggatcatttgcttctgacagtgaatgttacaatattaatgttttttaaattggccttgtccgtccgtgtctttgccgtcaatccttttccttacccacactgttaaatacggttaatagaatatggattactacttgccggttttggaattaatccagccactgccttatcgggatatggaccatggccaacggtccaattaattgcaaccccttccaaagtccatggttccgtggaccatatatattcctatcatacttggaaccaggattgaaattcacctataacttatctcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 6721 - DNA, 630 bp, Aspergillus oryzae
atagcaaatatatatacattagcaataatatcgaaacatttttctgttcatctggtaaaagaaaacacacatgaccatgattacatttaagtttagctggcatctataaaacttcacaatggtgtaaaaagacattgatgggggaaaagaaaatgaagaagaaaggacgggtgcaaccagcagcacccggcagaagacgtgataatgaaggtagaatacagaccggaaacaatcggggcaacttaggtcattgcgacgcgttaccaggcagaagagaacccttcacacattagctggaagctggtagtacacattcgtatgcagcaaagcgacattgacgtgcatcatggtcgcgaagtgaaggcgaccaatatcataatggtcatacattaaacagatagaacattgagcaccaaattaaacggttgaagtatgcaagtcgagaagtatctcgttcttggtgtctttcgccatgacctggcaaaagatctaatcagaactagaacgggaccaaagcggatataactcttggaacgaggttctgctggccctcccgtggatcctctcaggtatgattataccaagcggattcgctcataagtcgtgccaatgttctttccaaaacgccaa

SEQ ID NO: 6722 - DNA, 688 bp, Aspergillus oryzae
  misc_feature (1)...(688): n = A,T,C or G
cttgctcacactctcactcgcacacactcctacctaacaccacatccacccatcaaaatgttcggattctcttggttcaagtcttccaaggaggaggaaacctcccagcagcctacctggaaccccaacaccctcaccatggagcagcctactagccctgcggctcccaaccagcagcaggtcgttactgagcaacctgtacgtgacatccccacacaccatccccataattctccacgtttctatcctgccttgattccttcttgtcatctgtcgtacagtgtcgctaacaatccaacaggccagccaggaacagatgaacatgagcctccgtggtggtggtggcggtggcgtctgctgtggaatttgcgccggtctggcttgcttcgagtgctgtgagatctgctgctaaagtgtcgcacggaccccatcttggacatcacctgcgggccgtcatgatgtctacgtgaccgactctcgtgtcaatgttaaagatacccagagttctaaactcgctatgttgaatgttaatgctcgctatggattanatgcgatgtaagatggcctacggccgcataatgcactaaggttgaactggtgttcgcnnnnanaaaannnnnnnnnnnnnnnnnnnntnnnnnnnnnnnnnnnnnannaaaaaaaattcctgcgggccctcgcacctccg

SEQ ID NO: 6723 - DNA, 682 bp, Aspergillus oryzae
  misc_feature (1)...(682): n = A,T,C or G
ccgagaacatccacgtgatttccaaaaaagataacagccaacatgccgttgtcagtattgataatccctcttccggtacaaggcaactgccgccttcgtcggttcgcgtgcgaccgcttatactcagattgaagtcttataaaccttcctatacgcctgccggggaattacactaatggtgggaacactatacccggccccaagagaccacccgttctataaaaaacaattgggtgtgggagatcgcccgcgtatggggatgtcccagggctctaaaacgcaactgtgatctcaccccgggatcgacactctggggattctggccgacctcaggactcccgacggagctaacgctgatcccgggccanccgcgcgggcattggactgatgtgagcgagcaccggaaacatctgatgacgtactacaaccgatacaaagtggtgagtgaagatgaccgggacactatggcttggacggcatctattcgtgcgatttggggcgccggctatctgctcagagagtatgtcttttcttctacaagaacgccttgtcattcttacagnggngccgggtgggttgagctggactactgatgaagccggacttgtccgcctgcgggtgttgttaaatttggctgcgtcgaactaaaacgggcgcgttcccttttactaataaacttttg

SEQ ID NO: 6724 - DNA, 249 bp, Aspergillus oryzae
  misc_feature (1)...(249): n = A,T,C or G
cccccaacgctcgtatcgaaagcatattgatgagcctccctcgcacagcaagctgggcctatatggatccggtgtcgggaacccggaccgaggcttctgcggaggaaaagaatccgggcgaggacaaggagcgtgaaaaggaattaatggatgttctcagacatccccggcaatgggtgtaagcctccctattcttaatgtaaaggtatataaccaaaaatttagataacgtcttcccttcacctgtnn

SEQ ID NO: 6725 - DNA, 649 bp, Aspergillus oryzae
gggcaataggcctgctttccgtgttggacaggtcgatgctgaactcttggatgaggaactgttagggttactgaaagggcaagtcgggaatgctttgaagtatttcgggccccaagcccgtgaggactggtcccacgaaatccaatttgctctacgtgcaatcttattcaagctctcgatttgggaccacaacgcatcttatggagcggccttacaaaatttgaaatacgtagacactcgcagcaagggcccgattcactcagccccaacaaagtggcagaagtccttgtatggtctactcacagttggtggtcgctacgcctgggagaaatgggagagctggttgatcaaccaagaaggcggctatgacgagccgtcccgagaagtgcggatactggctcgtatgacagatctcatttccacgacacactcgatcgcagctttcatctctttccttgtattcttagttaacggtcgataccgaacattagtcgaccgtatccttcgcatacgcctcactcctccctccgcacaggcaagccgcgaggtgtcgtttgaatatttgaatcgacaacttgtgtggcacgcattcacggagttccttttgttcctgctgcctctcgtgggaatcagcagatggcgacgatgg

SEQ ID NO: 6726 - DNA, 676 bp, Aspergillus oryzae
ggaaaggatgagatccttttatggggcccgatgagaacacggccgagttggtggactgggctacagagcatgcaaggaatcgtggagctccttggtggaagtcattctttactggcaaaagtcccaagctgggcggtatcccgcatgatacttacggcatgacaaccttgtctgttcgccaatatgttcttggtatctaccggaagttgaagattgacccatccacggttcgtaagcttcaaaccggtggccccgatggtgacctgggatcaaacgagattcttctggccaacgagaaatacaccgctatcgtcgatggttccggtgttattgttgatccaaatggtctggaccatgaggagctggtccggcttgcaaagaaacgcgtgactatctccgaatttgacttgtcgaaactctcccctgaaggctaccgtgttctggtggatgagagcaacgttaagttgccgaatggcgagttcatccccaacgggatgatcttccgcaacactttccatttgcgccgagaacttccctatgaagtctttgttccttgtggcgggcgaacggagtccattgatccttctactgttggaaaactatttccaacgggaaatcaccatcccatacttggcgagggggccaacttggtcattacacaaaacagtataattcg

SEQ ID NO: 6727 - DNA, 1256 bp, Aspergillus oryzae
cgaggcgaccacctcaccgtcgacaacaatggcgtctcgtcctaccgtcactatcgccacggctgaaggcaagcccagcggggccactgcccccctgcccgccgttttcaacgcgcccatccgtcttgatgttgtccagcaggttcacaccggcatggccaagaacaagagacagccttatgccgtgagcgagaaggctggtgaacagacttctgctgagtcctggggtaccggccgtgctgtcgctcgtatccctcgtgtctctggtggtggtactcaccgtgctggtcaggctgccttcggtaaccagtgccgctctggtcgtatgttcgctcctaccaaggtctggcgcaagtggcaccagaagctcaacctgaaccagaagcgcttcgctaccgcttctgctcttgctgcttcttccgtccctgccctcctcttcgcccgcggtcaccgtgttgccaacgttcccgaggttcccctcgtcgttgagtccaagaccttcgagaacgccgctctcaccaagaccaaggctgccgtcaccctcctgaaggctctcggtgccggtgacgacctcgtcaaggtcgccaagtcccgcaagatgcgtgccggtaagggtaagctcaggaaccgccgcttccgccagcgccgcggtcctctcgttgtctacaaccccgaggttgatggcaaggagctcgtccgtgctttccgcaacatccccggtgttgagacctcccccgtcttcgccctcaacctcctccagctcgcccctggtggtcacctcggtcgcttcgttgtctggacctcctccgctttcgaggccctcgaccaggtcttcggctctggctcctcccctgccgccctcaagaaggactacctccttccccagaacgttgtcgccaacgctgatctggcccgtctcatcaactcttctgaaatccagtccgtcctccgtgctcccaagggcgaggctcgcaccaagcgcgccaacgttcagaagaagaaccctctccgcaacaagcaggttatgctccgtcttaacccctacgctgctgccttctctaaggagaaacttggccaaaagggtgttgagagtgagaaccctgaggctccttcaaggagttcctccacaactctttacgagaactaaaagggtgattcgggtttgtgttgaaatgattaactcggttaaagggaccaaaacaatgaatacggtttgcaatcccatgattctttttacgaaaaaaaaaataaaaaaa

SEQ ID NO: 6728 - DNA, 1067 bp, Aspergillus oryzae
gcccatcttcgatttgagaaagtcgccatgggtcgcgtgatccgcaaccagaggaagggtcgtggatccattttcacggccaacacccgtctcaacaaggcccctgctcagttccgtacccttgactacgctgagcgccatggatacacccggggtgttgtgaaggagatcatccacgaccccggccgtggtgctcctctcgctaaggtccagttccgtcacccttacaagttcaagcacgttaccgagaccttcatcgccaacgagggaatgtacactggccagttcatctacgccggaaagaacgccgccctgaccgtcggcaacgtcctccctctttcctccgttcctgagggtaccgtcgtcaccaacgtcgaggagaaggctggtgaccgtggtgctcttggtcgtacctctggtaactacgttaccgtcattggccacaaccccgaggatggcaagaccagaatcaagcttcctagcggtgccaagaaggttgtgaagagcacctcccgtggtatggtcggtatcgttgctggtggtggtcgtaccgacaagcctttgctcaaggcttctcgtgccaagcacaagttcgctgttaagcgcaactcttggcccaagactcgtggtgttggcatgaaccccgttgatcaccctcacggtggtggtaaccaccagcacattggtaaggcttctaccatctcccgctacgccgcccaggtcaaaaaacccggcttatcgttggcccgggaaaccggctgctccgtgggtccccaaaagcccaaggacttaggggtattatggtgggggaggtttttttgtttggtgaacggttcaaaaaggtccttttcttataagggcaaagtccttaggcgaatgcggataacctcaccccccgcccttaagggataaaggtgggggcacaaattttttggaggttttcccccctcaaaaataaagtcatcaatacgcataacataaaataatataatttttctgcgtgccgttaagactgattttattagggcccctttattttaatatttataccaccctctcctttcccc

SEQ ID NO: 6729 - DNA, 633 bp, Aspergillus oryzae
gacagctgcttcataatgtcttcttacaacatcgtcgtctttggcggagaccactgcggtccggaggtcaccgctgaggccatcaaggtcctccgtgctgttgagaagaactgcgatgttactttcaaccttcaagaccacttgctgggaggagcgtcaattgatgccacaggatctcccttgaccgacgaagccttgaacgcagctaagaacgctgatgctgttctcttgggtgccatcggtggaccgaaatggggcaccggcgccgtccgccccgaacagggtattctaaagctccgtaaagaaatgggcaccttcggcaacctgcgcccctgcaacttcgccgcaccctccctcgttgagagctctcccctccgcgccgacgtctgccgcggtgttaacttcaatatcatccgtgaactgacgggcggtatatacttcggtgagcgcaaggaagacgatggcagcggatatgcaatggacacagagccctactcgcgcgctgaaatcgagcgtattatccgtctggccgctcaccttgccctgcagcacgacccccctctttctgtgtggagtttggacaaggccaacgtcctggctactaaccgtttgtggcgtaaggttgtcaccgag

SEQ ID NO: 6730 - DNA, 643 bp, Aspergillus oryzae
  misc_feature (1)...(643): n = A,T,C or G
cacgttttacatgatctgtggtctcgatcaacaaatcaaggaaatcaaagaagtcatcgaacttggtttaaaacatccggagctgtttgaatctcttggtatcgcgcaaccgaaaggtgtccttctgtatgggccaccgggaactggtaaaacactgcttgctcgagcagttgcccaccatacggattgccgattcataagggtcagtggctcggaattagtgcaaaagtatattggtgaaggtagccgtatggtgcgcgagctgtttgtcatggctcgggagcacgcgccgagcatcatcttcatggatgagatcgacagcattggatccagccgcatagactcagcaggctcaggcgattcggaggtgcagcgtacgatgttggaactgctcaatcagttggatggattcgagcctaccaagaatattaaaattattatggctacgaaccgactggatattctcgatccggccttgntgcgccctggacggatcgaccggaaaaattgaattcccttccccatcggtccgaaactcgcgctgataatttgcggattcactcgcgctcaatgaccctaacgcgtggtttcaacctaacanagatcgccgaaaaaatggacgggtgttcttgtgcaaagttat

SEQ ID NO: 6731 - DNA, 667 bp, Aspergillus oryzae
  misc_feature (1)...(667): n = A,T,C or G
cggatgcagtgcccatcgtgctgcttcatggatggcctgnaagcttcttggaatttcttcctctgctccagctgttccgggatgagttcactcccagcaccctgccgtatcatctcatagtcccgtctctgccgggctatggcttctcttctggtcctccagtggataggaactataccactcacgatgccgctcgagtcatcgacaaattgatgaaggacctgggattcgaaagtgggtatattgcccaaggaggcgatatcggaagccgggtatcaagatttctggcagtagaccatgacagctgtaaagcggttcatttgaacttctgtgcgatagcgacacccccaaagggagtacctgaggagagcctcactgcctccgagaagaaaggactcggacgaagacaggaattcctgacctcgggcctcgcatatgcttttgagcatgccactagaccaagtaccatcgggcatatcctctcttcaagccctcttgctttgctcgcatggatcggagagaaattcctcacctgggtagacgagcctcttccctcccagacgattctggagtttgtcactctgtattggctgactgacactnttcctcgagggatttacccttatcgagaggaacttcccatatccccggaagggaatcccctgcg

SEQ ID NO: 6732 - DNA, 696 bp, Aspergillus oryzae
ggctggtattgatccaggcgtctagccaccgctgttcgtcacccagccagcaatcgatgacgttcgtgaagactttttcccatgtcccgaagatcgtgacgacgaacatctagcctctcactctcttgggtttgtccatgcgtcttctggtgtcagacgatggacacgcaaaggcatcaagcatgaaattgattgggccttgatcaagatcaacgatgatcggattgatcctcgtaacatagtgttcagtcaacaacctatgcaacagactgaaactatttatttgaacgacatcgcacgcctagaagatcttggtggcttgaaagttcattgttgcggtcgaactagcggcttgcaaactgggcagatatctcgagcaatgacaattgtaaaactccacggccgacagactttctcgacgagtttctgtgtagacgggaacttcggtgttcccggcgactcaggagcatgggtcttcgaaaagtcaaccggtcgagtatgcggccacgtcctagcttggtcagagaaaagccacacggcatacatcgcgccaatgggagtcatgttagaagacatcgctcgcaccctggacgcgacatatgtcagtctaccaagctatccacatggagtttttctcgtacccaacgccccggttcctcccacttttgaaccacaaaaccccaagattatcgcgcc

SEQ ID NO: 6733 - DNA, 719 bp, Aspergillus oryzae
  misc_feature (1)...(719): n = A,T,C or G
agatattactgcttgcaaatgcagcacgaggcggatcgctgccttgaaagctgcagctgatagagcagatgaagcggacgttgcatcgaatggaaatcgacgacgaggggcatcatacgcgtaaggtccttcatgatctctgatgaacatgcgaaccgtatcagggggttactggctaaggactgataaacggaaacggtggagcgtctgtggggccgaacgtcgtcaagatctcgacttggagacgatctgggaagattgatatgttaactacgaccacttcctctgcaaattctaagaaattatcaagcaacctacgctaaacgaagcaattttgtgggctatgcttcagcttttaaccaatggcgtatgtgctcaactttgatgcacgttcaccaactggtgtgccaatgtacctgataacttgacttttctgatgaaggatcgtgctattgatgacatgcagagatgctttgagatcagctccgatctcgctatcagaatggcaaacagcctctacgtcatcagtggtatggactgttgccggaatccttataacgcggagctgcatgatactctgtatttgctgaatcttttccggattgtagactgtccttgctctttgttctggcgcttatcttaggtctcgcaataccctttactgtccttaaatcttgtctattggttttcgaanaccaanatgctctgnaaaagatatt

SEQ ID NO: 6734 - DNA, 706 bp, Aspergillus oryzae
ctacatatactcctgcttcccatcgatcttgttgaccgtttccgtcttttcttctatctatctatctatcccttcggtcatacccttccttccccagactgagctccttcaattcctcttctcccgtgggtacatagctatattcttagctacctccccttacacatacacaatgttcaagtcaccagccgcccgtcaagccgtcaaggctctcagtatcaacacacgccctgctgcagtaacagcagcatcccgaccagcggtggccaatactttcttccgaggtctctcatcgacagctccccgtgccaacgatgagaagtcgaaggcagcaaaggaccccatcttggctgccaccaacaaagctcctgagggtgccttggactcagagggccgtttcgcccgtgtcgactatagtttgcacatcgaataccccgatgatgagaacctgccatcgttgcctatcgtccaaggccgccgaagaatgcactttgaaaggcacctggttcaattgttcctaaaaaaacaaggtgcccctcggttctctgaggtgcccagtgtttgggcttgggcccagcactgggcgtcctgtgcaacgggaacggcactttcaattggcgtattttaacaaggccgaaacttgaggagcatacccccaagtatgttggaaacatttaacgagggagaaccccccgtttgaaacaag

SEQ ID NO: 6735 - DNA, 699 bp, Aspergillus oryzae
  misc_feature (1)...(699): n = A,T,C or G
ggccggagagcaatacatcgtccacccattcaatgtcgtggcttacacaatgacaaacaacccccctcgtccttaccgcttcaaatccacaaccttgaaattccaggttccaggtctcaagggctggccgagctttatccaggattcgaaattcattcgggatatgtcgggttccgatacctggaaaaccgcgatgaatatcttccataaaattcgtacttggtctcggatgaccatctggggagacaggctcttcctgcaatttgatggccccgcgactattctcatacaaacccgtggcccccgtattaatgaagttctcacctcgcacgaagtcaatgagattgcaagcgccccgagaggactaaccattggacctgcaaagcccgcagaggaaaagaaaccgtctgccgacgaggagtatcggaaggcggccgaggaggctgtcaatgctgcccccgcacccacgaggaccgttgaacaattagaacaggagatcagagggtcagcgcaaagcattgccactcttacgaaggaaggcaaggtgatctttgagaaacctggccaacaaaactaaagtgtaacgtttgacatcaactgtcccagttggggcatgataaagcgctcattctaaaatttcttattgcaggcttgatgtattataggtagcatactccaggtttcaacaatttttttttn

SEQ ID NO: 6736 - DNA, 28 bp, Aspergillus oryzae
tcctccgcatccgatgccgatcgcgagt

SEQ ID NO: 6737 - DNA, 633 bp, Aspergillus oryzae
ctctgagctcctttagtcgcccgcacgatctccgccagggtgcggctcgtggcacgcgaagtgcgcgtcgcaaagagattgtctccgcttttacctgggaggccctgaccattgggaaagctagaaccggggagcttgcaacctcatccggaaacagtaaaggtccgcgacagctcccaattgctgtggcacctcccaatacacctccatccaagatgtcacggaatcgtcctagggggcctccactgcctagagacaatggtctggcggccaatgaggaaactgatatgtggaataagatcctccaggatctacgaaaggcaaaggagaagaatgataagcagaagtccctagctgagcagatatctgctttgaatgagaagattggcaaagatggtgggaagccgagtctacatgagcataaccagctggacagtctgtaccggcaaatgctcaagctttgtgaagatgaaagggccattcttcaagatgaacccagtgatgtgatcaagaacttgggccttctgaccgcacttcgtcaggcatctgaagcagaggcgccactttaccgtgcggctgctcttgggaaatcccgtaaaaagagaaatgacgtggacgggtcagctacgggtt

SEQ ID NO: 6738 - DNA, 737 bp, Aspergillus oryzae
  misc_feature (1)...(737): n = A,T,C or G
nnngcgcagcggcttgatactactgcacgaggtgcgggggaacaattctccttccggcccttattggccaactttacccaatgctttttgccaaaattcagtcccctatctgaaggccctaaggggcctatgtcgatgaggatgaggatgagcagtccagaaaccactcagttgatttcggcgtggcatgaaggacaactggatgctctattacaaaccacgtgggccttggtcctttaccgctataccggttctggagatatttgcttcggtttccaacaaccgacggctggtgattttgcgacccattcctcagatagtgcgtctatctgtacatgcagactctcagtcagcgaagatgactctatccgaggattgcttgaaaaagcgaagggtcagagtgacctcgtcaattccgctgagaaatgcggaaccccgagcgtggtaaacaaaagctttcggctgtataacactatgttgatgatccaaaattgtcgtgagacgataagaacctcgacggatatcccagtacaaccagtcgcggcgaccgccctcccagatgagtgtcgcattcgcctttacgtgaaggtcttacgtgaagatattganatttttatggagtggtgggataacgacatgtgaaccgagcatataataagcttgtgcaactatttncaacaaacttttacccggggtttttggggcagatgacctgatccgtgaccaaactacccggg

SEQ ID NO: 6739 - DNA, 725 bp, Aspergillus oryzae
cgaggcgaagaggacgagtattgggcaaatgccgaccccgtgaaagagaacggtgtcggttgcaggtgcagatgtgacacagatatcgtggatgttgagggtaaacaaggcagctgtcttgccgagtgggtagaagttgcgggaggctgggcttctccctagattcgggcaacttcatgctttgtccgctgtataatcttcgcctcctcgtttccatacctttattgttcaattatgagcattactcgggttgccgttggagttaattgttgcttgagccttcatattatgttggctgtggggttctggacggcgttcaacggatctgacagcttcttcatggaaaatggtgtgatcattctcatcaatattcacaaattcatctagcgtgctttgtatgttttcatttggattgccgcgttcttattaaaacagaagactatcttctggaaagagacggttactgtccgactgtgagcttcaagatagtccccgagagcgtctatcggtattcacgttcggtcttcccacaggcaagacttgttttctctacgtagctcttggctacggtgaatattccacgcctcttgttcctacggtctcttgctaaagctcgctgtgcgctaaccctggatttgattatgcctgctgctacccaattttccttgcatttttgcttattgtccgtccacctcaggaaactgtccggcattggttccaaactt

SEQ ID NO: 6740 - DNA, 990 bp, Aspergillus oryzae
  misc_feature (1)...(990): n = A,T,C or G
cagaagtattcaatctgatttgcaacacttcactcctttccttgattggacaaaatgaaggtcgctatcttctcgactctgttacccctcgtcctggctctcccagccccccagacacagtcaaccgagggaaagttgccttggaagaaaggcagcgtatgcctggcactcacggaggactgtatggggacgattggatggtgtaacgccgaggcgcaacgcctgaaggagttcggcgctcgtgagaagtgcctcgcccaaagagagcgccgtcctgccgacgcacctaaacttccctggatgaaaggtaccggttatgactgtgcctatgctctcactcccgaggagagatgttatggcactgcacttttctgccgtgagggactttacccccagggtcaatatagggacgagcaggaatgcttgtctgacagagaggatgctccgaaagatgccaagaagcagcagagcctcccagaggcagaactgaaggcgaagaagccattccttcagcccgcgcccgacagcgacacttcgtgcatgaccttcgaccgcggcagtgaacgctgtgttggaaccaggtactactgtaccaatgatatcatgaagttcccctacacagacgaggacggcagtgtctacaataatgctgccgagtgtctggatgcccgtgaatctgagcctcaatctgccgatcccgatcgcattgtgttccctgataactagggtcggatatggacgtagtccccaactaagtgcggtccatggcttgaccacccacgttagcattcaggggatgcggactaaggagggaaccctgaaagtgttgtgaacgttcccatttgcctgtacttatgtgtattaacctcctggcgttagattcaacatctaggccagtcttagtgcattagttntatttatttcgtcgattttgaatcacactgagaaaagggannnnnnnnnnannnnannnnnnannnnnattatttt

SEQ ID NO: 6741 - DNA, 647 bp, Aspergillus oryzae
  misc_feature (1)...(647): n = A,T,C or G
cgataaaatcgctcgatgcgtgagaaatacaatatgtgggggaaaaaaaacaggaaaaaaaatatggggtgctgagagggataggccacgattgtaccctcctgaaccaggatcttggacttattgcagaccaagaatcccagaccatgattggtcatgtcacaggctgtcgctcctaactggagaccggtcccaatttggaatccatttgcccacccaccaacacggctcttgatcagtagcgtccttgtaagggactaacgccgcgaaatggatggacatcaatgtttctactgacttatatagtgtctaaactgaccgcgcttgagacttcaaccatctgtcattggcccacttcgtgcttnctgagcatttgccgacgattacacctctatcgtccttttcttccataaaaagctcaatttgtgatagcgaaggagaaaaccgggccaaggagaacaccttttgcactgtgacttattgacgtntttttcattcttttctttntatttatcaacgaaccgggggattcattcggggatatctactagaatcttgtcagcacgccacgccggtgcagggtagaattcgtcgtaatgcccacacattcacagtgggacgcacacttctataaaagcattgccaat

SEQ ID NO: 6742 - DNA, 656 bp, Aspergillus oryzae
  misc_feature (1)...(656): n = A,T,C or G
ggaggcagaagcgctccgttaaccgtcgcggtggacccgccctacccgacctgaaagaccgtcaaaggactatccgcacaatgattgtatcctccgtcattcctaattcggccgcatctattgatgaaagtaacgtcttcaagcgatctgggtcgagccgtgccaggcgcgctgctgtcgggttgcgggacactggtgacgattctgatgaatcagacagcgacgaatcttcaattacaggctcccccgctatcggtcctcatctggcccaaggcactgcgcgcacaagaggcatgcgaggggctgccagtgctgctcacgctgctctgcgtgcgaaccttggtcagtctgccactccggagcctcaccacgagggaagagcatctgctaggagacgggactatcgcgaagagagcatcgaagagccagaaaaactaattgtgaagcttaagatccctcgtgagaagttccgtcagcttcttacccacggaccacagtcaataccgagtctctcagcgactccagcccctcagccaccgtcacatcaaggcacgcctcannatagcacttccaccccaagcaacatggctccaccgtcacacatncagcctcaagccagagtttcaggtgtcggtacacccacgcaacggaccgtc

SEQ ID NO: 6743 - DNA, 697 bp, Aspergillus oryzae
ccttcaactcctagaccttaccttgcgacactatcatagacactaccgcaaaagctctcaccacgcgatggaagtcgcagctgaaccagagcttcaatatgtcggggatcctcttcctctatcggctggctgttcgggtgccgaagttcctctttcatcagctcacaacgcgctgggcaattcgcagctcgatttcaactcacttgactttccccatttctagaccaaaaatctatcgatgaagtggcatatggatgctatatcgtccacatacaatctgttcgacgatcgcgctccgaacctgattacggaggatcacagcatttcaacggttcctgagaccactcgctcccaggaagatcgcctttgccagataccccaagaatgctgtatctgactcgccacacgggtgcttcgaactatgcatgcctgctcaagctcctggattctggggatgatgggccaatattggcttctccaagctcaatatcagcttgaagggaacagattttgcgcctgaaacagttctatttggaagcagtccggatcggtacatgatgtgggtagtaaagggagcccgctactacttctcttggcaacgaccctgtgtatgatatgattgcgtggctctggaatgttttggcgattataaatgggccgtcaaacttttttccgatcatcgggccgtttaatctcg

SEQ ID NO: 6744 - DNA, 467 bp, Aspergillus oryzae
atttacccttgactgcctctttgtgtccctcgtcacaatctatcgcaatggccgactccaacgaatctcagccgatcgtccgggccaccaagcccgtcagtgaggcattgctcaatgagaagtgggatcgcgccatctcctccatgatcattcgctcctcccttggcctcggtttcggtgttgttttctcagtgctcctcttcaagcggagggcttggcccgcttgggttggtctaggcttcggtgctggacgtgcttgggaagaggccgactcttccttccgtcgtggcgactcgcccgttagagacgccctgcgtcggtagagggttcagcatttgattgtgtatgatacctgtatagccgagggaataaagtcagtttagggcttcattcatgctgtttagaagaattcctaggctctgtttaccgtttagcatgcaattcatcattattgtatcccgccattg

SEQ ID NO: 6745 - DNA, 722 bp, Aspergillus oryzae
gacatcaggctcgatccgactacggcgcgacgagtgatgacccggatggctcgagcgatgctaggatctgggcgtccgtaacgagctggaggtcgaaattgctggtctttagattagtataaccattcgcgaggcctaaatcatcactctgaccccggacgaggaaggccgaggcagagatcagtgccagcgaggtatagaagcgtatcaaccccatagcgcagatggcggcgaaatcggcattttacctttgtcacttagagcgcacgccacattcaaatatgcttcccttgacgacttgacatcatggctgggttcaattaaggcagttttcctgaggggaaattggcccagcgtccgacctgcataagcgcacttcggcttcgcatcccgctgagatgcagattcgccgattggtggacacggttcgattcagggggagatatagcgagacatctagctgtaaccctgatcaatatcgtatcatctgatcgacttgatagaactcgacaggatttcaacttcctttaaagtgccgagacagagatggctgcattgattgaccctcggatagcccttcctattaaccgatgcatgcgacgatcacttttgaccgcacaggcttccgaccaagagatagtaggaatgcaaccctggacgaactaggaatctgcggacttatataaccgatcgttaatcgcccagtctctgggtagcttgct

SEQ ID NO: 6746 - DNA, 487 bp, Aspergillus oryzae
cgtcgtcgcttttcccgttcgaacgacacctctcaaatataagatgacatgatttcgccaacgcccccaaaaaaaaatcttacttttatattcgcccgacgagctatatacctccactcgatttaccttgtaatcatgacgacgtgagctagcattggattcggcaagagtccccttttcatatttccggcgtttctactatttagggttgtgcattcttccggcatgggttgcacttggcgtttggttcttatagcacatatttggctatacttgcttcttatcgaagattcccgcgaatgcgctttatagacgtggatatcctgaggcttggtacacacatgctctcgagcctcattgtatgggtttgtatcgatatggttggttaatggatgtacatgatatgtgtatatatgtggtattggataaatacaacattttctatggtgtgtctggcggtcgacatgagtgtccgcgaccacctttg

SEQ ID NO: 6747 - DNA, 755 bp, Aspergillus oryzae
  misc_feature (1)...(755): n = A,T,C or G
agggtattgattaggtgacactatagaagagctatgacgtggcatgcacgcgtacgtaagctcggataatctacagcagacgatgcgtaatgatctgataatgcggagctaggtgactgagtacttcaggtgctaacactcttgcacgttacgaagacgagaatctcggactgcgaacatcgatccagtagagatcgacacaataggnggatgatgatcgcgcattgacaagcagctatagaagttcgatatgcatacgctgagacatcctttacctacagaagatggggaatcaaaagcaaagttacaacgaccactgtcgagtgaccgcgaagtgagcagtattcccagagctttcgaccaagacctgaagcaaccttctcctaatgctgccgcggaacctccatctccatatactacatcggctgtatcgcacggcacgccttcaaatgcggaagctgaaactggtcatgatgagaagagcgggaatcggatttacccatggtagcaccaattctacgaagcatggatgcacaaatgtaatacaccggtttccagcactttgcctactgaactagcaactactgtggcatccattatcctaatccataatgccttcaacgagcgtgtctgtcaccagatcctagaatgggagatacaagcgcttccgtctgatctggctacaagaaatgtggagggtcgaaacatatttcatttcggcggactgggcagataccgctcaaatcaaaatcctt

SEQ ID NO: 6748 - DNA, 459 bp, Aspergillus oryzae
  misc_feature (1)...(459): n = A,T,C or G
ccgaagatctgccattgagaaagatttggagtcatctctcgtggttagcgagaaacgagctaagaaacttgacgagctatatcgtgaagccagcgccgagaatgaagccctttacgaccggttcaactcggagctgagcaaggttgcaaaagacgtgcgagcaggagatgctgaagatgcgctcaaatcccaactctcttcagcgttagaggagattggccgattgaaaaaggaaaacttccggctgaaacgagagggtggaggtctganaactcancaagccgcggtggccttactgaaggcgagcgaatgacaatcgaattgcggttttggaccagtggccgttctccgagactctgggcatggaagtatacttttttacctctcacttgctctttttcgagaactgaaatgggttggacccgaattacctgcatttactaagggacaaaccccctg

SEQ ID NO: 6749 - DNA, 1153 bp, Aspergillus oryzae
  misc_feature (1)...(1153): n = A,T,C or G
gccatcgccgcctgtacctttgcaaattgcccacctgtatcctcctggtcccggcaacccgcactatcagaaagccatggaaagggaagcggcgaagagaggatcggctgctgtagcaaacgcgccaaaccaaggagacggcattcccactattacatcgcctggtgcgcaggcactccaacagtccaatgctaatttgactcctcagcagcagcgccagcagcaggcttctgccgcggcggctggattggcagacaagcttaccagctccatgatggaacaggaattggatgaaaacgaacctcccaccatcaaattgggagacgcatcggttgctgcgcctttcactagcaagtttggccaatgttatcgccattcccaatatcattcgtcaaggccgttgtacactcgttgcaacaatccagatgtacaaaatccttgctctgaattgcttgatcagtgcctacagtctgagcgttatctacctcgatggaattaagttcggtgacggtcaggtgaccatcagcggcatggtgatgagtgtctgcttcctttcaatttcacgcgcaaagtccgtggaaggtttgtccaaagaacgccctcagcctaacattttcaatgtatatatcattggctcggtgcttgggcagtttgcgatccacattgtgactctgatctatctgtcgaactacgtctattcaattgaaccgaggaaatccgacatcgacttggagggagagttcgagccatccctactcaacagcgccatttacctgcttcaactcatccaacagatctctaccttctctatcaactaccaaggccgtcctttcagagagtctatccgcgagaacaaggccatgtactggggtttggtgggagcatcggctatggccttctcttgcgctactgagttcattcccgagctcaacgaaaagctgcgcctcgtcccgttcagcacagagttcaacgtcacgttgactgtcctgatgatcttcgactacgccggttgctggattattgagaatgtactgaagacgctgttcagtgatttccgcccgaaggacatagncgtgcgccgtncggaccagctcaagcgggaaaccgctcgtaagccaaggaggagcttgagaagctgtctgcgcaagaagcc

SEQ ID NO: 6750 - DNA, 685 bp, Aspergillus oryzae
  misc_feature (1)...(685): n = A,T,C or G
tttacgagggcgcttttcccccgggttctccccggataagaagtacgccatacttttgaccccatacggcggcccaggcgcccaagaagtgaccaagagatggcaagccctgaatttcaaggcctatgtcgcctccgacagcgaactcgagtacgtaacctggactgtcgacaaccgcggcacaggtttcaaaggacgcaagttccgctccgccgtcacgcgccaactcggcctcctcgaagcagaagaccagatctacgccgcgcaacaggcggccaacatcccctggatcgatgcagaccacatcggcatctggggctggagtttcggaggctacttgaccagcaaggtcctggagaaggacagcggtgctttcacattaggagtcatcaaccgcccctgtttctgactggcgtttctacgactcaatgtacactgagcgctacatgaagaccctntcgaccaattgagagggctacgagaccagcgccgtccgaaggactgcccggttcaggaacgtcgagggccgattcttgatccaccacggaaccggccgacgattacgtccatttccagaactcgcttgccctggtggatctccttaatggcaaatgcgtctttccttaagagcttcaatccgcattggtcaccagcctcagaaccacggaatcaggtaccaatgggg

SEQ ID NO: 6751 - DNA, 664 bp, Aspergillus oryzae
  misc_feature (1)...(664): n = A,T,C or G
tcagtctcaacccgaaacccaaccgcagacccatcggtcaagcccagagcctggtagatactccgtctgatatgagttgctatacgccggagcccgatgctagagatagaagttcgactttgtctcccttgccagagacgatgtcacctcgcagtcacgacaagcttaagatagaacaaactcctgcttcagagattgatgatactcaatctttgccgacaacaacttatagccccagcttaccaaacgagacacctaaaaccacagatgatgtgtcatggaaggatcttgattcctttcaaaatcatcttcttgctcttcacgaaactcttgaggcttcgatggccggatttatataccctaatgaagaagaaaaccgcacaccccttttatgagcggcacggattatctagagacgaagagtgaggatctgccgagcccctgggttcattcttagatgttgtcaactcgactttcctgattttccctttattattccccgcagccacttcgtcgttaagcactcaacggtcttgactctgtaacacttcattccccctcatcccttctaagcgtctgagcccctttttcattttttcctttattttcctttgctggtcanggatttaactatatagagcatctatggcttgattcaaccggg

SEQ ID NO: 6752 - DNA, 732 bp, Aspergillus oryzae
cagttctattactcattacaaacccaaatcacacagaaactctcatcatgcgtctcgctccaatcactgtcggtcttgcagcatgtgccaatctggtgtctggtatggctttcacggctcctgcccgatgcttgacgatgaaagacacggctgagaaactggacgttaatcgttggattgatctgtggctggaaactacctgcaaacgctgtcagtcgcccaagctgtcggattatcgaactttgcgggaaagccacgtcgctccctttgtgaaggattgctctgactctatgggcacttctcacctttcctccaactaccttgccctcgctgatagcctcttggacctggccaaaagcaaatgcgaggtaaccgacgaaaccgacttgtgcgaggatcctgatcaattgaagacagtagccaagtgcgttcaaagcaacgcctggtctttcgtcctgggcaacgtcggtaatttcctgtccatcctgttggcagacccctgcggcagacaaatggacttcattgcaaacccggacactctggaccgcaccattcgttcccacttggccaactacgagaaaacttgcccaaagaatagcaaatcgctcggccagtgaaaatcccgaatcaaactgtgcttcattccaatttgagcagccgtgtttaccttccttcaacttccccttgtgcgtggtttagttatctcggggctccgtgtacttgcccgggctt

SEQ ID NO: 6753 - DNA, 119 bp, Aspergillus oryzae
ctcgctgggccttggggggaacccctcggagcaggggggcactagccgggcaaccggccggcgccccccagcaccgggtgggggacgcccttggcaggcttcggccgtccggcgggcgc

SEQ ID NO: 6754 - DNA, 657 bp, Aspergillus oryzae
tctgtcaactaattatgactctggttgtctctcgcctcctactggatcaccagtacggtgatgttgctatcttacgcttcaccacgctgccgccttcatgctcagtgtactacccctcccccggtgcgggtaataatatgcttctcagccctttgcagaccaccaacccccccgcccatgaaggaaaaaaggacctggttctctgaacgccctgataaaggccatgggctgatgtttccgcgtgaagacacttgtcattcgtgtctcgacgtttccagacctcgaccgagtgagttaatctgtcattctcatttttaccatcacactttcttctacttacgtcgtcaccatccacaagcactatttgtgcattcccactcatgtcatgacaaacgtctcgctgatacttcacatgagatatacatatatgagaatacgacctaatatgtctcgtcgatttgtactggtagtagtggtgcgatattacatgatatcagatatgtcgtctcgatcgctgtcacttcatgacgctgataccgaatattatgttgactcgaccttctgctggtgattatgacgtcgacgacatatcagcttgacgatcctcgatcatcatcaatctcccgactatctccgtcatcatgtctattgttcacg

SEQ ID NO: 6755 - DNA, 626 bp, Aspergillus oryzae
  misc_feature (1)...(626): n = A,T,C or G
gtcgtgagcttccgtcaccacatctgatcttcatcccaccaccatctctgctcccacctcaacgtccatcctcaccatgttccccactcgtgtcttgcggatgcaggcctctcggccttttgctttccctactcctaaggaggcccacagcgctcacactatctcccagcgtctgcgcaccctcaagcgggtccccccggagttgattcctctcggtatcgttcttggcgtcgctgttggagctgctatctactccagcggcaggaagctcatgaccgacaagactctccgtcttagccgcaacagccctgagagccgtgagcactaaagtgtattaccatatttcaattgcaatggcgatccttggtgtgatttttgtcggcggtctgtattattcacgggaaagttgatgtcgcgggagaatttgaaacttcttaaaaaactcgggtggagcgcgtgtatatagtacggcttgaacggagggttctgatggagaaatattgcaatattactggcgcacggctttctgtttccnannnnnannnnnnnnnnnnnnnnnnnnnnnnnnnnnnnnnnnnnnnnnnnnnnnnnnnnnnnnnnnnnnnannnnaaaaaatcccggggcn

SEQ ID NO: 6756 - DNA, 669 bp, Aspergillus oryzae
  misc_feature (1)...(669): n = A,T,C or G
ggatcctcatttctgcgctggagtatatcgtcgcgttaggtgctgtcgcgaatatcgtgaccgcctgctaccagctaggtatacagtgcatatgtaactacgcgacggaagtcaccgcgcagtcacttatctgggcgttcatcgtcggactcgttcatatcgggggtactatcgctctatcacttcgctatcgcgttatccgatcacctgtgggagaaacccatactgtgcagccgaattggtttcggagatatctgatccgggagataaatccatcgttatactctaccccacccccggacgtcgacgagatcgaagaatcgtatttatttctgctgttctcatggtgcgtctctaccggcgctgtagtccatatcctgtatgggacaatggtgctctccagcttgttgtttatctcagttcaagatgcgctcgcgctcgcgggacggtttcttgcgtcggttgtgtgttgtcccgctgtgttggcgtatgagctngctgggctgagacaggcgaaggctggaatatgggaaatggggaggggtctgagacactggaattgaggtgaaagtgaaagaaggagatccaaaggtgcaaatatgggtggcttaaatatggtctttgaagaaaacttggaccaagaagaaaggcggaatcttccatgaaagg

SEQ ID NO: 6757 - DNA, 672 bp, Aspergillus oryzae
  misc_feature (1)...(672): n = A,T,C or G
ctgaaggggatgaggttaagactttgccgaaggagcagacgatttttcgatttcgggtgccgctatctacgcctcgtcaggatgagatggatgtgacggaggacgcgggtgcaaatgccggctccagtgctaggaaggagcttactttcgagcttcatgggagtcagttcctgaatcggccggttgatcgtgcaaacaagaagttcaagtggcgcaatgtggactatctttgattgatggtgcggtactatcgcctacactttttataatgttaacgacactctttgaaggattggccgaccgagaagactgcttatttggcagcacgcggatgccgagggaatgaagcgcaagacgcgaaagaacactgacgccgagtcgatatgagagaggattcctggcatagcctgcgcattgccctcaaacatggaccaagcctccggcctccttcatgccgtccattggcatcaacactactccagagcaatgtccaaagtaaggaagctgcgcctcgaaggccgcagctctactttctgtgccttatattgagcttgtctcttacatatgctacaggattaagctatggtcgggtgattcccactatgtgaacgcagatgctactcaggtgatccaatgggtatcattcgagctagaanaattgtttctcaagtn

SEQ ID NO: 6758 - DNA, 801 bp, Aspergillus oryzae
  misc_feature (1)...(801): n = A,T,C or G
ggcaaagccgaaccttttgcacgcggatcccacatcatcaccgcacggaggtctggtcaatagattccattaagactgtcatcatcaccctgcagggtattcaagccctcgtcgttttggttcgtggtgtcatggcgttagccaatattggcaatcaaccgttcaacgcaaccatctctatgagtactattttttacccccttgctgtccttggtctgcttcggctgttcgctgctccctggttgaccgaaaattatacctacaacgagcatgaaacgtacgagagcagcaggatcttggcgcagcatatcatgcacatcccttcttcggatggcgcttcctatgccgccgtgcgcaccagccctgacaccaaaaatgcaccgccctcaaacacatcactgttacccagaagctcgatggcaatgcgtgatccgtcgcccgatgtttatgcgcgttccaagggattccatcttcccgctcaggctgtcgccgtggccgtccgttgctgctatcttgcctaatgactgccatcctggccatctgtgtgtgctatatgatcccttacaaacgngcgctgatgatattgacccagnccngcgccttcgccgtccttttgctgcttatcgnngatgatatgggtcattctcgaatcgacatcctattggcacttattcatccgtgcggccggacacaacacttgtatccatgcttcggacatggggaaccggcatacacctggtctcataacggagatatgcgtggatcgtctttccggtttacacacgggaaattggcggcccg

SEQ ID NO: 6759 - DNA, 687 bp, Aspergillus oryzae
  misc_feature (1)...(687): n = A,T,C or G
gaagcttacagccagcccatcgagcttgaggcacccgagtcccccgaacagatcggtgccgactgggctttaaaagacaccaagagaccacaaattcattggcgcgaagtcttgcagcaaaatgggtggaactaccttctgatttaagtttttttagataccccctctctctccatgggattgcatctcatgacgtttacgcgtcccttgaagggacccattcaagcgggcttgaatatgcggccaactcggagatctcgagagtcataatctgcgccaaggggatatatcaatgaatgcaaatactcgcgccggttgaatgatggctggatctcatcattcctgagcttactgctccgccatatttgctttcaggaaacgtccatatatcccagactgtgtcggcttggtgtcggctcttgggtctgtctttccattctttatatattattggctctgtttcactgctggccagggaaatcatgacacgaaaggctatgaggaagcattggatttgtggcgatagttgcagaggcgcagacagtcatacccccacatggtgttttggcgttttggagtggatggaccttttcatgggactatatctatataaaaaaaaccatattatatgctgtcggcattntgtttatttaagcattgtgatttgaattgattcaatggactatg

SEQ ID NO: 6760 - DNA, 568 bp, Aspergillus oryzae
  misc_feature (1)...(568): n = A,T,C or G
cgaggcatgtcaggaganactccntcctacataggtcatctgtcttaatatcnaacgtcactctccaaccanaangacncacggcgatcccaattactcctccttattagaatcagaagcgttttgctcagcgtcagccatctccgtatcttctttgtcatccttcttatccgagctggctgcctccggagcatgggcactattctcgggatcggtgcccttgacccaagaacggaaactctgatttatttattccacctgatcctttgcttaaactgtgccccaatattgcctcatttttccaatttgtgctaaaatttaccatatttttgtacaacccctatcataatattatttgtgttgtcttcccaccaatctcccattagaatttgtccctgtaatttttacttgaatctgtaagtatttttagaaaacttttctaagtttttatgcaacaattacttatttttctttttgctctttgcttcattctttacttttttattgtactcatatttgtttaacacactactattaacattcctctatcttccaatatatactctac

SEQ ID NO: 6761 - DNA, 658 bp, Aspergillus oryzae
  misc_feature (1)...(658): n = A,T,C or G
ctcccgcagtcctcaaaagggaaaaagaaatcggtcgtgtcttttgagcgggtctacccgttgctttcaccttaactatgcacaacatggcgatgaaccggtaaacagcggacaaagagaaaagaggactagaagcagaagccgacaaaagccaaatcatcgccatatcaatcaaccaccctcaccaacaccaccaacccgacaaacatcagaccacccctgaaatccaagcacacatcttatctcactcttgctgaatggtcaaccagtgcatttgtctggacttttcctttcttttttcctttttggtttatttctcctaaccctcccctgacatgaccgcatcgactcggttggcaagacaatcgttctcctgtgcttccggccttgaacagggagagtcgacgctttgacttccagcgctgcagaatgccgcctccaacctccctcgtcncagcagcccctccatctgctgaggacgatcaattcgccgccagtatttggagaaaacgtttcgagaaaagacctctttcacaacaaccgatgattgcgatactcgatgtggagtacaacgaattgacccagtcttgggagagatttcaagaaaaccttcctcttgcagatcatgtcgaatttcaggaacgaccacagacgtctc

SEQ ID NO: 6762 - DNA, 667 bp, Aspergillus oryzae
  misc_feature (1)...(667): n = A,T,C or G
cgggaataataagcaggagagtgctcacaagggcagtgttgcagctgtcaaattgcctcgcaagtttgcgtacctagagcagcaacaggaacagtcaccgaccgtctatcagtccccgtacaacatgccttctggcttcagcgagtatgcccagaagacgtttgggctgactccaagcgagccggagctccctaaaccctcactggccaatgactacttcgccagtctttccccggaggaccaagaaaagattctaaagacctgtggcagttttgtgcaacgggccattgagcgatccgctagccatagacgccagagctccgcatctaacctccgactcgcatcggcactagcccagcaaaccgagaacccaacgatagacataacaacagtcgaggacatgccattgtcaggtctggatttcccactacatgcggactctccgggttccagtttcagtcgtccgcacctgcgcttctatccccgaacgatgacaacgctcacggaccaganacacatcacgaccatcatgacctctttgcgaccagcaggccacacacgggtcttgcacatggnccctgggttggagcgatggcataccgctaacgaaaatctcggcatttttggactacgaccggtgaagcccgacttcctattgactttcttg

SEQ ID NO: 6763 - DNA, 647 bp, Aspergillus oryzae
tctcacgattatgtcgctattgtaatcgcggaagaattccacctatttatatacgatacaaccatttcccaagatactgtctacggtcctggtggccaccgtatcgtaaccgtcgctcattcaaggaaactgggcctgtggggtataattgacccaatcagagaagtccatcccgcctaagttcagttcctgatcaacatccgggaacatagcaccgaatgtcgggtcgttaagcagctggtcaggaaactgcatcaagataggcggctggcctgctggcctatcaacggcggtatccgcgtacgcaggtgaacaaagccgattaatgacctgcagacaacgagctgcaagtcgattgctactcaacgaaagatgccataacaaggtcttagtagcttcaatgtccttgagcccaactggggcatcccgactggtaaggtctgtcataagcaaaatgataggggagacaccacctttgaaacagaggtagagcatatccattgcctctatctcgtgcaaaaatagtggctcatgaaaccgttgatggagaaaatagtcaaacaacctttttgaaaaccccacattttgctttcggtttaaaaagggctctccgtttatttaaagaaccaggggtcccatgtcttaaa

SEQ ID NO: 6764 - DNA, 655 bp, Aspergillus oryzae
caccttcctcttcctgctacatcaacccatacctaacctgctagagctttctttaccgctttgtctattcctccctccccctctttcgacttccaggaccaacaccgccatcgtcttttttccctccctccaacatccttctacatttttctttcggcctgttcaaaaccttctctttgtacataaatgcagtatacatcggtcccacacacagtacatacgtcggcggctctctcacttgccccagtatcttgttaatttgctcggcctcgccgtcatttacttcctaatttgtccatctctccaccggtctcgtcacgctgcagaagtcgattgacatacaatttgacgtgtcaatactccggaacattttcctattaattcgtgaaatcttttgcccctcactcaagagacgaaaggcgttgacgagtccgaataaaatcaataaacgataatcgtcagcaaccataccgcttgttctgcgcctcaaatctgcgccggaccgatcgtaacgggcctcagcggggtccgaggaatcgaacaatttaagcccctacactaacacgccaacaacaccacttcgggcccactttttttttggtactacacatcttgcatgatctttattttgaacgctctctgaatcatgggctcc

SEQ ID NO: 6765 - DNA, 676 bp, Aspergillus oryzae
gttgatcggtcttttagggtttctggaggaactgccaaatgcaacaagggcaagatgccggttagtggttttttgatgtaataatttttctttatctctctgtccccttttcgtatttcctttccttttctttgttcgatatctttctcaccgaaaatattattcgcgttcgaacatgttgggaatccacaagggagacttatctccgcggagtccgcggagataaaaaaaaaaggtaaaaaatgagatcaacagttggaggcgacggttaatgatatttgttactatgataaagttcagacatcgatatgtccaaattcttagctttgcttatttccagtgtacagagctagaaaataagacacttggatcaattacggtccccccggaccttttcttttctgtggtgttaatattggtcttgaggttggttgatctaactcttgaatatatattgccgaaggtatactctggaaattactttcccacgttctgattgggaaatataaatatatatcattttgttattttatatagaaatatagttacgacttgtgatgaagatataatgtctttgtggggcgtctatacattttttttaagggcccctctatggttatttttttttttaccccttatatatcccccctcccccaaatatcttttttataaaaag

SEQ ID NO: 6766 - DNA, 673 bp, Aspergillus oryzae
gtgatccttgtttgtcgagcgtcggacacggttcgtatacgaaaaagtatttgttcatcggtcgcggacattacattaagcaacagcaccaaaatgtcttcccttccacccggggcagctcttgcaagcacagttacttcggtcgctgcacttggttttgtacctgttgccgtgcattttgatctctttgacactttggcaaagatcgagggcccagcgagcggagaagatgttctggtcgcttacagaagtagcaagggtgataaggctgaagataatgtgccatgtttacgtttagttcaggataccctatatgctatgtccggtctgggttttgttgacattgccggagacgatctgtacagcgctaatgcaatcaccaaacacttggctaccatgccttctgcccagcatggtgcacttcactttacaactgaagctctcctgggcgctgcattcttgatgaagaaactgaaagcagacaactttgaatacccctttaaggagctggagacgccttatcagtacgcctatcactcaatgggccaggaggagctagcaaagcaacacacttattccattatggctgctgaaggccggatggacagcttcaaccactttatggttggcaagttcatgaagacaaatactgcccctgatcgcctcaaggcat

SEQ ID NO: 6767 - DNA, 639 bp, Aspergillus oryzae
  misc_feature (1)...(639): n = A,T,C or G
ttcgcccaggccggcggaaaccccttcggcggcggccagtcccgcggcggattccctggcggattccccttctaatccacggacggcacgtattcaacgcgacagggataacagaacatataaatcttgaaaggaaaccagaaggacggaaccgaaaaaagaaatctttaatgactgacaagtcttgtctgtggctgcatttatctggggaaaggtctcgttcttcacccttttctcttttcctacctttcgccgatcaatccatcctacgctgtctcatctatacgcggtctttgatattcccccggtgcattgcatgatttcagactgttaagcacgatgcgatagacttgatgctntgccttgtttatttaccatttatcttcttttccagtttcacccccttttttttattcattcccaacctagcatagatgggacgcttgttttatttgtgacttttctcttcctccattttcctttattttttcgtttctccttctgcttttccaaagaccacccccctgcgatctgtaagcagggatgtgttgaatatggaagacaaacagtgaacatcctagtggctacattctggcgttatatactcttgggtcttatgcttgctccctattgatactn

SEQ ID NO: 6768 - DNA, 705 bp, Aspergillus oryzae
  misc_feature (1)...(705): n = A,T,C or G
ccacctctaaccattctctcagtcatgtttcgttgccgggacattgtatctcgtattgttcttctttctgtagcttttttgtcactgacaactttcacgttggcatcttctcctgcctcattctgcaaatgcacctgtttctctaacagcaccatcatcccactcgatcctgcgaaaccagacactaccactctaacaaaccttttccgtatcctcggccgtagcgactccaccgatgatcacgacaacacaaatgaaagacgagccaacaaatatcgctcgctgagctgcaacgattgcaatcgaaagttttgccttgattatgacttaccaacgtgtaaagatgcgaaagaggaggatgtatttactacatgtttccagagggactccaggaaagacgaggccattgtgttcatttttataattgctacaagcggactgcttgcatgggctgtcttcaaaccatgggtacagaagtatctcgaggcagcaagggaacggcggtcatacatccctgtgtctgaaaatgcggaccgataaatgttgccctgctactaagcctcttctagatatccataatgggtatagtagctaccttcttcggnnaaananannnnnnnnnnnanagagnnananagagaaaaaaatttttctgcggccgctcgagccatgattttagagggcccccttatttgaatttagttg

SEQ ID NO: 6769 - DNA, 675 bp, Aspergillus oryzae
caatccttttacagttcatctgttcgacagttccacaggctagttcctgtttgctttcttcattcctttttttgattcttggtttcttgcctgtggcagttaccagacattcctttttcggacaaacaccattgtactacgtgtgacaaaagtagcgccctcgctcatcttcattatacggacaatcgtctctcgatcagaaagtcattgttctctccagtcttgattaaagcaggcattgttactccgccctgcttctactcaaaagactctttcgcacgactacatccaaggtcttgtcccgcggttctgattcgtccggtacgatcagaatctccagccattctttcagctgtcaaacagtccgatctatagcaccaccgttccttcaaaatcaaaatgtttagcaaggctttcctttccgctgctctgctcggcgctgccgccgttgagggtcacatgatgatggcgcagcccgttccttacggcaaggacactctcaacaactctccacttgcggccgatggcagtgatttcccgtgcaagttgaggtccaacacttaccaggtcaccgaagagaacactgccgccatcggtcaatcgatgcctctgtctttcattggtagcgctgttcacggcggcggatcttgccaggtcagtctgaccaccgaccgt

SEQ ID NO: 6770 - DNA, 686 bp, Aspergillus oryzae
  misc_feature (1)...(686): n = A,T,C or G
caaaagcacaaagtgggatacgtgcatcgccttcctaatgtgccattcggaatcatacaatacagaccaagtggctaagatagcagcaagggtgaacaccaccagtatatggtaggcccaaatgtagagggaaataaaggaaatgggaagaaagagatgaagtatatagattgtataacaagaagattaagatatcttagttgaatcgaatgcttcatgaatttttataatgattacttcatgtgagcttttattttctagcttatttatttatttgctatgtcttcttatttatatttcactttatatttttatttttatataactatttattatctttttatttaatattattattattgannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 6771 - DNA, 639 bp, Aspergillus oryzae
gaacaccgacttcgcgactcgcaagtccgcaccccgcctgggcgcgaagatgacaggaaaggataagactatccgatcgactgcgactgtgaacgaagttgtgggcgtgcttgaagcgaagcagattcaaagcattatcgagaaggaatgtggggcgcaaactactgttatcgatggttcctctggctcttatccatccgactttggcgccgacccccgagtcctttttattaatttcccagtgcttcctctgggtaaggagagggctcagcagctttctgacaatgatggccttctttctgatatcatcgaacggataccttcgtcgaagaagtacaccattctctacgtaacatcacctagggaattcggggagtccgactcggttatttatcaatccgaaactgatccctaccaagatcctgttcacatggatttgaaacgagattttgcggcgcatagtcgtcgctcggagcctgcatctaacaagtcactcttccaagagtatcagtacctcacaccaggtctcttcatgggactcatggaaccctttgcttcattatgattttgtatgtccgctttaacggccttgtccagcttgaaagtccttaatgccggttttgaaaaagacacctcccc

SEQ ID NO: 6772 - DNA, 909 bp, Aspergillus oryzae
  misc_feature (1)...(909): n = A,T,C or G
ggaagtcgagcaagaaggcgtcagatcgattgagttccaaattcggccacccggcgctcaccaagccgctgatcacaccgatggtacacgcaaaggccgccgatgcgctaaaacgtatctatcggggtcgcattggcacatcagaagtggagggggagtatacagatattgcgatggatcccatgtcagcatcccatccaggaaagtccaagatggaagcctcagaatccgctccattcgaggttgttcctgagaatcatctcgacttctcctaccataaggaccggccggatttccgtgatgagtttggcggtggtatctatggccggccggacgatttgatcaccgaacgctcgcagacgccacggaccggcttaggggagtggtcgccgacttcctcacgagcagcgtccccaacgccatcgcttccctccatatccggattaagacagtacgatggctacgacacaagtactaacgacctcgtccatcctgcattccgcaccccactgtcccactcagagagtggtctggtgggcaacggactctatcagcatggcgacgagagtgaagcacgactgctcagtcaggcgcaggggccggccatgacagacagcgctcaccccttcaatcgatggcggccagggggatacgggcctgtggaacaggaagatcccagaacctnctacgactactaccgcagaccacgacaactgtgattaacgacattacctgaatataccatagattgatttcttcagtttcttttttttcccgtgttttaattggttattgtttatagagctttggagtgtatttggatatgactggacgtggtcaacggaagtaacgctgcatatacgtgcatatgatctggatatctgggttgtaaaaaaaaaataaaaaaat

SEQ ID NO: 6773 - DNA, 682 bp, Aspergillus oryzae
  misc_feature (1)...(682): n = A,T,C or G
ctttcttccctttccatctgaaatctcatcctgatcgaaatcaactggaaccatttgacctgtctcttgttctgatcagattgtcccccttccgagacccttctgctggggaggaaccagccatggcaggcgacgacaattcaaaccgcaatagagattcttccgcccagagctctcaactatggcccgatgatgacaacccgttcgttgctttccgtcgctttgccgacgaacagatttcctccatgttacagtcagtaacggggctgccgtctatggtcacggccccgccacccgatcattggtctattttctcagacgacagatactacaaagacgcgtatactcgccaaagacgaagcggtgacggcaacgaaggagaccattatgcaggctcagaaactggcgcatcagccgagtcgactgataatccaccatcgaagtcgcgctggccaggatcagatgatccttggcagtcccatcgtaccagaagacagactctgcctcacgactccttcgatatcgacttctttttcgatatctttttcgacagggtctgggtcgatgatcgnggtcttttccgttcttccattcgtccaaaagcccctggtctcagcatgataaacgaagaatcttcgggctgggctgttactaccttatggttaagccttacttcccttgn

SEQ ID NO: 6774 - DNA, 655 bp, Aspergillus oryzae
tctcgatactttctgccgtcaactcatacgctcaggctactactccatacccttctcaacgcatctctacagatattctctattggcccataacatcttctgaaccttcggtcttcgcccgcgtctcctacgatccaacttctttagagtccaacgtgatatcctactcacctccaagtgcggtacaacttgagtcaccaaccctagtgcgtatcggcctatatacctccaatgggatcgaccccgaacaatggaccgggactctcacgtcttggtctgccatcgcaggaagtgatggacaaaggccaatgcttcagctttatctcgattcttctaataaagtttaccaagtggccctgacattatcattactcgagtctaccgttgcatcaaacactacaagccccattatgaaactcatccctctcgaagctggacctcgaccgcatcttaatcgccctgttgttgtcagtccagatggcacaaaccctgaagatgtcgctgagaaaacattcttccagaagtattggggggttttcgtcctcatcacatttctggctatgtctggtagcggtgaagaacaatgattttttttgggcggtcctccccactattcactcagagttgccattaatttgcctgagaaacttgcatt

SEQ ID NO: 6775 - DNA, 680 bp, Aspergillus oryzae
ctcctcgtcttgacaagattgttccactttgatcctacaccattcggtggaagtcaaacatattttatactcacatacttcctttgagtgaggagcttgcctcttctgcctaccttacagcctggtccatcaaccattgtcgtcttgcatatcctaccgacttcgactcttcgagcaatacatcttatcacaatggcgactcaacactatcaagctcccccccttcctatcaatgttccctccaaggcgccggcacctgtcaatctgtatcctatcagccgtgtttcaggatccccaccagatgtatctgataccagcacgacggcgggtagtcgcacatccgccggcttcagctacgggtctgggagtatcagcggcgattacgagtcgagttctgcatcgtactctggagtcgatgttgtcgatgtcttgagtgaccgcatgcagaacgtgtttgaccccacgccattggataaagggctggcaagacaggcacaggcttccggacagctgaatgcccaaacaacgtgaactccttgaattgcaagctctcgcccagcgacgactgcaaggtgtacgtgccaacttctctgacggcatcaaagtagcccgggagactaagagggaccctggaatggacacaaaaaacgagtgagtgcgttgaaggcaaaagctgaagg

SEQ ID NO: 6776 - DNA, 664 bp, Aspergillus oryzae
  misc_feature (1)...(664): n = A,T,C or G
tcatctcttccatagcctcttgacaaactccagcttgttatatattaaatagctctatccgcttctccgaagaaatagacgcaatacgcctttgtcacatttcgaacaaaatgttgaccaaatccctcttcgcaggcgcagccctaggcctttccctttcatcggcagttgcccacgaggcccctgtcgtcgaaggcaacgagccccaaaccgtgtacgaagctgttctccaggacaaagacaacaccactgttcgaggaacgttcactacccatggtgctgaggatggaattgggattcaatttcgtgtcgctcttactggagttccaaaagatacatttttaaactatcacattcacgacaacccggtgccgaaagatggcaactgctatgccaccggtggacacctggatccttacaagcgcggtgaccagcctccttgcaatacaaccgtacctcagacatgtcaagtcggcgacataagcggaaaacatggacctgtctggactgccgatggcaactcgaagtcttgtacaggactttttctttcgaatgtggagacactatcgctttttcggaaccgtcggcgttgccatctgccgataacaaaggataatggggaacttcactgnggtccaagggaggaaaaanaaaataaaannag

SEQ ID NO: 6777 - DNA, 639 bp, Aspergillus oryzae
  misc_feature (1)...(639): n = A,T,C or G
ctcgcccaatccgctttttctctttgttatganannctaggccgaggggatttgggggcttttttaaaatcccctcgaccccataaaccccgatatacatacatacagcagtggatcattattgacagaagatcatgagtttgtttagacccttgatctgattgacaatttctaggcccactgcttgagtttttcatgtgaagggtcaacggatttacacaaccgattgacactaagtttatacacatctacacatccattacaatcgtttccttgcacgttgttctcccgataaaaaaaatgccttccgcagccaaagtattttatttggctgtgttagccttcttgaggctcaccaatgccgagtctcaacaccatgaccagaatacatgcgccatcgaacctaaagccacggtctccgacgcttgcgtctcctacaacaacattgattcgttgaacgaaaaagtctaccctttccttcaaaccatacccaagaaacccgactcctttaatactattggctaattctcttaacaaaatctgcccctttagtcaaacaaaaataactgagggagacaatttaagctccgtaacacactgaaggtaaaaaagattcccgatcccggggaagcaaggacc

SEQ ID NO: 6778 - DNA, 377 bp, Aspergillus oryzae
  misc_feature (1)...(377): n = A,T,C or G
cgaggggagtactattgccagcctttgtattcccatactgctactcctccacctctagctcttcctatgccagaaaagtcttccaattattgcgcctaaacctgtttatatttgatttctccttctcttcgttattattctgcgttcccgatttcattctccttcaactttctgcacattgggtcccgctgtttagtttgatatcttatcatttccttcccgattaacacccacatctatactgtacaagcnnnnnnnnnnnnnnnnnnnnnnnnnnnnntnnnnnnnnnnnnnnnnnnnnnnnnnnnnnnnnnnnnnnnnnnnnnnnnnnnnnaaaaaaaaaaaaatttcttggggccgttaaaccttgtttttaa

SEQ ID NO: 6779 - DNA, 608 bp, Aspergillus oryzae
  misc_feature (1)...(608): n = A,T,C or G
ggggtccaagtttagcaaccaaccattcgagtactccaactatctctgatcccagagcctgttggtggcagttttactccctcctctactcctgctggtctcgacttcttttaatcagtccttcacccctggtttatatcttcctgggcggttaatacttttatatttgtttttttatctgtcgctagtattgtgtgctacttggcgttcgcatcttcattccagtacatatttacctaattttggtctaggtctattactggtgttgtgtttataaggaggggaaaaaattctgtttgcatangactcactagcagttgtgctacgagatngtacattggcgtttattatcctttttccccccacaaaggtatcttcaacccttcctcttgcttttcacctctgccgcttttcacacttttcctttttaatccaaaaataattctttccnaatcaaaggggttgaaccaaaggttcaccttgttgttcgggggattgcccctccggatcacctttggaaaaaaaaaaaananaaaaaaaaattttggagggcctgtttgggtttcccaaaaaaaaaaaccccnnnnnnaaaannnnannanannnan

SEQ ID NO: 6780 - DNA, 617 bp, Aspergillus oryzae
  misc_feature (1)...(617): n = A,T,C or G
cgaggcataatacatcaccatcaaaaaagggtccgccctcacctcaaatgcccaagcacagaagttttatatctagaactcaagatttctagcataggtactttgttttatctgggcgttcggtttgtggcactaataacaatcctagaagtgcacccacaatcggttcattcataccgcatataccatagatggataatcaccgggacaaggacgggaactcaactactagaataaatataaccagacgcgcacttgagtgtatgcttatattcagtaccctgggttgtattcaactatatatcacagactggttctttatggaggggaactatgaacctatttataccgtatgctgtaccgcgtctaactctacaataatgtatttctacttgagatatangtagtcgtgaagttacctgtaagcatattgctaagaatgcattcaggaaacttggaacanaaaataatacagactgaatatgtcttgcaaggaagaaaaaaaaaattcctgcggacgattaaagcttgcttctaaagagggccaattcgcccttaaagggagtccgattacaattcaactggcccgtccgtttaaaaaccttcggactgggaat

SEQ ID NO: 6781 - DNA, 649 bp, Aspergillus oryzae
  misc_feature (1)...(649): n = A,T,C or G
ttggactagattgtaccagtcgggcaatggaagaataccgaagctccaacatgtccagctatgtcacttgctggttgtttgatcaggcccggaacaaccgcagcagcctgacgcagatggatcccagtcgttgcatctctacctatcaagccggtttagaagggcggtcgttcaatatgctagctgttaccaagcagagcgatgcattgaaccaatcgacaacctttccccctccgagaaatacgactctgccagtgctggcgtatttccatcctctggactatccggatcagattgagcaatggtgtagcggattgtgccaacgatgggggcaaggcaataatagcacgaagttctgcttcgatgagaactgggatgaagcagcggttccatttgcttgccaggagcataaggttaacgggacgggttgggagcccaacgcgctgtcgcaaacgagctcttggatgtgccaccccgacgccatcttatatggtgaatgcaacgggtccgcggcgacgaggaatgccacgaaatggaccatnctaccggagcattatgagatcgatcattgtcttgtaacaaatgccagccatacctgccagctgctgtacagtccgattatcttatacattgcgaatgcatgccatac

SEQ ID NO: 6782 - DNA, 641 bp, Aspergillus oryzae
  misc_feature (1)...(641): n = A,T,C or G
gccgacttctcgacgaaagatgctacctatctggttatcatcaacagcctcaagcatcttccctccgcaaaaatcgatgccgccatgggtgtcagtgctttagctatgctgtgcattatccgttcgggttgcaattatggcgcgaagaagttcccccgtcatgccaaggtttggttcttcgtttcgactttgcgcacagtgttcgtgatcttgttctatacgatgatcagtgccgctgtgaacttgcaccggcggtctaacccgcggttcaagctcctgggtaaagttcctcgtggtttccaacatgcggctgtccctcaggtaaattcgaggatcatcagcgcatttgctagcgaacttcctgcttcgattattgtcctgcttatcgaacacatcgctatctcgaaatcctttggccgtgtcaacaactacacaattgatccctctcaggagctggttgctattggtgtgtcgaacttgcttggaccgttccttggtggttacccagcgactggatcgttctcccgaactgcaatcaaatcgaaagcgggtgtccgcaccccacttgccggtgttattactgcggttgttgtcctcctcgccatttacgctctggccgctggcttcttttacatccngag

SEQ ID NO: 6783 - DNA, 795 bp, Aspergillus oryzae
gttcgttagctacatacttttacaagaacaaggattacaatcatgagccaaatcgacgtgcagctcaaggatgtcgccatcctgggcgccatccccaatgacgcccgcaagatcctcaccaaggaagcttgtgccttcctggcgatcctgcaccgcaccttcaacccgacccgtaaagctcttctccagcgccgaattgatcgccaggccgagctcgacaagggtcatctactcgacttcctcccagagaccaagcacatccgtgagaatgacgcctggaagggtgctcctcccgctcccggtcttgtcgaccgtcgtgttgaaattatcggcccgacggaccggaagatggtggtgaatgcgctgaatgctgatgtctggacctacatggctgattttgaggactcgagcgccccgacctgggaaaacatgatcaacggtcaggtcaacctgtatgatgccatccgtcgccagatcgacttcaaacagggcaacaaggaatacaagctgcgcaccgaccgcaccctcccaactttgatcgctcgtgcccgtggctggcacctggatgagaagcacttcaccgtcaacggagagccgatctccggtagtttgttcgacttcggtctctacttcttccacaacgccaaggaactggtggctcgcgggttccgggccttacttctatcttcctaagatgggaggtccatctggaggccagactatggaacgacgtcttcaacctggcccaagattacattggcatgcctcgcggaaccatcccgggtactgtcttga

SEQ ID NO: 6784 - DNA, 655 bp, Aspergillus oryzae
cacaactgtcgcgcgcaacttgagtggaccagctggagaccctacgctggcacaatctttcgaccaggaagccgctgcagttctgatggcacgtattgcagtcttcaaggcagaggtcgatgatggtcccgatgtccttagatgggttgaccggatgctcatcaggctctgctcccgctttgcggattacagaaaggacgacccaacttcattccgacttgagaagaatttcacgctttatccgcagttcatgttccatctccgcagaagccagttcttgcagttcttcaataactcccctgatgagacagccttctacagacacgttcttaaccatgaggatgttggtgactcccttgtcatgatccagccgaccctggattcatactccctggaacatgaaggcagccagccggtccttcttgattcggcttctatccagccttcccacattcttctgcttgatactttcttccatatccttattttccacggtgaaaccatcgcagaatggagaaaggctggctaccaagaccaagaacgctatgagaacttgaaggctcttcttgagcaaccaaagatgacgctagagaacttatttcggatcgcttcccactgcctcgtttcattgtttgtgatgctggcggctctcagg

SEQ ID NO: 6785 - DNA, 880 bp, Aspergillus oryzae
cagacgacctgccaccgccgacaagatgggtgccctcaagtacgtggaagaaatccagaagaagaagcagtccgatgtggtccgcttccttctccgtgtccgttgctgggagctccgtcagctgaacgctatccaccgtgcttcccgtccttctcgccccgataaggctcgtcgtctcggatacaaggccaagcagggttatgttgtctaccgtatccgtgtgagacgcggtggccgtaagaggcccgcacccaagggtgccacctacggcaagcccaccaaccagggtatcaaccagctcaagtaccagcgtgctctccgtgctaccgctgaggagcgtgttggccgccgttgcgccaacttgcgtgtcctgaactcctactggatcaaccaggactccacctacaagtacttcgaggttatccttgtcgacccccagcacaaggccatccgccgtgatgctcgcatcaactggatctgcaacgctgtccacaagcaccgcgaggcccgtggtcttaccgccactggcaagaagtcccgtggtatcaacaagggcccccggtacaacaacaccaagggtggcccccgccacacctggaagctccccaacacccagagctactggagataccgttaagcgtagtttggtggaaaactggggttgtgtgtcgtggaaaaaatttcattttgaggatgggtttatttcgatcaaaactcggttttatgactatatccttgaaatgggtgcgagaataatgcatcagatctttcggatcggatgttagcaaaaatcttttcgctggttcaatttttatattcccctaacgaagtatgactgtttctgttcacccgcttggtgaacaattgttttcgactgttg

SEQ ID NO: 6786 - DNA, 689 bp, Aspergillus oryzae
ggagagtatgaggattgcttgctgctattggcttccttattaaaattctggctcacgatgacttctggatcggcttacacgggttggatacatggagcgtttgtgagagagttgtgggatgatagagattgggattggttgttgtggagatggacagtaagtcagccttccaagaaaaaagtcacggacctcattgctggttgtaaaaataaactcgtcctcgggagacgcacgctgctccgccatccaaaaaccgctttcagacaatgctttcgttctaaaaacgattctgaagttattacccattacttggttcaccgagccataggtgatgcatacatcagcatagacagacgccagtcgtccgctttccacatctccagctactcagatctgcgaaaagaatacaaagaatcaggttatacccatcttttgccgattatcaatcgctttgatgtgcttcgtcagtggcttggggtgtgtgacaagcagcattcatgcatgcgggaaaggtctcaagtcgtgccaaagcgcgttattttcgttggaacagatcattcagatcagctgcaaactcgggagtccggccacataacacagccttttgactatttcacgctattccactggttgggcaagcccgcccgatgaagagatggagcgatttcgttccacgccttcaaaattct

SEQ ID NO: 6787 - DNA, 496 bp, Aspergillus oryzae
  misc_feature (1)...(496): n = A,T,C or G
cgagggaacaaaggggaagagaaagggctggtttcatttttccttcatactttgtttctcattatccatcttccattctcttcattttttttcttttcttctaacctatatggggtgttttaccggaagccgatttatgtttatcttcatcttgaccatgtgcattttatccggagctcgcttgtcgggtgagatgcttacgacgactgactttgtttattcttgttcgggccccttccgtccctattcgcgggcaatgactgcatgattgaacttgtattcccacggctggctcttctgttggacttggtcgcgggtttgagcgctattttgtgttgggctttctgtgtttcggctcggtttgggtgggttggtatagactaggcgaattggttaattctaagagtaataggaaagattttcccagacaagtgatgtatacgacattgcctggggaanannnnnnnnnnnnnnnnnnnannnnnnnnttttcctg

SEQ ID NO: 6788 - DNA, 636 bp, Aspergillus oryzae
  misc_feature (1)...(636): n = A,T,C or G
cggataggtctatcctcctcgtttcgacccttcctgtatttctctcttgccggtgcgatttgtgcgtacatatctatgacattcgtcctcctcgagccactcgacagttcagatgaccgtctatagtcaagcacacagtgattgcgaggtaaagctattcaactgcgtcacaccacggctaccgaatttgcgcaacattcgaaaggttgtctttgctggtattcttccagtaggggctttttttttgtcgtttcaaacccctccaatccccagcacgtatctagctatgactactcctatggtggtatacaacaacatctcatgaagaaggcatgagaacatccgttcgcgcatccgacccatcgaggcgatctctcccttattgcacaagatgccaaacaatcctgagccaccgtatcccatgtttttatgatgccttcctgaagcccgtcagtatttataaaccaaacttactcaggtgaagggtttaacatccggagatcaatgggagaggaccttgggaactcgtcacagtcagtagttggcttttgaatatatacgtgccttgctcangnnaaaaaannanaanggncanaagaagggcttggttngaaatacataaaaaaggaaattcct

SEQ ID NO: 6789 - DNA, 677 bp, Aspergillus oryzae
  misc_feature (1)...(677): n = A,T,C or G
caaccctgnggactcggngtatgcctaaccacgaggggcgacttatccagctgaccttcctgatcttctttcctctttttcttcccttcctattttcctattcaactcccccatttatcatcatctacaccccctttattttattttttctttctcaagagctggcattgtgccaatcgtttaacaaggattttagtcaatcatagagggtcctactttttggcgttgagatacagggtggaaaccagatggcggcgggttgactttcgttgatataccgaagttccggatgcattttgcatacttcctctcgctttcagttttctttttctttcacttttacttttccttgtctcttctatttttccatatcctgcttcctggttcgattcccctagtctgcaagggttgcgggctgtcattattatgtgtttacgatgagtcttcatacccatggaaatactccatctgtttcgtgtgcgggatatcctcgagtggatgcttgtttggacgatcaaatctattacctattgtgtccgtggttgatgttttggaatctatttctgttttgctcttaggagtttattaccatctatattaggtcacgtaaatctgtttgctgacactgaaagatacggntccttgagtatactgcattggttggatttagggcaatn

SEQ ID NO: 6790 - DNA, 691 bp, Aspergillus oryzae
  misc_feature (1)...(691): n = A,T,C or G
gctttaggttgcctttttgctttcttcccccacacggatattccgtggcattagcatcangtcattggagacccctcatactgacacgtccttataaaactgtaaacttgtctgcttagcaatcccgccactgtttgaaaatttttcttttttttctattgtctttgtttttttcattctcttccgaagcaacctctttttttactccagactacaggttggtaaacactggagctcagctttccatttcccgttgttttcggaaataccgcgctctagtgcaattttacccccaaggagaagagcaaacctgaggcttgttcttcctaaggctcccccactcttcccgtgacgtccgtccgcctcccgtccctagttacatacatncacacccctcttcttttcttcaaggcccaaaaaggtgccagcgtcgataagctattcacgcccaacgatagatcggctgagagctagtgcatgggcctgctgctgctactgcacactccaatcttccggtctgcccttcgtgttcctcgtcacccggttgatctatcaaaccttcccaggttgatacccaacttttgttaactgcgccctgtgttgtcttcgaaaaaaagaagaaggctcgacggtagatcttcggaacctacttttttttttggcaacacataccgggttgggggaaaaccac

SEQ ID NO: 6791 - DNA, 670 bp, Aspergillus oryzae
  misc_feature (1)...(670): n = A,T,C or G
ggaatataagcgtgtggatgaggagacgctacaatcccgcgttcttctctcggactatcgtttaaaggccatctatctctggtgtcctaatgacaaggatggtggaggtcccgggtggcgaatcgcagaacttctgccccacgaagacagtagggcagatggcgatgtatggtcggcatcgataggggaagccaactctcactccaaggaacggctgatagaggatactttaaagagcagcggagaaagaggaggaangcgctaaagacgaggaagacgacgacgacgacgatggttactgggctcagtatgacgctacacctgggagggacccatcggtgaaaaacgccgctcctaatgcacggtcggggctttcagcacaggacatgtcggaggcgtcctactttttcgcgatatgccgatgtgcagcggcgaatggcaaccatggaccgtcngnagaacaagcgggactctcgacatcttcgctgggccggaaactgctgggcaacctcctttaaccctcatgctgataatgaagcatccgagaaccaactggaacttaatggtcaaggngaacacggcaaggcaatggancaaccaagaacgttatcgggctcctccaaaagttggaaggctgtggcaaagcttcagttagagggggaaaaacaan

SEQ ID NO: 6792 - DNA, 641 bp, Aspergillus oryzae
gatggccaactggctcatatgatttggcgtatttagcacgcggcgggagaagttgaagctcggtatcgatcacaaccaggcccctcgcgaagaccttgccaaatttggagaggcagccgtacaatcaggcaaaatcacacggcaaaccttgaatcgactcaagcggcaggaacccatcatggccaattcagcggaccattacccattattggtacctgcaatcctggtcgttcttaacccgggtgtgtccaatgatataattaaccgcattggactatggtatgcggaatcacggttggcgttcgggttctgctacaagtccattgagtctctcaaactgaccttggttcgttcggccttttggtggtcaggcaatattggctgcttcaccgtttttgggtttgcctcgaagaaactgtgatcgtactcaagtttcagaaatcttcctcttcaactgggatctttcccttaatgccaccaaggaccaagattacaaggaatcacaatgcaaatgtgtagatcagttgcgggtaagtggaggtcgatacgagcgttttgaactttccaaagtttccattgagtccatgaaattagatcctttcggattgtggggctgttgtttgttgaaggaaatgatctct

SEQ ID NO: 6793 - DNA, 655 bp, Aspergillus oryzae
gtgccagcaggtggccctcccacgttttatccgatcagttcaagtgcactcgttcgacttcgggactataccacctgatcttgaggtgaaagatatctgtgagccgtttgccgacttctacgaggaggatgaagatgacgaaacatccgatgtgtccgaggagctggtctccgggcatggcacccagtggcaccgggatctcaacgaacccccatttcacgaggaaatggcaatgaatcgcccgttacgagacccattcgatgaagcttttcactcatcgactttgcggtcacctatggaacacctgaaccctcacttccttccccgtgcgggcactccgggtattcctggcggaacttctacgttagggtaccaccttatgtcccttggtggattgtcggggacacaaactccccttgctgcggttgcaggcggtacaccgttcgcaaatggttggactgaccctggaatgggcgcaagtagcaagggccatccatccatcttccggccgactgcggttcatccatctcgcatggaagctgatattgaacctagcaatcctaccttacgccccttcgaactcttacacggctttcttcacattccgttccgcgtccaaccagcccaacgggagatgcttcgaacgggaaaggag

SEQ ID NO: 6794 - DNA, 744 bp, Aspergillus oryzae
  misc_feature (1)...(744): n = A,T,C or G
aaaaaaaagctcacgaaagggtctttaaaaaccgagcatgagacgttgacccgcactgggtttatcgggaacggacacgccctccggtattgtgggcacgttatttttctacggacccgtgtttgagcgccttgcaaatttcatcatggatcggtttacttcacagccacggattggagcgcgaaattggtcgtcttctgctcctgccgctgtggaggcacctccaaatttcgactcgaaggtcacctttactgctgctcgtgtacgagccggctttgtcctggttaagttcggggctgatcattttgaaacagccaaggattggctaggtagcattcttcgtgaagaggggaccgttattgacgaatttggtgaagaagctttgtgctgtttgtgatttggttgtgcattttttcagtttactttctagttcaatttgcgggcaatagtcccgatcctttgcatgcaggctgaccgccacaaaccaaaaacaagaggactgtggaagtctatcagatgatacccaaaactggatcctggacgatctaatctttctacatatcacattttgatgccccaaatacaaagaacatgtattgtctcgcatcaatcatattgcgttgggcaaaaataagaaatagttaaagtagctcncaaaaaaaaaaaaaacatcgtgcngcctcgtgctgaaagcgcagccgcggtcggaatctcctaaatgttcagatgttacaaaggcttcag

SEQ ID NO: 6795 - DNA, 704 bp, Aspergillus oryzae
  misc_feature (1)...(704): n = A,T,C or G
nggctgacctgtccgaattcggcacgagggcattactgagacaggctttggggtcagcccggacacgagcacagaaactctcaagaagggccacataactcctcctattgttttcacgacagaggaggggtcctcatcggtcgacccaaacacacctttcatccagacgtctagtgtcgaagatgacaccgagacaatccctgattctgaagccactccacggccggtccataccccttcactcggcctagattcggagattacacctcgtcaaggaggacgatagaatgtttacgtttacacttcggttggaaagatagactgtttgcctttgatttagaaattgctgaggacgcaggtgtgtcgttgcctagccaaatattctgcatgtttcctgtgtggttatggccctatttccttctctggatttttttttctctcccttttcacttgtctgatattgcggtcggcccaagttactctccattctgcttggttttctttttcttggtggttctcattccattntcccttgcggnggttagcggtgggttcggagtgattgatatcatctcaatcgggtcatttggagtctttcttttcttttcacctttcattatctggcttncactggttgtgcaccatatccattcattccatttcctaatgtctatcactcatattctcattcaaaaccaacaaaa

SEQ ID NO: 6796 - DNA, 734 bp, Aspergillus oryzae
  misc_feature (1)...(734): n = A,T,C or G
gcgacatctctgtcgagcctcatactggacaccatgaggacattccaatcatcagtatcgcaatggatggccttcctccttatgtgtctgggcttggcaaatgcccacacggtcatcgtttatcccggctatagagggaacaacttatttacaaacggcactgttgcagaagccaacggtctcggggtagctatgagccccaacgcaacagacagcaactcctttatatacccctatggacaacaatggatctatccttgcggaggtatgcccacctcaacgaacagaaccaagtggcctgtcagcggcggtgcggtctctttccaacctggctggttccagggtcacgccacagcattcatctacatcaacttaggcttgggaaccgtgcccgataatatgagccatcccatgatctcaccgttccagatcaacggtccttctaatgagccgtacccgggcacagtttgcttgccacaggtcccgttaccggccaacatcagcgtgagtccaggcgaccacgctacgattcaattggttgagacggctaaacatggcgctgctttgtacaattgtgtggatattgaattcgcagaacccgaggacgtcgccgaggtcacccgcgataactgcttcaactcgagtcatatcaccttctcacagatcttcgctgcgacgtctctgacgtcgggtgctgttgcacagggtacaacgagagggacgtttacgtcgtn

SEQ ID NO: 6797 - DNA, 538 bp, Aspergillus oryzae
  misc_feature (1)...(538): n = A,T,C or G
cgaggagcgcttgtctcacaggaccacccagtcatagctccactagcatccaccgaccatacttacaacgagttcttggtggctttccgggatgaccctcgcgggctgcgaccggctgtgcgactagtggaggatatgctgcacgcttctaaccaagaccgggaacttgacgatcgggttactgttcatggcaaaccatcggtgcggacctggacgatccttatgagcgccttcaccttcaataaacagccacttgccgcggagaaggttcgggagatgatggccanacacggagtagaatacaaccaggttacctggaacacggtcatcaacacctatgcaacgcgcagaatattgcggaggttgcaaagtctatcaagccatggaagctcaagctattcgatgattcatatacattgaatgtcttccctacctcaaaaatcaaaccgcctattgtatgcggtaaaagaactgaaccaggcgaccgatgcttcgcacgatttgggaacctccttggtataaaggctttaaacatgaa

SEQ ID NO: 6798 - DNA, 669 bp, Aspergillus oryzae
aaattatacttcgagctcatctactgcatatatattctcgcaatggccccaacagaacatgactatcagccacaggagtttatccttactcggacagggccattgcgaattaacatgataattgcccctaaaagagacgagcataattcccgttactttgtacacatcaatgggttattccacgataacacggatattaccttgcatgccagcgacagcaagaatggtccgatcctcggtagctgcaggttcaacaagttctacaccactagaatgcaccttaccctcggtgaccagcaatcatatctgatgttctcaccgcaatatggctgctatagctggtctctaatggttattcgtcacactgaggggaaagtccaacaaaggcgggaatttctatggaaaaggaccgaagcatcgcgagtctcaggcctgctaggcttggaactatgtggtgcagacacgtctgacatttatgccgagtattttggagcggcgtcagggagtctgaaggcgggcaaactgcggcttagatatgatttgggcgacatttggaggacgatggcactcttgaccctgtctgcattgatagaaaaggagaggcaacggagggctcgacaagggcatactagcattgcgatgcttagttcctagagtacagacttgttt

SEQ ID NO: 6799 - DNA, 722 bp, Aspergillus oryzae
tttcctgccaccctgcgtacaccgactttatatcgcccttgtttcttattcccttcatctctcttgcggttgagtaatctgttcttcacgaaacccaaggcaaaatgcgccattcagtatcagatcccgacgtggacgagaagcttctctccgatgaggaagctacttggcctcgtgaacagaagaaaaatgagagcctgttcaagaaatgtgcaaaatatttcctttttgttgcagtcgccgtattctcctgcttagtaggtgttgttcttggacgtcagcaacacaatctcgataaggtctgcactcgacaactcacacaatactccccggtgatcccagaagtcgggatcgaataccaccaagaacagtttaatggctcgttcttaaaagaaaacatttatcggcaagaagcaagccctgaagtagatgctgcgtgggaggctcttggtgtcaactacagaagtcttagagtccctgcagaagaggcccaaaagtcaggacttgcccctgaccaggtgaagatcaacgaaaagtatggcggagggtatcctgcaaatgttgaggggttgcatcatctgcactgtctgaacctcctcagacagtccctctactacaactacgactactatcatgaacaaggccaaagtgccttcgtgaacgaagattatattgtccgacgccacgtgtcccattgcctggtcatcatacgacagcagctt

SEQ ID NO: 6800 - DNA, 667 bp, Aspergillus oryzae
gcacattctcctctttatccagaacctatatcgacattacatctgtatcctatctcattcataaactcaaccgttgcgaggcaatatgaagatctctactacttttctctataccttcctcgccatcaccaccctgggcgtcgcgagccccacgggaaacaacgctgttgccgccgaaaatgtctcgcctgcttacgttgaaaccgagtctttcttcgagaagcgtaagggctgtagcggcgacaggaaagattcagacgtgtgtggcggaaagaggctcgcagaacaaaactcctttcataactgtaaggggaagagcaagggtaaatgttgcgccaagaattcagacgggacaggaggaatcgacgtgaacaagggcggtggtgaaacttgtggctattgcttcagtggcaaatgctcgggctgattggccttagcatgaggatatctcgcatggcatcggaaggaggatgtccagaaattcgttatatagaggatccttgaaattgccgtctagtcggtggtaaatagcccatgtttgattctaccaaactcgagtttgtcatgtgtgtccagaataacaattcacttaaaacagtgtccatatggcaaaaatatattaccgtggggaaaaagatggacaaaaaatttccggggggggccccaa

SEQ ID NO: 6801 - DNA, 637 bp, Aspergillus oryzae
caagtaatattctagctggattatccaaagtgtgttttatgttgtccttccatggtatcttccaattcgtttgctgacagcatatgccattccataatgccctttaaacaacccctctaccgtatacgcgatagccgtcacgatgacgagtgacattatgtctccaattataccactaactggattaattacataccctcgctatgacatcccctcaacgcttaaacgggtggcaccctccaggttgtacccgactctcatattatttcacaacattccacgggcactgtcgcctcaagtgatagacacacgcatcccatgcttcacatgtcccatttacaacatacatgcaacttcctccgtatcactcagacacgtcgttctctcatctatcacacaccacgtcaccagagacatttcgtgtcacagcccacataccattacctatctttacactaccacgtgcaatctcatgcatgacacacgctcacaatatgatgacatctctccatcatcacacctcatgactactttatcagatgatacactacataattctaccactcaatcacccgattcgctaccactacgagacgttatcctaaccatatcattgtaacatacttgccacctatcg

SEQ ID NO: 6802 - DNA, 674 bp, Aspergillus oryzae
  misc_feature (1)...(674): n = A,T,C or G
gaatcaaccatgaccgtctttgaagtttcaatatctcagagatgtatccagatatgccagaactactcaaagtcttgtttggcttggacctgngagtcggagaaacagctctgccatatcagcaactggatggtaccaggagaacaggctgaaggtaaaacctcgggaatcaatgtgccacgtgcgaaaaatcttgttagcatgtgtcgatcgtgatcgactcggctgaccatccacaaactgtcaacattgctcataatcagagggcaaggctttctcaataccacatcccaggatgaccattgttaagtcacaaagagccccacggcagtcgatggaatatcatactcggatgcaggggattcaccgagctgccagaggtcgttttagcgggcggtggcgaagtctgcacaattgacataagtatagcgattgcctagctgcacgaagtgtagcataagcccacctattcacacgatctattcaacagatatcttcaccattcggcaacaangggaatagagaagtgacttcgccctccacagggcttatcttttgacgcagcccgactctattttttttcttcactacgacattttatagacggctcatcatttgtggcattaccgttcttcatcgctgtatataccttaaagaactctttgcttacttga

SEQ ID NO: 6803 - DNA, 350 bp, Aspergillus oryzae
tagagacaagctttttgagtgcgtggcgaacatgctagaagaccctcagcacgaagtgagggctggagcatcagccaccttgtctggcatgatccgttgctcacccgtgttcctgcgcgaagagatggttagccggttcaggcagcgattttcgaaaatcctgatcgacaaccctcttccaaaacgccccaaaatccttcggtctggcttgtcaacccctgtttcatgtggggctggaaccccaacacccgagcatgctcgactcataatcacgagacacggtgcacttttaggtctcggtgcactcatgcacgcatttccgttcactagctcgccgcccacgtgacatt

SEQ ID NO: 6804 - DNA, 606 bp, Aspergillus oryzae
ctggagtgacaagagctggaacagaacctcatcgtgactagctgatacttctcattccacacttcttttctcaactatctaccaatttatccaagcaaaatgtctgcaccagttgttcagggcctctcctccttgggctctcaggccggacagtatgccaggcgtcaggccaacacatggagggacagactcttgactacagacaaatcgcgccgtagggcacagattgttcagacctcgttcgcagtccaccgccccgtctgggttacggctggcggtgctgcatacacgactgcagcggcagcacttctcacactgcgatacatgaaacgactaagatgaatggttgaaaggaggggtaacgagatccttgatggatggtgacagggatgtttctggcaaacatacacatacagcgggggactggtccacgactgcattttcatttcctttgtgattttttttttttttatttttgacttgtgatatgtgggaaatacttatttttggttattgggacaggtgatttgtctatagccaccctgatggcagggatggagttacagagttgttacatccaggaaactcaatgaaatgataatcaat

SEQ ID NO: 6805 - DNA, 732 bp, Aspergillus oryzae
  misc_feature (1)...(732): n = A,T,C or G
tcgcctggaacatgacgaggagccagcgactgaggctgaaatggccatctacaacaaggtgcggaatttgttcgatgatgacgccgtcgatgcctttggtaaactcagctccactgtggcccgtgtatggggtaacatcctagacggagtggtagtatggggaattaccaagctcatgggcgaatcgttcaagcttcactcgcaggccttggttggctacgaagactcattgcgcgtcggcaaggaccaacctatccacccaatgccaacgaagacacttgctagtgtaggcacggcgtactaggcgatgagtatgtcggcttcggagttctacactataatcaactatttttcaaatcgctattatgctctttttggccctcggggcggagttccacttctcgtgtttctcgctctgactcgggtcccattcatcattgaacgttttcgctttttctttctctcgtttcctgggcatttggacactggcggaatctcggatttttagggtcgggatggaggagcaagaaggtgggcggcgaagtttgatttccggttatggaatgctatgatactgaaccgccgcataatgcttcttgctggtgtctnctgactgatgtttgttcgtcgcttaatcgtttgttacgtctttccttgcgtcggttatggtctttccctgtggtttttacaagagctcacnagagtccggtgtggtcattntcttgtttcacg

SEQ ID NO: 6806 - DNA, 648 bp, Aspergillus oryzae
ccttgatgattcaagtcaaccccgagacggagtataagcgactgcagaaagcagtgctgaacatgcctatcagcaatccggacaacagaaaggagaggtttcccaaggagatcccacagtcgttgttcccgttcgaaaaaatactaaagcctgaattgcgagaagaaatcaaggagttcataaaggagcattgcagtgttgatttggataaggagttcgagaagttcaaagcgcatcacgaaggctctgccacctccgctgccgcttcaggcccttcgtacagtgagcgggaacgaaagccgtaccaggcgtctgtttccaccgtagtagacagcgatgaggaggaactcgacactccttcgcgttccattgaacgacagaggaaaccatacaccgcgcatccaggaggtgggaaggagtatggtgacattcaagaacctaaccatcgacatacatcctcgttctctgggggctccattccaagggatactttaacgtcctcggagcccagagtttccgagtatcagggccttgaccctacttacgttcgacccagcactggtcagcctccttcaccaccgtgaggcggcaagggagcccgccacgaggatccagagtaggtagtgaatacagacactctgagggtga

SEQ ID NO: 6807 - DNA, 711 bp, Aspergillus oryzae
caacctctcggagcgaccgtggcatggaaaatactcccatggtgctctttatcagtgccctttaccaccagtgtcaaatcactttgcattcaatgattgttcctttgttttctggtacaaaccgtgggccaacaatagacccagaaattgtgaagcaaagtgccgagacggtcacccaacatgcagagttattcgaagctcttttagctccttacatgtatgggaaaggggatattacacttttaccgccctttgtaggatatggtgctttcatcacaggtgttgtgttcttggctactgaggtctcttttcaagacaaaacctcacgaaggcctatccccggaacacttccagagagccgtagattgtcgattgtccaggggacccttcgcttactcaacaaacttcgattttattggagggctctacagctttcttgcagtgggaaaagcttgacgctgcgttgcagctacatctatcatgctacagaacacagcacgaattaaccagcccacacgccatcacggcccgcgaaatctactcttcagaacctaaatcacggctctcagctcctgtatcagaagactctatagataacgagcagtccagcgcccgcgaagcatcggtaccttcgataggccccctcggcgagcatctgcatcaatgggcgagtgaccggagaaactctgaagtcgatgcaatgcaacaaaa

SEQ ID NO: 6808 - DNA, 733 bp, Aspergillus oryzae
cccgggtcgggctaccatggcagggacctcggatcagactctcggtacgacgaatagataccagtaggactaaatcgcttggggtcactgatgcacttcatctccagtcatagcctgcgttgcctctgcatgatggttcagcatgcatgaagttctccttttttatcattttcattatgagcgttgtgtataaattcttgggaaacgtcgacttattacaccactgatgatccagggatcaacccacatcatttctctttacctcggttcctagcgtacggtacactggcataaaagtggcaatgttttcatagtaggattaactggtaagaatatctttgtcaggccaggatagacgatgaattacccccaaaattccttggcacaaagtaatgttaggggtattcaatcgactccaacttggttaactggcgttacacataaggcatcagggccccgtgctttcctaatttcgtcgctaacatgttacactttcctaacttcatcaatttactttgcctattgcccctctcagaatcaaaaggtttcgggtttcaaactttgctcctttggccctttgagctgctcacttggcctttgtccggtctggccattggggcactggaccctttccccaacttcggtgaacacccctaactggtgttcaagaccaacccggtttgggctcccacatcaatggggtgcgaacggtattggaacggtgggccttgct

SEQ ID NO: 6809 - DNA, 586 bp, Aspergillus oryzae
gaaacaatcccatttgccttaaaaaaaaaatggggcaaaaggttccaaaaaccccccgtttttttgtccatttttcaaaaactttttacccaaaattaaaagaaaaaaaaaacggccttaatctttactaattaacccctttttgctttcaagggacccataacctttgaatgccggggttcccttaaacataaagcccccttttgggccccattttaccctccctggtaaagcaaaccccattttttaccgtaacgcctttttaaaggacataagcccaaaacttctttttaacccttgctggggaacttttcgttgaaagcattcacagcaatggcaatttggcgggccaaccaattccttaaacttttattctgccccgggataaatgggccatttaccccccccttggagggaaaactcatgccagggccctttttaaaaattgtttggatttcgggacaacgtttttcccacttaatttgggactttttggtgcccacaaaactttttacgggcttatttgaactttaacaacttttttttcccgggagagttttaaaaaccccaattaaatcccccttaa

SEQ ID NO: 6810 - DNA, 679 bp, Aspergillus oryzae
cagagggagatgggtctttgggagatggctatagcgaatcaatggaccagcataaaacccctgctcaattggacgagaaccacaagcttgggctagatgccgccacatcgccgaaagaggagaaacctggcacagagtatactcgcaagcgtccacctggagttcccgaaactcttgaacataaatcaacgtcatttttggagcaaaagcttcaagagctcacaacctcaaccccaagggtcctaagcacgagtcagatactgcgcattctgatcagagatcgccatgtacgccccgaggtacgacactatcgggcactattacgcgccaattcggatgcagaacgtggatcgccagaagtagttcgacagctactgggagagatggaggcgaatggatttacattggattctggaacgctgcacacggcattacaggccatcgcagttcacccagactatttactacgccaggagcttgtgcgcacccttcgagatcgatggcttccactgagcccggatggttggcattatgtggtggctggccttgtgagggagcatcagttcgagttggccctggatcatatcgcgcacatggagagaaaggacatgccggttgagggttggttacacagcatgctcatctactacctgtgcgaatttgaagagtttgacgaggg

SEQ ID NO: 6811 - DNA, 614 bp, Aspergillus oryzae
aggattacgttttagtcccatggaggtcgacgaccagacattgtactccatatgggaatagcggctacaagatcgtactactcgattgagaccaaggcgcatcgagattcttaccacttgtccgatatcaaaggcagaatcggttatgaagatggggagaaggtttggagggagcagcagctcccgccagtactccaggctggtcctgcggcggattccacagacgtagtacggaaagttctccacccccagccgcccaatgacgactttctcaacacgtggaagtcgtttgtatctcctggagcagacgtccggatatccgaggacgctggacgctacctctgcgagttcatcttttatacaagtctggcccaggcgtttcaacaaggccagcaccgaaacgtcgttttcttccatgtgcctggatcttgcgccgacgaggacatcgagagaggcacggatattgcagctggattgatcaaagctcttgtaagatgttgggttagcgagcaggtatagagcggcatgcaggttgctggtatcgttttgcaaagcaagagcatgggcactggacgatatatatacttgcatttctatggcgcggtgcactatct

SEQ ID NO: 6812 - DNA, 550 bp, Aspergillus oryzae
  misc_feature (1)...(550): n = A,T,C or G
gccttgcgaaggttgaattcaccaagcagtttctacggatatgcctccacgattcctcttccagccttccttcaaggcctttactgggtcttcgcatgttcagagcccgcttgctgcgctttcattgattgcttccaggacatctatcagagcgggatccgccgagactagggaacgccgaagacatgatccgtttttgatggcacagtcacgtcagcgcaaagccgccaatctgtctcgtcaacaagctcttgccgaagaacgcgaaagctctctcggcgatcctgtggagagtgcacccactccattcatccaagagctcaaaacggtcaaatctgggccacaagccccttcaagctcagatgccagactcaactacttcgtcactcccgagggactccaggaggccatggaatattcgaaagccttgacatctcccctcgaaaacccagacagagacactgcagaccctcaacttgagaaggaggcatccgagagacatcttcaggaacattgcantgctcaggaaggcatcaagccgattcgggan

SEQ ID NO: 6813 - DNA, 650 bp, Aspergillus oryzae
ctccactgcgattcaattgaatctaaagacctatcggccagcccctgctgatacttgtcgtatacaactatgcttcagcacctgttgtttttggaatcttgaaggaactacccactggtaaatcactgtggggggcctgtatagcccaccatcgagattgtcaatcatatacacgctacgcagcaggctcccagtttcggtacctggaagttacgatccttaatcgatttttggaaataacatgcgtagcactccagtcactgccaaggtcaaggtgttgcccgctaaagggtccatatccacttgtggcctttggccacaatttgtcgatcttcgtcacccgctttaaggagcatattatattttttcattcctttgccttggacttggacttatgtactatgagactggaaacaggaaaacgagccgtgaccacagtacttgcaggagcttgcccgcagaatagttatcccacgacactgggtgacccattccagcgtcgagtttcaatttggaatggaagcgttccgtccccaaatgtcactgtcagccaaaagaaccggctctttgacttttcaacgaggcaatgtcgtatccaagattttgagacctgtcccgggatattgttccgggttatataacccgctgag

SEQ ID NO: 6814 - DNA, 1083 bp, Aspergillus oryzae
  misc_feature (1)...(1083): n = A,T,C or G
agcgcagatccgtgaaaccatccgggtaccctgcaaaaccattcaattccatccgcgctgggggctttatttccactctggttgtcggtatcattctagccgtcttcatctacaacctccatcaaggtggtttcaaacttccttgggcattcctggtcctcctgatagccgttatcctttcccttcttaattacgtcctaactaccataacccactgttgctatggcctctcgccgcgtctatcactcctatcgaatacgatctgtctccttctctggctcatctccctcggtctactgagctggagcatgtcgcatacgatcctgactacctgcaacgccacatactgggctacttctaccggtatcaccgtttgccggatatacaaggcattgttcgccttcactgtcttgggaaatatctcgtacatcgctgccatcgccctcgatgttatcgtacgcagacgtcagactcgtctgggtgagtacgaccccatggccagcaacccggccttgaacgattacaagatgcacgatcgcagcagtagtgttttgtcgggaggcatgggcccttacggtggactcgaggaacaacatcccgcttttcgctcgaataatcacgcagatgaagtctacaatgatatccctgctccgggtaattacgccggtcagacgatgcccccgcctgtatatggtgctagctccacccttgagcagcatcatggtggcgaggcacaggattattatcaaccaacgcctactcgtcctcgtgtccgattcagcgcttatggacatgacgggtacagtcacccgtcagagcagacgcattatgatcctgcggcatatagatgagctattgcggtatacacccttatccaggtgtaactggacaatcactgggaatngtacagtatggggggcctggctgcttacaaccgacctggtaatgtgtcgattatattaaattcgatctgatgtgttacgatcttgcagtgaagggttcatacttgttttgtcctggcgtaataaggatatcatttgtttaaagatgtcgcccgtcttgccagcttaaatggtgtgatct

SEQ ID NO: 6815 - DNA, 575 bp, Aspergillus oryzae
cgaggcagagatacaaacaaaaagcgtcaattctcaacaaatgccaggtggctgagtcggataagcctggtagatatctaggtacatggtggatgattaaatagatcccttattacgaccagaggcgttccacacccgtggtgaaacgatatgtcgccgcccaaagtttatttatggctgtgaaattggctggagttggagataacggctccgtccgaacgtcattcatcaactgatcatcaagaccgagcgcgccgcaacgagggatataggtcgaatcaccgatctcagcttactccataattctccttctccaatgcgaaatatcttcatccgcagcgtccagcatacagctctcgcaacatgtcttcattcactcagccgatgccagtagttgcctgcggcagaatacccgcgatggggaaatcaatctcccagcacctacggcctgaatatgaaggttctttcttgatatacattcccgaaataaacaaagtatggtgccaatactcctcagtcatccacttcatcttgtcatacaaggctgcaaaaactgagctcccgcatttgcttgc

SEQ ID NO: 6816 - DNA, 647 bp, Aspergillus oryzae
ttgaatgagtcatgtcttccgtctcggaatctcgtgtctcataacttgccttcctcggatcccgccgaacataaccctatgtacctcccttagtcagcaatgcacgttatgctccaacttccacttggagatcatcttgtgtggcatgaatcaactacagtaaccagcaggaaacccgttcctcctaatctcaaggactctctcatcgactttgacgaggttacagccggagcctggctccttaccgtatccggcgcattcagtttctcagccaacacctggccgttacttattcaaattgagggtactgccgacatttgatggtcttgtcccttcagatactgtaaaaccgtcaaggaggacaataattatcatggagcacctgagtaccgcccagaaaaatgaccttggaccttaatagacgtgccttatggaatcgccacaatgggggtcccctgggcaaagaacgcctttccctatccgcaattttagaccgaaggggcgaagaaaagatgaccaacccaaccccctaggaaagaagattggaggaacgggttttcacgcggcaaaccggggaaaaaaggaggctttactccaccggcatggggagaaaaccaccatttgtgatcttctccctgaggtgggac

SEQ ID NO: 6817 - DNA, 701 bp, Aspergillus oryzae
  misc_feature (1)...(701): n = A,T,C or G
gcggctgagctgactactgggcgggttnatattatncttgacaagactggaacggactgatgtataaacatttgtcaatgtagagcctttccaagtctattcctcgctatcggtatcttcgttgcccataagcactttcaatgcagaaatccatttcatcacttcgtgttgcaaagcagtcaacttcgccatgactgccatcaggctcgggtcctgactctccacgcgaatcttttcccttactttgacctcgtctcccttccatgtgaaaacatctccaacttcatcatgcccacggtgtcgagttccaaacaaacggtcgcgcaaattgaacccagtcaaagaaatgtcggtggcaaaagctgttggagtatgtgtgggtgtgctagactcgagcgtccttagatacaagacgagagcagagtcggcgatggatagatggaacgaaaggtttagcggcaacggtggatcaaacatatcctcaagcgcacttgtctcccaccacttgcccctgacttgatcactctcgcccttcaacatctggcgagcctcagacagcgtttcatataataagcgcagctggccatatatgaaacttgcattgagcgggtcgccagtccaagggctgacatcccccacatttagactctgggtgaaccaggttcttcccgaaacccacctgaggggcccaacgctctgag

SEQ ID NO: 6818 - DNA, 687 bp, Aspergillus oryzae
gcatttgcaatttcatcacacttcgaattcttcccctgccccagaatccgggataacctactgacaagtcgaccgtgtctcttggtgaacctcgctttgtttgcttagcggaaatgccgccgatcgacgcagttgacggcaggtaagtactccagcagcgtaccaccttcgcatgatccccggctttcgaccttacatggaacgccttacagttggcatggctgacggcttcaacaggccctggccccacctggcaaaagagacgcttgacgttatcagtcgaccctagaatcgtattcgaaggtcagatcactccaccaggtccaccacggtgccacgaacctcaccccgtaatggctggcacttcatttatggggtatattttctgtgcgccgtattctagaccccggtccatgtcgatcagcgcctcaaaactgctgatggtgtgctaagattgttccggatgcttgcacgcgcagaggttttgctttttctcctccattccccctgaaactgacccaacggtccgtaaattttcttgatcacacgctcacaattacccttattttgacataaattaatatccgctgctgagttggcaagccctcagcctcaacttgttggcttgcgccaccgatcaatgacccgtgggacagcatatcccgcttactcagtgccaaatgggta

SEQ ID NO: 6819 - DNA, 663 bp, Aspergillus oryzae
ggcgcatttccgtctgggtatgccgatgtttgctgccggccgaagcgagaccttatcgacctatgcgacacttgatccacacctatatacgcctaccaggcaaaagccctaccagggtatatggattggagactactccgctcacggatgtgaattcatgcttttcttgcaacgagacagtgaagaagggcctgacgatacgcccgaggagggcgagtcggagttccttcatgatggcattatccagaaaggtagcctcgaggctatcaaactaaccggagaccccaatgtccctcgaggcgagctctcattcatttcggatgatatcgggcctaagggttttgtccgtgtcgcagatgaatcgctcttccgaggggcgaggattgtgcgtagtcgaggacatgtagcgggtatcgggtttagagacgattcattcatcgcctcgcaactcattctcatatcacctgattgtatagctcactattgggagaccatggggcatatctcgtatttccgccgcctcgacatagacggacttattccggatatgaacggatgtgtgatgaacccttacaatgtaacgattccgggcctattatttggtctccttcctgggaggataatgaatcaaatacatggattggcggtggtggacacacggtc

SEQ ID NO: 6820 - DNA, 646 bp, Aspergillus oryzae
  misc_feature (1)...(646): n = A,T,C or G
gcttcacctacgctatggaccgtaaagcggtccgcgcagaatacatacaagagctggtgatccattatcactatgttgaagatgttccgaatgaggacgagtactatccaatcctcgtggagagcctggtgccgacaatcggccgtctgatcaacttgagacaacttgttgtcaagggcctcgaatatgatatatgtagatcttatgatgatccggatttcgggcctcgtccaagactcgacgctttgtctgagatatggtcctggctcttccagcaatcaagccacgcgatggcaggcgttctgccttccttaacaacatgcgagctaatcatgaacgaccttacacccatcgaaaacgaaacaggcgacatgtggtacttttcctcgcgcgagactgtcctgcttcaccccacgctacaaaacctgagcatagtagcagccatcatctcggacctgcgctcagaaacactaagttacatcaagaaaccctggttcaacccaacatccctagaaaccctgaacctgctctgctgcgacgtatcaccacagtctctccgcgagatgctccagttccccaaagccctcaagaacttcnaccctaggggatccccctggacgacccgatgggaattcttcctcacaga

SEQ ID NO: 6821 - DNA, 570 bp, Aspergillus oryzae
gcttcgtcttccttctcaaagaacaacacacttctacacttctcgtcctcttccacgtcgaagtcgtcatctatcaaaatgcaattccgctccgttatcgcccttgtggctttcgctactgccgtgaccgctgctccctgtgacagctgtgatggtggcaactctggcgactctggtgactctggcaagtgcagccctaaccaaaaactgaagtgctgcaccggtctcacccaaggcctgaacctcggcatcctgccggccctgtgtcttcctctttttgccaactgcaacaaccaggccgcctgctgcgaggccaatggaggactcctgaactgtctcaccatccagctctaagttcatcgcatttcaccaccgcgagtaacgatacacgggcgatgtccggtgggggagtgatgcccgactcggtaaatggatatgtcttactacggttgggcggtgacagtcttcttccagcatctaggtgtacacggattgtcctaggtccaaggtgtgggaaatgaaatattaaattacatcgctaggaaaggctcatgcaactttggcggttgt

SEQ ID NO: 6822 - DNA, 637 bp, Aspergillus oryzae
gggagagagacgtttttcggtctccacaggacaattactcggtcactgagccttcaccattggatgtgtaccatggaaggcactcgccgagttctctgtcaaagcctatgaatgctgaaaacacgggacaactcacgacgcaggtgccgaagccttacaggtcgacaacgcccttgcgtagtgtctaccagactccttgaattcctggtctcctgatgtcgtcaacgcagacattgcttgtaacgacctcaaagcagcaatctgtcctggaacgggcaatctgccacagtgccgccaatcgcgtgtcaagcggttcgccacaaactattacttggcgtgtacggcaagttccaaaaggcgacaacgaatgttcacttaccatacagtcgaccagtgtggagatgaactctctgccactacgatctgtgactaccaaccgctcgtctagtggtggtagccaacaattgcgcatttcacagacgatgtctaccgccacaagccaacaagtgtcagttggaaactactgtaccgagctcatcatctatgcgtccactgtgagttttaagagcggtctggcatttgccgagttttggcaaaatattggatccgcttgttcatctgccggaagcatgtttgg

SEQ ID NO: 6823 - DNA, 651 bp, Aspergillus oryzae
cgaggcctgttcctctcatccatatccatcttctccccttttattttctttacataccgcataaatcattcacaatgcctttcggctggggcgacgctgagaacgctcaccaacaggtgcaggaggggcagcacgagggtcacctctctcacgatctcattgccggtgccgctgctttcaccggtatgaaggcttgggaagaccaccagcgcaaggaaggcaaagaagtctctcacagcactgccaagcaggtaattgctggattggccgctgctggtgtcacgagattggttgagaccaagggcttgaatgcgatcgacgagcataaagctaagaagcaggccgaggagaacgcccagcgcttgtacgaagagcactacgagcgcggacaaaatgctcctcactttaaccctaatgagcacaaacctcacccgtctttcgagcgcaatcgctttgacgagcacccacaccacgagggccgcccccagggaggccaagttgaccggtggtaaatatttcacagacggagtgaacatagatgtcgcaggagacggtcctcgtcagttccaggtgatgacatatgtaaatagaaatgaataaataaacatttgtgaaagaaacctgtccaaagaaacgaaataaaatgacaat

SEQ ID NO: 6824 - DNA, 1064 bp, Aspergillus oryzae
cacgattcaagtcggacagcaacacacctttagaacttatcccttgcccttaaacatcctatcttcaccgaaataaggagacatggggggcaagtctgctaccaaggccgcttacttcgagaagctgaagagccttctcgatgagtacaagacggtcttcattgtcggtgtcgacaatgtcagctctcagcagatgcacgagattcgtgtgagtctccgtggtgagggtgttgtcctgatgggtaagaacaccatggttcgccgtgccatcaagggcttcgtcaccgacaaccctgagtacgagcgtctccttcctcacgtcaagggcaacgttggtttcatcttcaccaacggcgacctcaaggccaccaaggagaagatccttgccaaccgtgtcgctgctcctgctcgtgctggtgccatcgctcctctcgatgtctacgttcctgctggtaacaccggtatggaacccggtaagacctcgttcttccaggctctcggtgtccccaccaagattgctcgtggtaccattgaaattaccaccgatcttaagctcgttgaggccggcgctaaggtcggtccctccgaggctaccctgctgaacatgctcaacatctctcccttcacctacggtatgaccatctcccaggtctaccaggagggtcagaccttcggtgccgatgttctcgacatcgaggaggagcagctccttaaggctttcagcagcgctatccagactgtcactgccctctctctggccaccggcttccccacccttcctgctgtcatgcactaccttgtcaacagctacaagaaggttctcgctgtcgctgtctctaccgagatcagctggcccgagattgaggagctcaaggaccgtatcgccaaccctgacgcctacgccgccgccgctcctgttgccggtgccggtgctgccgctggcggtgacgctcccgctgaggagaagaaggaggaagaggaggaggagtccgacgatgacatgggcttcggtcttttcgactaaacttctcgtctcattgcgcgggctacgaccaccatgttta

SEQ ID NO: 6825 - DNA, 690 bp, Aspergillus oryzae
  misc_feature (1)...(690): n = A,T,C or G
gtcaaagttcagcaaccaggatggtgcacagcaaagtcgttatcattggctccggccccgtcgcacacaccgccgcgatctatctctcgcgtgcggagctcaagcctgtcctttatgagggtatgctggctaacggcaccgctgctggcggtcagctcaccaccaccaccgacatcgagaacttccccggcttccctgatggtatcggtggtacagagctgatggagaacatgcgcaagcagtccgtccggttcggaactgaggttatcactgagactatctcgagagtggatttctcgcagaggccgttcaagctgtggacggagtggaacgatggtcctgacaatgagcccgcccgcactgccgatgccatcatcatcgccactggtgccaatgcccgtcgtcttgacctgcccggtgagaccaagtactggcagaacggaatcagcgcctgtgccgtctgtgacggtgccgtgccaatcttccgtaacaagcccctctatgtgatcggtggtggtgactccgctgccgaagaggccatgttcctggccaagtacggcagctcgggttaccgtttggtccgtcgcgacaagcttcgtgccagcaaggccatggccaaccgtctnctgtctcaccccaaggtgaccgttcgtttcaacaccgttgcgaccccagtcctgggtgacgaan

SEQ ID NO: 6826 - DNA, 635 bp, Aspergillus oryzae
  misc_feature (1)...(635): n = A,T,C or G
cgaagtcttcgctcaggaccctgtgttcaatacccatgacagatccctgctcgcttctcttgacattaccgttctcgaccatccccacggctttgaaaaagtctcacctagtactctcctctattgtcccggcgcagaacggacgcacctcgaacaattactttcccacgcgcctgcgctggtatttggtggtccattagaagacatcgagtcagatgctgtgaggcagttcgtggaatcaaggttgtccataaagatttcgcggttcgaggacatggaacatgcattctggaatatgagagtatactcacccgaggagtgtgagcaatagatgagacgacgacatatcggtaaaattcactgtaaatacttttgtatgatacgatttatgaccttcgtctagactaactacataggagcagaatacaaccgctaagaaccgctattaacaaatatatggatgccgaattgaaagtagtatttgcaaaagtctgaaacaccccatcaacttcgagtgttcagataatatatacacggtgacactctttcattaaacatccagctatgcatgtgcaatgganaaaagatcaattattcacaaaagaagaagaatttcaaaacgcctcaacccaacc

SEQ ID NO: 6827 - DNA, 687 bp, Aspergillus oryzae
ctcgatttagcatcaacacgatatcagcacgataactattctgtaggtcagaagccactttctaacacggtgttttgaacaggaagggatgtttttcgacttgacggaccttcttgctctggcatcatcacctgaaagaaaggatgggtcagttctcatactacaaggccacacaatcctgcccatggtgacttacggggatcgagaaattcaatagcggcacgcactctatcctgagcggcctcatcacggagctgcactccgtccatggtgatagtgtgcttcgcagacaattattatacggggtgaggatatattggtgaaaattcaaattggtcgatgtgatttcagtgcaacgaatgatccttgtaattttcgataacacccgctaaatcacagaaacgcggagagaggggggatgattcggttccttgcgcccttgagggcgagtgggatggcggatggatctttctgaaagctgtggaaacacgccgtcccaatcgggcataattggaacgcgttgttcttcttgcacaacgcgctcacacgcggagtgcgtgatgactcagcgggacaggacaaaactattggattgcctaactgggaaatatcaacaataggtacttaggtactatacaggcgctgggttgaattatatccaataatattcgtacactctctagagat

SEQ ID NO: 6828 - DNA, 684 bp, Aspergillus oryzae
  misc_feature (1)...(684): n = A,T,C or G
aataccgtccgaatcgcacgagggccttataatccacaaaggtaccggaagggcctctctctcggtgtccagtcatcgggaaagactgcaacttcactcatctcgtcattctctgcttcccgcaccgaacaatcgaggtgcttcccctcccttttcatccacgtcgggtccgcaggtgcgctgagtattaaatgccagcactgcggacaagctttgcttcttggctgtcatagtgcaggcagtatctgaagaatacatccaacaccaacatgctcggctcctggggcctagttccaagatctacgtctgtatgggcggcagctttaatcatcctctgccaattagtcccgctggccgtggcgttgcggacagcaccaggatcgccatgtgcaaacgtttgcaataagcaatcgaccaatacaacgggatccgagattacctgtttagatacggactntacttncaccagcanagggtctcagttcaagcagtgcgtcgactggtcagtgcgaagtacttacagtgacccatcttccgggagacggatgtngactggggactttacaaccttcgttatacttttacctcctgtgtctatggcttcccctaagagtgtgagcaatatctccacgcagtgcacagtgaattgccagcccgttgacaaaagccctagagtttgatctg

SEQ ID NO: 6829 - DNA, 662 bp, Aspergillus oryzae
  misc_feature (1)...(662): n = A,T,C or G
gttgaaggggtgacggcggacggtaggaacgcaatcaagcgatcaattccgaaaggtgttggagatccgattgatactgttagaaaattcggcatctgggtcgcttggaagcgtggtaatgaaaaagctgctcaatggacacgacctggtgtcgttgaaagcaacgccaaactcagtctcacagagaaaaagtctgctggtcgacctagtcgccgttcagaacgtaatatggacaaccaacgcatgtacgcagagagacaggctgtgcagagacccctagaacaacatcgtgaaacttccaatggggtctccggtagtagcacctcggtaccaccaagcatcgtcgttcctacacctctcatctcttcgggtagcggggtgaaagaggagaatgtntccaagcctcgaaacattcatcggggttctggactaagtcncaagcgggttgcctgtgatgcttgtcgcaaaagaaggattcgatgccatcataaagatgaacaaagtgacncaacgccaacgaagcaaatgacggttggtgtcttcgctggaagccaatcatccctggcacatgatgccgcatctgcgctgagctccttggcagcaattgcatctgaagcaagtcttcaagatggaaatggtgggattggacgaatcgaaactgg

SEQ ID NO: 6830 - DNA, 642 bp, Aspergillus oryzae
cccagcagagccccaaggctgccacccagcattaaatctgcccttagcctcgtataccacgcgggatgctgggaacccagcgagattattgcaatactgacttcctcctcctatccgccctaaacacacctaagcaccattaagcatcctgtgaacgtattactattcttggttgattgtacttccaacaacagtagaccgacgatgctcaaaagactctcctggacacctacattccctcaaacaagtacatcgaattcctcccctccaccacggacgcggaggcaagacgcggctggcaattatctacggcgagaaaagctacaagccctcctggagcgactgttccctgatcacccagggttgaactttcacattcgactcgatgacgaaatttggtcgttcgatgcaccacgagaggtgacccgtcaagagctgagagaagcgtctgattgatcttccacactctgagtggtcgggatgaagtggcagtgactggtcagggtgagagttctggaagacagcgcttggccttctttgagaaaggattggcggtgcatggcgcttggccatcgtgttgctgagtttttttaatgaccttttttatttcgtgaacatatgccacataatattaacactgag

SEQ ID NO: 6831 - DNA, 689 bp, Aspergillus oryzae
  misc_feature (1)...(689): n = A,T,C or G
gggacttctaccgcgagcacgtcagccgtctggcgccttccggtcaaatcccggcccggccagcctctccacgctcctttcaaccctcggatcgtgaccatcaggcgtggcctactacagacaccacacagcgagttgtggatccaagcggagtgccaccgcccgcatcggcgaccagatcaactggtagctggacaagtcgagggactctagcagacgaacagcaggcaagatcactgccacagttccctgggccttggacacgcacttgatgatggaagcaagacattgggctcatatgtcccagcttatgtccagcttccctctgtttcttttgaggggatctccgtgcgactttgaaaggagcacgccgnctctctttaacattctttctcctgcggctcgtcggctgcccattttggcatctaaggagatccgcggaaataattacttgaccatatttcaatacaccgcctgaggcgagaatcatactgcattggaggagattgtgtcatttgtgcgatcatcatggaggttttggattattcgaacggcgaaaagcattcttattgatttgtgcgaactggattcctgacattcctgcatatattttgtctgctttagctctcaatgttttcacccttttgcttatagagtgctttaacccctggtcattttgggtgagaaag

SEQ ID NO: 6832 - DNA, 632 bp, Aspergillus oryzae
  misc_feature (1)...(632): n = A,T,C or G
gttctttcttattagtcatgcttggtgaatcttgcaggcaaattgggggtgatctacagttttcttgagtcttcacggatcagggtcagggtctcctccgccctgtcacccgcaatcggagtataaggatgggatttagttattgtcggtgttgaatttggcaaacctatatcgcacgttggacttacaacatacgagcctaccgtgcccgcagtagctcggcttaaatctctgatagggactagagctgagaatcaactgattggcgttcaaatttcattcatccgaagtttgtcctaaacccgctccgcgtatagattgcaggcgagaggtatacaggatatatgaatcacacacaggatccaggacacaggcacattcgagcaaattgggtttgtgtcttgaaatatatatggggagtgttttcttgaacatacattcgcaagggactcggagctcatcaggctgcaatgtttgccttgctctttttttatcctaaggctgttctatcttggcgcttgttacggagtactggctactacgttttgaatagtgactacatacatatcaggcttcagcttttcatncttggacaagagatcaancgcagnaacagtattgtactctactac

SEQ ID NO: 6833 - DNA, 672 bp, Aspergillus oryzae
  misc_feature (1)...(672): n = A,T,C or G
ggctgttcaaaatataaagtcgtagatgagttttcgttcacaggtttctgacttccaaccacctgaaaacatcgagttaccttttcctaccataagctgctcactttttattgtatctcctccatcattatgggtgtcctgaaggtcttgctcaaagcgatcctcattcccatcgttctcctgctggtcatctcggtcgtcgcgttcctcctcatcaaaaggcaccgaagccggaaggagaaagaaaggcaactcgagaatgggttccagcccccgcccattgtgcaatgggttccgcatcaggaccccatacaaaagccggctccgattgcccatacgtcccacctgcaaccgggtggctgaaagcattttgaatgccacaacattgggtagattatctttctatcgtatacaaccggctggcttggatatcgttgttgtgcagggtgttcangaatactgttgttgaagaatgatgacgggcttgaaattgaggcgttagtggatatggtttgttctgctttgttgattcgttttcaatttgtttcccttgctaggtaaatcggaatcgtgaatgtgtctgatattgtttcattgtcgttttgctttactatcgttctttaaccaggtatcattgatcgttaccaagagaaagacgttgtctatagcgag

SEQ ID NO: 6834 - DNA, 668 bp, Aspergillus oryzae
tcgaccgcagtccgtacaacggtccgtccccatgattctgatttgccggattatgatgccgtcgttgcagaagacattcccgttccgccacctctccagtcacctcagcaagcccatatccgaaatgctgggcgcggatctagccaactcttctcttccctggatattcttcatcatcggccgggccttggtcactctcactcctctagtcacaatgatgaagaccgaagactgcgactcgttcaagctcgggctcgagtctagaatcaggacagaggccgcttcacctgcatagcggaggggacgttgaactctccagagatgcgcatttatgatgattacggtactgtcggcgctggacgctgagaggcgctatatttcagagactctcctaatttcccgatagaagaaaagcaactacctcacttcgttttgtatctataatagaccggggtattgggggctcctgggggctttccttttcttttttccatatctatagaggtggggatggtctgtttttccccacttgattatctccactcactcgctgtatcgtcgccacatctagacatgatctgctgatcttatcacgatcgcacgcagctgagatctcgtctttatccatgatgacattccaattattatcttccacatctcacgcttcc

SEQ ID NO: 6835 - DNA, 617 bp, Aspergillus oryzae
ggaagaacaaaattgggggtttcggaaacattttattccccgtgaaatcccaacctttaaacattccaagtttttaaccaaaacttccaaaaatttttttcccccaatttattcctgccaagcgggaaactttaaaaccggcctttgggaaattttgaaactttaaaccccttggttgaacttaaacattgttcaaaaaattatttccccttttttggccaaaatttaaaatttttaaaacaaagcggtccgaaagtgcttcccccccaccttttggtaaaaataacaataaaaactttttttctgtgggaagtccttttcccagtgaccagttccaggcccttttttaaataccaaacttctttacaatttttttttttttgaactttccagtttataccaatccctccccaaccatttttccctgcaattgaaattggtgttccggaaattgtaattcttgtttttgggagactgaaacactaattgctttcccttgccccgttccaaaattcttaaaaaaagaaccttgtttaaacaaaaataaacccgggatttccttttattcttcaacaagcggccccatggggatggtattaaacgccgtgtttttctct

SEQ ID NO: 6836 - DNA, 724 bp, Aspergillus oryzae
  misc_feature (1)...(724): n = A,T,C or G
cgaatctgtgctactactcccgcgtaccttgcaaacccccacaacgtcgtcgctcataccgtccatttctaccgcgcccgcattgatcggcattcctaaaatgagttcgccctcggtacaggttcaaccgcaaccttccggcggcgcaaagggcgtttcccacacaacgaaagaggctggtgccatgaacttcgacattgtccgctgctcgagatgtcagcgctccatgagccttgaaaatgactcctcccccggcgttgtgcgcttcggcatgaattcatactactgcagccgctgtgcgtccatggtcggctttatccgatgaagcaatcgcctcttgcaattcgcgcaacggaacaagaaaagagaaacgacatcgttacgaacgcatttttcgtcgtgccttctagctctcctgctacccaccgccgtctctagggagtaggcaggatcagcatgttggttctccagtttttgttgttttctacttcgaccattcgctcagacgacttatccgagaactgttctgtgctggcacggcttctctcacacccttcgagcaaatgaatagggctacggactacggactacgattcagtcgtttaggtcgaatgggctttatcaacgccacacttcntctcaacaatacccgagggaacaatgactcaccgcgcgcaaccgagaaggtacngtggaccagatgggggacaaaggaaatantttt

SEQ ID NO: 6837 - DNA, 717 bp, Aspergillus oryzae
  misc_feature (1)...(717): n = A,T,C or G
cctgcgatggcctcatccgaaggatacagcgaacaggataccgtggagagatcacctttggagctaaatatgacccatgcatgacgctcttccagaaggcgcaatcggtctttaagaccattccacaaggtgttcccgacgaggtcgacatcagcgtctctttgaatgttaactttcccggcttgtcggcgacgggcagcaagcaggagaagatgcccgagccaggcatccagacactctgcaaccgcacagataactctactttccagatgctcgatcctcagactctggagccaattggtattgcggaccaaacagtcttgcatccatcgctccgtggaccccttagcgcggcccattgcaagacagacctgaccaccggtgatgtctacaactacaacctagacattggtctgacaagcacctatcgtatcttccatgtttctcgagcaacaggaaaaaccagcattcttgcaacattcacgcatgctgctacatacgtgcactctcttcttctgacggagcactacgttgtgctctgtctttggaacgctcgctttcgagctgggggcatgtccttgctatggacgcataactttgtagatgcattggccgactacgaccccacacagcgcagcacctggttcgtcgtggatcgtacttctggagggcggnggattaatcgcgcgttacgaattcgaaccctttctcagtttc

SEQ ID NO: 6838 - DNA, 651 bp, Aspergillus oryzae
  misc_feature (1)...(651): n = A,T,C or G
cgcgagaaggttgagattatcgtttccgatcttcaacaagctgcaagaaatgcgtctgaggaacgtgttagagacctcggaagagacagcggcgtcctacaagagtacaaccaagccttgcgggctattctcgcattttccaacggtgaagaactggcgcgggtgacgtcgctcaagaactggaccagtctattcttgccaacttaagggacatttaagaatggaggtcttgtacctttttttggccaggtgggggatatggcggctcttattacacgatacccctgggccggccttttcgaaggtggagaagaacacatggtccatgtgccaagtaacggccgtcttattgaggccggacctctggagattcggcgcggcgatatgatattggccagggttatatttcacaaaaatactatagcgcttaaagtgcctgcgcaaatgatggagcgcggtttttttacgaagagaccttcgccttgaagggtgacttctcangcagtcttgaagctatgagccattggcttgagaagacttcgggcttttaactgcccgtgacattattaacaaactgggcgagtttggaattcccgaagtggttaccctctacttcacggtaaagcgagatcgaagcgtggatcaatggga

SEQ ID NO: 6839 - DNA, 713 bp, Aspergillus oryzae
  misc_feature (1)...(713): n = A,T,C or G
cgaaggaatgatgccatttctcatctatggcgaacgaggcgtggccctttccttctagacaatttcacttatccatcaactacgaaacggatccagaaacacagtctgtactgtctatatcggtaccaatggccattgaaaacaaactaccagtatatttgcgccagtggattgaatcaaggctagcgaaccccctcttgaagttggatttatcgggtctatgctggggcataaaccggtattgggaagcctcaatatcacgtgccaaattatggtcgcggctagaattccaatatccaggactgatcagaagtcgtgggacaaccaggattactgataagctagatgacttccaaaaccccgatatgctctctctctcgaatatgagtctacgcaaaatactaccacaccttgagcgtacatcgatgctattcgagtccggagatggagagtctgttcgagcctacttttcatgcgaactaacaatcgatgaatgggcatgtgaacccaggttggtgccggggatcagtgtgtctgcgccgtccatgatgcatggcaggttgggaagcaaggtggaacaagatgtcaaaggactgtttcacacaattttgaacgagaaacagggcgggagaataggcgcagacgttgatattgatgcagatgcaatagtacatgctgccgagcatatnctgggtgcttttgtctgtgatgac

SEQ ID NO: 6840 - DNA, 722 bp, Aspergillus oryzae
  misc_feature (1)...(722): n = A,T,C or G
tgatatagctcgatgctaataactgcacgagcgacgggcattacgagnccgccaccgggcgcttagggcgcatgctgagttgagcggagtcaacatcatcctcggaatctctaaccggtccatcggcgtctttcactggagagacctactataccgaataggtggtcgagcccatcactcttcccaagacgaaagcattcgttccgaccttccactcgtgtctgatctctcgcatatattgcctcgaactcagcctctcttaccatactccaaacgccaatatcctgaccccaacggcaacgctcaagatcccaatccagcttacaagccgggcccggtccgacgcaaagacaaaggattctgagcatgagatcacccagcatgaagttaatgcagagtttttcagtccccgcagcgtcgcacccccgacactggtccaggtagcgccaccagagtattcggagaaccaaggcccaattctgcctcctgaccgttcgatcgatttgatgtctactgcccgtgtccccagggttcatgctggaagtgtggggactgctttttaatggtcttcccgtatccaacaacggatacagggggtttcacgagatacaaaagttcatgtgttcatggcgatgagggaatgtgttttgtctgaatatacccgggttgttatgttggatgaaattcgcatagcagtagcgcacaagggcgtttttgatcgn

SEQ ID NO: 6841 - DNA, 708 bp, Aspergillus oryzae
  misc_feature (1)...(708): n = A,T,C or G
gagggctcaagctaattcaggaaatatttatttgccccttacactcaagtggtcccctgtgtcggcagccccgaagcaggcgggtactttacaactatccatcagaacaaggatgcatgggattacctctctttccagaagcattccggggcagaattccaacaccgcatgaacgacctgcatgagctcgtatttgtacgtcgtcccgaatgcgcaatgcagcagatcttccaagtctatccagatcgagaatccttcggaacagatgatctatggatcgaacatccggtgcacaaagggctatggaagattatcggccgcagcgatgactatgtatatctagcccatggtgacggactacatgcttcgcttctggaaccagagatcatcgctcatcctagcgtgaagtcggcgataatcggaggacatgggcagatctcaccggttcttctggtagacttgaaccctggggtggagttgaacaatgaggctntgagggaaagtctaaagccctatattgagaaagtcaatgcacattgtcatgactgtgtgaagctctcttcggagcggttgatcttcgccacgaaggacaagccattcatcttgacggntaaaaggagtgtggccaggttgcaaacctttggctctctattagaaagagaacgcattctttgttggttaaggggggaagaccttggtataatattn

SEQ ID NO: 6842 - DNA, 674 bp, Aspergillus oryzae
  misc_feature (1)...(674): n = A,T,C or G
ctttcccttcggccacatcaactgacggcaccgatctcggtctgcgtgaaagcagtaacaaccagggtcacttggagaatctaaaattcgaggaggttgacttttctgcaggacgcactgtaccagaagttaagtgcgaagattgctgttcacctaggcccccggcttcccctagggcttctttctcggaggaagagtttcgacgagtgcctggtgcgctgccggatgatcagatgtccattgccagctatgctggtacatctaagaccacagactccaatcccaacctcaacagcatgagcatagaatttcgtcgtcggtctaaggcgtcccgggagcgagaactttcgccgatgccacctcagtcggctttagcccttaccagcccctcggacaaagaaaacgcggcctctctgattcagaagacatgcacggtggtccttatccctccgattcagttatttatcgtcctcattcatatagcagctcggatcgtattaggcccagctntgacatcggccatgggggagttaaatcataagtatgagtatcaagtggcggatcctcaggaggctgtggacgactntgatcttccacttgcacccgactgtccgaagaaacagtcggtatccgaagccaactcttgggatttggattaatgttctgncaaggca

SEQ ID NO: 6843 - DNA, 661 bp, Aspergillus oryzae
ggatgtctggcaatgataatgaaaattattccgtttcttctggaaagatttcccacttattcttctctttttgttgaaccttatgccatgttattcatgtcacatgctcattcctcctaatcttctcgtccatgatttcggtactcggttgcttatacactcttccgtttccatccgttgattggaagaggcaggcacttccgacgttataatgtacaatgaatgttgtgtttcaaaagcgaaatgccataatgaaggtggggcttttgaagaatctagcgagataggttggcttgcagggatgtctgatatgtttttgttttcttgttatgtcctttgcatttcaatacccggagttgcttcagcagttttccgtcccggacaagcgttgacaccgacgtttgacccaaccaggacaagactttctcacggctacttgtttgtctcatggaagacatgatgtagcttatgtgtttatttcttttcccctgtcgttttcagtcatcttgtatgcattgcatctacactggcttggtgtgtgctggcgatgtctgctttatctgctatgatatgtctctctaaaaccctttgctagacaaaatcttcgttagaaaaagtttcctcttttcttttcaaaaaaaaaaaaataaaaaaaaaaaag

SEQ ID NO: 6844 - DNA, 798 bp, Aspergillus oryzae
  misc_feature (1)...(798): n = A,T,C or G
actttgctcagtcgtttctttttcctttacttccaccaaacttctttcccgtcattacgaactttcccccgttcagtccgacttcaaaatcagcccaagcaacaagaacgaggccaacgcaaagcagcagacacccaatgcagaacgtgatccataccaatcccgcgcagatacctcccttccatcacggcgggactgaccattcctcctgaacggcaacctcccttggcggtttgatcggttgcccgtgccgaaaagtaattcgatagattgttgtacatacatatacggcatatccatttcttgtgctgcccagttgacgatatattcctcttacggaacccgtacccagcagccaaccgcaccaactagcttacgagagatcccctactgaaagcaggccactcggttcgtcttaagcacggctctggacaccaaattctattatctcccatgcgccattgtgttcgcaacgtaaaaccctgagcttgcttctaccaaaggcgaccaaaaaccacgtcaatgcccggaaaacaccagaacctagccatcgcaactcgaggctccacgctcgacctgtgtttaagcccaaatagtaaacactcagttgctgcaagacaggctaacgcccgtcaaaaaactgaatcatacaagaacaaagcccttgcgccctctggcaaaaatggctaccgtgtcgataacaagcgatctggagccatatctggcttcccttcgcagctatctagctagaaacagattcgcgtcccccgggttggaggaccggntcgacgagcaatc

SEQ ID NO: 6845 - DNA, 680 bp, Aspergillus oryzae
  misc_feature (1)...(680): n = A,T,C or G
ggtaccggttatgactgtgcctatgctctcactttcgaggagagatgttatggcactgcacttttctgccgtgagggactttacccccagggtcaatatagggacgagcaggaatgcttgtctgacagagaggatgctccgaaagatgccaagcagagcctcccagaggcagaactgaaggcgaagaagccattccttcagcccgcgcccgacagcgacacttcgtgcatgaccttcgaccgcggcagtgaacgctgtgttggaaccaggtactactgtaccaatgatatcatgaagttcccctacacagacgaggacggcagtgtctacaataatgctgccgagtgtctggatgcccgtgaatctgagcctcaatctgccgatcccgatcgcattgtgttccctgataactaggatcggatatggacgtagtccccaactaggtgcggtccatggcttgaccacccacgttagcattcaggggatgcggactaaggagggaaccctganagtgttgtgaacgttcccatttgcctgtacttatgtgtattaacctcctggcgttagattcaacatctaagccagtcttagtgcattagttttatttatttcgtcgatttgaaatcacactgagaaaaggaaaaaaaaaaaaanaaantnnnaaaaaaaaaaaaatcctg

SEQ ID NO: 6846 - DNA, 697 bp, Aspergillus oryzae
gcataaatagatttaaacaattaccatactaataaaggcagctagcagttcaatcagaccatacattcgcatatatttccatataatgtccgcagtgcaccaagaaaacgagcctgctgcgctctgtctacacgccgaacttcttcctaacatccgccacattactctctacgtatcacttccggaggcgatgcgatcgcaaaatgttcgaccagaaatctgtctatccgattcgcgtcgtgccataacagtatctctcccatcgccacacgaagatgccacagacacgatcaaattaccagctcgtgttaatgaagcgtctcggctggccttgagcgtggctggacagcgagctaaggatccgcgggaccgcgggcttggtcagcatgaatactcgtttagaatgcaaatcgatgacgaagattattcgttgctctcgagagaagaacatatggatagctgtgtgccgtggacccgcgatcgacatgacctcctgtactaagctttgttgtcgccattgtaagactattctttctcgaatcgaatgtgtccgcgtggctcctgtgctgaagacaatggttatcacggggtggatgtggaaaggattagcctcatggagaattggggcctgaaatgatgggtattatgggcactggacacaaaccgggatcctcaatgacggtctaggaccatggcg

SEQ ID NO: 6847 - DNA, 694 bp, Aspergillus oryzae
cgggatctctaccaagcagtttagaagatcatcgcacagacaattcctctttgggacaagagtttgactcacgtgcaggaacgacggcatgcacgtatagtctatgatagcgttgactatcacccaacttcgacaaaggagccagcttatgacgattatagtgatgacgaagaatgtgaccggaggtatcaggagtggcaacgctcacaagaaataatactccgcgaaccaggggagttcacacctcctgaaataaccgagaagatcaatctacgggagcagttacacgaatcagggctgcagatcatcgtgaagttggctcacattgaattgaccccggagaagccggagtacgaacgcggcacctggcatgttgaatgacaactaaatgaacgcatctgcgcaacggccatctactactatgacagtgagactatcagccagagtacacttgctttccgtcaacgcgcagacaaggacgaactgtcagaaattgcctatgagcacgaccgccatgaattcctacagcacgtctatggctcttgccccgaggtcatcgtccgtgacgatacgcaggtcacccaggaacctggcagcgtgggttgccaggaagaccgactccttacgttccccaaaatccctccgcaccgggtgtttacgttcttgttgacagatcggtccaagccctgccccc

SEQ ID NO: 6848 - DNA, 696 bp, Aspergillus oryzae
ctttcaagctgcacttctgctcattgcagaagtgctccttaagcttaatctatcagatgtaatcaccattgctcaaaagcactatgtctcctgcacctgtcgctgcctctcagcagcaggactcacaacttcaaaccctggccaaagctttcgaagctcttctgctaaccactcaacaatatatcttgcaagagagaatcttgcaacaaaagctggaatatgcttatgacgagtatatgaagctcgcaggtccacttcccggccggcttgacactcatgcccagaatggctcaaaaaagaaccgcgggcactccttccaattccaaaaccaagaaatccgggtctttcagtcctccggatgtagtaaaaccactaccaaagcctgggaatgtaggcaaccaaactctgaacccaataccggacggggtgggggtgtccaaatctgtcctgaattcacagagtgccccgacctcaacccatgtctggttgcccctagggccggagctcctggctctttagaaaaagacttcaccaccaagggcactcaggggaatctgcactgcccattcgcaaaaaccaaaattatgccatctcaaaagggggatggctaatgggaatagaaaactctttacagaacccaaaagggacactcgtggggacacaaaagtttacaacccataaggggttgacaaaata

SEQ ID NO: 6849 - DNA, 1293 bp, Aspergillus oryzae
  misc_feature (1)...(1293): n = A,T,C or G
gtcgactaagtctcgctacgtgaatctactccgcataggtggatttatgtaggcgaaagccagctcccaggaatcctgcaccttctcaacagtctgtaagctttcattttcgttaatgaaggctgtcgattacgaggaggatcttgtctcgggaaggcttccaggactctctgtttcatgcagtgtgtatgagtcggtagcgtcattcgtttatattaaccagctcgttcgatcctttcctttcgtttggcttcttctgtcaatcttttgtctctacgtctggatgtctcttgtgtcattcctggccaagttcatgggcatggacgataggctgaaaaccgctaatcgctcgttcactcgaagcgatcgagtcggcaagcctagaaggtcgccaaggaagacacataggcatgtgaaggcgaagaaaatgcaagagaaggtggaaagtcagtcaccggctaatcccctcacgagccctatagtcaccatgatcgttagtcacgaacaacgtgtcttcgtagctcatgaggaaatcctgtgccgctcgcctttattccggtctctactcaaagacgagtttgtcggggacagcacgaataaggcagtggctctgccagatgaagagccagaagttttatcctgcgttctcgaattcttgtacaagggagattatttcccgcgcctgatccgtaacaaggacaccggttcatgggaactcgagaacagccagaatgccaccacccacaccggtggccgcgggtcgagcgaagcgactatgttccactccgctgtaggcgatatcgtcctcagggacacggtcgtgtactgtgcagctgagaagtatggactggaggggctcaaaagccttgctattcgcaagcagggtcttcagagcggaatccccatcgatgtgattctacgatccgctcggtatgcctacgacaacacgccggactcggagtatcgactgcgctctcattacttggctatgatcattcggacccgacagattttcaagactagtggaaccatgcagtatgagatggagatgggtcataaattgtttttcgatctgtttgttgctatgtgtaaccacatggatgatcttgaggagatgagtaacaacgaatcgcctaagatggcctaacgattccacagcgagcatgacgatatgtacagaaaatcattggaaaaaagattctgatcttcatataaaggaaccgaacgagactgcttgttcaagatgantcgggttcattccctgaccatggcgaattctacacncttccaggt

SEQ ID NO: 6850 - DNA, 246 bp, Aspergillus oryzae
  misc_feature (1)...(246): n = A,T,C or G
gagcttctccctcctcaatatgagtggtcctggcgatgatcgatggcgcgggggccgcacatacgaccagaaccgtcagtcggggcaaagacactccttgcacagaacaatgagcgcacacagtggctctcgtagcggacagaaccagaataactggggagagtcgcgtgatcaactttccactggaccagctcaggaacaacatgtccccgtgcgaggcttcaatgccgccgaggcgaaggcggn

SEQ ID NO: 6851 - DNA, 692 bp, Aspergillus oryzae
catggatgcgccacggcttttaatgatctatccagcagatctatacacgcatccatcacctggaattaccattccccacgagaacttcgacgccgtagatggtcatttcctgtctgagctagcagtcagtaactgttccaaaggcattatccctgagatcccagccgacattcaatcaggccgttttcacgggtgtcccaatcgaccaatcactgacttgccgtcgtcgtcacacattaacgctcttactcacgctacacttgcagctcaggtcattgaagatcacctaaaggcaaattctactctcgtgctcgatgggaaaacagcacacagctcggttctgcttgtagatccacgtattgaaagggtacgcccaatcgatatcacatcacgccgccattcatcatccagtaccggccctgtcccacacttggagaaataatcggtttacaggtatgatgcatactaggaggaaaactccatttagcaagccacagcccttaccgaggtctaacgttctcgcttacgcatacagctacgcacgtcaaaccttcggatcaaagagatttccatggtatcagatcaagatcttccgagtacctaaagatcattctcatggttatgtcatcttgtcacccagtagacttagtaccatctatcaatcatctacatccagcagttctccatctttg

SEQ ID NO: 6852 - DNA, 653 bp, Aspergillus oryzae
  misc_feature (1)...(653): n = A,T,C or G
gccgtcgcacctaccttcgaacctcaggatgagaagcaaagtgccgccatgaccttaggccttctcagtagtggaatgagtcccatgaactcggctccccccgccttcggcgatggcacccttaaaatgggcgagacgccactcccaccacagggaggatttggagcgacagcagatataccaagggctccctcgcctctaagtgccatgttcgggcaaatgccagatatgcagctccctctcgattgggacacctgggaatactatattcagaatgcagcacttgatgcctcgaaccagtggtgggcaacaatggatcaacagcaacagcaacaaccggagcacaaccacaatctcaaaatgcgttaggctctgctggtttagcatcggtgcaaaataatggtgccgaaagatgcgctcattgccttctttttccacgtattttaccctgatgcccacgtttaaaaaacaacaatttaccgccgaacaagcggggacacgtttacccagctgagatgttattngcttatagatcccctttttttttttgagggtaaggaaaattcccttaagtgggcgtaaaaaaatttggcacaccccggggggaaaaataaaccggggggggttttatggggtgcctttttgttgccaca

SEQ ID NO: 6853 - DNA, 664 bp, Aspergillus oryzae
tgcaacaaggatcattatactttgatagtacttcattacaccagcggcagagccctggatacagtaataccacgtgtgactggtacatcaatatcagcagagaaggctaacaacatgaggagctgatgtgagaggcgtcttgaatggactgcgcctccaggcggctttgctttcatatttcctaaaccgtggctgaagctccagaaaatttcccctctttcgccgcgcattgctccgactacttttttttttttctttctcacatcggagataagaacgatatttgcttgcaagtgtctcattcttaagggtctgtttttgcgctcaggtcaccagatttacttgcatctatcctagaagtcgcgcatttgactgtatcactttttttctccgttgacccctcatctcccttgtcgcacgacaaaaacacacattcacaatgtctgccgaacagaacgttgccaacaccgaggccgagaaggacgtccagaatgtcctggccgaattgagggtgaagccgacacaacggcgccagaaagaagaagagccctccacgaaaaccagaggaacccgtttttcggggccgccccacttcgtgagaactcccaaaagctgaagaagacaaagaacgaaaaaccgtggtggggcccccgtcgaaaaaccc

SEQ ID NO: 6854 - DNA, 674 bp, Aspergillus oryzae
  misc_feature (1)...(674): n = A,T,C or G
gattgggaagcgcaagacgagggacgtgcagttttatcgtgaggcgactganatgcaatttgatgagactggcaatcgtaggcgcaaacatcggtacggcgatgaggaagagttcgaggcataccaacacgagaggcggcggagagcagccttagatcgagaatttaaggccttcgctgaaaaaatagcagatgcaggtaaagacgaaggagtggacgttgacatcccgtttagagaaattggtttcactggtgtaccgaaccgctccaatgttctaattcagccaaccacggatgctctggttcagttaacagagcccccttttcttgtgatcaccctaaatgagattgaaattgctcatttagagcgggttcagtttgggctcaagaactttgacttggtgtttgtgttcaaagacttccacagaccacctgttcatgttaacacaattcccgttgagtctctcgaaggagtgaaagattggctggattctgtcgacattgcattcactgaagggccactaaaccttaactggactacaatcatgaagacggtcggtagtgatccatacggcttctttgcagatggaggcttgtcattccttgcaacagagtctgattccgagggtggtgcatccgatgaggaagaatctgcattcgaactgtcggagtcan

SEQ ID NO: 6855 - DNA, 1002 bp, Aspergillus oryzae
cttatccactgcttgtcccgcatagcttgatagggtgaagtacttatctcttgattctacttggccgtacctccctccaatctataataactccacgccgacaccatgaccggctttgacttctccaactacaaccgcaacgcggctctccacgccaagggagtgcctctacctaaggctacaagtacaggtaccactattgtgggctgtatatttgacaatggtgttgtgattgcggcagataccagagctactagcggacccatcgtagcagacaagaattgcgagaaattacactatatttcgcccaagatctggtgtgctggtgctggtacagctgcagacacggagttcaccaccgccctgattagttccaacgtcgagctgcactccctctcgaccggccgggaccctcgagtaatcacttgcatgaccatgttgaagcaacacctcttccgctaccagggacacattggtgcgtatctggtggttgccggtgttgacccaactggcaccggtctgtacacagtccacgcccacggttcgacagataagcttccgtatgtgactatgggttctggatcgttggcggccatgtccgtttttgagtctacgtggaaggcaaacctgaaccgcgaggaagcggttgaactctgtgctgaggcgatcaaggctggtattttcaacgacctgggatcgggtagcaatgtcgacgtgtgtgtcatcgagaaggacaaacccacgcaactcctgcgcaactacatcaagcccaatgagcgtggtgagaaggaacgcaattaccgcttccccagaggcacgacggcctatttgaaccagaaggttatcagcaaggaggatatgaggaaatatgttactgtggaagaggtctccggtgaccctaacctaatggaggtggactcgtgagttaggaagtgaacctatatttgacagagccttattatttattacactgaattacgcatgaaggaattacatgatgag

SEQ ID NO: 6856 - DNA, 645 bp, Aspergillus oryzae
ctgctggttacctgccacgttatcatgaagcttggttggatcgaggtggccgcattggcggctgcctcagtagtcagtgccaaggatgatctcgcgtactcccctcctttctacccttccccatgggcagatggtcagggtgaatgggcggaagtatacaaacgcgctgtagacatagtttcccagatgacgttgacagagaaagtcaacttaacgactggtacaggatggcaactagagaggtgtgttggacaaactggcagtgttcccagactcaacatccccagcttgtgtttgcaggatagtcctcttggtattcgtttctcggactacaattcagctttccctgcgggtgttaatgtcgctgccacctgggacaagacgctcgcctaccttcgtggtcaggcagtgggtgaggagttcagtgataagggtattgacgttcagctgggtcctgctgcttggcctctcggtgctcatccggatggcgggagaaactgggaagggttctcaccagatctaggcctcaccggggtactttttgcggagacgattaagggtagtcaagatggcgggggcattgcgacagctaagcattatatcatgaaggaacaagagctttccggcaacaacccgaggctgtgg

SEQ ID NO: 6857 - DNA, 645 bp, Aspergillus oryzae
  misc_feature (1)...(645): n = A,T,C or G
cgaagaggagctggatgacactatcgaacagcgtataggggaggccgatgacttctactatcacatcagccccctacctatgagcgatgacctacgaaacattcagagacaggcattcgcgggcatgatgtggacgaagcagtactaccatttcgtctgggatcaatgggcaaacggcgatcctgcgatgatcccgcctccccctggtaggaagcatgttcgaaaccagcagtggaaacacttatacatggacgacattctttcgatgcccgactcctgggagtatccgtttttcgctgcgtgggatactgcttttcactgcatccctctcgcgatgattgaccccgagtttgccaagaagcagctggatcttctcactcgagaatggtatatgcaccccaatggacagcttgctgcatatgaatggaactttggcgatgtanaccctcccgttcacgcatgggccacgttccgagtcttcagattgagcggaaatgtatggtcgcaggacttaaatttctcgaacgggtgttccaaaagtgcttcttaactttacggggtgggtgaaccgtaaagactcaaaaggaaagaatgttttcgaagggaggctccttcggctgggatacactgggttggtccatccgt

SEQ ID NO: 6858 - DNA, 666 bp, Aspergillus oryzae
  misc_feature (1)...(666): n = A,T,C or G
ggggtgttatagggggaggagtggtttcgaaaggaaagaaagagaggcaaacgggaccaggagcgatggtgacgaaagggagggacacaacaactacgtcgttcttttcttgcgcgtattattgagccactgggaatgcgtgaagtcagttaagtgtttcccgacgcaagggagcaagagattccgggggtgaggtcgtctattgcttggatttgggggccgtggaatgcaagattaccgtgtttaattggggaatggaggactggactcgagagtctcggagtgctacggtactgtctattccgtttcccgtttcccttatttttttcttttttctttagttccttttattaagaccgctggctggtcatgtttgaaatgtgacttgggtggttccattcgatctttgattgaattccatgaagatggctgtaattgcactgtactccgcatacacctgtggaatgttccatggattcaatcgccatttttttgattagtgtttcgatttcatttgctcaagtggatttatggatatcangtctgtttattttttgggttaaattctattatgtcgcgatctgtgatatggaggttgggtaaacaatgggaactattgattggattgatcactcttttttgggggatgtctgatagtaagcgatt

SEQ ID NO: 6859 - DNA, 676 bp, Aspergillus oryzae
  misc_feature (1)...(676): n = A,T,C or G
cagatatccaaaccaaacaaagccacgggcacctccaacgttaagaaacagatgaaagccaatggtgtggtcaaggcgactccggcgctcaatcccctcaagcgcaaggcagaactagaccgcccctctgcaactcccgcccagggacgtaccacgggggatttggagcacaagcgacgacgggcggttagcacatcgagtagtagcacgggaagtgcttcaccgcccctcagtcgggagattcttctccagcagctgcgagagaaatcgcagcgctttaaacactactatgccaagtaccgttcactccacgatacaatggcagctcatccagatccaccgagggcggagttggagaagttacggcggcagcattttcgactacagcagatgaaagaggaaatctgggatgaagaccggcggctccgcgaagggctntanacgactacttcgttagacgaaatcngnacngggatgtgctaattaaatttcctattggacactggnagatccgggttgttcacggaacggatcacccgtttatattctgggatgtttatgtattcatctctttttctttatcgcatcagaaatcttctagcatgacgaggcantgttctgangttgcttccaggcgttcatgggcttgtttcatattacacactcatgtctggtg

SEQ ID NO: 6860 - DNA, 732 bp, Aspergillus oryzae
  misc_feature (1)...(732): n = A,T,C or G
gggtccgactcgatcgatgcagacgacgtgctgttcttgtcttaacgatcgcggtattgctgcataatcccggtcttctcttctctttctctattccattgtctggtagattctggttcctgtcgcggaaccctgcccattgattgtcctaatcttgattcgtttatcgagctgtgtttctcgactttgagacgatcttgtggacagaagtggtgatcgatcttcaacattgacgtctccttctgctggccggtcccactcaagtcactccacagcctccactatccgaggtcatcccgtagttttacccacaattataaacgaagatgacgaccgccgccggtctaggttcccaaacggtccgccggctatccagcctggacgccgttcgggccgacctttatggcggccccagggtggtcgttcctcccaagcacttgatggccctcagtgactctcatgaaacggctatggcaatggaaatggccaagcaacacctagaagatgagggttcatctgatgaggggtcaccccggcgtgcgtcctcggtctgcgaggcccttgaccacactgatgagtngcgctggcctcgacatgacggcgtcttatcagggcggagaacgatcccggcgccttanggcactcaattatcaatgggccaatcggatggattaagaccctatatttcttacaatgtggagcaaaacganaagaagatgcttgatttancat

SEQ ID NO: 6861 - DNA, 384 bp, Aspergillus oryzae
  misc_feature (1)...(384): n = A,T,C or G
cgacatcgctagagccctttaacgagcctcaaacgaaacttcttcctcaacggtggctaccgaacgtttgccttgcgcttgctctctcttcttgccttcacattgggtcattgttgtatagtgtcgggaaactacggtcagaaggccaggttcatgtctaggtacacgtgcgaaaggggtaattgtatttttttttttctttccgtatcatattctgatatgtcaagccgccgttgtctaacggaacgagactggcgtctaaatgggcaatgtaaaggttttcatatataggaaatatatgttgagcaattactgggttttgcacaccgccggtacttgttttgccgattagctcaaccaagttcataacccannnaaaaaaan

SEQ ID NO: 6862 - DNA, 968 bp, Aspergillus oryzae
  misc_feature (1)...(968): n = A,T,C or G
tgcccgtgttgctttgggccttgtcaatgacagcaagcaaaacggcaaaagagtctttgtcaaggacatggccaagtgcctgatgccactccctggtgccgatcctcgtatcgcaccctctttacattacgagcagagggccattaacagaatggattccttgcaaaatcatactgctattcctaacccaactgtcttccctctagatattctttccggcttccattacaccttcttaatccggaaccctcgacagagtatccccagtctctaccaatgctctatcccaccgaagtcccacatcaccgggtggaacgggttcaaagcgaccgatgcgggctacgcggagctacgtattctgtttgactatcttgtgcaggttcagatcattggtcccggaaccgggaacgatatctgcattgttgatgccgatgatctcttggcggatcccgaggggatcgttgaagagtactgctgttctgttgggatcccttacgaccctcggtccttgcactggggagcagaaaaagatcaacagcgagctcgtgatatcttccagaactggatcccgttccatgatgcagcactgaagagtacttcactcaatccccagcctccgcgagttacaacccttgaagatgacattgccgaatggaccgagaagtttggggccgaggccgccatgctcatccaccagaatgtcgaggacaatatggaagactacctgtacctgaaacaattcgccatcaaaacctgatcagtaaagattcctcctgttagccagatacatacacgatgacaagtcaagctctttccaatcaatcaacctaacaccttcaccatataaactctcctcagcccattctccaaccccagatgagtctncacataccccaacctctcataaattcccacattctccaccatcatctcattcgtatacaacctgatgcgtttgaagcccactt

SEQ ID NO: 6863 - DNA, 677 bp, Aspergillus oryzae
  misc_feature (1)...(677): n = A,T,C or G
aactgctgtcaatcgacgaggcccactccagggctcctacacctctactgcggcttcatcccaatccggccgggcatcgccttggaacggatcctctcggggtctagccagaaggccaacttatagacaggggctggacgactggaagcgcacgccaaaacggcaatccatgatcatcccgtccgacatggcctaccgcagcgccagttctataccggcacccctggctgattccgaagaagaatccggtgatgcccagcatgcactccgaaaggtactccaggagaggggccgcattcctcgatcccacactgtcaacttcggctcacgggtcaaccgatcgtcacgctccttggcgcatctccgctcctcaccaccccgatttggagccgaattggatctcaatcttcaggccccaaacacgtcccccacgaccatgacggatcctgatctggcaaccccaagcaccgaccgatacagcaattcgagcaatggaccaagatgatctgtatttcattgaccatggtgggccactgatgattcatgtgaatcgtgcagccatggctacatacccaatgtgtcgtcttgagcgagccaacttgcatcggctacngctgggctctgactctactcttctcgagaatcgcatcgggtcccgcggagcgtgccatgcacaa

SEQ ID NO: 6864 - DNA, 661 bp, Aspergillus oryzae
  misc_feature (1)...(661): n = A,T,C or G
cggaaatcgaccaaaatacataggtccgcgatgcccgaagtggtctcgcgaaatcggcagatgttgccacctttcccgttcgcctgaccttttttccattcttttgtgatgttgagccagtgttgtatatcacaagtcacctggccttctcttactttctcctctacgctatcctggatatagttatggcgttttagatcctcgatctaccgaattcctgggagctatacaccaccgctcgaccgggaatcgttatgaagtgatgactgatgaatatgatgcataagtgactcgattaacagggaggggttttgactcgtggctaccagtctctttcgggtgtcttcatttcctttcccgcagtttccctgtctctctttttccatcagggtcgcgatggtttttgcatgttcgcatgttcgggcgttgtttaagggtttgtccatagcgcatgaagatacccctcggcctcaatctcgagttcagctacgaggttctggatggagtttttctactctggtcgtggtgtggctcaattgttcatggngattgccttgntnctatctatctatctatctatatatatggacgtttcctttgtgtggcgggggtttgacggtcgtgttttactatattcgggtcttgatatggttattatgcg

SEQ ID NO: 6865 - DNA, 598 bp, Aspergillus oryzae
  misc_feature (1)...(598): n = A,T,C or G
ccatccgagcccgccgcctctcgactcacaataccaacctcattccgattgctcccagctccattctctggggatgatgccgccccagcctgtctcgagtcaatcattgaacgcgcctctcgttgacgagaacagctgggatcccacccgtataattactcagtgggacatggcattttccatggcgccttccacagtgaatacaaactctcccccaatggctatggatcattcagttcaagcgcctttggcaggacaatacactgtccagtatggacaaacaacaaaggttacgccagtcacgcctcctcaggctatctcaccacctcaatttaatggacaacaagtgctctttacagcgcgtgactggcaacaaagtgttgccagtgtttatgatcctaatggcttgaaacgacgctggaattattccgtcgatataggtacagagcacactcagaagcgcgcaccttgaatatcagtatatgcaataggcactgaggactaactccgttggtgtttactttgagaaagtggctgtattgatgactcttgtgatatagaactcttcgttctaatatacccctngtctttactttgt

SEQ ID NO: 6866 - DNA, 671 bp, Aspergillus oryzae
  misc_feature (1)...(671): n = A,T,C or G
gcaaaagccgataacgcagaggatgtgattgactgggaggatgacgatgtccctgctgcagatgctgccgcagcgaagccatcgacccgagctggtgccgcgcgatccgcggtggggggcaagggccctggtttcaaaccggacgtgagtttcggaccaagaacaaggcaacaatcccggttacaacagacgaccttacggtagattcaattggggatgctgccccaatggaacaagggggaacggaagcagaacttgccgaggccgctgaaacaattgaggaacttcaagttgaggaaaacccggggccggctaatccaattggccttctcggtaacggcaatggnggaggatttgagaaaccttaaggtctcgcccagaaatttgtgaattcaggagaattcgagaaccgttctcaaaacgcggagagaacttttgagagggctacgggttgtgaagtgctcccgggaccggtatacaaccggttttaacattttgccaaaggcatttcagagcgaaaaccgtgtaagaggtctcgcggagatattgcacaggggacgcgagagagaagacagggttttctgtgaggaggacgggtctcagtcacagtctcaatctcagcaacaagtgtcaagagccggacacggcgacagggtcaacgtaacaagggg

SEQ ID NO: 6867 - DNA, 656 bp, Aspergillus oryzae
ctgcacggttgtatgcgtatgacgtccgcccattgatctctccgcttgctcattggaagatcccgtatttgttgtttctggttgaggtactcctgacgacgcgaatcagccagctgaaactctagtgagatctgctattctagatcgctatttgtccgtcattttcctactattgaattggcgatccccatctcgctcccttccgcaaacagggcagttggaatctggaatttgctatttcacttgcccttcccgtttctattccttttctcctaaatatagcaggcggttctaatccctgtcaactaggactttttctcttttttccttctttatctctttgtggaaattaccaacccttgaagccgtgtctctcagcggatcccctatctttttaccccagctttgacttctaacggatatttgagacggttcaatcaccaactacttctgtcgcatacactccgtacgcaacatcgtacactttgacatcccttcaccatgcacaaaccttccctagctcagattgtgcacaatggcaccttttcgcgcccgcgcacgagcgatccagcgacattctcagcttatattaccccgaaccttgtttcgaaagttggatcgaaacttcgacttctatggatcgctggacccgttga

SEQ ID NO: 6868 - DNA, 689 bp, Aspergillus oryzae
  misc_feature (1)...(689): n = A,T,C or G
gtgagtgagagggatgggccctcttagtcagcggcgtcacatcagagctcaagccacaaacatcagagtctcagccacaatctatatcagctgcagccacaacatggaaatcaaattggggaacgataatacgagttccggaaagcttccctctccgacaaataatcagtctcatctacagaattaatcataataataatcgtattgtttgcttcgtgcacagctgaatcgtctgcggcacccaggctcaaacttctctatcctatctccggtgacgattcgaggcggggcacttttgaccgattcgggaaggaaacgacatagattactactacatgggaccggggtacttctctgtgttgtcgataacgctgatctctcgcctacgttcgccctttgcagtttgattgtcctcggattgtgccgaagtgatcgccagattcggttcgattaaccagttcgtttaatttttcgtaacagcagagaaccccctggtcgaacagtcgccagctgccctcatgtcttatccgccatccgggagcaccgccttgtccggcccgggcaagtccttcttaccggtgttacctcgttttagaccgcaattacacggggacagtgatcgcactcgatgctaggatccacgttatcgttcaacaattgaaaagaggccatcgacgtggtgcatattn

SEQ ID NO: 6869 - DNA, 697 bp, Aspergillus oryzae
ctttcatgcagatacaagttgaccggtcgttttgatggctccaaaccttcatatatacggcagggtctttctgctattcgaatacaatccatcgtagccaccgaatgctcccaggatctccctccaattcccattgttccatatgcgctcacactatctatgggtgtgtcgtatcagcagtttcgctcgagcaagcttattacccatttcgatcgggccaaagctagcttggaagcttgctgtacacttctagaagccttagggatctcctggtgttctgcagaagcaatggcacggctagggcgaaaagccctacaccagattgatgggttaaaccttggtatccacaaccctagacaagctcacaggcagtcgccgacgcctggcagcacgctcattaaccctacaaacgcacaaagtgctgcgccggtcttaccgctctcatcttatcagcgcgatgaccatccacttgctgacgtgtctgctacccaacaaattccctcacctcacggatcgttggtccctccagagaataacatgcaagtttatgagaccgatgggtttcgcgatattgacgtgctttttggtgacttcttagatttgctttaactacaaacttctgggatccggttttcttgccctgaccaacagcataggggaacgtgatgttactttgtaagaaaagattttgggaagg

SEQ ID NO: 6870 - DNA, 650 bp, Aspergillus oryzae
  misc_feature (1)...(650): n = A,T,C or G
gcgggatccggttcgacctatttcaagtttaaagaagagcaacttgaccagcgacagcaggagcaacaaggcctcttccaagtcaactttgacctcttcgaaggcgttctgagccagacagccgactacagggccattctcgacttatcggaggaggatgccgagttgattgacgctgcatttgatcagcaacccatgatgcctcctaagccgcttgtcccagcctttcccaaaagcgggcgcggcgctgtgctctttaagcaatccgagaagaaggaggaagatgaagtgaatgggatctacgtccggaacgagcccgccaaacgggcagtcgagctcaagcggcctgacattgatgatggtatatgatgatgggtgcaataacatggtcggagaaagagagagagagagagaaactgacagacanacaaacgttcagatgacctggatgagctattagcactaggcgatgataaaaagcagacatcatcatctgttgctactgcttctactactagtggnagcagtaatagcaatagcaatagtaccgaaaaaccgctacaaccgcctatggcgaacccatcaaaggattcaantgcaagacctgggtcgattccgaagaaacgcagacgatacaaanaccaaagcgg

SEQ ID NO: 6871 - DNA, 730 bp, Aspergillus oryzae
  misc_feature (1)...(730): n = A,T,C or G
naaagtcgactctgttgaatacggccgaggcgaactacgcatctgaacggtttgataatcgcgacgcgagtaccatgggtgctgtgctctatgaagctgcccacgctgcggcgaccaagtcgacgactagcgaatcatccgaagatggtgtttctgacgcaccctctatcgatcgtcggtccgccaagaagcgcaagcgtgacgagcacgtttagttgcccccactgccgtttgcaacttcacgacgcgatgtgaccaggagctccccccttactacttaatacactatcataattactccaccattgcactggttggtctggcttttgtctttgcggttttggcgtctgggcatttacattggcggtgtcaggtgggaggctaaggtgtctggcaaaaggatttcgtttctcacaggggaaaagagaaacataatatagcacatggtcttcacaaaggaagatttacattggaggcattagaccggttgtctgggcggcaacggattcggcgcactgggagtccacggtttggactaaacttagagcgcatgacgccttctttgaggcacaggtggtgatttgggatttttctttttttctcgtcgcattttctggcaaagatgtttttgcctcgatcaacagaatggctcgagtcattcttcactcttcttgtacccatnnttctnttcttttnttttttttttccctctttttctcttctctatacc

SEQ ID NO: 6872 - DNA, 67 bp, Aspergillus oryzae
  misc_feature (1)...(67): n = A,T,C or G
gtgggcttcctcaaatacgcattcactcngtagttcaatatttaggtacatacgaagtttcagatgc

SEQ ID NO: 6873 - DNA, 765 bp, Aspergillus oryzae
  misc_feature (1)...(765): n = A,T,C or G
ggcctcaagtcgttcgcaagaaggaagtcgtaacgatacctccagtggatggtatatttgaagagaagaagaaaaaaaaaaagaaaaacaaccaataacaacaattttcgactgctacgaagccatggaaacgagatgcaagagtgttatgagctgcacgatctgtatagggagttgtcggtcatcaatgactgccaatggggtagtgcgggttgtcagttttgcggattcaatcggacgggcctcacacttgacagtcgataactcgcaattcttttatttatcacctgaatttccctttgcgaaatacaacatcacggctttataaactatctggggcaacccactaagggaattttctttggcgnttttctctgttgtgttttgtctccaatatccagtcttccataccactgcgtttttgggttacttcatgccgttgcaaacattcgagccctcatttccggattcttctgtttgaccgagtcggaacttgagatgtcacccatcggggtgctgctgggtccgctgtgactggcaacctacgatggtccataatctgcacaccgaatcttctggtacatgctagaaagtttgtattctctgagtatgccaacgaatctggaacagtgacccanatcggtgagtatggctcangcatgattaacacaatgagtgttgtctgcactggacattgatacctctcagcgtcgactattgacgaaccaatcatagtgtggaattttgctgcatttacctctcttc

SEQ ID NO: 6874 - DNA, 678 bp, Aspergillus oryzae
ggtgatataaataagaacctttatggtaacgagggatcaaccgacgccaccaacgatgggaaggttaagtaccacacatgatgtattccttgcttgctgtctcggcaccgctacccacttgctgttccagcccaagctgtcacgcatgcaaagggggaaaagggagacccgctgtttgctcggtgatcggcgtgggtgtaccagatggagcgacgcgagtggaacaaattccatcaataaatgcgacgatgcgggaggagctataatggatcctttccaaagggaaaaaaaagggaaaaatagcaagagagccaattaacgtcatacggaggaaaaagcaatgacgatccgattcgttactcgtagactaacggcgaactcggtccagcaaccttctctttcttaaggtactgtgttgtgagtcagtgcacattgttgctcggcattctgagccatggcttgagaaagtccatcaggtggcctggtgagccggttaaaaaggcatttgccccgcaataacaaccctggcgcgcgtgggttgttatccttgggccttgggtccaacaaaaaaaagaaaactgggggaccctttaaacaccaagggaccattaggtctccgggggaaactgggaccctttgccctttagggtagttcctgggaatgattacaaaacccat

SEQ ID NO: 6875 - DNA, 674 bp, Aspergillus oryzae
gctattagtggctaggcgttacttcttcagacttttgttttcataactattatatgatgttgtgtcatacttatcggtgcctgagctgcttgacctgagatgtacaagtcaagagctttcgcagcgcctggtattctcgagtctaccacagtctttttggaagagccagtttgctcgaggctccagcatggatttcctattccctgatctcgaacagtcacgcgattggttccgtttatatcgcggtacattggctatcctttatgccaaagatcaatcgcctgaacagctctccctgctcaaccgcaagataatccgcgaggtcctgtaaccggtagcatctgtcgtataatcggacagtggacggtttaaagaacctcacgggcgcccggcgaactgcatggtattaataccttggcaatgtatacctttcacatgggatgtatgttcctagctaccggaacggcgcgttcccacagtctatgtcgcggtgtgggaaaaatgaaagtttaaactgtggagctaagtgcacgagtatttatttatccgacttagtcttttaagatagggcctcgctgtcattgtgggttggccggctcgggaacattaaaggggcccccttacagctgaatataagttggattgaagtatcattatgttcccataggctggcg

SEQ ID NO: 6876 - DNA, 712 bp, Aspergillus oryzae
  misc_feature (1)...(712): n = A,T,C or G
ctccacctcgaaatcaaccagcaatacccctcattcgaaaatccccatctgcgcaaaatatctcattctagccggcgacgtaggccgcctaacagactacgaccaactacctccacttcatccaaaaacacacatcccgattcgaactcgtattccttactctgggcaaccatgaattctacaatctgtctttcgcagaagacctggaaaaggccaaacagctggaacaggaaccctcgttacagggacggttagtcctccttcatcgacgaggctacagtgcaggcgaagaatcaaagatttccagaaaaatcacaagctggacgatttcgatgaccataatcactatcacgaggcagatctcgactggttgcttaacgagatccggaccgctaatacaccgggaaatgcgggcccagaagcaatctattatagtcgtgacgcatcatgcgcctttgagacgagggaggtcgagtccgcggcacgcgcagaacgcctggagctcggcgtttgggactgatgttttatcagatggtttggatgggatccgaacatgggtcttcgggcatacgcactatacggactgatttcaaggaaggggggacgagggttgtgagtaatcaacgggggtatgtgcttncttggagtaagacgaatggaaaggatggggtttgatgttgggacggtattcatgtgtgaatcttggtggggg

SEQ ID NO: 6877 - DNA, 651 bp, Aspergillus oryzae
gcgacaatgtagtactggcctgttgcaaccggccaccgacatttgcgagcttatagcgtgacaagcattctctctaagtacactggtgatggtccgaataccgtcattctgaatacttacactctctctgaccgagcgtatgtagctctcttcacgtcgatcaatgcgctgcagtactaggcttcacatccaccaatgcggcgaaccctattgtaactgattgatactcatctatccgactgctgcgacctctactctgggaacatcgcaacgccacatatccgtacgatgggactccatacccgttcagactttgatcgagaccctgcccgagactattgggaacttactgagtactcgtccctgcctcatgatctcgtggctcgcagtgatcagtagatgatgcttttggctatggtgcaggatgatgatatgccgtttattgatgtgccaccctaggcagcgatcattgatactcaatgctagatgcggtatcggagacggcatgttccgtccgctacgatggtgcgaagtgctgattgaactgatgctgctcctacttagactggcgacatgcatgttatgtcgactgatgctgatgcaacctcggatgggatggctgacgctccgacttcggaccctaccgatcag

SEQ ID NO: 6878 - DNA, 658 bp, Aspergillus oryzae
gtccaaacccaacacctgccctttgagcgattctgggttactgactcgcctgcagaaaaaccttccgtttgttttggaccagccaagagccaagacgtcatctgacgtggttagtcaattaaacgactcacgtcatcattgaatcgattgtttttcgtttgaccgtcgatctatcttgaagccagagctactatccactaccatacgactttatatagcctgatggcgcggtaatttcttgacccatataaattggataagggttcgaagaggaatgtgacacgtgtgattggcttatcgcgtgaacggagatagacatcccgtcaccaggtggatcaagagtcagatctgatattgcaccgacacgctaaattcgactcatactgggaacattctccatttggaatatgggagcactaatgagcagcatgggtggcggtgttttcctaccaacaccttcagttgtgcccgccaatcactttactcctttccagttctgccaattaggtgatatccagcttggattcggacaggatggttggaaaaatgacgtacacagaatgcaactcgccgcgcagcaagtcaatgcggaggagttcgacttgtgcattgccgtcggtgacttaaccaacaggcgacattcctatgaaatcaccgc

SEQ ID NO: 6879 - DNA, 658 bp, Aspergillus oryzae
ggcgttaaacgaacgatctgtatatattttctagcattgggatgtatctctattacccaggtgatgtgattgactcacctttcgtaccaaacagcgttgatgatcagttatggtcggacggttatcctcaccaccccgctcatctgcaggctgcgatcgaggggtacaaatggctcaacgcctcgaatatgatggggatcgggggactttatggggatggcttccatatcagcgggtggaagagcgctgaagagcctggcacccgcaagtgtgacgtcctaaataagatggtatacacgtataatcaaggagtgatcctcagcgggctgaggggcctctggctggccactgcttcatggcagtacttatacgatgggcacgaccttgtccgcaacgttataactgctacagggtggcacaacaagaaaagtaagaaatgggccggccttggccgtgggggcgttttggaagaggcttgtgattcggggggcagttgttctcaagatggacaaacattcaaagggatcttcttcaatcatctagcagaattttgtcgacccgtccgccctcaggaaaacgcttcctggcgagtgcgaaccagacgacgggaccaggcagcgactgggagtacatctatgattggcatcaagcacagtgt

SEQ ID NO: 6880 - DNA, 672 bp, Aspergillus oryzae
  misc_feature (1)...(672): n = A,T,C or G
ctttcattgaagcaagcggctctccacgttatccatccaaccgagtataccaacaaggagctgacctccaagcgttacaaatcaagaaactgcaaatacctaatgggaccggagttgagggtatagacactgcaacaaaccaggcggtggctgagttcgagaaacgtgaacgccagtctgattatgacaaccgcttgacgcacaaggtctgggaactggccaccacgaatgcaaatccggcggtggacctcgtagtttgcttggaacgccgacaaccgattggattccgctatgtcgatatcacccgcaatgtcgttatacaccatggaagcagagatacgcgcgttcccgttgataatgtgaggtggcttggccaaagtatgcgacgctgtgaggttcgaatcctcgagggagaaggccatgggctgatggcctcagcaacagttatgggtaatgtcttaatggaaattgccaaggagtgggaagactggatgacggtagtccagggtaagcgtcgagcaactataggaacaagatcaggcatcgctgttcaagcctaatttggttgacaagatctgaaattgctgcgtcgaagtcatggaagattcggaggaatccggagaactaaggatagggaagatccgaaactaanaagaagaagaagaaatttgg

SEQ ID NO: 6881 - DNA, 447 bp, Aspergillus oryzae
gtaatctcccttgcgagtctgtgccgacgccgtcgctggccggagccccagttcgaggcctatgaaggtcctaccgggtatacctgcattgttcgcgtcaacaatcgggaataccagacggacactgtttaccaaaacgaaaccctggctcgagagaatgcagcaatgcgagcatacctcatctgtcggaatttctccgtcaacgatggcatgtatccagctggacatgaccacggaggaatcgtccagggaatgcctgtggcgataggtactggacgaaaggcccgctatgatgataccgatacatcgaccagtggaggaagcagaagcggagggagcagtcccgaaagctacgagggaggacgattcgttcaggacagacccgctgtgccctcgagggccctcgcattcagcagccgtggaatgtagtctcccctgccctcctca

SEQ ID NO: 6882 - DNA, 255 bp, Aspergillus oryzae
gggaccacggttaccccttaccctatattcagtgggtgcaggtgaaacttccgcatacaacacgcttaatgactcactaatgcttcaccacggtataatttcggcataaaatgtctgaaggttatgctcttcggagggagaagtcctgtatggactatgaaacggactgcggcacaacctggaatgattttgttgcatgttgtccctccgactcatattgcccgggaggagagagtacaaccgtctgccggaagt

SEQ ID NO: 6883 - DNA, 666 bp, Aspergillus oryzae
  misc_feature (1)...(666): n = A,T,C or G
ggatgacaagcagcttcttgcagtcgtctcgcagccggcggacaaacaccctcagccgctagacttcgatgaaccacctagaaacgtggaagagattccgcttgagaggcacggtgctttgcttcttttggctgcccgagctgcgatggccgaactattctcatcgggacaggtcaccccgattgccgtcttccctgagctggctcagatatttgacaactttgtcggtgctcacgataagccggacgagattgcctttgggcagcctcaggcactactggactctttgctgacattgaccgtcttttctatgcaacgatcaatcggagagccttccactgagatagagttccgacgcttcatcttatccctaactgcttgcacaacgcgacaaagttacaactccatcagacgcatccctgggaacattctccacagtcacccgtctcacattgtccgcttcaagactattcgcctggtccttgaagatgatcgtttcaanctgatcanggacagtgctatanggtggctgaaagatgaaattcctgatgctaacaaaaagcctctggctcaccggaatccgacatattcatcaacccacatttacttctcaatctcntcnccttactcttcaactcgtcggagttactcctaaacgtctcctcc

SEQ ID NO: 6884 - DNA, 641 bp, Aspergillus oryzae
gaagtataaatatctttattgagtcgattcctaggtaacgggactcaagtatacacctccacagtgcatttggtggcctttgggcaacagtaatgtgataatggatggcccctccactttgttaatgtgcgatgggtgtgaggggggcgagagacattttaactaactactagtactcgagagtgtcagtccgacttgactttgtttaagtcaccaatggccgaagtaagaaatgcaagttgattgtgcttgctctgactataatacattgattggccagatggttggtttctttgatttaggatgggaggcctaattgcctcatcccgtattcaattcaggcaaaagagatagatgggatcgcggcgctatctctagctctatcgacgtcctcgatgtgttagaacgctgcgaagctactatgttctcctcactgaggggcagtcagcggactacacatttctggcttcgtgctcttatctactggactttcgtctcgtcgctcgtctgcgctgaaacaccattctcaccagtcatgggcggactctacaaggagcttccttgaagggcttgatgaggtccatgttaatatcgctggaggcggcaccgcgggctgggttcgtggcatctcgaatgaccga

SEQ ID NO: 6885 - DNA, 537 bp, Aspergillus oryzae
cgaggcggcacgagggaacctggcgttgaagacattcacttgtctatttctaatttcctttttttttttttttcccttctgtattgaaatgatatctagccagctctttgttatccgcatcaccgatatccatcccatgacagagcagcagttcattgttccctcactcttacatgagggcgggttgaacattgaataatttatgccttttccttttatctttttttcctttttttttccactccagcattctcatttaatttcgtgtctggttaccctatccctcattcaatttcctctttagcttacgttttggttttgaacgctggatatcccatcatctcttggtgccctcgtgtgtacttatatcactcatatttcctgcctcacgtccgctggagcaatgagcgacgacagggccacgggcacggggaatggcagggtacgtggactatcatgtctttttctcatgtgtcatgccgggtcggtcattgggtcatagtcaaaactaaggattgtgaaatatttgttcgtatt

SEQ ID NO: 6886 - DNA, 245 bp, Aspergillus oryzae
atctttacggaaacgggggtgtgtgattctaagcgccgtgaccactgccgcatacgaatgaaaaacataccgtttggatctagtaccactctggtataggttcacttcttgagactaggtataacagtgtgatcctgttgaaccccaaaccattgtgaaagggataggagaaagagggagtctttgataatagcaaaataagaggtaccagacctcttgtggcaacatttggccatttgctctgg

SEQ ID NO: 6887 - DNA, 661 bp, Aspergillus oryzae
  misc_feature (1)...(661): n = A,T,C or G
ctctctggacttctttctttctctttcttcccccccttcatcatttatcgtcatctcctttgtcttcattcaactttctgattatattccactgatcatatttaatctctgtccaactctcatgtccatcctctaactccttccaccaacatcatgcagctccgttcgttccttctcgggagcgccgccgttctaagcgccaacgctttcctagtcgttccggaagtcgaagtagaggccatcgcctctgaacctgaatttgccggtctccatcctcttgaatctcactcttctcagcaacagaatgtcgatctcctctgcactgagtgccctttcagagaagtcaccgaaaatgggaaggtcagctggactgacggtttccaaaccgctttgtctctgaacttctcgattgaggatggtaccttactggccaacggccgtcagatctttcctacccctcctcccaccgtcatcaccgntgttcagcgccgtctatcggatgaccaggagtcggagcctatcccgttgggatatgccgtcgagatgttgccgctgccttctccgccagaggaacctatcgatctggtcgctggtcgcttcactgtcctcgacttggacagccacccactcccgtttgacaccgtatcaattcagctgcttc

SEQ ID NO: 6888 - DNA, 638 bp, Aspergillus oryzae
  misc_feature (1)...(638): n = A,T,C or G
ctcgacttcctcctataaacggaccaaccgatcccagcagcctcgaatgcaagtttcttcctcatctgccgtcaactctactcgtgaccgttcgttcggctctagggctcagaacatgcggactaaggagaggccatcgcgtcgtggcggcgtcgttggcgagagggaggtgacattcacacctcatgtgaagtcgaaacagaacagggccccggcaccgtctcgggatacaagtttcagggcaaaggagagacgcagtgcttccggcaacactttccgaaagatgtgattctgcaagatttgacgaagtttatgtcaggtagttacgatgcacttccatttatgaggagctttcccttacaaaggtacgctgtactacgggcttcagttatgcaaacgctatatcttcaaattggggtctattggaccagactctgatgagagggtttccatgatacctctagcataaaactcgggttggcatccaacatagttgccagtgcaccatatacagggcgtcctagccattctccctagcgtgacgtattcgaacagggtacgccatcatagaactccgaatcccacatggatgccctgngcttatcatagtttgagcttccgggccctctatatcaaga

SEQ ID NO: 6889 - DNA, 659 bp, Aspergillus oryzae
  misc_feature (1)...(659): n = A,T,C or G
catgcttgatcttcgtcgtctggtcttggagagtggtaaaaccatctctcgcaaagctgcttcgcgtgaaggttctcgccgcacttcgcgcacaaactctgcgcaaaattcccaccaatcttctcgaaatgcaagcaggcatccgtccgacgaggaggactctgggaatcttagtgatgacaccgcgttgagcattggctcgctggacgatttgacagataaccctgaggttgacagcaacaattgggctcaagagctccgcgatgtcattcaagaaatcggggaccgcaaacgtagcagcgtacagagccgcgaagaatgctacgctgcattctgtcgtctgctgaaatgccactatgtcgaggaacacgttcgaagtagcctcgacgaacttttagacgccttttgccggagcatcaaacttgaatccagtgtgcgtgagactaccttggcattgcgagcgcttgaactccttgtcatcaccgtgttcgaagacaccaattatagaaatgttgaacctatacttactcgaactattcgagactcgacatccaatcttgttaaggctgctgctattcattgtctaggcgcatgcgctattttcgggggtgcagganaagatgggatcctaaaccaaatgacattcttcctggacattg

SEQ ID NO: 6890 - DNA, 704 bp, Aspergillus oryzae
caccaagcatattccttggaattattcgtacggctgaagcggcacaatatgacgaacaatatcgacatccactatgcctctgagtctgaatcggccgccctgggtcatattaatatagccagttttagacacgggctagtgtgggtaaatgctttgccggggatggatcctgaagtctgtatgccgatgaaacatgctcgctgtcttgagaaactcgccttccctgatattcatgtcttcttcgcggtggataccaatgtccatcgggtaatggggtatgcccgctggaaaatcccctgggaggaaaaaaaagtcgagttattcaaaaaaggccggaccaaagggggcaaatgccccaagtttaaacccaaggggaatagaagccacattttgggaactgagctttaagtttatgaaagagaaaagagggggttcacaccacaaaagacaaaatgatggttggaattactaaccgtttttgccccaattccaaagagaaggggatgggcccacaattgctctctgggggaaataaaaggttgtttcgccgaaatgggccaaaattatttggagggtattatgaggggaaccccctcttacccaaagtccggtggggccaaaggggccaaatataaaaccgtttttcccttcccgtgtatcaagccgaatcattttgtaatgaaaaacaagaaccctccgatgat

SEQ ID NO: 6891 - DNA, 667 bp, Aspergillus oryzae
  misc_feature (1)...(667): n = A,T,C or G
gattactcccagcggcatctttgtgtaatcccatcactcagctcctcatacagactgtattgtccctcgatcggcattcgtatacacacttgagctcttctatctgcactacctgtcgtcttcaccacatgttgctacgacctaaggagcagcattgcattccaactcccagatactccttgatgttgtcactgatgccgtatccagcttcgaccgatccaacatactaacacaagctcatcgcatgatgtctactcatgttagcgctgaaagtgccagtggcctggctttagactcaacgactccagcgcttactgttcacgcaacacgcggtttcattcagtgaaactgtttcaacagtgttcgatacttgagtcatgcgatctctgatcctagtcacagtcctcaacataggtcatgtgcagaagtttcctcatcatacttattctgctgtccgtgctaatgttcagtatcttaccaagctagttgcatctgactctgtgatgacatcctcgacttcatccacatgttgctcatgatgtgcatgatggaggaaatacgcgtcnattgtgcagttcaatttgtggatgtgcaatatcggttctgctgctagactacactcatctttcccgaacacgatccgtttgtactgtgactcgattatttt

SEQ ID NO: 6892 - DNA, 687 bp, Aspergillus oryzae
  misc_feature (1)...(687): n = A,T,C or G
gaggtcttcaggccagtggacttcagggagtatcttgagaccgtcgttcgaggcacagcgaatggtgtatacaccgaccgtatggtttcgaaagttcatcagcgggcattcccacgcacagagtcgaccgattcgttgtatactcggatattcccaagaactgagtccagcgactcgctatacatgcggtaggcgcctgtatgatcagtttgaccttaggcaacggatgtttattttcctcactttttgcgatatgggtttagactggcgtttatgtttgtttgcgttaggggaaagcagacgataggacaggctattagaacaccactccgccttgtatacgggttcatgagaatggtaaaacacatggtatatttaaaaaaacaaaacttctagaactttctatgacttgtaagctcttttttttgggcttcattaaatggggataaaaaaaaattccctgggggcgttaaaaaatctttttaaaggggcctataccgggtaactcttttgggaccccctttaattttaaaccccttcccccaaaattggttttaacccaaaaaggagtggtttttaccacccccgaaccttgagggcccctttgttatttttttaaaactttttttgggtcttaataagagttttttatatggtggaaaatcttggttattaatgttgtgcccn

SEQ ID NO: 6893 - DNA, 657 bp, Aspergillus oryzae
cgaggccgtgagcaacggaactggcgccacagaaagacagctgcctatcgacgagctcgagcggtacctatcccaagctctagatattgaccaccgactcgagagccgattctcggaatgctcaccagagtggcagttcactgtcatgcagctcactagcccggaccctacccgggttcatggtgacgcttaccatagctatcacgatgctggaatcgtcggagtttggaacgatatgcgtacatgtcgcgtcttggccaaccacgccatctgccatcttctcctaaggggagccaagtcggaccccagttggttcttctccaaaaattacaccgatcaactacaggaaaccagtcgaacaatgaggcaaattcgcgatgacattctggcctctgtaccccagcagatgagctacttccccttccccgcccaggcgcagttggagccagtgaacctggagcagtatttcaatcaaatgacggtaccgggcaccaagtggtctgatgattcgtgggcaactttcaacagctcacctggcttcgagcactctacgtatacaggcgcaagagttggtgcggatttccccagctgggtgctcttgctggccggtgtttgcacaccaactcagaggacccgcgaacatggatagagcgccct

SEQ ID NO: 6894 - DNA, 1047 bp, Aspergillus oryzae
gatggcaggaaaagaggttcaaccagaaaaaagtcccatctaccgttccttgggtcagtttgacctaggtatacgattttcgtccttcccgtacacaggccctgtgtccggtccggttgcagttccttcccctcgtactctcgtcgcccttccgtcgcatcccgttgcgcccactggtacacgtcactcctgcgcaaagcgaaccttcaaagataccgcatcatccattttcagacgatctcgcccaaactttttttctttctgatttctctgttatcctttcgtctcgttcgcttgcatctagcttcccatacaaaccgtagctatgcatcgcacctattccatgcgccaatcgcgcatgcccaccgcatcgcagattgagaatccgcctccgccgttgtccacgaccaagacaaaccgatggattgggaaaggcggcttcggccatgccttccgtaagaatgccgccggcgcattcggacccgatcttgcaaggaagctctcccagctcgttaagatggagaagaatgtcatgcgcagcatggaaatggtagccaaggagcgtatggagaccgctcaacaactgtccatctggggtgagaactgtgacgaagatgtgtccgacatcacggacaagatcggcgtgttgctctatgaaatcggagagttggaagacctctatgtcgaccgttatgatcagtaccgtgtcaccatcaagagcattcgcaacattgaagcttccgttcagcccagccgagaccgcaaacagaagatcaccgatgagatcgccaagctcaagtacaaggacccaaactctcctcggatcgtggttctcgagcaagagctggttcgcgcagaagccgagtccctcgtagccgaggctcagctttccaacatcactcgcgagaagctcaaggcagctttccagtaccagttcgatgcactccgtgagcactgcgagaaggtggccatcattcgttgctacggcaagcaccctcttggatctcatcgacgatactccagtcacccttggtgaaaactccgcct

SEQ ID NO: 6895 - DNA, 1212 bp, Aspergillus oryzae
  misc_feature (1)...(1212): n = A,T,C or G
gggtgccctcaaatatcaccctgacaagaacgcaaacaaccccgatgctgctgaaaagttcaaggagctctcccgtgcctatgaaattctctccgactcccagaagcgttctatttacgaccagctcggtgaggagggtctcgaaaatggtggaggcgccggtggaatgggtgctgaggatctctttgcccagttcttcggtggcggcggtggctttggaggtatgtttggtggtggcatgcgggagcagggccccaagaaggcccgcaccatccatcacgttcacaaggtcaacctggaggacatctaccgtggaaaggtttcgaagttggccctgcagaagtctgtcatttgccctggctgtgatggccgtggtggtaaggaaggtgccgtcaagtcgtgtggcggctgcaatggtaccggtatgaagactatgatgcgccagatgggacctatgatccagcggttccagactgtttgcccagactgcagtggtgagggtgagaccattcgggagcgcgatcgctgcaagcgctgcaacggtaaagaagaccgttgttgagcgcaaggtcctccacgtccatgtcgacaagggtgtcaggaacggccacaagatcgagttccgtggggagggtgaccagatgcctggcgtcctacccggagatgtggtcttcgagattgaacagaagcctcacccccggttccagcgtaaggaagatgacctcttctatcacgctgaaatcgatcttctcacagctcttgctggcggtaccatcaacattgagcacctcgatgaccgctggttgactgtgaacatcgcacctggcgaggttgttactcctggcgctatcaaggtgatcaagggccagggtatgccgtcattccgccaccatgacttcggcaacctctatattcagtttgacgtcaagttccccgagaaggatcagctcaacaacctcaaccttttggaacaggttctgcccccccggatggagcagcctcaaccacctaccgattctatggtggaggacttcgagctggaggacattgactctagcgagtactcccaggcacgcgcccatggtgctgccggttccatggatgaagatgatgacgacgttccttcctgtgctgagagagtgcaatgcgcctctcattanaaccgngggctttctgtggttgataaaggtgcagggctagggcattactgag

SEQ ID NO: 6896 - DNA, 659 bp, Aspergillus oryzae
  misc_feature (1)...(659): n = A,T,C or G
cgctgccagagaagaagtacccggtcgtcgtggttaccccggttacatgtacactgatttgtccactatctacgagcgtgctggacgtgtagagggtcgtaacgggtctatcactcagattcctattctgactatgcctaacgatgacatcacccaccctattcccgacttgacaggttacattactgagggccagatcttcattgatcgtcagctgtacaacaagggtgtctaccccccaattaatgtccttccatctctgtcgcgtctgatgaagtctgccattggtgagggtcgtacccgtaaggaccactctgatgtgtccaaccagctgtacgccaagtacgctattggacgtgatgccgccgccatgaaggcagtcgtcggtgaggaagccctgtcctccgaagacaagctgtctctcgaattcttggagaagttcgagaagaccttcattagccagtcgccctacgaatcgcgcagtatctacgactccctagacatcgcctggaacctgctccgcatttaccccaaggacctcctcaaccgtatcnccaagcgcgtcctggacgaattttacgcccgctcttcccgtaagatcccaacaaggatacangggacaacagcgtttctgaacaaactcagtcgtcgactggtga

SEQ ID NO: 6897 - DNA, 746 bp, Aspergillus oryzae
gtgggatgacgaccttgatacgaactcggcacgagggcgaggtctaccgacagcatctacgctggaaaatgaacttgagccgcgttaggcctttctatgcggtcaagtgcaacccggacccggagattctccgcctgatggccaagcttggtaacggcttcgactgtgcgtcgaaggccgagatcgacatggctcttgacaccggcattgaccccagccgcattatctacgcgcagccctgcaagaccaagtcctacctgcgctacgccgcgcagatgggcgtgaagcagatgaccttcgacaatgccgacgaactgtacaagatcaaggcctgcttccccgatgcggagctctatttgcgcattctgaccgacgactccaccagcctgtgccgcctgagcatgaagttcggcgcgtctttggacattgcccgccaacttctggagttggcccacgagctcgagctgaaggtcgttggcgtcagcttccacgtcggctcgggcgcggaagacccgactgcttttgtcaaggcggtccaggatgctcggatggtgtttgaccaggctgctgaaattggtcacgaactgcacaccttggatgtcggcggcggctttagcggagacacatttgaaaagtttgctggtgtcctgagtgaggcattggacacgtatttcccgcctcatattcgtgttatcgcggagcccggtcgctactacgtcgcgaacgcctttcaccctgccgcaatg

SEQ ID NO: 6898 - DNA, 685 bp, Aspergillus oryzae
  misc_feature (1)...(685): n = A,T,C or G
cagtcctcagcctttctttgtaacgatgcgctcaagtcaagacttatcgacaaaatgaagaaatgaagataccccgccaaagaaaggatactgaacacgaaaggaagacaggggaaaaaggtagaaaagagagggcccgtcattcagcgacgatatccgaaaatgccaagaaggaaaacgaaaaggaacataacccgtgaacatacctggcatggtgcttgaaggcgacgttattctaatgcgatatcgaaactggtttacaacggatgtcgaagcagaggatgttaaagaaaagagtcgtctaagaagaagaaagggatcttgttggggaagaagaatgttgttctgtcttggcagatggtgccgcggaaaagcaacgcaaaagaaggcgactttataacgcccggtgagcggcacaaatcgggaaatacggcaaagcctgtgggcagatccaatcccccctttcacgtctatctatcgacgttgcgtgattgcacgagtgatttatctcgcttttccccatttgagatatcttctaccaactcttgggggtaactctcgcaccgacaggaaacttcttttgtcccctgaagcaatttcccacgntgatcgaagatgtggggtgtgacctgaactgatcgggtatacaaagcacccactggattccatgaacataatcgatgtn

SEQ ID NO: 6899 - DNA, 671 bp, Aspergillus oryzae
cggcacgaggcaaccgtgtttatagcaacctaggagccaagatgggaaagcgggtacgccatttcgtcggggtggagagctctgagcagctcgctttcatcgatgagcttcaagccgctggactcaacaacacaatcaatctttccgaacttgtcgtcggtcgggaaccaaaataccggaaggaagcttggcctttcagctatcaaccgaggtttctttccaagttaaggacactttgtgcacttcgtttccgattcaaatacttgtttcgaccgacttccgcggccaaggaccttcccgtaaaggttacattggtcccggttccattgtctgaggaaaacaatgacctttttccccggttgaaggattcctttatcgaaaaaagggatctgacttcgaaggtcatgggggagattatatataacgcaccgaagtgtattttcggagaccaaaagtcccccaaacattagactctcagagacgagacttttcaaatagagctctcgggccatgaagaagtgctctggactattgctgacctgcccggtataatacgccgaaagatatcgaccgggggagtagatggatagaatgacgcccgtagtggagtaaatgaatagcctgatgtgcagtaaaacgcagtagtcgcagaagaactggcttcttcctaa

SEQ ID NO: 6900 - DNA, 651 bp, Aspergillus oryzae
aggaattttttttttttttttttcaacatgaacaattcccttgatggtattaacagaaggagaaaaggaatcaatcgttaataggcacaactatcgtaacccgtgaaccaagaagtatgtaaaactagagactccagacctctgatatgatcatatccagcacaacgcaaatgcgcctcatccgaaaattttctttcaatagccagccgtccagccggcaacttactgtacgccggtaaggggaaacaaagcacgcatgatttgatcatcggtgtacatgctttccaagccgagaccagtaatgagtttataaccgaactgtgcctccccgttcgccttgtatgataccaaagaccgaagagaaaaaggaagaataaagcatgaagagacagatacctcacaaatacatatcgttggataatgttgatcccaaaatgaaagtagatggtacatataccagagcgtatgtgactcaattttgcgagtatgatagtgcccagatgccttgctcgtcatgacgtcagttgcaatggtgtatcatagtagatatgggtatcaaaaactgcagcacgcgattgtgcattatagtcagatggcaaagattttaatttgacgcgacccatgatatcctccacggccttttgggttaca

SEQ ID NO: 6901 - DNA, 663 bp, Aspergillus oryzae
  misc_feature (1)...(663): n = A,T,C or G
aacacttgacccatgataccctatatgatgagtacctggcaggcgatgctgaatcagatcggcacttctccttctgctcacaaggagtgatccaacccatggaacaacctgtctcaccccggagtagtttctctccgatcagcaaatgcaactctgaagagagcctaatcttatcccgtgcggcatcaattgtccgcaagcaccgttcttccgtctcgaccactagtgttccggagcttgtgcacagcttggcaaatagccgagagttgtccacggtagaccaagccacctcaggcgatcactctctaccctccgggcctggacaaccggagccgtcttatcatcgtcaaacgaaaagcctggcaagagatatcgagactcangttgcttttcgagctgatggcagtttgattcttgaatctgctgggctcatgccaaattcgggtcctgctatccatgatcgggcagaacctcatctgaagtagaggcgaccaaggctgaactccctatcagaggaacacatncgcgaaagggcagacatcgtactcgctctttcgctcccgcaacttccactacgtgcttgagtgcaccattttatcctgaancgtaactggaataanggtctttctttatcttgtcccttacacttatataaataccgan

SEQ ID NO: 6902 - DNA, 660 bp, Aspergillus oryzae
  misc_feature (1)...(660): n = A,T,C or G
tggagacggtcttcagagctagttgtattgcatgcgacctggcttgtccgtatgatcgatatggtctcggaaaggaaaatgcgcctgattgatcccttctttggacacgccgcggcgattgcagccacagtacatctttattattgttgcgcagcggatccacgactgaagcaaaaatcaaaaatcgagtacatgaactatattcgtgtgcacatccgtggtgatcgctttctctgcagactgcaaagcttatgacgatactctgtgcatgatgacacggattgcatgcggctcggaaaatgtgaactacgactggatgccgtccaagatccacctgagtatcncgttgatgtgggaccttctccaaatcaactgtatgccggagcctcgggagatgtctggtggcttattgcatcccacgctgatacccgccatttcacgagacgataccggggaaagctcctgtacgctagaagtcattgtggccatgtcacctgaagtcactgtcaatacggcagatggcggacaggccgcccatatgcaaccgagcgtgaccaacatgtcctcggtgcaatcttcaaccgaacagcctcgcgttcgctgacaagtttggtcgcgccggctgacagtctcatgatgaatacccggtggctctgaagg

SEQ ID NO: 6903 - DNA, 658 bp, Aspergillus oryzae
  misc_feature (1)...(658): n = A,T,C or G
tgactctttcacgcangttaacaagatcaacaccaaggtaaccaaccggaaccctgaagttgtgaaaacggcaaccgccggcctcccaacaattaacggccctggccttggccttggaaccaagagaaccgtcaaggaaaacgggtccgcggcggtgttgttaagaaaaaggaaggaatctcttggtggttgaaggaaagaacatttggaatcaggtcacacgtcacaggacctcagtgacgtatatggcgctttggaacacgctgccgccgctggtggtggaaagagaatatggcacgataggggataatatctggccgagaacggacattttgtctggcgcgatctccagcgtgatgtggatagactcgcctatgagaagatgttgctccatctcctgatgttgcatcactgacagatgcacacgtctcggagctgaatgattttgtgctgtattcttggagaagcatctctagacggcatgctcttcgtaacaagatagtgtttgggtcggcgacgagcactgctactctgaacgatctactcatgacatcgtcgtcttgaggctacgaactgtgtttgctgataagctggatggagcatgactgtagtgctactagcgtataatgatgaaattccttctaaacactccctgagg

SEQ ID NO: 6904 - DNA, 665 bp, Aspergillus oryzae
  misc_feature (1)...(665): n = A,T,C or G
cttcctctgggcaagtgacgccgaagcccgtgagaaactcgctgttatgtccaactcaaggacagagccgcagagcatgcctcaaacccccaccaggactttgcgtcatggaggaacaggacccctcaccccacagaccgatcgcccgtttcgaaatacccctgagtccgggtcgaagaactttcagaccccttcgaaaagtgcaaaggcgcgcatgatgactgaggactccgatgagttcgaatgggatgatatcattccagacgaagccactacagcgcagcataagcctcgccaacccgactttggacaagttgctggtggctcggataccgccccacggaagacgccgcggacggtttatctaacctcacccagtaaacgggagctgtctgatatggagagcgcatcgtcnctcacgcctacgtcagtgttttccccgcggtcgactgcgtgtcggctccctccggcgtccgctgagatctcgantactcctactccgagcaaatattagaatgcgctgtctactgattctgcggcggatacgtcggagttatcacttcagggcttgagggatctggagagcacaatgcggtcgtggcaaggaggctcangangggctcacagagttacttgaacgacatgacatgaaaaccagaggcatn

SEQ ID NO: 6905 - DNA, 665 bp, Aspergillus oryzae
cggaccacgaatacactttatgaacgaggcctagccgtgctcactcaaccatccgacagcatgaacatttgtacctccctggcatatctctcgccgccgccataactctattgacccctacattgccttcactattgtgcaacggccaacaggcaacattacgacgcgcgttgccccttctttaagcgccttcgatcgcccgttcgactgtaccgtgctagacacagctttcggagatagaccaaatcaaaagaaaactcgtctctttttctgttcacttttccgatcaacggccataggagcgatcttgaacaagagttgcgccaactcttgctaggtcctttcgcctccatggtcttatagagacgaagtccatgccgcacgttcccatcagtttgtgagatatcccacaaaccgatcgtttcaacctatctgaaacacgctggaatcgcatccctcggtggtcctcatgccccgctcacggaaacccgctcggttctcgagcgaagctccttccgagtcgtcatcctcgacatccccggaccggaacgttgatgatgacaccgacttcttcacagcccaagcaaatgattcgcaatcatctggtggtggattgcgacctcccgtgacggacacccccaaaatgaactttatgggcttccccg

SEQ ID NO: 6906 - DNA, 669 bp, Aspergillus oryzae
ctcgagtacctctacaagggcgattattacccccagctggtgcacaacaagcaattaaattcctgggaattggaagatacgggaaccgataaggatggccagagtaatggggcgactttgtttcatcatgctgctggagcggagatactgagggatacggctgtttactgcgcggcagataaatacgggctagatctcctcaaacgcctagccctccggaaacaaggcctacactccggcatccaatgtagtaccatccttaccagcgcacgctacgcctacagtaatacccccgagaacgagtcgaagctccgggcgcattatcttgccttgatcatccggagtcggtcgacgtttaagcggagcggtacgatgcagatggagatggaacaaggagggaaattgttttttgatctttttgtagcgatgtgtaatcatatggatgatcttacgtctaaggctgagccttctccaggttattgatatccactggtttggggtcttcgtgcgacttggttatccgatatataatgtatgatgggatgttatgcgggtggtatttttgttgaaatggccgttcttttcagcctgctacttgtatttctagggctctttggtaagagtcgatgcaggccatctttgacctacgcctaacaacgattgttcacc

SEQ ID NO: 6907 - DNA, 1154 bp, Aspergillus oryzae
cattacgactttataacgttcccctcccaaaagttctgatatttcctccttgcttgcttgctttctcgtcaatcccgggtgtcgcagaagaaaaagaaaaccatcggaaggaccgtcctcgtcgctcgcttaggtggatagaaaatgggacaaaggcataacagacgtcgcacacgcccacgatctcgaaaccgcagcgctaatcactctcccattgagctgcctccatataacgtcaactacactcgcagtccagcttttctaaaaacgacccctgccgcctgcgattcactcgactccatctcaatacccttcgccccgacctggcattatgggtatacaacatggcagaagcgtgaccgcacgttgcggctagaggccttacggctggaggctgagcaatgtcgtctttttggtggtgaaccgggagatgacgtcggactttgctatcgtatgctcgaatacttcggtggacttgattatatcgactcctcacagagtccgagactactacctgggtgaagggcaactcaagatcaaaagccttaccgccatcagcgcccatatcaccatatttggaatgttggaatcaaatgaaaattctccacatccagagccgatatccggacagactatcctgcaagaaaagaaaaaccctcttgatagcaggaaatcaccaacatgaaaatagtcgggatcaccagttccgtgggaaaaccaagtttacgacttgtagcaatgaagatatctcttcctgcgcacggcaggaagggtattggattggtcccttacgacttggccacgagttcctggtccagaagatgactacgtctgtcacgtcgagaaccgagggttcttctgatcggtgggttgagttcgcatctgaccgtgtgttgatgcttgaaatccccactgagcaggagggctcctgaagtatctccgccgcattctttgtcagattccctgccccgactgttacacgatccaccatgctgttcgaaaccaacgatatagagaggagaacatcactgagataagacgtttcctccatatccaatcgtccgttccattaaacccgaaatttgggttcgtccatggaaaaaaagaaaatgaagctcaaaaccctcgtatgacttcatgagctgatttttgtg

SEQ ID NO: 6908 - DNA, 694 bp, Aspergillus oryzae
atcaccccagcgaactctatttcacaaaagaacttaagcacggcggttcaatgaaaggcgtcgtgaatgccctcagctcgcccgaatcctcctcatctttatatcgaagcctccttcacagatgttgatggttggagacactaatggacaagggggtgcttctccaaagatgtattatcttctgctgaaaggtgaatgtgctcgaatgcatcacaaaagctgtcgttggaactgcaagcactgttggggtcatgatccactgcgccgaagtttgcattgatacgtaaagggaaacaagagagaatgccagactttaaaatgctatcctgcttgtcctcttggcttggcacgtggtttattacgcctagaaggtcgtcaaaagccatagctagatcatcggtcagatcagggcgctgccgtagacgattcccaaaatccccaagcgtgtattgtttgtcatgtttcgtcttgaaatggtccgtcgctgccaaaatacgaaccgtctcaagatcagcatacaatgctgctatctgaagaagatggggtcccttgaggcgcgggcaagtagagtattcatgccaccgatcaaagatcagtcgcaatacgttatggctgttataagtgatcgcagtagtcaagggagttgatccgtcggcagagatggcattgatatctgctccataatccagtaaca

SEQ ID NO: 6909 - DNA, 725 bp, Aspergillus oryzae
  misc_feature (1)...(725): n = A,T,C or G
cgaggggatgctttggaagcagagagtcatgagcccgaggaccttgaagaattcgagatatgatcatatttggcttactgccttcgattatactccggcttcgacaccaaacgtatcaccggccttccgcagaagatgccgaggtttactttcgaattctcttatttttgagagcatctgtggtgacctgaactctcttcttctcatttatgatttacgcccggatcgcaaaatttcgttgatgcctttcataatcagctatactggcgcccaaaagttctcatctcatcatcttggactacgacccgatatggataacagtacattcttcttttttaacttttctttcacccaaacttgtattgatagttagcgaaggtacctatgtcttggtatgagatactgtgattgatgttcatgattttgattggaggttagatatctaagtttggattgttatcgatatccacgacgctttgactactggcnnnnnannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttttccgggggccgtggccgctgcctttaaggggccccaattggcccttagaggggggtgtttaaaaattaatggggcgggcgtttaaaaaccctgggagaggggaaaacccttgggtgtaccccaattt

SEQ ID NO: 6910 - DNA, 644 bp, Aspergillus oryzae
gccttgaagagcgttttatacatttccttatctgtggtacccaacttcttttcagatgataatatagttatcacccaacgatcaggtgtattatttatttgttactgcctccgcctcgtgctcttcgcaagcttctttccaacacttgggtttcctggccatgtcacattgattttttagtcgacctatgtctatttatggcctgtgcgacgtcagccagacgaattccaaagggctttcctgctgtgactatatcacaatataggttcaagcgtcctctgtcctgtgagctgcgacgccgacatacgtaacagctagtaaagggcagtctctaaaaaaacaaaccagccgttgatataccctgataacaaaccccaaacccctctttatgagcgattttggggacccccgctgtctccggaaatagttcattacaacaagagtctggaacgtcaagaatcaggttctccccaagaatctagaacttcagggaggataactttggccaagttaccccactggcaccgaattcggttttattcacgaagcggctttcggaaaaaacaaccaatttgttgggtgaatcaaagggcggaacccgggaactcgcgtgggggctttttttgttgggggggtacaaaggt

SEQ ID NO: 6911 - DNA, 699 bp, Aspergillus oryzae
  misc_feature (1)...(699): n = A,T,C or G
gatgctactcatgcggcaaatcccctagtgatgaactggtcatcacaggcatacggcccagacggtccatggcaagccgtgaggatagcagtgggcagcaataaacaatcagtcgatctttatcccggcgccaatggggccaccaccatcttcgccgactcgatttgctcgaacacaaccctctcgacaacatgttacgcagcacgcgccggcacgtacaaccagagtgaatcaaccacggcggtggccttgaaccgaagcgcatgggagacctcttattggagcgtacaaggaggaagtatacagggtttcgttggtgatcaggtcgaggttggctctgttatcccaaatgtcagcttcaagactgtttatcaaacatatcaaacctatcccaatggcaagagttatccggtccccgttggaaatttggccttgggtggactgcaattaaaagatgtggcctcaggactaagtctgaacacgatcgcagcgtggctatacacctncggaggagacagcagcattccatcttactcttacggacttgacatcgggtctgtagagccagctatttcaaggatctctggtgctgggccgggattgataaaagtcgagtccttgctgaagtgaattcacagtcagaaagcctggcgtcttaatctaatgggatatgggcaaatgtattgaaggatttccgct

SEQ ID NO: 6912 - DNA, 668 bp, Aspergillus oryzae
ttacccgaaagtgcgaacacggaacgaaagatcttcgcagaatgggcatcttcagttccgttcgagaaaaaagcggatgattttcaaattcacaattcaaaagagttagacaccaagatagttcccttcttaaggtcactcaaccttcttgacaaggggtattcattggtacagaacgggaacacggccttaatgatgtcgcagataacatcgaacaggccacatttgtttgaggacgacttacccgaaagtgcgaacacggaacgaaagatcttcgcagaatgggcatcttcagttccgttcgagaaaaaagcggatgattttcaaattcacaattcaaaagagttagacaccaagatagttcccttcttaaggtcactcaaccttcttgacaaggggtattcattggtacagataccggggccgaaatatgcgccattccaccacagcaaaggcgatgcgtttatcattccaatcgagatacttggcaatagccccagcgcctcgggaaagcccctccaagaaggaaagcgactatatatgaaggtaaaccaagaagtaaagatcgaaccaaagttgcgcctacttttcatcttgctctagcggacagattgtacgaattattatgcgggaatagtggggaatggagaaccctcatgtggggtagg

SEQ ID NO: 6913 - DNA, 702 bp, Aspergillus oryzae
  misc_feature (1)...(702): n = A,T,C or G
catcaccattgaatctccggaaaagcaccgacattgaaccgcctgaatataaactgagtgtggtcgacgataatggggcctatcttccgccatctccgccggaaaaacagagcttctggcgcaggtacccaggttccaatagatcctcgaaccatcgcgacctcgtcgatgagaatgagccgttctcaatatcccgcgaatccttcgattcgtatcgtcggtcgttcgatatatctgcccgatcacctataaatcatagcgacgcaatgccctctcgcacctcgcttgattcgcgtttctcacgtctatcatcgccctacgtaagaggcctcgaaaagcaacccacatcgatggaagaagaacaattcgaggatgttggactcgacgatgacaacgaagccaagccgaaaaagaagggcttattctcgcgactcggcgactttacgaatgacagccagacgtcaaacaactccaaactgggcttttacatcccgggcagaaaacgaggacagagcaatgtagggtctgaactgggatctatgaagtctcccccaactttagaggcggagttacgtgatgcgtgagggccttgcaaccatgatatatttgggtaatgaatggggtaagcgttcggggggggtgataagggttttttcccgatcgacgacttatatatgcgcctttgacctggattcttggccn

SEQ ID NO: 6914 - DNA, 658 bp, Aspergillus oryzae
  misc_feature (1)...(658): n = A,T,C or G
cccgagcgcgccggccgaactgagcagcgttcgggtttgttctgcatagacctcacaaccgttctgattcgattcgcatgtcgttcccccgaccaaccatgtaagtacattcgaggtgttctgctcggacatatgaacttgagctggactgaggtgtttttgttcatctatgtttgttgattttctttttctacttttctactgtgttctggtgttatcgtttcgtgtcttttgtcctccatctctgctcgaattgtgtgaaaaaaggtagccatctgtttcttcatacgtgtcgcggctgggttgcccggcggacgttggcaagggctcctacgcctcctacagcgttggagagcctggtcggtgagcttctgctgatgtgcgtttgggtgtgcccctggtcagccccccatgatgtgttatacgtcggntgtcttgcttgtgtctatttggctgcattgngtctcatttncttttctctggcgggggtttattgcangtnctggactgggagcgnagcactcgtgctctcgccaggcttgatggagaaacatttgggtggaatacggaaaacgccagggaatcacaattgattataattcgaccgatttaatctcgaaccaaaaggttttggcggattaaaagaattaaattccan

SEQ ID NO: 6915 - DNA, 674 bp, Aspergillus oryzae
caaccgctctagaagcagctgtttcgtatgcttggtctcaatatcaaaaaggacataacaccaatgcaatctaagcctcatccagcaccgtcactcaaaccagcatcgtcgccttcaacccagccgaattcttcgtcggaatcttcatcctggctatccgcaatctcatcgactttgcgtttccgttggctagctgataggctcgtttcaattggcacttgaggcaggattagtggtggtggggtcttgtctatcccacgtagaccgtcctattcattaatgtgagtcatctgcgagtgctgtacgagaaatattcaagcctaccgtctcaatcttgaatggtacgatattctcgtccaatctcaaagataaagttttccctgctctcttcattacctccgcgaaatgaacacccttggaatccccctcatcctcaggcagaaagtcccgaaagatggcaattctcacatggacactgttctcccatgttccgcccgcgagaaccggacacagagttgcccgcggctggcctctgattcgggtatgcgtctggttgactagaaatataactaaaccatgtgtagctgctagtttcacgaattggttgccaaagtcgcttgtgacttccatttgcggttcatgagccattgaatctgcatcttgtccgtgattcc

SEQ ID NO: 6916 - DNA, 1087 bp, Aspergillus oryzae
gttgtgttaaaaaggtttgtccttttcttccccggccagcgtctccaatgtcatagaacatccgccagtctgtctttcgttctgtttttagtacctttcttctttgggcaatcgcctctctttcattctgaccgtgtccttcgttccatagaacatcttgcagaaagcgtccgctcccttgtcttttgcgataccgatttttagtcctctgcttgcttcgatcctgcggcagatagtgatcgatcagcgcactttgcatctcatttcgattcgacctaattgactacgaattttcttcattccgatatccccagctttgcaatcatggagtgtttccggcagattggtcgactggttaaggccccattccagcgtgactcgcatcacaaggcattggaaatcgggcccccaaccaacttccgcaaggaggaaatgccgactttcttcccagatgacgatgctcaaacattacatagccacagctcttccctagagaaggattcaatgatcaagaccttggagcgtgaaccctcagctcgtcaacgaatcaagaacaacgtccgaagactgagtgtcagagtagcccggcagtctcagaacacgaagactgaggctgtttgctcaaagccggcacgggaatgcctggcttgctgaacctcaggagttgcgccaccagaatggaatcaatgggcgccggattggctgtaaaatcatctcgcttaaaccatctgcggattcaaagcaggaaagttggaacttcgttgagacgcgatttcttcgactgcggattgttcccacggggtggagtttcccgtcgggttttcctaatagacggtgaagaacctcgaccctgtacttgtacgtctgaattttgtagctctggcagctcaacaaaatcatcatcaaaaagcaatctccttttggattgggtagcggttggtgtcttgtatctagcattgatagactgcattttcctcccccggtcctttgtaggggtcaaagggctatgccgagaattcgacgacatcgaatcagaactaatgagacgagctttctgagtgggaaaaaaaaaaaaaaaaaaattcct

SEQ ID NO: 6917 - DNA, 694 bp, Aspergillus oryzae
ctcaatggacatcgactcatgtttcggtcataagaacaaacaaacccgagaggatactttggtagcttgtgtcaaatgtctcttgcaatgtatcaatctaacatgcgccgcatcagctgaagctaccaataattctatgtcagacataaagcgacttctgcacgaaacattggatagtggaggcagaaatgtgcagatcacgctgtacgagcaactccgcatgttcttcagtagagtaacaacaggggctttagaatcacacgacgaggaacctaagctgcgcaaagtacaaaagtctttggcggccctggcaggtgagatgttgtctcgccagatagatgtgactgcagaagcaatccgaagagaacgtgcgcaggccgcaatgtcatacattatgctctgcagacaacttgatattgggcttgacatcgatggggaactctgcgagttactgaaatcctggaggaagggcgaaagatccgggccggtgcagcaagcactagaccaagccctagcgagactcatgcaatgaggcacgagttgtccacgtcgcaacgagcatgggtagcagctaaggtctacccgaagcattcgaaaaggctacgacattattcaactagtaagccgtagcctattaaaaggaccttaagtgaacgatagccttcgtttcatgaagattaaatgccctaaaaaa

SEQ ID NO: 6918 - DNA, 526 bp, Aspergillus oryzae
  misc_feature (1)...(526): n = A,T,C or G
ttgctaattcctggaaaacctcaagcgttcttaattccactgcagtctattctgtcttctaaaaatccgcatcacatccatcgtaaaaacaaaacagtcaaaatgggcgcttcttccatctcatctccggtgaacttcatccttccgtcctccagctccggatcctccatcaagaaacccatcaaatccgtccaaaaaccatgtttcggctgtgactgtggtgatgaagagtgcgattgctgcatctgcactgtgatgtaatggatgtgatgatggccaagttcgatcggttgacgccaatatagtccgggggtaacggttgattcaaatatatgtgtgtcttgatgatataatgcttgatgcggatctgggagggttatggccacaggcgggaggattcttgccgcttttctgagcgatgattggtgattggtactgctatngatatccatttgactattctctctttatcagtcttgaaccggagtctgagaaaaggtgtgggctttcgccctctctcttggtc

SEQ ID NO: 6919 - DNA, 676 bp, Aspergillus oryzae
ctggtagagcaacactccttgtcaaaaatgattaacatggttcctcgacatccttatgagttttcggagagttactatgcggtgcacgagctattactggaagaagccaagcatgagcatttagtgactttaggcttaccagtcacacaggtagctggacatgtgttttaaagataggactcctcttttctggttgtttacaaccaaaccagccaagcattgaggcatgcagactgggctaattcatcataggtcctgaagaatccttgaggcccataccgtgttgaattgcaacctgactcgtccactcaggtagtaagaacagctgtgtgcatcatccttaatgtacaacgcaaggcagcttcatcgaggcatggacagataagataataacgttattattggttaatgaagctacttgtataacttaggaaatcgggatacaattgcctcttagagcacatgtgaccattgaaccctttatttccgggcgagtgaatcattttccttgtctgcatggcatactgaagcaactgaaggacttttcgttgaatttcaattaattcactaccgtgggaggcttaacaagtgggatttctttgtataagaaagccgctttcttgttaatgagagctacttccatattttcatcccatgcggctagcccgataatatg

SEQ ID NO: 6920 - DNA, 553 bp, Aspergillus oryzae
cagcagtctgagacagtatcctcgtctgcttggccatatccttgtcgacgggcttctttctctttctgtgttgtttccgtcgctccttttatcaggttcccagcttccggctacgtcccaccttgcttaattggggcaccagctcctgttgttactgcgaatcgacagtaacttataaccccgcggccgagaaattggcgccttatactaccgtggaaatcgcctggtgtagcttattgtccctgctgggctgattgtgcaaggcggactttcattggcccccaagaatcaattcagctgcactcttccatcattggggtctggctctctttttcatcccaagtgacaaagcctgaaaattgcttggtctgagagggtggcttatggcagaaaaaaagcgtcacggtgccggagttagagcgtcatcgcaaggagcttctggtgccacaggtcagggaatggccggagctatggttcctttggaggtcgctttgagcggcgcaatcggcgcacgccgtcgcattactaccggcccgggcttcaacgacattcg

SEQ ID NO: 6921 - DNA, 674 bp, Aspergillus oryzae
  misc_feature (1)...(674): n = A,T,C or G
gtatatctccattcagccatcacattcaactgcaatgattctgccgtcaatgcacacccgtctccacctctcatccgtctcactgaatacaatcttaagcctctcaatctccgagtaaaggacactcttgtcaaacacatgctggcctccctgatatgcggaggccatcaactgcatagctttttcggaaggtaccggaccaaaatggattattctcaagcgaccgtccagtggaacagactcgggtgagatcacgaactctctttcaagtctcgggaccatcgttgccagcacgtacatgtgttctttgatctccatggtatccacatactcgctgttagcttcactatcccacttggtgagactaattgtaccggcatatctatggctctcagcaccacctggagggaagagaagttcctctgcagccaatttaaacctatcagcgccgaatctgcggtattcagtagtatcactatcggcaaccaaggcggcgtgtatgccccagcttgcaacaaccgcaccatgtactatcggaacttcatacttagttttgatgttggcacttatactagcccgagaacggccttcctcggtgacatattgcgcgccgggtgagaattttgcgccgaaaggtcngtaaaggcctggtctttcttccaacagcttcttan

SEQ ID NO: 6922 - DNA, 658 bp, Aspergillus oryzae
cccaccacaagatttctcattgtctggttggatctgactctattccacggttggttcttctatgtcactttgcccctggcccacactttcactacccaccctttggcccctatccttaaccaaaccccccgccgcacctgaccccctcaagccctcatactgtgcatgtgatgtggttattcgacctcgttcacttcaaaccaacgccaaatcaagcttccgttgcttgattgatcttgaatctcaactgaagtagagcatgtttctagttagaagccttgtatcatgttcggatggtgtaatacgctgggcttcccttcagtgagctcagaacctgacagggagcggcgggctccatcgggcccgacacctatagacttcccagcgtataagctcccggatgccacagatgatgatccggatgcctctttgcggcaggtgcatgatattctagcatccatcataaggccacaacatatcacgctcgacaagttcaaagctctcaatctgaaggtggaagcaggtctttctgcttcgtgtattggccgtaaggatgggccagatttctttccttctttaccttgggaggacacttcacccaattccggcccgttgaccgaagatggttccgcgatcttaatgcaaaatgggaattcct

SEQ ID NO: 6923 - DNA, 616 bp, Aspergillus oryzae
  misc_feature (1)...(616): n = A,T,C or G
ttaccatccttttctatctatctgcattggggaccggaacattgaaacaaaaaaacgaaaacaggtgatcgacaacatggaatggcgcagcatggcatgattttaggagggaatgacagcacagcaactcacgcattttctgtaccagctgattctaatccttgactcttttttatccttctttggtctggggatgaagggtagaccccagagcagccaatcagttcagaccaaattgttcatatctgggcgtctttccttgtctctttttactgtactttggtgacttctcttcttctataccatgtactcgtatgctaatataagcgtgcgcagtgttttttttccctcttcgtttggatttcctttctttcccccatctactacgactttccctcgttttgcttgctcgttcatgccatgtctccgcttttcacttgttctgctctactggtccattcatcatcgatgtattatccgacagttctactctgttattctaaacagagatcaatactcgtacagtacataacatgtcacctgacataaagaccttgacaatccagtgcctaagctgcngattaaaaaaaaacaaanganaaaaaaaaaaattact

SEQ ID NO: 6924 - DNA, 610 bp, Aspergillus oryzae
  misc_feature (1)...(610): n = A,T,C or G
atgattagagatttatctatttcattccctgaattcctgcgtatattcatgtacttgctggaattgacgtccaccgggaacttgcgtccagactgcgggaaagccactgccgcctgcaattccgattcttagatagagggtgggaggtgggcacaccattgataccgtaacaaatcatgaaggcgagttgtagtgcacagcacgagtactgttccttccactgaattcatatattgtaaggccttcctcaagtgtattttagtgtttcaccttcaaatcctcccgcttcaacagctggatcttgcccatcgtcagcacgggtgtatttacccctgcacccgcatttgcatcagcactgtcttctagactcttagctagagatctgtcgtaactcgtgggatcgatgcctaagatcccacccacataccctnctcttctccaggtacgctgaattcacgaaatagggatttccactcgttcaaccaagccttgactggctttcctatcttggctttcccattcttaaaatgggggcactgtgccctgtgatgcataaaatacacgccggccttcattaacatgcttgaagaggatcttttcccggtattta

SEQ ID NO: 6925 - DNA, 650 bp, Aspergillus oryzae
gccatgcaaggagtcctaatatggttcgattactacgcggtaatggtggacagaagcccttgatctgcctgtcaagggtggccaggcgtcactgcatctcgctgcgggccagccattttggcggaagctcagtaaagctttaacggctccttcgcccttcagtgccttccgactaccgacggattgaatggacatgtgactgtggtaaagaattgtatggtgactatcataaatcgggccctgcatcagtggaggacttttcatccaatctcaagagacagcggggtatgaaatttaagactactccagtcagcgtgcccccccaagcaactgggtgcatacctggccatgatcaaccttcagagaacactggagataaatcaggctcggaccatagcatgaacacggtggatatgatccaatctgatttgaccctaccttcacacttgactcaatcacaatcaacaagcaccaatgacaccactcaaacaacaactactaagcgctttttcgaactttgtgttaatacgggggaattcagtattagtctcggcgagattgacattactcacgtccagagcgatagtgagctttttcaaaagatataccagcgatataaagatatttcgggcccatcgcatgcgttgaaa

SEQ ID NO: 6926 - DNA, 302 bp, Aspergillus oryzae
atcgctgctgtattactctgagcttttgcgtctaaggaaggctgtctcaatacctagtctctacggagaggtccactttctcttttaccacgcctcctgatcgttcttttccgctccagctagcttgcttgctttaccccgcgggccgtctcttcaccgtcttgatcgcctctacctcgccctgacaccctttgtccaatcttctgattctctctatttcgcaaaactccttcacgatgtctgcggaacaacctgccgaaactgcctccgctggtaaccctctggcagatcgtatcacgacg

SEQ ID NO: 6927 - DNA, 673 bp, Aspergillus oryzae
  misc_feature (1)...(673): n = A,T,C or G
ccacatccgtcgattggatgtcgcgggtcgtgatgtcacccgtaacatgatcgccctcctccttcgccgcggttatgccctaaaccgtacggccgacttcgagactgtgcgccagattaaggagaagctttgctacgtttcctatgatttggagttggacaagaagctttcggaggacacaactgttcttgtcgaatcctacactctccctgacggtcgggtcatccgtgtcggaagtgagcgtttcgaggcccccgagtgtctcttccagccgcacctggtggacgtggatcagcccggtatcgccgagatgctcttcaacaccatccagggcgccgatgtggatgttcgctctagtttgtacaaggccatcgtgctcagtggaggaagcagcatgtaccctggtctgccatcacgactggagaaggagctgaagcagttatggctcacacgtgtactgcatggagacccggagaggctgaacaaattcaaggtgcggattgaggacccgccaagacggagacacatggtcttcctaagcggcgctgtccttgctaattngatcgccgacaaggaggatatgtgggtcaccaaggcaagaatggcaagaacangggtgctcgtgccctggacaagcttgggcccanataaaccgaaaaacgttggtcacgtt

SEQ ID NO: 6928 - DNA, 671 bp, Aspergillus oryzae
  misc_feature (1)...(671): n = A,T,C or G
gcagtttgtatctacatttcattccatatatcaagaccagtttcaaccactaagtgctcatttatacaatatttgcagaaccccgcgctacccctccatcgccaacatgtcttccaagtcgcaattgacctacagcgcacgcgctagcaagcaccccaatgcgctcgtaaagaagctcttcgaggttgccgaggccaagaaaaccaatgtcaccgtttccgccgacgtgacaaccaccaaagagctgctggatttggctgaccgactcggtccgtacattgccgtgatcaaaactcacatcgatatcctctccgatttcagcgaagaaaccatcaccggtctgaaggcccttgcagagaagcacaatttcctcatcttcgaagatcgcaagttcatcgatatcggaaacacagtccaaaagcagtaccatggcggcactctgcgtatctctgagtgggcccacatcatcaactgcagtattctgcccggtgagggtatcgtcgaggctctggcccagactgcttcggccgaggacttcccctacggctccgagaggggccttttgatccttgcggagatgacctccaagggatctttggctaccggtcaatatactacttcttctgttgactatgctcggaagtataagaagtttgtgatgggattcgttn

SEQ ID NO: 6929 - DNA, 737 bp, Aspergillus oryzae
  misc_feature (1)...(737): n = A,T,C or G
cattcccaaccaggagtacacatccaacatcggacgcgaggggtacgagcggcacgtggtgaaactcaaggagcacatctccaaaggcgatatcttccagaccgtgccatcgcaacggctgtcgcgtccaacctcccttcacccattcaacctcttccgtcatttgcgcacagtcaacccatcgccatacctattttatattgattgcgaagacttccagctcgttggcgctagtccagaacttttggcgaaggaggaaaagggtcgtatcattacgcatcccatcgccggcaccgtcaagcgtggcaagtcacccgaggaggatgaggcgctcgcagatgagctacgaggaagcctgaaggatcgcgcggagcacgtcatgttggtggatctggcacggaacgatgttaatcgcgtgtgtgacccgacgaccacccaggtggaccggttgatggtggtcgagaagttctcgcatgtgcaacacctggtgtcgcaggtatcgggtattctgcggccggataagaccaggttcgacgcgttccggtccatcttccccgccggcacggtctccggngctcccaaagtgcgggctatgcaactgattgccgagttagagggcgagaaagcgcgagtgtatgctgggcgcggtgggctacttcgggtacaacatcgncagcacggacggagcaacagaaatgccgggtgctatggatacctgcattgcccttcggacgata

SEQ ID NO: 6930 - DNA, 450 bp, Aspergillus oryzae
  misc_feature (1)...(450): n = A,T,C or G
cgaggcgagagaggaccggacgacctggtggtgacatttcatcgcaaccaatcccaggaccgccttccatggaatgagttcaagtcgcttggcccaccagctgcaactgcagttgtcaaagctgggtggaaatttgtggccttagaacagatcgcggagtcaatacgcgcaaggcggttcgacgagaaggaactggataaacttcgaaatgaggccagggacgagcgcaagcggatttccattcgcaaaccttcggatccagttagcgttttcgaaatagactaggtcgaaggattggatggccagttgctctaagccaatagcaatagtagccatgcatgtatagatgcagccgatcattgtacgtagtattcgtaagtaggtaatgaatacggtgcctgtccaaannaanaanannnnnnnannaaaaannnttttnnnnaaaaaaan

SEQ ID NO: 6931 - DNA, 756 bp, Aspergillus oryzae
  misc_feature (1)...(756): n = A,T,C or G
ggagacgntttagtgacattatagtattgaatactatagtggtatcagcctggacccagatttgggcccagggctctcgctggtgtcttgggggcttaatttccacagagacattgaaactcttaattctgtccttggcgtctcttgcgcccctggtttccgttcatttcaagctgaactacccgactagccgtggattcgatgaggacaaaatgagtcagttcccctgcagtggcctgtctcaatcctcagaacggacgaaggtctctctttccgctggtgacttccctgttgccttgacaatgggccattcccagacagctgtggaagtgcttctcgctctcggaaacgaccctggcaccaatttcaacattactctccacccgaccttccgagtggagggtttgggcgccttttgccttcccaatgtcacttttgatgagtccatcgtcggcgtcaagttgacagatggaatgaacgcaaccctgcaggtacagagcaatggtgacccgagcggtggtctttacgcgtgtgctgatatccaattcacggatgtggactattccgcaccctcctcttgctcgaacaacactggtgtcaaggcgacttcattcaccggagacgccgcanagcgcaatgcgaacgagtccactgctgacngagaggcacanagtggctcctcgtcgtcctctacttcncagtnnctctaccggtagcgctacattcacttgctgcgcggtcgctcttgagacggcc

SEQ ID NO: 6932 - DNA, 540 bp, Aspergillus oryzae
  misc_feature (1)...(540): n = A,T,C or G
cgagggaaaggtcgcactgccaatgtgtcccgcgaaactgcgctgtaagccagctagcttgtattcgaggtcctgtgcctgttgacaatacgagccccgttgagagtttgtgccaacggatttgatggtatacccaatgcagcggactttgtgagttaaccgagagacgaccacacgaaaatgcgggggtaggatgcaatcatcaacgatgagcaggacgtggcgaaaggatttaactgcatgacangccgatgaaaatcgcgacgatcttggagccaacgggacaccagaatttaatggccctgtaaaatcccgcatacttcctcggattggctattagaaggggccaatcaaccatggctattacatagatatgtgaggcctggaaaaattttcaccgcacttcgaaagtccgcccatgatggctccagattttaacatgggatcacagaacagtgtttggagcattgggctgatcggcgttgttcgtaataatctggccctgggaagtcttcttaaaagtgataagatgcggcgtaa

SEQ ID NO: 6933 - DNA, 697 bp, Aspergillus oryzae
gtcatctcgtgcgcacatattctgctttcttgcatgaaatgcgcctgctcccgctgcgcttatgataggtcccaccactgtctctccgttctccacacttgcttgactttgacgactttaatgatctgcacctaacaccggtgtatacgcatgagcacgataacatgccttctgatgacattaactcacggacctctgagtctgatgatggtaactggttcgtcttccacgctctgggcctttctcttttcaatctggctggctccagtaacaataaagatctcgatgagattctgtacgacaacccctctgctcgcgatagctcacaggttgccagctaggaaatctctccacacttacggatacagcaaagagccatcgaacaactcgatgcgcgcaagagacataaggaagatgacgaactttgtggcgttaatgctattgcagaagctgaagtctaatgcgcccaaatcatcgctactcctatagcacgggacataaatctctatggttcagaagctgctctgagtatacttccatacgagagtaattgataccggcttgagactggagaaacccaccatttggactttgatggtattgatgttacatgctttacgattagaatacgaccgccgaggtgtacgtgaagctttttgacgatatcgatattgcggctgcgcgcgaaaaaatccca

SEQ ID NO: 6934 - DNA, 557 bp, Aspergillus oryzae
  misc_feature (1)...(557): n = A,T,C or G
cgaggtttgtgcatttaccagcacacttacacgcacctgaccatcaaccaccgtctgcaccaacttgacgttcaaggcgatgtttcaggatttttcgagtcgggacggcaaccacctctttctgttcaccattggaagtcgtggttccatatggacatggcaaaactcagtgtcgtcagcgagctctgtggcgatagctgccttctgcggcaatggaagttcgcggacgggtggattttgacgaatggcttctcggtcatgaagtatagcaaggagctcgatccgaacgacaagaccatggaacttacatgggagggccaaaacggcgcagtacacgaatcgttcctgcacgagttcggtcctttgcgcgaaaaggactgggatnagttcagctacgtgctggaagactccgttgtcgatggcaacaaggtacggcaatggtatgtccatcgcgatgctgagaagggtgatcanaattttagaattgatttggcgagctcaatagaggactgtatgagttctcattttgccgctggtggtgtttcttttctactacn

SEQ ID NO: 6935 - DNA, 659 bp, Aspergillus oryzae
  misc_feature (1)...(659): n = A,T,C or G
cttaacctttgcttcccttcccatgtcttggaatttctagtgggctgtgcattagcgcctggtacacctgtatgcacactgtacatcccgccagaatgtaatgcacataccaaggaatatcccccgaattgcctgatttcagcgacatgcagaccaagagccaaagcaactcgaccctttgccgctgggttgtgctttccactggatatggtgtttgcttttgtgttgctgacgctgcataacgggtggggaacttgatcccccgctagaacgttttagcgcatccctttgagaaatcctgatagacggtatcgtcaagcgccctgttgtttgggatttggaactttttcttatcgccgtcttttctatttttaatcgggttggatgttggggattgtaggatgtagaagacagtactggacgtatgcatcgtcagcagatatccactccattgataccaatgttgtcggtagaactagtctggtactacgggtaaaatatatccaacatgtactttntcatcggtcggttggttatagtatcacgccagtttgaagatatcagttctgatgcgctgctacgtgtttttttggagaaggatttgtcatgggaaagtgattggcttattttggatgtggttttcataacaattggccgga

SEQ ID NO: 6936 - DNA, 685 bp, Aspergillus oryzae
  misc_feature (1)...(685): n = A,T,C or G
ggaaacttctaggtttctcgataagataagcgattcgttgcgatggatggctttacctccacccgaaatgtacactacttgaacatgcgataaaatgatacaccaattttgaatacgtccctgctctatgctgtttcactggaactgatttccagctttgtccttccatctaagcatacacatgattgacattagcaaaatcccaacagttttcaatatgttgataactgtttggagcctcggcatctcaacgtgtattacataagccatatccccatctcattttcttcccccttgtccagctgtcgaccagttcggtatcaattgcttcaccgtatcgctctgggggcattctcagccgttactgctactaactcaaacccataactcaatcgtgtcatatagcacacgggacaatccaccgtcagcagcaggaagcccagataaagcactcaacagctgccatccaaatacgactccagaanaaaagagcaacagcagcacagcaaagatcgaagatgtctttcaaacccggttcttctctgggcccccaaagccttacaaaagctgtatcttctaaggtacaacgctgtcagcttaaacctttggggaaactgcaccctccgcgggttttacttcttacaacaacaccccagagaaaaattccgccattttaaagaaaatt

SEQ ID NO: 6937 - DNA, 718 bp, Aspergillus oryzae
  misc_feature (1)...(718): n = A,T,C or G
ctcactcatgtgtaacaagatcttgacatccgcacaatgaatccatccaagtccatttcggatcaggagtctttcgatggaagtctcttgaactcaagcagcaactctcgcctctttcatgtataccatactttgtggcgctatgattacaccgtgacttcggacgacaagacacctcttttctttgtggatacgtcgtctttcaccccaaagaagccagacctcacattccatgctggcactgataagaaggcccctgttgtgggcgtctccaaattcctacatttttcaaggcacatgaaagtagggcttggtgacccgcagagtatcgaccaagttgagtgggaggaccttatctctcaaaacatcaggagcaacaaataccgctggcaaatgacagtccggggtgcctatggagcagaacgacggtcttttatgtggaagagaacacactctgttgcggtcgagggctcctccgcatctaaatggagtagtcgcaacttcaagctggtcgatgagcaaaccggtcagattgttgcaatctttaccagcactgctttcaaaagcgtcaagaaaagcggcaaactccanatcgactcgacgaactatggcgaggaggttgatctgatggtccttatcactgcgctttctctgtacgagaaacaaagacggcgacgacatancaattgangtngccngcggtgggtgaagatngtaa

SEQ ID NO: 6938 - DNA, 641 bp, Aspergillus oryzae
  misc_feature (1)...(641): n = A,T,C or G
gtgccatggtcctgccgtgtatcagtcaacctgagcgttcangtatctcgcgtggagagcaaatggggggtacgaacgactgaggacgaccatttggtttccagccctgatcggcgtctgacattttatctttttactcgagtgtgtggaggcgaagaggtacgatatggcagagcagccgctcaaggaagaaggaaggcaaggagttgctcgttcgctgtgttggggggtagaaaaaggagtgttcccaagcgcgcgcgtgcgtcaatgaaaactggtgggtataaggcaaggttgatgtggaacttgaggtacaatcccaaaagaatcagaagagtcaaatcgcggatgattaaggtattagggtcaaaggtatatatgatggtgagaagatcagaaccagctgagcgcaatgtatgggaaaatgtagggggttttgatcgatcgcaagactgatgaggccgaagatcgaaacttgtcgcactaatgaatgggtaatggccaaaagggaccacttttagtgggtagttatcaaagcccggacgggggtgataggggaaatgcacgctcgggggaagatcattcggcccaaagagaagtgtaagtagtattcgtttggggagggggaaaggatctaaaat

SEQ ID NO: 6939 - DNA, 660 bp, Aspergillus oryzae
  misc_feature (1)...(660): n = A,T,C or G
ccgtgatcgaggagtttgcaactactgtgcgagctaagtacccaccgtctaccgctctgccaacatccggtcctctcttcgacacgtctatcctagcggccatcgaacagaaataccacctcgaaccacacagaaccaactctgcagtctctaatcccctctgtgaaaaattccaggatgccgaccattggatcagcctggctccatacagcacagccgatggggacctagccgatgccgtgaaaatgctacttatatcaaacgaaatgctcgctttactacgtctagcaaaccacaagaagatcccactagcgacccttgataatctaagttggggccacagcttcggtgtcaaccatcttccggacgtagctctgcaagcctacctactactaaacattgccgctgctgtgaaagccaatgccaaacgcgggtctgcggatgtcactgtccgtctgacggagacgcagcggttcaggtacttcgctgactgggctttggcggatcatgactatccggcgcagaatatcccgcatcgtcagtgttggaatgcgaagggtattactgatattcattgctcatcgcgggatccgntganacttgagacggatggggaaagtcaagatatgaaggcgtttttgaagatgtgttgtgagctgt

SEQ ID NO: 6940 - DNA, 305 bp, Aspergillus oryzae
  misc_feature (1)...(305): n = A,T,C or G
ctttttttgccaccatcaaagctgcggtcactgtcatgagcagcgaggagggtgactggcgtcgaaagcaactccaagaccggatctaccacttctatgacctcctctttcatcatccccactgggaacatgttcgaagatccggaatcctgagcattcctaccaccgaccattttctgacaggttcttcgttccttgtacccattatcccagtcatcacacagccaggctactgccgtagtctcgagaaatggctcctagaccgtggaatgtacacgcatggggtgcggtatcccgttgtgccn

SEQ ID NO: 6941 - DNA, 696 bp, Aspergillus oryzae
  misc_feature (1)...(696): n = A,T,C or G
gaggtggagtcgcctgctaggaacatgtcggttcgggttgataatatggcgttcggggatgaactcagcacatcgggttccttccgtcggaactttgagagcgacgacgatgattcgagcaatgattttgcagcggaatcagcatcccagatcaatcaagcctggcctggcgtcgagaccttcagagacctgtggtcacgtgggcacggtgaccctgaacaaatcttacgaatcatacacgaagagggccgccaggaagagctcggttgggttgtcacggccatgacaaagcttcagcgcagtgatagtcctagagtgtcctggtctcatgatcaaagctcctcaggtccatctagttatgtcccgggtccgggcgagacagactcagagtttgcaagtcataacacaattgcctccgcaggctcatcactaccggattctcattggaacactacatctcagtcgtcaactcctgttggtcggccctgggatatcgcgagcccgcacgctagaaacgatgctgctatggaccagttgcacactgacttcgctttcgattntccagaacttggacctggaagcgaagaggatagggagtcgcagtcagatgctcgtagctcagcaaatgacttagttggggctgtccagaanttcacccnccatgacccctcaagtgcanacaaatcctgccaatta

SEQ ID NO: 6942 - DNA, 256 bp, Aspergillus oryzae
acaagaccccgatccaagagtgaggatgttcccaccctggttcggttgttagtgccgctcgtttctctgctctggttcgctctcattgctgccactatcaaactattgattgcaaaggtggagctaatttgtcaatttccacgacgaccttctcagatgagtatatgaacgtggagttccggaacagacctaaaaacgctccgtcccctgcattgcttagcccctcgcgtgggatcgactcctgatcaaaaaggtc

SEQ ID NO: 6943 - DNA, 657 bp, Aspergillus oryzae
gttcccttcacagttgacgttccccacccttcacccacagccgaacagtgattttcctccgtcattccgattcgcgattaataacctcggcttcaagacaattcctgttgcgcgacgaacgatacacaccgtacatgcgcggatccgagtgcgcaagaacactcgattggtcagggaaaagctgaaggaacccgcaaggaagcaaagcaaaagttgaagctactcttacacaccgcatcgatgccagtgagcgggtcgtcggcgagactctgcgtggactacattccagccacgctggggtctcgaagggtgttaatactgcctcgaggcacgaggccggcctatgccagacaatgcagaagaagtgtacaacggtcatatgccagtgtgagccgttcccagacgccaagcccggcaatcatccatataaccaaaggcttgaatacccgtgggccacggctgggtcatgagtatatgcgacagtacgcatcagcagcagcgaatgaagcaagtcggatgttgcagctgagctacagggtgggcctttcaaagagtatgatgcgcgaatgctacaaggtcagctacaggatgacccataccggagacgtacgtcctacactcttcttcgctattaacggtcaacccaaagggcatggg

SEQ ID NO: 6944 - DNA, 395 bp, Aspergillus oryzae
  misc_feature (1)...(395): n = A,T,C or G
acaacaagcggttcgagtctaaatacagagaaatacaaaccggcaagcagagcggcaagaaatccttttacaaacacctgcaagccaagagaagagcaaaaggcaagtgataagactgatgctgctcctacatggatagttctgggggccattatactgtaagaatctctcttgaaccagacttcgcatgcttcaaggcatggataaacgaacggttcgcgatgaattcagcgaatctgagcaattgcccgtcctctcgcttcgagccacccaaagtgcaattgcacacactaatcgcttttgaacgcgcccaaaaaaannnnnnnnnnnnnnnnnnnnnnnnnnnnnnnnnnnnnnnnnnnnnnnnnnnnnnnnnnnnnnnnnnnaaaattcct

SEQ ID NO: 6945 - DNA, 694 bp, Aspergillus oryzae
ccgcctgagcacaatccaagcaatgcttctacttttgaaagcacgagaatccgtgccaaagaagggctattactaccgctcgtggcagactgtgaaaacaattgtttcaatggctaaagatttagaaattgacgaacactacaacacgcatgcagagcatagactctgcgatctcaaccccatagagtgtttggtacagacaagagtgtggcaagccctcctggttgttgaagtaatgattggtgcaccgcaaggccgatcggactacggtgtaactcctgacaccgtttgtatggatcctgcgctggatattaaagatcttgaccaattcgaaatcgatcgatctagacaatatgcctactttgtccagaatgctcatcacattcgtatcatcactgatacataccacaaaatcaagaggcaaaaggactggggtgccaatccaaagttcgttgagaagaatcctctctttaccgattggcttcaaggtcttccttcagatctacagattacctaccctcctgacggctcacccccgtggataccgtcccattttgtggctaatatgcattcccattgccatctaggcattattctactacaccgacctcagttgcttgcatctaaatcctttgccgcaggcggggggtggaaaatgcatatggctttgtgttactcttcggctaaatatctt

SEQ ID NO: 6946 - DNA, 583 bp, Aspergillus oryzae
  misc_feature (1)...(583): n = A,T,C or G
cgaggtctcgaagacgctcctagcctctctctcttaggagtttcacagccgctattgtgttcgcccattctcctttaataattttgcttcttgacgttgtctttttctacttttttcgtgttttcgtatcgtgcagctttcttggtttacaagaagcaagggttcgctaggacggactgcacatgcctgtttgataccaaccctttacgaccttggtgatcgccttgtctcaaaggatccgagttcgaaggaactgacaggcattgtttttgaaatgtcttccggctcgtttcctttantccccgcttgtcctgccgctccgncttccctttccgaaaaagtgcttctccacgcctttcttacctnctattctctcggcatctagtattcaccggattgctcctcgatcctttccaaccctgatcgcactgtcttcttcccggcttattgaaattgttctctcgagcaacttcttcacaccggttactggacccttttttctgggaccatatccggtatttccataacctcctggaatccccaattcaccgaacttcccccgcatgggtattccgaacctggg

SEQ ID NO: 6947 - DNA, 659 bp, Aspergillus oryzae
ggtcaatcgacacatacgcaaatcacgacgcctgcatggtcaccgctactgtcactttcatcattgatgttcgatactcgttgcactctacgtctaatgggattgttcgcgatatggacctgtggctctgaaaccgtaaaggctccagcggaggctccaattgtcctacaagtaacacgacttcaattggtggagacgacagtgtagcaatttttagagaatgtcgcatttcacatgacacaaaacgttttaccggataagctatgtaagcgattcaatcgtgagaagctgtatgcttggagtcttcattccctgtgtgtgcacatgatgctccatttatgtaacctttggcgggagagtgtgcttataatgcagggctgttcagatcgcagtggtatccaccactggtaagatatcgatgattgacatcggaggtgaaaagtgcgactgatgccgacgacagtgatacagtcacatccgctcggcgagaggaactccatgcagcgaggatcagcttggtgtcaaacgtgacttggtgagcattatgtgcacactgagggatgcctgctgagattgggattcccgaacccttcataggggcgttgagctttgttcgcatatgcgtaagacctcatggatacatggatttcatttgaatg

SEQ ID NO: 6948 - DNA, 672 bp, Aspergillus oryzae
  misc_feature (1)...(672): n = A,T,C or G
cgccttatcttgggagtggcactgattgttgtgtggagggaggttatgaaaccctctcttctccgtgtacttcccccagtctttcgtggcctggaaaagttgggtctgttgctccctcgacgattctttaccgcagcgtcgcaatacaccaaagttcccacgcaactcaaggatcatgaagtgttcccgaccttttccgaaatcccgtctatcttttcgaacatccgccaccctcgacgacgagcaatctctgttggtcctcagtcggaagctgatgcctacgaaaccctggcctatcgggagaagcgcagacgagagagcctgtcaaatagcaaccgaacgtcacccctggtagaggaggattctcggcaagacatctcggagggacaccatcctcaactatcacggaagcggtccaagctccatgaatatgaaactatgatgggaactggtaaccctcgactcgcaactggtgttgatggtgcagaggcacctncattgacggagccgttccctgatttggttcttgaccccgagccggacgaagaagagatgtttgcgcgaatcaagagacctcgtgtacgatacgatgtggaggtaagtaccaaagctgtaagataatccgggattgctttggattgggatggaaggagcctccttttgtttttgaca

SEQ ID NO: 6949 - DNA, 802 bp, Aspergillus oryzae
  misc_feature (1)...(802): n = A,T,C or G
gacacatgggctgactaacccacgcgtggggtttagaaagcgggggatctggcctggcaatatttctttcttttcaactcgcctgcctacttcactctcacccagacactttctttttcctacgaataaaacgtctttgaatattggaaaagaacgcctagtttgccatgtctgccgttctactgttctgcacttcaaaagtccgcgcgggcgtaatcaaccgactgatgaatgaatgtgctatacctgacaacacgttcaacttctttagtctagtccgcaccccagaccaggaagccttagacgaatggaatactcaaacccccgtccaagacttcgacaccggctttgaagggaaaagcgacgccgagctgcgcagattcttccaagaccgcctcgataagcacactgatacccagacaacgagtatttctgactcatggcttgcggtgctggacgataaatcgccctcagagaacgcagtggtcctacactatacatacgacaaatcgagctggggaccaggcccgattcctgggccggcggaggtaatggatgatgtgatctggtggaagtggagggtgccattcaagtcagcctggacattctggaatgcgattggaagcgctggggccgatgccattgaaatctattcaaggcccgagtataccagctcggatggtgttctacagacagagattccagagaagatcattaatggggagattgaggatccacatgcttagcggcttctctccatacaccttggtatcttctnctgtatcgcaaccggcggcacttt

SEQ ID NO: 6950 - DNA, 717 bp, Aspergillus oryzae
  misc_feature (1)...(717): n = A,T,C or G
cgaggtgagagtgacgacgaggatgctagcgagcacagcgaggatgagaagaagaagcccgcccctggcttcaagaggaagcgtcctgctccccaggctaaaccccggaagaagggtcctcggatcgagatcgagtacgaaaccgagggcgctggcaaggaaaatctcttcgcttaagacggagaccttccttgaatcttggaaacaccaacttgaaaaaaagcaaaaagcattctggtctgttgttttttgcacggcgttgtctggctgttgtctctgaagtcacatctgctacgatcgggcgtcatacccagtctctgcatagtttaccaacaccttcctggtcctgcggatttaatatggaatttactcttattttaacattnnnnaaannnnnnnnnnnnnnnnnnnnnnnnnnnnnnnnnnnnnnnnnnnnnnnnnnnnnnnnntttcctgggccgnnannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 6951 - DNA, 673 bp, Aspergillus oryzae
ctggaaacaggcgaccacctggctatggaagaaccgctggatatctcaggaacaacaatttcataccttctcgtgtcgcccctcttgccgccactcaatctgttcctaacgttcttctccacaatgtctttggatattggggctcaaagtccagctcaacggagacagattccatgtccgaagccaactcgtcagctgtgcgcccatgcaagtctagctatttacggcaatcaggacagcttcacgtctgcaagtaaattaaaaaaatggtcagacgaactgtcgcatatgcccggtggtcaatttcaatcggccgagattgacggagctggacatttctggagagagaatggggtagagtcgcaggcaagagaagcactgggaaagtggttgcgtctgataccttgacctttgctacatagcgaatgaaaggtaacttaatggcagttctatgatcactttaggagaggtctagaatatcggactgagagatgggaccgtgttccacattttcaggcccgtttcacatgcacacctcctatccacaaagcatgtgatagccctggcttcgcatgaccatccccaaacttatagtggggacttttcgtccggagtctgagatccgagtcccaaaggtctatcgtgtcactgggtctgcaagtccgtaaaattt

SEQ ID NO: 6952 - DNA, 164 bp, Aspergillus oryzae
gccaaaatcactggagcgttttgagtctgtgtctttaatctttctcatacattcaattgaagacgtctagacactactacataatgtccgcgcaggtcactccctccaagcaggctgcatcctctttcgagaacctcaagatgagcgattcacccgtcaagaag

SEQ ID NO: 6953 - DNA, 657 bp, Aspergillus oryzae
ttaattagcgccggttgaacggttgcaaaagcaaccatgacaacttccatgcagcagcccgaagccgtgcagcctatagttccccccgatggaggagggacaagccctcctggcgacagtcatcttcaaatgaatcgcacggtcaaccctcatacgtctgtggaggattatagccgcgttatgctggaatacacacacaaccggatggcgtcctttgccgatttggatgccgacaacggttcccccgtcggtcgcagcagcagaagcagcgcacgtagcggcgagagctggcgactcagcgggagacatgcttcgtcgaggccctgcacccacctctgcaggtgtctcccaccatgactttggtgagagaggtggacgcaaagctatcagagatggcgagaaaaaaccatccatctagagagaccactccccgaggtgcaggagggggtaattaaacgtgacactggtgtctcgttaccttgacaaaaaggcactgagtgccttgctgacgagttgacgatatcatatacgagattttggcgatttgggggagacactttagagtcatccggcgtttgattataccgaaagcattcctgcttcaagcgatatacacagagctatgacctactcgagtcgagcttggtgcctgtactt

SEQ ID NO: 6954 - DNA, 618 bp, Aspergillus oryzae
cgccccgggcgcgctttaacgaattgggtatgcagcgcaaaatgatcaaaacctacacaacgaaacgacgacttcatcaaataggggcctattatcatccctgccggtcaccaaacgccccaaacctgtgcagatgcggcagacgtagcgaacaactgagcaaaacgttaagaatatccatattgaatcgaatcgaagaagagggagcatcagcggaagattaaaaggtaagacagcgaagcaatatcaagtcgtaacataacgggttgaatcgtaatttaaacctccatcgagtcggcaatttcttcactcatggcacggaccgtgcccttgctgccagatctagatcggaattcctcgtcgctgagcacgtagttgtcgtattcgtccacaacgggtcgggctggcttgctggcgtgctcttcgtcggactcgctctcgtcttccaagtgcaccacgtcgccgagccagtaacgggcccgcttgcttgacccaaggtccggtgtgagatagccgtcgtcgtacgtcctctttgcggtcggcgtagcaacttcatcgctaagcgtgtgactaaagatcgggatggctctgaaggaaagataccaaaacgctttcgag

SEQ ID NO: 6955 - DNA, 654 bp, Aspergillus oryzae
  misc_feature (1)...(654): n = A,T,C or G
gcctagcatggcccgcactgtgtggggtgcccacaagcgttacatggatacctatctgaatgtttataagggctactacttcactggagatggagcaggacgtgaccacgacggatactactggatccgcggccgtgttgacgacgtagttaacgtatccggtcaccggctgtccaccgctgagattgaagctgccctgcttgaacaccatatggttgctgaagctgccgtggtcggtattgctgacgaactcactggccaagcggtcaatgcatttgtgtctctgaaggagggcaatgagacaaatgagcaggtccgtaaagaccttgtcatgcaggttcgcaagtcgattggaccattcgccgctcccaaggccgtctttgtcgttgatgacctccctaagactcgcagcggcaagatcatgcgacgtatcctgcggaagatcctgagcggtgaggaggacagtctgggtgatacttctaccctgtccgatccctcggtagtcgacaagatcatcgaaaccgttcacaccgnccggggcaaataggtggacgacgacatgacttatganaagaaagaccaaaatcaaagaaaaaaaaaagattgaaaacagcgatagtatgacatgatattcttaaatcctttgcactggac

SEQ ID NO: 6956 - DNA, 659 bp, Aspergillus oryzae
gcgacatcgaaatgacccatgcccacgccaaacattatgataacagaactgagtacatgtactccttcctgcaggtgctgacagcatccactgcttcttttacccatggtgccaatgatgtgtccaatgctattggtccatatgccacgatttatgacatttggcaatctggaaagctcaactccaagagtcctgtcccttactggattttggcctttggaggtgctgctatcgccattggtatctggacctacggctacaatatcatgcgaaatctcggtaataggatcacgcttcactccccttcccgtggtttttctatggaacttggctctgctattactatcatcacggcgaccaggctcaagcttccggtctccacaacgcaatgtatctcgggtgcaaccgtcggtgttggtctctgtagtggaacctggcgtaccatcaattggcgcatgattctgtggatctacttcggctgggttattactctgcccataactggtattatctctggatgtcttatgggcattatcattaatgcccctcggtggggaatgggcgtctaagtattacatttacacataagtgagtcgtttgggttgaaactttgccgctgttcacgcaccctagagcaccccgacaatataactaaataa

SEQ ID NO: 6957 - DNA, 727 bp, Aspergillus oryzae
  misc_feature (1)...(727): n = A,T,C or G
gcaactatacacatgaaaatgacaaattgatgagccatcagtacctaccaaaatgccttagtgtacaagctgcgctgggattcattgataaatacaagtcacggaactttgcatctaatgtgccgtggacaattcttcagcttcgccatgcttctgttctatatgcgctgtttctccagtaccttaaaaggggtgtccaagcagaaccccctgatgcagatgctatacgcattttacttggaaatacgaaatgggctctggacttgttacattatgttctgaacgaccttcttgacctcgcggatgatctaaaaaacttgctttcttgacaagaggccttttgcccaaaaattgaaaccactaattctcttgccctggatcatccttttgttaagaatggtccgaacctttcttcgctttattttgccgggggttgcaaggaaattaaggcccggttacccttcggaccctttgacgggccaacgctggcggtttactatgccggagaattatttgaaccccttaaacaccctccccttgtggcgaaattgaacgtttatataaaaaaaatgctttgcttggggtgggactccaaacccggcgacaatgtttttttatgtgcgcccaggtttcgaagaaaaataaaacggcccgggcccttaaaaagaaactcttaatcaacgggccggtatttccccctgttttttgtttacaaaanaactttatn

SEQ ID NO: 6958 - DNA, 641 bp, Aspergillus oryzae
tcgaccacggcgacccgcaaagcaggcttcattcagagtcttgtgtctctgttaggaatagggaggaacagcggacgcttgccagaggatagccaacgacctcccagtagtggaaacattgattgggttctaaaagatccctgggatgatatggagatgtccgaggatggcaccgaccgtgtccacaaccgggcaaaagccgatagcggtgctggtgaacgcaagaaatctgatgtttcttcacaagaggacgacggtgatgggtttgtgattggcgttcaggattggcgcgacccagaccttttagtcccgatcagcagctccatcccactcccgagcagtgtcccggagtcggacgctagcaaaacccagactaccgggaaaggctcacgccccacaagtgcgtcactcaagggtggtagcataactccaggaagcggcgagtatcgtacactagattagtcaaagactagcaaaacagagttgcacaggtcccatcacaagagcttgacgaatgacactcaaagatacgctaagcagaaccagggatggtttggcaagacattttcttgggcgaaacgtggccagaaagactcagtccgtctgttaggccagaacttttcgaggacccaaagttgcct

SEQ ID NO: 6959 - DNA, 654 bp, Aspergillus oryzae
gctctcgcccgcctagcttacgtcgtcgcccaaggctctgcagacattacctgggaaggtgtacctctaggaatcctctccgccttcgaatccctcggcggcgtcctctgcgccaacctcccgataatctaccgattattcaaaaccgctgcacagaaaatcagcagcagcgtctcgggccagaaaagcaagggctcgaatcttcaatacgcgtacgattccagggcgtacgggtctaaatctcacggccgccaaaaccgacgcagcactgatagtgaaagatggattcagatgccgaatgagagtgactctaccgagatgcagacgcatgtacaaggtatgagtcctgagatgaaggctgacgggtttgagatgggacctattcctagagatgggattgcggtacagagagagtttcatacgacggttgaggagagggtttgatatatccaatctggttcattccttggtttgggcggttgttctttttattcaacgatggactgatatctgtattgggacaagaaataccatggggttcatgcgcggggactttatgactgattaataccacttatgtcatcttgctaatggcgaacgtctatcttgagatactcactcttgtcacggcccgatgcagtgaataaataaagg

SEQ ID NO: 6960 - DNA, 629 bp, Aspergillus oryzae
  misc_feature (1)...(629): n = A,T,C or G
ctttttacttatcttatcggggtctccaataccggtggccaactgttgatgagggcggcatatatcatgtcatctctccaccgcaaggactcggctccgaacttattacattggatgattaagaactcttccgccagctgtatcgcaccttcggtttcgactcccgcgcctctctcactcccttcctcttcattcttctcagccactcagttctgccacatctttgacttcagcgcaaggaacttgacatgaacgacgactcaggtgtgcagtttgtagctgcacggccgagaaagcgcaaccaccaacaaatgtcccgaacgtctcattcacccaatcgccgtttcttttcacaaaatggagagccctcgtcctccagagctccgaccaaccagttgccacccatgaggtacgctggggacggtctcgacatgaggagacctgtcgtctcggcttcccctcagacagatgaagtgatcgatttgacaaatgaaccggactcgcctncacaacagcgagataggagcgcccgagcaacatcgcggcgccctagacagccccgctttggaagggatatcatggcagacgtcgtggatctagaagatgaaccggatnacacaatngatctc

SEQ ID NO: 6961 - DNA, 472 bp, Aspergillus oryzae
cgaggggacacagatcctgagcgtggaggcttgtcttctgcgtctcggttgattactggacagttcgacgacttaaggagccatcacattcatggatggtcgattatttccggtcgacagatctcagattaaaggtcgacattgggtgttcgctctggtcttgagctcccttcctttcggggttggtgagctcggctggagagcctggtgctcggcggcgtcatattcctactccctttaccgatttggccgtcggcccatgaggttagggaaaaaccatggccagccaacatacttttttcctttactacgtagtttttagctgcagctgtatgctagataggagtgattggtagactgtcttgcagtataactgatcgattgagcatatatctcgtaaaggttgcagagtgcttcgtataacacgcaattaagcgtagtgctgttgattttacacctctatcctatatgc

SEQ ID NO: 6962 - DNA, 567 bp, Aspergillus oryzae
  misc_feature (1)...(567): n = A,T,C or G
cgaggctttatccctgtcaattctcgccagcatgcatgggttaggctcctcacctacctctccagctagcttccgccttgccgatggccttggatatggtctgcagcagaaccaccgctccgtcatccgcctaaacttgcaacactttctctggcgtgaagtatttggctttcacatccacccctcggtccaccttcccccttcggacaattctaccgagccctctgaccatcctgccattgccgacgttgctacaggcactgctttgtggttgattgacgtatccagggactttccacatagccggctggatgggatagatattgacctcactcaagcccctcatcctggatggctgccctctaacattaccctgcagcattgggatgtcttcacaaacgtgcccgcgagccttgagtgccaatatgatcttgtgcacgttcgaatgcngtcttggtgctctcgaacgtagacccattgcctgtgatccggcaactgtttaanttattcaaacccgggggttccattaagggggaaaacctaaacggtgaaaacctaaaatacaaa

SEQ ID NO: 6963 - DNA, 685 bp, Aspergillus oryzae
  misc_feature (1)...(685): n = A,T,C or G
caaccgccgggcggtgtatctacttccagttgtcgcattctggtaccccaccattcaatactttttgcttcagcagagctcttcgttcggtaaccctaccggtgccgtgattactgaggtggttgctttctatccttttgttttgctctctgtcgcctgtgccgccaaattggtgcaagcgggcctcaaccttgaacgttatggtgatcttgccaaggagcatattcccctcattagctcgtacatcgtctattctttcggggagaagcttgcaaaatcattcatagtgagatttatcggttcattttggctcttttcgagcacgggtctccagctcttggttgcaatcttgtgttctgccgttattccatctaagtggctcctcttggccattccatctatcctcttcacactcacttctaatgtgcatctgcctttggggatcacaacttcggggctcaaatccgcgcttaatgaggaaggattttcactggtagatcgtcaggagtcctccaccggttatatttcggttttggataacctcgaggatggtttccgggtgatgcgctgtgaccatagtcttcttggaggccagtggactaagacctatcgcaactacaaacccaaggttcaggaccctatctatgcggttntctctttgctcgaggctgtccgactggcggaa

SEQ ID NO: 6964 - DNA, 152 bp, Aspergillus oryzae
tccggttacgggtatcagtaccgggactattaagcatggcagcgagaagctgtctgccttggccgtcagcgggtctcccagcgaggttgagaccaagaaagcaaaggacctctctaccaagctttcctccgcatccgatgccgatcgcgagt

SEQ ID NO: 6965 - DNA, 669 bp, Aspergillus oryzae
  misc_feature (1)...(669): n = A,T,C or G
gaaatgggctagacgctttggtggggggtgcgcgcgatataaccaatgcgatatagctacagcacatatggccacgatacctgctctcggaaatctgctacacctaggggtgggcctagcgtgtccacatggacgcaatatgagttggggattctggcacaggaggtgcccgatacgctggtcggagggatgagccgacaagtgtggctgtggctggagacagctttgcgtgacccgcaaactgatgggtgttttatacacctcttcctggaacttataagacaaccgtcaacagtgcagtgctctttccactacgtcaacggagggagcctaaagcagatgttacagggccttacgaaagtatcatggtcgacgtatgcaaatcaggtctccgcgggtgcgaaataaaccaggctggaaattctcccacaaatcatcctttctcgcacctgtctacaaggattctgtaaaagtgacggcatttatcgatacaatactcatatgaggagtttctaaattgttagcgactacactaatcgggatattctccggcggcaaagttttgggaacatctacatccaaaccatgcaatgtaggtaaatcggactcgaatgtaaaaagacgcaaagttccaatgggactttgaggctctccaggttcaaaaataan

SEQ ID NO: 6966 - DNA, 642 bp, Aspergillus oryzae
  misc_feature (1)...(642): n = A,T,C or G
gccctccatcgagacaagttgtgtctcaacaggagttacgaggccgccggtccttaatccatcgcgtcgtccagaagttgacgacgctttggcgaaactcactcggattgagagacccttggatttttattagtcatgccttcggtgatgggaactgcttagagctgtggtgaacgtgctttgcgcatctgaaccgctagaccacatgacgatgcctctatgttcaaatagacataaacctacaccttcgcgaggacgcaacaataagttcgcatcttggatcagtcagatgtttgtcatgttgtgtctctggccctgcccccctctggtggaatgcgcatactgggggaaaaggcgagccttcgattatttagcgacgttgtccgaagggacgttccttgacgccatataaacgattggatctagagacacttaccgattagctatcgagtaggggggactgtggggtgttgaccagagcttctgggagctgtagctgcctaagccttgtggctgggacaggaaccttttgcgaaacggcacatattgtaagggacttgctatttgggttggttatcattgggaggggaaaaatatcactgtgtcnatgggtcatgctgtaagttaagtacactaaattta

SEQ ID NO: 6967 - DNA, 686 bp, Aspergillus oryzae
  misc_feature (1)...(686): n = A,T,C or G
ctttgtcgcaacatttttggaattctcttcttcctcataggcgactgctagctttattgaagactttcttattcgggaaaagacctggtctatggtcctgtctgaacggccaacagagtaaacctactccggatccatatcccctgacactgttccgaccgctgttccattattctaccaatctcgagaattcgcgatccacgcgttatatccgtcggaatattgacaggactgtcttgcgaccgattgggatggtccgcgccggctaaatacagtcgaaattggacacacaatgttcactccaagtcataattcctggggccaagctcgggtcagggaaacatcagtcgaacctcgagcaaagattggcccaagcacaaatttctggtcatctatgttagataagcgtcgcaactggaaagcgctttgccgganaatgaatttttcttattccttcgaggcaccctccataaagccaaatataggttttttacacaactgggtgctggcacatcatatccccaccttgtcatacaacatgacgaatggtatggttcccccccgtgtgccaatcaggttcgctttggggaacaccttcccagaatgtcctaaactcttaaccagaaaaacaactttgcggctgttttttgctatcttattttccaaccctccatttttttttgccc

SEQ ID NO: 6968 - DNA, 528 bp, Aspergillus oryzae
  misc_feature (1)...(528): n = A,T,C or G
cgaggaaagagtttccttcctgctggcttctctccgtttcccttttctcccttttctactgcctttcacaacctatttccaatggcctttgggcttctattctgatgatctgatgaccaaagcgggctttgctgtcgttatttatttttcttacattctaccacactaccttcgctaattggcattttcaatttgtcaaccggtggctccatgttgcgtcttaaaaggtgacattgcatgcttattaccggcgtcctgngtgttatcaaaagagataaatgtggctagaattcgtgcctgaccatgtaatactattcattgggatttatactttccgcttcgatgtttagaggtttctacatcatcgtttccattcgtttttcatactgtcttatcacactctntatttgcactgtgatcattgcatcacggtttacggcgaaatacccaaggggctactttattcttgaatacaaggagttaaacaagttcaaaaaaaaaaaannnaaanaaaaaaannnttttcct

SEQ ID NO: 6969 - DNA, 668 bp, Aspergillus oryzae
  misc_feature (1)...(668): n = A,T,C or G
gattcatttctcttcgtctttttatgattttagacgtcccaaactatgtctttatctacatcgtatacctgctcattctgtgggtacctgttgcacaacactcgtgcacttgctacttttgccgatgattttcattgtagccaggtagatggctcttgttcttatttttattgtttgggtgtgttcctgactagcggtcgtacagtgcggcttgtcggtatccgaaggtaatctgcaaatgcaagaagacctcgtggcactcttctccaggcagatgcggatggatataccaatatcgtctggcagtcaggaaatgccatcgtccactcatgttccggtcgcgcacagtatctcccaacattatcatcactcctctcatgtggctcgctgcacatttccaacaggatcgccgaagcatgatgagtccttgggccatagcgtgactcttaactcagcacatgaaatgctgaggttacagaacatcaacccatcatcacttacctcacacagctacagctatttgagaaatgcatgccnggagcacgactacgcttgatccagatctggcaaatcttccagagtctataaatgcatccgcaactcagggatgaagcggntgaatcagcgaacttcgaactgtgggcaaaatcttttggggggaaagcggg

SEQ ID NO: 6970 - DNA, 359 bp, Aspergillus oryzae
cctgtaatgggtggaagcttccttccttcaatggcatgcgtaaatggaaaaccatcttgaaatttatttcatacgatgcaacagggacgttcgcaggttaacatttataatatccatgtattgtaccataaatattccagggccgaaggaccagataccaggacaaagattggaggtgtacctcgcagaggccgtttgggtgattgattgatggatgaatgattggggtttgggtttaactattgacttgctgctcagcttggaaaaggcgcaactgttctggagttagagtatttgccgcgttcatctatttcaaccttcttatttagtccgaggtgaaatgaaatcgttaaattgtt

SEQ ID NO: 6971 - DNA, 638 bp, Aspergillus oryzae
  misc_feature (1)...(638): n = A,T,C or G
ccaatcttacggggctactatctactctgctgctggcacgccgagcacacccaatgccggtacaccccagcaccagggactgggcacactgacacctggcgctgtcggcggagtcttgggacaatttcaggttgggaaagcatgaaagtcatttagctaagatctcatttgtcaatgggtgttagatttggttgggggagtttatgatatgccttgcatcattgttcctctgtatctttccctttgtttggtctctttgtatgggcttcgtgtgtctgaaatcttactgggaattgtcgagtggcttcccccctcgggaacgttctccaggttcctggacgctatttgtcttattaccgttaacctcgttcacagcgattgcttttctctctttctcatggcggnggttgcgggatggatacgatatgacggatgttcatagcatgtagcaccacggcggcgcctctatctctacttatctttttgagtcgcattttctcggtggtaagggtctacatttcacggttcggcgcctagaagccttcatattgtctggaaaaagggttttcgcaaaggggtgccgggtgttgatatggggccgaaaataaaattccgggttcaaagggctctcaaaaaag

SEQ ID NO: 6972 - DNA, 682 bp, Aspergillus oryzae
  misc_feature (1)...(682): n = A,T,C or G
gggaaagcaaagcatgttccgagcagccaagcacctaggaatgcgggctctgataaacctcaaaccccagtgtcttccacccctaccgctgtaacacacaaccaggagaaaacaaaacagacatcggttacgcctgttaaagatcttaaagacttgacttgtcgttcggagaatattggaaacaatggtagaacgttctctcagccaacaatcagatatccaccaggcgattcggccactggtgtaaaacaatcactgtcacaggtaaaccctcagtcaagcgcgtcacgcaatggtgagcgccgagcttggaaggatgaatatcagaagtacgggaatttagggcgagaactaaaacatgccgctgaaagacataccgccagagatttcgtggctgatgttgacgagaagcttgccgctgctactgctattgaagctattctctgttttattctagcctttgttgctgacgaccaatccaaaactttgtctcgtcaggttagcgactcatcatcttggctatctatactcgcttattggcgtgtggtcaaaaagaatagcgcccctttcccacagcttcatagcctttgtttgattcttggcgctacatcctatgatgctattcatgctcttgatctggagcggttggcgggtcactctttgccggngggaaatacctctg

SEQ ID NO: 6973 - DNA, 690 bp, Aspergillus oryzae
gccattgtatgccgatttatcagacacacgtggtctgggcgtatacggcggccacatctatgctgaccacattaccgcgatctacaggtccgctccacatggaccgatcatcttcctgttgcgcgactaagtgatactggctgctggggagacacgagccacgccgtctgagggaccgaagattctcgaagacgatgctttgacacaggcgataggccctacccttagaaagcgagattcgaaccaagatcttggagctctggcagccactgacatctaccgtatcacatttgactagattagggggcatgagattgatgatatctgataaaaacgcactaccgaggtccactgccaatgcgccagatatcttctcttctggttcggaggaactcgccgcgtgatccgtccacagagccttatatgagctcatacagttgagcagctgatacggtgagcgcctcagcttctataacgcactgtggttctacccacactcataattggctgaggtgaatattcgagtaaagacctgtgtaaacgtcaacattgcttctactagataactcactatagcttagaatagacacttcatgatgagagccaagaagctcacgtgattatatgcgctaagagataaaagaagaaaaattctgctggcgtccaggatgcatatagaggggcgcatta

SEQ ID NO: 6974 - DNA, 745 bp, Aspergillus oryzae
  misc_feature (1)...(745): n = A,T,C or G
cgaggccggtgttgctggggccatggccaatacgatctcaaccggccgcatcagccgccgaggttcgggatggggagaaatcacgggcgatgaaagtgacgaggagaagccgagggatcgaaaggaggacgaagagcttgatatcaagtctgaagtgccaggcgaggcgaagaagggctaggttcatgaccgaaggttgtcccaatttgagattggggcgatcggagatgatgttacgcactcaagaaactgaatatccatgtataatttccgttcacatgatgactaatgcaaagaaggaaaggtagagaacgtttatgagggagttggttcggagttcgactgttttgtttttcttgggtttatgtcagtttctcgggtggcgataggatatttggacgaactgttgatggacttgatatcccctgcgaatgagtttcactggtcgttatcatttctttttcaattttcacagtctaataacatgctagttccagtngcccnnnnnnntntnnnnnnnngnganaaanaaaaagagnaaccaacagaaancctttcccaaaaannncctttttgtgcgccggcgaacnttttttttatccggcccccccttacaatttctttttgggcgcccccctttctccttctaggaggttaaaattacaccgggggggcgcgcgcttttgtacacccccttccttgggggaacccctgggttttccccttttttaacgggtggcggtta

SEQ ID NO: 6975 - DNA, 661 bp, Aspergillus oryzae
  misc_feature (1)...(661): n = A,T,C or G
cggcatatgtgaagtccgaggaagcatattccttagatatctgcatagaaatcgacaattcgaaggtacatatctgttcatttctgatttcctctttctcttccagcctaaggctagtatattatacattgctccagcaacaatgagaaagctgttgagactggcctttgctgcggtctcgttggcaggtatatccattgctgacaacttcaccacgacttgtaatgggtattaccttgaagacgatcatgttttgcatgcaacatgtaccgcgaagaataatgtggcaaaccagagacaacttgatttgaatgattgtcttgcaaatttggatggccagttagcacttgttgggaagggaaacgcatttgccacgtgtatccacggctgcggcctatgttttttagaaggagagaaacttacgtgctcctgccgaagaagcgacatgcggagtgtgacatttaatacactcgacttagatgttatcgttatgaatcangatgggaagctgtatgtaacctgtaggtattaactgagtaccttttattttcaaaggtactgtactangaaaactataagaaagcgaagggggtaagataacaccgtgaaatatattgtgggagaatattcttccattttttaccggcaaaaaaaaaaaaaa

SEQ ID NO: 6976 - DNA, 673 bp, Aspergillus oryzae
cgctgatctgatcagctcatgtttccagaatcaatataggacaccacatactacagtggctcccaaccccgcagatgtgaccccactctcttttgcattgtcttcgggcgaagggagaccaagcaatacgagaccatgcgaaacttcttcctttcccccgactggcggtggcggcatagttacctactagatatgtgtgatcaccgccaacaaaaaaactgcgcagtaaatacagaaattatagaaccaatttactacgaacgcccgttacacgtctgagctcactcttgcctacgaccagattctaaatcgaccattctaacttgaaatatatcggcaatcgcaaaggtcgaactgatctaccctacggattctcggaccctactacctcctatggtggattgcctccctactgcttttgtatcgccatttggacacgcctgcagctttgactgtcctatcgcctgtgctacgccagcgagttcaaggtctgaagtccctttgcgcctctccgagcgaaaaaagggtgagactgccttgttaggaatccggggaaggttgaacgtcttaaaagaaaatggacaataaccgctttgtaacccacccaagggaccgggagattggactgccccataaaaagccctgtggaaaaaaagcgccgaaaataagagcc

SEQ ID NO: 6977 - DNA, 675 bp, Aspergillus oryzae
cgaatattttgatcaacatgtgtgagcccgggaattcctccatttcgggttttgataaaacaaaggtccacgcgctggagtttgaatctacgtctgcgccggcgtccttgattttcagtgttaccttcacgccgcagatcctgcttggaatcagtacggccaagggcttagtatccggcggtgttggagcattcgtcaatctgccaaaagtatctgtgaatgcgactcaactgagtcatgtcagtgaaaagtgtgagcccgtggctgataaagggaatgaaggtagcagcttgatatctgtcctggatgatgtcttcgacagcctgacacatatcgccccttcggtggacatcgacatgggtgtcctcgctaacatggaagtcgacgttgctgattttagtgaaagggtcggagtacaagctgtcttggcatcaacctcctatcctctacccaccgcttgtctgaagtatgatgcgaagagccacacatatggtactccttcacggacgccaaacgctaccgcaacttcggggtcaactaaaggagccgctgacagttcgtccgattcggataaacagtctggtgccggcaagttgttagaaagtctttaaattcttccgctgagtattttggccgcttcaatgattgctgttggttggttgtgttattgaatgg

SEQ ID NO: 6978 - DNA, 740 bp, Aspergillus oryzae
  misc_feature (1)...(740): n = A,T,C or G
ggagaactcctctcgacaagccaaaccattccgatatgttgagttctgccaaaaccaaaccagcgccagtctttgcgagcaccaggctcgtaaagtccgagttgactgctgctttctcttttcaaagacccaatggggacagcttgacgatcgagattccggtctaatgtacctggatctgacctttcatcaacccagtgagtgtaaactggccaatgcgacaatcaccatgaccttcaatcacaccaatgagcagcgaggaggcctcaaggatagcgtggaagtcaccgaattcttcggtcctcagatgttgagcggagaaaaaaaagagcgacacatcagcaaatgcttctacatgaatccaaagttcggcgctgcgaatgcatcgtttgaaggtgtgggtggatcacgaacatcggacgccactctttcctcaagatggaaattcacaggatcgcgattcaccgtgaatgacccattgtcgcgccggtcaaatcgtgcctatcgtcaacttgtctggcatcttgaggaaaatgacctcgagagacaggctattcacaatccagtcatccatactgctcttgccttccatcatcagtccaaaccattctacctcgatttagaaatcaaggcanaactgcacagttggcatcatcggttcaagcaacatcttgtctatcctcctnctagtcaggtctcacgcacgcgggcgaagatcgatcctggtgtggagacagacn

SEQ ID NO: 6979 - DNA, 720 bp, Aspergillus oryzae
  misc_feature (1)...(720): n = A,T,C or G
caatatcgactggggaaattggtggtcgtggaataaggacgcttcatactccaccgatcgtgcatatgactatatccacgttattggcgcatactggtcattgtatcgcgccggccgcgacaaccctacccttctcaaggtgcacccatggcagtggtatctgggccaggcgtacaatacgaccgtaacgtgctttgcgacaaactctgccggtgacggcctggtaggttattcgcgcctgggtctaatgggagagaccgttgtcggagagctcctggcagatctgcaacgcgaaggctggaccgaagaggcggacgcagtagaagccgccatgaaactgcgcgcggaagcgtgggacaggcaatcggagccctttggaagcgaaatggcatgggattgcacgggccaggagggcgtttattactggagcaattatttcaatcttacgcagacaacgacgaagaccatcaatagcattttaggtctgatgccaacggtatcgcattggggctggaatggngaacgcccgcggtactgggatttcatgtgagactcagtccagcatctgcctgtccaagactaagatcctttagctatgccgggaagctccaacggattgaacgcatgatccatcattatggttccagcctcaacgcattgcccctnctcgctgagtttcgancaaacccgagcgacacctatctncttcgaggtgggtcn

SEQ ID NO: 6980 - DNA, 664 bp, Aspergillus oryzae
tccttgtcgtgatacattaacagtaacacatcagagtataattttatctatttctttttaatatttcctccttacagactttacaatacatcatggatctcgtcaccaaatggggccatttcagtaaggaatacaagcaaaggagaaaatccacgtcctccaccgaagaacataagggcggcgaggaacataagggcggcgaggaacataagggcggcgaagaacatgaggaacagcgggcgttcaactggcttttgggaaaattcggccgtcctcacaatgatcatcctgataggagatcgagtggtgcggggaacatggcaacagatatcgatgaatggagacgcagccagaagaagtcgacttcgtctcagcaaggagtccctgatctgaagtcccaggaaggggtctcggatttgcgacctcaggaaggtgtttctgatttgcatcctcaggaaggaatttccgatttgcggactcacgaacaggtctctgatttgcggcgtcaatgagcacgaattgctgtcttttatggcgatatgatttcttatgtattgattgggggctttttctgaaatctggggtaactggtttccttgtattgtacggagtacattatgaccttatgatgatcgacgctgtagataattatgggtaaataacc

SEQ ID NO: 6981 - DNA, 775 bp, Aspergillus oryzae
ccttctcttccttctcattacatcctatagattatattagtcttccatcacctccagccttaaaagtactgaccggattgtgttgtgcagatttcttaaattcgataccaaccgctctttcgactgagcggtcgctttaaaagcctctctctctcactctcttatttttttttttttctaaaaaaaaaaaatcacattaccaacaaaatggctcttaagagaattaacaaggaactctctgacctcggccgtgatcctccctcctcctgctccgctggacctgtaggtgaagacttgttccactggcaagctactattatgggtcctggtgactctccatactcgggaggcgttttcttcctagcaatccacttccctaccgactacccattcaagccgcctaaggtcaacttcaccacccgtatctaccaccccaacatcaactcaaatggcagtatctgtctggacattcttagagaccaatggagccctgctctcacaatctctaaagtgctgctgtccatctgttcgatgcttacagaccccaacccagacgacccgttggtgcctgaaattgcgcatgtgtacaagactgaccgcggtcggtatgaagcgaccgcccgcgaatggacccggaaatatgctatctgatcttcgaatctcaataaaacacggccaccttggtcttccaaatcgcttctgcgtcttctttcgttccgttagatcagatccgaagcctggcgtaccgggacagaaaatctttccctggtttccg

SEQ ID NO: 6982 - DNA, 1167 bp, Aspergillus oryzae
ccacgtccacccgttatatttctactccggcatttcttccttgacatcgattcttccttcttcatacttttcttttccaatcttccccatcttcttctgaatataccccttcgttcgtgataccattccggctttcacaatgtcttcttctcttgaacagctcaaggccaccggcactgtcgttgtctgcgactctggtgactttgccaccatcggcaagtacaagccccaggatgccaccaccaacccctctttgatcctggccgcttccaagaagcccgagtacgccgcccttatcgacgccgctgtcgagtacggcaagcagcacggcagcaacgtcgacgagaaggtcgacgccacccttgaccgtctcctggttgagttcggcaagaagatcctcgagatcatccccggaaaggtctccactgaggttgatgctcgcctctctttcgacacccaggcttccatcgacaaggccctccacatcatcaagctctacgaggagaacggtatctctaaggaccgtgtcctgattaagatcgcctccacctgggagggtatcaaggccgctcaggtcctccagcgtgaccacggcatcaacttgcacctgacccttattgtctccaccgtccaagccaatcgtggtggccaggccggggcctacctcatctcttctttcgttggccggattcctgactggtccaaggctgcccacaagcgtgactacactgcccaggaggaccccggtgttaagtccgtccagaacattttcaactactacaagaagcacggctacaacaccattgtcatgggtgcttccttccgtaacactggtgaaatcaccgagcttgctggctgtgactacctgaccatctcccccaacctcctcgaggatctctacaactctaccgccgctgtccccaagaagctcgacgccgccagcgctaccggccttgacatccccaagaagacctacatcaatgacgaggctctgttccgcttcgagttcaacgaggaggccatggccgtcgagaagctgcgtgagggtatctcccaagttcgcggccgatgccgtgaccctgaaggacatcctcaagcagaaggtccaggcctaaaggcagactgtcacttgcattaattaaagttatgtccatgcaatgtcctcat

SEQ ID NO: 6983 - DNA, 555 bp, Aspergillus oryzae
cgaggcaaaggtggtcaacagaaccaggacttccacgatttgctgcgtctgtacttggccctgcacggtgaccacgagggcggtaacgtgtctgcccacgctacccacttggttggaagcgccctgagcgaccccttcctgagctacagtgcgggtcttttgggtcttgccggacctgtgcacggccttgctgcccatgaagtcctgcggtggatcctgtccatgcaggagaagatcggaaccaagttcactgacgaggacgttcgtacctacctctgggacactctgaagtcgggccgtgtcgtccctggctacggacatggtgtcctccgcaagcctgaccctcgtttcgaggctctcatggactttgctgccactcgccctgatgtccttgccaagcctgtcttccaattggtcaagaggaattccgagatcgcccctggtgttcttaccgaacatggaaagaccaagaacccccaccccatggtgacgccgcgtctggtgttttcttctaccactacgggattcaacagcccctttattaaaccgtacctg

SEQ ID NO: 6984 - DNA, 644 bp, Aspergillus oryzae
  misc_feature (1)...(644): n = A,T,C or G
ctgaccccaagcaggcacccttcgctgccgatgctaaggagtttgtccgtaagaggctcatcggaaagcatgtcaaggttaccatcaacggcaagaagcctgctaccgagggatacgaagaaagggacgttgccacggtcatctacggaaataccaacattgctctggctcttgtcgaggccggctacgcttctgtgatccgccaccgtcaggatgatgacgaccgctcccccgactatgattctttgctgatcgctgaggctgatgctcagaaggacggtaagggaatgtggtccccaaagccacccaaggcgaagcagtaccaggactactctgagagcgtccagaaggccaagatggaggtttccatcctccagcggcaaaagcgcgtgccggctatcgtggactttgtcaagtcgggctctcgcttcacagttcttgtgcctcgtgagaacgccaagctgaccctcgtcctgtcgggtattcgtgcgcctcgatcggcccgtaaccncaacgaacagtccgaaccattcggacaggaagcacatgacctagcanacaggcgttgcatgcagcgtgatgttgaaatcgacgtcgagacaatcgacanggtggtggtttcaatcggaccctttacgttaaca

SEQ ID NO: 6985 - DNA, 680 bp, Aspergillus oryzae
  misc_feature (1)...(680): n = A,T,C or G
ggccatgctaccaccgcctactatgctcacaagcgtggcaagaagatgatcgccgaggccctcgaagacccagagatccgcgagactgtgcacaaggtgctcgaggagactgcttccctcattgtatccaagcatgagatctcggagcaggagcagaaggaatacgttgacaagattgtcagccgtatctccaacccctatctcgaggacaacgttgagcgtgtgggacgtgctcctctccgcaaactgtctcgcaaggaacggttcattggacctgcttcgcagctcgcagagcgcggccagaagttcgatgctctcctgggcgccatcgagatggctcttcgcttccagaacgtcccaggcgacgaggagagttccgagcttgctcgcattttgaaggagaactcggccgaggatgccacctcgcagctcaccggattggagaaagaccacccactctactctcatgtggttgagcgtgtgtccacggtccagcaaggctccaaatcagtgctgtgattctcgatcgttttccacaccaccacactcctttntatcaccagaaaacgaagggttccgagtccatcaccaatatggatcgccccgaggatattggatctgatatcanactgttctgtccgctggccgggcatgaactgcatgggatacggcgaacatat

SEQ ID NO: 6986 - DNA, 662 bp, Aspergillus oryzae
cgaatctacaaatacggtggccagccattcgcaagagattacctggcgaagcatcatggtgctgagttcgataatgctttcggaaaaggaactggtaaggctatcatgcatgctaccgccggaagtttgatcggtatcggtgaaatcgtccttcttcctttggatgtcctgaagatcaagcgtcagacgaaccccgaagctttccgtggccgcggtctttttaagattatctccgatgaaggcatgggactttaccgcggtgctggctggactgctgctcgcaatgcacctgggtctttcgcgctgtttggtggttctgccttcgccaaggaatacatctataagttgcaggactataattcggcttcctgggcgcagaattttgtggcatctgtctgtggtgccagtgcctctctgatcgtgtcggcacccctggatgtgatcaagactcgtatccagaaccgcaattttgagaaccctgagtctggcttccgcattgtctcgaacatgatgaaaaacgaggggcccaccaatttcttcaagggtcttacacctaaactgctcatgaccgggcccaagcttggtttcagcttctggctgggctagacgttgatccccgcgtttggccaggtcgtataaaccagaagagcacggaatgattt

SEQ ID NO: 6987 - DNA, 680 bp, Aspergillus oryzae
gacggagccgactgtgtcatgctttctggtgagaccgctaagggctcatacccttgtgaggctgttaagatgatgagcgagacctgtttgctcgccgaggttgccattccccacttcaatgtctttgacgagttgcgcaacctcgctccccgccccactgatactgtggaatccatcgccatggctgccgttagcgccagtcttgagcttaacgccggtgccattgttgtcttgaccaccagtggtaacactgctcgccttctttccaagtaccgccctgtgtgccccatcctgatggtcacccgtaaccctagagcttcgaggtattctcacctctaccgtggtgtctggcccttcctcttccccgagaacaagcccgacttcaacgtcaagatctggcaggaggacgttgaccgccgtctcaagtgggctatctcccacggtatcaagctcggtatcatcaacaagggagacaacattgtctgtgtccagggttggcgcggaggccagggccacaccaacaccgtccgtgtggtcccagctgaggagaaccttggtctgattgagtaaatccagacagcagtatcacccttggtgcatgacgtggtaacgacagcaactgggtaggtaagtagcgacgagggtgtgtcctcagagtcgtaaacgggtctcggctaagt

SEQ ID NO: 6988 - DNA, 759 bp, Aspergillus oryzae
ttcgcgatcacctcctccacttccatcccaccttaattcatcctcaatcccgaggcattacatctctcgttcacggagagtgtatttgatttctaattggtctttttttgtcgcgcgcacgacctcccacacaatgttccttcagtccgtctctcgggctgctgctcgcagctcggccatgcccaccactgccattcgttcctatcgcaccgtctcgggcccaatggcttgcctgaatgcccgccctcagcctgtgaagaagtctatcgctccccagcagacccgcgcctcatccgagcacgccatctcgaatcccacactcgccggtatcgagaagcgctgggaggccatgccccctcaggagcaggccgatctgtggatgcagctcagggaccgtatgaaggttgactggcaccagatgacccttcaggagaagaaggccgcttactggattgcctttggtcctcatggccctcgcgcgcaggcccctaagggtgagggtcttagaattgccgttaaggtcgcccagcttactgctgtctccgtcgccctgttctacgtcattcacttgttcgctaagccccagcctaagaccatgtccaaggagtggcaggaggcttccaacgagtatgccaaggccgagaagatcaaccctatctacggtatcagtgccgagggttacgagggcaagggcttcgtccagagcccttctgctgagaagtcatagattgtggaccagtgatgcgggatgaacaagtt

SEQ ID NO: 6989 - DNA, 655 bp, Aspergillus oryzae
  misc_feature (1)...(655): n = A,T,C or G
gaaggcagtgcctgggatagtatcatgacaaactataagttcaacacgttagtcgctcggtatcaacgtcccggatattacaacgatcctgacttcctaattgcggaccatccgggactgtcactggacgaaaagcgatcccaattcgcgctttgggcttcgttttcggcacccttgattattagtgcacatattcccgacctatcatctgaggatctagagtacctaacaaatcaagccttgattgcggtcgatcaggatcctctggcgcaacaagccacactggccagtcgcgatggctcccttgacgtgttgacgcggaatcttgccgacggttctaggttggtcaccattctgaaccatggtagcgagtccatcganacagatatttccctggacatactcggcctctctaccgattgtacatacaaagcacaagacctctggggcggctctactcagaccatcaaggatgcgatacgtattaagttgaacacacatgcgnacgccgtgtataaaatagacaccgatgagaagtgctctcaagtcatanccaacggncttatctttaacacggcctccggaaagtgtcttacaggaacctcatcctctgtgggatctgaatcctgcancgggagcaaatcccagatatggn

SEQ ID NO: 6990 - DNA, 1339 bp, Aspergillus oryzae
  misc_feature (1)...(1339): n = A,T,C or G
ggcgacagagtataaactactcgttcgagctgaacgacccaagtctgctccactttgactccttcgtcggcaacagctgggtccaggcgaagagtgggaaacgctttgaggtcgttgatcccggaaccgacattccttgggccagctgtccgaccaatagtgccgaggacgttccatcagctgtggaaaccgcgcacgccgcgttcgagcaatacaagaaaagtaacccccgccagcgagcacaatggctcctgaaatgggatacgctcatccgggaagccaagcccgacctcgccaagatcctcacacacgagacgggtaagccgctggccgagtcctacggagaaatcgactacgcgaccggtttcacctggtggttcgccggcgaagctgagcgcatccacggcagcatcagcgtgccctcggcgccaaaccgccgggtcttcacggtcaagcaacccattggcgtggcggccgccttagtgccctggaactttcccatcgcgatggtcctgcgcaaggcgggcgcggcgttcgccgcgggttgtaccatgatcgtgaagccgagccccgagacaccgctgacagcgctggtgttggcgcatctagcgcagaaaagcggtttcccnngcggcgtgtttaatgtgctgacgacggatctggagaatacgccgtcgttgagtgaggcgttgtgtaagcatccgttggtgaagaaggtaactttcacaggctctacgcgggtcgggaaattgattgcttcgcactgtgcgcatggactgaagaagttgacgttggagctgggcgggaactgtccgttcctggtgtttgatgatgctaatctggatcaggcgctggatcagctcatggcgttgaagtggcggcatgctggacaggcgtgcatcacagccaaccgggtgtatgtccaggcgggcatctatgatcgctttgcacagttactcaaggagcgtacgcagaagttggtcgtgggtcatggtgccaaagagggcacgacgatgggccccgtgaccactcctcggagcattgacaaggcactcagccaggtcgaagatgcccgtcgacttggagccgacgtgattctgggagggaataaggtcacggataccaaggggtatttctttgagcccacgatcctgacgggcatgaccaaggacatgttggtgtccnnggaggagacctttgcgcctatcgctgccctctataaatttgaaacggggaagaagcanngcactcggcaatgacactacatgggacttgccagtacccttcacaagaaattgatcgatggggaggtacttaaaaacttggagctggttgattg

SEQ ID NO: 6991 - DNA, 682 bp, Aspergillus oryzae
  misc_feature (1)...(682): n = A,T,C or G
gtacgccatcgactcgagtcaagcagtgttgcgaagcgccttctcaaagtcatgggagtattggcggttaccatggtccttgcagatggcctccttacaccggctcaatcagtgctaggagccgtccaaggaattgaagtagtatcacccaatatttcgaaaggcaccattataggcgttaccgatgctatcctagtcgtcctattcctaatacaaccgcttggtattaccaagcttacatttgcttttgcacccattgtcatcatatggctcggctttaacgcagctttcggcatatacaaccttgccaagtatgacgctggtgtcttcatagcgttcaaccctgggtacgccttcagtttcctggcccggcatggagaggagggttggaggatgcttancgggacgctattagctttcactggagttgaggctctcttcgcagatattggagccttcagccgaagagctatacagattagctggctaggttacgcctttccatgcttactcctagcttatatcggacaagcagcctatattagtggtcatccggaaacatattcgaatccattttttaatgccgcaccaccgggcacggtctattctgcgctagtcattgcaattctagctgccattgttgcctctcaagccattaataccgcaaccttttcagttctga

SEQ ID NO: 6992 - DNA, 658 bp, Aspergillus oryzae
  misc_feature (1)...(658): n = A,T,C or G
ccggcgatgatatcccgctgatggattatctgctccgtgagcaggagcggattcagtcgcgcgtgcgtcgctaccagtccccggatgaatatcctttctttccggatgtccttgaggagccgatcctagcgccgctggagtatccgaagatccttcatgacaatgatgtgaacgtgaacgataccatcaaacggcgctacgtcgaggatattctccctgctgtctgtccgcagtttggacgtgaggatcgtggtgagacgcaggagaactatgggtcggctgcgaccgccgacgttagctgtctgcaggcgctgtctcggcgcattcacttcggcaagttcgtggccgagtcgaagttccagaaggagccggagcgattcgtcaagatgatcaaggcgaatgatcgggttgggatcgatgatgctattaccgacgcaaaggtcgagcggaaggtgctggagagactggcgctgaaggcgaagacttacggaactgatcccgcattcccgacggagaccggctcgaagatcaacgtcgatgctgtggttgccatgtataaggaatatgtcattcctttgaccaaggtcgtatatgttgaaaacttaagcaacgcctgaagggaaccattgggagtanatgaaggatggataaagattta

SEQ ID NO: 6993 - DNA, 730 bp, Aspergillus oryzae
  misc_feature (1)...(730): n = A,T,C or G
gcttagaggtggtgaaaagggcggaaagggtctacctcgaagcatatacaagtattctgctcgtcaacaaagagaaactagaagctttctatggacgtcctgttattgaagcagaccgtgaaaaggtcgagagcggaagcgatgagattctcgctggagcagataaaacagatgttgcattcctagtcgtcggcgatccttttggcgccaccacccatacggacctcgttctgcgcgcccgtgaactgggcatcgaatctaaggtcatcccgaacgcatcgatcatgtccggtattggttgcacgggactgcaattgtataacttcggtcaaactgtcagcatggttttcttcacagaaaactggaagccctcgtcatactacgataagattaaggagaacatttcactgggccttcacaccctcgtgctcttggacattaaggtcaaggagcagtcgtacgagaacatggcccgaggacgcctgatctacgagcctccgagatatatgaccgttgcgcagtgcgccagtcagatgttggagaccgaggaggagcgcaaggaaggtgtttatggacctgacagcctcgcggtcggagctgcgagagttggagccccggaccagaaattggtcgtcngaactctgaaggaatnggcagaggtcgagatgggcgcacctcttcacagtctcggtcttctgggaaggaaggcgcatgacttanagaaggactt

SEQ ID NO: 6994 - DNA, 664 bp, Aspergillus oryzae
  misc_feature (1)...(664): n = A,T,C or G
ctcattcggcttttatttccatccaacttctagactttaccccactatctatagatatcgtcacaatgtgccctggtgcagacaacgagcccaatgggcacgcggcccctgccaatggcaatggcgaacaccccggcttcactggcatcgagactcgccagaaccctcacccctccgcctcccggaacccctatggccacaacgttggtgtgaccgactttctgagcaacgtctcccggttcaagatcattgagagtaccctccgtgagggtgaacagttcgccaatgctttctttgataccgaaaagaagattgaaatcgctaaggctctggatgatttcggtgtcgactacatcgaacttaccagtccttgtgcctctgagcagtcgagacttgactgcgaggctatctgcaagctcggcttgaaggccaagattcttactcacattcgatgccacatggatgatgcccgtgttgccgtcgagactggtgttgatggagttgacgtcgtcatcggcacttcgtcctacctccgtgagcactctcacggcaacgatatgacctacatcaagaacactgctattgaagttattgaatatgtcaagtcaaagggcatcgagattcgattctctagtgaggactccttccgttctgnactcggcga

SEQ ID NO: 6995 - DNA, 1409 bp, Aspergillus oryzae
gccttatgacgaaaagaccggcattccggatgtcgaagaaacctcgccttcaccagtcgagtacgacgaggacacgcccactgaggaagagttggccactctgcgccgtgtgccaggaagcctcccgattgtggcctatctcatctgtgtggtcgagttctccgagcgagcttcgtactatggtgtttcgggcctcgtttccaacttcgtcaatcgtcccctgcccgtcgggggcaatggctacggtgcacctccgcggggtacgcagcagacggctggcgccttgggcatgggcactgtcaaggccaacgccgtcaaccagtcgttcagcatgttagcatacgcccttcccatggtcttcggctacctgtccgatgctcatacgggccgcttcaagatgatctactggggtgttttcgttttcggtatcgctcatgtcctgatggtgggagcgactgcgcccaatctccttgccaatgggggtgcgaaagcgcccttcttcatctccctgtatatgttgtcggtcggtgccgccatgtttaagcccaatgtctcccccctgctgttagatcagatgcccaataccaaggcgaagatcaaggtgctgtccaatggcgaaaaggttatcgtcgaccctgaggtcacgaccgagcgtgctatgctctggttctatctgcttatcaacattggcggcttcatgcaggtcgctacctcctacgcggagaagtatgtcgggtggtggttggccttcatcctgccgctgtttttgtatctcccgcttccggccctcttgttctggctgcgtaaacgtctcgtgctccaccccccgggcggcagtgacttgctcaatgtctgccgtgtattgggcatctgcctccgtggcggcggtatcttgcgcattggacgccatggcttctgggacgcggccaagccgtccgtcatcgcagcgaagggacagaacattcggactcattggaatgaccaatttgtggaggatgtccgccgcacattccaggcgaccggcatcttttgcttcttccccatccagtacatcaatgacaacggactgggcaacgcggcgagctttttgtcgaccatgttgaccacgaacggcgtcccgaacgatgtcatcagcaacttcaactctctcagtatcatcgcgtttgcccccgtcctcaactacgggttgtatcccctcctgcgtcactttcacatccgatatgagccggtggcccgtatcacaaccggactggccctgtctactattggtggcatcggctacaccgttctgaactactacgcctacaaactcggaccctgtggcaagtatggctcttcggacacctgcgtggatgccgacggagtttccttggtggctccaatcaccatttggtggatggccattccct

SEQ ID NO: 6996 - DNA, 671 bp, Aspergillus oryzae
  misc_feature (1)...(671): n = A,T,C or G
cataaatacggtttcctctcttgctggggagttgatcacttactacatactataacaccagtgatagtatttccatcaaacaaaaacaatataattccaaagaaagtcactcgctttagtactcaagatgtggcagccaagctctgcacttcttcttgtcgcgtcacttctcactgctctcccagtcaacgctgatgggctgtacactaaaaaatcgcctgtgctgcaggtggatcacaagtcttatgatcggctcattgccaagtccaatcacgcatcgatcgtagaattttacgctccctggtgtggccactgccaaaatctgaaacctgcctacgagaaagcagccaagaacttggacggtttggccaacgttgccgctgtcaactgtgacgatgacgaaaacaaacctctgtgtggccggttgggtatacagggcttcccgaccctcaagatagtgacaccttccaagaaacctggcgcaccaagggtggaagattaccagggccagaggaccgccaaagctatagtcgatgcagtggtggaccgcatcccanaccatgtgaagagggttacggacaaggacctggacaaatggctttccgaagatgaaaaagccccgaaagctatccttttcaccgagaaaggcaccacgagtgctctcatcaaag

SEQ ID NO: 6997 - DNA, 702 bp, Aspergillus oryzae
ggatattgctctatcctaattctgcacgacgcggctggaaggccgccagactctaagatctccttatatgtagaattgacccaccaggctgtcacgacattgacgatgctcttcatgcgcgaccattgcccaatggcaactatgaagtaggagtccatatcgcagatgtatcacatttcgttaaaccgaataatgcgatggacctcgaggctagtctgcgtggcacaacagtctatctagtcgacaagcgtatcgatatgcttccacatttgcttggtaccgatcttagttcgctcaagccttacgtggaacgttatgctttctcggttctgtgggagatgactccaaatgctgaggttgtctctacagacttcaccaaatccgtcattcgttctcgtgaagcttttagttacgagcaggcccagatgcgcattgacgatccatcgaaaaaagatgaattaacggagagcatgcgcactttgcttcggttctccaagattctccgtcagaagcgtatggacgcaggtgcactgaacctggcctcgcctgaagttcgtatcgaggccgataacgacgaggttggagatccacttacggatgtcaagacaaaagctatgctcgcaaccaacagtcttgttgaagatttatgcttcacgccaatatcactgttgcagctaaaatctacaggaccatttcccacat

SEQ ID NO: 6998 - DNA, 716 bp, Aspergillus oryzae
caaacctcaccgccagcgctccagccttcgcaaacctcgcactccatatcaccgatcttcagtaccaacccgttcggactggatcgatctcaccatgtggatcattaactggttctacgatgtcctggcctccctcggcctgctcaacaagcacgccaagctcctcttcctcggcctcgacaatgccggaaagacgacccttctgcacatgttgaagaacgaccgggttgccgttcttcagcccaccgctcatccgacgtcggaggagctcgctatcggaaacaaccgcttcactacctttgacttgggtggtcaccagcaggcccgacgtctctggaaggactatttccccgaagtgagcggtatcgttttcctcgttgacgccaaggaccacgagcgtttccccgagtccaaggccgagctcgacgctctcctcgccatggaggagctcgccaaggtccccttcctcattctcggcaacaagatcgaccaccccgacgccgtcagcgaggacgaactgagacaccagctgggactctaccagaccacaggaaagggcaaggtgccacttgagggcatccgaccgatcgaggtcttcatgtgcagtgttgtgatgagacagggttacggcgagggtatcaggtggctgtcccaatacgtttaagcttgaaaaacaaaaactcgcaggtaaccttggaccgaaacatttccaaagg

SEQ ID NO: 6999 - DNA, 710 bp, Aspergillus oryzae
cgaggcgtagaacctgcccacaacgacaacaaccgccgacaacatacatcccaagggagtatcctagagcagcgctcttcctttcgctggatattttcgtgacagaagagcaggatgtcctccaccgagccagtcgtcgtcattgacggcaagggacaccttcttggtcgtctggccagcactgtcgctaagcagttgctcaatggtcagaagatcgtcgtcgtgaggtgtgaagccctcaacatctccggcgagttcttccgcgcgaagctcaagtaccacgcctaccttcgcaagatgacccgtttcaaccctacccgcggaggtcccttccacttccgtgctccctctcgcatcttctacaaggccgtccgtggaatgattccccacaagaccgcccgtggtgctgctgccatggagcgcctgaaggtcttcgagggtgttcctcctccctacgacaagaagaagcgtgtcgttgttccccaggctctccgtgtcctccgtctccgccccggccgcaagtactgcaccgttggccgtctcagccacgaggttggctggaagtaccaggacgttgtcgccagactcgaggagcgcagaaaggtcaagagcagtgcatactacgagcgcaagaagggcgctcgccgccaactcgtccaggcccagaagtcgggcggtgtcagcgacaggaccaagagccagcttgctca

SEQ ID NO: 7000 - DNA, 670 bp, Aspergillus oryzae
  misc_feature (1)...(670): n = A,T,C or G
tatttggtgatgcctcttttccatgtccatggcctgctagcagcattcctggcgcctctatactctggaggatccgtcattgtacctccaaagttctcggcccatgaattctggtcagacttcgtagcctacaacgcgaactggtacacagctgtgcctactatccaccagattctgcttaaaactcccctgcccaatcccatccccaatatccgcttcatccgctcatgttcctcaccattatcccccaaaaccttccaggatctggaaaagacgttcaacgcgcccgtcctggaggcgtacgcaatgaccgaagccgctcaccagatgaccagcaacccacttccgcccggaaagcgccaacccggcagcgtcggcctcggacagggtgtagagatcaagatcctcgatcaagatggcaacgaggttccccagggcaaggaggccgagatttgcgtgcgcggtgagaatgtaaccaaggggtatctgaacaacccatccgccaacaaatcttcgttcaccaaggacgggttcttccgcacgggagaccagggtaagaaggatccggacggcaacgtgatcatcaccgggcgtatcaaagagctcatcaacaggggcggagaaaagatcagccccatcgagcttgacaacacgctcctacaccacccan

SEQ ID NO: 7001 - DNA, 631 bp, Aspergillus oryzae
  misc_feature (1)...(631): n = A,T,C or G
cccaagtcgtcaggatgtcgaagaataccagaatttaagagcggtagtaaatgagctagtgggccgaatcaacggcaaattcggaacggtggactacatgcccatccacttcatgcacaagtcggtgagcttcgacgaacttattgctctatatgcggcatcagatgcctgcattgtttcttcgactcgcgacggaatgaatctggtatccttcgagtacatcgcaactcaacagaaacgcaaaggcgttctgatcttgtctgaattcgccggtgctgctcagagtctcaatggaagcattgttgtcaatccatggaacactgaggagctagcagaggcgtatcatgaggcggtttcaattagtgaagaacagcgcgccgttcaatttgcaaagctctacaagtatatctcgaaatacacaagtgctttctggggtcagtcgtttgtggccgagatgtctcaatgctcatcttgatagactagaatctatctttccttcgttctcttcagtctttctgggtacagtcaagcgtggcagttatgtttcttttcgtgatggcatagcattcgattctaatacatagatctgatgactttctgatgaggcttagcaacagtcatatgtttaatn

SEQ ID NO: 7002 - DNA, 666 bp, Aspergillus oryzae
  misc_feature (1)...(666): n = A,T,C or G
gacagtctatccaacaacccttctccaacgacctcttcgccgttttcaaacccaccttttcctaccaacaacgccaatatcccctccacaatgcgtgagatcgttcaccttcagaccggccagtgtggtaaccaaataggtgccgctttctggcaaaccatctctggcgagcacggccttgacggctccggtgtttacaatggctcctccgatctccagctggagcgtatgaacgtctacttcaacgaggccagcggaaacaagtatgtccctcgtgccgtcctcgttgatcttgagcctggtaccatggacgccgtccgtgccggtcccttcggtcagctcttccgtcccgacaacttcgttttcggccagtccggtgctggtaacaactgggccaagggtcactacaccgagggtgccgaactcgttgaccaggttgtcgatgttgtccgtcgcgaggctgagggctgcgactgcctccagggtttccagattacccactccctcggtggtggtaccggtgccggtatgggtactctcctgatctccaagatccgtgagggagttccccgaccgtatgatggccaaccttttccgttgtcccctcccncaaggtctccgacacccgtggttgagccctaccacggcaactctttcggtcaacaa

SEQ ID NO: 7003 - DNA, 1354 bp, Aspergillus oryzae
  misc_feature (1)...(1354): n = A,T,C or G
cttaagctcccctggagactatcatcccgttattgtcctttgactgaacccatatcctaaatttcttctcttgttccctgatttctctctctcccccgactcaagccatttatttcccctcttaaccactttattctcttccctctccctataatttaatcagtgccgttgcacctgcaccatggccgaaatccgtcgcaagcttgtcatcgtgggtgatggtgcctgcggtaagacttgtcttttgattgtcttctccaagggtaccttccctgaggtctatgtccccactgtcttcgagaactatgttgccgatgtcgaggttgatggcaagcgtgtcgagctcgctctttgggatacggctggtcaggaagattatgaccgtctccgccctctctcctaccccgactctcacgtcatcttgatctgcttcgcggttgactcgcccgattcccttgacaacgttcaggagaagtggatttccgaagtgcttcacttctgccagggacttcctattattctcgtcggatgcaagaaggatcttcgcaacgaccccaagaccattgaagaattgaccaagacctcccagaagccagtcaccgccgaacagggtgaggaagttcgcaagaagatcggagcctacaagtacctcgaatgctctgcacgaaccaacgagggtgtccgtgaggtcttcgaggctgccacccgggctgctctcttgaccaagactcacaagaagaagaaggggtgcaccatcctgtaaactagttttcgtctccttcacaaaaggtctgtgtttaatgcggagattatatgaacggataagggtctcgactatttggtgttttcttttactcagaaaggggtcctccgttggcgtgttccgatctgtgcctggatgcgagtgtggataaagttcaatcacgggcacacgaggtttatgggattatctggctatgcagttggtcgactttcttgttttgcagacttcttctattttatttctagggaagcgttgtcttcataaccttgtgggttttcttctcttttccagctctccgtacgcccacgaagcggttcgatcactatggcagaggatggctatttcgctggcangaaaacagggtcatcaatacctggatagtgcagatcggaaataagctattgaggatggcgttgtctcgtgtgtgtcccgtcagtcaaggatcttcgggaggttgataaagaaaagtcgaaatttcgtgatacgatagatgatttctatcaccttcggattttcccaacaggagntctttattgcctttgggtgtggtggttttcgggtaaaagaatgcatggaatcatttttgctttt

SEQ ID NO: 7004 - DNA, 592 bp, Aspergillus oryzae
cccttgaggatgaacttgatgtcactgatggtatgcgtttcgaccgcggttacacctccccttacttcatcaccgataccaagtcccagaaggtcgagttcgagaagcccttgatcctcctttccgagaagaagatctccgctgttcaggatatcattcccgcccttgaggcctccactaccctccgccgccctctcgtcatcattgctgaggacattgagggtgaggctctcgccgtctgcattctgaacaagctccgtggtcagctccaggttgctgccgtcaaggctcctggctttggtgacaaccgcaagagcatccttggtgatcttggtgttctcactaacggtactgtctttaccgatgagctcgacatcaagcttgagaagcttacccctgacatgctcggttccactggctccatcactatcactaaggaggacactatcatcctgaacggtgagggtaccaaggactccatcgctcagcgctgtgagcagatccgtggtgtcatggctgaccccaccacttccgaatatgagaaggagaagctccaggagcgtctggccaaacttttccggtgggtgtggtt

SEQ ID NO: 7005 - DNA, 773 bp, Aspergillus oryzae
  misc_feature (1)...(773): n = A,T,C or G
nttttagcatgnacccttagcacaanccgtagattaacgctggtacccaaccccgaatctcaattcggcccaaggggccaccaaggcctcggttgatttcttgaacaagttggctgttgttaacctgaacggtggcttgggtacttccatgggttgcgttggccccaagtcagtcattgaggtccgtgagggcatgtccttcctggatctgtccgttcgccagatcgagcacctgaaccgcactttcaacgtcaacgttcccttcgtcctgatgaactccttcaacaccgaccaggacactcagtccatcatcaagaaataccagggccacaacgttgatatccttaccttcaaccagtctcgctacccccgtatcatcaaggactctcttctccccgctcctaagagctttgatgcacctctgcaggactggtatcccccaggccatggtgatgtctttgagtccctgtacaactctggcactcttgacaagctcttggaacgtggtgtggagtacaatcttctgtccaacgccgacaacttgggtgctgtggtcgaccttcgcatcttgcagcacatggttgataccgagtctgagtacatcatgngaattgactgataagaccaaggccgatgtgaaaggtggtactatcatcgactacgagggcaaggctcgtctcttggaaatcgctcaggtccctaaggaacacgtaacgagttcaagtttattaagaaatttaagtctttcaacacaaaacaaattttggatgact

SEQ ID NO: 7006 - DNA, 1192 bp, Aspergillus oryzae
ctttccacctcaccttttcatttcttccagatagaattctttctatcctttcctacacatcattcacaatgttcgctgctcgccagtctttcaacctcctccagaagcgcgccttctccgcctctgccagccaggcttccaaggttgccgttcttggtgccgctggtggcattggccagcctctctcccttctcctcaagctcaacccccgtgtttctgagcttgccctctacgatatccgcggtggccctggtgttgccgctgacctgagccacatcaacaccaacagcaccgtctctggctacgaggctaccccctctggcctccgtgatgctctcaagggctccgagatcgtcctcatccctgccggtgttcctcgcaagcccggcatgacccgtgacgacctgttcaacaccaacgcctccattgtccgcgaccttgctaaagccgccgccgaggcttcccccgaggccaacatcctcgtcatctccaaccctgtcaactccaccgtccccatcgtctctgaggtcttcaagtccaagggtgtctacaaccccaagcgtctcttcggtgtcactacccttgacgttgtccgtgcctctcgcttcatctcccaggtccagaagaccgacccctccaacgaggccgtcactgtcgtcggtggtcactccggtgtgaccattgtccctcttctctcccagtccagccaccccagcattgagggtaagacccgcgatgagctcgtcaaccgcatccagttcggtggtgatgaggttgtcaaggccaaggatggtgctggctctgccaccctctccatggccatggctggtgctcgcatggctgagtccctcctgaaggccgcccagggtgagaagggtgtcgttgagcccactttcgtcgacagccctctctacaaggaccagggtgttgacttcttcgcctccaaggtcgagctcggccccaacggtgttgagaagatcctccccgttggccaggtcaacgcctacgaggagaagctcctcgaggcctgccttggtgacctcaagaagaacatccagaagggtattgacttcgtcaaggccaacccttaaattactctcataagggaaactaggccgtctgcagctcttttcctcctgtataacagtcttgtgtatgacattttaccgcctattacccatcgcgtatgctt

SEQ ID NO: 7007 - DNA, 965 bp, Aspergillus oryzae
  misc_feature (1)...(965): n = A,T,C or G
cgggtcggtatcgttctcttatccagtgaggcttccgctatttaactttaaagattgtttggaaggcggagctaaaaaagcgcaccgggcatctcaagctttgtcggatatataccccggggtcgaatctaccggatatgctctatcagtgccgatggctggccaccccgtattagatgctgaaaaaacccgacgggagtttgaacaacttgagagactgatatgtgagcatgatgtcatctttcttctgatggatacacgggaatcccgttggttaccaacagtcatgggaaaggcagcgggaaaaattgtgatgaatgctgcgttggggtttgactccttcgttgtcatgcgtcatggtgtgaaggttgcagaaaacccagcagcagagctcggttgctacttttgcaatgatattgttgcgccagtgaattccataaaagaccagacgctggaccaacagtgcactgtgactaggcctggtgtggccgcgatagcttccgccttattggttgagctgctaatttctatacttcaacatcctctgggtgctgcagccccagctccggcctcaaggaatgatgatcgaggtagtcatcccctaggactcgtgccccatcagatcagaggtttcctttcaacatttgagaatttatgcgtagtgggcaggagctacaaatgctgtagcgcttgctcagagactattgttgacacgtacaaggagaaaggctgggattttgtgcaaaaggctttgaatgagactggatacgtggaaaacctgagcggtcttaaggaggttcaaacaatcgctgaagccacagctgccgatattgagtgggatgatacctctggcaccgatgatgagttagaggccatgtgaactagcggatgatngtacgtactcttnttgaggcgagttctttgagcttgtagacttgcgcgaaaatcattggttcaagaaaaaa

SEQ ID NO: 7008 - DNA, 926 bp, Aspergillus oryzae
  misc_feature (1)...(926): n = A,T,C or G
tcgatccatgggttcgagttgacttcactcctcccaaatcgcccatttgaacaactctggcgccttgtttggtcttgcgtctgatctccgataatattctcccttccatgtccttctatccttagagatcctttgcgcacccttttccacagtccttctacgtaaaataattgcgactttccctccgctacccctgatcctaccattacttctaccaagtttctcttgtcacaatggcatccacttccgctgtagggtcgtattcgaaccctttgaaaaagttcaagctggtgttcttgggagagcagagcgttggcaaaacgtccctgattacgagattcatgtacgactcattcgacaatacatatcaagcgaccatcggaatcgactttctgtcaaagactatgtacctagaggacaggactgtccgactccagctttgggatacagccggtcaagaaagattcaggtcgttgattccttcctacattcgggattcgagcgttgctgttgttgtttacgatatttcaaacgccaagtccttccagaatacccggaaatggattgacgacgtacgaggggagcgtggcaatgatgttatcattgttctagttggcaacaagactgatcttaacgacaagcgcgaggtcaccaccgcgcagggtgaagaggaggctaagaagaacgggttgatgtttatcgagactagcgccaaggttggtcataacgtcaagcaacttttccggcggatagcccaagctctaccaggcatggaaggcgaaggtagtanaggagagagccaagtgatcgatgtgaacatcaacccaaaagagaccacaaccaacgatggatgcgcatgctgaaagctgtaatgtactacctggtcggcatttttcgattacgttcaccaatttgttccctcgacg

SEQ ID NO: 7009 - DNA, 990 bp, Aspergillus oryzae
gtcccccttcaacctttatattacctttacgatacccacgttatcgttaactactcctctcacattcataatgtctgctcctgcttctttctctgacatcgccaaggcggccaacgatctccttaacaaggatttctaccacaccagcgctgccagccttgaggttaagtccaaggctcccaatggcgtcaccttcaacgtgaagggcaagaacgcccacgagggtcccatcgctggctctctcgaggccaagtacgtcgacaagcctactggcctcaccctcacccaggcatggaccactgccaacgccctcgacaccaagctcgagctcgacaacaacattgccaacggtctcaaggccgagatcctcacccagtaccagccttccaagcagtccaagggtgctaaggtcaaccttcacttcaagcagcccaacctgcacgcccgtgccttcttcgacctcctgaacggcccctccgccaacttcgacgctgtccttggccacgagggcttcctcgttggtgctgagggtggctacgacgtccagaaggctgccatcaccaagtactccgctgccattggctacagcgttccccagtactccgctgccatcaccgctagcaacaacctgtccgtcttcgctgccagctactaccaccgcgtcaacgctcaggttgaggctggtgctaaggctacctgggactccaagaccggcaactctgtcggccttgaggttgccagcaagtacagactcgacccctcttccttcgccaaggccaagatcaacgaccgtggtgtcgccgctctggcttacaacgttctgctccgccctggagtcacccttggccttggtgcttccttcgatacccagaacctgaaccaggctggccacaaggtcggtgccagcttcaccttcgaggcttaaacgagtctctctgtactatctctccacgccttaaataccgcgttccgctagcttgaggataacaa

SEQ ID NO: 7010 - DNA, 690 bp, Aspergillus oryzae
cccaccttcatggatgctgtctcgcggtgaatatgactttggcaagctccacgaagttgtgcaggtactggttcgtaacctgaacaagatcatcgatatcaattactaccctgtccctgaggccaagaacagcaacatgcgtcaccgccccattgctcttggtgtcaatggtctggctgatgccttccttgcccttcgtttgccattcgactcacccgaggcgaagcagctaaacacccaaatcttcgagaccatctaccacggagctttgactgcttcatctgacctggccaaggacttcggaacgtacgagtcatatgaaggctctcccgtctcccatggcattcttcagtacgacatgtgggaccggacccccactgatctctgggactgggacgctctcaaagcgaaaatcgcccataccggggtgcgcaacagcttgctagtggcgcccatgccgacccgaagcaccagtcagatcttgggcttcaacgaatggcttgagcctttacccttcgacatttactcccggcgtgttcttgctggtgaattccaggtcgtcaacccctggcttctcaaggacttgggccaccttggtctgtggttggacaacattagaaaccgatcattgccgaggggggttcattctaaaaatttctaaaataaacccggatataaaggccttctaaa

SEQ ID NO: 7011 - DNA, 741 bp, Aspergillus oryzae
cgacaaaccggttctcaacggcaaacagtcaagatgcctttccacaagcaagtcaagaacagcgcttactacagccgctaccagaccaagtaccgccgtcgcagagagggcaagactgattactatgcccgtaagcgcctgatcacccaggccaagaacaagtacaacgctcccaagtaccgcctcgttgtccgcttcaccaaccgcgacatcatcacccagatcgtctactctgagatctccggtgacaaggttttcgccagcgcctacgcccacgagctcaagcgctatggcatcaccaacggtctgaccaactgggctgccgcttacgccaccggtctcctccttgcccgccgtaccctcaagaagctgggcattgacgagcagttccccggtgttgaggaggctgatggtgagtactctctcaccgaggccgttgagaccgatgacggtgagcgccgtcccttcaaggccttgcttgatgtcggtcttgcccgtacctccaccggggccccgtgtcttcgctgccatgaagggtgcctccgacggtggtatcctcgtcccccactccgagaaccgcttccccggttacgacattgagaccgaggagctcgatgctgagactcttcgcaactacatcttcggtggccacgtcgccgagtacatggagggtcttgccgacgacgatgaagaagcgtaccgcggcagttccacaagtaccttgagaaacgaggtggaggc

SEQ ID NO: 7012 - DNA, 680 bp, Aspergillus oryzae
  misc_feature (1)...(680): n = A,T,C or G
cccttttacttttttccctctcctctcgaaaatagacctctttctccggggctacattccttccatcccactgcgacccgacctcctatcataacatcatggccagcacaatagcacgttctgaggagcgccagaacgccggcaccatcgagcttaaagatgacactgtcattgtagtacttggtgcatcgggagatctcgcgaagaagaagacgttcccggcacttttcggcctttaccgtaacaagttccttcccaagggaattaagattgtcggctatgcccggacaaacatggaccacgaagaatatctgagacgtgtgcggtcgtatattaagacccccactaaggaaattgaagagcagctggacagcttctgccaactatgctcctacgtctcgggccaatacgacaaggatgagtctttccaaaacctcactagacacctttgagatatcgagaagggtcacaaggagcagaaccgngtcttctacatggctctccccccagcggctttactactgngtccggacattaaagagaaactgctaccccaagaacggtgccgctcgtataattcggcgagaagccattcgttaaagacccttcaaagctttcgggatctccagaagcccttcaaccaatttgaaggaagagaagatttccccattgcccactac

SEQ ID NO: 7013 - DNA, 736 bp, Aspergillus oryzae
cttattacatggttatttggcatcattctttacttcctcagcgccaccctttcgtttcacttcatctacgacaagcgcgccatgaagcatccaaaattcctacgtaaccagatttccatggagatcgcgcaagccgtgaacgcaatgcccgtgatggcagccctcactgttccatttttcctggctgaagtccggggatacacaaagctgtacgatttctccagccaggcgccgtttccgctttacacatacctccaatatcctatcttcattgcgttcaccgacttcggaatctattggattcatcgcggagagcatcatcccaaggtctataagcatctacacaagccccatcacaagtggatcatctcgactccgtttgccagctacgcctttcacccggtggatgggtgggcacagagcctgtcataccacgtctttcctatcctgttccctctccagaaagtcgcctacctgggcctgtttgtgtttgtgacaatctggactgttatgatccatgatggagagtatgctctggactcacctgttgtgaacggttccgcctgtcatactattcaccactactatttcaattacaactacggccaatttctgaccatctgggaccgtattggaggaagctatagaaagccaaatcgggagctttttgaccgcgaagtgcggatgacacaaaatgaaatcaagaaacaggtcgaggagatggagaaactcgtca

SEQ ID NO: 7014 - DNA, 933 bp, Aspergillus oryzae
  misc_feature (1)...(933): n = A,T,C or G
cagaaaccggagacaatctaagttatcatgaacttcagaaacctcttcctatcgtttttcttccttctggcggttggactggctctagtccacgccgaagaagctaatcagccccgtggcccgaagatcacttctaaggtgtacttcgacattgagcacggcaataagcctctgggcagagtggtgctcggattgtatggcaagaccgttcccaagaccgccgagaacttccgggctctcgctaccggcgagaagggctttggttatgagggctctaccttccaccgtgtcattaaggagttcatgatccagggtggtgacttcacccgcggtgatggcactggcggaaagtctatctatggcgaaaagttcaaggatgagaacttcaagattaggcacaccaagaagggactcctgagcatggccaacgccggcaaggataccaacggctctcagttcttcatcactactgtggctactccatggctcgatggccgccacgttgttttcggcgaggtccttgagggttatgaggtggttgaagccatcgaaaacgttcccaaggttcctggtgacaagccccaacaggtggtcaagatcgtcaagagtggagagctggagtctgaggacaaaggtagccacgaggagctgtagaccttctccgggtcaatgtttgattcttgaaagagtttgaaacgttgctgatagttcttgacctctaaagaagacatcgttatcattgaggagccatcagaaactccagcaccatcttcaccagcacctacacccgcatcagctagtgcttatgcttcctcttactctcttntcggatttgtagtattccttggtgccgntgcccttatagtgatctctngttcgaacgtctgcanggcactgtgccagtgcanatcaaatgatgagacaagcattgtt

SEQ ID NO: 7015 - DNA, 1015 bp, Aspergillus oryzae
  misc_feature (1)...(1015): n = A,T,C or G
ctgcgtgttgatctacagccgaagaatcttttcatagattgagccagtccgtgcctacatctacattcaccatgggcttcatgttgaagaagccggatgatgctacgggctctgctgcccctgccatcgttattggcttgtttgttgcctttggtggtgttttgttcggttatgataccggcaccatcagtggcatccttgccatgccttactggcgcaagctgttctccacgggctatatcaacccgtcagacaactatcccgatgtgacctcctctcaatcctccatgatcggggctctcctgtctgcaggaactttcttcggtgcccttggtgcagcacccattgctgattacttcggtcgtcggcttgctatgatcatcaacacatttgttttctgctttggtgtcatccttcagaccgctgctactgctatcccgttatttgttgcgggaagattctttgcaggcctaggtgttggattgctctctgcaacaatcccgctgtaccagtccgaaaccgctcctaagtggatccgtggtaccatcgttggtgcctaccagctggctatcaccattggattgctccttgctgccatcgtgaacaattccactaagggccgngacgatactggttcctaccgtatccctgtcgctgttcagtttgcctgggctattatcctggttgttggcatgatcgtactccctgagacgcctcgcttcttgatcaagaaaggcaagcatgaagctgctgccaaggctctctcacgccttcggcgcatcgatgtccatgatcccgccattgtggaggagctggctgagatccaggccgaccatgaatatgaactcagtgtgggcaatgccagctacctctccattcttcgagggagtatcggcaagcgactggcccactggctgtgccgctcaaggtttgcaacaactggctggagtcaaattcatgcttgtatacggaaactactttcttttaacaccttcgggtaaacggaccgatttat

SEQ ID NO: 7016 - DNA, 1000 bp, Aspergillus oryzae
  misc_feature (1)...(1000): n = A,T,C or G
gtggatcgcgcgagagccatgggacggtttgcatcataggctatggaggtcgcggctaaacctgcgcataggggtatgagactctgatacacctgcacttaggggaatcacgcctggctgcacctgcacttagaggtatagtcgcctttccgctatgcattttttttacttgatatctcggtgaattctctggctcgcttggctcatgcccaccatctatctcattctcgtaaattctttgttctctatttaaactcgctcttcctcgctctcgagcccttggtttccctctcccgctctcatatcaggtctgaccgtaatcaacatcccctcctttgtcccaccataaccactatatcccaccgtcatttctccctgaatagattcttttcttgcctaacatggcggtcaacggcacaaacggcacatccaagaccaatggtcacagtgtaaacaacggcactagtgcctaccacgccgcctccacccaagaggcgattcaagctgagagtgattttgccgctcacaactatcatcctctccccgtcgtcttcgctcgggctcagggcacctcggtctgggaccccgagggtcgtcactaccttgacttcctgtccgcatactctgcggtcaaccaaggccactgccaccctaagctggtggctgctctcgttgagcaggcgtcgcgggtcactctgagctctcgtgctttttataacgatgtcttcccacgtttcgcccaatttgtcactcaatacttcggcttcgatatggttctgcccatgaacacgggcgccgaggctgtcgagaccggtattaagatcgctcgtaagtggggatacaaggttaagggtattccggagaaccaggcggtcgtcttgagtgcggagaacaacttccacggtcgtacatttgccgccatctccctgtcatctgaccccgagtcgcgtgacaactatgggtcttacctcccggcatcggntgcaacatcccccgcacc

SEQ ID NO: 7017 - DNA, 663 bp, Aspergillus oryzae
  misc_feature (1)...(663): n = A,T,C or G
aaatacttcattagtgcacatatatcaaccaccttcttcattatactgccgaaatagtccagcatgttcatcgcgcgatcggaatatgaccgtggaattaacaccttctcccccgaaggacgtttattccaggtcgaatactctcttgaagctatcaaactaggttcgacagcgatcggtgtcgcaaccaacgaaggtgtcatcctgggcgttgagaagcgtgtcacatctactctccttgaagcctcttccgtcgaaaagattgtcgagattgatcagcacatcggctgtgctatgtccggtctgcaggcagatgcccggaacctcgttgagcatgcccgcgttgagtgccaaaaccatgccttccactatgccgaaccactgcgagttgagagctgcacccaggctatttgcgatttggccttgagattcggagagactggagacgacgaggaaagcgtcatgagtaggccttttggtgttgctttgttaattgcgggtttcgatgaggatggccctcaactatatcatgccgagccatccggtacattctaccgatacgacgcgaaggccatcggatccggaagcgagggtgcgcaagcggaactgcaaaacgaatatcaccgntccctcactctagaagaagcggagacactggtcctt

SEQ ID NO: 7018 - DNA, 1143 bp, Aspergillus oryzae
  misc_feature (1)...(1143): n = A,T,C or G
cttcccccacacatccacatctctcttgcctttgaacaaactctgcacatttccctccgaatccacttacactcaagttcaacaccatggcggcagctattaaggaaaccgtatccaacctgctccatggtcattccgacaacactcctcgtcagccttcccctgaagagttccatcaactacaacagaagtataccgatgccgggcagggacatgtcttcaaattcgtcaatcaattaaaccaggtcgagaaggctcagctcttccatcagctgagcaacttcgaccctaaccggatcaatgaactggccgacaaggtcctgaaccccgccaaaactcaggatggtcccgttaccctcgaacccctccctgaagtggctactgcctctataatggactccgacccgaaggacattcagcggtggtacgatgaaggtctccaggcggtgtcggagaacaaggttgccgtggtcttgatggctggtggacagggtacccgcttgggaagctcagcacccaagggctgcttcgatattggtctacccagtcagaagtccctcttccagattcaggcagagcgtattgccaagctccagctcttggcacaaggaacttccggcaaggaagccattatcccttggtatgtcatgaccagcgggcctacccgcaagcccacggaggagttcttcgagcagcacaagtattttggactggacaagaagaacgtcgtcatcttcgaacagggtgtcctgccctgcatttccaatgagggtaagattttgctggagaccaagtctaaggctgctgttgcccctgatggaaatggcggaatctaccaagccctcattacctctggagtgcgtgaagacatgcggaagcgtggtattgaacacattcacacttactgcgtcgataactgcctagtcaaggttgccgaccccgtcttcattggtttcgccgcttccaagaaagtcgatattgctaccaaggtggtccgtaagcgcaatgctaccgagtcggtcggcttgatccttcagaagaacggcaagcctgatgtggtcgagtactccgaaatcgacaaggagacngccgangctaaggacccncagcagnctgacgtgctgaagttccgtgccggcacat

SEQ ID NO: 7019 - DNA, 813 bp, Aspergillus oryzae
cttgttttaccaactgccttgctccccttgctaaggttatcaacgacaacttcggtctcgttgagggtctcatgaccactgtccactcctacactgctacccagaagactgtcgatgctccctccgccaaggactggcgtggtggacgtaccgccgctcataacatcatccccagctccactggtgctgccaaggctgtcggcaaggtcattccttctcttaacggcaagctcactggtatgtccatgcgtgtgcccaccgccaacgtctctgttgtcgacctcacctgccgtaccgagaaggccgtcacctacgaggacatcaagaagaccatcaaggctgcttccgaagagggcgagctcaagggcattcttggatacactgaggacgacattgtctccactgacctgatcggagatgcccactcctccatcttcgatgcctaggccgggttttcgccttcacgagcactttatcaagctcgtctcttgatacgacaaccagtggggctactcccgccgtgttgttgacctcattgcctacatctccaaggtcgatggccagtaggaatcaggacagagaccagaaactagaagtgttctataaacaaaacactctagtcccctgactgtgtcccaagttcccggattatcaggtcaccaccccttgaaattgacctgtgggataacaaagtgccctgttgaccggggatctacatatcgcataaaaagcatatgataacgtacttatttaatgaaatgatttgacgtttaaaaaaaaaaaaaaaaaaattcctgcggccgcgaattcttc

SEQ ID NO: 7020 - DNA, 834 bp, Aspergillus oryzae
gtaccgtggccatcttgacaacatctccaacaacatgctcattggtgccgtcaacgccgagaacggtgaggctaacaaggtcaagaacgctttcactggtgaatacgacgctgtccctgctactgcccgtgactacaaggctcgtggcgtcaagtgggttgtcattggtgactggaactacggtgagggtagctctcgtgagcacgctgctctggagcctagacaccttggtggtcttgctatcatcactcgcagcttcgcccgtatccacgagaccaaccttaagaagcagggtatgcttcccctgaccttcgctgagcctgccgactatgacaagatccagcccgacgacaaggttgacctgctctgcaccgagctcgaggtcggcaagcccatgactctccgcgtccaccccaaggatggcaagaccttcgacatcaagctcaaccacaccttcaacgagtcccagatcgagtggttcaaggacggttctgccctcaacaccatggcccgcaagggtggcaactaagtttgccgcaacgtgggttagcgctggggtcaacattggtccgtttgtaaattatactgtatatgtttctaaaactcaataagaaacatatcagcttagtgccttgccatgcggcttagcacgttgagaatgagtggcagctctggggatgttaacggctgcttatagtatttctaccagggatattgcggagtcaaatttcaaaatttaacgacctggttactttggtatctcccacattggtggaccctttttgaatttgggggggactatatggatattagcctaaatcttttttcctaaaa

SEQ ID NO: 7021 - DNA, 653 bp, Aspergillus oryzae
  misc_feature (1)...(653): n = A,T,C or G
gataccatctatgaaaatgacgacaacgtggcagctgctggtgttgctcagccgggtgcccattacgttcatggcggcatgagctatcgcaccacccactcgccacccagtcagctgcctccaagccatgctacggccaccacttccgcaggccccattatggctaatcctgcgacccattcgccgactgggacacccgcactcacaccaccctcgagcgcgcaatcgtatacctctggtcggtcgcccatctccctgccgtcaacaagccgggtatctcctcctcatcacgaatgtggctcaagcatgtacccccgccttccatcggctactatgtctgacagcatggccgctggctacccgaccacatcaagcgcagctcctccgtccactcttggtggtatctatgaccatgatgatcgtcgccggtataccggtggcaccttacaacgcgcaaggccagacgagcgtcatctacctgagccaatggatctgactcatgatnataacgatgactgatagcggacaccaactgccaagccgcgtcaagcaccctcgtcacccggtcgcatctccgctagcttgaatgaccctgctctttccggctcggcaaacgaagcagagacgatgccgacggtccagccgcgactgag

SEQ ID NO: 7022 - DNA, 689 bp, Aspergillus oryzae
gagatgagcgttttcggctattttttccatcggcttctgggtcacgaggtcgccgctgcaccaatgaagacacaaatgcctaagaagttcagtgtccctggacttccagaactaaatggtagccagattaatgcagtcaagagtgtgctacagaggcctctgagtctcattcagggacctcccggaaccggaaagactgtcacctccgctaccatcatttatcatcttgccaaacttaatggaggtcaggtcctagtctgcgctccttccaacgtcgctgttgatcaactctgcgagcgtatccacagaacaggtttgaagacagtgcgtgtaaccgccaaatctcgcgaagatgtggaatctcccgttggcttcttgtccctgcatgagcaagttcgcctgaatgacagcaatattgaactcctgaagcttaaccagcttaaggcggaactcggggagttgtcaagtcaagacgaaaagcgactgaaacagctcacgcgttcagcggagcgcgagattctgaacaacgctgacgttatctgctgcacttgcgtcggtgccggtgacccttctttcgcgaaactaaagttccgcctggtttaattgacgaaattactctatcatccgaaccggagtgtttgatctccgtgggttttaggatgcaagcaggatggtctccgatgggaact

SEQ ID NO: 7023 - DNA, 1189 bp, Aspergillus oryzae
ttcccgtcatcaccactgcgacaagcgccagtcgattgatatattcaattcgctgttcattgcaatatcaatcgcccaccatggccccctctcagcttcccccgatcttcaaccccacccagcaggacattgagcagctgctcgctgctcagtgccacctgggttccaagaacctccaggtgcacatggagccttacctctggaagactcgccctgacggtgtcaatgtcatcaacattggcaagacctgggagaagatccttttggctgcccgtatcattgcggctgtcgagaatcccgccgatatctgtgtgatctccgctcgtccttatggtcagcgtgctgtcctgaagttcgctgcccacaccggtgccaccgccatcgccggccgtttcacccccggtaacttcaccaactacatcacccgctctttcaaggagccccgtctcatcatcgttaccgaccctcgcaccgactctcaggccatcaaggaggctagctacgtcaacatccccgtcctcgctctttgcgacactgactcccccaccgacttcgttgacgttgctatccccaccaacaacaagggtcgtcactccatcggtctggtttggtggatgcttgcccgtgaggtcctccgtctccgcggtaccctcgctacccgcgagaccgagtgggatgtcgttcctgacctctacttctaccgcgaccctgaggccgaggagaacaaggagatcgccgatgagtccaaggttgctactgccgaggaggtcggtgccggtgccattgagtctggcttcgctggtgagaactgggacacccagggtgctggtgctggtgttcctggcactgctttcgctgctgctagcgctgctggtcctaccagctgggaggctgatggtgccgactgggccgccagctccgctcctgccgctgctggtgagagctgggctgagacccagcctgctgagggcaagtggtaaataaaatgaatagcgacaatggacagctgttacgaggggcatgagttttttctgcgaaaattggcgctgaggaggactgacgttttatattttctcttcacccatgatctgacgagtaaccgacagcatctcccgcaaagaaaaattctcttgacatgtctatcctaagctctgtttgaaaacttcctatttcaaagccagaagaaaaa

SEQ ID NO: 7024 - DNA, 1047 bp, Aspergillus oryzae
  misc_feature (1)...(1047): n = A,T,C or G
tggaaagaccgaactctgcaagaagatggccgagtttttgttttccaccgagacagccgttgtgagatttgacatgagtgaattccaagaaaaacacacgatcagtcgcttaatcggttctcccgccggctacgtgggctatgacgatgccggccagctcacagaagccgtcagacggaagccgtatgcggtccttttgttcgatgaatttgagaaagctcatcgtgacatatctgccttactgcttcaagttttggatgagggcttcctcacggatgctcagggacacaaggttgatttcagaaatacccttattgtcctcacctctaacctgggagcggatatccttgtgggctcggatcccctgcatactctcaaacagacggataatgacgagatttcccctgataccaagaaagcagtcatggatgttgtgcaacatgcatatcccccagagttcctcaatcggatcgatgaatttattatattcaagagactttctcgggaagctcttagggacattgttgatatcagactcaaagagcttcaatcaaggctcgacgatagaaggatgacactgcaggtggacagtgagatcaaggactggctttgcgaaaaagggtacgaccctagatatggtgcccgtcccctcaaccgcctaatcgcaaaggaaatcggcaacaggttggccgataaaatcatccgtggtgaagttacctctggacaaaccgcccatgtttcattcaacgccgacaagagtgggcttgaagttactgcggaaggaacaaagactgaagatgcaacaaatgcaacgtacccaacagagaccgaaaacccataaatgtgtgagatgaattcttgatcttggtcttggtcttttcttttcttcactggagtcagataacccaagcaggttcggtaggttggggaatatggtgtnggaacgtctttcttaatgatgtctatgtatattaacgagatctccgcttttggtgtacattactacagggtaactagaaacatatgtatatgaaatttctatgaaaa

SEQ ID NO: 7025 - DNA, 1392 bp, Aspergillus oryzae
cccaccctttccctttcccctttcctcccctcttagcttatttacccctctttccctgctttgaacccagtgttctttcctccctccaccaccaccccacactgacgctctctctccatttctctatcttccttattcttcaaaccttccaaatcgctaacccatctcctcttataacggaacagactaactcaattgtttgattcgagaatctcgtccatcatggtcaaagctgcggtacttggagcttctggtggcattggccagccactgtctctcctgttgaagacctgtcccttagttgaagagcttgctctctacgatgttgtgaacacccctggtgttgctgctgatctatcccacatctcgtctatcgctaaaatctctggttttctgcccaaagatgatgggctgaagcaggcccttactggtgctaatattgttgtcatcccggctggtattccccgcaagcctggtatgacccgtgacgacctcttcaagatcaacgccggcatagtgcgagacttggtcaagggtatcgccgagttctgccccaaggcctttgttctggttatctcaaaccccgttaattctactgttcctattgctgcagaggtgctcaaagccgctggcgtctttgacccgaagcgcctctttggtgtcaccacactggacgtcgttcgtgcagagactttcacccaagagttctcgggccagaaggatccttctgctgttcaaatcccagttgttggtggccactctggagagaccattgtccccctcttcagcaagactacccccgcaattcagatacccgaggagaagtatgacgcactgatccaccgcgtccaatttggtggagatgaggtggtccaagctaaggacggtgctggttccgccaccttgtctatggcctatgccggttacaggttcgctgagagtgtaatcaaagcttcaaagggtcaaacgggtattgtcgagcctaccttcgtctacctgcctggaattcccggcggtgatgagatcgttaaggcaactggcgtggaattcttctctactcttgtaaccttaggaactaatggcgcagagaaggctagcaacgttcttgagggcgtgaccgagaaggaaaagaagcttctcgaggcttgcacgaaaggccttaagggtaatatcgagaaaggcatcgacttcgttaagaacccaccaccaaagtaaacgcgcccacccccgttcatcagatgcaggattcccacccaccagtcggtaatttgccatctatatcgcactcttgtctccacagaaaggacctcgtactttcggtgggctactttgcaattcacgaaactgaaagaaccccgctaatctttgatacctgggcaagataggctttga

SEQ ID NO: 7026 - DNA, 671 bp, Aspergillus oryzae
ccctgtgtatctgacctgatttgttgagagattctctgatcacctcatcaagagtgaccacactgtcaccatgtctatcctctctctagtcgaggatagaccaactcccaaggaggtgtacaactggaagatttacctcctcgcagctgttgcctcatgcacgtcttgtatgatcggatatgatagtgccttcattggtacgactatatctctccagtcattcaaggatgagtttgattgggactccatgtctgccgcgcaccaagacctagtgagctccaacattgtctctctctaccaggcgggtgcattctttggtgcattcttcgcctatcctatcggtcatttttggggtcgaaaatggggcctgatggtctctgctttaatatttacattgggtgccggcataatgctgggtactaatggcgaccgtggatttggtttactttatggaggacgagtgcttgctggcttgggagtgggagctggctccaatatcactcctatttatatctccgagttatctcccccggcgatcagaagacggttggttgggggttacgaattggggtggcaaattggtgggcttgtaagcttttggatctgttaccgcgttgatgaaacgcttgcccccgagtcataaagcaggggatcatcccattcgctggccc

SEQ ID NO: 7027 - DNA, 689 bp, Aspergillus oryzae
  misc_feature (1)...(689): n = A,T,C or G
cccccttccattccgtcgcctgtggttgggttctctttttcttccttttgcttctctttcttgaatacaggaaactgtattgaagcacaagggatttactaccaacacgtctcccgataatcacacgcgtgccccttggcgaagaccaccactcgatatacacataggcacaatggcgcgactatcgagtcgcaacggtgcggccaagccgttcactgcttggactaccatcttctaccttctccttgttttcatcgcgcccctggcattcttcggtaccgcacacgctgaggaggactctgtccaagacaactatggaactgtaattggtattgatttgggaacaacctactcttgtgttggtgtgatgcagaatggaaaggtcgagattctcgtcaacgaccaaggaaaccgaatcactccttcctacgtcgctttcaccgatgaggaacgcctggtcngtgacgccgctaagaaccaatacgccgccaaccccgtcaggaccatctttgacatcaagcgtctgattggtcgcaagtacgatgacanggatgtcaccaaggacaccaagaacttcccctccaaggttgcaacaaggattgcaagcctgtcttgaaagttgacctgaacaagacccccaagacttcacttcttgaggaggttccggcattggtcctcgaaagagaang

SEQ ID NO: 7028 - DNA, 690 bp, Aspergillus oryzae
  misc_feature (1)...(690): n = A,T,C or G
cgaagcgcccccaagactcattgcagaccgttctcggctggtccgcaacgttgcagcgactccctttccgtgcaccgcaacaagcctaccaacaacccgagcatcccgttcacgttcaacgagcagaaccaacgattgatcgatgagatcctcaagcgctatcctccccagtacaagaaggccgccgtcatgcctctcctggatctgggccagcgtcagcacggcttcaccagcattagcgtcatgaacgaggtcgcccgcctcctggagatgccccccatgcgtgtctacgaagtcgctactttctataccatgtacaaccgtgagcctgttggcaaatactttgttcagctttgcacaacgacgccatgccagctcggaggctgcggcagcaccaagatccttgaagctatccaggaacacctcggcatcacccccggacacaccaccgaggatggactcttcaccttgcttgaagtcgagtgcttgggcgcctgtgtcaacgcccctatggtccagatcaacgacgattattacgaggatcttactcccgagttcatgaagactctcctcaccgcactcaaggagttcgcgactgccaccgacgccggcaagaccgtccaaaattctggccctggcccaatgagtgggagaaacacctgtgagaacagcgccggactggacaacctn

SEQ ID NO: 7029 - DNA, 773 bp, Aspergillus oryzae
ggtgacgaaatctccatcctcgtcgcggtagcgtagcctgaccgatttgctgcctattgatcgattggtgaaccgggccaatttcgcatccactcggtctgtgagcgagcggaacatgatgttgctggcaatcactagagtgacgtagttatcatcgaaattaaccttcgctttgagttgggtcggcatgagaggctcctcctctggttcttggctgagaggggatgtaggctgatctagaaggtatcttcgaggtcaaggctaccgctggtgacactcaccttggtggtgaggacttcgacaaccgtctcgtcaaccatttcgttaacgagttcaaacgcaagcacaagaaagatctcactaccaacgcgcgtgccctccgccgtctccgcactgcctgtgagcgtgccaagcgtacactgtcttctgctgcccagacctctattgaaatcgactctctctttgagggtattgatttctatacctcgatcacccgtgcccgtttcgaggaactttgccaggacctcttccgcggtactatggagcctgtcgagcgtgtcctccgtgatgccaagatcgacaagtcctctgtccacgagattgtcctggtcggtggctctacccgtatccccaagatccagcgccttgtctccgattttttcaacaaggagcccaacaagtccatcaaccccgatgaggccgttgcctacggtgctgccgttcaggctgccatcctgtccggtgatagttcctccaagtccaccaacgagatc

SEQ ID NO: 7030 - DNA, 639 bp, Aspergillus oryzae
  misc_feature (1)...(639): n = A,T,C or G
cttccatattacttgtctggccaccccaagggtgcggccggtgcttggatgttcaacggctgcctgcaggtcctggatagtggcctagttcccggcaacaggaacgccgataatgtagacaaggtcctcgaaaagttcgactatattgtctaccccagccgtagtattcaaacggatggtgtaaaggcattctcagtcacctcattcggttntggtcagaagggcgcgcaagttattggtatccaccccaagtatctttacgctgctctcgaccgcactcaattngaggcctacaagggcaaggttgaggctaggcaaaagagggcgtatcggttcttccacaacggtctgatcaacaacagcatatttgttgccaagaacaaagcgccatattatgataaccttcaaacaaatcttccttacccctgatatcgggttactggtgacaagaaatctttgaacttaagttccccgcaactccccccaaagtggttggtaaaggaagtgaaagcaccaaggcaggtaattaagtcccctgcgaaagcttacccctgtggaaaacctcaaatgggggtggaaggggaaaacccggaggctttcataattgaatagtaaaccttcttcaacagaatttcccct

SEQ ID NO: 7031 - DNA, 1509 bp, Aspergillus oryzae
  misc_feature (1)...(1509): n = A,T,C or G
ctcccattctttttaaagtgatcttgccgtttgtctttttaactactttttttcttacaagctaattatcattttccgttgagcaccattcatttctagacatgttccgcactcgagtaacgtcggcagcttgcgctgctgcccaaaaagctccagcagcacgcaatttcgcaagagcttcaccagtgagctctgcttctcggaaccacaaggtcgtggtagttggtggtggtacggctggtctgtctatcagccatcagcttcttcactctggcaaatttactcaagacgatattgctgttatcgaccctgcagagtggcatcattatcagcccggatggactctagttggcggtggtcttaaaaccaaggaggagttgcgcaggccaatgaacagtctggtcgaccctaagctcaaattctacaacgacagcgtgtccacgttttcccctgaggagaatcttgtcactcttggtaatggcgacaaggtcaactatgaacagctggttgtggttcccggcattaacatcaactatggtagcattgagggtctgcccgaggctctggagtctcccgactctcttgtctctactatctatggttacaacacttgcgacaaagtcttccgcactgtccaaaaactcgagaaaggtgttgctctttttacccaacctgccggtgtgatcaaatgtgcaggtgcgccgcaaaaggtcatgtggctcgcattggaccattggaagagagccggcctgtacgatcccagcaacccctccagttctgctatcaatatcagctttgccactgctctcccggccatgtttggtgtgcccaagtacagtgctacacttgaggctctgcggaaggaaaggggcgtcgagggactcttccagcatgacctcgtcgccatcgaaggcaacacagccacttttgctcgtctcgatggtcaggagaaggtcaagaagcagttcgatctgttgcacgttgtacccaagatgggaccccacgcatttgtcaagaacagccctctagcgaacgaagctggttttgtcgatgtcgatgatagcaccctgcgtcacaagaaattctctaacgtctggtctgcgggtgatggcttcagtctttctacagcccagaccgggggcgcaattactttccaatcacccattcttggtcgtggtttgctttccacaatggaaggccaggagccccaaggaaactatgacgggtatacttcctgtcctctgctgactgagtacggcaaggttcttttggctgaattcaaatacggcgggcagcccaaggagacttttggcacctgttcggtatcgacaagccactcctcccgtgcattctatcatctgaagaaagacttcttccttngggtgtactaccaaaccattgtcaaagggcaatgggggcggcccctaagggtgggttaactataaaaacctggagcccgcgggtactataccttttgagaaaaccaatactgggaagcttcaaattacg

SEQ ID NO: 7032 - DNA, 757 bp, Aspergillus oryzae
  misc_feature (1)...(757): n = A,T,C or G
ctccgtggtggttcttgggtcttcattgaccctacaatcaatccagaccaaatggagatgtacgctgatgaggaagctcgcggtggtgttcttgagcctgagggtattgttaacatcaaataccgccgtgacaagcagttggataccatggctcgcctggatgctacttatggtgagctccgacgctctctggaagactcgtcgctcagtaaagagcagctgtcggagatcaagactaagatggctgcccgcgaggagcaacttctgcccgtctatttgcagattgctctgcagtttgctgatcttcatgatcgtgctggccgcatggaggccaagaacactattcgccggccgctcacctggaagaacgcacgtcgattcttctactggcgtgtgcgtcgccgtctcagcgaggaacttatcctcaagcgcatggtgggtgtgggaaccgtcttccgcaccccgggaaagccagcagtgggtgccatcccgaccaccccagccggaaacgtctcttctactgaatccgctcgctcgactcacctttacaccctgcgtacctggactggaatgcttgatgaccaantggagcgtgatgaccaacgtgtggccttgtggtatgaggagaacaaaaaacttattccgacaaagatttgaaatcctcaaaacccagtcccgttggtggagatggtggggcaaatggttaattggcaacaaggaccgggggaattgaagggtggtccccaaaggtttttgg

SEQ ID NO: 7033 - DNA, 689 bp, Aspergillus oryzae
caaagatgtccgcatgctgtgcgctgagcctgcggattccacctggcttcctactacgagtcaagaagtgtgcaaccgcatcttccacaccagctatatgggcacccaaaattccagtaaggagacaagggaccggtcaaagaggctttcaaccgacattggatcttatcatgtcgacttcaactttgatacagttgtgacttccttgacgaatttgttcacgatggttaccaacttccagcctaagttcaaggttcatggtggtagtcgggcagaaaatcaagcgctacagaacgttcaagcccgcttaagaatggtgctttcgtacttgtttgcatccttgcttcctacagtccggcagcgaccaggtggaagcggactgcttgtcctggcatcatcaaatgtagatgaatgtttgcgtggctatttaactaaatacgatgccagtagcgcagatttgaacccaattggctctatcagcaaagtcgacttgaagaaattcatcgcctggtctcgggattcgtttgaattgcctattcttcacgaaattctgaatgccaccccaactgccgagctggaaccgataacaatcacgtacgttcagtcagaccaaacggacatgggtgtaacgtacgctgagttgtccacttttcggtaactgcgtaagacccggaaactaggacctttgt

SEQ ID NO: 7034 - DNA, 1617 bp, Aspergillus oryzae
tctccctcgacccatctataagcctattgaacaacattatcacaatgtctgagcctattaggaataagaaagcagattttccggtcgccccgacgcctcaaaacaccccagctaataatgcccctatttcctcccatgcccagcagcctggagtctccagcatcaaagaagaatcccttgatcatgccacagctgcttctttattcgcgagaaaccctgggctcgtctccatgattcaaggaaaattgggatcacttgtcggtcgctcttccggatatattgagtctctgcccgcacctgtccgccgacgtgtcgctggactgaaaggtatccagaaggaacacgctaagctggaagctcaatttcaagaagaagtgttggagctcgaaaagaagtactttgcaaaatttactcctctgtatcaaaggcgtgccacgattgtcaatggggctgcggaaccgaccgacagtgaagttgatgcgggcaagggtgaggaagaagatgtggatgttaagagcgaagatgagtctaaaaagtccgaggacaaggtgtcatcaacagccggaatacccgagttctggctttctgctatgaaaaatcaaatttctctggcagagatggtgactgaacgagatgaagaggctctcagacatctcaccgatatccgaatggagtaccttgatcgtccgggatttcgcctgatttttgaattctctgagaattcattcttcacaaacaagactatttcgaaaacgtactattacaaggaagagaacggctacggtggtgatttcatctatgatcatgccgagggcactaagattgattggaaagacgacaaggacctcactgttcgtgtcgaaagtaaaaagcacagaaacaagaacacaaagcaaactcgcgttgtcaagataaccgtacccacggagtctttatttaatttcttttctcccccacagcccccaacggacgacgatgatactgtcgctaccgacattgaagagcggcttgagcttgactaccagcttggagaggatatcaaggagaagctcattcctcgcgcaatcgattggtttactggggaggctcttcagtttgaagaactgggcgatgatatggatcctgatgagtttgacgacgaggacgaggacgaggaagaggatgaagatgatgacgacgacgacaggaagtctgatggggacgttgatgacgactctgatgaagaggacggtacttcgaagcccaaaaaggaggccgcagaatgcaaacaaagctgaacagtcagctaatcgttgaaagtgcaaattcgaatggtgctataatccatatctccacctgacttctgatgcctgctttttattctttgtttctctcagattgtttcttctaatcatgcgtggctcctgttccattcaatagcggtccgctgtatgtatggtcaaagtattatgtgtaaccatgcatacttcaccatcagattggtgggcatgtagtggatggtaaagctcgttggatggaaccgtcaaggcagtgtcggtccctaatcattttttcttcctcatcgccctccaaactccttcaccgacgacctttttctccctctcctacttttcttta

SEQ ID NO: 7035 - DNA, 676 bp, Aspergillus oryzae
  misc_feature (1)...(676): n = A,T,C or G
gctgtttaccgaggccggtattatgtccatcgaacacgcagactttgacggtgtggagcgtctggctctagtcactggtggtgagattgcatccacctttgaccaccccgagcaagttaagctgggtcactgtgacgttatcgaggaagtaatcatcggtgaagatactctgattaaattctcgggcgtggctgccggtcaggcctgcaccattgtgctccgcggtgctacggagcagctgcttgacgaggctgaacgctctctccacgacgccctcgccgtgctttcccagactgtgaaggacccccgtgtcaccctgggtggtggttgcgcagagatggtcatgtccaaggctgttgagcaagcggctcagaacaccacgggcaagaagcagctggctgttgactctttcgcacttgctctcaagcaattgcccactatcctggctgacaacgccggtctggactccagtgatctcgtgacccgactacgacaggccatcaacaacggcatgaccagctctggccttgacttgctcacccctggtggcggcattgctgacatgcgggagttgggcgttgtggagagttacaagctgaagaaagccgtggtttcctccgcatcggaggcatncgagcttcttctgcgcgttgacaacatcattccgtctgctccc

SEQ ID NO: 7036 - DNA, 672 bp, Aspergillus oryzae
cgtcataccctttttcgttcgcacttctcccactccatcaccatgtccgagaaaactcaccccactatccaggatggctggttctccgagaagtccaacatgtggcctggtcaggccatgagcctcaaggtcaaccagatcctgcaccacgagaagtctaagtaccaggatgtcctcgtcttcgagagcagcgactacggcactgtcctcgttctggacaatgtcatccagtgcactgagcgggatgagttctcctaccaggagatgatcacccacctcgccatgaactctcaccccaaccccgagaaggtcctggtcatcggtggtggagacggcggtgttctccgtgaggtcgtcaagcacgataccgtcaagaaggccatcctgtgcgatatcgatgaggccgtcatccgtgtctctaagaagtacctccccggcatgagcatcggcttccaacaccccaacgtcgaggagttcgtcggcgatggctttgagttcctctaaacccacaagaacgagttcgacgttatcatcaccgacagctccgaccctgaagggcctgctgagagtctcttccaaagccctactgtgagcttctgggcgatgcgctccctgacggaggtgtgattaccacacaaagccgaaaaccaatggttggacctttttttatcg

SEQ ID NO: 7037 - DNA, 869 bp, Aspergillus oryzae
gcaaggtacttatcatctctgtctcctcttttatctcccttttccccttctattctactagcattgaaaaaatggcgatccaagcttcggctacgcgtctcttcaagagggcggctatccccgcatctcgccagtggcagcgacagttcagcgctgcagccccagcactcaaggagatccaggatgcctatatcctcagtgcttcacgaactccgactgctaagtttaatggatcgttcgcctccgtctctgcccccgagctgggcgccgttgccatcaagtctgctgtgaccaagtctggactccctgtcgagaagatcaccgatgtatacatgggaaatgtcctccaaggatcggtcggccaggcaccagctcgccaggcttctatcttcgctggtttgtcgccaacagtggaatccatgacagtaaacaaagtgtgcgcctcgggcctcaaggctgtagcacttgctgcacagaatatccagcttggcctggcagacgcccaagttgctggaggaatggagaatatgtctcgtgtcccttactacctcccacgttccagccagcttccaccgttcggagagatcaaactggaagatggtttaatcaaggatggtctgtgggatgtctataacaagtttcatatgggtatctgtgccgaaaccacagccaagaagtatgagatctcgagggaagaacaggatgaatatgcgattcagtcgtaccagcgggctcaaaaagccttgaacgagaataagttcgccgatgaaaatggccccgtcacctgcaagggtaaagaagggtgagaccggtggtccaacgtgaccaacggctattaaaattggcgggttggtaaaaataaaaacctc

SEQ ID NO: 7038 - DNA, 677 bp, Aspergillus oryzae
  misc_feature (1)...(677): n = A,T,C or G
tatcgacgaggggtcangtagcccgccgactgtccaaaacgaagagatatataatgccaacagaaaccaacgtggtgaaatcgcatttgaatgattacaaccactctacgattcgctcgatgtccccgacaccgatgttcgctctgcgtggaacttggtcaacccctccgcatcccacacaattaataaggacgctacccttgcgttcctgcatatactgaactaccgacacgagggcttccgcattccacgcaccgttcctgcttccctccgcgcctcgtttgaaaacaataagatcgattatcaggtcgataatgcacgtccggcacaaaagtggggtgcaaacggagacacggaaacaccaactggtcggaagactaaattgggagatacgtacttgagtcggttgggggccggaggaaagtcgtcgtatactcccaagggaacaaacttcagcgacccatttcaggataaggaatgggaaacggttcttttaaggcccaaactgcggaagttggaaaccaaattgaattttgcacaacaggcctccgaaggccgtagggaaaaacccttgaacaaagggcggaaccacttggggtcttgtttaaaaaaggaaacccttaacctttttggggataaaggaaacccagactttccaaacttggggaaggcctggg

SEQ ID NO: 7039 - DNA, 677 bp, Aspergillus oryzae
  misc_feature (1)...(677): n = A,T,C or G
tgcgcgtatggaggcgtccgttccggaggaggtgcttcgcatgaaatcccctcctatggcggactggctggagaatttcatgaccgtgcgcgtgcatgtcatggtacgctttggcatgtgggaggagattattcagatggaattgccccatgaccaagatttatacacggtcaaaacagccatggttcattatgccaagggagtcgcatatgcagcgacgggacgggtaggtgaagcagagcaggagcgggaattattccaaagggctcggacacgagtgccagagactcgtcgggcctataatagcaagtgctccgatctcctggctgtggcgtccgctatgctcgatggagagattgaataccgtcgtggggagtacgagcaggcgttcgacagtctgtgcaaatcgatcgagctggatgataggcttccgtacagtgaaccctgggcctggatgcagcctactcgacatgcctacgctgcccttatgttggaacagggccaaatcgagaaggccgagagtgtgtatcgcgctgaccttgggctggacaacactctcatccggccccggcggcatccgaacaatgtctggtccctccagggctaccatgaatgctnggtgcgtttggggaagacggaacaagcggctatgatcgagcctacactaaggctggcgc

SEQ ID NO: 7040 - DNA, 634 bp, Aspergillus oryzae
cacaacgtccctttcttttccctccaccttcgcccatctacaaagactcctttctttctagttgtcccgcttttacgtcacattcgatatgtcacgacgatacgattccaggactaccatcttctcccccgaaggtcgcctttaccaggttgaatatgcgctcgaagcaatttcgcacgccggcacggctctaggaattttggttaaggatggaatcgttcttgcagcagagaagaaagtgactagcaagctgctagagcaggacacttctgcggagaaactttatactctgaacgataacatgatctgtgccgtggcaggtatgacggcagatgcaaacatcctaatcaactacgcccgacaagccgcccagcgttatcttcttacctacgacgaagaaatcccatgtgagcaactcgtccgtcgactgtgtgatctgaaacagggatacacccagcatggtggtctacgtccattcggtgtctggttcatctatgccggctacgaccctctgcgggagttccagttgtaccagagcaaccccagtggcaactacagtggttggaaggccactagcgtgggagcatactacgcaagtgcccatagcttgctcaaacaagattaccaggaagac

SEQ ID NO: 7041 - DNA, 993 bp, Aspergillus oryzae
  misc_feature (1)...(993): n = A,T,C or G
gtttagtatctcggagattcaagatcagaacactgccttatcttctgtatcacaatttagccctagtgtggcagtcacccttgcccgctcccattcatactcccatcccgtaccccgccgcaatgtcgacctctgctcgtcgtcgtctcatgcgcgacttcaagcgtatgcaaaccgaccctcctgccggtgtctcggcctctccggtagctgacaatgtgatgacctggaatgccgttatcatcggtcctgctgatactccttttgaggatggcacattccgtcttgtcatgcactttgaagaacagtacccaaacaagccccctggcgttaaattcatcagccagatgttccatcccaatgtatacggcacgggcgaactgtgcctggatattttgcaaaatcgttggagcccaacgtatgacgtggcggccattctcactagtattcaaagtctgcttaatgacccaaacacatcatcacctgccaatgttgaggcatccaatctctacaaagacaaccggaaggagtacatcaagcgcgtgcgtgagactgtcgagaagagctgggaagactaggggaccctacatgtgatattggttatttctcttaattgttttctattcccttgtctcggtatgatttatctgtgggcttttatgacgaaacaaatattgtctgctcatgtcaaaaggtgacagcatactgccaatggtggcggacacgccgttggcatgacttgtccttggaggattcacacgccgtttgatgacatgcacagcgcggggtttgggcgcctggtacatattctccctttggtctctttttgtggataatcgcatgtttcagttgcgaggtgcataatgcattagcttaggatgttttctgcctcaattttgccttgctgnctattagtctntcccttcccgctctgcttcactttgacttaaccgatagcgtggtttgctttcgcctnctgagtcttttatggaa

SEQ ID NO: 7042 - DNA, 687 bp, Aspergillus oryzae
  misc_feature (1)...(687): n = A,T,C or G
gctcaccaaggtcgacgtccccaaggacgttgacgtcatcctcgttgcccccaagggctccggtcgtaccgtccgcactctcttccgtgagggccgtggtatcaactcctccatcgccgtctaccaggatgtcaccggccaggccaaggagaaggccatcgccatgggtgttgccgtcggttccggttacctctacgagaccaccttcgagaaggaggtctactccgatctctacggtgagcgtggttgcttgatgggtggtatccacggtatgttcctcgcccagtacgaggtcctccgtgagcgtggccacagcccctccgaggccttcaacgagaccgttgaggaggccactcagtctctctaccccttgatcggtgccaacggcatggactggatgtacgctgcctgctccaccaccgcccgtcgtggtgccatcgactggtccagccgcttcaaggacaacctcaagcccctcttcaacgagctctacgacagcgtgcgtgacggcaccgagacccagcgttctctggactacaactcccagaaggactaccgcgagaagtacgagaaggagatgcaggacatccgtgatctcgagatctggcgcgctggaaaggccgtccgtgcccttcgccccgagaaccagaagtnaatgtaatgtgcattgggatttggaaaaaagtt

SEQ ID NO: 7043 - DNA, 681 bp, Aspergillus oryzae
  misc_feature (1)...(681): n = A,T,C or G
cactatcgcgtgaattgatatttttctttctcaatctccagtggaactagggaattcaatatggcggacggcattgacagacgggcagatgaccgcatggagttcaacacctccaaggaggtcacggttgctcctaccttcgaggacatgcacttgaaggagagcctcctgcgcggtatctacgcttacggctacgagtctccatcggcagtgcaatcgcgagccatcgtgcagatctgcaaaggccgcgacacgattgcccaggcgcagtccggtacaggtaaaacggctaccttctcgatcagtatcctgcaggtcatcgacaccgttgtgcgcgagagtcaagcgctcgtgctatccccgactcgcgaacttgccacgcagatccagtccgtcatcatggcgctcggcgactacatgaacgtgcaatgccacgcctgcatcggaggcacgaatatcggcgaggacatccggaagctggactacggacagcacgtcgtttccggtacgcctggtcgtgtcgcggatatgatccgtcggcgccacctgcgcacccgccacatcaagatgctggtgctggatgaagccgacgagctgctcaaccgcggtttccgtgaacagatctacgacgtntaccggtacctgcccccggccacgcagggtgtggtcgtcttcgcgacc

SEQ ID NO: 7044 - DNA, 650 bp, Aspergillus oryzae
ctcattcattccaccatcagctctctccaacaatgtccacaaacatcaccttccatgccagcgccctgacgcgcagcgaacgcagcgaactccgcaaccaacgcggtctcacaatctggctcaccggtctctccgcctcgggcaagtctaccattgccgttgagctcgagcaccagctcctccgagaccggggtgtccacgcctaccgtctcgacggtgacaacatccgcttcggactcaacaaggacctcggttttagcgaaaaggaccgcaacgagaacatccgtcggattgcagaggttgccaagctcttcgccgacagcgcctctatcgccatcacctcgttcatctcgccctaccgtgcagaccgtgacaccgcgcgcaaactgcacgaagtccccaccccgggtgaagagaccggtttgcccttcgttgaggtcttcatcgatgtccccattgaggttgccgagcagcgtgaccccaaaggtctttataagttggccagggccggtaagatttcggagttcaccggcatcaatgcgccttacgaggaacctgaatagcctgacgtgcatatccataaccatgatttgccagtccaagatgccgggaaacagattgtggattaattggatgctcaaggctactgc

SEQ ID NO: 7045 - DNA, 775 bp, Aspergillus oryzae
cgattttcgtgtagtttggtgtatcgacaactccgcgacaacgcgcaattaagcagccatggcccccgttcctcgcgtctactccaagacctacaaggtcccccgtcgtcctttcgagtcggctcgtcttgactcggaattgaagattgtcggcgagtacggcctgcgcaacaagcgtgaggtgtggcgtgtccagctcaccctgtccaagatccgtcgtgctgctcgtgagctgctcaccctcgacgagaaggaccccaagcgtcttttcgaaggtaacgctttgattcgccgtctggtccgtatcggtgtgctcgatgagtcccgcatgaagctcgattacgtcctggccctccgtgtcgaggacttcttggagcgtcgtctccagacctgtgtctacaagcttggccttgccaagtccatccaccacgcccgtgtcctgatcaagcagcgccacatccgcgtcggcaagcagattgtcaacgttccctccttcatggtccgtcttgactcccagaagcacatcgacttcgctctcacctctccctacggtggtggtcgccctggccgtgtccagcgcaagaaaggcgcttctgccaacgcaggtggtgacgatgccgctgaggaggatgatgagtaaatcatttaaatcggagtatggacgggtttcgttttggaaacataaaaatgtgggggcctcaactgtgactgcagcatagcgtattgatgttgtacgatcatgcccttcatgaccaaaagatagcttcagcttatt

SEQ ID NO: 7046 - DNA, 720 bp, Aspergillus oryzae
ccggatcggcctactagccccgggtcggtctaccatgcccgggtcctcgtatcagcccccggtacgacgaacacaccctgcttgatgtaccaggctacgatcagaatgtcaagttcggtgttttgactcacttctgctacgagattgatggcactaaggaaaggattgagattgccactactcgtcccgagaccatgattggtgataccggtatcgccgttcaccccgaggacaagcgctaccaacacctgatcggcaagtttgccaagcaccccttcgtggaccgcttgcttccgatcgttgcagacactgatgttgatcctgagttcggtaccggtgccgtgaagattactccggctcacgatttcaatgactttaaccgcggaaaggcccacaacctcgagttcatttccgtgatgaacgacgatggcaccttcaacaagaacggtggtatctttgccggcatgaagcgtttcgatgctcgttacaaggtcatcgaacttctgaaggagaatggactgtacgtcaagtgggagcacaaccctatgaagatcctcgatgtgccaagtccaacgatgttattgagcccatcctcaagcccaagtggtggatgaagatgggaagccttgccaagcttgccattgacgcttgtcaaaagggttgcattgtcaacaagccagagtctgccgagaaaaactaattccgctgggtatggatatg

SEQ ID NO: 7047 - DNA, 798 bp, Aspergillus oryzae
cgactaagcgctaaatgttccctgtataactaagcctcactactactctctgccattgatcgcaattccttcctaccttctattcatgcaccgatacatctcccctttgagcttgctttccttttattctgtttctgcctcattgtcccgagacacatatatcaaggacttgaatatctcaacatggccactcctactctaaccttcacgagctccgacggcgttgacatccctgtcgaacgtgatgtcgccgaacgctcgcagctcattaagaacatgctcgaagacttgggtgaaactggagagcccattcctatccccaacgtcaacgaagccgttctgaagaaggtcattgaatggtgcacccatcataagaacgaccctcccagcaccggcgatgacgatgattcccgccgcaagactacggatatcgacgagtgggatcagaagttcatgcaggttgatcaggaaatgcttttcgaaataattctggccgccaactaccttgacattaagggactacttgatgttggctgcaagaccgttgcgaatatgatcaagggcaagtctcctgaggagattcgtaagaccttcaatatccagaacgattttacacccgaggaggaggatcagattcgtcgcgagaatgaatgggcagaggaccgctaaatacgcctctggccgatggtagtcttgcctttgctcttgaatcccgcccaagtttcatgatcttgtccgggaggcttgcagttcttcataatctttcagcttgaatttcatctgggccaatgggctttt

SEQ ID NO: 7048 - DNA, 1019 bp, Aspergillus oryzae
catccgcccactggcctacgagagcaactacacagccgaaatggctctttccgacctcgactactacgcaaacaagcaatccgccgacggccccgcaatgacctgggccatcttctccatcgtagcgagcgacgtctccccatccggctgttcagcctggacctaccaccaatactcctacgatccctacaccagaggtcccttcttccagctgtctgaacaaatgctcgacaacgccagcatcaacggcggcacccaccccgcctacccattcctcacgggccacggcggcgccaaccaagtcgtgctattcggatacctcggcctgcgtctcctccccgaagaaggaatctacatcacccccaacctacccccacaaatcccctacgtcaaataccgaaccttctactggcgcggctggcccatcgccgccgaatccaactacacccacaccaccatccgccgcgacacaaagaccgcccccctctccaccgccgacgaacgcttccgaaacgccacaatccccgtgcacgtcggcagcgacgaagcggaaacccacaccctccaaccaaccggaagtcccctgatcattgagaaccggcaaatcggcacaattcccaccatgcaaggaaaccagatccaatgtcagcctatcacgtctccggatgagtacaaggcaggccagttccccatctctgctaatgacggtgcgacgtctacgaagtggcagcctgcttcgtcgaatctctcttctattactgttaccttgtcggatacgcagttggcgaatgccgtgtccgggttccatttcgattgggcttctgcgccgccggttaatgcgtcggtcattttccatgaggaggttattgacaatccggcttctgtgtttgcgtttgggactcaggaccatgctcaagatgaaggggatgagaagtatagagttgtcctcactttgacgggtattgagccctcgacgatatacacggcggaagatgagaaccaggttcgcattccggttg

SEQ ID NO: 7049 - DNA, 716 bp, Aspergillus oryzae
ctttcatctccgtaccgactaagcgctaaatgttccctgtataactaagcctcactactactctctgccattgattgttattccttcctaccttctatttctgcaccgctacatctcccctttgagcttgctttccttttattctgtttctgcctcattgtcccgagacacatatatcaaggcgacaattgtttcaggttttaacagtctgcttaggacttgaatatctcaacatggccactcctactctaaccttcacgagctccgacggcgttgacatccctgtcgaacgtgatgtcgccgaacgctcgcagctcattaagaacatgctcgaagacttgggtgaaactggagagcccattcctatccccaacgtcaacgaagccgttctgaagaaggtcattgaatggtgcacccatcataagaacgaccctcccagcaccggcgatgacgatgattcccgccgcaagactacggatatcgacgagtgggatcagaagttcatgcaggttgatcaggaaatgcttttcgaaataattctggccgccaactaccttgacattaagggactacttgatgttggctgcaagaccgttgcgaatatgatcaagggcaagtctcctgaggagattcgtaagaccttcaatatccagaacgattttacacccgaggaggaggatcagattcgtcgcgagaatgaatgggcataagaccgt

SEQ ID NO: 7050 - DNA, 801 bp, Aspergillus oryzae
  misc_feature (1)...(801): n = A,T,C or G
gtcctgttcccactttgactccccaattgattcccctcaccactccattcctcttctccagtccgctatctcatcccccgccatggcctcctcgaagtcggtcgcgaggctggtcacctaccgccggcctgcgccttctctgttgacctcttctttccgtcccttgggttcaaccgcaaacttctcctcctcagtgtgccgggctgcgaccccagctggtccccctccatccggtttccgtctggctccccccaagaaatgggacgagaccaccgagtcctccttggacaaggccagcaaatacttcctcatgtctgagattttccgcggcatgtacgtcgtgttggagcagttcttcagaccaccttacactatcttctaccccttcgagaaaggtcccatctctcctcgtttccgtggcgaacacgctttgcgccgctatcccaccggtgaggagcgttgcatcgcttgcaagctttgcgaagctatctgccctgctcaggctatcaccatcgaggccgaagaacgtgaggacggaagccgtcggacgacccgttatgatattgatatgaccaagtgtatctactgtggctactgccaggagagctgccccgttgatgccattgttgagactgccaatgctgaatatgccaccgagacccgtgaggagctgctgtacaacaaggagaagctcctggccaacggtgacaagtgggagcctgaaatgcagccgctgccagagctgancgctccttaccgtaaaacaataccagctgctttcatatcacaangggcactctt

SEQ ID NO: 7051 - DNA, 649 bp, Aspergillus oryzae
gagcgtaagatcaatgcgcctttcatgatgcccattaccgcgaagtatcgagacatgggtaccatggtcgaaggccgtgttgagtccggtgtgatcaagaagaacgctaattgcatcattatgcccaaccgcaccaaggttgaaatcacagctctctatggagagactgaggatgagatcccgactggcacttgcggtgaccaagtccgcatgcgtctccgcggtgtggaagaagaagatctccttcccggttttgtgctttgctccccgaagcgtctggtgaactgtgtgtcaagctttgaggccaagattaggattctcgatctgaagagcattctcactgccggttacaactgtgttatgcacgttcactcggccgttgaagaggttacatttacctccctgctgcacaagtgcgagcctggtacaggccgtaggagcaagcgcccgcctcccttcgccagtaagggtcagacaatcatcgcccgtctcgatgtcactagcactgctggtgccgtctgtgtcgagcgtttcgaggactacaaccaaatgggacggttcaccctgcgtgatcagggacaaaccattggcattggtatgatcaccaagctcatcaagagtgacgaggacaactaaccccgctttatac

SEQ ID NO: 7052 - DNA, 833 bp, Aspergillus oryzae
  misc_feature (1)...(833): n = A,T,C or G
ctcctcatgatgttgtttctatcaatggtgttgttccagggccggatgattttgaggatgagaaccgcaaacttgcctgcaagcgcgcacttgagtacatgggtctcgtggctggtactcctatgaaggaggtccagattgacaaggtcttcatcggctcttgcacgaacgctcgtattgaagatctgcgggcagctgccaaggttgttaggggtaagaagatcgcccctaatgtcaagcgcgcgatggtcgtccctggttctggtctcgtgaaggaacaggctgaagccgaaggtctcgacaagatcttcactgatgctggctttgagtggagagaagctggttgctccatgtgcctgggtatgaaccccgatattctctcgcccaaggagcgctgtgctagtacttcgaaccgtaatttcgaaggtcgccagggtgctcagggtcgtacccacctgatgtcccctgccatggctgcggcagctggtatcgtcggaaagcttgcggatgttcgtgagcatgttgtcactagccccgttctgggtaaggtgcaacccagggttgatgtccagccagaggcggaagatgtcgacactgaggaagaactcgaccgcatcttggaccagcccgcagacaacgaaccccacaccaacacctctggcggctcgagcgctggcttgcccaagttcaccacccttaagggcattgccgcccccatgaaccgctccaacgtcgacactgacgccatcattcccaagcagttcctgaagaccatcaagcgtactggtctcggcagcgcgctcttctacgaactgcgctacaaggatggncag

SEQ ID NO: 7053 - DNA, 636 bp, Aspergillus oryzae
cgacctccgttcagactcctgcccttcggtcggttggaaacattgtgaccggtgacgacgtccagactcaggttatcatcaactgcggtgctctccccgctctcctctctctcctcagctctaccaaggatggtatccgtaaggaggcttgctggactatttccaacgtcactgctggcaactctagtcagatccaggctgtcgtcgacgctggcatcattcccccgctgatcaacttgcttgccaacggcgactttaagacccgcaaggaagcttgctgggctatctccaacgccacttctggtggtctgcagaagcctgagcagatccgctacctcgtttctcagggatgcatcaagccgctctgcgacctgcttgcttgccccgacaacaagatcatccaagttgctttggatggcctggagaacatcctcaaggttggtgagatggacaaggaggctgcacagactggcgaggcccgtgtcaaccgctatgctctgttcattgaagaggccggcggtatggagaagatccacgactgccagaacaacgccaacgaggagatctacatgaaggcgtacaacatcattgagaagtacttctccgatgaagaaaggccggtggtgatatcgatgg

SEQ ID NO: 7054 - DNA, 809 bp, Aspergillus oryzae
  misc_feature (1)...(809): n = A,T,C or G
ccccatatggcttcatatacagacctcatcaagctggcccatcaaaaccccaacctgtccagcatggaaaacctctgggaggcttactactcctattggaacaatgatatcctcgccacaggaattatcaccttcatcgcccatgaactaatttacttcggccgctgcctcccatggatcatcgcggacgcaatgccaggtactttcaaccgatggaggatacaagatcacaaagcaccaccctcagtagccacccaatgggactgcactaagtatatactcgccatccacttcatcgtcgaacttcctctcattgtcctctttcaccccatgatggacctctgcggcctcaaatatgcttcccccttcccagacctcaaaactctagccgcccaacttgccatcttcttcattgttgaagacacctaccactactggttacaccgtgctttccattggggccctctctaccgctccatccaccgcatccaccaccaatacgcgactcctttcggtctcacggccgaatacgccagcccctgggaaaccctcctactcggtcttggcacgatcgccccaccactcgtcctgggctatttcacagagaacgtccatctgatcaccgtgttggtatggatgggtctgcgccaagtacaggctatcgactcgcactcgggatatgatttcccctggagcttgagacggatcatgccgttctggggcggagctgactggcatgatgatcatcatcgntactttgtgggtaantactcgagctcgttccgctattgggatatcttgatgggtac

SEQ ID NO: 7055 - DNA, 919 bp, Aspergillus oryzae
  misc_feature (1)...(919): n = A,T,C or G
gaaaaatctgctttctttgggtgaggatcgttacttgactacattgatgacgaagcacttccctaccatgtcctacaaattcatcccggatgcctacgctagcaccgccgcccccgagacgttctccgtcctgctgtctcagcgacgtcgctggatcaactccactgtccataacttggtggaactcgctgctctgaaagacctctgcggcttctgctgcttcagtatgcgctttgtcgtattggtcgatcttcttggaactatcatcctcccagctacctgcgtctacttgggttacctaatctacagtgttgccagtggtgggccaattccaatcatatctatcgccatcttggctggtgtgtacggcctccaggcgattatctttattgtgaagcggcagtggcagcatattggttggatgatcatttatatctgtgcctatccgatctatagtttcgttctgccgatgtattccttctggaaacaggacgacttcagctggggtaacactcgtgttgttcttggagagaagggaaataagcgagttgttgcagtagaagatgaaccattcgaccctcgcagtattcctctccagcgctgggacgattacgctcttgccaataatctgcctggccgccgtggagattataacatgagccaggagaaattctacggaggtcaatatggagatatgggcatggagatggatgatatgcattcccagtattcctcggtcaagcctgcatccacaatcttaaccggatttccaggagcaggccggaatggtagtccttacatgccgccgcagtcgcccgcccccgtcggtggaaataccccangcaacaggcattcgcacctgtncagctttagtcggtataccgatatgccgctcagccagggcaccagtctcgaaacc

SEQ ID NO: 7056 - DNA, 598 bp, Aspergillus oryzae
cgagggcccgttgggacggggttttctacaggcacacctactgctaccactgaagaggagacgtccagggactttattaatttctttaagaactttcaagacatctttggaatcaagaaattcaagatttacgtgaccggtcagagctatgctgggcgttatgtgccgtacattgctgcggcaatgctggatcaaaatgacaaggactattatgacgtctatggggcactggtttacgacccagtcattggccaatttgactatgtgggacaacaagtggctgctgtgccaactgtgcaggagaacgctaacatcttcaactttaatgcaagctttatgaatcaactacaaagtcttcacaaatcgtgtggttatcaggactttatagacgaatatcttactttccctccatcgggggtccagcctccgaagtcttttgaccctaccagcgacgctgattgtaatatctataacatgatcacggatgcagcttatcgagtcaacccttgctacaacgtgtacgccatcaaccagaagtgtccctttctgtgggattgttcttggagggcccacgaaactgcactacctacccgccggt

SEQ ID NO: 7057 - DNA, 547 bp, Aspergillus oryzae
  misc_feature (1)...(547): n = A,T,C or G
cggtctgcctgagttggtctctcgttctaaaatcgcccaggcatccagaattgccaaccctggttgctacgcgacagcggcccagattgctattgctcccctcgtccctcacctcggtggacagcctaccgttttcggtgtttccgggtactcgggtgctggtaccaagccaagccctaagaacgacgtggagaaccttaccaacaacatcatcccttacagcctgactgatcacatccatgagaaggagatcagctcccagcttggcaccagcattgcattcattcctcatgttgctgtttggttccagggtattcatcaaaccatcagcatccctctcaaggaggaaatgtcctcccgtgatatccgcaacatctaccaggaacgttatgctggtgagaagcttgtgaagattatcggcgagcccccggtggtgaagaacattgctggtcgccatggtgttgatgttggtggattcgctgttcactctagtggcaagcgcgcagnggtgtgtggtccctatgaccacctgctgaagggcgcaccn

SEQ ID NO: 7058 - DNA, 666 bp, Aspergillus oryzae
gcggatgcgccaggagctcctcacgaacggaaacccccaaatgtgggatattgtcgcctaccgtatccctaagaaccgtaccccccatatccgtactggcacgaagtggtgtatctatccatcctacgacttcgctcactgtctctgcgatagtttcgaagggatcacccacagtctttgcacaacagagtttgttactgcccgtgagagctacgaatggctgaacaaaacgcttggtgtttatgagcctatgcagcgcgaatatggccgtttgaatgttagcggtactgtcatgagtaaacgagttctgagagaacttgttgaaaagggccatgtgcgcggctgggatgatcctcgtctttataccttgattggtattcgccggcgaggtgtacctcctggtgctatcctttctttcatcaacgagctaggtgtgaccacgtcactcagcaccatccagatcacacgattcgaacagtcggttcgccgttatctcgaaacatcggtccctcgcctcatgttagtcctagaccctgttcgcgtcgtgattcaagacctcggcgatctagaaggacaagagctagtattaccattttcgccaaagcagcctgagtttggctcctataagttgaagatgacgtcgactgtttatatcgaccagtccga

SEQ ID NO: 7059 - DNA, 732 bp, Aspergillus oryzae
  misc_feature (1)...(732): n = A,T,C or G
ggcgtgcgactaggtcgagtctggacgaggcacgaacctcaacgaggccaagctcgacgagaccaccgaggtcgtcgtctcccctcctgctctctacctgaccctcgcccaacaggtcgccgacgagaagaagaaggttgccgtttcctcccagaacgtcttcgacaagcccaacggtgctttcaccggtgagatctcggtttctcagctgcaggatgccaagatcccctggaccatcattggacacagcgagcgccgtgtcatcctgaaggagactgacgagttcattgctcgtaaggttaaggctgccattgacggtggcattagcgtcattttctgcatcggtgagactcttgaggagcgtgaggccgacaagaccatcgaggttgtcaccaagcagctcaacgctgccgctaaggagctcaccaaggagcagtggtctaaggtcgtcattgcctacgagcccgtctgggccatcggtaccggcaaggtcgctaccacccagcaggcccaggaggtccacgccgccatccgcaagtggctcgccgatgccatctcgcccgaggcctacgagaacacccgtatcatctacggtggctccgtcagcgagaagaactgccgcgagttggcccaggaacgcgatgtcgatggcttcctgggtggcggtgccagcttgaagcctgctttcgntgatatcatcaatgctcgtttgtaagcaaaccgatggtgctt

SEQ ID NO: 7060 - DNA, 863 bp, Aspergillus oryzae
caacctcaccgttcgcaggaagtgcagcaaggtcacctccaactctcaaaatggcccgccgtcccgctcgttgctaccgctactgcaagaacaagccctaccccaagtcccggttcaaccgtggtgttcccgaccccaagatccgtatcttcgatctgggacgtaagaaggccaacgtcgatgacttccctctctgtgtgcacatggtctccaacgaatatgagcagctttcctctgaggctctcgaagccgcccgtatctgtgccaacaagtacctcgtgaagatcaccggtaaggaaggtttccacatgcgtgtccgtgtgcaccccttccacgtcatccgtatcaacaagatgttgtcgtgcgctggtgccgatcgtcttcagaccggtatgcgtggtgccttcggtaagccccagggtaccgttgcccgtgtgaacatcggccagatcatcctgtccgtccgcacccgtgactccaaccgtgccgccgccatcgaggctttccgccgttccatgtacaagttccctggtcgccaaaagatcgtcgtctccaagaactggggtttcacccccgtccgccgtgaggactacatccagctccgcaacgagggcaagctcaagcaggacggtgcctacgtccagttcctccgtggccacggtctcgttgagaacaacatgaagcgcttccccgacgcctacgagtcccaggcttagatggaatgagctttagcgttaggacccataaaagacatgaatttttattatattcctccggttaccaatacatgttctgttattttgtgatgtcattttagtgtcctcacgcacggcggagttgattttaatcatggattcctcggg

SEQ ID NO: 7061 - DNA, 941 bp, Aspergillus oryzae
cgacatctttgcctcccaagtccggaaagaaggccgcccctctgccctacccccagggcaaggctggttctaagaaggcccccaagaaccctctcatcgagaagcgctcccgcaacttcggcattggccaggacatccagcccaagcgcaacctcggccgcttcgttaagtggcccgagtatgtccgtcttcagcgccagaagaagatcttgaacctccgtctcaaggtcccccctgccattgcccagttccagagcaccctggaccgcaactccgctgcccagaccttcaagctcctcaacaagtaccgccctgagaccaaggccgagaagaaggagcgtctccacgctgaggctaccgccgttgccgagggcaagaagaaggaggatgtctccaagaagccctaccacgtcaagtacggtcttaaccacgttgttggcctcgttgagaacaagaaggcttcccttgtcctcatcgcccacgacgttgaccccattgagctggttgtcttccttcccgctctctgccgcaagatgggtgtcccttacgccattgtcaagggcaaggctcgtctcggtactgttgtccacaagaagaccgctgctgtcctcgctctgactgaggtccgctctgaggaccagagtgagttctccaagctcctctccaccatcaaggagggctacaccgacaagtacgaggagtcccgccgtcactggggtggtggtatcatgggcgccaaggccgtcgcccgccaggagaagaagcgcaaggccgctgagtccgctgtcaagatctaaactagtccaaatgtctagtctagttccgcaatgacgggttttcaaacgatcttaatgacaaaatatcgcgctcttccggataccaaaaattgggattaattgtttaaaagcaaatcgcggccacggttttctggaatggtgttg

SEQ ID NO: 7062 - DNA, 662 bp, Aspergillus oryzae
  misc_feature (1)...(662): n = A,T,C or G
ccaccgatcaacgttcgcactgttgtcggttttgctttaatcgctattcaacccggccacgtcaaggtcccccaaatttcaaacctcaccacttttagggcttgacaagctctcacaaccattcattatggctaacgacgagtatgattttctcttcaaggtggtgcttattggagactctggtgttggaaagtccaaccttctgagtcgtttcacccgcaatgaattcaacctggactccaagtcgaccattggcgtggagttcgcaacccgttctattcaggtcgattctaagacgatcaaggcgcaaatctgggacactgctggtcaggagcgttaccgcgccattacctctgcctactatcgtggtgccgtcggtgcccttcttgtttacgacatcagcaagcatcaaacctacgataatgttaaccggtggttgaaagagctcagagatcacgcagattctaacattgtcatcatgcttngngggaaatangagcgatttgagacacctgcgcgctgtgccacccgangaangcnagcagtttgccagcgagaacaaccctctcttcatcgagacatctgctcttgatgcgagcaacgttgagcttgctttcagaacatcctcacagaaatctacccgattgtgtccagcacggctt

SEQ ID NO: 7063 - DNA, 722 bp, Aspergillus oryzae
tgtatgactcgtttgaatgcagcacgaggcatccttggtcttgaaagacatgcctgtcccagcgcgggcgcatgtggaggcatgttcactgcgaacacaatggccacagctatcgagtcgatgggtctgtctttgcctggctcctcttccacccccgctacatctccatcaaaaatgcgagagtgtgtcaaggtggcggaagcgattaaagtttgcatggagaagaatataagaccgcgtgatcttttgactaagcggtcattcgaaaatgccctcgtcatgacgatggctcttggaggaagcaccaacggtgtgctccacttccttgccatggctcggacagctggcgtggaacttactttagatgatattcaaagggtcagtaacaagatcccattcattgctgacctttcccccagtggaaaatactacatggcggacttgtacgatattggcggggtaccgtctgtccaaaagctgttgattgcagggggcctgcttgatggcgatattccaacagttaccggaaagactctggccgagaacgtggcatcattcccatcgttaccggacgatcaggttattattcgtcctttggacaaccctattaaggcgactggccaccttcagatcctccgtggaaacctagcccccggaggcgctgtggccaagatcaccgggcaggaggggcactaaattataggaaaagcacgagtgtttga

SEQ ID NO: 7064 - DNA, 780 bp, Aspergillus oryzae
gcgtagcacaataaaccgaacaaaatcggttggtattcattgtaaaaaaggatcgtaaataatggggactgaactatgtaatgcaccacaacattgggtagtgataccaaaagaagtatgctgttgaatcatatcataaaggcctaaaaccaaccgaacgccttgcaagggtacttaacccagttgagtaacgatagcagaaaatcaaaccagacattagtttccaccacggaaacccaggaccaaagtgtaaggggctctccttctgaatattgtagtctgaaaacgtgcgtccatcctttaactgcttgccagcaaagataagacgttgctggtctgggggaataccctccttgtcttggatctttgacttgacgttgtcgatagtgtccgagctttcaacttccaaagtgatagtcttgccagtgagcgttttaacgaagatctgcataccaccacgaagacggaggaccaagtgcaatgtagactctttctggatgttgtaatcggacaaagtgcggccatcttcgagctgcttgccggcgaaaatgagacgctgctggtcaggaggaattccctctttatcttgaatctttgacttcacattatcgatcgtgtcggatgattcaacctccagcgtaattgtctttccggtgagagtcttgacgaagatctgcatgatgacgacggtgaaagtatttcagttgtatagaaggtagtaaggagtatttttagggagacgttgggagaaaggtaggtggacaacagccgcagtgactg

SEQ ID NO: 7065 - DNA, 637 bp, Aspergillus oryzae
cccgggtaagcagccttcgatcgccagtcgccgaatcgccatcattatcggcgacggatacgaccccgtcgctttcaatggcctcaagggcgccatcacggcggttggagccttacctttcgtcattggcaccaagcggtcacctatctacgccgacggtgaggacaaatcatcttccaagggcgtgatcgccgaccaccagtatgacggacagcgctcgacgatgtttgacgctaccttcatccctggcggtccgcacgtcgaaagcctcaaggccaatggccagatccggtactggatcattgagacattcggtcatctcaaggctctgggcgccactggtgaagcggcggctttcatcaaggaagccctgggctccgcgcttgatgtgaaggtcgctacgtctgataacccccagccggttgagtggtatggtgttgtcacggctggaaagatccacaaacctgagagcttcaagggaggtatccagattgtcaaggatgcgaaggatttcattaacaccttcttctaccagatcagtcagcatcggaactacaagcgtgaactggatggccctcgctccacaggtgcattctaaatgctttcgtgaatggttgaggacatggaaggctgtgtt

SEQ ID NO: 7066 - DNA, 644 bp, Aspergillus oryzae
gatcattcgggtcttgggcaattgtttaattgatccccttagtctatttttctcctcgtcaatcaccccaaggatcagggcatttttccccctctaaagtccttccacattccacccactccgtttcacacacccccctccttccaatcttaattcctttgtcactccgacattcgtcccttttagactcgacaagatgagagaagttattagtttgaacgttggtcaggctggttgccagatcgccaattcttgctgggagctctactgtcttgagcacggcatccagcccgatggttacttgaccgaggaacgcaagaaggaagaccctgaccatggtttcagcaccttcttctccgaaactggccagggcaagtatgttcctcgtaccatctacgccgatctggagcccaatgttgtcgatgaggtccgcactggcacctaccgtacccttttccaccccgagaacatgatcaccggcaaggaggatgcctcgaacaactatgcccgtggtcactacaccgttggcaaggagatgatcgaccaggtcctcgacaaggttcgccgtgtggccgacaactgcgctggtctccagggctttctcgtcttccactctttcggtggtggtactggttccggtttcg

SEQ ID NO: 7067 - DNA, 701 bp, Aspergillus oryzae
cccatcgtcctccccgctagacttcgacacaaagcagtgctcctgtgttgagtgtaattctacgggccttttctccaccatcaataaataaaacacaccatggccatgcccatgcgaaccactcgccatgctaccaagctggctcagtcttcgcgcctattggctcagtatacctctcgcagatcttatgcgacggcggaacccgatctgaagtccgccctcaaggcggtcatccccgccaaacgtgaactcttccagcaggtgaaacaacagggtgacgatgtgattggtgaggtcaaagttgccaatgtcattggtggtatgcgtggtctcaagtcgatgctctgggagggctcggtccttgatcccgatgaggggatccgcttccacggcaagaccatcaaggattgtcagaaggagctccctaagggtacctccggtaccgagatgttgcccgaagccatgttctggctcctcctgacgggacaggtcccctcgaccagccaggtgcgcgccttctcgcgcgaattggccgagaagtcccacctccctcagcacatcctggacctcattaagtccttcccccgcaacatgcaccccatgacacagctgtcgatcgccgtcgctgctctgaacactgagtcgcagttcgccaaggcctacgagaagggccctgacaaggccgattactgggagcccat

SEQ ID NO: 7068 - DNA, 648 bp, Aspergillus oryzae
caacttgttcatcacacaagacagtaaactccggctcgaaaggtccggctgtatactgtttaaggatgcatcagcaaataagggtggcgtgacttcgtcgtcactagaggtccttgcgtcgttgtccttcaatgacgatgagttcgtcgaaaacatgtgtgtccgtgaagatggcagtgttcccacattctaccaggattatgtcaagcaggttcaggaggtcatcaagcagaatgccaccctcgagttcgaggccatctggcgtgaacatgagcaaactggccttctccgcagcgtcctcagtgatcgcctcagtctggctattaccaagctcgatgaggagttacagaagaccgagttatgggacaatgttgaactccgccgctcggtccttgatgacgctttgcccaagctacttctgaacaagattgggctcgacacaatcttgcagcgagttccctgagaactatctccgggccatatttggcagctacctcgcaagtcggtttgtatacgagtatgggagcaaacctagccagttctccctccttgacctcatgaccaatcgactttccaaggctatggcaaaacatgctttcaaagggcgtgtgatgtccacgttaggatttggatcttccgggtaaacat

SEQ ID NO: 7069 - DNA, 696 bp, Aspergillus oryzae
gtggatctgtgggtggatagttagcaggagaaccgtacgacgtataacgttgtcgcgcacacgaacggcggtgatccgaacaacgtcgatctgctgggtgggcacacggactcactcgaggcggggcctgttatcaacgactatggctcggggattattagcaagttggtcattgtcaaagcggtcacgcaatacttcgtcaagaatgccgtgcgcttgctcttctggacaacatacgagtttcgtctgctgggcacgaactactacttctcccatttgaatgccaccgagctgaacaagatccgactgtaactgaacttcgacatgatcgtctcacctaactacgccctgatgatctatgacagtgatggatgggcgttcaacctgagcggaccgggccgtttcgccctgatcgataaactgttcgaggactactactaattccatagacctgcctcatatccccaccccattttgagggaaggtcccactaccaaggctttattctgaaccggatttcgttcggtggactctttacaggcgcgcggggcattttttttccaacaaaaacccaaaccccttgggaagtttatccctggttggccttaaaaccacaattatccccccgcgggagaaataatgaccacccccaccctgagaaactttttttcaacatcaaaacacacccttttttct

SEQ ID NO: 7070 - DNA, 666 bp, Aspergillus oryzae
  misc_feature (1)...(666): n = A,T,C or G
aatggaccacgcagcagccgccttttcttaatctatttgattgctcctctcctatacggcctccctgaaaactgtggaataaatatctcagttggctaaaaccctgcagctgatctcaaattccatctgttcaccgtcataactgttggctcaacacgaaagcaggcctcccaccatatccgataccacccaggtccagaatatatcatcagtgcatgtttgtggccgatcatacgttctatacgagagtctacagtcatggaacaatccacccaaagtgctagccagcagcagggcagacagcaacctgtgtatgatactagaaacggtggacactatggtgccagcgcagcgctttctgcacagggatatgcgcccgtagctgaactttatacgggtacttgggcaaatgtcaatcaaggcttgcaaggcacggctcgtgatattctgacaacgtattggcagcatatcatcaaccacctcgaatcagacaaccatgattataaaatccatcaactgccattggcgcgtattaagaaggtcatgaaagctgatccagaagtgaaaatgatttcagccgaggcaccaatcctctntgctaaaggttgtgatatattcattaccgagctgactatgcgagcctggatacatgccgaggacaacaaa

SEQ ID NO: 7071 - DNA, 706 bp, Aspergillus oryzae
  misc_feature (1)...(706): n = A,T,C or G
ccaaggcacggcgtggccccctcaccgcggagtctttcagctctgctcaaacatgaaagcgtctcaactcggaatcgattagcagcagtatgctcgtccacgcaatacgcaacggcccgtaggtcattacacaacggtcgtccacggaagtcccagtccgccgccgcaagtaacaactcgtccaatcccgccctatcatttccttgtcttgacgcccaagatgcgaagtccgctctcctctccgcacggtctatcgagtcaggtcccgagccgtcatacacaaccggccaccatgaacagttccgctgcgaagacccattgctgcttgactggggtggtgtcctgcccgaatttgatatcgcatatgaaacatggggtcaattgaacgcagacaagagcaacgctatcctcctacacaccggtctctcggcctcgagtcacgcccatagcaccgaagccaattccaaaccgggatggtgggagaaattcatcggccccgggcaacctttatatacaaacaagcacttcgtcatctgtacgaatgtcatcggaggctgctacngcagcaccgggccctcgttcatcgacccctncgatggaaagagatacgcccacccgattncccatcctgacgatagagacattgtgcgcgcacattccgtctcttggactcgcttggaattcaaaaactgtcgccctccgtcgc

SEQ ID NO: 7072 - DNA, 1029 bp, Aspergillus oryzae
cgcaaccctcattactaaacccctcagaagaatcgagtctgccaagcaacttgccgaaagaatggcttctcttcctaacacatacgcggaccccgtccgtatcgccgtcatcggtggaactggtctccgcgaactccctggtttcactcaggttgcttccttgaacatctcgactccttggggcactccctcctccccgatcacgatcctgcatcaccagtgctctcacaacaaacagaccgttgctgttgctttccttagtcgccacggcttgcaccatcagattgcgccccatgaggtgcctgcccgcgccaacatcgcggccctgcgctccattggtgtccgcaccatcattgccttctcggccgtcggcagcttgcaagaggagatcaagccccgcgacttcgtgatcccagaccaggtcattgaccgtaccaagggcatccggcctttcacattcttcgagggaggtgtggttgctcacgttcctttcggagacccgttcgatgagggtgttgccaaggttgtgagggcttgcggccacagcctcgaaggcgagggtgttgtgctgcatgaccgcggcacattggtgtgcatggagggacctcaattctccactcgcgccgagagtaagctctaccgctcctggggtggcagcgtcatcaacatgtcttgtcttcctgaggcgaagctggctcgtgaggccgagattgcctaccagatgatttgcatgtccactgactatgactgctggcatgaggctaccgcagatgtcactgtggaaatggtcatgggaaatatgaaggccaatgctgagaacgctaagcacttcgtgactgccgtcctcgatgagctcgcctctgacaagaactcggaacttgtccaagctaagcatgtggaaggctctgtcaagttcggtctcagcaccgcccagcctaactggagccctgaagctagagagaggatgaactggcttttccctggatacttcaactaattcatttgctattagagaaggtgcctgaacat

SEQ ID NO: 7073 - DNA, 569 bp, Aspergillus oryzae
ggtgtccgatgtcgctaacgctgttcttgacggagccgactgtgtcatgctttctggtgagaccgctaagggctcatacccttgtgaggctgttaagatgatgagcgagacctgtttgctcgccgaggttgccattccccacttcaatgtctttgacgagttgcgcaacctcgctccccgccccactgatactgtggaatccatcgccatggctgccgttagcgccagtcttgagcttaacgccggtgccattgttgtcttgaccaccagtggtaacactgctcgccttctttccaagtaccgccctgtgtgccccatcctgatggtcacccgtaaccctagagcttcgaggtattctcacctctaccgtggtgtctggcccttcctcttccccgagaacaagggagacaacattgtctgtgtccagggttggcgcggaggccatggccacaccaacaccgttcgtgtggtcccagctgaggagaacctggtcttgatgagtaattcagaccgcagtatcacccttggggcctgaagtggtaacgaccacaacttgggttcggaaaact

SEQ ID NO: 7074 - DNA, 671 bp, Aspergillus oryzae
  misc_feature (1)...(671): n = A,T,C or G
ttcaacagcgcccagaacgacggaaagcgagtatccttggcggatctcattgtgctcgctggctgcgcagctgtcgagaaagctgccagcgatgccggccatattatcaccgtgcctttcacgccgggacgcatggatgcttcgcaggaccagacggatgtcgagtcattcaatcagatggagcctgtggcagacggcttccggaactatggcacatccactgctcgggtgccagccgagcactatctggttgacaaggcgcagttgctgactctatctgcgcctgagatgacggtacttgttggtggtctgcgggctctgaatgccaactacgatggctccgcccatggagtgtttactacccggccgggccagctgacgaatgatttctttgtcaatctcctcgacatgaacacctcgtggaaggcatctggcagtggcaatgacatttacgaaggcaccgaccgcagaaccggctcgaagaaatggactgccaccagggccgatctggtcttcggatctcacgccgagctgcgcgccatcgccgaggtgtatggcagcagtgacggaaagggcaaattcgtaaaggactttgttgccgctggngctaaggtcatgaaccttgacaggtttgatgtgaactaggatgtacattctttcttttaactttt

SEQ ID NO: 7075 - DNA, 689 bp, Aspergillus oryzae
  misc_feature (1)...(689): n = A,T,C or G
cttcaccacctcacgcttccccccaaccctcagtcctccacatcctcttacttctcacctatcgaaccctttcactcctctagcttcgattttgtttttctccactctatcaaattaataatgagttcgcccttcgatatcaacggtggtgcctgcgtcgccatggtaggcaaggactgcgttgcaattgcctgcgatctccgactcggcatgcaggccctgaccgtctccaataacttccccaagatcttcaactacagcccatcgaccttccttggcctgaccggcctggcgaccgacgtctcgaccgtctcagatctcttccgctacaaggttaacatgtaccgcttgcgtgaggaacggaacattgcaccccagaccttggccaacctggtcagttcatcactgtacgagaggagatttggacctttcttcgtcagtcccgtcgttgcgggtataaacagcacaactggcaagccatttatctgtggctttgatagtattggatgtatcgactttgcaaaggatttcattgtcagcgggacagctagtgaccagctgtttggtacctgtgagagcttatgggagccggatctggcccccgaggacttgttcgaaaccatctcccaggctctcctcagtgctgttgacagagacgcactctccggttggggtgcacaggtgtacan

SEQ ID NO: 7076 - DNA, 999 bp, Aspergillus oryzae
  misc_feature (1)...(999): n = A,T,C or G
ccgcaaggaaatggccgagatgaagccactgcctagcatctactatcccgactttattgctgccaaccaggaggaccgtgccgacaacgtcctcgagggaaccaaggcttgctgggctcacgtggagaagatccagcaggacatccgggacttcaaggcccagcacggtctggacaaggtgattgtcatgtggactgccaacaccgagcggtacgccgacatcgtccccggtgtcaatgataccgccgacaacctcctcaactcgatcaagactggccatgaggaagttgccccgtccactgtctttgccgtcgcctgtatcttggagaacactcctttcatcaacggttcgccccagaacaccttcgtccccggcgcccttgagctggccgagaagcacaaggccttcatcggtggagacgacttcaagtcgggccagaccaagatgaagtcggctctcgtggacttcctcatcaatgctggtatcaagcttacttacatctgcggtctactccacctgtgcagacagaccctgagaacctgagctcccacaagcatttccgctgcaacgaaatgaccaagtccaaccatgtgtatgacatggatggggtcaacctcatcctgtacaataaggatgagcattcggaccacaccgctgtgaataagtacataccggccgctggtgacaacatgcgtgctctggatgaatactactcccagatcttcatgggcgggaaacagaccatcagcttgntcaacatatgccatgactccttgctgggtttccgtatgattattaaattggatgagcttgccgagaatattacttgcgttaactggaaagatgaggaaggtggcgactacaaaggcttcaaccagtggtcactaccttagctacatgtccaaggctactttgctgtctgggccacccccggtgcggtcgagttagcaaatcaagctatgcatgaatcacatttttcttgcttggcttggctcccg

SEQ ID NO: 7077 - DNA, 894 bp, Aspergillus oryzae
  misc_feature (1)...(894): n = A,T,C or G
ggatcgagcgtctgcggactattaaccgtcgcactctggactctcttgcagctcgtgtatatttttattactccctcttctttgagcagattactcctctccccccttctcctgctgccacggttacaatgattcgccagccattgcttgcagcgctcaggacggccgtgcttcgcaaggatgttgacacccaagctactgttatgacattgcttctgcgcaactacttgtccacgtctcatatctcacaagcagatctgcttatctctcacaaccgcttcccgcagtccgcatctaacaatcagattgcccggtacttgtactacttgggccgtatccgtgctatccaattacagtatactgatgctcacggacacctgatcggtgctactcgcaagtcaccctccagccacagtgcgcgtggattttatcaatcctctcataagttgctcgtggtggtagagcttcttatgggagacatccccgaccgtgcgatcttccgtcagcctgctctggaacgtgccatgcacccttacttcttgcttgttcaagccgtgagtgtaggtgacctggatggctttttgagcattgtaaatacgcacagtacgacattccgtaaggatggcacgtacaccctcatcctgcgcttgagacanaacgttataaagaccggaatcccgatgatngtcgctgcttattctcgcatctccctgcgggacatttgccttncgcctgngctggacagtgaggaatcagncgagtacatcgttgccaaagcgatcncggaccgtgtgatagaggccactcttgaccatgagcgnagatttatgaagagtaaggaaggttgagaaatttatgcgactagaggaccttgcgaggcattccacggacgct

SEQ ID NO: 7078 - DNA, 974 bp, Aspergillus oryzae
  misc_feature (1)...(974): n = A,T,C or G
atgcgattaacctgacggtatcaaaccgtggccaaattaatacctggagaaagtcccgtcgagccatggcttattcaacggttggcacgcctgactacattgcgcctgaaatcttcaacggccaaggatatacttatctttgcgattggtggtcagtcggtgccatcatgtttgaatgtcttgtgggatggccacctttctgtgccgaagacaccaccgatacctaccggaagatcgtgaactggagggagtgtctctacttccctgaagagcttactctttcccgcgaatccgagggcttaatccgaagcttcctttgtgacgcagagcaccgtgttggcaacgacggcggccaattcggtggtgccacacaaatcaagaaccatccgttcttccgtggtgttgtttgggagcagcttcgcaatattcgtgctccattcgaacctcgattgagctccaatattgacgtgtcatacttccctattgacgaaattcctcaggaagataccagtgctatccatcgtgctcaggcccgtgccatgcccgaggaacaggaggctgaaatgagccttccgtttatcggatacacatacaaggcattcaatgccttccagaacaactgagaatcgcactgatactcgagatgatcgatgtatgcaggatgagcgcctcggaaagccggtccgcgggcaggcttgcgcggaagtatttccagcggctcatctaagatctattctcgaaatatctttgttcatttgatttcatctagcgtctagcgcatttggcatttcatgtcattgataacgacctgtgcatcttccttactgtgtttgcatgtcgcaagacgaccccggctagttgcacaccgtgtctagccttanagaactacaaacaagtgcattatttggttgaagttcagagcctgtgacacctacaagtgcggatcacgaatgactggctacttttgtttcctc

SEQ ID NO: 7079 - DNA, 704 bp, Aspergillus oryzae
ccagcatacaaggcatgcaaaatgagatgttttctatctttatgctgcttgtcatcttccccaatctggttcaacagatgatgccatattttgcgatgcagcgttccttatacgaagtgcgggagcgtccatcgaaagcctactcatggaaagcattcatgctcgcaagtattgtggttgagcttccatggaacatgctgatggctgtgcctgcgtacttctgttggtattatccaattggccttttccgcaacgcctatccaacagactcggtaacagagcgtggtggcacgatgttccttcttgtcttgatctttatgctgttcacgtccacgtttagctcgatgatgattgcaggcatcgaccatccggaaaccgctagcaacatcgctcagctgatgttttcgatgtgtctcatcttttgtggtgtacttgcaagtccagacgtcctacctcggttttggatattcatgtggcgcgcatcaccgttttcctacctcgtgggctccgtcttggcggtaggcatagccggggctccagttcattgctcggatatcgaggtgcttcatataccacctcccggagggccaaattgctcgggctatctcgaagcctttaccacgatggcgagaagcacgttgctcaatcctgaggctgacagcgactgccaagtatgttccttgtccacgacggatcaatttctg

SEQ ID NO: 7080 - DNA, 1065 bp, Aspergillus oryzae
ccacctgccagatatacctctcgcccgcccttccatcctctctcctctctttgtcgcatcccgggccctttcattgtatcatactcacagcattcaggcaccatggtcgccagtgctgtcaggatgcgcactcccagcgccatgctcatcaaaggcgcctcctccctgaggaggccgcaggttatgcacagattcaaggatgctgttcaaccccaattgcccgccttcgctgccctttcccgctactatgcctccaagtccttcccccctcacactatcattagcatgcctgctttgtcgccaacaatgcttgctggaaacatcggtgcctggcagaagaagcccggcgattccctgcagcccggagatgttttggtcgagattgagaccgataaggcacagatggatttcgagttccaagaagaaggtgtcttggctaaagttctgaaggaaactggtgagaaggaggttgctgtcggctcccctatcgccgtcctcgttgaagagggcactgatgtttcgtcgttcgagtcgttcaccgctgaggatgccggtggtgacaagggtgctgccccagctcaggagagcaaggaagaatccaagggtgctgctgatgctgctcccgcttctacaccggctcccgagcctgctgctcaggagcccgagacctcgggtgagaagcttcagcccagtctcgaccgtgagcctactatcagccctgctgccaaggctcttgctctggagaagggtgtgccaatcaaggcccttaagggcactggccgaggcggtcagatcaccaaggaggatgttgagaagtacaagcccagcgcttctgccgctgctggccctacctatgaggatatccctcttacatccatgcgcaagactattgccagccgccttcagcaatccaccagagagaacccccacttcttcgtctcaactactctgtctgtcactaagcttctgaagctccgccaggcccttaacgcctctgccgatggcaagtacaagctttccgtcaatgacttccttgtcaagcttgtgctgcggctcttcagaagg

SEQ ID NO: 7081 - DNA, 663 bp, Aspergillus oryzae
ggagctctttggcatcaagaacttcaagatttacgttactggtgaaagttacgctgggcgttatgttccgtacatctccgctgctatgttggaccggaacgacacggagcactatgacctcaaaggtgcccttgtatacgacccctgtatcggccaacacgactacatccaggaagaagtgcccgccgtgcccttcgtccagcaaaatgccaacctcttcaacttcaactccagcttcatgtcggaactggagaaactccacgactcatgcggttacaaggattacctagacgagtacctcgtcttccctcccgccggtgtgcaaccccagaaatccttcaactacaccagcgacgccgactgcgacgtcttcgacctgatcagcaacgaagccctggtcgccaactcctgcttcgacatctacgagatcaacctcatgtgcccgctcgcctgggacgttctcgccatgcccacagcattcaactaccagcccgccggtgcgacggtgtacttcgaccgcccggacgtcaaacgtgccatgcacgcccccctgaacgtcactttttcaagttgttccaacgagaacgtctacgtttgcggcgacgcccggccggaacaagaaggagacttgtccgcaacccgatcgaacacgtccttgcttag

SEQ ID NO: 7082 - DNA, 1229 bp, Aspergillus oryzae
  misc_feature (1)...(1229): n = A,T,C or G
cacgtgcatgcatcgcaacctgactcctgaaaatgatgtccctgcgtaccatcgtccgctctgcgcctcgcactgactcccgctccatcgccatctcttcccgctctgctctcttccgacctattccgactgctgctcctaaaaatgttatcctgcaatctgctctgaagccttcatacgcggctttctcgacttctagcgtattcaaacagtctcaagctgaaggtgattttgagcttgctgccaagcttgaggatgaactgaagcatgacaaggcttctggtcttgaggacctggattcttccgtccagaacatccagtatgttcttcagaacaactcctgggaggtcaaggacgtccccggtgaccaggaggtcgtgttgacgaagaagttcggtaacgaggagattcgcctcacctttaccgttgcggaccttcagaacctgagcgaacaagaggaattcgacgaccaggctttgagtgacgagctggattttgagggcggccaccagcccgctaaccggggtgcctctggcaacgttgcccagcaccccgaggatcgggttgccccggctgatcgcgagctggatgagttggaccgtgatctggagcccagcttccctgcccgcgtcaacatcaccgttgagaagccaagcaacggcgctttgctgatccagactgttgcccaggatggtctcttccagatcgaggaggtctcctacttctctaagcctgacttggcacatgcccagacagctgaaaaggactgggctagacagagcctctacgctggacctccctttgagaacctcgatgaggatctgcagaccttcttggagcgttacctcgaggagagaggcatcaacgcagagctcgccaacatgattcctgactacatccaggtgaaggagcagaaggaatacgttcgctggctcgagaacgtcaagaacttcatcaccgcttaaatgcagaccaatgatgcattaatgcgtctgcaaatatgcattggttaaatccctactcctaattctaattctacattcctcgactttctcgtgatctttttgtgagggagtttgccgtaacttcctgtcatgttagcttgacgtctgtccatgcaagtcgcctatgacaatatttgctaggcagtgtgcacgtgtatcaatatagaaacgaatttagcatctacatgtattatatttaaaaaaaaaaaaanaaaaattcctggg

SEQ ID NO: 7083 - DNA, 715 bp, Aspergillus oryzae
gggcgtcgctcctcccaccatcgttttgttgtttgtcttgattgaattcccatctttcgttgatcgacccctttatcacaatggcctccactactgagactgcctcccccattggcattgccaaccttcccaaccagcgtcacaagattgtcgctaagcggggtgcggctttcactattatggttgctggagagtctggcttgggaaagaccacgtttatcaacaccttgttctcgacgaccatcaagaactatgccgaccacaagcgtcgtcaccagaagcagattgaccgaactgttgagatcgagatcactaaggccgaattggaggagaagttcttcaaagttcgcctgaccgtcatcgatacccccggattcggagactacgtcaacaaccgcgattcctggcaacccatcattgagttcctcgacgatcagcatgagtcctacatgttgcaagagcaacagccccgccgcacagataagatcgatatgcgtgtgcatgcctgtctgtattttatcagacccaccggtcacactctgaagcccctcgatattgaagtcatgaaacccttgagctctcgcgtcaatcttatccccgtcattggttaaagccgacacccttcagcccggcgatctggctcgatacaggcagagagttaaagctgtcatttgagcccaaagcatcaggatttacacttcccccgattgaagaa

SEQ ID NO: 7084 - DNA, 675 bp, Aspergillus oryzae
  misc_feature (1)...(675): n = A,T,C or G
ctcgataccttcgtccccgcttacattccccctgttcccgctcgtttacttttctaagtactatatacgctcatcgccatcatgtctggaagcgcatacgacagacatatcacaatcttctcagaccaaggtcgtctgtaccaagtcgaatatgccttcaaagccatcacctcagctaacataacctcgttgggtgtgaggggaaagaactgtgctgtggtgttgtctcagaagaaagtcgctgataaactgattgatccatcctctgtttcacatatcttccggctctctccctctgttggttgtgtcatgaccggctccatagcggatgctagggcttccgttgaccgtgctcgtggagaggcggcggagttccgatacaaatacggttatgaaatgccctgtgatgttcttgcgaagcgacttgccaatatcaatcaggtctacacacagagggcttacatgcgcccgttaggagtcgctatgaccctgatctctgtcgactcagagaatggcccacaggtctacaaatgcgaccccgcaggctactacgtcggatacaaggccaccgcatctggtccgaaacagcaggaggcaatcacttacctggaaaagaagctgaagaacaaggattacgccgagggcaattgggaagaggttgtcnaattgggaatc

SEQ ID NO: 7085 - DNA, 672 bp, Aspergillus oryzae
cgaaggttgaggaagacaagtcttgtcgaggccttcatcaagatgcagatcttcgtcaagacccttacgggtaagactatcaccctcgaggtggagtcttcggacaccattgacaatgtcaagtccaagatccaggacaaggagggaatcccccctgaccagcagcgtctgatcttcgctggcaagcagctcgaggacggccgtactctttctgactacaacatccagaaggagtccacccttcacctcgtgctccgcctgcgtggtggtggtaagaagcgtaagaagaaggtctacaccacccccaagaagatcaagcacaagcgcaagaagaccaagcttgccgtcctcaagtactacaaggtcgacggtgatggcaagatcgagcgtctccgccgcgagtgccccgcccccgagtgtggtgccggtgtcttcatggctgctatgcacaaccgtcagtactgtggcaagtgccacctcacctacgtcttcgacgagtccaaataagcgatctaatttcggatcgccccgcctctcttgttaccggtgatgcatacgagtttatctaaggcaatttcggtggatttagattggtggatattaggttgaggagcatgggttaccatagtccgataggagccttgaaaatgaaataaacattcgaaacactcg

SEQ ID NO: 7086 - DNA, 655 bp, Aspergillus oryzae
gcgccttccagctgccctgagtagctcatcactctcccatcctctccaacaagagtctgagttcgtctaggcttgtgcttgtcattctttcacatccagtctttcgttccgtcttctccacatttcgtctagagagcaatcactatggttatcttgagcaaagtcgctgccgtcgcggtcggcctctccacggtcgcctctgcattgcccaccggtccctctcactccccccatgctcgtcggggattcaccatcaaccagatcaccaggcagactgcccgcgtcggtcccaagaccgccagcttccccgcaatctacagcagggcgcttgctaagtatggcggtactgtgcctgcgcacctcaagagcgctgttgcctcgggtcacggtactgtcgtgacttctcccgagcccaatgacattgagtacttgactcctgtcaacattggcggcacgaccctgaacctcgacttcgacactggctcggccgatctctgggtcttctccgaggagctccccaagtccgagcagaccggccacgacgtctacaagcctttctggaaacgcctccaagatcgctggtgccagctgggacatcagctacggtgatggcagcagtgccagcggtgacgtttatcaagatactgtcaccgtg

SEQ ID NO: 7087 - DNA, 1604 bp, Aspergillus oryzae
  misc_feature (1)...(1604): n = A,T,C or G
tagacaacagctttcacaatggccttcggaaagatttacggtcagcctaacaacggtcgcaccatcgctgccctcgtcgcggctaaggccaacgacgttgagctcgagctggtccagactgaggctaacgccaacgccgagttcaacaagtctgctgagtacaccaggatcagccctctcggcaaggtccctgctttcgagggtgccaatggttacactctctccgaggctattgccattgctgtctacgtgacctcccagaatgagaagaccaccctcttgggtaagaccaagcaggactacgcttccatcctccgctggttgtcctttgtcaacgctgaggttctcccccatttcggcgcttggtaccgtcccctcttgggcttggatggctacaacaagaagaacgttgaggaagcttccaaggttgccctgaagaacatctccgttttggagaagcacctcactgccaacaccttcctcgttggcgagcgtatcaccttggctgatattttcgccgcttctctcctcacccgtgccttcgctaccgtgttggacaagaagttccgctctgagaaccctgctgtctctcgttggttccagaccattgtcaaccagccttacttcaaggctgttgttgagaacccagttcttgttgacgagatcatcaagtacacccctcctaagaaggaggagaagcccaagaaggaggctgctcctgccgctgctgccgagcccaagcctgagggtgagcagaagaagcccaagcacccccttgaggcctcttggcaagcctgatttcatccttgatgaccttaagcgtacctactccaacgaggacacccgtcccgttgctctcccttggttctggcagaactacaaggcccgaggagtactccctgtgggaaggttgactacaagtacaatgacgagctcaagctcaccttcatggccaacaacctgatcggtggtttccatgctcgtcttgaggcttcccgcaagtacctgttcggtgctcagtctgtctacggtaccaactacaactgtgtcatccgcggtgtcttcctggtccgtggtcaggagttcaagcctgccttcgatgtcgcccccgactgggagagctatgacttcgtgaagcttgacccctctaaggaggaggaccgcaagtacgtcgatgacatgtgggcttgggatgtccctgtcactgtcgacggcaaggagtacccctgggctgacggccacgtcttcaaataagctagtgcattaggtcccgtggcaaatttatgatgttacgtcctaatttcttatcgtttggtggcctttctcattttcggcctgaaaagcttcacttcactttataccctagggctggagagtgctacgcttagcacggcttgtggttcaggttttctgcaccgtgccgcgcgtacagttttccgcccgatacaaatcccgtctaatgtccacactgtccatgacggtttacgctttctgaaaaaaacactatttgatcatgtcatgcttacgaattgagatgtcggatgatgcagtagctacctagtttagcactgaatagcactttgtgctcacgcaaaanaaaaaaa

SEQ ID NO: 7088 - DNA, 505 bp, Aspergillus oryzae
tttcgagccacagatccgcaagattatctcccagattcgccctgaccgtcagacttgcatgtggtccgccacgtggcccaaggaagtccgtcagcttgcttcggatttcctcaatgattacatccaagtcaacatcggttccatggacctgtccgctaaccaccgtatcacgcaaatcgtcgaggtcgtgtcagactttgaaaagcgcgataagatgatcaagcaccttgagaagattatggagaaccgcggcaacaagtgtctcattttcactggtactaagcgtatcgccgacgaaatcactcgcttcctccgtcaggacggatggccagcactttctattcacggtgacaagcaacaacaagaaagagattgggtcttgaacgagttcaagacgggcaagagcccaatcatggtggctactgatgtggcttcccgtggtatcgatgttcgcgacattactcatgtgctgaactatgactaccccaacaactcggaagactat

SEQ ID NO: 7089 - DNA, 694 bp, Aspergillus oryzae
attcctgcggccgcgaattcttccagttagccaactcccaggtgtcccatcagtcttagcagccatgggtatcgacttggatcgccaccatgtgcgtagcagccatcgcaaggcgccgaaaagcgagaatgtctatctgcaagttttggtgaagctctatcgcttcctcgcccgtcgcacggactccaacttcaacaaggtcgtgctgcgtcgtcttttcatgtcgagaattaaccgcccccctgtttctctgtcgcgtatcgcttccaacgtgaccgatgcgcacaagggcaagaccatcgtcgttattggctccgttactgacgacaaccgcctgcttaacgtcccgaagctgtctgtggctgccttgcgcttcactgctactgccagagccagaatcgagaaggccggcggagaaacattgaccctggatcaacttgctctccgggctcctactggagcgaacacacttctcctccgtggacccaagaacgctcgtgaggcagtcaagcacttcggctttggtcctcatagccacaagaaaccctacgtgcgaagcaagggacgcaagtttgagagggcccgtggaaggagaaggtctcgtggcttcaaggtttaaaggagctcatcacgaaaaatatcttgtatcagggtcgtaactgtcatgaccatggaaatacatgcgcacggcctt

SEQ ID NO: 7090 - DNA, 2142 bp, Aspergillus oryzae
  misc_feature (1)...(2142): n = A,T,C or G
tctcaatcccatcgtctcctttacaatccttttttcttaccccctaatacctttttgtatcgcgatacttcatccttcttcacaatgcgtgagatcgtgcacctccaaactggccagtgtggtaaccaagttggtaccgccttctggcaaataatctctggcgaacatggcctcgacgcgtctggagtgtacactggctccaacgaccaagaactggagcggatgaatgtctatttcaatgaggtcggcaaccagaaatatgttccccgcgcggtcctcgtggacttggagcccggcacgatggacgccgtccgtgctggtccgtttggacagcttttccgaccggacaacttcgtattcggccagtcaagcgcgggaaataactgggcaaagggtcactatacggaaggtgctgaattggttgattctgttgtggatgtcgttcgtcgtgaagccgaaagctgtgactgtctgcaaggattccagatcacacactcccttggaggtggtacgggttccggtatgggaactcttttgatctcgaagatacgtgaggaattcccggatcgtatgatggccactttctctgtggcgccttcgccgaaggtctcggatacagtggtggagccatacaacgccacattgtctgttcatcagctggtggagcattccgacgagacattctgcatcgataacgaggccctctacgacatctgcatgcgcaccctgaaactgggggaagggcacctgngctgtcctgctcttctttccttcttctcttgacagttatctaacagtcactctttctgattgtaccttcttcattccttccaccatgaaagccaccatcttagcgactatcgctttggcggcatgcagtgccgccagccccttgggcagcgctccccacgcccgaggcctccttggagattcatccaagccctgcgactgtgaatcggatcatgatggcagctcgcctgaggtaccatctgggcctggttcggagggccctgctcccgttccgatgccggttccagttcctgttcctggtggagagccaaacggtcctggcggagtcccaaccgttcctggccttcctggtattcctggtgttcctggtgttcctggtgttcctggtgttcctggacaccccaaccaccctgaagacccagaggatcccgaagatcctgaagatcctgaagacccggaggatcctgaagacccagaagacccagaagaccctgagggaccttccaagggtggctgtgacgacgacggctgccacggaactggacacctcatacaggatctgggcccgcaagccaacgacatcctgaccattgttggtgaacacaccgaggagctcttgctcaagctcagccccggtgttgctgggcttctgaccggactcggcctccctggcttgggccaacccgtcggtcacatcatcaagagcgctgccaccattggcgaactcatcgcggacttgggtgactccgtcgaatgcctcttgaccgtcattggacaggacggtggattcctgttgattgaacttgagccgtccattgctggactcctcactggactcggactgcctagtatcgctcaacccgtcggcagcattgtcggcactgtcggcaagcacctcaagcgtgacgatggactcctcgaagaccttgctccagttgtgaactgcgctcttaaagtcgttggagaggactccaagattctcctcattgcattgagcaagtccgttgctgagctgctcattggtttgggtctcggccagcttgccgagcctgtcggcactgtcatccagtccgctgcgaccgttggcgatctcgtctatgacttgggtgaccccgtggagtgcatcctgaccatcatcggtgaagacggaggtgctctcctggttcagctttctccttctattgcaggcctccttgtcggactcggattgcccggtgttggtattccggttgcacaggtggtaaagactcttggcgaggctttgtaaatacggtcgtcggacgtccgaaacacttcggccaccaaagcaaagggcttgaccgaaaagggagatgaaccacgggctgctgtgtgtatataactttaaggatggataaatcaaggtgcaatatg

SEQ ID NO: 7091 - DNA, 629 bp, Aspergillus oryzae
caacatgcgggacacttgggtacatggcgcccgagattttcaaaaagagcggccacggaaagccagtggatatctgggccatcggtgtcatcacctacttcttactctgcggctacaccccctttgaccgcgactccaacctggaagagatgcaggccatccttgcagctgactattcttttactccgcttgaatattggcggggtgtctcgcagcacgcccgggatttcatcaaacggtgtctgaccgtggatcccgaagcgcgcatgaccgcccacgaagccctccaacacctctgggtcaacccgccctacgacccatacgccgatcagtccggtcaagacttgctcccgaccgtcaagaagaacttcaacgcccgtcggacacttcacaaggccatcgataccgtccgtgcgatcaacaagctccgcgaaggtggcggcctgatgatggacggggtgatgagcgtagacccgaaaccggaaagggtcaacggcaaccatgtcgtcgaggaaacatcacaccacgacggacagatggacctcgacagccgcagcgatgcgcgcggccagacggaagaacagatccgggcacaggagcagagagtgaaacagatggtagccggactg

SEQ ID NO: 7092 - DNA, 1129 bp, Aspergillus oryzae
  misc_feature (1)...(1129): n = A,T,C or G
cgaggcccaaccttccccccaccactatcaacgcggtcacttcttgaacctcccgcctattctcagtctttgtatctttattcctctccatattttatcatcacttctttcatcctccttccacattcaccatggccgactctttgactgaagaacaggtctccgagtacaaggaggccttctccctattcgacaaggacggtgatggccagatcaccaccaaggagttgggcactgtcatgcgctctctgggccaaaacccctctgagtcggaactccaggacatgattaacgaggttgacgccgacaacaatggcaccattgacttccctgagttcctgacgatgatggcgagaaagatgaaggataccgactctgaggaggagatccgggaggctttcaaggttttcgaccgcgataacaacggcttcatctccgctgccgaattgcgtcacgtcatgacctccatcggcgagaagcttaccgatgacgaagttgatgagatgatccgcgaggcggatcaggatggtgacggccggattgactacaacgagtttgtccagctcatgatgcaaaaataagcgctaccttcctgtatatcccgccaattgatagcgaaaatgagtgagagtaaagaatcatattcatcctgtctcattcccgcttctgctattgctttgtagtctactgagtccgacatccgctgtcgatggcagtcggccgtgcgtaccgttttaagcgttgccttttttgcgggatgaatgcagttggatggatttagacggagccagacgaattgagatgatgaggtggaatctagaaaacaccgaatgtctcttgtttggcatgaccacttttggcttgcaatttcctataccgttttcctttgcccttctctcctacctactattgacgtttatcatacaccccattcaggttcctgatttctgggcttaggctctttcatccccgtagcaggtttcanacagctgcacataaaaatcaacaagaggccctttgcataccccgtattgctntatcgtttccctacgttttgctagacataggctgttatattcgatgtcttgaggagtttctaaattctaatgagaatcattcactagagaaa

SEQ ID NO: 7093 - DNA, 718 bp, Aspergillus oryzae
  misc_feature (1)...(718): n = A,T,C or G
gagctttcggtattcttctttctaaaacaaaaagaagagaaaacgaaatgagtgctatggaaaaggatcacaaccgaaagcccagcagtttgcggtctatcatcgcgggctcgactgcaggtgccattgaaatcgcaatcacttatccggctgaatttgcaaaaactcggtcgcaactcaatcgcaaattaccggacgggaaaaagctgccatggcctccgtttggaaagcagtggtacgccggctgcacgactttaattataggaaattcgctcaaggcaggcatccggttcgtcgctttcgacaggttcaagtcacttcttcaggatgagaatggcaagatctcgggtccaagaacggtaattgctggctttggggctggcttcactgaatctcttttagcagtgacaccattcgaaagcattaaaacccaattgattgacgatcgcaaatccgctaaccctcgtatgcgaggattcttgcacggtagtaaactgatattccaggagcgaggtattcgaggttttttccagggtttcgttcctacaacagcaagacaagccgccaactccgcgaccagattctcaagctatactatgctaaagcaactagctgaaagctatgttgcacctggagagaaactgggaaccgcgagcaccttcgccatcggcggtatggcaggctttataacagtatatgtcacacaacctctngatan

SEQ ID NO: 7094 - DNA, 692 bp, Aspergillus oryzae
  misc_feature (1)...(692): n = A,T,C or G
tcattccgctcctggttggggatgccgaggttgctaagaaggcctcggacaagcttctggaggagcatggaatttatgtacaagccatcaactacccaaccgtgcctcggggtgaagagcggcttcgtatcacgcccaccccgggacatatcaaggagcaccgcgaccacctggtgcaagccgtccaaacagtctggaacgaactgggcatcaaacgcaccagcgattgggaagcgcaaggcggcttcgtcggcgtgggtgtcgatggcgccgaggctgagaaccagccgatttggaatgatgtgcagctggggctgaaggaaaacgaagccattgaggctgctgtggaacgcgagtttgccgaggcccccatgcggaccgccacccgtcctgccgcggctgctgcttcgtcaatcccggtgggtgtggctgcctgaagtggctgcccgcatgtgagctgaaatcgacgtggaattctatacacacacacacacacacacacacacacacacacacacacacacacacacacacacacacacacacactctaacacacactgtgttataaataacatatacacttctacgtcccgttgatgacngtaagggttatagagactattagctacaagcatgcagtcgataccatcaaggatgggggccaataatgattggacatgatgggtggga

SEQ ID NO: 7095 - DNA, 900 bp, Aspergillus oryzae
  misc_feature (1)...(900): n = A,T,C or G
gggtgtttacggtttggcccgctccatgcccacatccggtgctgtcgacctggttgccaaggcacagggtctgcagagctacgaggtgcccaccggctggaagttcttctgcaacctgtttgacaacaagaagatctcgatctgcggtgaggagagcttcggtactggtagcaaccacatccgtgagaaggatggtctgtgggccatcgtcgcctggttgaacatcatcgctggtgtggccaaggagaagccggaccagacccccagcattgcatccatccagaacgatttctggcaggcctatggccgtactttcttcacccgctacgactacgagaacgttgacagcgatggtgccaacaaggttattgctatcctatctgacaaggtcgccaacaaggacagcttcgtcggttccaccgtgtccggccgcaaggtcaccgatgtgggcaacttctcctacaccgacctggacggcagcgtgtccaagaaccagggcctgtacgctaagttcgatgatggcagccgtatcatcgtccgtctgtccggcaccggcagcagcggtgccacgatccgtctgtacattgagaagtacgagagcgacaagagcaagtttggcctgactgcgtccgagtacctgaaggacaacgttgctctcgccctctctctgctcaacttcaaggagttcatcggccgcgaggagcctgacgtccgcacttaagtgacaatgatttgatgtttgtaaatattgtgccacaagcgccttgaggcgcagagttattatgatgggagcanaaaccatccatggacaggtttctttctnnnnnnannnannnntnnnnnnnnnnntnnnatntannnnnnnnnnnananaannanannaaaaaaaaaaaaattctt

SEQ ID NO: 7096 - DNA, 758 bp, Aspergillus oryzae
tttccccctcactgactgtgatatatttcttcagcctatacctgaacgataatcataataacctgcctctcgacttttttaaccacgattttctctccgccccgccaatcccccctcacgtgcggggtctcatcggcgtcaagcctactgctttagctcgccgcacatttaatttttcatgattcaaggcggtcattctattcgggcacaatgagtttcactaatatgctcaacaagctgtcgggacagcccgagagttatgagaaaaaacaactgtacaaatttgggagaacacttggtgctggaacgtacggtattgtccgtgaggcagattgcagccgtgggaaagttgctgttaaaattattctgaagaaaaatgtccgaggcaacgagcagatggtttacgatgagttggagatgctgcaagcccttgaccacccaaacatcgtccattttgtcgattggttcgaatctaaggacaaattctacattgtcactcaactagccaccggtggtgaactgttcgacagaatttgcgactatggaaagtttacggagaaggatgcatctcaaactatccggcaagtgctagacgcagtcaattatctgcatgaacggaatattgtacaccgagacttgaaacccggaaactgcttaccttactcgtgacccatcctcgcctttggttctagccgactttggcattggccaaaatgttggacagtcccagtgaacgatcgcctacatggatggggcat

SEQ ID NO: 7097 - DNA, 677 bp, Aspergillus oryzae
agacctatgcgctgctagcttctttgcagcagcgttatggacagaggctactacgctggtggtcgagtgctctcaagagtcatgagtgtgacttgcgatgcgccgtctttcttcgaagctcttcggcagggtgctgaggtctaccaaaaactcaagactctcaccgaggccattgagcatgccggttacactggcaagatgaagattggcatggacgttgcttccagcgaattctacaaggctgatgtcaagaagtacgaccttgacttcaagaaccccgacagcgactcctccaagtggctcacctacgagcaactggccgacctttacaagactcttgccagcaagtaccccattgtcagcattgaggaccccttcgctgaggatgactgggaggcctggagctacttctacaagacttctgacttccacattgttggtgatgactagaccgtcaccaaccccctgcgtatcatgaaggccgtctagaccaaagcttgcaacgcccctctgctcaaggtcgaccaaaatagtactcttaccgaggccatccaggctgccaaggacgtctacgctgacaacaggggtggtatggtttcccaccgttcccgcgagactgacgatgtcaccattgccgatatcgcttgtgggctccgctctgcccaaaataagaacgc

SEQ ID NO: 7098 - DNA, 777 bp, Aspergillus oryzae
  misc_feature (1)...(777): n = A,T,C or G
gaaaggaacccttcgactctcgacaaccatccccatcaggcctttcggcaatctatatcagtcgaccgtccttcgaacataatccgccaagatgggtaagggacagcctcgtggtcttaacgccgcgcgcaagctcgcgaacacccgccgtgagaaccgttgggccgatcttcactacaagaagcgtctgctcggtaccgcctacaagtcctctcccttcggtggtgcttcccacgccaagggtatcgtcctcgagaaggtcggtgttgaggctaagcagcccaactccgctattcgcaagtgtgtcaaggtccagttgatcaagaacggcaagaaggtcgctgctttcgtccccaacgacggttgccttaacttcatcgacgagaacgacgaggttctccttgccggtttcggtcgtaagggtaaggccaagggtgatattcccggtgtccgtttcaaggtcgtcaaggtctccggtgtctccctgctcgccctctggaaggagaagaaggagaagccccgttcttagagaattgcgcgaacgaacgattgcagcgggaacgatgggaaagggcccattccatggaacattggaagattactacgatgggatctatcttcagtctatggtctggtctggaaattatgggtcaggacggatgaccctgcaaataaattgcagctactacgattgatatacttataaaagatggcgccatgatttatttctttgggaagggcccctaaaataatcaagtctcaaacttcnaaaaaaaa

SEQ ID NO: 7099 - DNA, 1697 bp, Aspergillus oryzae
cgactacatggaccgtcgtcgcatcttcaccattgacccagaacggttcccggccgatctgtacaaagaccttgtggacaccatccatgcgagggaccagcattacatcgtcatggtcgatcccgccgtgtattacaaggagtctaacccggcgcttgatgaaggtctcaaatatgacattttcatgaaggagaacaatggctctgaatatcagggtgtcgtctgggctggcccgagtcacttcccggattggttccaccctgactctcagcagtactggagtgagcagttcctggccttcttcgacggaaccaatggcccagacattgatgctctatggatcgacatgaacgagcccgcaaacttctacaaccacccataccctggcaacaacaccacccccgagaacttcgccgaggtggatggtgaccctcccgcggcgccagcagtcagagacggccccgatgctcctatccctggattcccggccagccttcaaccaaactgggttcagggcaacgcgactgaaaagcgctcaactgctgctgttgtcaaacgtcaacgctcgcagtcccgccgcaacctcggcgccggtcactggaagtcccccaagggcaagttcgacgcgcgtgctggctggcaacacggcaaacagaccggttctggttgtggccccaacgagtgcaagggtcttcccaaccgtcatctcatcaggccgccgtacatgatccagaacggcgccggtcccacgcttgccgacagcactgccgacacggatctggtgcagagtggtggatacgtccagtatgatacccacaacctttacggggctatgatgtcctctcattcccataatgctatgcgcgccaggcgtccggatgatcgggctttggtgattaccaggagcacgtttgctgggtccggaaaggatgtgtcccactggcttggagacaatgtatccgggtggctttggtaccagctctcaatcagccaaatcctgcagttcgcgtccttgtaccagatccccgttgtgggtcccgacgtttgtggcttcggtggtaatgtcacggagacactctgtgccagatgggcaacccttggctccttctacacattcttccgcaaccacgccgagatctacgcgaactcgcaagaattctaccgctggcccacagtagctcaagccgctcgcaacggaatctccatcagataccagctcctggactacatctacacagccatctacaaacagaaccaaaccggtacacctgccctaaaccccctgttcttcaactaccccaacgaccccaacacctaccccatcgacctccaattcttctacggagacggcatcctcgtttcccccgtcacagaagaaaacagcacaagcgtcaccttctacctccccgacgacatcttctacgaatggggcaccggcaagcccgtccgcggccagggtgaatacgtctccctcgataacatcgactacacggacatcaccatccactacaagggtggtatcgtctatccccagcgtatcgagagcgcaaacaccaccaccgctttacggcagaagggtttcaacattgttgttgcgccgggcttggatggccgtgctgagggttcgctttatcttgatgatggagtgtcggttgtgcaggatactgtgtctgagattgactttgtctatgagaatg

SEQ ID NO: 7100 - DNA, 690 bp, Aspergillus oryzae
  misc_feature (1)...(690): n = A,T,C or G
gcttctggtggcgtattcaccgcgtaccacaatggaacaggcagctgtgttgccataaagcagatgaatcttgatctgcagccaaagaaggatcttatcataaatgagatcatcgtcatgaaagatagcaagcacaagaacatagtcaatttcttggacagttatcttcatggtctggacctctgggtggtgatggaatatatggaaggtggcagtcttaccgatgtggtcactttcaatatcatgagcgaagggcagattgctgccgtctgcagagaaactcttaatggcctacaacaccttcattccaaaggtgtaatccatcgtgatatcaagtcagacaacattctcctctcattggatggcaatataaaattgaccgattttggattctgcgcccaaatcaacgactcgcacaataagcgaaacacgatggtcggcaccccgtactggatggctccggaagtcgttacgagaaaagagtatggtcgtaaagttgacatttggagtttggggattatggctatcgagatgattgagggcgagcctccatatctcaccgagtcacctctgcgggcgctgtacttgatcgcaacgaatggganctccacgatcaaggatgagcagagcttgacaccggttttccgagacttcttgcatctngcattgaaggtcgatcctganaagagn

SEQ ID NO: 7101 - DNA, 657 bp, Aspergillus oryzae
cccactccacagggtttcttctatgatatggccatgcctgataaccgcgttgtaagagagaccgattggccagcactggacaagcacgcaaaccgtgtcttcaaggagaagcagagctttgacagattagaagttacgaaagagaacctgaagaagatgttcgcctacagcaagtacaagctgcattatattgataaactggtgaccggagaaaagagcactgtttatagatgcggtaccttggtcgacctttgcagaggaccccacattcaaaacactggcaagattaagaccttcaagatcatgcagaactcctctgcttacttccttggcgaccaaagtaatgactctctgcagcgtatccgtggtgtcgccttccccgacaagaagcaaatgcaagaacatttgaagttcctggaggaagcggaaaagcgtaaccatgtgaagatcggcaaagaacaagagctcttcttctttgacgaagtctccccgggatgcccattcttgctccccaacggtactaagatctttaatgctcttcagaaccctttgcggtcagagtatcgtaagcgtggctaccaggaagttcagacgcctaacatgtacgatgttggcatttggaagattttggacactgggcttactacaaaggtgaca

SEQ ID NO: 7102 - DNA, 705 bp, Aspergillus oryzae
  misc_feature (1)...(705): n = A,T,C or G
ttcttttccctgtcccccgtcacctttcgagctttccaggtttctaaaaaaaagaacaccgccatggcgaccgttaataccaagaccggtcaggtcgtcgaccgcacggtcttggagtcgatgctccgccgccgtcttttttacaccccctccttcgagatctatggaggggtatctggtctatatgactacggcccacctggttgtgctcttataaataatattgtcgatttgtggcggaagcatttcgtgctcgaggaggacatgctggaggttgactgcactatgctgaccccgcacgagattcttaaaactagcggacacgtcgagaaatttgccgactggatgtgcaaggaccccaaaaccggcgagatctttcgtgcggatcacctagtagaagaagttcttgaggctcgcttgaaaggcgacaaggaagcgcgtggccagaatgttgtcgtggacgaaaagaatgaggccaagaagaagaaaaaggctaatgagaccaaggctgtccgattagacgatgctgttgtcaaggagtatgatggaaacttaacgcaaattgacaactactaaggcccggagctggaacaaatattcccaagttcgatatcagatatccgacgaccgatggcaatctttttcctcccgttgggttcacctaatgttccagacttcaatcggtcctagcagccatattgctcn

SEQ ID NO: 7103 - DNA, 688 bp, Aspergillus oryzae
cgagaatccccatgcttcgaatgtccggagaagaatcggaaagctccgtgactatgtgtcacttagtagtgactggatttgctatgccatgattgacgacattgtggatagttttggccctgtaatccgcgaaattgaggtcgagtccgaggcgattgaagatctcgtcttcatcgcacgtatggatgattttgagtcattcttgccacgaattggtggcttgcgcaaaaaggtcatgagcttgatgcgcctcttgggcggtaaggcggatgttattcgaggtttctctaaacgttgcaacgaacagtactcagtaacaccgcgtggtgacattggcctttacctgggagatattcaagatcatgtagtgaccatgatgtctaacctggctcattttgagaagatgctcagcagatcacacaccaactatcttgcgcagctgaacgtcacaaacctagttttgggcaaccacgtcaacaagatcctcagcaaggtgactctcattgccaccatgttagttcctatgaaccttatctgtggtctattcggtatgaatgtcacagtccctggtcagggccaggaaggccttgcgtggttttttggcatcgtcggtgtgattgcggcggtagtcattattagcggtattgctgctcgctgctacaagcttgtataagatttaaatgtggtt

SEQ ID NO: 7104 - DNA, 691 bp, Aspergillus oryzae
gatgatacatacttccaaaccgagaccgttgatgctatcgtcacacagatcctttctctctatgctgccaaggttgcagcgtacgctcgtgatgataagaaactcgagatccgtttagataaggaggctgaggatcatgcggtctacattgacacaagcaagcccggcatcacgtcggtcgacggccctcggtatgagcagagaattgagaagaaatacgtaaacggatccacacctagtaacagctatcgggttgagactttccgttcgccaacaccaattcctggggacgatggccagcaactccggtgctactttgtttacaagtgccagttcgtcaaccctaacccgggtccgaatgaaacaaacattgatattatcggtgaaaagagattcttgcaaaaggcaacggaaaatactaaggccatctatcaagaaattatcacgaatgccgttaatcgatcaggtcctgtcattgaaatgttcgaaatcgagaagagtcgcgaaaaaaggttggtcatcgcttatcgccagggctctgctatgggtctattcagtgcactctctgatctttaccactactaccgcctgacaagctcccgtaatattttgagaacttttctaacggcattacggtcttattttagcatttataaacaacagcttcgttgattggcttctcgttgtcgca

SEQ ID NO: 7105 - DNA, 743 bp, Aspergillus oryzae
  misc_feature (1)...(743): n = A,T,C or G
gaaatcgcgaagatcctgacgaagatggcctataccgctagaccctccgcagaatccgccgacctgatcgacgtggacatcccacctactcgtgctgatgtcctccaccaggccgatatcatggaagatgtcgccattgcttacggcttcaataacctcccacggtccttcccaagcaagtctggtaccatcgcccagcccttacctatcaacaagctctcggacatcgtccgaactgaggctgcaatggcgggctggtctgaggtcttgcctctcatcctgtgctcccatgacgagaacttcgcctggctcaaccgcaaggacgatggtaacactgctgttaagctggccaatcccaagacactggagttccaggtcgtccgcacaagcctcctgcctggtcttctgaagaccattcgggaaaacaagcaccacagcgttcccatgaagatcttcgaggtcagcgacgtagcgttcaaggacctttcgctcgagcgtaagagccggaacgagagacactttgccgccgcatggtatggcaagaacagtggtttcgaagtagtccacggtcttctggaccgcgtcatggccatgctcaagagtgcgttcatcaccggtgaggagggtctcgagaaaccccgtatgagcgactctcagtactggatcgaggagctngatgaggcaacctacttccccggccacgccgcttttgtcacctgcgaatcggcggcaggagcacgtca

SEQ ID NO: 7106 - DNA, 679 bp, Aspergillus oryzae
tggcggtggtgtcgcatcgcaatccgcgaccaacgcagaccgtcgcgagcgtcttcgcaagctcgctcttgagacgatcgacctggacaaggacccgtacttctttaagaaccatgtaggaagctttgagtgccgtctgtgtttgacggttcaccaaaacgatggctcttacctcgcccatacccaaggccgcaagcatcagacgaacctggctagacgtgccgcgagggagcagagagaaggaaagaatcaagatccgtcgacgctgccgggtgcgatgggcgttcaagttaagaagcagacaatcaagattggtcgaccgggttacaagatcacgaagatcagggatccattgacgcgacagctgggtttgctgtttcagctgcagtatcaggagattacaccgggtgttcagcctcgagtacggtttatgtcggcatttgagcagaaggttgatgaccccccagacaagaacttccagtatcttgtcgtagctgcggagccatatcagacgtgtggtttcaagcttcaggctcgggagattgaccgcagggatggtcgctactggacttgtttcgacgaagatagcaaggaattctgggttcagatcatgttcaaaaccgatccaaaggatggtttattggggggccgggtttggccccaatggcacccatggtgt

SEQ ID NO: 7107 - DNA, 940 bp, Aspergillus oryzae
gacctaacctcctcgacctgtcgacaatacccgcgccctccgtcttgaccgcgcagctccgtcaagatgaagctcaacatctcttacccggccaatgggtcgcagaagatcatcgaggttgacgatgagcgcaagctccgtcccttcatggagaagcgcatgggaaccgaagttgtcggcgactccctcggtgatgagttcaagggttaccttttcaagatcaccggtggtaacgacaagcaaggtttccccatgaagcagggtgttctccttcccacccgtacccgtctcctcctcgccgatggccacagctgctaccgcccccgccgcaccggtgagcgtaagcgcaagtctgtccgtggtgccatcaccggtttcgatctcgccgtcctggccctgagcatcgtcaagcagggtgagggtgagctgcccggtctcaccgacactgtcgtccccaagagactcggccccaagcgtgccaccaagatccgccgtttcttcggtctcgacaagaaggacgacgtccgcaagttcgtcatccgccgtaccgtcaccaaggagggcaagcccgagtacaccaaggcccccaagatccagcgtctggttaccccccagcgtctccagcgcaagcgtcacaggatcgccatcaagcgccgccgctctgaggctgctcgcgaggctgctaacgactacgctaagctccttgccaaccgtgtccacgaggagaaggccaagcgtgatgagctccgcaagcggagggcctcttctatgaggaagtaaatgcatcttcttgggggttaatggtcgggttacgtctctattatggctagggaaaaatcttagcggacgaggaaagggggctatcgaggtgcaaagcaggggtgtaacccaagagaagagaatatatttcttgggggcatgcgtctgcgggaccgatgct

SEQ ID NO: 7108 - DNA, 656 bp, Aspergillus oryzae
cgaggctctcgttcctcttccttttttccttataccttcataaatatcagcaaccatggctgctcccgctcaccagttcaaggtcgccgacatctccctggccgccttcggtcgccgcgagatcgagctcgccgagattgagatgcccggtctgatggccatccgtcgcagatacgccgctgaccagcctctcgccggtgcccgcattgctggctgtcttcacatgaccatccagactgctgtcctcattgagaccctcgttgcccttggtgctgaggttacctggaccagctgcaacatcttctccacccaggaccacgccgccgctgccatcgccgctgccggtgtccctgtcttcgcctggaagggtgagaccgatgaggagtacaactggtgcttggagcagcagctctctgccttcaaggatggcaagaagctcaacctcatcctcgatgacggtggtgacctcacctccctcgtccacgagaagtaccctgagcagctcaaggactgctacggtctctccgaggagaccaccactggtgtccaccacctctacaagatgatgaaagagaacaagctcctcgtccccgccatcaacgtcaacgactccgtcaccaagtccaagttcgacaacctctacgggtgccgtgagt

SEQ ID NO: 7109 - DNA, 627 bp, Aspergillus oryzae
ggatttgtttcttcgtggtttctagcaatctacctacaaaatgtcaggtaataccaaggcttactttgacgtggaatatgacggcaagactggccgtatcaacttcaatctctttgagaaggacgtccccaggactgccaaaaacttccgagagctctgtaccggagtccacggttttggctatgcaggctctggattccaccgtgtgatccctcaattcatgctccagggtggtgactttaccaaccataatggcactggtggcaagtccatctatggtacaaaatttgaggatgagaacttcaagtataagcataacaagcctggtctcctctctatggccaacgctggccccaacaccaatggctctcagttcttcatcaccactgttgtaacctcgtggcttgatggcaagcacgtcgtctttggtgaggttgccgacgatgagtcaatgcgggttgttaaggagattgaggcccttggctctagctctggtaaacccagcaagccgatcaaaattgtcaaagctggtgagctgtaaatgcaagtttatactctcctcaatcagggcggtatatttcatagttagcttagctgacggaaattctattggtcttattctctgag

SEQ ID NO: 7110 - DNA, 994 bp, Aspergillus oryzae
tctggaaaatcctccctcgtccaccttgactcccccctccacccccctcaaacggttgtccgtctttgcaattgactgcaattgctttgcccgccatgtctctctcctccgcttccagcactctgttgcgcgcttgcgcccgccaacagctgcccacttctcgcgctgccatcgcctcctgccagcagcggaggggagtcgctgatgcgtccaagtcatccttcgagagccctttcaccagcgccaaggaatcctcgacctacaagatccctgacttcagcaaatatgcctccaagaagcccccacgctccaaccaggtcttctcttacttcatggccggttccctcggtcttgcctctgctgttggtgccaaggctactgttcaggacttcctggtcaacatgtccgcctctgccgatgtcctcgctcaggctaaggtcgaaatcggccttgcttccatccctgagggcaagaacgtcatcatcaagtggcgtggaaagcccgtcttcatccgtcaccgtacccaggatgaaatcaacgaggccaactccattgagtggcaaactctccgtgatcctcaggccgatgaggaccgtgttcagaagcccgagtggcttgtcatgcttggtgtttgcacccaccttggttgtgtccctatcggtgaatccggtgactttggcggctggttctgcccctgccacggttctcactacgacatctccggccgtatcaggaagggtcctgcccctctgaaccttgaggttcctcagtacagcttccccgatgagagcactctcgtcatcggttaaacgaatcaaacgatgccaattcgagcgaacggtttatccgacggacgggaaacgacgttgaaggggatgagagagtgaaggtttgtaactgcgctttagatgaaatctctctgtgtcttgtcaagattaaggagaccttgttttaatatggatcgattagaaaaactgagcctcgtgtttctatt

SEQ ID NO: 7111 - DNA, 1045 bp, Aspergillus oryzae
  misc_feature (1)...(1045): n = A,T,C or G
gttcatctaccaaagattgttccatcctccgataccaaagcctatggagctatctcagatggaatcctcgctggcgtccctatcatgggttgtcttggcgatcaatcctcggcacttgtaggtcaaaaagggttctcaccaggaatggcaaagaacacatacggcacaaggtgtttcctcctttacaatgttggcgaaaagcctgttatttccaaacaccgattattggccacagtagcctatcattttgatggaaaaccaatgtacgctctggagggaaacatcgcttgtggtggcttcggagtcaagttcctgcagaacaatctcgaattcttcaagggaatccaaagagttaacgatttggccctcacggtggangattacngaggatgcgtttttgttactgcgttcagtggtctctttgcaccttattggattgacgacgccaaaggaaccatcttcggaattacacagtacacgaaaaaaggccacatcgccagggccacacttgaagcgacctgcttccaaacgaaggcaattttggacgcgatggaaaaagacagcggccacgcgctgtctgagctggcagttgacggaggaatgagtaactctgatcttgcaatgcagacccaagcagacctgatctccattccggtctatcgccctaagatgcgagagacgaccgcattaggtgccgccattggtggccgtctggccgttgggctttggcgaaattttgccaaactgcgcgatataaccgagctggtggtgccggctttgaacctatgattacccaggagcaaagtgccgaatcatttgctctctgggaaaaggcagtaaacatgagcaggggataggttgggatcgaattgccacccactgtccccgagaccaagaaagatgtttacggagctgttcagccagtgataatacccagatagtcccaacgtaaggccaaccgaagcattcttgccgcctaaaagccgntagctaagcatttgcaatgaacttgacgaagcttatgaagaccatcatgatgacggaa

SEQ ID NO: 7112 - DNA, 627 bp, Aspergillus oryzae
cgaaacgcagcatcgcacagcgtcctcctttcggtgttggccaaagccgatatcctcattgatccttaccgccccggcgtcttataacgcttgggtctttccccatcggaggtccttctgaagtataaccctcgcttgatcgtggcgcgcatgacgggattccgacgagacggtcaatacaaggacatggcgggtcacgatattaattacatcgcggtgtccggggtgctatccatgctggggcgagcaggtgaacctgcttatgccccgggtaatattattggcgattacgctggcggaggcgcaatgtgttacatgggcatattgcttgctttgctgtcgcgcacacgcacaggacgcggtcaagtcgtagaggctaacatggtcgatggctctgcgtacttagcggcgatgccgctactgaatcggctaacgccgctgcggagcgggccctgacggcataacatgttagacggaggcagtccgtgctatgacacgtatgagacccaggataaaggcaggtatttcgccggtggagcgctggaaccccaatcttacgctgcgctcctcaagggactcgggttccgttcggaggaactttcctaagcggaccatagggaaaattgg

SEQ ID NO: 7113 - DNA, 637 bp, Aspergillus oryzae
cccaattctcattatcacaaccacccaacatgtcgaacggaaagactttcacgctgagcaatggcgttaagatccccggtgtcggtttcggtaccttcgccagtgagggctccaagggcgagacctaccaggctgtcaccaaggccctcgagaccggataccgtcacttggactgtgcctggttctacctcaacgaggatgaagttggtgatggtatccatgacttcctcaagaagaacccctccgtcaagcgggaagacatcttcgtctgcactaaagtctggaatcacctccaccgtcccgaagacgtccagtggtccgttgataactccctgaagaaactccgactggactacgttgacctctttcttgtccactggcccattgcctccgagaaggaggaccaggaaaaacccaagattggccctgacggcaagtacgtcatccttaaggagctcactgagaaccccgagcccacatggcgcgccatggagaagatctacagggaccgcaaggcccaagccatcggtgtttcaactggaccattccgggtctcgagaagctgttcaagttcggcgagatcaagccttatgttaaccagaatgagatccacccctttctggccaacaaagaagtt

SEQ ID NO: 7114 - DNA, 947 bp, Aspergillus oryzae
  misc_feature (1)...(947): n = A,T,C or G
gcgcacctcgattttcctggcagccaaaggaaacatttcagccgaccgactgctatcgtcgacgttgaacgctcacccaacgacaccgcccgtcaccttttacgaatccctccctcgacaacaggtgcattcggcgtccataatgtctgaccacggggaagtcgaggtcgaaaacactgcggccttccaggtcctccccaaggaggctctcgcggagatgggaaccgtgaagctcttcaacaagtggagctacgaggatgttgagatcagggatatttccttgaccgactacatccagattcgtaaccccgtctaccttcctcactccgccggtcgttatgccgccaagcgtttccgcaaggctcagtgccccatcattgagcgcctgaccaactcgctcatgatgaacggccgcaacaacggcaagaagctcatggctgtgcgcatcgttgctcacgctttcgagatcatccacatcatgaccgaccagaaccccctccaggtcgccgttgatgccattgtcaactgcggtccccgtgaagacagcacccgtatcggttccgccggtaccgtccgtcgccaggccgttgatgtttctcccctccgtcgtgtcaaccagtctattgccctcttgaccatcggtgcccgtgaggcctctttccgtaacatcaagagcattgctgagtgcctcgctgaagagcttatcaacgctgccaagggaagctcgaactcctatgccatcaagaagaaggacgagcttgagcgtgttgccaagagcaaccggtaaagggataatgttgggcgtattctccgtttggtcctgtttctatatgtactggagtggacggggggttctataggattcagtcgattggcatgcatctgcgcgactgtacatacctcanaacagtcactggagggagcaaaatccaaaacgagaatgagac

SEQ ID NO: 7115 - DNA, 781 bp, Aspergillus oryzae
ccgcccaactcgcgaactcaacggaccgtcgcaatggcctctactgctaccaccgtccccactcaggaccatgtcctcgtccccgagactctcctgaagaagcgcaagagccaggagcaggctcgcgctgtcgcccgtgaggaggctgagaagaagaaggccgccagcaaggagaagcgtgccgccatcttcaagcgcgccgagtcctacgtcaaggagtaccgcgatgctgagcgtgagaagatccgccttgcccgcgttgctcgcaaggagggtaacttctacgttcctgaggagcccaagcttgtcttcgttatccgtatcaagggtatcaacaagatctctccccagccccgcaagatcctgcagctcctccgtctgctccagatcaacaacggcaccttcgttcgccttaccaaggctacccaggagatgctgaccatcatcaacccctacatcgcctacggttaccccaacctcaagagcatccgtgagctcatctacaagcgcggttacggaaaggtcaacaagcagcgcgttgccatctccgacaaccagatcatcgaggagaacctcggcaagtacggcatcgtctgtgttgaggatctgatccacgagatctacaccgttggccccaacttcaagcaggccaacaacttcctctggcccttcaagctctccaaccccactggtggcttccacaagcgcaagttcaagcacttcattgagggtggtgactatggtaaccgtgaggagaacatcaacgccctcatccggcgaa

SEQ ID NO: 7116 - DNA, 1014 bp, Aspergillus oryzae
gtccaagtacgctgactccttctccaagaagcccatgaagggtatgctcactggtcccatcacctgtctccggtggtctttccctcgtgacgatgtccaccagtccgtccaggctcaacagctggctcttgccctccgtgacgaagtcatcgaccttgaggctgctggtatcaaggtcatccaggtcgatgagcctgccctccgtgagggtctccctctccgttccggcaaggagcgtgaggactacctcaagtgggctgtccgctccttccgcttggccaccaccggtgtttccgatggcactcagattcactctcacttctgctactctgagttccaggacttcttccacgctattgccgctctggatgccgatgttctgagcattgagaacagcaagtccgatgccaagctgctcaaggtcttcattgacgaggcctacccccgtcacattggacccggtgtctacgacatccactctcctcgtgtccccagcgagcaggagatcaaggaccgcgtcgaggagatgctccagtacctccgtcctgaacagctctggatcaaccctgactgcggtctcaagacccgtcagtggcccgagaccaaggctgctttgaccaacatggtcaatgcggccaagtacttccgccagaagcacaccaaataaatggtgtaccttaattaataacaacccatgaaggggcgacattctcaacctgtcgcttcgggggagacgaatacgtttcgttttatgatgagttacgatgatgataccaaaagttcaacataatgggttcagggtttctagagatatccccgggggtcaacggagttttcaacattcacgatttcaacatcggcgtcagccaaatattgacatgattgcaagttcagcgttccccgatcctggggtgatggttgtttctttctaatcctttgtgctgccctctctgcgagaggtagcatgagcgagattgcctctggtgccgaattcggatcgagctcgtacacacg

SEQ ID NO: 7117 - DNA, 705 bp, Aspergillus oryzae
ccggttcgcctcggaatagacttcgtagcgcggacccattcatttttttggagtattcagcactccctttgtagcctggaatgtgcatttcttctaagtcggtggttactatccataccggtgacgcaggcagaacaaagattgtcagagcatgagcggaagttgctcttatggattaagagtatgatggatgagactgacatggccgttgatccgccaggcgcacctgatgtggactttcttgctaatccctataaggcaaagcaactcagcattgctattgttcgagtatgggcgaggacattcaaagggaatacaagctgggcgatagtggacttggtcgggtcgagcttggaagcttatgcagatcttatggaaacacagctctgatgatctgcctggttttatacatgcgctagcctcgtgggaagtttgtgttggaataaagcacttaacagggcagttggtaactattcgcgacagacataccatggcagctgcagaatgcctaatttcatgctctaactgcccattggctgaagaagtctatgaatgaatactggcaacgcaaagcaagatgggcttcgtcaagacataccatactttcttgttggataaccatgtaaaacaatataaatatttggcgcatgcccgaatctgattatgggaatagggcatcttctatcttttggaatccttcggatg

SEQ ID NO: 7118 - DNA, 808 bp, Aspergillus oryzae
  misc_feature (1)...(808): n = A,T,C or G
ctttagcatagatcgtcgcgcctgtgggccgtctttctttcgtcagaaccactgtcattgtcccgccttatttagacgctcgcccgtctcaaccactctctttgagaaatctgattgcgcctcgcattcgtttcttgcagagctgctttcgctggtcgcattgacctgttcaggcaccatgtatttcaactacgctgcagctacactagctgcactactcccactatgctcagcccagacctactcggcatgcaaccctcttaaggaatctggttgcaagcccaacccgggtatgggttccaacttcaattcggacttcaccaccggcgatggagctctcggcggctggacaactaccgccggcaaggtcactactggtggccagggcgctgagtttactctggccaagaaaggcgatgcgcccacaattgacaccagcaattacttcctgtttggtaaggtcgaggttgtcatgaaggctgcgccgggaaccggtattgtcagcagcattgtcctagagtcggacgccctcgatgaggttgactgggaagccctcggtggtgacaccactcaaattcagaccaattacttcggcaagggcgacacttcgtcctatgacccgtgcaacctttgtgaacatgggctctncacagggctgataccatacgtacaccatcgactggaacaaggaccagaccacctggtcccgtgacgggaatgttgngcgtacttttaactaccacgacgcccagggttgttcttggtaaccccaacacccttatgccctggaactgggcttttgggccgg

SEQ ID NO: 7119 - DNA, 677 bp, Aspergillus oryzae
ccgtcatgccggtatctttttcgctcgtggcggtaaggaagatttgctcgtcactaagaacctgacccccggagaggctgtctacggcgagaagcgcattgctgttgaaacccctactgaggatggtaccactaccaagaccgagtaccgtgtctggaaccctttccgttccaagcttgctgccggtgtcttgggtggtctcgatgatatctacatgaagcctggctctaaggttctgtaccttggttctgccagcggtacctccgtcagtcacgttgctgatattgttggacctactggtaacgtctacgccgtcgagttctctcaccgttctggtcgtgacctgatcggcatggccacccaccgtaccaacgtcgtccccattgttgatgacgcacgtcaccccctccgttaccgtatgctggtacctatggttgacgttattttcgccgatgttgcccagtccgaccaggctcgtattgttggcctgaacgctcacatgttcctcaaggagggtggtggtgtcatcgtctccgtcaaagccaactgtatctacatgtcccgaccatgcctgaggttgtttttaccccgcgaagtccataatgatgagagaggagaggattcaatcccaaggagcaatttgcttcttgagtcctttcaaacaggtttacttggtg

SEQ ID NO: 7120 - DNA, 858 bp, Aspergillus oryzae
  misc_feature (1)...(858): n = A,T,C or G
ctttctttttcttcttcaaacttccccccgctacaaacacaatgcccctcgttaacacaacagaggtcaatgaggacactcgtgtccttggatacgatccattgctgtcccctcagtaccttcagtccgagatcccagctcctgcagaagccactgccactgtccgctcgggccgtcccggatattgacgaatcctacaacatcaacaagggtctgcgcatctcacgtaagctctacgccgatctgaccagcatgggcatgccaattgccagtgagatgctcgataccatctctccccagtaccttgcggatctcatctcactcggcgccatcggtgcccgtacgaccgagtcccaattgcaccgtgagctggcctccggtctgagtttccccattggctacaagaacggcacggacggcaacctcgtcgtcgccattgatgctattggtgctgccgctcacccccaccgtttcctcggtgtcactaagcagggtctcgcggccatcaccaagacctccggtaacgagcacggtttcgtgatcttgcgtggaggcagcaagggtaccaactatgaccgggagagcatccgtcaggctcgcgaagccctgcgtagcaagaagcagcgtgaggtgctcatggtcgactgctcccacggcaactccaacaagaaccaccgcaaccagcccctggtcgccaaggaagtcgccgaccagatgcgcgagggccaggatgctattggtggtgtcatgatcgagtccaacattcatgagggcaaccagaaggtccctgccgagggcccgaaggccttnaagaaggtgtcagcatcacggatgcctgcattgactgggagaccaccc

SEQ ID NO: 7121 - DNA, 705 bp, Aspergillus oryzae
cataaataaacacctttttccatccacaaccaactattcttttcactcccaacccaacctaacataccaattcaatcaaaatgtctggaatcaaggccggtgacagcttcccctccgacgttgtcttctcatacatcccctacaccgaggaggctgacaagttcaacgtttgcggtatccccatcaactacaacgcctccaaggagtgggccgacaagaaggttatcctcttcgctcttcccggtgccttcactcccgtctgctctgcaaaccacgtccccgagtacaaggagaagctccctgagatccgtgagaagggtgtcgacgttgttgctgtccttgcttacaacgatgcctacgtcatgagcgcctgggccaaggccaacggtgtcaagaacgacgacattctcttcctttccgaccccgatgctaagttctccaagagcctcggctgggccgatgaggagggccgcaccaagcgctacgccatcgtcattgaccacggcaaggtcacctacgctgctcttgagcccgccaagaaccacctcgagttctcgcgcgctgagaccgtcatcaagcacctgtaaatacgtcaacaggaagaaggactatgacatgggaccaatagaggatgctggcactccagcagtggggataatgttttagaattagacagcccactttagagatacattaattacgaat

SEQ ID NO: 7122 - DNA, 687 bp, Aspergillus oryzae
  misc_feature (1)...(687): n = A,T,C or G
tatcactctcaccctggttttggctgctggctctcatctgtcgatatcaacacccagcaatccttcgagcagctcaccccgcgcgctgtcgccgttgtcgttgaccctatccagtccgtcaagggcaaagttgttattgatgctttccgacttattcaaccccagactgtggtcatgggtcaggagcctcggcaaaccacatccaatttgggtcacctgaataagccgtcgatccaagcactcatccacggcctgaacaggcactactacagcattgctatcaattaccgtaagacagggttggaggagaacatgttgatgaatctgcataagcatgtttggacggaagccttgcagatgaaggatttccatgaggaaggcgagcacaacgtcgaccgcatgaagcagctcgtcagcctcgccgagggctacgaaaagcgagttaaagaagaaacggaactcagcaaggagcagctcaagacaagatatgtcggaaaggtcgatcccaagaagcacatcgaggatgtaagtcagcagttgattgaagataatattgtcgcagtctcgcggcagatgatcgataaggaagcctcagttgccaggcaatcaaatgggaaaggcgctcaaaacgggtgccagtatgganggtggatgaangacctatagatgattagtgagtattatgaa

SEQ ID NO: 7123 - DNA, 696 bp, Aspergillus oryzae
ctggcatatatatgactgcatccttaacttcaaaaaagaaaaagtcccaggtttatgcgaagactctcagctctgccgcactgcgttatcggtgacgtagtcttgttcatcatgagagtgatcatcagagaaaccgccttggaggcttcagagtatatcgccgattatatcatcagtcgtatcaaagcctttaagcccacagaggatcaaccttttgttcttggccttccgacgggtagtagtcccgaagttatctacaagaccctcgtgcaacgtcacagagcaggagagatttcctttaggaatgtcgtgaccttcaatatggatgaatatgtcgggctaccccgcgaccaccctcaatcataccacagcttcatgtataaacatttcttctcccatattgacatctcgccccagaatatcaatatccttgatgggaacgcctctgacctcgctgctgaatgcgcctcttttgaggcaaagatcgcccgctgcggcggtatcgagctcttcctgggtggtgttggccctgacggacacatcgcattcaacgagccaggatcatccctcagcagtcgcacccgagttaagaccctggcttacgacacgattctggcaaactctcggttctttggcggagacgtggacaaggtaccccgaatgtcctttgaccgtggtatccaaactatcatggaa

SEQ ID NO: 7124 - DNA, 665 bp, Aspergillus oryzae
  misc_feature (1)...(665): n = A,T,C or G
cacatcacagacacgtttcctttgggcgtcactgcaggccccgatgacatcgcgatcgtctttatcaattcggactccggcgagaactacatcaccgttgatggcaatccaagagaccgtacgctggcagggctgcacgcatggcacaatggcgacaacctggtcaaagctgccgcagaaaagttctcaaacgtagtggttgttgtgcataccgtgggacccatcctgatggaagaatggattgacctcgactccgttaaagcggtgctcgtcgctcacctaccaggacaggaggcacgctggtcactcaccgatatcctgtttggggactatagtcctagcggccatctgccttacacaatccctcacagtgaatcagactacccggagagcgtcggtctaattgctcagccattcggccaaattcaagacgactacaccgagggcctctacatcgattaccgacacttcctgaaggcaaatatcaccccccgatacccattcgggcacggtctctcctacaccacngtcaactatacggaactcacctatncatcatcatagccctagacacagactaccccgacgcgcgatcctcaaaggctgcacacccacatactacaccggncaaacacgacgcatcagaagtcggctgggataagaac

SEQ ID NO: 7125 - DNA, 659 bp, Aspergillus oryzae
  misc_feature (1)...(659): n = A,T,C or G
ctcatcatgaaggacaacctgtaaggcggctgcggcccacgcagcccaggagcgccatttgggccagttgggcgcagaatggctagaccttcaattcggtaccggatcgatcaaaatcggtgttaagttcgttgagaacaagcagcaaagcttgaagctggaggacttcgaattggtgaaggtcgtggggtaaggtagttttcggcaggtcatgcaggtcatgaaaaaaagatacagggcgtatctatgccctcaagactatcccgtaggctcacatcatttcacggtcggaagtcacgcacactctcgccgagagatcggtgcttgcacagatcaataatccctttatttgcccctttgaagttttctttccaatcccaaagaaaatgtacttcgttcttgctttcgtaaaccggggagagctgtttcaacaccttcaacgagagcaagcgttcgatatcaaccgtgcccgtttttacaccgctgagctgctttgcgcattggagtgtctggatggcttcaaggccctttaacgcgatctcacgccgcaaacatttttctttgactatccnggaacaattgctctttgcgattttgggctcttgcagttagacattaaggatgaagatcggacaaacaccctttgtggaacccctggg

SEQ ID NO: 7126 - DNA, 655 bp, Aspergillus oryzae
ccaattacatctcttcttcagagaaaccactctcccactcctctgaaccccattcacaatgttcagaaacgctttgcggcagtccagccgcaccgttgcggctgccactgctactggcaggatcgcttcggtccgcgcggctgctcccggccccgtctctgctgctgctaagcaggtccgtacctacgccgctgaggccaaggcttcccccaccgaggtctcttctatccttgagcagagaatccgtggtgttcaggaggaggctggtcttgccgagactggacgtgtcctttccgtcggtgacggtatcgctcgtgtccacggcatgaccaatgtccaggctgaggagctggtcgagttcgcctctggcgtcaagggcatgtgcatgaacctggaagccggccaggtcggtgttgtgcttttcggttccgaccgtctcgtcaaggagggtgagaccgtcaagcgtaccggagagattgttgatgtccccgtcggtcctgagcttctcggccgtgtcgtcgacgctctgggtaacccaatcgacggcaagggccccctcaacaccaaggccaagagccgtgctcagctcaaagcccctggtatcctgccccgtcgttccgtcaaccaacccgttcagactggtttgaagtgtgtc

SEQ ID NO: 7127 - DNA, 686 bp, Aspergillus oryzae
  misc_feature (1)...(686): n = A,T,C or G
cccttgtactctgactactctcccatcccaccagctgtttctttttaatacgctccatacccccctcttgtgtttctctttctcttccaccttcttttatacattaaattggtcaatccatatacacatacaacatggccaacagccctcacggtggtgtcctgaaggaccttcttgcccgcgatgctccccgccacgaccagttggccgcggaggcggagagcctgcccgccatcgtcctctccgagcgtcagctgtgcgatcttgaactgatcatgaacggtggcttcagtcctctggagggcttcatgaaccagaaggatttcgacggtgtctgtgagaactgccgtcttgccgatggcaaccttttctccatgcccattacccttgatgcctcccaacaggtcatcaacgagctcaagctgcaggctggctctcgcgtcactctccgcgacttccgtgatgaccgcaacctggccatcctgaccatcgatgatatctaccgtgctgacaaggagaaggaagccaagctggtctttggcggtgatcctgagcaccctgccatcaagtacctcaacaccaaggtcgaagattctacattggtggaaagatcgaggttgncacaagctgaacactacgactatgttgcctgcccttaaccccgcagagtgtgcatcactttgaan

SEQ ID NO: 7128 - DNA, 683 bp, Aspergillus oryzae
  misc_feature (1)...(683): n = A,T,C or G
gagggccatcagtgatgtccgtagtgctggtctcagacctgacatcattgcatgccgctgcgagacacccctggaggaggcaactattcaaaagatcgccaattcttgccaagtggaacggaaccaagttgttggcgtacataacgtctctaccacatatcaggtccccatccttctggcgcaacagggattcctcagtactcttagtgaactccttaaaaccgactctatctctaaggatcagaagcttattgacagtggtaagctcatctggcaggaatggcagggcttggctatgaaccaagtgcattcccttgagactgtgacgattgccttgattggtaaatacacaagcttgcatgactcatatatgagtgtgagcaaggcgctggaacatgcgtccatgcattgccgcaagaagctgaatctgatctggatcgaatcgactcatcttgaagatgagcacaagacaaacaaccctgcggaatactattccgcgtggcacaacttgaccaccgccaacggngttcttgtccccggtggctttggttcgagaggtacgaccggtatggttttggctgcccaatgggcccgtaccaacaacgttccctaccttggtatttgccttggtatgcaattggctgtggtcgagtatgctcggcatgtctgcggtatggataacn

SEQ ID NO: 7129 - DNA, 875 bp, Aspergillus oryzae
tcagtcctctttcctctctcttcgtcaatttcatcaaacaaccgcaacaatggtaaacaccaaggcattctttgatgttgagtacgcccctgtgggcaccagcgccaagaaggttggccgcatcaacttcaacctctacgaggatgacgtccccaagacctctaagaacttccgtgagctttgcaccgggaaacacggctttggttacaagggctccagcttccaccgtgtcatccccagttttatgctccagggaggtgacttcacccgtggcaacggcactggtggtaagtccatctacggtgagaagttccctgatgagaacttcaagttcaagcacaacaagcccggtcttctttccatggccaacgctggccccaacaccaacggctcccagttcttcatcaccaccgttgtgacctcctggctcgatggcaagcacgttgtcttcggcgaggttgccgatgcggagtccatgaatgttgtcaaggagattgaggcccttggcagcaactctggagctctccgctctaacgtcaagcccaccatcgttgactgtggtgagctgtaaatatgtcaagaggaggacaataaggaagccaatttgtgagaggaaaagtgctgaccttgaatgcctgaccttatgggatggattaaaaacggcttgtgggcttcattgtttcccttgagtgtgatacgggttaacgttggtatcctgtttacagtgcgcggtataatgtcgagtgtatatagacatattgccaactcgcatcatcttaatgacgtgttattcccgaacaatttagagtgatcgtgcactcaataatgagtattggtagtatacaattatgtcaaaaataataaaaaaaaattcc

SEQ ID NO: 7130 - DNA, 689 bp, Aspergillus oryzae
  misc_feature (1)...(689): n = A,T,C or G
cctcattctcttcttctacttcttctttgctaccgtttcccttataccttaataaccaaatacccttctcactctttcgttgtttacttcaactatttacatttctcaccccccccccctttacaccgccactatgtctgctcgtcctcagaacattggtgtcaaggccattgaggtctattttcctaagcaatgtgtcgaacaaaccgagctggagaagttcgacggtgtcagtgagggcaagtacacaatcggtctgggacagacaaaaatgagcttctgtgatgaccgtgaggatatctactctgtcgccctgaccactctctcctccctctttcgcaaatacaacgtcgaccccaagtccgttggtcgtctcgaagtcggtactgagactctcctggacaaatccaagtccgtcaagtccgttctgatgcagctctttgccgagagcggaaacttcaacgttgagggtgttgataacgtcaacgcttgctatggaggtaccaacgctgtcttcaacagcatcaactggcttgagtcttccgcctgngatggaagagatgccgttgttgtctgcggtgacattgctctgtatgccgagggacctgctcgccctactggtggtgctggctgtgttgccctcctcattggtcctgatgcccctattgtctttgagcccggtcctcgtg

SEQ ID NO: 7131 - DNA, 516 bp, Aspergillus oryzae
gttgacctgcttatccgcatctgcagacttcccgctgttaactacgacgggaagctttcaaggaattccgtccgccactgccaggacgttgtggccctctcggcggcaacggtaatggcagggacgggggacctgccattgtttcggcgcttacgctccctgcatgggcgtgtggatactgatacaccatatggcagtcatatggcagcacatatggcgatcgggctgcttttcttgggaggaggtagttatacactcggcacttccgacctggctatagcgtcgctcatctgttctctatacccggtctttccgacatcagtgcttgacaacaaatgtcatttgcaagcattccggcatttatgggttctcgcggccgagccgcgctgcttcgtaccgcgtgacatagattctggccgacccatattcatgccgatcacagtgacaaacatggccggaagaacccggagattaccgggcctgcttcctccagaactggagctatcgctaaggtga

SEQ ID NO: 7132 - DNA, 641 bp, Aspergillus oryzae
  misc_feature (1)...(641): n = A,T,C or G
ccctgttggatttggaattcctcactgatgaagtcgggcggagagttgctgctttcgggtggtccgctggctatgccggttccgcattggctgttaagaactgggcctggcaattgactcatcctgagggcgaacctttgcccggtgaggttccgtacgcaaaccaggatctcctgacccagtccgtgaaagagtccctggaagctggcaagaagcaatccggccggtcncccaagattcttgtcatcggagctcttggacgttgtggtaacggtgccgtacaacttgccaaggatgttggcatccccgaatctgatatcatccggtgggatatcgaggagacaaagaaaggcggtcctttccaggagattatcgacgcagatatcttcgtcaactgcatctatctttctagcgagtctattcccccatttgtaaacgttgaatctctttctacccctaaccgccgtttgtcggtcatttgcgacgttagcgccgacaccactaaccccaacaatcctattcccgtgtacgatatcaccactacttccgacaagcccacagtacccgtcattctgccggcggggacccagggcccccctcttagcgtggtcagtatggacaacttcccctcgcttctcccc

SEQ ID NO: 7133 - DNA, 692 bp, Aspergillus oryzae
  misc_feature (1)...(692): n = A,T,C or G
tccaagttcggcaatttgcatcctggaaaatatctccggctgctttgtcatcggtctggcgtatctccatgagctgatctgcggaagtgcccatcatgtacctgcccacttcatcgaaacagctgagataaagttgtccagtatgatcgctaacgctaatgagcattatatagcgatactctggtcgtggatgagttttatcgcaacgttcacaccgccattggccaggatcaagctctgttacttttttattgcaaccttcagaaagacaggcaggatagcacatggtatcttgcttgatgtagataacagtcgccttcagtgagaaataggccacctcatctgacatacccaattgctcctctttgacctgtgcgacagtcttgaattgttcaagttttgtagtagatgcggctacaccaggcattgaagcatgtgaagcaaagactccatcccggccttgagcgtcgtaccaacccttcaatttgtgggcttcctcaatatcaggatcaaccgtcattgaacctgaactcagcaagcttaaacttctacctccaaagtcagacactttcacacccttgaacgctattacagactcgggtgtcacgttgaaattcagcgcagttgatccccagacagttaggcgaacggaanaccccgtgctgtccactaatgtaagctcacgtttgtta

SEQ ID NO: 7134 - DNA, 664 bp, Aspergillus oryzae
  misc_feature (1)...(664): n = A,T,C or G
ggaggattagatttagaattacggaggaagtgctgcgccgagatggtagcgcgagatacaccgggcattgccattggaggactctccggaggagaagccaaggaggagttctgcaaagtggtcgatacttgtactgggcttcttccagatcagaaaccgagatatgtgatgggtgtcggctaccccgaggatttgattgtaggagttgcactcggtgcggacatgtttgattgcgtttggcccacgagaacagctcgatttggaaacgcggtggtcccgtctggcactctcaaccttcgcaaccacacttttgcccaggacttcaggccagtgcaagaaggctgcacttgcaccatctgtcgccccaaagatcagggtggcctaagagttacacgggcttacttacatcatatagcggccaaggaaacggttggcgctcacctccttacaattcataatgttcattatctactttccctgatgggggctgcgcgacaggctatcctggaggaccgattcccggcattcttacgggagttcttcagcaagctttatggagaaaagtctaagtatccggaatgggtggtgggggcgttacggngtgttggcgttgatttgatggaagactagtatatatcatgtctttgagcattatagatagcgg

SEQ ID NO: 7135 - DNA, 613 bp, Aspergillus oryzae
ctctccaaggacgattgacgacctttcgcactcgccatgcctcccaagttcgaccccaatgaggtgaagatcattcacctgcgagtgactggtggtgaggtcggagcccagtctgctctggctcccaagatcggtcctctcggtctgtcccccaagaagatcggtgaagatatcgccaagaacaccggtgactggaagggtctgcgtgttaccgtcagactcaccatccagaaccgtcaggccgccatctccgttgtgccttccgcctcttctctggtcatcaaggccctcaaggagcctcctcgtgaccgtaagaaggagaagaacatcaagcacaacaagtccgttcctcttgacgagatcattgagatcgctcgcaagatgcgccacaggtctttggccaaggagcttcagggtaccgtccttgagatcctcggtaccgctttctctgttggttgccaggttgatggccgcagccccaaggatatcagcgatgagatcaaggctggcgagattgacatcccctctgagtaaattatggtcggaaatccgcggcggtcgttttaatgtatcggcatgctagttaggagaatacgattaatgcctttcaaac

SEQ ID NO: 7136 - DNA, 661 bp, Aspergillus oryzae
  misc_feature (1)...(661): n = A,T,C or G
cgctggacaacatccacaacgatggttgattatgagaccactgctggtggtgacaagtttggtaatatatggatgctgcggtgtcctaagaagatatccgaacaggctgatgaggatggatcaggcgcacatttgatccacgaacgtggttatctccacggtacgcccaaccgtctggagctgatgatccatgtttacactcaagacattccgaccaccttgcacaagactcagcttgtagccggtgggcgagacatcctcgtctggtccggtttccacggtactattggaatgctggtgccttttgtcagccgagaggacgtcgacttcttccaaaacctggagatgcaattggcagcacagaaccctcctcttgctggacgggaccatctcatttaccggagttactatgcacctgtcaaaggcgtcattgacggtgacttatgtgagacgtatttcttattacctaatgacacgaagatgatgattgccgcggaacttgaccgttcagtgcgagaaattgaacggnagatttcggatatgcggacgagagtggcgtactgattttagcggacacggcgtctagcgacttcctttttacgtancggggttcttagatacccgataatcgattgtgagatatcatcatgtaccgcttctn

SEQ ID NO: 7137 - DNA, 681 bp, Aspergillus oryzae
ctagaccatcatacattctagactatcatactggacctctagtgtcaaagagcccaagatggcgctcgatgcaaaatcaccgacagttgctactttaaacgatggcactacagactatgtccccatgaggaaaaagtacacctccaaccagccgcacatcactgagcaacccatcacttggggcaactggtacaagcatgtcaactggttgaactgtttctttattctcttcattcccttcctaggctgccttggagcatactggacacctctccatctctatacgggcatcttcgccgtggtatactacttcaacgcaggtcttggcatcacggccggataccaccgctgctgggcccacagatgctacaaagcaactctcccattgaggatctacctagccgccgcaggagccggtgcaggacaaggctcgatccgatggtggtcccgcggccaccgttcccatcaccgatacacggatacagagaaggacccatactccgtccaaaaaggattctggtattcgcatattggctggatggttctgaagcagaacccgaaacgaatcggtcgcacggacgtcactgatcttgacgccgatcccgtcgtcgtctggcagcataccaactatatcaagtcagctctgttcatgtgtctcgtcttttcgacgttggtctgcgg

SEQ ID NO: 7138 - DNA, 649 bp, Aspergillus oryzae
  misc_feature (1)...(649): n = A,T,C or G
gtcgaaaggaatcttcaacgtttagcgctttttattctcacggtccatctgtgtgcgatttttatctcccgacgctctacctatttacaaagttgctcttccgactatagaaatcatggcctccagagccgcagcaggcgcccgtcctggtgccagattcgctcagttcaaacttgtcttgcttggagaatccgctgttggaaagagttcgctagtattgagatttgtcaaggatcaattcgatgactaccgggagtcgacgattggcgctgcctttttaacacaaaccatttctttggacgaaagcacgacggtcaagttcgaaatatgggataccgccggtcaggagagatacaagtcgctagccccgatgtactacagaaacgccaactgcgcagtagttgtttacgatatcacacaagcttcgtcgctggataaggccaagtcgtgggtgaaagagttacaacgccaagcgaacgagaacattgtcatcgcccttgcgggtaataagctcgaccttgtcacagaanacccagacaagagggctatcccaaccgcagatgccgaggcctatgcacgtgaggctgttttgcttttctttgagacatccgcgaagacctnctcgaacgtgcgggaatggtttaccgcn

SEQ ID NO: 7139 - DNA, 708 bp, Aspergillus oryzae
  misc_feature (1)...(708): n = A,T,C or G
tggtacccaatttgggcgaggggcactcctatccgggaaacatttaattatattaacggaccaccttttccaacctaattctttattccgtccaactttggtgcctcctatactactcaccatggctgactctcagcgtcgtccccgtgtcttctttgacattcaaattggcaacgaaaaaactggccgtattgccctggaattgttcaacgatgtcgtaccaaagactgcagagaacttccgtgctctctgtaccggagagaagggcatgggaaagcagggcaagccattgcattntaagggttcgatcttccaccgtgtgatcaagcaattcatgatccagggtggtgacttcactgcattcaacggcactggcggcgaatcgatttacggcgagaaattccccgacgagaattttgagctcaagcatgacaaacctttcctcctctctatggccaactctggccccggcaccaacggaagtcagttcttcatcactaccgtccccacccctcacctggatggcaagcacgttgtttttggagaagtaatcaacggaaagagtgtcgtccgcanggtcgagaacatgaacaccccagcagacaagcccgtcaaggacgtcactattgtcgagtgtggtgagctcacnggccangactacgatgatgctgatnagcanacccctgatgctaccggcgacccctacga

SEQ ID NO: 7140 - DNA, 726 bp, Aspergillus oryzae
  misc_feature (1)...(726): n = A,T,C or G
nctatgacttgaacancggnanttnnnnnnnnnnnnnnnannnnnnnnnnnnnnnnnnnnnnnnnnnnannntttttttnnnnnnntttnnnnnnnnnnnanangnnnnaatnnagaagntattaattggtggataggcctgtttaagtatgataagttcaagggcacccttccgaatgtcttcatttggaatgatatgaacgagccatccgtgttcaacggcccggaaaccactatgcccaaagataaccttcattatggcaactgggagcaccgtgacattcacaatgtcaatggtatcacgtttgtgaatgcgacatataatgcgatgttagaacggaataaaggcgagcttcgtcggccgttcattttgacacggtcgtattatgctggagcccatcggatgtctgccatgtggactggcgacaatcaggcaacttgcgaacatatggccatctctctgccgatggttctgaacaatggtatctccgggttccccttcgcaagaactgatgttggtggtttcttccataacccgagcaaggaccttctcacccgatggtatcaaactggcatttggtatcctttcttccgtgcgcacgcacatataaatactcgtccgcgtgaaccgtatttgattagcgagccccacaggtctatcatcgcacaagccattcgtttgaaaaaccaactcttaactgcctggtacactgcctttcacgaaac

SEQ ID NO: 7141 - DNA, 1981 bp, Aspergillus oryzae
ccgtcatcatacagccatatactgaacaagaactagaatatcaagaagcgttccacaatggcctctttctaaatcctcccccaggaaagagctcgtctatctctcgtgagacaggcatcatagatcctcaacggacttcgtcttttatcaatatatcttcaccacacccctcagagtctcctgtcccaggacctctgaactttagcaccacctcgggtagctcaagttctttgaacaacatttctacgttcgacttcacgtcgttcaacacggatcaccatcagcaaacatggctccctacacccccgccccagcagcctacggctcagaatctgaattacaacgacaacaacagtgccaactccctacaggaggactttgtgctatatccccagcatcccagggactctcgtgcgccagcaccctcgagtacaacccctagatatcctgcataccatccatctctggtccgtcttgggcacctttctcgacgacaaactcttagtttgcagcagcaacagcagcagcagctctcagcctcgccagtacaggttccccgcttgaccagacttgcctcgcagtctaccgggttccctctgtcttcgtctcatcggtttagtccctccactagaaagcacctcttgcgtctacgcgcagcgtccgttgcttcgaattctccacctgcggttgtgaattctgcgtatcccaatcgcccgcccgttcccctattcaacagtcccgccaattccacctatcagaaacggcaacaaattccgataaatcaccgtcgcataatgtctactcctaacattgctcaagatctccccgatttcttcgatcttcaagctgatcgcttcggggacgatttggttccgaccacggagcccaccatgctctcccctcatcagatgaccgccggcgtcatggcaggtcccgactctctggcagatctgccatctggcacgatctcgcccaaggatctgttcatggatgcctctgctccgccgtcggcctctttcactgatttgagcactccctcattcgagtccccagggtacttcagccaagatacttcccccatgttcgctacagacatggaactaggccctggcgtggaggagtggggttctctcttcccctcccaggacgatttctccttgggtctcgacaccactgcccttgacattgctgcggctctgtcgcagcccaaggttaaggctgatgtcaccccagcatctcctatgatccgtaccacgtcatcccgtgctacatctccctccgctcgctcagtcaccaagccctctcatgtggctggtgtgaacgcgcgccaaaggaagcctctgcctccgatcaagtttgattctcaagacccagtggccatgaagcgtgctcgcaataccgaggcggctcggaagtctcgcgcccgtaagcttgagcgccaggaggagatgcagcgccggattgatgagttggagaagtcactcgaagaagctgaacgtcgtgagcaatactggaaggctcttgcccaaaacaaggcctaagtgatgtaaaagtcggtttttagttaccatgctgtttctgcaagttctgttatgaatgggtttctgcggtgggcgggggctaggagcctctcgccaacccagatgtcggatgcactcactagtgcctggaactggtcactggtgaagtgacttccgacaggataaaagtttctattgttatttttaccatatggtcgtgtgctagcactttcggaccgctttgtcttgattatctctacttcttgccagatatcggctatctatcttctgatcattgttctagttcactcatgggctctgatgtttcattatttcgcaatggccggttctgatgtctcctgcttggcaggattgactcgtggctactaattttttggatgttttgcttgattacttggattgtttgatgcttgtgatttcacgtgtattagattgtctcc

SEQ ID NO: 7142 - DNA, 653 bp, Aspergillus oryzae
  misc_feature (1)...(653): n = A,T,C or G
gtcaactgttcgttctactacaagatcggcgcatgcagacacggcgacagatgttctcggaagcatgtcaagccttcgtactcacagactatcctgatgccaaacatgtaccagaacccggcgtacgacccgaagaacaagatgaaccccagccagctccagaaccacttcgatgctttctacgaggatgtatggtgtgaaatgtgcaagtacggagagatagaggaattggtagtgtgtgacaacaacaatgatcatctaatcggcaacgtctatgcccgattcaagtacgaagaagatgcgcaaaaggcctgtgacgctttgaattcccgctggtatgcagctcgaccgatatattgtgaactatcgccggtcacggattttcgagaagcatgctgtcgattaaatagtggcgaaggctgtgtgcgtggcggattctgcaatttcattcaccgaaaggaccctancaatgagctcgaccgtgaactgcgcctgagcaccaagaaatggctgaaggagcgccgcatggacgccccgcattgtagtcgcaatcccagcccggagccgacgaagcggagaaattaaggtgtggatttggtttttgtggtccgcatgtggcggtggggatttgaactctggcacctgtaattttt

SEQ ID NO: 7143 - DNA, 658 bp, Aspergillus oryzae
  misc_feature (1)...(658): n = A,T,C or G
ctttggggccgatagcaccagcaagcctgtttttttttacgagttagttcgctggggattgctgattgtcatttacccactcagcaaaaatgtctgcaactcagttactcaatcccaaggccgagtcgaggcggagggcggaagccttgaaggtcaacattagtgctggtgaaggtctccaggatgttcttaaatctaacctgggcccctccgggacattgaagatgttggtggacggtgccggcggaatcaaattgactaaggatggaaatgtgctattgcgagagatgcaaatccaaaatcccaccgccgtcatgattgcccgggctgcgacagcacaggatgatatcactggtgatggaacaacttctgtggtgttgttggtgggagaacttctgaagcaggcagaccgttatatttccgaaggattgcaccctagagtaatcacagatggatatgagatcgcgaagaacgacgctcttaagttcctcgatcaattcaagatcgagcgtgcaatcgaccgtgagctgttgctgtctgtcgctcggacttcgctcagtacgaaactgaacagtgcacttgccgagaagcttacccccgacattgtcgatgccgttctcgctatccacagagctcccgagaagccagatctgcactn

SEQ ID NO: 7144 - DNA, 575 bp, Aspergillus oryzae
  misc_feature (1)...(575): n = A,T,C or G
cgaattccaccgtcagagtcgtctatagtcgaggaccaattcttttggacatatacggaagagcctcaccgttcaagacggcaagcgattatcaaagcccatccagaggttaccaagctctgtggttatgagcctctcactaaatatgtggtgtttggtgttgtctccctccagatatgctgtgcatatctactccgggacacctcgatgctgtcctggcggtttcttgcaaccgcatacttgatcggagcaactgccaatcagaacctcttcctcgctatccatgagatttctcataacctggccttccggtccccaatgggtaatcgtctgttggcgatttttgccaatctccctattggggtgccttacagtgctgcgttccggccctaccacctaacgcatcataaatcccttggtgttgcaggcctcgataccgatcttccgactggctgtgaggccttcctnctttgactcctcctcggcaaggccttcttctgcacttttcagatcctcttctacgcccttcggcctatngtcatctacagccngnccttcacctacatncacactct

SEQ ID NO: 7145 - DNA, 657 bp, Aspergillus oryzae
  misc_feature (1)...(657): n = A,T,C or G
tccctcctctaataaaatttaaactacttaccgtcgccatggctcccaaggttgctatcgtttactactccatgtacggccacatcgcccacctggctgaggccgaaaagaagggtattgaatctgctggcggccaggccgacatctaccagattgctgagaccctgcccaaggaggtcctggataagatgcacgctcctgacaagaaggatcaccccattgccaacccggaaaagctcaaggaatacgacgctgtgctgttcggtatccctactcgttatggtaacttccctgcacagtggaaggctttctgggaccacactggcggcatctgggccaccggtggctactggggcaagtatgccggtctgttcgtctccactggtaccctgngtggtggccaggagtccaccgccattgctgccatgagcactcttgcccaccacggcttcatctacgttcctctcggctacaagaccatgtttgcccagttgtccaacctccaggagatccacggtggtagcgcctggggtgctggtacttttgctggtgccgacggttcccgccagcccactgctctcgagctcgagatcgnctgaggcccaggcaaaggctttctacgagcacgttgctcgtgtcaacttcgcttgactgctg

SEQ ID NO: 7146 - DNA, 657 bp, Aspergillus oryzae
cgatatcttcattctcccctgttctacccccttttttgttctttagattttcctctttgttggagcgactgtctcttgcatacgctgccagccatggcaagcccgacctcaataaacgtcaacgatcccagcttgatctcgctggtcaataagcttcaggatgtcttcgcgacagtcggagttcacaaccccatcgacttgcctcagattgccgtcgtcggttcacagtccagtggtaagagttcggtgctagagaatattgtcggacgggatttcctcccccgtgggtctggaattgtcactcggaggcccctcattcttcaactgatcaacaagcccgcaactcaatcgaatggcgttaaggaggagaagctggatacgacggatagcgccgcaaaccttgatgaatacggagagttcctgcacattcccggccagaagttctacgatttcaacaagattcgcgaggagattgtgcgggaaacggagtcgaaggtcggccgcaatgccggtatctcccctgcgcctatcaaccttcgcatctactcgcccaacgtcctgaccctcacactggtcgacttgcccgggttgactaaagttccggtcggtgacaagcccaatgacattgagaagcaaatcagggatatggtcttaaat

SEQ ID NO: 7147 - DNA, 787 bp, Aspergillus oryzae
ggtactgactgatccgattcgcacgagtatttgcaacttctcttccctccctgttcatttctttcttattatgcactttcttactttttcattacccactcaacccccgttgatttcttctacagctaatccaacttgtccactcttcacttggctcttatttattttctgatagagtcgtctagttactaccttttgcgccactccaacgatcaagatgtctctgtgtcttaatcgcctgacagaagaaagaaagcagtggcgacgtgaccaccctttcggattctatgcgaagcctcatcgaacccctcagggtgtgttggatttgaagcgctgggaatgtggtgtccctggaaaggcgcagaccctctgggacggcgggctttttaagcttgatgtcacttttccagacgaatacccgaccaaaccgccaaagtgcaaattcgtccctcctctgtttcacccgaatgtctacccctcaggcaccgtctgcctctcaattttgaatgaagaagaagcctggaaacctgccatcaccattaaacagatcctgctcggcatccaggacctgctcgatgaccccaatccggagtcgcctgcacaggcggaagcatacaatctgttcaagaaagatcgtccagcatacgagaaacgagtgagacaagttgtgaagggagaacccaacgctttgagccaccctttcattctacggcggataggattacgttttcggggttttcatttttttttcacatgccgtcttttctcgccaaatttctcacgtggg

SEQ ID NO: 7148 - DNA, 755 bp, Aspergillus oryzae
  misc_feature (1)...(755): n = A,T,C or G
actggcattcngacgaggctgctgagctaataggtccactgccatgcgcgggatgtgtgactgaatgctggcattctggccgagatgctgagcggaaaacccttattccccggaaaggactatcatcaccaattgactcttattttggacgttcttggtacaccgacaatggaggactactatggaatcaaatcccgacgggctcgggaatacattcggtctctccctttcaaaaagaagatccccttcaaggcgctcttcccgaaggccaacgatttggccctggacctcctggagaggctcttggcattcaaccccgctaagcgtattactgtggaagaagctttgcgtcatccatacctggagccgtatcatgaccccgaagatgagcccacggcacctcccatcccggaagggttcttcgactttgacaagaataaggatgcccttagcaaggagcagttaaagattctaatctacgaggagatcatgcggtgagcttgcattggacagcttgtccatcgggaaagactgaatacaggtcgggataaataggatgggatgaccgaacccatgcacttcatatctagttgcatagacgacaagccagggtaacaatcgcacatcgactatgatattggctgagtctcatgattggcccttttgacacgggttcaggcgtctggtgctttcacttatttacaagataaccgtcttacgcttgtcatcttgagctggaatacatatgctangaa

SEQ ID NO: 7149 - DNA, 637 bp, Aspergillus oryzae
ctcattcgacgcgagattaacatataccgcatacaacaggcgtgctcaccatgccggtcaccaaatactcacacccagacccttactcctatcacactggatttgattcttatcatgaaacggtagccttccaaggagcccttcccgtaggccagaactctcccgataatgctccgtatggtctatatgccgaaaaactgtctggaacagccttcactgctcctcgacatgaaaaccaacaaacttgggggtactggatcatccccgtggaagcccacgagaactttatggtcaagaaccgatactcctatcacactcatatgatcaccgaaaccactaaactgcaccacattgccaatcagctgctatggaacacgagcgacctggatgagactgtggactgggcgcatgggttgcatcttatttcacgctccggataccccaccttgaaacaaagactgcgaattttgatgtacgcggctggataagacacgggctaggaagccttgttttctgccgatggtgacttgctgatagtcccacagactggagttctacacatacacaccgatgtgcgtacacctattggtcggccaatagagactggatccttgccccgatgagaagcaccccgtag

SEQ ID NO: 7150 - DNA, 1002 bp, Aspergillus oryzae
  misc_feature (1)...(1002): n = A,T,C or G
caaccacgtcctcatcatggctggtgctgtccagaaaagtgcctggcatgccatccaggttactcttttctcgagctatgcaaatgtgttgctggtgtttgtcttcctgggtatttggtccggtgctcgaggatgggatccatcagctgtgttcatgttgaatttcttagctatctttcccctggcttctttgctttcctttgcaactgaagagttgtccaaaagtgtgggacagaccgtggggggattgatcaatgcgaccttcggaaatgctgtcgagatgatcgtgggaattactgccgtaactcaaggggagatcaacatcgttcaatcgagtatggttggcagtattctgtccggaactcttctggttttaggatgttgctttctaggtggaggatatggaaaggagacgctatccttcaacgtcgatgtcactcaaatcatgtcgtctctgatgatcgttgcctcgacctccctcatcatcccttccgctttatactcgactactctctgcgagctgcccgacggagacgattacatcctcaccctatcccatatcacttcgattttccttctcgttttttacttggtctatctttatttccaactgaaaagccacgctcatcttttcgctagcaccgaagaggaatcggacgaaaagcgcgaattagagcccctccccgctagcatcattctgatctttgcaacacttggagttaccgtctgttccgattacttggtggagggcgtggacgggtttgtggaggtatacggagtcagtcgggctttcctggggatgattgtcgtccccattgtcggtaatgcgggcgaatttgccatcacggtgaatgccgcaatgggcggcaagctggatctggccattgnggtcattgttggaagcacacttcagatcgcgctctttgtaactcccttcttggtgctctgtggttgggctctcgggcagccgatgtctctgcggtttaatactttccaaaccgg

SEQ ID NO: 7151 - DNA, 1565 bp, Aspergillus oryzae
  misc_feature (1)...(1565): n = A,T,C or G
acattccttcccctctgtgttcgttttattctgcgcgcgtgactcgactcgacatcatgaatccctccgacccctcggagacggtcgaggtcgccaaagcgacagccaaccttcatgatgcccatttgaatgaaaaaaaggctccttccattgacaaggacttggacatcacaccgagtattgaagaagtcccggcgaccaaagtttgtgggcgcacccaccgatgataccgatctccaaaagacctatccgaccgacgaggaactgagaaccctgcgtcgagtgtgcggacaaatcccatggacctcatataccgtggcgtttgtggaactgtgcgagcgattctcctactatggaaccacagccgttttcgtcaactttatccagcgtcccatgccggcaggctcctccaccggtgcgacctatgatagttcacgagtgccgggagcgttgaacatgggccaacaggcctccactggtttgaccttgttcaattccttctggtcctacatcatgcccacggccggcgcattcgtggccgatcaatacttgggtcgattccgcaccatcatgtactccatcgctgccgctttgcttggccatttgattctggtcatctccgccattcccagcgtgatctcccacccccagggcgcgatcgcctgtttttcgatcggtctgatcatcatgggcgtgggaacgggcggtttcaaatcgaacatttcacccctcatcgccgagcagtatcgcgaggaatatccatacatcaagacccttgcctccggggaacgggtgatcgtggacccagccatcaccgtccagcggatctacctgtactactacttgactgtcaacattggttccatcaccggccaggtgagcatggtctatgccgagagatatgttgggttttggctctcgtacttcctgccgacatgcttgtttctgtggtgcccgacggtgttgttcctctgccggaacaagtactaccgggtgaaaccacaaggctccgtctacacacaggcgttccggctctggaagctggcgatgaaggggcggtggtcgctgaacccggttcggctgttcaaacgcaatgacaagccattctgggaaccagtcaagccgagtgctttgggtcctaatcgtcctcagtggatgaccttcgacgacgaatgggtcgacgaggttgctcgtgggctgaaagcgtgcaaagtgttcctgtggtaccctctgttctggctcgcatacaaccagatgttaaacaacttgacatcccaagcggggcaccatgcacctcggtggtgtccccaacgacatcatcaataacctcaacccccttgccttgattatatgcattcccatttttgatcgggtcatctaccctggcctgcgacacctgggattcaactttacgcctattaagagaatcacgtgtgggttcgtggttgccggctgctccatgatcgccgccacggtgattcaacactacatttacgtgaaaggcccttgcngcaagaggccaactacttgctcgatgaatatggaaagtattcgcccatctncgg

SEQ ID NO: 7152 - DNA, 672 bp, Aspergillus oryzae
  misc_feature (1)...(672): n = A,T,C or G
attcatagttacggactttgagcccccaccccaatagaatagcgctacaatgacccaaacttcgacctccaagggaacgataaaggttgcggactatctgttcgcccgactctgccagctcggcatccagtctatttttggggttccaggggactacaacctcagactacttgatttcgtggagccatccgggttgcactgggtcggaacctgcaacgagctgaacggcgcatacgccgccgatggatatgctaggatcaacggtctgggagctctgatcaccacgtttggtgtcggcgagttatccgccatcaacggaatcgcaggcgcgtatgcggaaaaggctcctgttatccacattgtcggtacaccatcgcgtgcgttgcaggatgcccgcactttagtccaccatactttcgccgatggtgaatataaccgatttgccgcaatgcatgcccaggtcacagttgctcaggcgaacctcattgatcctcgcacagcggcagagcagatagattgggtactacagcaatgcctagtccatagccggccggtttacatccaagttccggatgacatggttgacgtcatgatcccggcgtcaaatctcgaaacaaggaagatcganatacctgctaccccgagcaccaagaacgagacgtncgtattgan

SEQ ID NO: 7153 - DNA, 667 bp, Aspergillus oryzae
  misc_feature (1)...(667): n = A,T,C or G
ccattgtcatgaagccagctgagcagacacccctcagcattctctacctcgccacgctcatcaaggaagccggattccccccgggtgttatcaatatcgtcaacggcctcggaagagttgccggcagcgccctggtgacccaccctgatgtcgataaggttgcctttaccggctcaaccttgactggccgagaggtcatgaagttggccgccggtactttgaaaaacatcacccttgaaaccggcggtaaatctcccttggtcgtctttggcgacgcagatattgagcaggctgctaaatgggcgcacatcggcatcatgtacaatcaaggacaggtctgcacagcaacttctcgtatcttggtccacgaatcaatctatgacaagtttatcgagcttttcaagcaagaagtggcctcggtcagcaaagttggtgatcccttcgccgacgacaccttccagggccctcaggtcaccaaggcacagtacgaccgagtcctttcgtacatcgaggctggcaaatccgaaggagcaactctcgtcgctggcgggcagccttacaagaacgtcggtgacgggaaaggcttcttcatcgcgccaancatcttcacgaacgtcaaagacaacatgcgtatctatcgcgaggaggtcctcggcccggttcgtcg

SEQ ID NO: 7154 - DNA, 667 bp, Aspergillus oryzae
  misc_feature (1)...(667): n = A,T,C or G
ggtaaccttgccgagaaggaggtcgctactgctaccaagtatcagaagaaggctgtccctaagggtatccctgagtgtggtgctgatgctttgcgttttgcccttgtgtcttacactaccggtggtggtgatattgcattcgacattcaggttattcacggataccgtcgcttctgtaacaagatctaccaggccaccaaatatgtcctcggcaagctgggtgacgacttcaagcctcaacctaccgtctcgaagactggccgcgagtccctttccgagcgctggatcttgcacaagttcaactctgctgccaaggagatcaacgaggctttggagcagcgtgagttcaacgttgtcgctactactgtgtaccagtactggtatgcccagctctgtgacgtcttcatcgagaactccaagttccttctcgctcctgaggtgccggccgatgtgcaggagtcggctaagcagactctctacactgctctcgagggcgctttgaccttgattcatcctatcatgcccttcgtcaccgaggagctctggcagcgtctgcctcgccgncccaatgacaacactatntccatcatgaaggcccggtacccagaatacaaggctgagttcaacgatgtcgaggctganactgcctacgaacttatcttgaaaa

SEQ ID NO: 7155 - DNA, 890 bp, Aspergillus oryzae
cccgacgaacgttcatcagcgacacgacacgacaacccactgtcccttcgcttttcgagtgctgttcgaaaagcgaccttgagaggaacacccgcaaaaatggctgacaccgaatacaacgctgaggaggctgccgctatcaaggccaagagaaccttccgcaagttttcctaccgcggtattgacctcgaccagctcctcgacctctcttccgaacagctccgcgatgtcgtgcacgcccgcgctcgccgtaggttcaaccgtggtctgaagcgcaagcctatgggcctcatcaagaagctccgtaaggccaagcaggaggccaagcccaacgagaagcccgacctcgtcaagactcacctccgtgacatgatcatcgtccccgagatgatcggctccgttatcggtatctactccggtaaggagttcaaccagatcgaagtcaagcccgagatggttggccactaccttggagaattctccatctcctacaagcccgtcaagcacggtcgtcccggtatcggtgccacccactcttctcgtttcattcccctcaagtaaagaagaaaagctttcaggagtgtcgcgtggaggatcgggcgtccggttgtgttgggagaagaaatcataagcgatggataccatttgtgcctatttgggttcatccaacttgtatgtcaagtgcgggtcagctgtttgcatctcaatataaaggtcttgtcggcatgtgaacgaaccacggattcctactccaatgttgaagagatcttcagtccttaaccctaaagggacgaggcaagaccgcctgttcccttcctattatccaagggagcggtggctaatttaacgaaaataatgcacttggcgatacaaaattcctgcgtgcggtt

SEQ ID NO: 7156 - DNA, 710 bp, Aspergillus oryzae
gttcactcgttcatcgccgagaaggatgcggattgctacaccgggatgatgaatatgccctcacatcaggagtcgtcgatcctcgccccattgtcacaacttctcgaaacccgtctgtccgtttaggcgcattcgcaaaggaaatccgcctgcttcttccaacctcgattcgactgaaccgtggtggtcttgtgctcccagaccttgtatcgagtgccaatgctgcagcgttgacggatatggttctcctgcatgaacaccgaggaacccccacagcgatgaccatttctcacctacctcatggcccgacagccagtttttcacttcacaatgtcgttcttcgtgcagacattcctaatgctgcccgtggtaccgtgtcggagagctacccccacctcgtctttgagggtttcaagacgaaactgggccttcgggtagtccagatattgaagcatctcttccctccgcgtgaggctggaaaggttggcaaccgtgtcgttagtttcgtgaacagggaggacagcatcgaagtgcggcaccacgtgttcgtgaagacgagttatcgggacgttgaactggccgaagttggcccacgcatgaccatgagattggttgagatccgcggtggatccctggagaaaggctctagtggtgatgttgaatgggctcttacacagtacaccagaaccagcaggaagaaggattacttg

SEQ ID NO: 7157 - DNA, 959 bp, Aspergillus oryzae
  misc_feature (1)...(959): n = A,T,C or G
tttacgtcgagctcgtccgaaccggcacgaggctcgaagtatcctcgtcggtgctatacgctgcttttccgtagcaaaccaacttgggttctctttgggattatcttcgtcttgaacttcgtcgatgttctcttgatcgttgtgttggatctgcataaccccgctgtcaacaccctgcccgggggaccgcgggtgctggccgccatcttccaggcagcatcagcacggcatacggggacgtcgagtttcaacctcgccgatgtaaacccagccgtccaattcagcctactagtcatgatgtatatctctgtattccctatcgccattagtatgcgtgcgtccaatacctacgaagaacgttcacttggattgttttccagtgacggtgaggtcgtcgacgagagcaacactacgaattacgtcctgtcccacgtgcggaaccaactcagcttcgatctgtggtacatttttcttgggatattttgtatctgcgttgccgaatcaaacagaatcatgaacccttctgagccgggactcaccgtctttgcgatattctttgaggctatttctgcatacgccaatgtcggcctcagcttagggtatccaggggtcagtacttctttaagcggacagctgtcgaccttcagtaaagtcgttgtctgccttttgatgattcgaggaaagaaccgcggactgccctatcagttagatcgggctattcgtcttcccaacgaacgcctggttgacgatcaagtagattctgagtcggataatctgtatacggacggaaaattggatccgntggacattcgagacctgaaagtgaaacggcatcacaccaaatagcatcggttttgaatcacacgattatacatcngccgaatagacccctatacatggttttaagtgaatggaacctgtaattgacagcanaaaattaccacttggtgacctatggt

SEQ ID NO: 7158 - DNA, 641 bp, Aspergillus oryzae
  misc_feature (1)...(641): n = A,T,C or G
caccctttgtggaaagcaagttctggagggcaaggacgccgacgatgctgccaatgctcatgttgaggagggtgtccgcatcaagccagttacagtcgaacttgaattggatgactaaggcacccgaatctctctcactattgtcgacactcccggtttcggcgatcagattgataatgaagcaagctttggtgagattgttggataccttgagcgccagtacgatgatatccttgccgaagaatcacgaatcaagcgaaacccccgcttcagggacaaccgtgtccacgttcttttgtacttgatcacacccactggccatggcctccgtgagctggatatcgaattgatgaagcgtgtttcgcctcgtgtgaacgtcatttccgtcattggaaaggctgactccctcactcttgcacaaatgggcgagtccaagaaactgatcatggaggatatctagcattttcgcgtccccgtgtatatctctcctttctacattttggaggatgacaaggataccccggaaagaacactcaaaaacaggggctcattacgcgtggccccttgggtctgtgactacttgaaaacttggggcgggaatgcaccccccactttcttctggagagttgaggggtaaaccn

SEQ ID NO: 7159 - DNA, 703 bp, Aspergillus oryzae
  misc_feature (1)...(703): n = A,T,C or G
caccaccggttacggtgcggccgtcgtcaccgccaaggttgaggagggctcgaacgttgccatcttcggtgccggctgtgtcggtctctccgtcatccagggtgccgtcaagaacaaggccggcaagatcatcgccgtcgacgtcaacgacggcaaggaggcctgggcccgcaagttcggtgccacccacttcgtcaatcccactaagctcaacggcaagactatccaggaggagctgattgagatgaccgatggtggttgcgattacactttcgactgcacgggtaacgtcggcgtcatgcgtgctgccctggaggcttgccacaagggttggggtgagagtatcgtcattggtgttgctgctgctggacaggagatctctaccagaccattccaactcgtcaccggtcgtgtatggaagggttgcgccttcngtggtatcaagggccgtacccaattgcccggcttggttgatgactacctgaataacgagcttaaggttgatgagttcattacccaccgtgaaactctggacaacattcaacgctggcttccagcagatgcaccacggtgactgtatccgctgcgtcgtggactgccgtaattaaattgtttgaaaagaggttaaaatgtatgctcgcttgatgatatcaatgtatgaattatgtattgaatgaaaccataataagcctagaatgaataa

SEQ ID NO: 7160 - DNA, 711 bp, Aspergillus oryzae
cttctaatcacacgagtcgaccatacacgccaaagtagtcgccatgtcggacggaaaggacaagagcgcgaaccccatgcgcgagctgcgcatccagaagctcgtgcttaacatcagtgtcggagagtctggtgacagacttacccgtgctgctaaggtgctcgagcagctgagcggtcagactcctgtctacagcaaggcccgctacactgtccgtaccttcggtatccgtcgtaacgaaaagatcgccgtccacgtcaccgtccgtggccccaaggccgaggagatccttgagcgtggcctcaaggtcaaggagtacgagctccgcaagaggaacttctccgagaccggcaacttcggcttcggtatcaacgagcacatcgatcttggtatcaagtacgaccctggcattggtatctacggcatggacttctactgctgcatgacccgccctggtgagcgtgtcgctaagcgtcgccgctgcaaggcccgtattggtgctcctcaccgcatcaaccaggccgagaccatcaagtggttcaagaaccgcttcgacggaattgtccggtaaatgtttcatttctggtctttgggggagccagggggttgcgtttatgatgaatcaataaaaaaaggcagaaaaaatgccggtctgctttgaaatacttggttctaccacggcatgaggataggcgtgttaggaatccaact

SEQ ID NO: 7161 - DNA, 1895 bp, Aspergillus oryzae
caccctcctgttcttccttgtcgatcgctggacagagcatctcttttctccttttctctttcccacacccgtatatacctacgagccctgtgctaggttgacgcagcagctctatcaccatgggtgacgctgtagctccaaacgccctcgccgataccacgcgagtggaggcacccgtcaccttcaagacgtatatgatgtgtgcctttgcagcctttggtggtatcttcttcggttatgattccggttatatcaacggtgtcatgggcatgagttatttcatccaagaatttgaaggcttggatcctgccaccaccgactcggatcatttcgttgtctcatcgtggaagaaatccttgatcacatccatcttgtcggcaggtacattcttcggtgctttgattgctggtgatcttgcggactggtttggacgtcgcatcaccatcgtctccggttgtgctatcttcatcgttggtgtcgttttgcagaccgcatcaaccaccgtagctcttctcgtagtgggacgtttgattgcgggattcggtgtcggttttgtgtcggccatcattatcctgtacatgtcagagattgctcctcgcaaggtccgcggtgccattgtgtcgggttaccagttctgtatcaccattggtctgatgctggcttcttgtgtcgactatgccactcagaatcgcactgactccggttcctatcgcattccaattggcattcagattgcttgggccctcatcctcggtggggggttgctcatgctacctgaatcgccccgttatttcgtcagaaagggccagctcgacaaggcgtcccatgtcctcgctcgtgtccgtggccagcccgaggattcggagtatatcaagcaggagctagcagagatcgttgccaacaacgaatacgagatgcaagcgatgccccagggtggctacttcaccacctggctgaactgcttccgtggaagtctgttccaccccaacagcaacctccgccgtaccgtcctaggtacttctcttcagatgatgcagcaatggaccggtgtcaacttcgtgttctacttcggtaccacgttcttcacctccctcggaacaatttcgaatcccttcctgattagcatgatcaccaccatcgtcaatgtttgctcgactcccgtctcattctacaccatggagaaggttggacgtcgtcccctgctgttgtggggtgctctgggcatggttatctgccagtttattgtcgccattaccggtaccgtcgtcggtgacaagggcggcaacaacgctgcggtcagcgcggagatctctttcatctgcatttacatcttcttcttcgccagcacctggggtcctggcgcctgggttgtcatcggcgagatcttccctctgcccattcgttcgcgcggtgtggctctgtccactgcgtctaactggctttggaactgcatcatcgccgtcatcactccatacatggttgaccaggacaagggcgatctcaagtccaaggtgttcttcatctggggatccctctgcgcctgcgccttcctctacacctacttcctcatccccgagaccaagggactcaccctcgagcaggtcgacaagatgatggaggagaccacgccacggacctctgccaagtggaagcctcacaccaccttcgccgccgacatgggactcaccgagaaggacatcaccgacaaagtccacgtcgcccaccgggaagtctaatccacccgtatgggcacggtcggcggggactcgtttgggggttcgggagggtgttctgcaaattacttttcctttcttttctttaattgactggttatcagctatgaaactcatacccatgatttgtacgcgtcatgtcggtttaatgctgaggcagaa

SEQ ID NO: 7162 - DNA, 721 bp, Aspergillus oryzae
tactatttcccacgccagctccgacttaggcctccccggagagcacttttacaatactatccctttcactctccgcttcagtctatcccaatggctcctatcacggaagaggccgtttccggtcttaaggatatcatcggcaagctcgaggctcgggttgaggaattggagagccgcctgagcaatggatttaagcccaagtctgttgcagaacatatgcgcatggttctgatgggacctcctggtgcaggcaagggcacccaggcacctgcacttaaggacaaatactgtgtgtgccacttggctaccggagatatgttgcggtctcaggtcgccaagaagactgagctgggcaaagaggccaagaagatcatggatcagggtggcctggttagtgatgagatcatggtcaacatgattaagagcgagttggacaacaacagtgaatgcaagaacggtttcatccttgatggctttcctcgtaccgttgctcaggccgagcgcttggatgatatgcttgctgcccgtcaacagaaactccagcatgccgtcgaactgcagatcgatgatgccttgctggtagcaagaatcaccggacgtttagttcaccctgcttctggacgctcctaccataaagtgtcaatcctcctaaacaggagatgaaagatgatatgaccggcgagcctctcattcagcggtctgatgacaatgctgagaccct

SEQ ID NO: 7163 - DNA, 664 bp, Aspergillus oryzae
gcttcacattcgacttggtcacaatggccactgatttcaagacggttcttgcccctccaaaacgggctaattccgactatccgttgattgattccgacccgcacctgcgacgagtttttggatatgcgagaccttctgattatgctattgctggcggagcagctgccgcttcgccactagcattctgggccatggaaagggtgagcccatctcatgttggtagaggaggtttcgcccctgtgatgcggctagcaacagcaatcggccttattggaggtctccatgtgctctaccaaagatcttgcaatcgcttctatggtttcaccgagaattcgagggaagttgagatggatacaagagaaatggttgacaaggtcaagagaggtgaatctctgtatggcacctcgaaggtgtctgcttatctgcaaggagtcgcggccaggaactcgcggtattcagagttattcattcatgttcttccctggttcaacattgtaaatcatgatcagcatggcgtggacacagctaagtactatcagcaagctgagcgtgagctcgaagccgagcgtttggcgaaggctggttctgcgtgaaaatatgattggtatggatcatcaagttgagccgtaacttgcgggatctggaatatttattctttaggttt

SEQ ID NO: 7164 - DNA, 1033 bp, Aspergillus oryzae
  misc_feature (1)...(1033): n = A,T,C or G
cgacttcccaactttggtgctccgcaaccaccgcgtcctcggccgtttcttcgacaactcacttcacccaacagaaacgcaatcatggctgctgtccagggagctatttcgaagcgccgcaagttcgtcgccgacggtgtcttctatgccgagttgaacgagttcttccagcgcgagctggctgaggagggctactccggcgttgaagtccgtgtcactcccaccgtcaccgatatcatcatccgtgccacccacacccaggaggttctcggtgagcagggccgccgcatccgcgagctcacctccctcatccagaagcgcttcaagttccccgagaactccgtctccctctatgccgccaaggtccagaaccgcggtctctccgccgtcgctcagtgcgagtccctccgttacaagctcctcaacggtcttgccgtccgtcgtgcttgctacggtgttctccgtttcatcatggagagcggtgccaagggttgcgaggttgtcgtttccggaaagctccgtgctgcccgtgccaagtccatgaagttcactgacggattcatgatccactccggtcagcccgctaaggagttcatcgacagcgccacccgtcacgtcctcctccgccagggtgtccttggtatcaaggttaagatcatgcgcggttccgaccccgagggcaaggctggcccccagaagaccctccccgactccgtcaccatcatcgagcccaaggaggagcagcccgtcctccagcccatgagccaggactacggtgccaaggctatcgccgctcagcaggctgccgagcagcagcgccttgccgagcagcaggccgccgagggccaggagggtgctggtgcggagactttccagcaggagtaattggtttcattttcttaggccctgctcttttttcttcgttcctgtcgtcctacctgatatcattacctgacgcaaataaacaactacatgatcttccatttggntatcttccttcgctagcaagctangaaaagcgtcttcccgtccc

SEQ ID NO: 7165 - DNA, 401 bp, Aspergillus oryzae
ttgaccttggcacaacctactcctgttttgccaactatgaaggcaccaatgttgaaatcattgccaacgagcagggtagctacacaaccccctccttcgtctctttcaccgaaaaggagcgcttgattggcgaggccgcaaagaaccaggctgcgatgaacccgaagaataccatcttcgatatcaagcgtcttatcggccgtcgctatgatgatcctatcgtcaagaaggatgttgaatcgtggcccttcaaggtagttgatcagggtggaagccctgccgtcgaggttgagtacctcggagagacgaagactttcactccccaggagatctcctccatggtcttgatgaagatgaaagaggttgcggaaaccaagcttggtaagaaggttgaaaaggcg

SEQ ID NO: 7166 - DNA, 680 bp, Aspergillus oryzae
  misc_feature (1)...(680): n = A,T,C or G
caccttgtcgcggtacagccttgacaacgacaacgatgttgccatcaatgcaattttcgccatgggtctttgcggtgctggtaccaataatgctcgtttggcacagctactcagacaattggccagctactaccaccgtgaccagaactctctgttcatggtccgcattgcccaaggtctcctgcatatgggcaagggcaccatgacattgaatcctttccacacatcgccaggtcctctctcgtgtctcggctgccggtctactcacagtcctcgtgtctatgatcgacgccaaacaattcattcttgcagaacatcactacctcctctatttccttatcaccgccatgtatcctcgcttccttgttacactcgacgaggacctacaacccctcaccgtgaatgtgcgagtgggacangccgtggatgttgttggacaagctggacgttctaagaccatcactggctggcaaacacaaagcaacccaattcttctcgcatacggtgaaagagcanagcttgaagaagaacagtatatccctctcagcagcacccttcaaggggtttgtcattttgcgcaaaaaccccaacttgggaagggaacagaacactgcttaaaaagggatatactggttttctataaatattcgggtttactttagcgccagaaaacacaaccg

SEQ ID NO: 7167 - DNA, 677 bp, Aspergillus oryzae
  misc_feature (1)...(677): n = A,T,C or G
cattcattgaacaaaccaattgatatatacaggctgaaatccagaatttgcctgacattaaattcctcacctaattctttcacctctcaccatcacacgcacacaacacacagatcaagatgttggaagctcgcctagaacaagcctctctcctcaagcgcgttgtcgacgctatcaaggatctggtgcaggactgcaactttgactgcaatgactctggtatcgccctccaggccatggataactcccatgtagccctaggttccatgctcctcaaggccgaaggcttgtccccataccgctgcgaccgcaacattgctctcggtatcaacttggtctccttgaccaaggtcctgcgggctgctcagaatgaagacattcttactctcaaggccgatgactcaccggacgccgataacctcatgttcgagagcgctgagaccgaccgactaagcgaatatgatattaggttgatggacattgaccaggagcacctggcaatcccagagaccgagtatgccgctaccgtcgagatgccttctgcagaaatncagcggatctgccgaaacctgaacgcactgtcgagtctngtgncattgaggctaccaaggaaggtgtcaagttcctctgccaaggtgacatttgcagcggatctgtcaccaatccgtaacacacct

SEQ ID NO: 7168 - DNA, 1167 bp, Aspergillus oryzae
ctggccgagtccacagaccagtttgggcgtgcggaaatcaatgacgctctccgcgagctgcaacactcgctggagacgccgttcgatacggtgatgcggatgtcgctcgatacgtgtcaagtcgccgtggcccgcattggctcggacctgggtctgtttaaacatctcagccagtgtgcatctcctcagagcgctgaggaactagccgatcatctcggttgtgggagggaactgatgtctcggctcctccgctacatggcctcggtgcgcatggtacaacaaacagacgacatcaaatacatatcgagcaacatcacacagacgttggccgtccccgggctcgaagcaggaatgcgacatgcattcgagaatctctggccagtcctgatggccctccccgacttcctcgccgagcgcaagtatcccgacatcgtggatgccaaagacactgcgttccaaaaagccttcaacaccgatcaggactgcttccactggctagcaacccagccaacacgaattgcgaacttcaaggtcctgctcaccgacgagcgcaccccaaacttcctgtccacgttcccactagaaaaggagctcggatcatggtctgcagagcccgagaaggcgctcttcgtcgacatcgggggtggaatgggacatgcatgcatccgacttcgcgagaagtatcccaaccaaccaggccgcgtgattgtccaggaccttgcccccagtactgcaagctgcgcaggcgacgcagcccctgtcagggattgaatcgatgccacacaatttccatactccacaacccgtccaaggggccaagttctactttctccgtctcattctgcgcgacttccctgaccaccaggcactcgagatcctccataacattgttcccgccatggatgccgagtcacgcattgtgattgatgacggggttcccccggagaagggggcgcggtgggcagaaaccggaacggacatctgcattatgagtgctctggggtcgaaggagcggactcagcggcagtgggaggagctagctgcaaaggctggactgcagctacaagctctctaccagtacacctggccagtggtgaatgcggccatggtgtttagcctgcagtagctaccaatacgtagaacattatgtctccaaaaaaaaaaaaa

SEQ ID NO: 7169 - DNA, 687 bp, Aspergillus oryzae
  misc_feature (1)...(687): n = A,T,C or G
gaaggtcactggttctaatgccctaggcttcggtgactatagacaatcatgaagctcgatgcgaaggcgattcgttacctcacttctgaggatttccgtgttctctctgcggttgagacaggaagtagaaaccatgaagttgttccgaccccattgatcgcaaatatctcaggtctccgaggtagtagtggtgtaaaccgagctatttcgaatttggctaaaaccaatcttattgcgaaggtgaagaatgccaaatatgacggatatcgtctcacctacggtggtctcgattatctagcactcaacgctcaccaaaagcaaaaatgcatctactccgtcggaaaccaaatcggcgtcggaaaggaatcagacattatcgtggtcgcgaaccaccagggaacacagcgcatcctcaagatccatcgtctcggtcgcatttctttccgaacggtcaaaactaaccgagactacctacgacaccggcaaactggctcgtggatgtatatgtcgcgtttggcggcgatgaaggagtatgcattcatgaaggcacttggagagaacggattctccgtaccagagcctatcgcgcagaacagacacacaattgtcatgagtctcatttgacgccttnccactatcgccagaatttcgacaagtcccgaaccccggcgttctttgtactcagag

SEQ ID NO: 7170 - DNA, 678 bp, Aspergillus oryzae
gacactcgtcacagtccagagggatgtttacggcttctgctcgaagccgtctctccacactttcgcggccccgtctctctcctaccaactctcttcttgctagatctgctgtggcaccaactatggctcctcggcgtaaggcttcgtctgtcccggagggctacgtagaagacctctctaagggcaagatgctcagatttgaagattcccttcctcgcttgcccgtccccactcttgaagaaaccgcccgccgctacctgaaatcggtccatgcggtggtttccgaagccgaatatgagaacaccaagaaggccgtggaagccttcgttcgccctggtggcgagggtcaaactctgcaggaaagacttctggcccgtgctgcggaccccaaaaataagaactggcttactgaatggtggaaccacgccgcatacctgggttatcgcgacccggtggttccctacgtttcctacttctactcatacaaggacgaccgcgctcgtcggaaccccgccaagcgtgccgcatctgtcgcgaccgcggctctcgagttcaaacgccaggtggacgatggctccctggagccagaatacatgcgcgccgcgcccatcgcgatgagctcgttcgagtacatgttcaattgctgccgcattcccgccgacggtgcggattatcctc

SEQ ID NO: 7171 - DNA, 799 bp, Aspergillus oryzae
cccaacaacccgcgacaaggaaaggcagcaccagcagcacagcccgctatccgtcgctcgtctgcaaaaatggctgctatcaacaagatcgccctcaactcgccctcgaggcagaacccctccgagctggagaacgcgatcgccggcgctctcttcgacttggagagcaacacacaggacctgaaggccacccttcgtcctctgcagttcgtctctgcccgtgaggttgaggtcggccacggcaagaaggctgtcatcatcttcgtccctgtccctctcctccagggcttccacaagatccagcagcgcctgacccgtgagctcgagaagaagttctccgaccgccacgtcctcttcgttgctcagcgccgcatcctgcccaagcccaagcgctctgtcaactcccgcaccaaccagaagcagaagcgtccccgttcccgcactctgactgctgtccacgacgccatcctcggcgacctggtctaccccgttgagatcgtcggcaagcgcatccgcaccaaggaggacggcagcaagaccctcaaggtcatcctggatgagaaggagcgtggtggtgttgaccaccgtctcgatgcctacggcgaggtctaccgccgtttgaccggccgcaacgtcgtcttcgagttcccccagagcagcgcctctgacttctagatgccaaattttctccttatgtccttttaaaagcttttttttttttccggggataaggccattgaaaaaaaaattagttctgggtatttcaagaccaaagaccccgggttttactttttttttt

SEQ ID NO: 7172 - DNA, 688 bp, Aspergillus oryzae
ctcatttatccccgtttcgctcttaaacaccatcataatgttcaagagcggtcttgcccggaccttcgggagggctgcttttgcccggcctaccccggtcgcccgtcgcgttccctccaagatcaatgccttcccttcccttgccaggttggccagcactgaggccggcgctaccggcaaggttcaccaggtcattggtgccgtcgttgacgtgaagttcgagggtgagaagctccctgccattctcaacgccattgagaccgagaacaatggccagaagctcgtccttgaggtttctcaacacttgggtgagaacgtcgtccgtactattgctatggagggtaccgagggtttgactcgtggtgccgctgctcgcgacactggtgctcccatcaccatccctgtcggtcctggcacccttggccgtatcctcaacgtcactggtgaccccgtcgacgagcgtggtcccgtcaaggccaccaagtacgcccctatccacgccgaggctcccgagttcgttgagcagtccactgagggtgagattcttgtcactggtatcaaggtcgtcgaccttgcttgccccctacgcccgtgggtggtaagattggtctcttcggtggtgccggtgtcggtaagaccgtgttcattcaggagttgattaacaacattgccaaagctcacggtgggt

SEQ ID NO: 7173 - DNA, 733 bp, Aspergillus oryzae
  misc_feature (1)...(733): n = A,T,C or G
cgagtactgggacgcgcttttaaccagaatcccaataacgaggatatttggcttgctgctgttaagctcgaggccgacgcccggcaaacagaccaggctagagagctccttgcgactgctcgtcgggaagccggaacagaccgtgtttgggtgaaaagtgtcgcctttgagcgacaactgggtaatgcaaatgaggcgctagacctagtaaatcagggccttcaactatacccgaaggcggacaagctttggatgatgaagggtcaaatctatgaatcccagaataagtacccgcaagcccgggaggtgtatggaacaggtactcgtgcgtgttccagatcggttccgttgtggctgttggcttcaagactggaagaaaaggctggtgctgtcgtcaaggctcgctctgttcttgacagagctcggcttgctgttcctaagagtgctgaactgtggacagaaagtgttcgtgttgaacggcgtgcaaacaatatcgcccaagctaagatcttgatggcaaaggcattgcaggaagttccaacatctggattgttatggagtgagagtatctggcatctcgaaccgcgggcacaacgcaaggctcgcagcttggaggctatcaagaaggttgataatgacccgatattattcattacagtggctaggattttctggggagagcgtcgactggagaaaagcatgacatggnttgaaaaagcgattgtgtcccacn

SEQ ID NO: 7174 - DNA, 687 bp, Aspergillus oryzae
  misc_feature (1)...(687): n = A,T,C or G
ttcatcgctatttgactatcaagtctatgtctcccgaggaaaggaagaaagtcttgccacgagtatccattattggtggcaaggcagccccagggtactggatggctaaaacagtcatccatcttgttaacagtgtcgcatcagttgtaaacaatgatccggacatcggcgatcttttgaaagtaatatttattcaagactacaatgtcagcaaggcagagataatttgtcccgcttcggatattagcgagcatatctcaaccgctggcactgaaggtagtggtaccagtaacatgaagtttgtactcaatggtggtcttatcattggaacttgtgatggagccaacatcgaaatcactcgcgagatcggcgaacaaaacattttcctttttggaaatctagctgaagatgtccaggaactacgtcaccgtcactactacggtgacttttaactcgaccctcagcttgccaaagtgttcgatgccatcccaagtggcacgttcnggaatcctggcgacttctttgcgcttattgcattcattgcaaaacatggtgactactatactgtattcgaccgatttaactcgttttgaccacccaaaaattgttggacaggccttcccgaccaaaaccaatggatagtcaagtccattacttatgtgcaccccctggcttttttttcccggn

SEQ ID NO: 7175 - DNA, 680 bp, Aspergillus oryzae
cattgccatcgtatctcatcggcgaccctaataacctgttctcttcatatcatatacttgaacttctgtcgaaccattcccaatcgcaaaaatgactggaggcaagtctggaggcaaagccagtggcagcaagaacgcgcaatcccgttcgtccaaggccggtctcgcgttccccgttggacgtgttcaccgtttgcttcgtaagggcaactacgctcagcgtgttggtgctggcgcacctgtttacctcgccgctgtccttgagtatctcgccgccgaaattcttgagttggccggcaatgctgctcgtgataacaagaagacccgtatcattccccgtcatctccagctcgccattcgtaacgatgaggagttgaacaagctgctgggtcacgtcaccatcgcccagggtggtgttctgcctaacatccaccaaaaccttcttcccaagaagacccccaagagcggaaagggtcctagccaggagctgtgaattgtttgtttttatttgggttttctcattcggcgtggtttggttctcttattgatgtgataacggggttctggactgggcacgtttatggctctgcgttttttttgttttaattttatggttgtacattatgtctacggacatggaatgataccggcagctttcaaaggaaatgggctttcggcac

SEQ ID NO: 7176 - DNA, 1053 bp, Aspergillus oryzae
  misc_feature (1)...(1053): n = A,T,C or G
ccgaaagctgagcaatggagatctccaagaaagcagcaacactgctgccaaagcccttctacgtgctgagtcaagccctgaacctctcgaacaaggaccacacaaaatggtggtatagcacagctccgatgtttgccaccatgatggcgggggccggctatgatgttcacgcacagtacaagttcctctgtatccaccgtgaggtcatcatcccggcgttgggtccatacccagaaaagggtcagcccatgcactggaagagtcatctcacacgcttcggacttcctttcgagctgagcttcaattactccaaatcactactacggtttgcattcgagcccctcggttccctgacgggaacgaaggatgatccattcaacacccaggcaatcaggcctgttctccaggacctcaaggccatggttccagggcttgacctggaatggttcgatcatttcactaaagcattggtcgtttcggaggaagaggctcggactctgctagatcgagatattgagatccccgtcttcaagacacagaacaaactggcagccgatctggagccatctggcgatattgtcttgaagacctacatctacccgcggatcaagtcgatcgcgaccgggaccccaaaagagagactcatgtttgacgcaatcaaggctgccgacaagtttggcaaagttgccactccactggcaatcctcgaggagtttatagctgagcgagcacccaccctcctcggccactttctctcatgcgatttggtcaagccgtccgagtcccgaatcaaggtctactgtatggaacgccagctcgacctggcctccatcgaaggtatttggactctcaacgggcgacggaacgatccagagacactggatggtctggatgcgctgagggagctgtggcagctattgcccgtcacggagggtctgtgtccactgccgaactgcttttacgagccgggtacctcaccgcaggagcagctccccttcattataaattntaccttgtctcctaaaagcgcacttcccgaaccacagatctatt

SEQ ID NO: 7177 - DNA, 686 bp, Aspergillus oryzae
  misc_feature (1)...(686): n = A,T,C or G
aacatcattcttacaacgaactgagacatccactctgcgatcgatctgcatcaaggccagcgatgctaattgattatatcatagaacgtttggagaaggtggcacaaaaagacgggcacaatgctctaaacgacccgacgtcctggttacgggataaatttaatgccgttcgtgagctacccagctttctcctgccgcggtattttgccattattgtccaagtcgcgtacaacgctgcctggaagcagggcattcggcttctgggggagagtatacagaagggacaagaattcgttcatcaactgggcatggtcagcgtccaacaaactggatacgtgaaaaccgcatccctatggcctacgagaagagtaccaagccttgcagctggcctaccacattttgctgtggactgggctagatgttggggtagagacgttttcatatctcttcgaggcttgcttctctgtactggccggtttgatgatgccaaagagcatattctcgcctttgctagcgtcctcaaacatgggatgatccctaatctgttgagcagcggaaagcttcctcgttacaattctcgagattctgtgtggttctttcttcaggctantcaagattacaccgcaatggttccaaatggtatagaactcctcggcgagaaagttcccagangttcctgccgtaca

SEQ ID NO: 7178 - DNA, 682 bp, Aspergillus oryzae
  misc_feature (1)...(682): n = A,T,C or G
cgttctgcttcagtatgcaattcgtcatcttcatcgaactgattggaacactggtcctccctgcagctatcgcatttaccttctacgtggtcatctcgtctattgtcaagaagccggtgcaggtcattccgctggtcctgctggccctcattctgggacttcccggtgtgctcatcgtcgtcaccgcccaccgattggtctacgtcttgtggatgttgatctatctcctctcgctgcccatctggaactttgttcttccgacctactcgtactggaagtttgacgacttcagttggggtgacacgcggaagaccgccggggagaaggacaaggggcatgatgctggggaaggagaattcgatagtagtaagatcacgatgaagcgctggcgagatttcgagaaagatcgccggcttcgcatgcaggccgcctggggacagcctccgatgggaggatatcctacgcgttacgaagaatactccgattactagtatataggggacatgtgctatatttctttttatgttggtcacgagcgattcgactgacttttgtattacgtttttcttttcatgcgtctctaattctttgggcctttttatctatcctatgacgcacttggaagggtgtntagagaaagatttttgtatagctttccgcgaaaggtaaggaccgtacacga

SEQ ID NO: 7179 - DNA, 750 bp, Aspergillus oryzae
gcttcgcaagagtattccgtccccttatcggttctccatttcgattccagaatcgttccataccggtccaagcgcaacacatccgagccatgcatatccaatcgattccgatgtggacggggaagggcaataattatgcctacctggtgacagacgagccaaccaagaagtctgtgattattgatccggccaacccgccagaagtagcaccggtgttgaagagtcaaattgaagatggcaagattgatctgacagctattgtcaatactcatcaccattgggatcacgctggcggcaatgatgaactgctcaaaatctttggcaacaaactccccgttatcgggggtaagaattgtcaatcggtgacgcagactccggcccatggagagacattcaagatcggagagcgcatctccgtaaaagctctccatacgccttgccatacgcaagatagtatctgctatttcatgcaggatggtgaggaacgtgtcgtattcacgggtgacaccttgttcattggaggatgtggtcgcttttttgaaggcactgccccagaaatgcacaaaggccttgaacgagacgcttgcctctttgccggatgatactaaggtctttcccggccacgagtacactaaaggcaacgtgaagttctgtcttgccgtgtcacagtcagagcctatcaagaagctggaggcattcgcagagcagaaccagcagacccaggggcaagtcacgattggtgatgagaag

SEQ ID NO: 7180 - DNA, 553 bp, Aspergillus oryzae
  misc_feature (1)...(553): n = A,T,C or G
acttctccttctggttttctccctttctctctggctagaattcgtttgctagacgttgttcaaatctccatcaaaatgtcctgcattaccacgccagccattcctccggtggctcttgaatcaatcactcaacacattggtaacacgcccctcgtgcgcttgaacagacttccacgtagccttgggattgaggcaactgtctatgcgaaattggaatatttcaatgctggaggaagtgtaaaagataggattgctctgcgcatgatcgaagaggccgaacgatcagggcgcataaagcctggtgatactctcatcgaacccactagcggtaacactggaattggtttggcgctcgtcggcgctgtaaagggatacaagaccataattactctcccggagaagatgtcagctgagaaggtggctgtactgaaagcgttgaatgcaactatcatccgcactcctaatgaagcggcgtatgattcaccggaatctcacatcggtgtcgccaagcgtcttgagaggaacntcccgacgcgcacatctggacaatatg

SEQ ID NO: 7181 - DNA, 653 bp, Aspergillus oryzae
  misc_feature (1)...(653): n = A,T,C or G
cgactctgtaatgaatgtccagtggtatgatgcgaatgtgtcgctaccgggttgcgataagaatatgcctggtgtgttaatggcgatgggacgcacgaatcggcctagtatcatggtctacggcggtagtatcaagcccggatgcagtgcaaagggccaaaagttggatctggtcagtgcattccagtcgtatggccagtacattactggccagatcgacgagaaagagcggttcgatattattcgcaatgcatgccccggcagaggtgcttgtggtggcatgtacaccgcaaataccctggcgacggctattgagactatgggtatgaccgttcccggtagcagtagttgtccagcagacgatcctaagaagctggtcgaatgtgaaaacatcggtgaagtggtgaagaatatgctcagggaagatatcanacctagtgatgttttgacccgtcaagcatttgagaatggcatgattgtgggtaaatatacctggggggtagtaccaaacgctggtcttacccccgatttggttatgctgacctcggccggattaaattgactatcgatgacttccagccgtatccgattagacacccttcctgggtgactgaagccctttggaaaatttgtctgaatgacctttccctatg

SEQ ID NO: 7182 - DNA, 849 bp, Aspergillus oryzae
cccttctttcttctaccacttgcaattgctgcctcccctttcctctccacctactttaattggaggattggctgtccattatactctctatctttggtttttttttcttctttaattccccatccttctcgccatgttccggactctcttgccgcgggctgcaccgcgggctgccctccgcactgctcgccctcagtctgtcccttctaacttcgtcgctgctcctaccctctccttctctctcttgaacaactcccacctttatcaccagatcctccacgacacgaaaaagcgcggtattgaggtcggtgatgtcaagctgaacctcgagcagatgatgaaggccaaggacacttccgtcgagggtctgacgaagggtattgagttcttgctcaagaagaacggtgtcgactacgtcaagggtactggtgctcttgttgatcctaacactgtcaaggtgaacctgctcgagggtggtgaacaaacccttcgcggaaagaacatccttatcgccaccggtagcgaggccacccctttccccggcctgaacatcgacgagaagcgcatcatcactagcaccggtgctctttcgctacaggaagttcccaagaagatggttgtcattggtggtggtatcatcggtttggagatggcttccgtttggtctcgtctcggtgctgaagttaccgttgttgagttcttgaaccagatcggtggacctggtatggatgcaaagatttgccaacaggctcagaagatcctgtcgaagcagggtatcaagttcaagactggcacccaggtcaccaagggtgatgacagcggcgcttctgtttctattagcgtcgagtc

SEQ ID NO: 7183 - DNA, 685 bp, Aspergillus oryzae
  misc_feature (1)...(685): n = A,T,C or G
gggccttcattcccgcgaggcgggtcaacagataatcaatgacctcagagccgtaggccatggagacaccgtggagcaatggagactgagagactggttgatcagcaggcagcgctatgaggggtaccccgattcccatcattcactgcggggattgtggccccgtgcccgtgccggacgatcagctcccagtcaagttgcctaaaatagaaggggactggctgaaagggaagagaggaaatcctctggagtcgtccgatgagtgggttaacactgaatgtccgaggtgtcaaggtcctgcgaagcgggatacggataccatggatacctttgtcgattcctcatggtattttctcagatttctagatagcgccaaccgacgacagccgttttcaccgtcatctgcgcgaccagtcgatgtttatatcggcggtgtcgagcacgcgatcttgcacctactctacgcccggttcatctacaaattccttgctaagtccggcttgttcccggagattgctcatgtaggtgatgtttcgaggccgttggagccgttcaagacgctcctttcccaaggtatggttcatggaaagacgtactcggagccctctacagggagattcctncacccttctgaaatggactctctagccccgataaaccgtcatcaaggcactcaaatcactct

SEQ ID NO: 7184 - DNA, 675 bp, Aspergillus oryzae
ccccatccaagatggcgaaaatcaagaagaagggaacttctggccaggccaaaaactatatcactagaactcaggcagttcgcaaacttcagatttccctgcctgacttccgtcgactatgcattttcaaaggcatatatccccgtgagcctcggaataagaagaaggccgccaaaaactcgactgccagcactactttctactacacgaaagatattcaatatctcctgcatgaacccctcctccggaaattccgtgaccagaaagcgctctcgaaaaagattgctcgctcccttggacgtggtgaagtgagcgacgcaactcgcctggagaagaaccatgcgccgcagctcactttggatcatatcatcaaggagcgctacccaactttcatcgacgctctgaaagactttgatgatgctctgtcgcttctggtccttcttgcgaacctttctttcactgcacatgtaccctcccaagaccaacgcgctttgccaacgccttttgcatgaatttcagcactacctgattgtcaccaacttcctgcgcaaaataattcttttcattcaaaggtatttacttacaagcttaccatcaaggacaaggatatatggtggtggggcctctaccaaatcgttcaccgggtgaatggaaaagtccattttcgaatcaggg

SEQ ID NO: 7185 - DNA, 677 bp, Aspergillus oryzae
  misc_feature (1)...(677): n = A,T,C or G
cccccctccccccctcttaattccactgtttcttcggctcattagagaagtgtttcttttcttttgatccgtcatcatgagctccctgagcttgcggagcctagctcccgcatccaagatttcccgtgccttgagggatcagagacgtcttttttcctcaacccggcccgcagcccggatttttggcagcaacccattgcgcgctagggaagccactggcgctatcgccgagaagtacccgatcattgaccacgagtacgatgctgtcgtcgtcggtgctggaggtgctggtcttcgtgccgccttcggtctggcggaagccggttttaacactgcctgtgtctcgaagctcttccctacaagaagtcacactgttgctgcccaaggtggtatcaacgctgctcttggaaacatgcacgaggatgactggagatggcacatgtacgataccgtgaagggttctgactggctcggaaaccaggatgccattcactacatgaccagagaagcccccgctagtgttcgtgagcttgagggctacggatgccccttctctcgtaccgaggacggcccgatctaccagcgtgcctttgggtggtcagtccaaagaattctgaaaggggcggccaggcctaccgttgctgtggtggccgctgatccgactggtcacgcctttn

SEQ ID NO: 7186 - DNA, 596 bp, Aspergillus oryzae
cgccgctcagagtgccgctattgccattgtcaagggcatcaacggcaatgccgtcaaggccgtcattcctcctattctcgagtccctggagtccgcccagaagtggactgagaagctgtgcgctctcgagtgcctcaactctctcattgagaccgctcccgctcaggtttcttaccgtgtccccgccctgattcctgctgtctccgaggctatgtgggatactaaggccgagatcaagaaggccgcttactccaccatggagaaggtctgcggtctgatcgttaacaaggatatcgagcgtttcattcctgaactcattaagtgtatctccaagcccgagaacgtccccgagaccgttcacttgctcggtgccaccaccttcgtttccgatgtcactggacctaccctcgctatcatggttcccttgcttgaccgtggtcttgtcgagcgtgagactgccatcaagcgtaagtctgctgtcatcgtcgacaacatgtgttaacttgtcgaggaccctcagatcgtcgctcccctctttgcccaaattgatgccttgtcttacaccacacccttgacacccttgcccgaccctgaag

SEQ ID NO: 7187 - DNA, 698 bp, Aspergillus oryzae
  misc_feature (1)...(698): n = A,T,C or G
ctccaccgtgccttttccgtgttcctcttcgattccaacaagcgcttgcttctccaacagcgcgccactgagaagattacattcccagatatgtggacaaacacttgctgctctcaccctcttggaattgctggcgagaccggttctgagctggatgccgctatcttgggcgtgaagcgggctgcgcagcggaagttggaacatgagcttggaattaagccggagcaagtacccctggataagttcgatttcttcacgagaatacattacaaggctcctagtgatgggaagtggggagagcatgagatcgactatattctcttcatccaggcagatgtagagctgaagcctagcccgaatgaggttcgagacacgaagtacgtctcggctgacgaattgaagacgatgtttgagcagccggggttgaaattcacgccttggttcaaacttatctgcaattcgatgttgttcgaatggtggagccatctcggctctccaaccctggagaagtacaagggcgagaaaggtatccggcgtatgtgatattctactccacggagactgatgatatgatngtacccggttttgtctcgcaacatagcgggtgctcttcggctggttctatctatttcccctaatgatgataccatggcatgggccagtcaaacgcattattatatttggacagaagttttctn

SEQ ID NO: 7188 - DNA, 951 bp, Aspergillus oryzae
  misc_feature (1)...(951): n = A,T,C or G
agcctccggcgacgcccgttctccattcttcttttcgatgaagttgaaaaggcagccaaggaggtcctcacggttctcctccagctcatggacgacggacgtgtcacagacggtcaaggcagaattgtcgacgcgaagaactgcatcgtcgtcatgacgtccaacctgggtgccgaattcctgtctcgtcccgccactaaggatggacggatcgatcctcaaactcgtgaattggtcatgggcgccctccgtgactacttccttcctgaattcctcaaccgtatctccagtacggtcatcttcaatcgcctcaccaagaaagaaattcgcaagatcgtcgacctccgtctggacgaagtccaaaagcgcttggagcaaaacggaaagaacgtcacgatcgaatgcacagaggaggtcaaagactacctcggcgacgcaggctattcgcccgcttatggcgctcggcctttggctcgcatcatcgagcgcgaagttctcaaccgtctcgctattcttatcctccgtggaagcatcgttgacggcgaggtggctcgtgtcatcatgcgcgatggtcgtatcgacgtcctgccgaaccatgagatcccggttgacgaagatcaagacatgctcgatagtgaagatgaagccatagccgagatggaagacggcagtggtgacatggatctctacgagtaaatttactaaaaaaaagggggattatcagcaaaaaaaatcanaggggatgtgcatttttgaagatatggagtgatgactgatgatgataacatgactttttcttctcgcttgattatgggtattggcgttgttgttaatatttctttcttggacatattatatgcactttgtacacagcattgagataatgtgctttaataaatagatncagctggattnnnnnnaannannataaaaagatgaaaaaaaaaattt

SEQ ID NO: 7189 - DNA, 624 bp, Aspergillus oryzae
gacgtgtacgatataaagatacccgtgtaatttttagtctaggatattcgtacaatatcaagaggtaatcgtgcagcattatgtacgcatttttaaaccagttactactcttattcatcgccaccaccgaggttggcacccacctgctgtgcagatttgccgctgcagatatcatcaacacggagaagtaggcatgcggactcgacagcagtcttgatgctctggagtttcactgcttcaggttcccagacgccatattccttcatatccaccagggcacccgagtcaccatcaagaccccatgtggtgtggccttcggcgtgcttggccctcatgcgagtcaaaacacgaatagggctggctcctgcgttttgagccaatgtccggggaataacctccatagcatcagcaacggccttgtaaggccattgttgaacaccctcgatagacttggccaactggcccagcttgacagaaactgccatctcgatagcaccaccgccaggggacagtcgtgggtggaagatgacattccgggcgaaggccatagcatcctgaaggttgcgctcaacctccttgataatatcctttaaaggaccacgtagaaggaatgtgaaagccttt

SEQ ID NO: 7190 - DNA, 761 bp, Aspergillus oryzae
catcttcatccgtgtatcaatctatcttcccttcacttgaatttttcaagaaattaaattaacccccaaccgtcaaaatggtcaaggctgttgctgttctccgtggagactccaaaatctccggcaccgtcaccttcgagcaggctgacgccaacgcccctaccactgtctcctggaacatcaccggccacgacgccaacgctgagcgtgccttccatgtccaccagttcggtgacaacaccaacggctgcacctccgctggccctcacttcaaccccttcggcaaggagcacggtgctcccgaggatgagaaccgccacgtcggtgacttgggcaacttcaagaccgatgctgagggtaacgccgtcggctccaagcaggacaagcttattaagctgatcggtgccgagagcgtacttggccgtactctcgtcatccacgccggtactgacgaccttggccgtagtgaacacccggagtccaagaagactggcaatgctggtgctcgccccgcttgcggtgtcattggcattgctgcttaaacacatagttctagtcaatctaggatgtgaagtgccgggtcagaattggaacagtcggtaaggcaaactgggaagtatcttggtgatgctcaaaagttgatctggacggatcttctatgcggttcctggaggactgataggaggtctctggtcctggcgaattcaattctagaaattgtataggaatgatgacacgagttgaattttattcgatattat

SEQ ID NO: 7191 - DNA, 696 bp, Aspergillus oryzae
  misc_feature (1)...(696): n = A,T,C or G
ggatgtgcacgaggggcgatatctacactgctgttatagactactacctctgtccttgaaaccccacagcctatcatctcctattgtcaaaaaccccacccattcaacatcatgcagaaggctgcacagcagtcttgggagctcgaaaatgccatcagcctcatagatccccaacgagacgccctctaccagtacgatcaagaaacacacaaagccctcagcgcggagcgcccatgggccaaagacccccactatttcaaatcgataaggatctccgctgtcgcgctactgaagatggtgatgcacgcacgctcaggcggatctctcgaagtcatgggcctaatgcaaggctacatcctgccagaaacctttgtcgtaaccgatgcatttcgcctcccagtcgaaggaacagagactcgagtgaacgcccaagacgaagcaaacgaatacatggtgtcttatctccaggcatgtcgggatgcgggacggatggaaaatgcagtcggctggtatcacagtcaccctggatatggttgctggttatcngggattgatgtcaccacgcaagatatgcagcaactcggcgggccgtttgttgccgtggtcattgatccagagcggaccatttccgcggggaaaggtagatatcggggccgttagaaacgtcccttaaggaatatacgccacccaaagaag

SEQ ID NO: 7192 - DNA, 632 bp, Aspergillus oryzae
gcactactccatcatttccggctggttcggcgaccacatgctcatgcccccaggcaagttcttcacgatgttccacttcctggaataccctttctcccgcggcttcacccacatccggtccgccgacccgtacgatgcccccgacttcgatgccggcttcatgaacgataagcgcgacatggccccaatggtctggggctacatcaaatcgcgcgagaccgcccgccgcatgagcgcctatgcaggcgaagtaaccagcatgcacccacacttcgcctttgactctgcagcccgggcattcgacctcgacctagccacgacaaaggcatacgctgggcccaatcacatcaccgccggtatccaacacggatcatggtcccaacccctcgaaccaggccaaacccccacagaaacctacctcaactccaataagcaagagacccgggaaccaatccaatacagcaaaaaggatatcgagcatatcgagaaatgggtccaacgccacgtcgaaacaacctggcactccctcggaacctgcagcatggcaccgagagaaggtaactcgatcgtcaagcatggcggtgtcgtcgatgaacgtcttaatgtccatggggttaaagggccttaaggtc

SEQ ID NO: 7193 - DNA, 690 bp, Aspergillus oryzae
tattttccattttctgtactgtgtttggataagagacaactttcaaaatggctacggcagtctctcagggggccgctggcaacaacgccttcaaggacaaggagaagcctatggctgtgcggacgtccaacattctggccgctagagccgtcgccgatgccatcagaacgtctttgggacctagaggaatggataaaatgatccaaacacccaagggcaacacgattatcaccaacgatggaaacactatgttgaaggatatgagcgttatgcatcccgcagcccggatgctcgtcgacctgagtgccgctcaagatgttgaggctggtgacggaactacatcggttgtcgtaatcgcaggaagcttgctgggtgctgcagagcgtctcttgtccaagggcatccaccccaccgtcatctcggagtcattccaaagagctgcagccgcagccgtcgagatccttcacaacatgtcccgccctatcagcctggtcgaccgttccactttactccaggcggcctctacgtctcttttatcgaaaaatgttttgcagaactcccgcctccttggccctatggccgtcgactcggtgctgaaggtcgtggatcctaagactgctgagaacgttgacctcacgaatattcggaatgtttagaaaggttgccggcccaattgaaaattatgtaagt

SEQ ID NO: 7194 - DNA, 628 bp, Aspergillus oryzae
gaatccgatgttgggttctctcctacttcttgcccccttggcgggagctgccgtgattgggtcacgagcggacacccagcagtgccctggatacaaggcatccaatgtccaggaaaatgatcggtctttgacggccgacttgaccctcgcaggaaaaccctgcaacacctatggcaccgatctgcataacctcaagcttctggtagaataccaaactgatgagcgtcttcatgttaagatatatgacgccgaagaacgtgtataccaggtacctgaaaaggtgacccctcgagtagacagtggcgatggttctagtaaagactccgcacttaaatttgaatacgaggaagagcccttttcgtttaccgtgaaaagagatgatgaagtattgttcgacagctctgcggagaaccttatctttcagtcacaatatctgaagcttcgtacctggctcccggagaacccatatttgtatggtctaggagagcataccgaccccttacgcctttctactaccaactacacacgtaccttctggaatcgtgacgcctatggtacttctgcaaatagcaatttgtatggcactcatcctgtgtactacgaccatcgcggtgaatccggaactcac

SEQ ID NO: 7195 - DNA, 491 bp, Aspergillus oryzae
gcaatcaccttatccctttgtctttttacttaaaacacatctaaacaatggctacccccaaggttggaatcaacggcttcggtcgtattggccgtatcgtcttccgtaacgctatcgccagcggtgacgttgatgttgttgctgtcaacgaccccttcattgagactcactatgctgcctacatgctcaagtatgacagcacccacggtcgcttccagggtaccatcgagacctacgacgagggcctcatcgtcaacggcaagaagattcgcttcttcgccgagcgtgaccccgctgccatcccctggggctccgctggcgctgcctacatcgtcgagtccactggtgtcttcaccaccaccgagaaggcctccgctcacttgaagggtggcgccaagaaggtcatcatctctgctccttctgctgatgcccccatgttcgttatgggtgtcaacaacaaggaatacaagaccgacatcaacgtcctctct

SEQ ID NO: 7196 - DNA, 681 bp, Aspergillus oryzae
  misc_feature (1)...(681): n = A,T,C or G
ctggcagccgcgcggacgagatggttgggtcagcatagtcatgccaagagaatgcataccaatgagtaatcgcaaagataggcatttcgaagcatatcaaggtgtcctgaatggcagcggcgagattgtcaggagtgtaccccgcgacaccgttggataaagctccgagccactgcaagatggacaagaagaaaccctgccagtaggaggcgaagataatgagtttgacgcaaaggaactttggcacgggacggaatggcgccaggtcgttgtgaaggcaaacccaaaacatcgccagcgagtacaaacttatcgtgacgctaacattatacacaatccctgtccagaggtaaccagaggttaaccctaagtagccctcttgatagctatctgtggctttcataatgatagatacgatagctaaaattggctttagccatgtatactgcagaataccgcgcttcacggccaggaaggtgtgcgggtcggatatatcgagcttgggcaggaaatggttcagcggccaggcatgttgtacgggaggacgaccgtgggtcattatgatcaaggctcgctcgccttcgagaaaatngatgagtaactggaagaaagtgtagatggtaaaggcctgaaggtgactcgtcagttatgttcatagctgcctagctcgccagtaatacn

SEQ ID NO: 7197 - DNA, 654 bp, Aspergillus oryzae
ccgacaactacgaaatccccaggctgaccgccataagactaaattcatagctggcaagatcattcctgctatcgcgacgaccaccgcgctggttactggactcgttgccctagagttctacaagattatcgacggcaaggatgacattgaacagtacaagaacggctttgtgaatcttgcacttccgttcttcggtttcagtgaacccattcctagccccaagggcaaataccagggcaaggagggtgaagtgaccattgatcagctttgggatcgcttcgaggtggacgatattcctctgcaggacttcctcaagcacttctctgacaagggtttggaaatcagcatggtcagctcgggagtgagcttgctgtatgccagtttctatcctccctcgaaggtgaaggaccgtctcccattgacgatgagcaagttggtggagcatatcagcaagaagcccgttccggaacatcaaaagaatatcatctttgaagttacggctgaggatacaacggaggaggatgtcgagatcccttatgtgatggtgaagctgaggaagtaatgtgccgcatctacataaaatctggccgctagaatatggcccctatggtacctcaagtttataaacaatgatatatgacttttttcttcttc

SEQ ID NO: 7198 - DNA, 669 bp, Aspergillus oryzae
ggaagactcactaatctaaaaccttttattaccccgtcaagcatcagctaacttaccgcaaaactttcgagcaagcgcatcaatcccaatcccagccatgtcttcagctgaggctgagcgcgatccgaaccccgccgaactggccgaccgcgagcgtgaggaaaaggagcgcaaggccaaggaagacgccgagcatcgcgaagctgccatacaagtggtcgcacacaatcaaagacgtggacgtgacgattcctgtgccgggaaatcttagaggaaaggatctggatgtagttttgactaagactaagatcaatgtggcggttaaggggcaggagcctattatcgagggagatcttcctcacccggttatacttgacgagtgctcatggacgctggagacgacatcgcaaccgcccggaaaggaggtggccgttcatctggacaaggtgaataatgtcgagtggtggtcacatgtggtgacttctgcgcccaagatcgatgtcagtaggattacgcccgagtcatcgaagttgagtgatctggactgtgagaccatggctatgggtgagaagatgatgtacgatcagcgccagaaagataatggtggcctgaacagcgatgagcagcgcaggatgggtcatctgaagaagttccaagcggaacatccgt

SEQ ID NO: 7199 - DNA, 507 bp, Aspergillus oryzae
gtttccctttccacacagattgactgacagctaccccgccacaccaacagacacatctaaacaatggctacccccaaggttggaatcaacggcttcggtcgtattggccgtatcgtcttccgtaacgctatcgccagcggtgacgttgatgttgttgctgtcaacgaccccttcattgagactcactatgctgcctacatgctcaagtatgacagcacccacggtcgcttccagggtaccatcgagacctacgacgagggcctcatcgtcaacggcaagaagattcgcttcttcgccgagcgtgaccccgctgccatcccctggggctccgctggcgctgcctacatcgtcgagtccactggtgtcttcaccaccaccgagaaggcctccgctcacttgaagggtggcgccaagaaggtcatcatctctgctccttctgctgatgcccccatgttcgttatgggtgtcaacaacaaggaatacaagaccgacatcaacgtcctctct

SEQ ID NO: 7200 - DNA, 677 bp, Aspergillus oryzae
  misc_feature (1)...(677): n = A,T,C or G
cgtggttcggcaattgtacaaggagggtggcatccgcagtgtcttccgtggaagcgcaatgaccctggcccgtgatggtcccggctcggccgcctacttcgctgcttacgaatatatcaagcgctccctgacacccaaggatgcgaacggcaacgccaccggccagctctccatgcccgctgtcctggccgccggtggtgcggctggtattgccatgtggattcccgttttccccgtcgacaccatcaagtcgcgcttgcagagcgcccccggcaagcccacaattggcggaactatccgcagcgtctacgccagcggtggtttcaaggccttcttccctggatttggcccggctttggccagagctgttcccgccaacgccgctacctttgcgggagttgagcttgctcacaacttcatgaagaaattctttgacgacgagtgaacgcgagttcaatcgatttagcgatatctgacagaaaaagaacctcggctatggttttgtagatttattgttgattttatgtctcaaatttggcgttcctgtgttttttgtttgtttagatctttgagcatttagcgcctggatttcctgtttccagaacttagacttgatgtttccttgttgnctagattggtttctaggaatacccatggttacccgcttgttacagctc

SEQ ID NO: 7201 - DNA, 795 bp, Aspergillus oryzae
ctaatcacactttcatccttacttggatacctcctttactccttcacaatggctcaggaacgtgctgccccgtaagtaacctggctgttatcgtttttgatcctcctgggtgacctaaagaccgtcaacatggactcaatcggggactgacatggcaattgactatagcattcgtctcggctctactgcccccaacttcgacgctgacacctccaacggtcccatctccttccatgactacattggcaacagctgggccattcttttctctcaccccgatgacttcacccccatctgcaccactgagttgggcgcttttgccaagctcgagcccgagttcactgctcgtggagtcaagctgatcggtctgagcgccaacggcaccgactcccacaagctctggatcaaggatatcgatgaggttaccggctccaagctcaccttccccatcattgccgaccccgagcgcaaggtcgcctatgcctatgacatggttgactaccaggacaccaccaacgttgactccaagggtctcgctctgaccatccgctctgtcttcatcatcgaccccaacaagaagatccgtctcatcatgtcctaccctgcctctaccggccgtaacaccgctgaggttctccgtgttgtcgatgctcttcagaccactgacaagcacggcgtcaccacccccatcaactgggctccccggtgatgatgttgtcatcccccctcctgtctccaccgaggatgctcagaagaagttcggtgaaatccgcgcggtcaagccttacctgcgtt

SEQ ID NO: 7202 - DNA, 542 bp, Aspergillus oryzae
  misc_feature (1)...(542): n = A,T,C or G
cttgattgcatcgcaaacccggacgaggggaccacctgccaaaaaggctgcgcaacccaatcttccaaaatgccatccacatacaagagggataagccgtgggatgtactctggatttggtagagggtagcatgactgtgaagaccacccggaagacttatgacccagccgcaattctcaaggcccgtgatcttatcaagctgcttgccagaagtgtgcctgtgcaacaggctttgaaaatcctcgaggatggcgtcgcatgtgatatcatcaaaatccgaagccaagtccgcaacaaagaacgtttcgttaagcgtcgccaacggatcctaggaccgaacggttcgactctcanagctctcgagctcttaacccagacttatatcctggtgcaaggaaacactgtctccgcaatgggtccttataagggtctganagaaagtgcgcaagtggtgaacgactgcatggncaacatccatcccatctaccacatcaaggagcttatgatcaaacgtgaatggncccaggaccccacattagcc

SEQ ID NO: 7203 - DNA, 689 bp, Aspergillus oryzae
  misc_feature (1)...(689): n = A,T,C or G
ggcaatcgagacagtaaacgttacattatcatttacaaaatggatcaatggcaaagggctgctacgagatgtcgaggttcaagggatacggggcgttgttgatcgcaggtatgtttattggtcagaagacgacttcgacccaaaatcctaccggcatgagcacaaccccggagacttcgagatcgattctttcaagatgagcgatgtgctagtcacggtataccagccagacaattttagaccgttttctgttagtatattctcttgcgacctgccacaactgagaaaacaatggctgttttatgacttcatgtcagccaatatgatgtcagggtcttttgacaattcgttgttcactattcatccacggcagactcacagtttcaccggagcacaactagacaacggggtaggagaggatggcagagcgagccattggaagaaacatagcaggatacgtattgatggtctgaatatcgatcatctaaaccgcggagtacaagggccattttcatggatccatgaaggaaccgtcgacatcgttgccgacattatgtttccaacagataatgatgaaagcctaaccaaggtaatggctgacatttatgatcgactagaagcaactgtcacatctactcattaccgngatgcattattggaaaactcagctcagcctggtgaaacttcta

SEQ ID NO: 7204 - DNA, 837 bp, Aspergillus oryzae
  misc_feature (1)...(837): n = A,T,C or G
gattgttcctgttagtcttctcagcctcacctcgaccgccttccagaaccaccggcttgctcgtctttttttccctccccaaaagcccatcatcttcaatcatcatcttagttacttacttctactactagtaccagttaccttgttcgggggaggggattccgcaacaatttattgtccccactcctttttaggctgctgtcaataataaaacatctccctgttcagcccttccatcctcagtgatttactacagctggccgggtacctgaaagtccaaagctccgaccaagggcatatcagcgcccaccctccactcaggtcgcgttccttataccccttcggtcagcgccccgtgttatcttgacgaagggattccgaagcgtcagcccacgtagaaaatggcccaacaacaaaatgacaatgtgatgcgaaggaagttggtgattatcggagatggtgcctgtgggaaaactagtttgctgagtgtcttcaccctcggttattttccgactcattatgtccccacggttttcgagaattatgtgacggattgcagagttgatggccggtcggtacaattagcattatgggatacggctggtcaagaagactacgaacggttgcgtccactagcatattccaaagcgcatgtgattctgatcgggttctcggtggatactccggattccttggagaacgtcaagcacaagtggatcgaggaggccaatgagcggtgcccaggtgtgccgataatcctagttggcttanagaaagatctccgggaagaccctctcgcgattgaggagatgagaaagaagtccctaaaattcgtca

SEQ ID NO: 7205 - DNA, 572 bp, Aspergillus oryzae
gaccttacccacaaccccgaattcacgacttgcgagttctactgggcttacgccgatgtctacgatgtcatgaacctgactgaagagctggtctccggcctggtgaagcacgtcaccggcggttacgagaccgttttccatacccagactggcgaggagtacaacgtcaactggaaggccccctggcgccgcgtggagatgatcccggccctcgaggaggccactggtgagaagttcccgccaggtgaccagctgcacaccgctgagacgggtgaattcctcaagaaggtgctgaagaagaccggcgttgagtgttctcccccattgaccaacgcccgtatgctcgataagctggtcggcgagttcatcgaggagacttgcgtcaacccaaccttcattactggccacccccagatgatgtcgccccttgccaagtaccaccgccagaacgttggtctttgcgagcgtttcgaggccttcgtctgcaagaaggagatcgtcaacgcctacaccgagttgaacgaccccttcgaccagcgtttccgtttcgaggagcaggccctgcagaagga

SEQ ID NO: 7206 - DNA, 661 bp, Aspergillus oryzae
  misc_feature (1)...(661): n = A,T,C or G
ggattgaatgtgttggttgcgccgaccttagtgcttatgacttaactgtgcacaagaacaagaccggagctcctcttgttgtccgtgagcctcgcgccgaacccctcaaaattgaagaatggcaggtcgacttagacaagaagaagttcggccctcgcttcaagaaggacggcaagactgttgcagccgctgtcgaggctctctcccaggaactccgggagaagttggctctcgatctggagcagcaaggcaagatcgaggtggatgtggagggcgtcagctcaggcaaagttgagctcgataaggaattgatcaagatcgagaagcggacaagggtagagaatgtccgtgaatacacgcccaacgtcattgagccatcgtttggcattggccgcatcctgtacagtaccctcgaacacgtgtactggtcccgagagggagacgaagcgcgtggtgtcttgtccttccctccagcaattgctcctaccaaagttctcattgtccctctctcgaaccatgcctctttccgtcctctgtcacatcgtctgatgatgaagatgcggcgcatgggcatctccaaccgggttgacgattccttggctagcattgggaagcggtacgcacgcaatgacgaaactggcacgccgtttgttttcactgn

SEQ ID NO: 7207 - DNA, 747 bp, Aspergillus oryzae
gtcgcttcatattgctaacgcggtttatctgaataggaaaggggcaaaaaaacttataaattatcttcagtcgatcgccttcactttaaggaccgcactttataaccccactccattgtctcctcaaaactacctcactacaaacgacaaacaattcattggtctacgagctcgtgttcttttacttttctttcatatttacatccttgtaacaagagttagagagcaacaatgtctactgtcgcgcaaaaacgtcttttccacgagtacaagaacctatccaccaatccgccagatggcatcaccgccggccccatcactgaagatgacatgttccattgggaagccctgatcgagggtccacaaggcacaccctttgaaggcggtgtttttgctgccgagttgaagtttccgaaagattatccgttgagtccgccgacgatgaagtttgtgggtggaggggtttggcatcctaacgtatatcccaatggaaccgtgtgtatctccattcttcatcctcccggtgatgatccgaaccactatgagcatgcgtcggagcggtggtcaccgattcagagcgttgagaagattcttatctcggtcatgagtatgcttgcggaaccaaatgacgagagtcctgccaatgttgaggcggcaaagatgtggagagaacggaggagcgactatgagcgcaaggttcgcgatgaggtacggaagggtttggggctgtaggagtgtgctcctaat

SEQ ID NO: 7208 - DNA, 685 bp, Aspergillus oryzae
  misc_feature (1)...(685): n = A,T,C or G
catctatcagaagctccttccccacatcccagaggctctccgtagtgaagatagccgcagcgtccacttccttgccttccctgaggtgcgtgaggagttgtttgatgaagtggttgagaggcgtgtatctcggatgcaaaaggttatcgaaatggcccgtgtatctcgtgagcgccgcactcttggattgaagactcctctgaagacgcttgtcgttatccaccaagacccgcaattcctcgaggatgtgaagtctttgcaaagctacattctcgaggaactaaacgttatcgagctcatcctgtcatctgacgaggagaaatacaatgtccagtatagcgttactgctgattggccgaccctcggaaagaagctgaagaaggatgcccaaaaggtcaagaagtctttgccttcgctcaccagcaatgatgtgaagaagtttgtctcagacaagaaaatacttgttgatggtattgagcttgttgaaggcgaccttatcgtaagacggngtgtcaaggaagacgcatcatccgagggtatggagcccaacgccgatgacgatgtgttgaccatcttggatgcgaacctgtacccggagctggcgcaccaaagactggngccggaaatcattaaccgtctgcagcgtcttcgtaagaagcccgcttagttcccactgacgatgtan

SEQ ID NO: 7209 - DNA, 739 bp, Aspergillus oryzae
  misc_feature (1)...(739): n = A,T,C or G
ttctctacatggagtcgtggaccaagattacgatagccgtctagctacttctatcctaattgcccatcaatatatgcatcactctcgcgcctgcatgctgtaaaatacacgacttctcatggggtacgaagggatactaacgtgatcaacaccgacctgagtgcggcgcgcataatccacgggtccattgacgaagtagacatgccgttggaccaattagatgttgacagtggctacgatgcagcattgcgcaatctccgggatcgagaggaggtgcccgagcccccggtctcggaaagtcagctgcaagaagactactaccgggcggtccgtacctacatggtctcgatctggatggttgccaacgtgatcctcgccatggcggtgtccgaggtctacggagtggactcgggcggcactaacatctacctcgccatcatcctggggtccgtgaccggactggcgttgatccgtgtgatcggctcgacgacgtacgctattttgcacgtggtgcagaagctggtggaaggaaaagccaagttcgacgcgggcaatcttgcccattggcacaggagggcgaatttcaatgccgggaacggcagcacagtgcagtatggcggcgggggcacgtttatagataagtcaccgaggcgaaatgggggatgaaancacacgtgggggaaagtatggttttggcgaaaagaatcctttctgtgtccatgctttgctttttgaagaa

SEQ ID NO: 7210 - DNA, 678 bp, Aspergillus oryzae
ggaactgtaccccggtcaatgctctgttcaggtcatcctattgcttcttgccgtcgcgcaagtacccgtcatgctcctcttcaagccgttgtaccttcgctgggagcataaccgtgctcgtgctcatggatacagaggtcttggagaacagtcaagagttagcgcgctcgaggacgatggcgatatggatggcggactcaatgggggccgcggcagcatggccagcgagggtgagggggtggctatgattgcccaggaccttggagaggaggagcacgaagaattcgacttctctgaaatcatgatccatcaggtcattcataccattgaattctgtctgaattgtatttcccacactgcatcctacctgcgtctgtgggctctttctctggcccatcagcagctttcgatcgttttgtggactatgactcttggaggtgctttcgagcaggaaaaccccacccttcgtgtaattatgattgtcgtcaccttctacttgtggttcactctgacaatcgccattctctgtgtcatggaaggaactagcgctatgcttcattcgcttcgtctgcactgggtcgaggctattagcaagcatttcatgggcgaagggataccatttgcttcctttagcttctaaggcgctcctcaaagaggatcccggtgactgatttgaac

SEQ ID NO: 7211 - DNA, 679 bp, Aspergillus oryzae
  misc_feature (1)...(679): n = A,T,C or G
aggaattttttttttttttttttttgccttaagaacaaactctgtttcttgtaatctcccccagccagactgcactctggctactatatgtgaaacctcaaaagcatgtattatcaaaccctttatacctaatgggcttataaccatgggcctacatgcccttgcttaatccggtcctttaaacccgggaacgtttccatcgccgggtttatcgattgaaaccaccacccgtaaagcaacccgcaaaaatggatccacccgattagaaccccaccaaccaaggttaaaccagcaaaaatatgaaccgtgtcaagtggacccaatcgtgccattgggatcactctagatccttgaaacacagggagaccattgcggtataggggctctcaaacgcatatcgggcaatctgagtgacaacaatcagggcagggagaaagggagaatnagactctaaagtgtacaacaaacagggcgacaagagaaaagaatctatgggcacataatatcaataataataatactacaagtctcaacagaattcaataaactcctgagagttgtcaaaataacgcaggtgaaaaatttgggtatcggttaaaaaagaattgccatcaggggtattttacaccggaaaaagtaaatgggggtcgttgtggataaggaaaaatttgtcttgttt

SEQ ID NO: 7212 - DNA, 588 bp, Aspergillus oryzae
  misc_feature (1)...(588): n = A,T,C or G
gaatcagccgatgatactaatgcagcacgaggtgaactccttagagcttccaggctgctttgggctcacttgagccaatggccaactcgatccaagccacaactcttaggaggccgctccgttctctttgccaacatgccaatatgagggcctcatataccaccaaaacctactatttacccatcagtgctgattttcgaagagcttcactgaaaaacaagttggatgaaagacgtacattatcatgtaataactcaccgtcttcacgctctattacgaccaaaatcccacaagctgtggcccgaggccgagcttcgtacagcacggaagccaccgcggccggggagcctaccattcacgccgtatttgagacgaagacaggtacatggcaatacgtggtcgctgacccatccactttggctgctgtcatcatcgacccagtcttggattatgacccagccagccaagccgttaccaccttcgctgccgattcactactctcattggtcaaggaaaagggttacaaagatcgacaggatcttggagactcatgcccatgcaaaccatntcactggagcgtcttatctn

SEQ ID NO: 7213 - DNA, 688 bp, Aspergillus oryzae
gcaaatcttggagcagcgacgtcagcttgcacaacagcacgctcggtagttgcgtttcttagtctactttgaggattccctgcaattcctgatgcggagcccggaagcgccgggcccagatgccacatcatattaccacagccaagctactcctatgtccagatggccgattctcctcgactcagccctccttttgctttaggattctcatacccttgcatctgaatggctgctatattcagtggcatcgtcttccattttctttgttgacgctgtcaagtccgaatttcgcaggcaaattatttggaacagcgtccagctatcaaatttcacgagtccagagacgtgtgggtctcccttcaaaagccaagaaacgagtccgggatagcaatggatggaaaaacccatcgagtgcattagcgtgaatcatctccactcgggatttgcaacggttgaaagggatctggtggtaaacgccggccactacagcattctgaggatcttgtgcggtgaagtcctggaaagagtaatgacctttagcttcactttgacccttttagcttcaaggtttctttccccacactcggccgcctcgtgctcaacactagtgagaaactttcctattcattcacggtcgagatccttcgtggaactgattcgtgtctacgtccacacggccgatatcgtt

SEQ ID NO: 7214 - DNA, 650 bp, Aspergillus oryzae
aggaattttttttttttttttttttgcgaccaagataagtatatttggtttgctaaatgtgaatatatagaggaaaatgaaatgatcgtatgtgatagtataattctgggtatagtgatgaaccaatttgaaggaaaggaaaaagggaaccaagggaaaattatttaaaaaaaaggggttggattcccttttttccttatccctgtaacccccctttttccaattggttttggccatccccagcaggtattgcaaccggggaaggtttgctctaaacctgcctttggcacggtcaaaaaccaggggaatatgggcactttatccgatagtgtcccacacatgtcggattaagcgcgttgaacacgagggtcaatttgttgaatgttcacaattttgcaggtttttcactcgcgtctctggaccaacaagggtcaatgttatcgaattaaaactcaatgggcaccattcttggctgctcgtatagtggaaccgggactttgaactttggacgtccccaaatcgataaaaagcccctgatccgttggggaccggaatgatccatggggcattgagtatcgcacttgggaccgtttcctgggaaatggcgtttaaaacccctcagggggggccggaaacgggggccatttgcg

SEQ ID NO: 7215 - DNA, 688 bp, Aspergillus oryzae
ccctctcccacccatcaatgttttctaaactgcgcggctcgctctctaagggcttgccgcgtgctggggagaaagctgcagcatattactgcccgtcctgcgcaacacggagacggaccctgtccacgcgtcggaacggcatcgtttctccccggctagaagctaaacgtctctctcttttctcctctcgtcccatcactacatcgtctgtgattcacgcccgacatgtgccaccgcgcttgagggagctatatgaggcgctgaataagattcaaggtgtggccacggagcaggtgaatatcagccgattgcagcttgctttgcgcggattggagagtgaaacacccataatccgtgttgctgttctcggtcttaacgatgcgactgccgcgcggaagcttgtgcgcttgttactcgccgatccattaaatacaagggagagctgggaggatgcactggatgcctacgactctgatcctacacagggcttgctgattcgatacggcgaagtatcagagtccattccgaacaacctttctcctactatctccgtgccctcccctatccttaagaaaggcaaccttgaaatcctaatgtctaccttaggtgctgagacagagttatcggatgccccatttacgggagatacattccttgtcccacagtggagaatccgacttcacattcc

SEQ ID NO: 7216 - DNA, 616 bp, Aspergillus oryzae
caactgcctctttcctccctccctccctacaacaggacctcccctacacaattcaaaaaaggggcaagatcacaattcccacattcctccctcattgacgcgcaataagccaaaccaacctcgctcaattcgccttctggttctgtggctggccggaaatccggggaaagcttgtaaacttcgggcactccctctcccgacttacttcttctttcttgagtttttttttcttgtttactgggttgattttactttttaggcccggtgaaaaaggttgtatattatatggttctcttttttattttcgtttcttgacgttcgttttttgagtgttgttttggggggtttactatcgttatccatgacggtgcttatctggacctgatcttttgctctcatgaagcgagtacaggtactaacatagcttttgcaccatgtcggactctgtggatcgagtcttcgtccacgccctcaacaccgttaaacgcatcccccgaaccggtaccgcccggccacccgcctccgagcgattgaagctctatggcttgtacaaacaaagcatggaaggcgacgtggagggggtaatggaccgaccggtcgggattacaacggacgt

SEQ ID NO: 7217 - DNA, 655 bp, Aspergillus oryzae
cggaagagagataggatatgcagacattaatgtccttgaggaagaattccgccaaacggaagcccgtgctcaactagacgaagaaagacaagaactggacgactacattgcaaaagtgttcaatccgcgtggatgaacgcctgcataaagagatttctgcactccatacagaatacgactcagagcatggctagcttgatgatgagaatgataatatcaacaactcaatgacaaaccaatagaatttgtctcacactagtctcacactatgtgggatgtaccatgggatctaacgctcgcttgcagctcgctctcaaaatcgttcaggaatatctctagccagtgaagatcgacgaaagaaagcctctagattgcatcgaagattcattggagattcagtagctctctagcaactggatcgggagtttgaagagatggatattcgaaacagtttaaaaacgggaagagaccgcgatgagatggcgagcatgattctaggattcaattcacgatgggatgatgcacggactgggacataaccagaatcttctcgacgatgtttctgcgaatatggtcaagatcaatgccgcaaccaatcgatcatccaccttaatcgaatctgacatgcaacaaatcttgagaattgtgtataccg

SEQ ID NO: 7218 - DNA, 684 bp, Aspergillus oryzae
cgtacgccaggacagcaacggtgttcagtggatcgctttcgagtactcttgggaccgtgtgaagatggaatacaccattcgttgtgatgttgaatccggtgacgtggatagccttagccaagagttcaagacggagaattgcgtgtatccccgagcctgctgcagtaaggaccaatacagaggtaacagactactctacgaaactgaatgttatgctgttggatgggctttggcatagcttaacccagcattgaggggaaagcggagcttgattcaacgtgcggttgacagctggaggaatagcaatcaagatccacgactcttaagcaggcgtgtgagaaggatggccaagataaatagacggcaagggctgccagcacaaccaccttgctcatatggccactgctaccacctgttgaacccggtgttcctggcgctagcctgacagcttccagtccacggtcgtaattgggttctctagccatgggccctccgcaactgcataaccaccatgcttcacccgaggggaatacgatgtatgaggaagttaacgggatgttccaccaatatgattcgtttttcccccctttttaagaatgataaatgggggggttggcttaatatcatgttcctccatttttatttataagccccgggcgggaggattcctttttgaacaaaggg

SEQ ID NO: 7219 - DNA, 688 bp, Aspergillus oryzae
ccccgtcccatcctcgtcacagcaaagcatcaagaacagctcgaacagctgctcaacgctttagtcaccgccatcgtggatattgtaaaacggtggtggacggatctggatgcccgattccccgagcgcatgcctctaacacgagatgaagaagatctgctgcggtggctcgagcaccaacattcccataacggggtgccctacgaggctcgtctgggctcttggagaccggactttctggttggggactacagcggtggaccctcgacggaaacctaccgtctcacagagattaatgcacgtttttgtttcaacgggtttatgcaccaagcatacggacaagaaggcctgagcgaccttggtgcggggaggaatggcctcatccatgcgaccgattcttcaaagatcctagatgggctgctcagtctcttcaatcctgaccgcccattgcacctgctcaagggtgaagagccgggaatcgatatccacatgtttatcgacttcgtgtatcgtcacattggaatcaagccccggctgatcacccctgcagatcttcggttaaattccgaaccccaaaagtaaaatgggtctaagcctctgttgtttgggtaaaagatcaacagaatgcttcgcttataaatggatacccttttcctgttaccactaaaggggagggtgtggaaaaagc

SEQ ID NO: 7220 - DNA, 622 bp, Aspergillus oryzae
caaactttccagcgcgacatctaccagcagaggggaattctcagcgcaacaattgcaccagactattgatcaatatgacgagtacagctccgacggaatcccaaaaattcctctccaccacagggggggactatcacctatcaatgatacctttgaattgacggcatcagatagtctagagacaaatgaatacgttatgtaaataccacaaataattggcatcgtatatgcctcagcgatacgtgtcatgatcgtgaacccgcgatgctataaaaacaggtgagaatagacaaacactcagaacacgccggtgacatgaccacgtgatatatttataacagaaacatctgacacgatagtcttgtatacgatgtacttatgatacacacgatattcgtaactttgtcgacacaagtctcatgacaatgatatatcgacatgccgagagataagagtgtcgatcacgatataatatcgtgatgaagtgttctcatcatgccagcgaatagacatctcctcattagaaatccttatagttgacatatcttcgtatgcaatcgtgatcatgtcgaatacttgatggagatgacgttaattataatttcatcatcgctgcatgtcc

SEQ ID NO: 7221 - DNA, 628 bp, Aspergillus oryzae
agatcgatggttcgtatctacacaagcggtcagtgaatgtggttgacaacgatccttttgcaatgagcgtctacacgctcaaggaattgatctggagggaatggggacaagattgggaaccgcgaccatcatcgacgagctacattcgactgaactcgtttggtaaattgctcgacgataaagcgcctctcacagactccaaattcagccgtgaagcccctaatgtggtgcacatgacagtcaaacctcaggaacttgtcgatgaggatgacgcaaaaggtcctagaccacagtacccgcgcgaacgtgtagccagtggacgcagaccggggtgacgttgtataaaccaacaggctcattggctcctgcttatgaacataccgatcatcgaggttgtatccttatccagctctcgacgtaacctggtcttccggttctgacagtgcacgtccgtggtctgttgactatcacacgatgtcttgtctagctgggatactcttggtggccatgtgctcagtacgtcgcataatgccagccgtctatcctgcgtttggaatgctctccatgtacatgtgagcgctttggcacggcaatcggacagtgcccttgatgtcggatatctacgttg

SEQ ID NO: 7222 - DNA, 303 bp, Aspergillus oryzae
ttcgctgtctaccgcatttggtggtcgttctggttcaacttcacctacttcaccttctcttcttcatagcttttctatttttcatattctttgattatctttatccccatctatcgatcccatagcgtcctgcgattcgccgtgttgaatatcgatctatcttccctctgctttttgtcggatttgcagatacccgtctacgttgcttttcccaccgccaacaacaacccacctcctcataacgccctaaccgttctccattcgactgttcgcccgccgcgcatctcttgtcactgcaattgc

SEQ ID NO: 7223 - DNA, 303 bp, Aspergillus oryzae
aaactccagaatcactcagtttacatacgtcggctagccgtcttcaccgcaacatctggttatcgcaagttacttcgctactacgtaatcagcatacccgtgcccctcctggccttcctgccttgagttgttcggtatttccagcacttctatcgcaacaaacaggcccagggagtcaagacattaataggtatctaagatggccgatgtggagatgaaagaagcgtctgctggtgcttcagccaagggaaagggagcatctaaggcctccgaaggtgcgagtgatggcaaaaagaagttcga

SEQ ID NO: 7224 - DNA, 673 bp, Aspergillus oryzae
  misc_feature (1)...(673): n = A,T,C or G
cgtctcacgtccgattcccaaacgtccgattcacctctcccttcaccagggcgtacgattggtactgcgcgatctgcggtgttagcttcaccggcatgcacatcgagtccccgtcggaaaccgcgatcgaacgacgaagactgtggattgagaagagatgtcgggcgctcgaggccggccaggacatcagccaaattcctaccgaagaaaatgatgcccccgtgcgcagctacgaccctcgtttagtcgacaccgataacatctcctggctctacaaggcatactgcctgggatcgaatcctccctccggtacttcgaagacgaacaaagcgtttattgctggtccgggatattatgcggatattggagaactagtggtgaaaccccgcaatgatcaatatcagccgtcgtcccggaaaaccttcatgtgttatgactagggaacctgagacgcagccggcccagtccttccattccattggagctgtttcgaaatcttgacccgagtcctcacgggttccaccgagatcagccgtgtcaacctcaaacgctcttacggtgtcatgtccggtttgaccaaccattcctcgttgcatctgaactacggaaacgatatttcacggtcgcaaggcccgtactgggaatgcattcctggtgcanagtactgtgccca

SEQ ID NO: 7225 - DNA, 712 bp, Aspergillus oryzae
  misc_feature (1)...(712): n = A,T,C or G
gtgtatgccgccctcgagtcttggtcttcttttcgtttctccctcgcatctgttggctatttgcacgagtgtttcgcacactggtctggattgtggctgactgctttccttcggatacttcagatcgttgtcgctgtcctggtgctttctgagacgttgtaaagcgaaggaggaccggtcaacaagcagagcactcgcgtcaggagtcacattaccttctacctcaagtagcttctgttttcactcttccttccgggaccgcggtagaagtttctcttcacaccacatcggtgtttctgcgaaattgattgtttcccactgccggtttccttgcaatgcctcttcgatctcttaacttcttccagcaacaacccacttcaactcgctttccatcgttattgaactttgagtcagggttgcgatcaccttcttatgcgaaattaataatactctacctattgcctccttagtctcncgataaagccgtaaagtaaaataatattctgatttgtctaattcaacgtattcttatgtaaccaatgttacactaattgctacatatgccatcgatctctaataccgttccctaccttattatgaaggtgatggtagcaacgtcgaaccttaaccaatagccctaccgtgttatcatactcatttgtaatgtattctctctctttaacgttatgccttcctataagtgatgtcacgg

SEQ ID NO: 7226 - DNA, 672 bp, Aspergillus oryzae
  misc_feature (1)...(672): n = A,T,C or G
cagtcctctggcaatctcttgtaaagtaataacgagaagcataccagtcctcccacaacgagcaggttgctaacaccaaatcctgaagcttcgcgttccatcaaatcgaaaagaagagaaagctctctacttttcatggagtcacgagattgacgattgttagcctgatcgcctgcgtcttgtccgctcagccagctgcaccgaggagaatctgagcggtccactttatatatatgttctgcctttatcccacccgcacaatcacctcaccttgtcgttgatattgcaaacggacattgcttcaacgaccgaggccatcatgatttaaacgaactataaatgactcgagcatacagattcagccaagcgtcaaaaggggaacatctacaaccaatgataatcaccaaagatggctcttgcttttctaatctcacattacttacacaacctacattnttgtttgaactttctcccacactagcccgtccttgttttaaacgacagctatcttttggtcgtactcaatgcanggaagggctctcgtatgcttctatcggntatgacatgacttgcacatacctatttcctaccggctggctaaatcgtggtctggtcccccttttttctcaaccttcgccggtttctctctttgtctggtttcaatcgcgccgc

SEQ ID NO: 7227 - DNA, 304 bp, Aspergillus oryzae
ccgtcgctctgaacccgagctgatcgtcaagccaccgtgcgtcgggctgaatcagtcgcgccaagacgacgcgatagcctcctcactgggtctattaacacgtcactgttcagctactattattacctactcgtctagccgccccaaagtatcgctaggaaactttccgcttcgggcattgagcttatcgcggggttataattgtgggattgttcaaggcgaaaggcgttttgctttattaggctgcacgttgatgtataggggtcaggtggtgattgactatttgagtcttcgtccctcgtgt

SEQ ID NO: 7228 - DNA, 683 bp, Aspergillus oryzae
  misc_feature (1)...(683): n = A,T,C or G
cttcaaattcatttcgcttttcattctccttccttctttatcctttttttgattcctcttaaccctacatatactctccactttctagaactccatctatcactatggaagcgcttgtggcccaggccatcaaggacaccgcgacctttcggaagacgtcggtgccatggaccttggacgagccttatacccagacttactatggttttgaccccgcaacatctacctgggtctccaagtcgccatccgccctcggaagctcgagtaagaatgataatgatagtctagccaccacagctattgcactctatacatggaatatcgacttcatggttcccttcgctgcagcccgcatgcgaccagcgcttgcacatctgtaccaactcacgcgccttctccctctacatgtcgcccctgttatctttctccaagaatgcaccccttctgacttggaaacaattgctgcgactccgtgggtgcaagccaatttccatcttacagatattgacaccaccaattgggccaccacgcagtatggcacgaccgtccttgtcggcaagcatctgcctattacgtcggtttttcgggttcactactcccacacgcgcatggatcgcgatgcccttttttgtgacgtttctactgagcttgangagaagcgaatccgnctctgcaacacgcac

SEQ ID NO: 7229 - DNA, 304 bp, Aspergillus oryzae
cctgttcgatgatgatgacgatgacgtctccgaggtcactgagatggctgcaggcgtgtcgttgaactcatctgccgatcgctcgactcagagcatgccgccttccccaactcgcaatggtcatcttcagcagtcgccccacagaacccgttctgatccgaagatcgctacaatcagcggcgatgcccccgaggcgaaattgaccaacaaagagaagtacctacagctcttcaagctcagggaagaggacggcgagtatatccaagacgtcactgagatgacccgggtccccatcatcctgaag

SEQ ID NO: 7230 - DNA, 686 bp, Aspergillus oryzae
  misc_feature (1)...(686): n = A,T,C or G
catttccacttctctctctctaccttcaatttccacacttcccaacacaagtcacaatgaagacctctaccgtcatcggtttcttggcaatgctctccagccaagcacttgccctggagcttgagggaacgtacacagtcgcgtcagcgggaaccgagctttatctggaagacgcatctgggcaaattatcttcgaggagggagatcctcaggcatggttcttcattgaagcagagacggaccgatatgcgatcgtgaacggcgtaacgaaccagtacatccattgcgggtcaactgagggtgccatttgcgaggcctccgatgtcgcgcagcttttccagatagacaacatttccgacaatgtctacactttcctggaacccgagagccagttgcttttgcatcgtactacggataaccagctggatctttcgcttcctacccccaccaacgatgagagctttgagttgactcaggcttcatcttaaaatattgaacataccctagccaagggccgagaatgaaggagcgttgatacccgaacgtgagcttggtggctgtgctgcgactagaattactctgcaagaacttcaacttgttcagagtaatctaactaggttaatcaagccgttacactttatagatagtgcacgtattcggaatttccggatacataantngactat

SEQ ID NO: 7231 - DNA, 682 bp, Aspergillus oryzae
  misc_feature (1)...(682): n = A,T,C or G
gcacgacgagaccgactacggcggagagagaatcatatgtcagactttgtccaccgaactatgtgtgaacacgacacgccgaagcgacgcgatgttcgtttgatctcgacctttgaacctaatttaacgacctgaatccgctacacggcatcccctttactgattggtagggcttttcttcatctgttgttcgcgttattgacgtgcagttcttcaacacatgtccatatcgtcattgacgttccgtcgtaaacggaaacccaatagaaaggaggggctgcccttactatcgtgacatgtggtcgatctcatcaaaaacttttgttttgcgttcatcgcatttgtacaaacttacaaggggctggtacatttctacgggacacatagcttagccatcgattgtccagggagacatgctttcacgacactatcgttatcggatcctcacgatcgcagacagcacggctactagtccacgtaaatttaacggaagctatatgcgtcgtgccgttggtgccacgcagtctatctactaccatgcaacttatccggaaatgcccaggtctggtcaaagttataattctgaacgcctattatccagtcaatggcaaagatttctccaattaacggcgtcgtgttaccccttctttcatcgctagctccgaaaaggctggntagattn

SEQ ID NO: 7232 - DNA, 653 bp, Aspergillus oryzae
  misc_feature (1)...(653): n = A,T,C or G
tgccttcgctaaaccgattcacaacctcgaggagcgcgctgatgttgcggatgtcttgaaatgtgccggcgataccgtgcagaaagggctcagcgtagcgttggataatgtttctcagtcaaatatcaaactggaggggctggacgggttaatatcatgcatcaccaacgctgctgccgaggtcaccgatattgcgactattactcaggatccgttaggatggctgcactctttggactgcacggaacaattcttgggaggcgcggagggcctggcagaattagggcataacgtgcagcaagtggaaaaccttctctccgtggtcgcggcgcagactgtgggaggtatagtcaaatgtggttcttctaagagcatttgatttggattgtggctgatttttgatccttgttggtttttgtctgcggggaggaatgctggatcaagggttatctataataattcgaatcttttcattggaggtttcctgtctggttttgggactcgtttgtcgttatatacttacccttttttttctcctttntgctgtcctttatccttcgccatgtatatcttggtcctccactttgtggtcattttgtatagaatgggccntctacccgaattgaatatccatgcagtctttatgtttggag

SEQ ID NO: 7233 - DNA, 583 bp, Aspergillus oryzae
  misc_feature (1)...(583): n = A,T,C or G
cgaggccatcccctccgaacttaccggattctagaaagagggttgatcgtggggaaacaaccgattccctgcatcttgtctaacatttacccaccctttcccttttctcgagggcatacattgcataaccgcttgtcctccgctgcaactttctcccgaatatatcagcggctacttataaacacccaaagccccccttctgaacaagtcttcactatgtcttgtggtccttgcgccgtcctctctcactaaattgccgctctccggcgaattgatggcacacaactggtttcgcaaactggtgcgcgactgttgcgaaaagccgttgaaatagtgaatgactgatctggtcacctggaaatcaaattaaatcttgtcaacgcaacccaacggaccttgaggagaccctgaccactattgccaccaagtccgcagtcttcctactgcagtttgactcttttacttctttcgccttctccgacttttgntagcacttctgcagcttttgcgctggctctagaagcaggatcttcttgaggcgttaagcggggctaattcatcatctatctacttattgatcttc

SEQ ID NO: 7234 - DNA, 149 bp, Aspergillus oryzae
gcctttaaagaggggagtaagcaatatctctagtcctattgaatacgatctgcccgtatttaaaggctcacctagaaggaggacatatagcacacgggcagatcgtattcaataggactagagatattgaataacatttacatcaagcg

SEQ ID NO: 7235 - DNA, 687 bp, Aspergillus oryzae
  misc_feature (1)...(687): n = A,T,C or G
cttgaactgctctgtagagttaacggtccagaatcggcgtctatgcggaaaacgctcggaaccgtatttaccgctgacgtacatgataacgtgctatagatactgctagcctagatagggtctcggagggccaccatgcgcgcattgtcgcgcatgctagcgttggtgaatgggtactcgcggaccccaaagtattcacggcctgttacgcgaaggctggcttcgttgcaagagcctgctactgtgccacctgctccggaaccagccgacgcattccctgcctgcacggtcatggtgggtatggaaacaggggagtctgcnaagatgctcgactgctatgagaatgccttgcatcatctgcagcagcttaatggacgccagatggtcctagatctggtatagtgatcgcacctcggaagctatgcaagcattcttactatggacgctagcctctagctggagatatctcaggtcagaacggagatacggagaataccagtgctccatggtggtcaccgggagatggccacatggaggcgagacgactcacggaagagcagcgcatgggactgcttatccagatcgtgcgtatgctcgggacaattggaatcatgcncgacaagctgcaagaagtgggacatgattcttaagacaactgatacctaactcactgatggatgccttaaa

SEQ ID NO: 7236 - DNA, 660 bp, Aspergillus oryzae
  misc_feature (1)...(660): n = A,T,C or G
tcatattgtacgactcatttctcttcgtctttttatgattctagacgtcccaaactatgtctttatctacatcgtatacctgctcattctgtgggtacctgttgcacaacactcgtgcacttgctacttttgccgatgattttcattgtagccagtgcggcttgtcggtatccgaaggtaatctgcaaatgcaagaagacctcgtggcactcttctccaggcagatgcggatggatataccaatatcgtctggcagtcaggaaatgccatcgtccactcatgttccggtcgcgcacagtatctcccaacattatcatcactcctctcatgtggctcgctgcacatttccaacaagatcgccgaagcatgatgagtccttgggccatagcgtgactcttaactcagcacatgaaatgctgaggttacagaacatcaacccatcataacttaccttcacacaattaccgttatttgagaatgccatgccggaacaaccactacgcttgaatcaaatctggcaaatctttccagaagtttaaaaatgccttccccaactcaaggattaaagcgggtggaatcaaccaaacttccaactgtggtgcaaatctttttggggggacaaccggtcaataaaggggggtgaaaaccaattaacttttn

SEQ ID NO: 7237 - DNA, 648 bp, Aspergillus oryzae
  misc_feature (1)...(648): n = A,T,C or G
ctccattcctaaaacagccgtgttgttgaccatccttacttcgtcctttgcaaaatctcagagggttacaatcagtcaaaaataacacgtgactgataatgtcgctgatcactgacgaagtcctcaagggtctctgggatagagctcaggcgcaatcttcagacgaatgggcctccgccaagttatggtcttatttatggaacaaacacctttttgcggagaaggaatgggttgtctcctctgagactcctccggaggggcgtggccgtcgacgggtggatataacgatagaatattttggcggagatagtaaattagcggttctcgcctttcacgaggcaaaggcattgaatgcggggcctcaagatgtccaagatgccgagcaccaagcattcgacgcttgtatgagatatctcggagaacatcctgagctgncatttgtgtatgctttcacatcatttggcacaaaaggcagagcatggcggtgcgctcgagagggatattaccttttccctttgttcggcttagatgaccttgctgagcgtactcaggtacgtgagttacacttcttagaagccctattattcanaaaggccgtccaaatgatgaaggctgtgccgcatctgaataggactatgaagccttatg

SEQ ID NO: 7238 - DNA, 616 bp, Aspergillus oryzae
aacgtctttgaatattggaaaagaacgcctagtttgccatgtctgccgttctactgttctgcacttcaaaagtccgcgcgggcgttcgtactcccatacaagattccgagaccagttactaaatatttccagtctagtccgcaccccagaccaggaagccttagacgaatggaatactcaaacccccgtccaagacttcgacaccggctttgaagggaaaagcgacgccgagctgcgcagattcttccaagaccgcctcgataagcacactgatacccagacaacgagtatttctgactcatggcttgcggtgctggacgataaatcgccctcagagaacgcagtggtcctacactatacatacgacaaatcgagctggggaccaggcccgattcctgggccggcggaggtaatggatgatgtgatctggtggaagtggagggtgccattcaagtcagcctggacattctggaatgcgattggaagcgctggggccgatgccattgaaatctattcaaggcccgagtataccagctcggatggtgttctacagacagagattccagagaagatcattaatggggagattgaggatccacatgcttagcggcttctt

SEQ ID NO: 7239 - DNA, 694 bp, Aspergillus oryzae
tctgccgaaactttcaagcagttcataacctctggtaacctccgaataacgatcaccagccaatgaaacatggtttagacagtgactggttaatgaaacatcggagtaatggtatggagaatcttgctatcatgcaggaggcgtgggcctggtcagcagacccgcgccctgtcataatcaaaccccgggtatggctggacgactagaccaatcagtacgaaaagcttgctccaccatggcggatgtctccagggaagtttgtcgcattactccggagtaatgcattgcactgatgttctggtgactacgaatggcctcactcggaactttcgctctattccaaaagccgaggccgattagtattgtctctccattgggtccttaaagaggcatctccactgcagatcgacaagggccatagagccgagtccaatagaggacttcaatgttgggctccggggcacttttctgggaccctctcggctgttctgttgcctttcaaggctagtgaatggcggttcccactcgacaattgtccagtgtcggaaagccagctttcgaaagccgtcttttgtttcacttcatttattgagatgtccggagcatactccgtcagggaagatgcaaattgttgtacctttattaatgtctgcaaatgacgggaagttggctgatcatgtttggttgacccttt

SEQ ID NO: 7240 - DNA, 216 bp, Aspergillus oryzae
cccatactctggctggttttaccgaacgtgcgtagatcatcggtgatggaactcggccatcccaggctggataacgaggtgttgttgccagcatctttcgttaacgcttctgtcgcattgaaggagaacagtagtgacgggtgtgagcatccggttaggtttcgattttctgcatgcaggaatccctcacagtaagacatgacatatatcgagtag

SEQ ID NO: 7241 - DNA, 98 bp, Aspergillus oryzae
cgggggaaccaagaggcccggcccttctttaaggatttttccaaacatttgggcccaaaaacaaaggggaagcttgcgtgcaactggtcccgagaaaa

SEQ ID NO: 7242 - DNA, 246 bp, Aspergillus oryzae
ctgcaatacctaccaaagattgtgatcaccctcttgatcattccccatactcgtccctatcgcaactatgtcggccgaactcacaaaagtcgattctgccattgctggcttgtcaataactcctaagggggagaaagaggccgacaagacggcaaaaaagactcacaggcgccactcatctcagtcggagggcgtctggaacatcaaggacttggaggagaagaagatagagttgactctccccat

SEQ ID NO: 7243 - DNA, 629 bp, Aspergillus oryzae
gcatgtgcttatacaaccaacctccagcaatcaagagatacaatcggggaatcacgtccaggacggccacatacttccacaagattatcatcactccccacaagtagaacactgtccacattgaccatgatcacagtgtcatcacgcatcattgggacaaaattcgagtcaatctccatcacatgggtgtcgtccgtaagagtacaacaaccaaggatcacctatctcaacacggcttcatcaatttgagaacgcagtaccagcgtaaccatcatcactgtctccagatatgttagatctatccacagtctagacatgcatcaagcaactcagggataaatccgttgaatcagtctaactgcgcccggtcttcatagtgcgtctcgcgcgacaccagttatacattgctgttcataccactcatctcataccgattccagagacgatctgccaatgtctcagtcattacaccacggatgtcacaatgtccatggacattaatcagccatctcagtcacgatttcgcgctatcaagtgtctgcacctccgaaacaatactgatctgcattctcaacatatctcgcttgaccctgagctatcaccaggctcaacatctacactgagggtcg

SEQ ID NO: 7244 - DNA, 695 bp, Aspergillus oryzae
ccgagcccaggtcccgatttggctcgagggatttctggatactcaccactttatgagtcctgcagacatcagaatggttcgagagcgtatgataccgcacgatcgtaccgactatagccttcagaaaagtggccagattcccatgtccacgctctctggagcatgggccatgaccagagcagtgggacatctacgtcatagaggatttttacgcaacgcacagttccccgcccaacgtgttcgtggtgaccttctccgcctctatcggctattccgcacaatgctgagagactcgaggcaaagcctctcttgagaggatgatgcccgacctctcattcccatacattgtatcgcctatctgtatgggagcaccaatatagtgcgagatttagctgcgacagccacgcgatcagattcggccatacagcgtatgaatcagcttcgggccacttggcaccgggtcgaaccaaatgtgcttcgtttaagattagcacaaagtttcatttatcaagcttcatcccgggttgcctgggttccccagcggtgccttgacatcgtctttccagttatcggccaaaagccccggggaacccccgcacctgtaggcggttgtaaagggcaaattcagggtctgtattcttggtctcctcccgcacggctcggcgcacatcatcccttaaaaagggaactggaca

SEQ ID NO: 7245 - DNA, 736 bp, Aspergillus oryzae
  misc_feature (1)...(736): n = A,T,C or G
gcacaatcgaggtcagctactggccgagcaaggctttcatgcattatccacaaataaccccagcgaccgggcctttctccgcctttgcgcaatgggtagagtagcggataaacatttagcggaactgtttgagaaagcattcacagagctcccgcaacctacacaagaagagctcattactggactgaacgtcgacgggtgcaatggcgaagacgcggtaatcctctactatatgcccgcgatattcgcagaggctctaagggtcacccgtactgcatcagatgtaaagaaaatccaagttcttcagagcctcatgtcattcatggcacgaacatacaatgatacaaagccagttgatggacatcccggcgtcattcttgaacgtgacgtgtctggggcgaaggactatatacgaatggacggtttcatcgacgatcccaccattttggatcaatgcgttcctccagtagcgacgtattaatgcaagcctcctgcactttgctttgtcccgagagactccctaatgttaaggttcaatcagcattgatcagccgtcattcgagattaacgagaaatgaactcatgactntcgactattcttactccaaaccttgacgattcgaacctcgtgatctactgccgcacggaataaagttgttcgtcaattcttattcgacttgccttatggatatttctttaatatgatggcgccggacttactgtgaatgtgggctat

SEQ ID NO: 7246 - DNA, 182 bp, Aspergillus oryzae
  misc_feature (1)...(182): n = A,T,C or G
gctcaactgggccggcgcaggtggacagttttcagtattcactgagccagtggccctgtgagatagtcgattgtgcccataacccccgagaggtgctaaacgtctacccattgagtcatacacacagcatgtagtgatatcgggaagctatggcgtcttgcgtaaccaacccctttgctctn

SEQ ID NO: 7247 - DNA, 691 bp, Aspergillus oryzae
  misc_feature (1)...(691): n = A,T,C or G
gcaaggcgttccctgcggagcctgttgagcgctgccgtgttcggctgtttgagcgctccatgaccgtgaccgagggcactggaagccgcgaagtacaccaaggctaccggattgcagtcctcacaagccctaaggtcaagacgctcagtaatgtaagccacatcattggtcataatgcaccaattgtgtttggtcttctcagaggcgaagatggggcgccggctctcatgctcaaggccaaacaagatggcaggagtcggtccatgctaatgacgtttcacgacgtcgaggagcgcagtgctctgcattctctgctgctcggaatgacaaccaaagaaggagagattaagacacctgacatccctatccgcgcttactccatcgaacagcctgccgatcgattcaacggtcagccggagacaacccacttacaatttcctgctgggagtgtgtcggttattgatcaggaacacgcctttgtcgaccatcaatatggcccaactattctctcagaacatttacgagctttcgtggcgacagaatggggatctgtaacggaccgtatcaaccttggtcctgggcgagtgaagttggtttggacatcaacaaccgtacaggccttagtctgtaccggcctggacaacaggatctgnaccgttccatcgccgagaattcaccngctctgagatgc

SEQ ID NO: 7248 - DNA, 668 bp, Aspergillus oryzae
cagatggggacctgaacatatcattgaaacatgccgacccctcggaaggcctcacggaccctttactcttctcgaagtcgggcctagaccactccgacctatttacaccatttgatatcactggcgctgccaaggacccgttcgaggcattacaacagaatgagatgcttacagctgcttacctttcccagagcgctgacctatcagcccttgggtactcaggaggacatctacaggacaccggttcgatcgcgggatcagagcctcgcatccaggcttttgcaaaactggaattcgacgatggtcatttctactgcaacacatattcctttattctcgggcgagatgtacgggctgcccgggccgcccatcagcgcgaattgcaggtccgacaggtcatgagacacacccgcgcgaaaagttcaagtggtggaaatacgtcgcatactcccattcgaatgaaacatgaaggcagcggcataataggcagtgtcgtcagtgaccgtggtggaattatgggctttgaccctgatgttcctccacatcttccctctcgtataagtcggcgatcgtccaactcttcccatgccgagctgggagctccgatgcatgcgacgccggctcaactacagtcgaatacaactgattacaacgctcttgctatggaa

SEQ ID NO: 7249 - DNA, 486 bp, Aspergillus oryzae
  misc_feature (1)...(486): n = A,T,C or G
cgaggtggcctttcaaagagggtggatctgtctgcaccttagtactcagtgttgtaaccgaggcgaattggtggacttatctgatcgatatatcactcccctccatcacctctagttcagcacgcgaacgaccgacggcaaagtgtagcgggttgctaggcatagcaacagggtaggcatcgcgacctgctctctataagaagcacacagtctcgttgagaccgtgacttgaacaagtgtaatcagcttttcaatacagtaccaaagggaagcgaaaatgtcaaagatactaacgccatccctgcgtcagaggttagttggcaaggagagcaaaggattaggcatacgaattgtgtcctttctagcagctatggttcggatctgttcgcctcgtttatcataatctcgcatatatatgaacgcatcacgtctaannnnnannnnnnnnnnnnnnnnnnnnnnnnnnnnnnnnnaaaaaaaattcct

SEQ ID NO: 7250 - DNA, 646 bp, Aspergillus oryzae
cgatgactccagctgttgcgcactcgagtaacgtctagcagccataacctcctcatacaagatgcacacaccacgcacttcgatttgcctgcgattcgttgcggccatcagctccctcgctgcgctgatagcgttcggatggtcccagtcaatgtttggaagcgacacggtgatggtggctgacttgggccatgaggtggtcagtccagtcaccggggcgaccgaatacacctttgtttggtcgctgataatagcatctattgaattatcccttcccgtcccgatccatccagccatctaccttacttttgacctttgcgcttgggctgcactggttagcactctgataatatatttgacactccacgagccatattataccggagacggctacggctgtgggatcaatggtagacctgattgtgatggaaagctcgtggcttatgtcgagcatttcggcacggccatggcttttcttgctctcatcatccatggtggggtttttggatgggcgtggtcgggcacccataaagcgccggaaaagcgaatccaaagggtcaagaaattgaacttgaacggactgtgtgagggtaattgaaagggttcacgacatttttactaaaatatggggggatgagaaccggtg

SEQ ID NO: 7251 - DNA, 424 bp, Aspergillus oryzae
  misc_feature (1)...(424): n = A,T,C or G
cgaggcggttatgaaatgcgcttcggaatataccccttcagcgtttgtttttgtgtgattgattgcttgtttttcttattaccctatctgttttatttcatttctccatacaggcgtatgacctatgttatacctatgtgagctatatttcacagtttggtgtttgttctttcgatgtaattgtttatagggaatatcatccctatgcatgctggcgttggatgtctgagggtacggaccaatgatgaagtgccccatctgctggatgatctatgctagcagttgaactgggtctgttgtttgggattatgactacgaacttggggtggcttgagtagcatcgtgtggtacgagtagatgtcttgtagttggatactgaatacattatctcttgaccaaaaaaaaaaaanaaaaaaaaaaaaan

SEQ ID NO: 7252 - DNA, 807 bp, Aspergillus oryzae
  misc_feature (1)...(807): n = A,T,C or G
ccaagctcttcggtgtttattttgattgcgctctcccatacagttgagaatgaggtctctctatgcctttcaggaagcgaattcgagggggaggtcatgacgccgcacttctctgttcacgagagactcatctctgatagcctgggaagctggatggattacatggcttggttagagtccgaatgcaagcaaaaggccgaccgactgattgtctgggatgtcgaagaccgagataagcatatgacatacttcaaggtggaagatagacaacgtcttaagcaactgcgagactatataacggatttaattgtcgtccttcagactgctgtgaacactatcggtcgcattgggaagagctgccaaagacactgtaaaatgagctgcgctgccagagatgattgtttctgtaattccatgatcggagagtttgttgaatatgagacagaagctcgcgtttacctggaacgggcaaaggtgttacaagagcgggttcagtcgacagagcaactgttaaccgatctactgagctttgaggagactcgagccttgaaacaattggcacgagcatcacatgtggagacaaaagctttgaaagaactggcccagacttctcaggaagaaagccaccaccttgccgagcttgcaaaacggagtgcagaatacgctgcngctgtgaagatgctaagtcttgtggtctgggttaccttcccaccaccattgtagcgaatgtcttctncactgangtcgtnnnaaataatgaacagggaggcatatacatttcaccctgggtttggattttggcagtca

SEQ ID NO: 7253 - DNA, 434 bp, Aspergillus oryzae
cgaggcgtcttggcagctatactcacaggggcatcactgggactgctgttgtactatacgagttccttcgttgtggagattttgaaccagtccctggggctaacataccctttacctcgtcacacccaagctcacactattaaggaaccgaagagcaatgctctggaaagaggatatagtccgctcaacgagtacctggccggcagcggtagacaaatcagaaagagtgggcttctgtcttccacgatcttggaggaggaagaatccaatcaggactcaaacggagatgatatctatgactgaccaagagaggcaagaagatttgtatgtatcttagcaggcccttcgatagttaatgaggggtgtttacaaaatacatcaatgtgcagtgtagaaaaaaaaaatttataaattataaaaaaaaaaaaattcct

SEQ ID NO: 7254 - DNA, 570 bp, Aspergillus oryzae
  misc_feature (1)...(570): n = A,T,C or G
cgaggcggcgaaacctcccctgcaagaagtgataaaggcagtgactggatgggtgtgacaacaggtacatttgtcaaatacctcacgctcggatacggttcatcctggagcatgtctaggacacccagcgcacattcccgcgttgaagcgttgaagcgagaagacgactcagccagctcgaacaagcagacaggtccacctacagatggtcaggaaaggtctgaagaaagtncttctgtgcctgaggatccctccaaactgaaagccgtggtaaattctcattggttaaaaaatgagaaaccgaaaaaaatacccagttttataaaatgtacaacaattaagaaattgggggatgaataacccaaaggcgttcctttttacttgggcaacccctccaaaataattcttctgggcaatacaacaacgagcagttttttacttacacaaaacgtttatttattcttttttttttgacccttaacttttttttttggcagaaccatttttctatttccagtttcaccattaattacaacctttccagggggttcttaaaaggcaaccctcccc

SEQ ID NO: 7255 - DNA, 431 bp, Aspergillus oryzae
  misc_feature (1)...(431): n = A,T,C or G
cgagggggaggtactggatgattcagagagtcatctggaggataacccctagcggatactctgccttgagagaataactttctcacacccccgactacggtccaaaggaggctgaggttgagccgagtctcgcactttgtgcgcctcctgcatccattgtatagccaaccggcgtcacaaacaccaaatagactcgaatgtcaagcagagactggcaacaatttgagatatatagtattagtggatggtacaaaacctagagagggcggtgactcaagttcattgtgtttaatattacttgcatgtctgcgagcgatgcgtcaaagtaccatcctatgcatccatacttttgttacatagagaagaaagccgatatatatcagaagagtatcagatacggaaaanaaaannnnnnnnnanaaanaanaann

SEQ ID NO: 7256 - DNA, 599 bp, Aspergillus oryzae
cgaggggacggtgaactttgcataatagctttccgctagcctcgcctgcggtcttgaatcctttattactcttgttcgtggcccccaactgtcattcagttcacctgagtctagtcggctccggaattgtgacgaagagtaaaacatctcctgcctctgtctgcgtcgacttgatactactcgctcgttgagattggtctgcggaatctagtcattgtctcgccagcccagaccgtacttggaattatcatacgtccttcgcagatgcaagctggctccctataggtggcttttccaagcagtatttgttagcgtggcttatctccagctctcgtcctgcagccatcctttcgggtctcactgcccgttgttggatgctggtcgttgattcgaagcccgttgttgcgtattccttgttgagcctgacagccgcttcgtgtcgtcactcgttttgtctcggagagcaatccaagactctccgctatcctatcgtttccccagtttaaataccatggcattttaaaagggggcctttttccccttttaacaaattttccaactttgggggccccccggtttcccggtttttttttttaaac

SEQ ID NO: 7257 - DNA, 390 bp, Aspergillus oryzae
  misc_feature (1)...(390): n = A,T,C or G
cgaggttttgaatactttctttccttctcttcttcccaggatttgttttgaagatcatgacatcctggaagaagctgggtgttgaggatacatggacgtgctgatataccccttatgactgcgattggttacgagttgatggtgtttgatgccctttcgatatgctatggctggtgtgttctgcaatcggtttggttgccaaatagtcgatccgaatcttgcacgcttcgtactatgggactgcagcgctgctgttagcgatgtatctaggtcgttgatagtcaaagaacatactagtcaattctacgtattatatttctcttttcnggatgcagttcatgtaccgcatgaaagccgactgtcaccanatgaccattgacgatatttcct

SEQ ID NO: 7258 - DNA, 391 bp, Aspergillus oryzae
cgaggattggctgaatgttttggccggaaagccgactgaggagctggagtcgcgtttacagaatgtgcagtcatcgcatgctctgttggctgatattcaagagaagagtgcgttcttcgataccgctgccgcgaagtatgcgccgagagtgtcctcttagatccctttcgcctagccctctttcatttctctttcatattcgatttccacttttcttctctatgcgccttgttcgatccggtgttttgttattttgatgatttatacgacggcgtagctattgtattgtgccaggtattatcggcgattgcctttattccgtttgctatcgtcccagttgtggaaatctgatttcatgatagacattaatactcaacatgtttggtgtagt

SEQ ID NO: 7259 - DNA, 672 bp, Aspergillus oryzae
gttcagatcttcgctgtattccgtctaccacaatggtcggccgcaaatgatgcacatgtgacattttctatgcacatcaacctgccgagattctcccgacgatcaacaaatgcagatcagcgcttgctgtgagccccgccgggctcatgggagctaccccagtcgttgcggatggcttatccaccgctaccttcatcaccaccgcacgtcaacatcaagacctacgatcacgagaccatcatgagtcgcaatacacagtagcaacgccacgttcgctgatacagcctacgctggatctatccgaggagcaccaaagggattcttatttgcaatagcagcgcacgtctctgggcatcgcttcacctccgcttccagttcatctctaggattgggacccgcatgtcatttacgctgtcgatcactcctgcgtcatgccggccacgtgcgacgatgtcggcaactggatccatgttcactgcatctcacgactcatgataagccagctgcataatgcctctctccagctatcaccgccactgtcgctttcactttgatcgtaattgtgcactgtctgtccactggtgcacaattgcactgtctaacggagtagatccgttcgatgacctaaccgagtcagtcgactttactaagatcgctctagcacaaacataa

SEQ ID NO: 7260 - DNA, 679 bp, Aspergillus oryzae
catcagcattgcacgcgtgttagcaggaatcgcaattagtctcactgttgtctccactgcacagactgttgaccttggtcctccacacatacacatctcaggttcatgcgtcgttggcgcatttcctcacattcaacattagcgtcgatatagtcatcacgatgtggtaaacagtttcgtatggatcaccacagtgatacttcattcacatcttcccggtcaacggtgtctcgagtcacatgtcgagttctcacactaattctcaaatcgaatcacatttcctacttgtttcatgtaccgtcacttctagtgacaccagtgtgaccactgtcatgggtttccaaacggtatgacgtctgtcggctctagacacatatgtcaggtgtgtggcacaaccgttaaaattgatgttagtgtgatctacatacctttctgactgtctagcgccattcatgacctgagcaaatgactaagctttgaacaaacacatgactgtccgtcttgagccttcgagttacatatctgatatcactagttataattcatgagatgctgcatcttattctgttacatgtatacataccagtgcatgtcgctcactgtgacgtgtaatcatactgatgcatatgcattcttattcaggtattgtcgatatatctctgtgtgatagtgacatggc

SEQ ID NO: 7261 - DNA, 663 bp, Aspergillus oryzae
cccttgcgatatacggagagcagccaatatcaactatttcaccgcgtttgcagattcttgtgaatcttcaatcttctctaactgtatatcaagagaagggcaccagtgtcaatatccctgcatcgcttttaaccctcattattgagttattatcacccgcagcttgtgagaatgcaaaattccctctgccttttgaacgttatcagacgctcgtcctggctttgtcgattctggaaaattacacaatcctaacgggcccattggatcccgactgctgcaattccttacgctcgcttactcagtgtcataaatttctctatccgaaccagtccgatcaaagccggcggattctgattctatacattcgggtactattgaaccttaccaacaaggactcatctctttgtgaggagtgttccagaactgaaattgttggcggacttgtcaaggtcatcatttcggaattctgcgctgtgcctgaagaaaatactggtaaagaatatagctcactggatgcggtaatattagctttgggggctcttattaatcttgcagagaatagtggatattctgaggctatttatccggaagtgccggattgatcgcgaaccttagatgtatttgagtcttaagtgaagttactaccagcaatacgctcaggcg

SEQ ID NO: 7262 - DNA, 686 bp, Aspergillus oryzae
  misc_feature (1)...(686): n = A,T,C or G
ctaaatccgaattgctacgttcggatggctctgtagatgagatgatgttccaggcgaccatggtcgtcaacggtgcggcaatctaccttcacttcccaaggtccgacctgctgtcgtcgccggcgatggctgcggaagtcatctgtggccatcatggcccttgtagcatccctgcgttctcgcatcatgcacacgcaatgaaggccgtaaaagcggccagtgaaatttcttcgttggcgtctattcgcatgccagtcgtcaaacatactcctttctttatctgtgctctagtaatgagttctattgtgcagctggctgcctgctccgtgaaagccggacaaatgcccgatccgagtcgagaccgactcacgctcacgattggagtattcaaatctctcggccgtacgtgggccatttcccaggccatcgtccgccagatcaaggcagtcgcacgcgatgtgatggatcttggcttacgaccaaccatggatcatatcgacttgaatagcgtccttgacagcggtcgattctggatgccagaatcccttgcgcggtaagggggctntagaaatttggaccttctctcaaaacttggaacctcacccctgttgatataatctgacggtatgactatggatacccaccgcagagattaaaacataaaaaccagcccacatgtcgatata

SEQ ID NO: 7263 - DNA, 652 bp, Aspergillus oryzae
  misc_feature (1)...(652): n = A,T,C or G
cggacgacgaggacgagcccaccgacacgatcttggtaatcgtcactcatggggcaggctgcaatgcactcatcggagccatcaccggcgagcctgcccttgtggacatcaatacggcgtccctcacgctggcagtcccgaaggaccgggtggctgtcaccgagaaagcagacacgatcggcggacctgtagcgccgtatcgtcccggaaacgatcaggtcgagttacgcgattacaagctacagctggtggcgtcgaccgatcatttacggccggtcacgaacctgtcgacatccgtcctttcatcgcccagtagtttaagttctccatcgtccgcataccgtcctcgattctcgacccgcccgtctttacccacaaggcggtttcgtgatcggtcctttctgctgtgtctggaccgggcacccgtntcgtggacaattttacgaaccttcaacgnntctcgggggtccagcggtcttggggggcttaactcgatctctggccggggacacggcggacgatattattcccccacttccgggatccttgttcggggtcaatggggactagcacaatgaccaccactccggccagaagtccgaagagtcgtaaatatggacgccacaactgccacagagaaccgtttttaaac

SEQ ID NO: 7264 - DNA, 98 bp, Aspergillus oryzae
tctcctgtcaacgtgacgcttcattcccctcccgtcacagtttgttgttgactacgcgtctctcccctctctcatcctgtttgctcttatgtgatttc

SEQ ID NO: 7265 - DNA, 676 bp, Aspergillus oryzae
  misc_feature (1)...(676): n = A,T,C or G
gccgaactttcatggcgtatactcaagatcatcgatgcgctcggctcccaatgcatgagttccttcttggcttcgggtacctacttccaacaaaaagtatagatcgtcagagttccgagagcttcgcgacagtgcatgccaaacagttcaatatgtctcttcttgtcacaattggcgggataaagattaggtggattgacacactgggcgcccatttggagtttgataaccgcaccaaaaccttgttcctctttcggtttccttctttttgcgccgcaaatctcgagaaagacttatcgggcgagaaatgggtgccaggagtcatacatggttgtactgccccggctggcgatcctaccaactgggctaccgctgaagatgtgacaagctttctatacgaggtgctgctgtcatatcgcctgcttttcgggctttcggcaaagggccgacaattctaccattcaatatgcccatttaatgaccttccgcctgaccaacatgatcctcttctgggagaactatgcngctcacgcactctgacacagttttcatggaccaccacgaagacgtctttagccttgttcagacttttcaatcctcacgaccgaatccaagccctttaacacatttggcttccaaagggacgtgggccgatacaatattggcggacaacaat

SEQ ID NO: 7266 - DNA, 664 bp, Aspergillus oryzae
  misc_feature (1)...(664): n = A,T,C or G
tggttgccttcaatctacacaacttcctttcttccctctacattcttttaccttttgttattctcgcgaacccagttcatgcggctccttatcagaatcgtattcttgagaccggcagtactttcggtgctccggatccatatggcccatggcaaatgatccccagcattcccaccgaagacctggtctacatcaaaactaccaacaccggaactgggagggtagaagttcacatcgcctcgggttcatcgggattcaaggcattctaaagtgcaacttcctctacaatcacgaagatgcagctgccagtctcattgggcctgctcactgtgctgatttcttcagttacagcgagatactatgactggggtgaatatcatccaaaggcctactgcaccggccatatttactattgtggaaagacccttctgactgtcggaaactacagggatcagataaaggacgttntacgtagcgagggatatccgctagacgattggcacatcaacaacgttctcctctactgtcggaaggggacgtcagacgaacttggttntgagagaatgcctaaatatcaatgctatgatgggggtgatggtagaagcgactatgttgatgacgttggaccatgaaatgagattctccacgtggttggttgagttgt

SEQ ID NO: 7267 - DNA, 718 bp, Aspergillus oryzae
  misc_feature (1)...(718): n = A,T,C or G
ctggaattacgcagaacgctctgaatgcccaattttgagccaaatgccgttattcgcggtgctcagctcacgattgttggaactgttcgagcactgcggaacccagaacttttcaaacatgagcacttccggcaagcgggttttgcgatagctgtaggaatcgccattgaattactcattcagatccccatcatcggggtcaagtttcttctatggatcttatcttggatggccgacttggagagcgcgacttgggacgatacccttcttgagagccttgattttctgagcaaatcggtccttcaagttcccttcttggtgatgacgctcatgcgatacatcaccccaactctcgatgaaatcttcatggaatctataaaatgggtcgactccacctatgttgacaaacataaggcagatgatcccaagaccctacgggccatgtactacccaagcctttcgatgtactccacgaaagggagtgttggggtgtctaagccaaaaggtgaatcggctctcgtcttcgtccgtcggtatgggcgcaaggtcggnatgatgctnggcgtctttttgctgtcgcttcttcctatcgtcgggcgattcgtgatgcctgcagcttcgttcttttcctttagcagatggtgggcccagcccctgcagttgttatcttgggacccgcctgggctccctaagcgctacctgtacacttcctccaccc

SEQ ID NO: 7268 - DNA, 691 bp, Aspergillus oryzae
gcgaggggcagatgccccctgaacagcaagacttgttgtaccaggatctgatgggacgcctagtccagtggcggctcaatgctcccaagtgcatccaagaagttggcgaactagatgacgagagcttaaagcaatatccctacccagaggtcttggaatatgcgggctgtatcgagtcgtacgaaaaggcgaccgttctctacttgcacaaggtcgcagcagcggaccgccctgatcgtgttccccaaagagcccttttagacatgcttgcatcgcgaattttaaacctcattgagaaacttgccaaagatgttggccagctagcagttctatggcctctgtttaccgcagggcgcgagactcgtaatgagcgcgagcagaaattcgtgcgggaaaccatgattaacctacaacggtttggattcaagaacgtcgaatagggcctcgaagaactggagaatgcatggttcatgcaacgcgcattccctgaaaggtggatagacaggatggaggacgttcgggctttgaatcttcttccgggatcttgcataaagcactcgattcgactaccctggctttgacccatttggggcagtctgatcacttacttcttgaaaagaatgtttcgtttactacccatcaaccttcctttatgatggggggtccatttttgcaatcttggtttaattac

SEQ ID NO: 7269 - DNA, 591 bp, Aspergillus oryzae
cgaggtgcaaaacatggaactgtccgcatagctactcgaatgaacctagcagatgttgcaccgcggattgtggtttcctacgaacacattgcgcgcagttctaacagttttttggtgacgatcaatcgatagatttatacgccggacagattaggtcattcaagagcatttagagtgtacgttgatcggaaagaaggagatgcctgtatcatcaccgttaaaggctgctgcaaaaactgcagcagcgaaagtgagatcaaaggtctcccgtagctcgcacgagaagtatgcgtggctttatgctcccccagcgaccaaagatgatattaatccagtcgtggaatgctggctgaaggatcaaagcaacctcgactatgtttctggagttacgggcggaacgttccgggataacccgctggaaaacgtcgttgaatcctttgcgatcgtttggacaaaaaacagtggcactatcgaaaggccctttcccggggaaatacttgctgattgttgggctggaatatgtggaccagattgatgggcttcccatattggaagagactacgtccttggaccatggcgagtattgtcttg

SEQ ID NO: 7270 - DNA, 696 bp, Aspergillus oryzae
gctaaccgttatttatctctgccagaccccttatttttcggtcgcattgcatcgcagtacctggctaaaaaaatttgagaccatcgcagggctttggataccattcgattactcatcgtgcatcccccgccacttatctactgctttggtgcatcccttcaacgtggtacaatctggagtggttctggactgagaagggcaaatcgggacgggagtctacaaaagccgagaatccaaaaatgtctcgggcaacgtcaacatcggctcccgaactgagcccccaattttgcttcaatgagaaattgctccgagatttcctacgtctatccagatcgacaatagatgattcaattacccagaacctcaatgctctgttcactccgtcgcgggagggcttcgatccctcgtcgactgcggtacgtcaaacagattcaaaagctgggcgtacaatagaccctgccgcttgtcagagtttcaaagacaacgttctattcccctcatggcagacacggtcagactgtgctcaatactgcgccggcgtcgctacaagtcctgacccggacgaccctgatcttggccttcgacagaccgaatctgccgggacccgaaagcgagtcgtcatgaacgtttaaaccctgacttttggccggtttttccctttgaaggcacgaacgaaatacttagccaattttgccg

SEQ ID NO: 7271 - DNA, 449 bp, Aspergillus oryzae
  misc_feature (1)...(449): n = A,T,C or G
cgagggttgtctatgttaaacttgcctataccgaaggatgatcgtggacggtgatggctatcagctcagctacgaaactcatctcacacagatagtctttagcttcacccgaggaacacgatgcttcctccaggcgacagtgcgactgatcaacagctcgaattctgtcataaaacacactgcctggtctggtaattaggaacgtccatgtttgaaggccttttagttccacgttctagtggatcacctctcggccgcttcgggggtcttagatgcgcagggcgtcactcaccaatatttgaccgtggtgcatgctgttggggcacttggctccgaggtgtatgcattaggctctctgcggccgcggcgaggttggatagaaccctagagggcgtcgtcttattataggtatatactgatagatatatacaactcangataccnaagac

SEQ ID NO: 7272 - DNA, 537 bp, Aspergillus oryzae
cgagggcctgaagggaagcgatgaatccacaagcttttattgtcatccttgtgccttcacccagtcctcgacacggcgttaaaccgtctgtctctttcccgtggttgcgatggtggatcatctcgactcttgatgtgggtgtcctattttcatacttcgtaaatgaatctttcgctcatcctccccacccaactccccgcttcaatttccttcgaatggcggcctttactgtttctgaggtgagatgacacgcactgggtttgttgatgattgttaccacttagtgtgcatagccaaggattacatacaacatctcgacaggatgcggccatagaaaagcttcgcagtgtctcaatgcttccctccgacacaacagaagtctgtcagcagagtatgcagcactattcattacactgtattgtacgccccatggcttgaggcccgccgccttgtcatacgcaacttcagtttcagtgtacccttggaccaattaaggtagataggactgtctcaaaaccggtatattcgtttgtgcgc

SEQ ID NO: 7273 - DNA, 169 bp, Aspergillus oryzae
  misc_feature (1)...(169): n = A,T,C or G
aaacccggcttccaggctccttttgctgtcgcccgttaaacgggcggttggggataagctgaaggtanggtcagtgggcatgatcgactcggcccagctggccaactcctttgtagagaaaggaggtctagattttgtcatgggtcggcggggttccaaaagaatccgg

SEQ ID NO: 7274 - DNA, 859 bp, Aspergillus oryzae
  misc_feature (1)...(859): n = A,T,C or G
cacgaatcgtccgattccaattctaaaagccaaccctcgatattatgatgctatcgatcgttgtgctaagttctgacttcattccgttgcaccgcaatatttcacatatatccagagaccctggttttggttcgctgtcttacccactcgctggtctttcgagaatattgagttgcgccatgggacatggagagtttggccgctgtcgagctagcgccttaccactccagtttcctttccgttcgtttgaatattttcggtttctttctctgggcccggtttatagagcttcagcattttgcattgatgacaaggcaacttttgactctaccattttattgcgccgtgcacctctcaccagcccggcactttgttttcatttagcggatccgattctttccttcatctccgaccactggccctacacttatttcctatgtcttgaacgattttcctacgttaatcgcccttcgactttgcattgggcctgatcgctatgataccacgccaccaactggcagttcctattcttggatctttccttatttttttccttattgtcttttaatcctacctccctatttcttgtataacaagcgagggagcgacccaactcctcgccgtacaatgtacatattgatgtacggctcgtcagaagggcgataattcgacatgcacgacagcgaccccgaaagttatcaccctaaacgggcagatctaatagctttggaagtgctcaatgcagctgtacatacacaaactccgcgtcggtgaactgacacctaatgggaaggccggnggattaagaactaaaagataatttcctttgttggaatgaaatgaaataacttaagaattt

SEQ ID NO: 7275 - DNA, 281 bp, Aspergillus oryzae
  misc_feature (1)...(281): n = A,T,C or G
cgagggggtacttggcttggttttgtgcttttgttgggaaaaattggcgtttgggaaggagtgttagattgcatgatgcgctgtgtttacgattatgagcgctttgcttgagattcagttcttgttcatgttgtttagttcatactacgtattggtatgtggtgatcggtttctctgtagagggccgagtgcttaatgggttatatctgttatttcacgattaggaaacttgaatcattttgttcatttgaatagaagacgagcataccttggcaaaaaan

SEQ ID NO: 7276 - DNA, 544 bp, Aspergillus oryzae
cggactacttataatctattcaccagtaacctaatcttttgctattttatcttggctatacctggaccatagttgctttttattgccaatcggccctttctaggcgactaccacaaccatggctaagtacacgaatatcaacagtaatacctacaatcagttacagcgatttcccgataaagctctccaaacttctgcacttgcgagctgctatagtgtcaacacgtcagcatcgagagttaatggtttccattactacactacgactggggccggagcccagtggtatccctgaggtcccctcagggtcgaaaaccttgtctccaagtcccccctccgatctctctacccattcaggaatggagagcagtctttcgggtaatattatacccgaatacaaaggggaggcagcgcatactatcccggaagagtgtgagaggctcttctgcgacacattgtctgtgattttccttggtgaggggattctctctggacaagagtcgcttggggcaagtgcgtatcaaggtcaaccgaataattcacg

SEQ ID NO: 7277 - DNA, 491 bp, Aspergillus oryzae
ctgttgagtgactcgttgaatccatctgtcacgtccgcggaggccgaggagtatgaacgctatatcaaccaccccctgaaagtacctcttgttgtgacatccagggacgaccttacggccacttctgctcgcgaacgagaatcaaacttggatttgattgagtatgtcaacaaatgcaatgtcgaagactccgctctcaaggccaacgcggatcaaaatatggcagactacgccgagttcctcaatatatcggacgaaggactcacagttactgcggaggaccatgaaatgaagcgctacaagcgctaccgacaatggttgaggggcaagagtcttttcaaacagcgagttgatatttgaacagcatatctgtgtgccacgattcatgaattataacttaatgacgcgatacccatacgcatcacgttagcattagcgtttgcaagtcttggcttatcatgttagatgtactaatgcatgggtttagctgc

SEQ ID NO: 7278 - DNA, 970 bp, Aspergillus oryzae
  misc_feature (1)...(970): n = A,T,C or G
gatattttgacacagtctgtctctcttgttgacacattgattcaactcgcaccacgcctcagtgacaaccatcatgatgaagccagttttctttaccaatacactgtatctcctcttgccagtgctggccagtgcggcgccagccccgattataggactagatatccattcgaggggcacaagcatcacggcccatcaaattatagccatcgcaccaagttccgcacaatcttgcacaaatcgtgctgataagaatgctcctaccgagtgtgccgatgctgaaaaagtggctacgaatattgccaagtcgtttgacaagtaccaggtcacaagccctgctgagcaggcggctgtgattagtttgatggctttggagagcgtggaattcctatataataggaataaaagtcctggcgtaccgggacaaggaactcgaaacatgcagtcgccggctttcaactccaaatatgcgcagtcacttaacgtagcagtgtccagcgatccagctcaaacccttgataagttggttgacaatcccgagtgggattttggctctggagcctggttcctgaccacgcaatgcacggccgatgtgcgcagtgcattgcaagccggctcagagaccggttgggagcgctatatcacccagtgtgtgcagactcaagttaccgataagcggaaagaatactggcagaaagcaatgcaagcgctgggcgtccaatcctcttgagttcaatcataggtgttttgaatactgcactgctggacaggggatttgtacgtttctgactcatagccggcccacacttttcattttcatgctttcttttccgcttggtggtactgagtaaaaccattattatgatcgncaattgattttatttttttttgaaaaaaaannnnnncnnanaannannnnnnannnnaanaannnanannnnnnnnnnnnccttccctggggcccgtaacc

SEQ ID NO: 7279 - DNA, 694 bp, Aspergillus oryzae
  misc_feature (1)...(694): n = A,T,C or G
aaacttgaagcttattgacaaaggaggaggaatctctttattaattattctggattgggtatgatcttcaaaggcatcattatttaatttagcttttctttcgtttctcaagcattcgttgacgcacctctcaatgaaatcacgacataatccacgaaatacgaaattaggatgaggaccagaaactcgccaagggctgtgtggcccacgcatccgaagttccatatgccgcanaggatgcagtttgctgtgtccagctttgtgggttaaaatgaccagattgagatccttcattttcacagctcgcccatgcatctacctcgccgcagactggtatagtgacaggaaggtaattagaggccgttgttggaacttggtcggtgccatcccagaaaccagggcttctatattgcangtttagcacttcatttgtcaaaaagctaacagctgtggttctgccttcaactccgtcggctgcccaagcgtcgccacttccgtaaggaggtaacaactgttggccatttcttgtcatggtagtctgggtttgcgtcccctctgtgctggtcaacccctctgcgtgtttatttatctctttgtgcgggccttctctgtttggtaaaactcatgttgcggcagactggcctatcgttcttaacggaaactttaatctgaaccgggatcatggtaaattctt

SEQ ID NO: 7280 - DNA, 606 bp, Aspergillus oryzae
cgaaaggatagcgtcggtgaggatgcgataggatggaaatatatcgaaatatccaggatattcattcgtcagattccgactcctcaggctgcatgaccttttcatcgagttcctacgtgatgtcgtcagtagagtaacacaaccaagtcgtcttctgaggcatacccttcccaaccggatcttcaggttctgcagttggctttccttgataaccaggtggcggtcatcgtccaggtcctccacaatgtagtcgtgtctttcttcgtcatacttcaaaataatggctttcacggacggatcgcattcgatcaggactcctgttggaggcgcatgttagctcgatcgcaagagatggtaggagcaacgtgcacatgcctcgaacagcacggggcattttgataaattatagagcggttgagatttctaactggtaatgtggacgcgtgaatatgtagcaagtcgcgcaagcgatgagatggtcgtgatgattgcagagaaaatctgcggaacattgtcgacttaccgccaagacaccctcaggcaccaatgcagaaatactatgatttggacctcaaaaaatatatatatataaaataaaattttcct

SEQ ID NO: 7281 - DNA, 699 bp, Aspergillus oryzae
  misc_feature (1)...(699): n = A,T,C or G
cggtcaccacgctggaccgacgaccggcccatctaaatggcgaccttcgactacccgactttgtgccacacgcacaggcgggaatgtttctaggggtatttgatgggctcttcaactacatctccgaagtgaccaggttgcgagacaagatcaggcagcgacacaatgaagggtatgagcctgcggttgactaccagatattgagtgaggccgtctcgattgactccgctatccggctttgggaaacgtcctatccgccaaacactgcgaactggtctctggcacagctttatcggcagtcgacctgggtgtacctctatcgtactattcgcccctcgcaaccaggtgacaagataggtcaagtggtggatgatggcctggaatacttggatcagctcccacaggacgctggcgcttacagcattgtcctgatgccgntgttcctcctcgggtgctcggcgtttttgcagcaccagcgggagcgaatccagaaaggattcgaaacactcaaatcctactctaaccttcgcaacaatcgaacctgcattcaaagtcgtagaaaaggtgtgggaaagtatggactccaacatcgaggaaagttgggattgggagaaaatcatcaaggatatggatatggattttctcattacctgaattaacccacgcattctcatttgcaatattgcatatgggcagcgt

SEQ ID NO: 7282 - DNA, 698 bp, Aspergillus oryzae
  misc_feature (1)...(698): n = A,T,C or G
gccttttgggtttccctgtttatcccctccctccccccaatttctttacctgaattgatgtctgacagagtaacatacctatcacttcaattttctcattgagattcaacttcgaaatctcacggggttaattggtgaagaggcttttgatgctctgcattgtttcaagagccagaatgtcccgcacaaactagcagacttcaccccaagaccgggttttttaaggatcaataaaacagttcggtttatagccagggcgttacaaaactagcgagcgctggaacaaaggtctccactgtgccaggtgcggcacaccggacactgccctttgataatacatttccggcagagacagcgacgcatcagatagaagagtggatgctgcatttaatatgtccagaaaagtctctctcgatgcggttgtgtcgtatattcatgacgcgctaagtcaagagggggatagtattctaatcccgcgagacgttctttccacaatccttgatgcagtgactcaatctgtaaatacagagaaagctctagcatgggtggaagcagactgtttgtctgtaagaagtaggttggaggcttataagagggctgacgaccttgtcgttgaggagctgtgtncagcgagggaaaanataacagcgttcgctaggaacaagttctcagatcccctggtgcaaagtaggaaggtt

SEQ ID NO: 7283 - DNA, 665 bp, Aspergillus oryzae
  misc_feature (1)...(665): n = A,T,C or G
gagattngtactgattgatttcgatgtgctaaatatatgaatgagtgtccttgttattgtacgactgggccttgaaggaaatgatttccgggacggttaattccaaatcagacccccttgcttgcatgaaattatggtagacataccatttatccaccatcgaaaggggctgtaagggaattcaattctatgcatatagttgaacctaggtgtcggtattgggttttgcttataagtctgcgccctactagcaaaactcatcgcatcagactcccgtccccaaatctatcaccgctatcagcaccgtgacatatgtcctacgacagcgtcccaaaagaggaacatgatagcccagatgcggagcagcttgctattaagacaagggatccgtcgggccgattgtgcgatatcaacatcgttcttgcactggtggcaatttccctgtgctttggcatgggggtattcatgttcttcgatttggcctacgaccagattaaacccgcggagacaacattagccacctcaatttcaattcaactgccgcaggtcaactttctgagcaccaactgcaggttgccgctttgacttgaccacgttcacttgggtgccaccagcgggcttttacaaccccttatggaggattttttcggttaaaaaactggacg

SEQ ID NO: 7284 - DNA, 788 bp, Aspergillus oryzae
ggtactcgctaaaatctcacctcccctcctcccgtctttccgtgatggagcctcacggagacggggagccgtggtgtcagttgacggccaagaacctatcgctgtgaagtcagtggttgactttcttaacaatacattggaaaaggaaggaaaataccacacccacatttttgaaggacccgatatccgtctgcgggaaggttactctgaatctggtcagatgggcgatgctacggttgattatttaaacaccatctcagcctggcaccgcatttcagatgaaatcgtgagcttcgtcaaatccttgtatgggtctttggaaccgaagtccgtggatgaagacaactcaacaccaggagcgtcgcccaaaggctctatccctaaaggagccgaaattcatatcagttcaccggcacaatcgagtgagaatggatctgtatcatactcatcgtcttccggttcagcgccctgtccggtacctgtggccctggttcctaggtaccagcttaccacagccgacgccttcgcttgctccgtacctatcggagactcttatgcaccactggatcattggcagtggatggcgtctctctggcgtgcctgtgtaggcccagatatcacagtctatgttcgcgaatgtgagaaagatgaattagatcgatatggggggaaccccgttgaagttcgcttgcatgatgcgcgaactatagtagtgcggagagcagctggttctccgagggaactagaagagaagactttgaaacgcgtggggtttgaaatcgaggact

SEQ ID NO: 7285 - DNA, 657 bp, Aspergillus oryzae
  misc_feature (1)...(657): n = A,T,C or G
ggcaccgatcctatcccaactgacccggccggtgacccccagacaatgctgttaggccgtgttttccgttttgattcacccctaacctttgaagcatcgccatggaactatgtatcatccacctctaagggccagatccgtctcgctcggccaggtaataagacggaggagggcggtacagagcggtgggagcgggtactacaacatccattcgagctgatagtccgtggtgttgtgaagtaccagttaccactgagctcccgattcctttcggcatctgtcagctccagtgttcaagtggtgcccgacaaaggtgacaatggcactggagatggcaacgacaagcctgatcctggagacgacgacacagttaccatatctaaaacaaggtcacttcgtcgcagtctgcccgagctgcgtcaaatagccaccaaacgctcaatggtcgatttggtacgagaagctnntggaatcaccngataggtcatcacggctcggntgccgtgatttcaatctctattatcgaactcaggatnntaccggctcatttcaccctttgccctnngtctttttggatatccttctgctatgggtagatcctntgcttncgtgcccaaatcttcgcttcaaccaatactgggaggaatagccttgtgn

SEQ ID NO: 7286 - DNA, 686 bp, Aspergillus oryzae
  misc_feature (1)...(686): n = A,T,C or G
cgactcatctctacatcattgcgaattcgctcggctatgtgcgctcagatacgcagttttcgactaacgcgtctatcaatgtcattggatatattgctaacttggaggaagcccggatttacgatatcatccctctttatgcatcgcttctaccaacataccaggcacactctgtgcttggccagatcctgattgaggtagtcgacccgcgggagagacgacaacaagtcaggctcatggagaatcatggtatcgatgttgaagctgtcttgcgtgatcagtggcagtgggttagcgctagtgtttcctcggttgaacattcaagtacgcttaagcgataccccaaggttgtccgtcgcaaggatggcctgcctgaggtggtaccagtcaagaaggattacattggaaccgatgtatctggtacggaagaacgcgtcattagaagcttggagtggcttcgccatgttgatggacaatgggggaggatctgtcaactgggtgccttgctgtacagaaaaattttatgtactggtagacttgctgctgctcgggagttgagtagacgcatgaagctggccgatatcttacggggagccatttggttttgacctgacagaaatcccctttgcggtgggggatggcgcaaaaccttnacttccaaggcttttacccgattaaacaaaatg

SEQ ID NO: 7287 - DNA, 130 bp, Aspergillus oryzae
tgggccaaaaagttgtgattatttcttgtggaggaatttgagttctggatggaaattgggatttgaggatatcagagctctcgcagattataccaaggtagagctaaaattgagaatatatctcatgatg

SEQ ID NO: 7288 - DNA, 525 bp, Aspergillus oryzae
  misc_feature (1)...(525): n = A,T,C or G
gatagcattgacaagatattccttgtggtcaccttcctacagcttcttcatgttatcttggtgcccattcaaggctgtggcggcgagaatggatgaatcctccgtggaactgaccatgatttgtcaatcgaagtgatgaatcatcgatcgaagtgccagatagcctttgtgagcgtggcaggtgttgatcaaagagaatggggacggcatctatacctagtacaacaagggagttgttggaccatccagcctttcgcgactgatctgaaactaagacagccagcagacacaaggcaaggagccaggactgttacctgacctttgatctgcgaagcgtacagtcttctggccagggttaagtagggagtaagatgagcctaatttcgaacggggaccggggaagacgatagtcccgaagcaacacggaggatcttggattgtttggacagaaccacgtggggatccgatcaacccagcagtccgttgctctaattaatgcctganacatctccaatggcattggcc

SEQ ID NO: 7289 - DNA, 545 bp, Aspergillus oryzae
  misc_feature (1)...(545): n = A,T,C or G
gaagcccagtccggcgcatgagcagactcataaatcatgtttcgcggataccctatccagtccatgtcaaacgttgcccttcctcacttcatggcatctggaatgccacttggcaacggcacgattatttacagcgtgcaagatcacgcaaatacataaatatcattctgtataatacgttgaagtacctcactattcgaaagacagtttttgtcttgcataagaaggatgtgtgaagttcttgtctaggcacctacatttgttccaggctgttggcttagtagctcaggccattatgaaagttattacccgtggcgtggcgttgatggcgcaaaggttctanggtatttaggattttcgggttttaggcaaggtntgtggttgggtatttatcgaggaagcgttgctgcaggtatggatttctttaatctaggccctgctctttctctcttctttttttttcgncccccattggtnattnctcctngtttnatggacatcgggatgatgagaataccatatttccaatgcatattccaggaacc

SEQ ID NO: 7290 - DNA, 640 bp, Aspergillus oryzae
gtcccgcgatctccgacttcatccgcagcatcagcgaacagtgcgctgctgccgtggagggcctgcatttggcccaggatgcggaggatgatgactcagacgagtccagcaagacactgaatggaaacagactggcccctgaggatcagtcctcaattcgcgagggcagcgaaatgggcgacgtggataactcccttcacgcccaccgggcctccagtgttcctcccacaccagacttggtacataaccggtcgagtacctcaatgtccatggtgagctattcaacctttccggaaaggtcgagccaacagtatggaccaggtgaggtgcccaccaggatagttgaggatgatgatgagcacagccatgagaccgatggtcttgatgaccagaccgataccggaacttttgttaagcataccagcaaggatcttatgcggttgagcactttccggctggttgtatattttgacatcgacaccatgattcatctgttattatataagccttgattggttttttgttcccgaccagatatttactccgcacatgcgcctagtatacttacggacttgactttcacactttctcgctcatctcttacttttacagattctttattaaacctttattgacttcg

SEQ ID NO: 7291 - DNA, 182 bp, Aspergillus oryzae
cgcttgcgaccagactcgcctccagggttcagccggcattcgtgccggtgtacttccctgggggcgggccagcgtcggtttgggcggccggtcaaaggctcccggaatgtagtgccctccggggcaccttatagccgggagtgcaatgcggccagcctggaccgaggaacgcgcttcggcac

SEQ ID NO: 7292 - DNA, 662 bp, Aspergillus oryzae
cattccaaacttggaatccatgaccccgccattgcctggaccgtcttccaagcattgtgggctgagcttactgcaacctccgctgcttctggatttgacaagaacttcaagcctcggccgcctatgcttgtaactgttgacggcctcgcccattggatgaagaacagcgaataccgctctgtcgaatttgaacccatccatgctcacgaccttgtgttcgtgcggcacttcctcgggctattgaagcctggtaccggaaagcctgcccttccaaatggtggtctcttgctctactccacttccgcttccaataacccaacgatctacagtttcgaggttgcactcaagcaaatcgctgctcgccaggctggcctgaatgcttcggcacctgaatttcctcaagcagatccatacagcggagctgacaagcgtgttattgatgcctttgactcttcgaagccaactgtcgccaaagaaggcatgctagagctccagacacttggtggcctcacccgggacgaagctcggggcttcatggaatactttgctcgcagtggccttctgcgggagaagatcaacgaccaatgggttggtgagaagtggagcttggccggtggtggtgtgattggtgaattaagaaattgggaagacgactgagagtg

SEQ ID NO: 7293 - DNA, 92 bp, Aspergillus oryzae
cctcaccgcgagtactggtccggctggacctttccttctggggaacctcatggccttcactggctgtggggggaaccaggacttttactgtg

SEQ ID NO: 7294 - DNA, 170 bp, Aspergillus oryzae
  misc_feature (1)...(170): n = A,T,C or G
gttgccccgcacgtcgtagttggatacgaataggcctccgggccacgaacctcagcaggctggcgacggctccccgggagaaaccccggggagctgtctggcagattgcaatgtcacctcgcgcggggatgaattccttgcatactactgaggtgaacaagcgtgntgtg

SEQ ID NO: 7295 - DNA, 678 bp, Aspergillus oryzae
cgacagagagcatgctgaacagcctcttgcaaccccaagaatgactccaccctcagctgttgatgtcgcagaggagaccagcaacaaggttcaagaacaaacctcctatattcttcataacccggaaagtacaatagttctggattctggagaacagtcagttgccgaacctagtgactgggagagtgaagatgacgaccaacctggttccatggatgactcaatgtccgagtcacagtcggcatatgatgaggaagaatctgaccccgagaggttatccgtgagattaagctctgctccatacatggatatcagtcagggcatacaagaagacacggcttgtggtgattatgatacttcgagtagggagttttattcgaaaggcacggaagcagaaggacgcacgccggatcttacccgtcagaccgcggccagctgcgaatagtatgcctctctttgacactacctctcggagtctcaatgaaccgagtacgtcttggcctggtactgccagagatgacgcgaatcccagcctccctgtacatccgagtggaaaattattcgatcactcactggccgggttcaattgcactgccttcacacaggcaatggagtcttggcaagcacaccctgctgacggatcagcctatcctttttcagatcactgtaggctacgcc

SEQ ID NO: 7296 - DNA, 670 bp, Aspergillus oryzae
ctcagggtcaggaagcattgctgagataataatggacgagaccaagtatgttgcgcatgagcgccaggtagacgtgacagtacaggggcctattgacatcgagaacccattgagtggtattcctcgagatcaactccttcgcgatgtcgaagactatgcacaggagtacgatctgcacgatattcttcctctcctgaagaagggagccctggtggcccagagaccaaaccagtacgatgacatcccagagttgagccctgaggatcgtcagtatttgcgacaagagacaaccaatcgctggaaacacccttgggcactctattacaccatcattctcaattctatcgccgctgccattcaaggatgggatcagacaggatccaacggcgccaaccttacttttgcgcatcaattcggtatcccacaagatccgcccgactgcacatctcctgcagaatgtaatcgcaaccagtggattgtcggcgccattaactccgggccttacatgacgatcgcgatttttgctggctggatatctgaacctttgaaccattggcttggtcgcaagtggggcatctttatttgttgcagtgttcaacttgatcgcttccatcgcctgtgcattgactcaatcgtggggtcaactaattggcctgtcgggcctacttgg

SEQ ID NO: 7297 - DNA, 649 bp, Aspergillus oryzae
cactatgtcaacatccgtttttcttgctcgtctcggtctgcgccaaatcccccgtcccgtacgagttaagcgtaccattctctctcctcgcaggcaacacccattcccgccccggtggagcagaacaccagagatacctcgaaccgcgaacagatacaattcacagaaccgaagtcaacatacacgcttccacaatatcgggactaccaacccaatcaccgattaacctcacacaagaaaagaaagaaagaaccagaagacaccggctggtccctgtggtcgagtgcattgaccgtctactttatactctaccaaccattcacggaacccttaacttttccaaataaaataacccagatccaaatggcgaaccggtggaagtctattaatgggccgaaccgcattcgttggccggtccgggcgtccctgggatttaaccctaaggcgaaaaacaaaccttttgcgggaaaccccaatactgcgcgtcgtgcatgggattcagaggggcacaatccttttatgggccgagggaccgactatctgacggaaggggatatagttataccgtgtaggtgaactaaggaggctaacttgtagaaagagaagatatgatgcacgtatatatgagcaacataccaataaaataacc

SEQ ID NO: 7298 - DNA, 644 bp, Aspergillus oryzae
cttctctatgtctcttcctccccctcctctcttttagcctttcttgagcagaaagagaccaaacctaggcgactaaaagccagccgctcgcttcttcttctttgccttcgccgtacttttcctcccagcttctcgaccaccaaacgcacctggctcgacttgggtcatgggaaggtcatccttcatgacctgactgttctgaagtcgcaccatgggctgttcattgatctcgggctggctgccccattctcggacagtaggtgctactgaagtcgctggacgaggagtgaaagagtctactttctttatcttcagcttgcgctctggagttgtatcgttagtgccccattgcgattcctccaattccagcgcttgtatagtcctttgacaatcatatgttgctgggtcaggctccggtagccagtgctgtgatatatttgccacagctggtgatacaaacccggtttcgcctactatcgaaatcgtgtaaagaaactagtggggagtcaaggaattttaggttttacattagatgttccatgaccctcggttgggagactactccaacacttctttctgggaatcaaacggaacagtgtctgttcccgctcctgaattaaaggaaaaaatgaccggaagacgcg

SEQ ID NO: 7299 - DNA, 621 bp, Aspergillus oryzae
  misc_feature (1)...(621): n = A,T,C or G
cgaggcatgacatcacatgtcgattatccccaacttcaagtatggacacaaaagatccgcactaactcaatagctaattgctgtgttgtcacttcactatttaatcgccaccgtcacctttcccaatctgaccgagtcacccttgaatacgataggcataccttcttggtagtccgaaatccttcactgcttcccaagaataccaaaaattcggcacctctacgagcacgaataaagaaaacagtatatataggtacgataaattgctcttcacgtcaactaaatgcaatgtagggatatactagcatccacgaaaaggcaggtattggtgcttcagatgcgcactctgctacccaaggtaatcttgaaccatggacacaggttgcaaagggcgcgtccgtgcaacgaggtcccgaggagatcgtgggaactcggccttctgctggttattctatgacctcgttccacagaanatctattactttgattagtacaactatttgtcccgattatcacataactgtacccattcgctgtccaaagttggttaaccatgtggatcgatcctaattctgggaggactcacggtaattagttatttttgcttgcagtgtgtgactn

SEQ ID NO: 7300 - DNA, 100 bp, Aspergillus oryzae
attgtaccatcttaaggttttaatatgtaggacgcgaccatgatatatacaatcctcaaacggcgatggagaacgacttcgagatcatgatgtctacaac

SEQ ID NO: 7301 - DNA, 644 bp, Aspergillus oryzae
  misc_feature (1)...(644): n = A,T,C or G
aagctacctcttctccgcacatcactctggaatgtgggtttcggcgcattcgctcggccaaagattctatatccgtacgagtaaagaataacaggacatgagaaagatcgcttgcatccatcacatttccagaactccactgctgaagcattcgactaaatgccatttcagctctgactaaaaggccttcatgccattgattgctttccgggtacgccgtcacatgtgcaatagaacatcttcgttcacactcccctgccgacttaagtctccccggctccgccttttcccaggagccccgtttggtcccattatgcgacccggtgcgaatgataggagagagcatcgggtctccggaaagtggcgagggagagcgaaaccagacggaagttaatgaacaggtagataaatggagcagaaagggcgcaagaaagtcaaggacgtaaaaagataaggaaaaaattgggaggggggggggaataaatcataaatatcaaaggtcatcaatagcgggtcgtttggcacgatatcttgtggaaggcatgaatgaatcaagacgtactctcgtaagatctgccgctcgcggcttgaaatggaaaatgaaaacctnctatcctaagaggaacccttacaacccatcctgc

SEQ ID NO: 7302 - DNA, 664 bp, Aspergillus oryzae
ttgcaattaacttcagccaatcctcgcatatcaacccattaccaccatgtctagagctttctctactgctcggcagagccttgcaagatggttagggtacaacaaggaattactgcccccagttttcaaggaggctgctgagcgttatgcagagaacggtgctgtagcgaaggtcggcaaaattgactctatcgagattttacatcgtaacgatggcagcagcccggttcaccagtctcacttcaaccgcaacgataaagcgctgattatcagcgcccgaatcgcccccgctgacggtactcggcctcgaacccaccacatatatgccgatggtaccggtaccatcaagaagggcgacaagcgcgaatactcgacatcctccgggcatgaggcttaagcacgcccttacaccagctgctatcaggcggggtgatttatgtggagttgaacaatcgactgggtaccatttatcgatcttgcgcacttgcaggatgagggcttcagagcaacggagctagtctatatttggttagagaattctatttttgtgtacagcgcttcagcggtttcgcagaaatgattcgctagatgaacaagaattcggcgcttgttatattttggtcgcaactattaaccaatcagaattaccttaagcctcagcaaa

SEQ ID NO: 7303 - DNA, 695 bp, Aspergillus oryzae
  misc_feature (1)...(695): n = A,T,C or G
ggggacgaccgggccccctgaagccagcggatcggggaatctggaccctaccgactccagtacaggtgaaaagcacttacgaccgcattacgccgccgccgatcttgcgaagattttcctggaccttaaggttcaattgaagtaattcccgttcgatcgtcgccttttctcgtatttcgcttattcttctcctcctgccttcctgttttccttccagccctaccttttccttgtataacacaccttttcgatatcgtactctctggatataccgtccgagtctacgtcatcgtcgatgcagtcgcagtcactgaccttctttttcttcttaaaccattgaaatcaaatccatcaatcggtcactcttcttctaccacgtgcctcgcccatggcgaaacctccattctttcgcgaagcttctcaacggcccnaataccggcggagtcttccaaaagtctttgtgccccgctacttggcttccttctttattttaatcgatggaactccctggtcttgggcgcattggccaaggttccaacaaaccgtcttccgcaaaccgggttcttaaaaataacttttcaaaattatcccgtttttcgtcccaaggccggctggatacaagtttgggccaaccattggttccaataatttaaacccgcgggtggggaatttttgagagggaccaattaagggcc

SEQ ID NO: 7304 - DNA, 711 bp, Aspergillus oryzae
  misc_feature (1)...(711): n = A,T,C or G
gggagtgtgattagtgactcttcgacatactgtgacgtaagatgctcccgggggtgagcttgaagcctctgcagccgccgacgtctagtgcgttatggcaacacagtctcatctactggcggatctcattaaagtatacgcttcaattgtcagtgaacctaccgccttggtcgggataggctgtctgtgagagtctgacctcggaattgatataatatgcgagactatgccagtcacagaacttgatcatgatagtgctgacttatgggatcagatcgacattgcaggcattgcggtgtcaagcattcactatatgtcgaacaattgctatctaatatgcgatgggtaatggtggagataccgttctcgatagcgattaatcttctgatatgcttacaataatgggtcggaatgctgagggaagagacattggcttatgtctttacaagccttcttggctgtacgtatttgttccttttggaagataaactgcaaaagtcggttcctggttgtacatgtcttgcatctttgagcgtgcatggtatattgctctttaaattgtttttttctacttccccctcttctcatgggtagttcggctctcatggctgctcttttaactagtcaacactctcccggaagnaaaaagaaaaattcgcggctcatttgatccaggggtggaactggggaaatttgggaaactttttttgg

SEQ ID NO: 7305 - DNA, 666 bp, Aspergillus oryzae
tgagggcttgctgttagatcccgcctttgccactgctcgacttggggacttgtcatcgtcagacatagttcccgatgcgctcttggtggaccggcagccggtctcgggaattacggacccattctttgtggatgatcccatcatcggcacgcttcttgggctttcgggagttactgatacccgtgagcagttgtatcaggactataccaggttgcagcagagcaagcagagcatggggtcagagcaagatcttctccacattcagaatccaatgcgcttgcttccaggcgatggggaaagtctagatttggtgtatcgtggtcccaggggttcgcctttgagtctcgccaataccactgaccggccgagcgagctcaactcgccatatgaaatgacagaacctatacgtagtgacatggacaatttcacgctgtcagagcagcctttggacaatgatttgctgttacagttgctcagcaactccgatgataacatgggaaccttgtacggcaattgatgtgggcattcatggctggaaacacgggcctcattatgaaattaggcgtgtcgcagctatagaaatgtcaaactgcttccggcagtcaagtcgtcttatgcccgtggtcattatagtaaacacggggctaacagccgtttgcgtgaagt

SEQ ID NO: 7306 - DNA, 594 bp, Aspergillus oryzae
  misc_feature (1)...(594): n = A,T,C or G
gaagaacgaagggtccaactgcctctcaatccccagcgtggcatagggcttgcaacacttacctatacgcgtaatggtcctgtaggagaagatcgaagattctacttccaagacgatcgcataatccctgcagagatggtttcccgtatgaacagaagtcaagagaccagaagccaggatttggaaggtatcagcagccaatgctcactgtctgacgacggggagtcacaggaagagcccacggaggcttgccactgttaccgggatactgagatcgacgagtcctctcacgtctttaatggagatatggttgatggcatgaaagctccacgggtgcggaagcatcatatgcggggaggctcggtgaagggaaagagcaagctggttaatggtgaccttgatagacacacctttcttgcggttttctgtcaagattaatacagcagtttccgtttggcctcccgtggtagatcaggatatgttggttttgcttccactgatgcatttagctagtcctggtgactatatttcacctatggtgaancanannaanaagggagaactntaccacttgctttagtcacctcctaaatc

SEQ ID NO: 7307 - DNA, 61 bp, Aspergillus oryzae
agaaaccggcgcccttgatttaaaaattggccaccccccgggaaaaggctgtttggctttt

SEQ ID NO: 7308 - DNA, 713 bp, Aspergillus oryzae
ggcctgtggtacggtatgagtcaagttatatgatcccgaaccgcggatccgattaggtctccccgttggattgcagggccactctgcgcatcatagattgtgccctgaatgcgacctcatcgctcgtcatgtctctatcagactccgggtctcccgcggttgcaataataactcgttccaccttttactatgcgccctgtacttgtcaaggcacaatttctgtcaatggtgcccgcgatgagaacgcgatattgagctgtcgtacagaggaaatcgttgcgattctctccggtgacgggctgtaaagctagagctcattcattatgacgctgctatacataaggggactagccccctaccaaccaggtgacaacggtaccgatgtgatcattaacgaagtgcacttcaatcgaaccacactaaacacctacaactacgggctctacaccaacggaacactttccaatggacaaactgctacctaacccttcagcgattcagacctcatatgttcgtcgagaatggaacgttcattcacgggaacatcgtgcttctccgcccattaattgatatcggccatcatgcgtgccttcgggcttggataatgcgctgatattgaggcaaactcccaccactcccattcaaactcaacctacactaaagttcgaccgataccatttatagtaatgaccaaccgtctggaattactaccg

SEQ ID NO: 7309 - DNA, 761 bp, Aspergillus oryzae
  misc_feature (1)...(761): n = A,T,C or G
gacgattatgccctcgattacgtaaantaagctgtaccagctcgaaccaatccggcccaggccctcgttgaccttctaaaattttccgctcgttcttccacctttctccctctcgtgaccggagtcacgggtctacctccccatcccgtgaccggcatttcatcacgggctgtcagattttactttctcaaggatcccccgaaacttaatccccgcgtgtcataaacatgcgcgacatgccgtccagatttatagaaatcctcgaccccgaggattctcattttcgtatgtctgatgccgacgtccggctggaagatgtcctagcggaccaagaggcgctcgccagccggccccgttcctccacgcaatcgtcgaccaaagcgggtctcgataaagaccggatatatcgggagggtccatcgtcgccacaacagcggtggaagcgcttgagcacgatcctggtccctgcgagacggggctccaactaaacggaggatctctccgaccacgttcacgctagacgtgatcatcaccgtcggaatatacaatattcctgacaagaaatcaatacatttttttcccgcatggttcttcctgtccagggagacccaaaatanaaatcgacctgccctgcctatggatggcggaaccaacccacagttacgggggttgtggattatgaaaaaaaccaggtttcggcacaaaacagggggtcgcgccccatacccaaccaggatttttttttttacaccccaaccccn

SEQ ID NO: 7310 - DNA, 715 bp, Aspergillus oryzae
  misc_feature (1)...(715): n = A,T,C or G
cggttgtgaatcagcgacactatagacgagctatgaccagctatgcatccgactagaagcttggatcctctagagcggtcgacaagtatgtatgtctaaagctacatgatcagcctgaaccgagcataactcgagtgccgagactcctctgatgtatatcgagatgaatgacaaacctacgggtccgttcttgagaagtgggctgagatttctcacttggcgaaaaaaaggacgggcgagcgggaacctgagtcagacgaaatacctggctacttgggatctcacatgacggtgttgtggaagagtgcatctattgtcattgctggagtgacggcagagtaggggtctaaagaaacccatactgagtagagatggagaagacaacaaaagcccaagacgacagagacgacagaagattaaagctatcagagcgagactatatcactattcgaaacctgcgagtaatttaacaagaagtacacatcatcattgttatcaattcgacgaagacatggtcgaaaattcttgcggtgtatatgtctgttgtatatgggcctgggcattgttatttttcgccgtctttatgtgtactaacacttccattgataccccagaacanaagatgaacgcttaaacagcaccaaaatcaggagaagaatggcgctgctctaggtatgcttctgggataaaaagcgatgttgaaacctcttaaaaa

SEQ ID NO: 7311 - DNA, 692 bp, Aspergillus oryzae
  misc_feature (1)...(692): n = A,T,C or G
caacgaaagaacagcattgcatgtgaaaacacaccctacgccacccagctcgcttccaagcgaattaacgtgagcttccgcaagccctagttatccggtggctattcggccatttcacggtagttactcggtagctgtcaagagttcgtcttcggaaccatagttccagagacccttcttcgaaatctagaagagcccactattgcttacggagcttaacaccacctagtccgtagcttgcacagctccaggcggagggttgcccttctctcttcaagacnggacccgattccgaagtactgggcacgcagaattggtgatacacagtatggtgcacgtaaccgtggaaaaggataagcaatgcctcgccatggtggagcctcaattagtccgacactgtggcgcatttcggttctgtttttccaattttgaggcctacagtgggacgctacaaacacattgtgagaggccacgtctaaattaatgggggaaaacttattgcggggggtattattaatcaaaattctcaaaaatttgagaaaaaaattgctaagggggaagtgttaacaaaaacacatttaatgggcccccaatatttatcaacttaaatctttatgggggagggccaatgggtagggttgaaaacaagggtcttttgggaaaggttttattcccggctaccatataaaata

SEQ ID NO: 7312 - DNA, 680 bp, Aspergillus oryzae
cgactggagaagattatacagcaaactaagaatccagaatgcatgatactgctcggagcgctttatgcggaggaggtctttaccagcgagagaattggtagcaaggaagacaagtcatccgaagccaaaaaggcgatcagtcttctagaatcggttcgcgccctctggaaggacgaaggcaagaaactctcacctgaagagtcagttttggtgtatttggctcgcttgtatgagcgtacagcgccggagaagagcatgcagtgcctgtcccagctcgaggaattgcaactggcagcaattgttgaggatgaacatcgagaaggtcttgaaaatgaggagcagctcacagctgctcttcgagtaaacctaccgcctcagcttctcagcaatatgggttgcttcttgtaccaggctgagaaggtagaccaagcacggactatgttcgaaatggcgttgaatgcctgcggtcggtcccaagagatagaaagcgagcatgacacggacgcccttgtcacgactaatagttattatcttggacgaacatacaatgccctccgacatgcccggaggaagcaaaaaaaggattttaagggtcttttaaacactctccggggattatttaggaacaaggcgctttatcgacacttttttgttccttctggggagccctacgagaaagg

SEQ ID NO: 7313 - DNA, 706 bp, Aspergillus oryzae
cgtctacgtctgcatacctttcgttcctcctctcccgcggtctctcctgcaaactttcgtgtcagatccacaatggccgatcttatcgaatccgcaaagcgcgcagccggtcaggctgctgtaaagaaccactaccctaaggatgccaagtatgtgggcacttggcagaggtccgacatccgatattatggttagcccctttaggagtatatgaaaatgatcctaagccacactttgtcaatacctgagctaatgtgtttgtaggtcgaaagagctccttacggctgatagatgtaatcgcgtcatgatattagtctatgtggatatattgcgacgccccttacggattagacgtatataattgaccacactcaattgggaacagatgtcaaagcttagtaacccggtgtaagagtctccctcacttcgcgatgtggaaagaagactacactgctcgaagcgtcacgaagcggtggatcttctatgacgacgatgttactcacgacattgtcgatagtatggtcttccccaaacgtatggcgacggagcaggggccgtgccccaccttctgatcggacgatgatggttgacgtacgaatacgatcatgatgatgctgaccgatgaagatgacgaggatgtccgatgagtcatgagataatagatagacgatcgaggttgctgattgacatcgagaacgatcggtcg

SEQ ID NO: 7314 - DNA, 640 bp, Aspergillus oryzae
  misc_feature (1)...(640): n = A,T,C or G
caggagaatagggttgttaggcagcgtccctaagctggcatattctgagtatctgaagagcttggttgtggcatacagccgaactgaattcgacactgacgcggatcctatcaagcgcttcacgcggtctcacattgagttcgtcgatcctgattcacagcaagccatctgtggtccggaggataaactcaggccctggagaccgcatggagcagctggagagaaaatcagttgcattctagagtggacacccaagaaaggtgatgaggaatatcacttcattgttattggtacggcccgtanaaaccagcaggaccgaggccgggtcatttttctacaaacgtcaaggatgtcgtcagatccttcgcaaatcgaatgaaccgtgaaatatgttcacaaatttgagggaccggttaattcgatcggaccatagggaaactttactctaagggtttcaccgtngcaggaaaccgccccttaaaaacccaatttttcacacaccaaatggtttaggggcaaaagggaccctgggccccttccaggggtttattaaacctcttagacccccttttacaatggaaatttaaggggatttttttaaccccgaagcgctggggaaaaacggggcccctctttcaaa

SEQ ID NO: 7315 - DNA, 730 bp, Aspergillus oryzae
  misc_feature (1)...(730): n = A,T,C or G
cgatcttgctcgttctatccgagttcgaggcgaggcatttctacctcgccggtcgatagtcgtggtccctaatgccgcattacagggctggcgggacatacaccaacatctgcgctggcgctgatgaccatgacccggctgtacgggtgcacctttaccggggctaggaatgatctgcctaacagcgggaggacaccaccgacttgttccatattcacgggcggacaagaacgtataaagacgccgaaccagatgctcaccaacttctgtatggaatgagagaaaggggagactccaacagaggcctcgttgtggcgacgttcgataatcgcaaccacggtgacagaacaattgattcagtcgcaattcaggactggaaagggggcaatatccagcatgcacaagacatgttgtccacgattgatggaaccaccgacgacatcaaactagtcatgaaatacctggcgtcttatgtcgatggcattttccatccgacccagttcatagtgaccggggtctccctgggaggccacatcacatggaacatgctcgccgaggaaccttccattgctggtgctattatcatcgtcggatcaccaaacctcactgatatgctcgtggagcgcctgggatacgcctccctatccgacataccacanaacacgaaggagtggccgaggtccatcgaaagtctatatcgagagcgtgacctagcactcgaaaagatagt

SEQ ID NO: 7316 - DNA, 708 bp, Aspergillus oryzae
cttgtcagttggactggactaaagcctctcacgcctgctcctcttgtttgtgttgtgtttattcacacatcgcttttgtaatatcatcaaagctgaacctagtcgaatcactgaaacactgtatcagtcggttgttcatcgcatcacttgtcttcgagatgaagcctgtcgtgtcggtgttgaatgcgtggtcctgcgcgatcatatcccttttcgctattgtcatcctctcggtcctcggatcgttatacaaggttcgtttgctgccggatccgccaccagatcttctcgcttgatgatggcgaactttgttgtctgtcctgcgtgtggtatactaggagtggtagctaatcgagatactcatagaaggagcaccacggcttcaccggctcagagggtgagcctgaggatggcgctgcggtcgcggcttcgatcttcacagccgtgtttgtatatgccgtacgatttgccctaccttgacacagtaattagaataccacatcgctgacagtggcaatctataggcctttttcgttttctgttctttcaagcctatcttcacgtacgaaaccgcaggggaggcgccatatcgcttaactaattcgccactattgttataccccttcttttcgatgatgaaattcccaaaatttgattctttggccataccgagatataactatgttgcccggatgataccaccgaggg

SEQ ID NO: 7317 - DNA, 573 bp, Aspergillus oryzae
  misc_feature (1)...(573): n = A,T,C or G
tgacattccattatatcgaagatttctcgaaattacttcagcaaatccggctttgtttgaagaaaggttcaccgaaagatgactctaggaaaggggggaggttaatcttttcagtggaacatcccatctgcacagccccagttaatccacaacctgactggaaggttctgccaattgaagatggcgatggagtgggtagaaagatttggcctttgaactcctacagtgatgagggtccgcgcatgacgagctggctgggcgttgacggggtcagaaagtatcatcgaaccgtcgaaacttatgtgactgctttgcttcagaacggttacgtcctgactgggttgaaggattgggttccttcggagcatgacgttgaggagcatcccgaatggaaggatgaaaggcatcggccgtattttctgctcatctctgctgagatccattcagattattagaatgaatctgttaaaggccctggttgtaaagcagtattgacctaggtattctaacttggatcctcattggacgaatctgaaaacaagcatcatgtcctcaaannaaaaaaaaannnnn

SEQ ID NO: 7318 - DNA, 176 bp, Aspergillus oryzae
  misc_feature (1)...(176): n = A,T,C or G
aagccagaagcagtgtaggatngtactcattggccgaggacttgggccggatgcacagccgtggcanaggagttttgaggcctttntagagagggatgagtagtacaagtcaattgcaggattatagagcggatgagtgtgctatatgtatagagggcgggattcaagttatacga

SEQ ID NO: 7319 - DNA, 773 bp, Aspergillus oryzae
  misc_feature (1)...(773): n = A,T,C or G
cttagtgacattgagaaanancagtttgaatgcttcgagtactatcagggaaantaagnnnggnnnnngngnggnanncagaannggaacgaaggttnaacaatccttccctcgcgcacaccttcaacaccgtgtgtgcttttggattgcaacaatcatggcgtcgtctgatgtcaaagatattgaacatggcttggatcggagggacaatgaatcggagaagcctcctttcgaggacaacctgaaggaggagccgccccagctcgcagtggacgcctttgtcgctgaagacacggcgaaggtcaagcacaacactttgaactggtgccaatgtgaaatcctcgagaccgttgacacagtctgtgtcggtgtcttgactcgtgacaccactcttgctcccatgggtcttatcccgaatcatctctcatagtcgggctcgggatagttgccacctcctactgaggttataccatcgcacaattccgacacaaatatccctacgtgcacagcatggctgatgcaggtttcatcctcatgggtcccatcgggcgccacatcatcgaagtcggacagctgctgttctttctgttcgcgtgtggaagcacctgttgaccttccccgtgtggatgaacaccctaaccgaccatgggacatgttccattgggttcagagttggcggcctggatctctccttgaattctccttgccccaaccatgaaaatgtntcctggttcgccgaaacctctttcttgagattttccccgcggcgacat

SEQ ID NO: 7320 - DNA, 669 bp, Aspergillus oryzae
  misc_feature (1)...(669): n = A,T,C or G
aaccccatcacggggatttcagtagcgttgcccatcatgaattgcccgtcgcgtactgatgatacgctcttgcatgtcgagtggaatcagaacccgccatttctggcgccagatctgacgactcgccaagacttgaatggaatctctaacgcccgtgagaataaggagggagatggaaatggtagtgattctggacagtcgttggcgtgcctcagtgacaaacggaggatgaattccctgccgattgatccagagaagaatctaatgtgggataatggggcgtcactgacctcgaagtcaggacgtcccattgacccgatgaccagctntaatgctggtcagcagagtggtcgtggtcaaaacaattctcaatcttttcaaacattcaagagctgggcatcgtggctactgtcggttctcttcacggcggcattgatttcccataatagtattgggcgatatctgcatggcccggaggttcccccagtcccctcatcaggtttcgaaccaattgaaagagaccttcctttcaagaaagaggaacatgtgcgcagggtggtgttgggggtancaagtacaaccttcctttgcacgttggcgggctgttcatatatatgtagtttcgacactagcctgcgcctttccggtcttgccatatggtttccgcgt

SEQ ID NO: 7321 - DNA, 640 bp, Aspergillus oryzae
  misc_feature (1)...(640): n = A,T,C or G
cagtctgtgtcgatcatgtggttgtgatcctgtttgggctaaatgacatctcagtgacgttcaagtttaccacgtaaacacagcttgggcaacgtttaccggcatgtcgtcagtgcagcaaccgtgccatattatcttccaggacaggaacaaggatatgagctgcaccgtgcttgctgtcttgactgacggcggggcacatgggacctcgaacgcttctatcatgaaaggactcgtgacagccacttcgtcatcttgaaagccgaataaaacccgcgccccttgggaactcccatggttacctcagggacttgcgcaacagacgaaagtctaaaagtacaaaacatcataacgttacaataatatatggagcccttttgatttcaaagatacacatacttgccgtaacaatagccgcttctacctttacgcaatcttcacctggcgtccggttcatgacgttgatctcccatttgtaggaaggctctagtcacatcattctggccgtgagtcaatagaagcctaaggtttttctgtgcctacactgcctagataataccaatttcagttaactggnnaaggantnnanngncaaggnngnnnnnnaaactttcctgcggccgagaaattcgaagaattc

SEQ ID NO: 7322 - DNA, 642 bp, Aspergillus oryzae
  misc_feature (1)...(642): n = A,T,C or G
ataattggtgtggatatgaagaaagaattcgctacagttaccttccgccgaactgatggcaccattttctcgcgacctgtacgcggtatggtgtatgcgactggtcgccggggctcccttggctacctggagcgtggactcctttctgagattgtggggtgcgatgataaaggcgatgtcagcccgacggtctctgggcaaaccttgcgacacaaagcatttgaaaacatggaaatcgcgaataatgtcttcatcgttggcagtttgacgggcgacactctcattcggtttgcacatggcagctgtgctcaaacagcaggcaaactgatccgtacatatactggggaaaacaatgcaaagtccaatgcggcggcctctccgcgaccgcagggatcatcaccaggggtgatgcagggcttcgatggccacgatgtttacggaaacggaaaccacagggcccaactcgataaaatagatagctgccggacggagtaccctatgcccgagaagtcaggtttgcttggaagcatatggaaagcactaacggcaatctggtaacgatacaatgtgctataatcccttttctatacatgcatgtctcatatagattctagaagtcatgtgcacaccctttattngtat

SEQ ID NO: 7323 - DNA, 666 bp, Aspergillus oryzae
taccacaatatagacaccagaagctctgagccatcccctaaatacaagtgcgatgtccatcctgcttttctgaaaacttctaactccgggccactcttccaaatcgtttcgcaatgatacttcagtgctggcccattcgtgtgctcgattcaatcatcttcgcggattttcctcaccatcaaaagtttccacgcaatcagccttgccgaaaatacagcagcaatttcgcattctcccgggtgagccttcgcaggattctccgctcctgacgcagccactaggggtaaaatctcatcgcttggcagatgtgcctactttgaccacattttacgacaacattgatgatctgtcgcatggagctgagggtcttaccaatcccaagccgtacattatgcctttactacagaagacatcacataaagatccaccgaccacagccctgagcttatcacactcatacttagagcatggcggtttggggatcatcgcgacttgtcagagagggcgtcagagtgacccagtggtcaccgatttagctagtccgaagaacatccctggtattgaccaccgatcaactagcgggacttaccaattgtcttctgcgagtagttccagtgtgaacaaaccaggttcgcagaatattcacctgatgcgtcaagcaactcg

SEQ ID NO: 7324 - DNA, 655 bp, Aspergillus oryzae
  misc_feature (1)...(655): n = A,T,C or G
ctcgcacgtcagagtttcaccaaagccttcactcatggctatgctcagtcgggagttgcggcgtcgcagtcttcctacgcgtcctccgccacattcaatcaactcgccaatcaaccggccaaggtctcccggagtgcattgcaaaatgtattccaaccctcaagttcttccggcgctggcgccaaagccagccagggcggctcgggctcgggagacttangcctcgcggcgtattatgccgcgtggcaacacgctcagcagactggcgatgatagtgattggaaacagtttcaggtgaagcggaaactggggtggaaaccgtcgacgccggaagaggcagcaaagttcaaagaagatagcgtgaactcgacgaatccccataatttcgactcggctnacataacgaaagcctccgccaatgcccaagttaacgctcaagttaagaagccgtggctcgaaagaattaattccggaaaccaagcccaaactgaggaggcttccaatgaaaggataactggccccttaggctttccctgacctaccagcaaacctggttgccttgccggaaggtttcacggagcaaggctcaaatgtttccaatcgaaatgtccacttggtttttaccaaaaagtccccgagatccccaggcattttg

SEQ ID NO: 7325 - DNA, 671 bp, Aspergillus oryzae
ctgctgtgagcacccacccctgtatttgccctgtgatcagactgttaggcaatccatctggtcacagccttgtggtttatttcccacaaactgtccgttgatgaccgatcagctgcggacataagatatgacgaaaggggccatctcccatccgtctcttgttctttagagactaccgaaagacagatcttccatgagcactgtttggattcgatcagagatccactgctcgactaagctttttcaacgggtccatcaggcagatgaatcaactgtcaccaccgggccagaaccggtgtcacctcgaaaatctacctgtggagatcattcaggagatcttcttccactgccttgaattcaatctcccacgggcctctctgtatatctccagagtgctttctgattccacggtatacacttggcttatccgactcgccttcagcagcgcgaacgagggctcaaagagtgatttctttactcccgactttctaccaccgcctctgtgcttctttgcgctctctgaacatcagagaagggaccttcaacatgaaatccttgcctctcgttggtgcacactacccttgatgcgcaagtgccaaagggagtacgtggaacatgccattcgccgcaagtgtcgaaatctaaagttgccccctgaagatcactatacc

SEQ ID NO: 7326 - DNA, 650 bp, Aspergillus oryzae
  misc_feature (1)...(650): n = A,T,C or G
cgagttctagtgtgcccgcgtttgagaggccgtcaaatgtcagggggctcctgttcgagtaaagattatccacaccatgtgccgcgcagacattcttcacgcatcccggcggcctgcgctggcagggcctggtcctgcacaggcgtcttgggggtgaaactgtctaatacttatccccggacaaaccccactaatctgctgtcagatattactcacagagactcagtcaaccaactactcggccacaagcatggctcgtctgtcaatattctgcctatcatacttcgcccttacctttctctcctacgcgaacgcttggacgctaacctggcgaaatgagactggcgcccaaatagtcgatggcgactctgaacaaaactgtaccaggatttaccatacgaaaggcgaggaattctcattcaaccccgaaggcaagtggtgcttgaaattttgggacgaggcaacatgtgaggcacagattggaaaaacgtgcgatgggcggagatggcaacanattgcatcacggaatatttctgcattcaacgtctacgcgatgccgcctgctgacattagcgcgaaccgtatggcgagtacaagtacgacattcactgtaagcacatcatttacgatcactaccacggttttttggg

SEQ ID NO: 7327 - DNA, 525 bp, Aspergillus oryzae
  misc_feature (1)...(525): n = A,T,C or G
gcattattctacgaatgttcgatttctctgatctccatcgatctgattcttgtctgcttattcatgctttttctccccgtcgaccacgttagcattgccagcatatcctttccattcagatgataagggcatgtttattccataaaatcgcgcacgaagcatacctagccatcaacgcaagccaaactcatggacaaagagaaccagaaaagcacaagagaaagggaaaaatacaaccaaccattccaccgtccttccgcatcccatgtcccgattgataaaaaacgaagcccaactggtttgcggctcgagagggtatgaaaaaaaggaaagagcaacggacaaagggagaaagtaggaggagaataggctggaacagtgtcttcatgatttccccttttccatcctgttttatcatgtttccttttttacccttcttgtctacgagcttaccttacttaccgattttgcccatctaatgaatcaattaacttcttttcttcttcaaaanaaaaaannnnnnnn

SEQ ID NO: 7328 - DNA, 808 bp, Aspergillus oryzae
caaatgtccatctgtgtcttcttccgtactattttaaaacgacgcttgattcccaatactagcgagaaaagacctcgatatgacagcaagttctggacaagcaggctcctgcaggaactcgaaatgcagccactggaatgacgcgcataatagattcacctgcaaggaagctggctgccggaaacagtggaaaatttgccaaactggcgaccacggaatttccggaaaatacgccatatgttcgaaatgcaaagatcatcccgcaggtggccccgatggctttatggagtggatcgacctgacacaatgaacatacttcaatcaaccttgctaagccattcatcgatgaattcctgtgagccggtaacctcgatagtaccggattccacatcgtccacacactcatcgtcagaactttcgatatcaatccatgagtgctggtatatgggcttctcattagctggatatcctgttgaccgtagccagctgaatattccgcgtgtagccgcctctgacaatgattccgaaaacaatttaaggtcgtgttgtgctgatggatatcgttccggtacatgtgtatttaaaccattttcattgtcagaagtaagatctatgcccagatcttcaagctcttcaccatttgcaagaacccagttccaagagtgatactctaaacaatggcatccgcaacatgcatgctgccgaacctgaggttctgtgtcatacagaagagtagcaccaaaaggcttccaagggtaaattggaactctaataaatccatcgcagcatgtaatgaagagaaggcgac

SEQ ID NO: 7329 - DNA, 681 bp, Aspergillus oryzae
  misc_feature (1)...(681): n = A,T,C or G
gccaggcaacggtcgcttcgccaacaccgacagcgcagctctatggatagtgccgatgaatctgttttgggtcgaaacgctagtattgatggctcggtagactctcgaggttatcggaattcgaagactctaggtgatgaaccccggtcaccaaggttgactgctcatcaagaagctctaattaaggagctggaggccgtaaaaagccgcaatgcatggtatgcttccgagcttgcattggccaagaaggctggttacacgccgaatccttcaagtagcccaactttaaacgagcgtgcgggtgatgcgttcgctgacgaagaccgccccttgattgaggcattcctcgcaatgagggcggaactcgcaaagatgcaggcgactgtagatcgacaagctgctatagcttccaagcgggtcgctgaggttgagcaccatagacatgtggccgtcaatgaagcggcttatgctcgtgctaaacttgccgctcatggtggtagtcaaagaggaactacacagcctgacgggcgttctcaggattctgaggaactgatgacngagagagggactgatatcatcaaaagattggctctatcgcttgcatctcatgttgaagctcaagcacaactggatacggtggctagtgagcttgaacaacaaaagcggggtaaaaagcttcct

SEQ ID NO: 7330 - DNA, 628 bp, Aspergillus oryzae
  misc_feature (1)...(628): n = A,T,C or G
cctgctcttgagttttcaaccttgtataatgttacgtggccttgttcgcttacttcatttccctcgtctccgtttcagtgcagtaagacgaagttgtcttgattggggagctggtggcttcgtgccgcttagacaaaatctcatgtgatcgtctagcattcagttgagttgattctgttacactaactttttgagttctatttgcggtttactatccgggccttaccatgcatgttcattatgacgcatacttgatcggtgttttacaatggtcgattttgtgggagttctgttcttgttctaatgggcgctgtatttcttctttcttttcgttttcatcatatctctttcctatgagagcattcgatacacgctgttacgacaatacgcgaagtgatatccgagcatatcctacgaggtggagttgcagcactctaaccggtcagtcgggttgtacaccggttttgtgcgactcgatgtcattccggtcatccttactgtgtgacaacgctggctcttcctggtgtctgccacggacgactgcttcctgtgtcatgcaacgtgcgngttaccttgtgttattcccattttgactgcgattctgcccggctgtgatgattgaaatgct

SEQ ID NO: 7331 - DNA, 562 bp, Aspergillus oryzae
cgaggcacaacacgattgctaaatactacactaatctcctctgcaggggaactattgccccccaatattgtgttaaacatgccaccgccgtcgactcacagaaaagatgtcgaaccccccgaggaaatcacctcggaagctgttcgaggatttctgacaggagcgtttcgatttggctccgtctctattctagcgcatatgatcatgatccctccccatccttttcaagttctcttcctccgcaacaccacctgcaccgtcacagcctcaggcccaatcctcgccccgaccaagaccgtcgcttctttccaaagactaacttcgatccaagctattttatcgccccctggaaaggttctcgggatggctggcttccggcttccggatctattcgggtcttaacccccaaacaaaggtttttttccaaatccaactattactcttgagggtgtttcttggcttagagaagggtgaaaaacttaattacctctttcggaaaaaccaacgggggggaacggtgggaggcccacaaggcgggaaaaaattccgggataatgaccgg

SEQ ID NO: 7332 - DNA, 639 bp, Aspergillus oryzae
  misc_feature (1)...(639): n = A,T,C or G
caagggccggcttccgggccggccgttttcccaggcgcccagggaaaaatggaccaaccggcaaaggaaccaccaggcttcgcgggaccttgccgttcgtttgaaccaatggcaacctgacctgctttccgttccggactctatcaccattgaacaagccttgattatcggcggctataaaagccagtctgacatggacaaagatctcgctaatcgtgagaaagaactgaagtaatgaactgagactaatggcattcgcagagtgtcgagttatgtacaattaccttcttctctgggcatggatttgtctagccactttctatcctatccacataggatcacttctctgtccacctttatatcatggactttgtttttaacgtcagatacccattgtcatgagcgtgcgagattcgttgaatggatcgttttttgttatcattactgagcaattccaagcttctgacagcgctacggcatcgccttgtctctcttcaatttcctaacatttcacagtcatgacgacgaanagtccctccaaacctcgtttcttgcgtaaagaccgtttcacgattacagtgtcacccgcttgcaacattcngattcttgtaaattctncaaaagaaccaagcttgctca

SEQ ID NO: 7333 - DNA, 629 bp, Aspergillus oryzae
  misc_feature (1)...(629): n = A,T,C or G
gtttcttgtggaacatatggttgtattatcatggaactcttcctgcagcaccaaggagcgaacctcccggtttctgaagatgttgtcaaggcagtggcagggagtttatatggtgggcataaaactatggagactctatttcgatacagaggggagaatctcccagtctctgaagaggtggtcagggaagctgcaaggaataatggagatcatggacctcaagtcctagaggtcctatttcaacaaagggagaatctgccaatttctgaagaggtagtcagggcagcagcaggaaataatggaagatatggacttgatatcctaaatattctatttcgataccgaggggagaatctcccagtctctgaagaggtggtcagggcagcggcagggaataatggagattatggacctcaaatcctagaggtcctatttcacaaagggagattctgccaatttctggagcggtcgttatggtagcgcaacggaataatggaaattatagacctgaaatcctaaaggtcctatctcgccaccgaggcaattatatgagggaagcaggggtacacctcgtttcctacgaaaggcgtgtaagcttgatttaaaacccacccatggtcctcgtcccn

SEQ ID NO: 7334 - DNA, 630 bp, Aspergillus oryzae
  misc_feature (1)...(630): n = A,T,C or G
ggagggtacagtaatcgcgctctgacaacgggtgttttaagccatctgtcggggctaggggatgcgacctcgtgtctggtgtctggcggngtggatgacaaggccgatcgtttaactgctgagatgacgaatcgcttgngcctgcttgacatctcagctaatgtccaacacgcatcaagcctgccggcttatgacagcgggtggtggtcgccagctctgctagaggaactagaggcattagtatatccaccgccagcagtgaaacctcgtgagaagtctacaccaaccctactttgcttcgacccaatcatttacccgctaaagtggtcactacgcctcgtgatcgacgatctaacggcttcccagatcagccgtgaaacctgatgcgcccgcatttgccgccttgtaagttggcctaccggnacgcatgaacctttcaagattcttattccaagtcaatcgccaaacacaagctggtgaacagaagaatctaaccccagagccacacctttggcaccggaacgtcaaacggcggccaacacaacaacgttccgttcgcttgaattgaaaaaatccgataaacttccttgcaagagacccaagacttctttaccgaaaccccgacaagaa

SEQ ID NO: 7335 - DNA, 590 bp, Aspergillus oryzae
  misc_feature (1)...(590): n = A,T,C or G
cgagggtctattgtgaaaacaacgacatcaatttacagtcgttcaccgttctagttaacggcctgcagcggaacaagtctctgttgagtctatcatacatggaccgcgataggatccagtcacttgacaaggtgcgccgagagatcgaaagcgtcaaacgtgatatgggcgtcgcgcaaggttccactacgagcacgatccgtcgatcactaaacgcggcaaaacatgcgacagtgggacataaatcaagtaaacatttgcatgcgccgggccaccttcgcgccggagtttcgatgcccaacaatctggcagctgccgaagcctcacctttcctataccacgacattgaagtggtcctgcaatccctgaatcgaaaatgggacgcggaggtttctcgcctacgtcgttatctatttcgaaacttcaacgtagccaatgggcttgaggttgaaactgctgcgcttgatggcgacgatgctgccagtgacgggcgtcccaacacggcagcgagccttgcgacaatgctggacaacctcaagcttgacgtaacagtatccgaaaaggaagtccagccgaggccgcagacnaat

SEQ ID NO: 7336 - DNA, 664 bp, Aspergillus oryzae
  misc_feature (1)...(664): n = A,T,C or G
cattgacaaacaagcaaccggtgacctagagcaagatgcgctggatcttgtggatctcgtgagcgagcaggtgcgcaggctcggtgcacaaagccgaaccaagaaagccattgcaatcttcggccacgtcggccgccagaacaccgtatcacagttaggcgagtcagacttcaagatagagattcgaaatcctcgcactcagaggacgttggcccaacttctatttgagacgttcgtcagcttcctcgaaagcgccgtatcgtccgtgatgctttggacgtttgccctctttcgctgggtctggaaaactgcaaacgctaatctaattatccttgccttgttaatatccagcatgctgataaatggattctatacctcacgggacgcctatgattggtggtacgaaaggaaagccgagaatttcatggctcgtctgggagttcacccggaccatgtcatgagcaaagctatttacatgagggacatcgatgaagtgattgcaaactcaaccctcggacatgcgagcgacgacgtgagtgacttgctcgccacctttcatcagcaaaccatacggaatggtggggaacacgtgtncatcaacacgtgttgcccgagagatttagcngacaagaagcgcagccagaccgctccagcagactcgtga

SEQ ID NO: 7337 - DNA, 654 bp, Aspergillus oryzae
cctttcttagtcttcttctgtctttatctgtagaggttgcaggcaactctcgtctcctaattaattcggaattgtgcaatactattctctgatgttgtttctatcagtcccctgtcttcagattgaacttgatatggataccggctcaaccacttcggtctcctaccatgtgtcctgcgcctccgatgcagacgagtcgaaatatctccaaagggttcaataccttcgttgggttcgactcgctctcgggatcatcatctttggcgtcgcggtctctatcatagggtgtgaagcagtccccttccagcattatcgagcgacatcagcatacggcaaggtcggattatatctctggcccttgaacttcgacatccgtccgaccgtcgcattgctgtcctgtggttgcataattgcctttctgaatttgacatacaccattatcactctccttccttctccccacgcacatatcatacgacacaacctcgtttcgacagccatcgccatctcaggaatccttaatgccttaatgggactcatctttcgcgtccttcttccagacacaaatccccccaacgggttcacgaaagttgaaacactgctttcatggacctgcaaatggaaaaccgtgcatggtccactggtcccgaaagg

SEQ ID NO: 7338 - DNA, 670 bp, Aspergillus oryzae
tcggtcgacaactcactcctgcttatcggactagtccacacggagcaactacgccgttgccacacttactccaccgcgtgtctagactcgactcagcccacatagccgatgcgaggaattcaggcactaaattggagcccgtcaggtgcaaaatttcgtccgcctatgggattggacatggccctcagatcggctgtctcttccgcagctgtcactggctgattcaacggttgctcggaaagggtctgcgtgtctcgaaaatgcgacttccagacaccgaacgatgaagctcatgacaaatacaatgtgatggactcctctggggcataatacagtagaaacagccgcgtcttttgagccccaaagataggcgcctcctgtgtttcatattctccccgcccaggagggttcacgtttcagaatccccgaccgccttaccctacaggctcttggcgatgtaactttgtcgccgacccactggcatgcttgagcgaagaatggaggcgcgctccctgccgggattcatcacaagctagacatttttgtctgcagcctgatatgaacagtgattcgctctgacccctgtggcgcgactaggcatgaacagccttctggcgagtcgtggaccccacggcgcctgctgcatgcctttggccaacatcataagccg

SEQ ID NO: 7339 - DNA, 673 bp, Aspergillus oryzae
tactgtttcttgtcagtactgaaaagttgctattgattcatgatcttttgattgatccaaccccgtcatggacgtattctatgcttatacctactccacagcgggatggctctcgctgcagagcatatccttgatcaccgtcccgcatatcatgacaaccttgctgttggatgagtccatatcggcttctgaattggaaatatactttgcacgctgtctcgggtttagtttactcaccattgccgttctaacggtgatgctgacaggatcgatccctttgaactccacggtgtctgaaccggtgaccacataggacaacaatcccaaggaccatttgccttcccactttgatcgttacagcccttttcaaggatttttcgccttttacccttatccccggaacttgtccttgggtcaatactggcttttgttttaggaatgatcgggttccttgggggtgggcccccaattgtgccttatgtggtaccctcttttgccatcttataattggaacaaattatttgggaaaaaatgggttcggttattaaaaactatggggttttttccatacaaaaacaaatcttgtcctagtcaaaaaaaattgcttataaaaaaataatgtctctttttgattgggggtattctttatagggtaaatatagttttgattgct

SEQ ID NO: 7340 - DNA, 657 bp, Aspergillus oryzae
  misc_feature (1)...(657): n = A,T,C or G
cgaggcaaccctcaggccctggccctggctattaaacagaatctgaccatatcgcctgcaagctccggatgagtggaccctgcgactaccgccgcagacccgcggataggatgaatggatcccagatataccccggagtcggcatactcggaccgcagtaggccacagccaacaagggaaagagatccagcccgccggcggtagatgaaggatgcttttcccttttatttgtctatgaatcccaggggtgtagcttcaattccaccttttgtctcaggagaacatcgccttgggagtattaaaatctgcgcaatctttttttactttcgcccctacctccagcatctatacggattagatgccttctttcttggcctgtgaaagaccaggccaaaacaatgatgcttaagctgttgagaccaaattgcagtctatttggagccataccttangaaacccggatctcgtgtttgacctggatgccaatcaagttatccttggttggtttcttatgctcatgaaacgtctccattggacgtggctggntggnnccttttctctcttatccttttctgcttgacctggctattgctaccgtttaaaggggcanaaagcataataatgggaacattgactggctttgggggctcttggctg

SEQ ID NO: 7341 - DNA, 664 bp, Aspergillus oryzae
cggataatggcgtaaaacacatattgtcatcactgcagtatctaggctcatcagggttgttctatccgttgtcagcctatgttcaggcgacggagtccaaattggagactcgagggctcagactcctctccactccctttttgcttgacatcattccccttcgcgggaggacggcgttctctaggagggcggttttccccaaattggggcacatctgcagcccttgcacgtaccttgggcttcgcctcttctgccacctttaccatctttgccaaattctccttgaaggccttgacgtcgtcctattcttcatcttcctcttcttcgacttcctcttcttcgacttcgttttcccaacacaagccagcacccgccggcctgtggaaatctgggtcgagatcctcatccgaagcgtcagctgccccactcatagcaagaacacgatgtatagtccactggagctggagcaatttgaccgatggtaaagggagtttaactggatcagttgtatagaaagtatcccgtacttgtgtctcgagataagaacgggggcaattggagaccgaagtccggtgaatgactggcttttagattcttatttgtagccgccaaaaaaatttaccggccatgtttttttgcgtcactcacctgaagcgggtccaac

SEQ ID NO: 7342 - DNA, 671 bp, Aspergillus oryzae
ggaacccgcaaccaaggttttgaccaggagttctaacgagctaatctcaatctgtcactgattgaggccaaagtgtcgctcctccatagctggaaattcttcgccatcgagcattgctcagactttatgacggatcgagaggttcagaaatcgatggctgtagtcgtacagagatgccttgaagctaataccaatggcgttccacaagaagcaatcttcgcacggattcaacaaacacgggtagattttgcacaagctctcctccagcgacttgtcgagattggatcccggggtgctgaagtttttggtctgcttggggtagtgtgggatgcattgcgctctcgccgcgcaacgtatgaggaggcaatcatcaatgacgacaccgagttttaccggtcccttctcaatgtgctctttctcgcccttcagtttcatcaagactcaccttcacagacagcgcccgaaacgcctcagttaaaaagctgagggatcattctgaccttaagactggggggcgaaatgtaaagactgtggatgctcaaagggtcaaatctttgaccgcgttcttgcccgaacaacccgagaaatgcacaccgtatgacttttgcatcattacagacattctgaaaaacatggttgtcagtgtaaacatcgtgatccgcgatttccct

SEQ ID NO: 7343 - DNA, 691 bp, Aspergillus oryzae
  misc_feature (1)...(691): n = A,T,C or G
ggaattcctcagtagcacttcgccaagctttggagtctctagtggccttcctcaaagtcgacagcccgagctaattgcccagtcgaggtttcttggagatagtccagggaccaaggcagggttggacccgtcacaatccggcaatggtgaaagcgagcccggggttatcattgatggcaatggcttcgcgcatattctaacagttgccgaagaggcgcagcgtaacctgaatctgcaacaagccgtcatggcaaagatgaaagctaatgcggttgaatctaactcgaatgcattaccccagacgccgaaacaagtcttgctacgccaagaaccacagtcggagcaccagcccatcccttctagactccagaattcctggtcacataagagcaaagcaactacgttgaattggaagagtcgcaccgaaacacctgcatcctccaataataagcccacctttttccagaagattgccggcttgttcaaaacgcgaatggctcctggccaaggaaatcatgttctggtggagcagccctttggccttgcccactaataatgctttgattctcgctgggtgtctgcaattcgctagatttcgatatattttcgttctatacatttttcttacgttggtcgccatgtatctgcaaagcgatcccatggagttgatcnccgatagcatttgtaccta

SEQ ID NO: 7344 - DNA, 436 bp, Aspergillus oryzae
  misc_feature (1)...(436): n = A,T,C or G
gcaagacaagagattctcgccgcgcaaagaggcgaaactcagaccgaacccaaggagaccgtataaccccctcctcttctcttctacaccaatgggttcaaacccaaccaccctctgctcttcccataaacatacatggtaacagctacacgcataatagacccctcttgctccttttttccaagactgtcgccccctaccctcataatgattgagtctctgatactcctggcgggtattatgagcattgtcagaccgtgagaaaagtttgctggtttttgctttctgctttagcttaacgtatcgctatccccacttcaacagggatctttggtgttgcttgatagctggagtntgtaaaataatgtatattaaattggaaactgatgaactggagtaaatacataattgcatgcagacaaaaaaaaaaaaannn

SEQ ID NO: 7345 - DNA, 263 bp, Aspergillus oryzae
tgaagtctatcgagtttcagggtttcttttgatatgtgttcttttttttaaggaaattgtcattgtccttctattctcatttcggcgatgaagatactataaatataccctaaggaatgcgggtacttggtctgcaactacaggcgagtactcccaccagtgcctgccttgcgggatactaggcaaaatgtcaatgccattactttgtacccactgtgacttatatactacagtagtgaaccagttaagtatgtgttgttatg

SEQ ID NO: 7346 - DNA, 627 bp, Aspergillus oryzae
  misc_feature (1)...(627): n = A,T,C or G
ccactggtggcttcacaactggatcttccggtgactttgtgttatccatgatgcgtcgtgtcggaacgttcccttggagttctggaatggttccaaccggggcgcacccgagtcattcatataccttccatggtcgacagcttagttgatacgccatgtcatctagcggaatccactatcgcccctatagtaggggagagaagcccaagaccgtccgctcgggaagattagggtttcgaggctcctactccggagatactccccgataagatagacggaggactatctccggccaatcagggagccaagatcgcttatcttgtgttgccactaaggagatgaggtaaacgcttcaactgccgaaatccgggggtcccttatcattgcctctagccccattggccgttcatggcgcggagattgctttgaaattcatgatcaatgagatcaaataatgaaaagaagggacaatcatgattggctacaattccacgctaatagtatatcttcagaagtctatcttctgccgccactcaacggtaaatgattaaggcattgtactcagaattgagtttttatagcggtgtaagcgtccctttgatatcatacgttccaatttgccagttn

SEQ ID NO: 7347 - DNA, 1108 bp, Aspergillus oryzae
gtaggattcattcggcggctacacttttagtactatagcatccccacagacacaccctcaatcaatcgaactttgcccctccagccaacgaattcaggatgggcatggagtttgtctttataaatgtcaaagagccgaaagacgctctgcagctcgctaaggagcccgaaattcgatctcacgtggctcggtaccagtggaagaaaatcgagaatcgcccgtctctcaagcgaaaacgaaatgcggtgctatcgttctgcatggacataagctgttcagcaacctggcagtcacgaagcgattccgaggacgactctcccgagattccggacacgtcctccaccatctccatccctctgcagttagggggactgcgagacgacccttttcggtcctatccagccagtttcaagccgttcatgccggtcctcgtggatcactacctggtgcatatggccgtggacatccccgagctcgatcaaccagggaataaaggccttctgagaaccagctggttccctttggtgatgacaaatcgcgcactcttcctagtcatcatgctactcgcagcatcccattatgcgtctgtgagcgagcatgccgcaggtatgaaaatagaccttctcaatcttcgttgtaaggcggtccaagccatcaacgatgccttgaagtatcaaccaccggaccgcgtcaatgatgcactgataggtgcgatagcgaagatgggaagttatgaagcgatgtacggggacatggcgagttatagcgtgcacatgagaggactcacccgggcggttgggatgcgaggcggtttatcaatgcttggtctgaatggattactccgccggatagtggtctggatcgaccgcaacgctgccttcctgcacggatcggcgctctattatcctggcgctacctttgcaccgggtcaggctcccgagcccaatcctggtcattttcttgcatcttcgtaattgagtaacagctttcggggtgtccgtcttgtatttatgtatgtaatatcagtagcgtgggatcaggagttaataggaagttctctttttttcaaaaaaaaataatgtgtggtaattaaaaaaattcctggggg

SEQ ID NO: 7348 - DNA, 471 bp, Aspergillus oryzae
  misc_feature (1)...(471): n = A,T,C or G
gtgagattcattcgactggctcactatggtcggcggttggtgagaagaagctcttcacctccatgtacctgatggttggacgcaagcccgagtaaatgcttgttagaatttgcattatgtgaaacgtctgtacaaatacctctttcataccatcatcccacctacagacgaggcggagtattccctttaatctggtgtcatgtattccattgttgacttactcttcttccccttgtcattattattacacaccgccgtgggacgctgtgtttgttgttttcatctcatgtgttgtccaagttggcggacattctacgagtcactgctgggaatgcgccatggtgatgatctttttcagttcgtatttccttgttctcaagcaaaatgtgtttcaatagccgctggtttgccgcaacaaaattcctatcatgtattgnanaanannnnnnnnnnnnnnnnnnnnnanttcct

SEQ ID NO: 7349 - DNA, 638 bp, Aspergillus oryzae
  misc_feature (1)...(638): n = A,T,C or G
cgctagcgaggctcgagatgataaatgcaagcacgaccaaacttgagttacaagagagaaatgaaggaagtatatgttttattggcaaaaaataaaaaaaggagaggaaagcctcatgtttatataccactatgtcctcgcggaccctgtgctattatgatctgtgccgttattgcagcgttatttgccccccttcaccagtcacagcgatattcaatccgcagacgtgaatttttctttgtctccttgtgttctgctcgntcctttattactcctctcgtttcgttcctttattggttttctatatctctttttgcccgggacaggatagttgcttaaagatgggatatctgcctcgcggcaatttttggaccttttggagggatcatgataaccagaatccaccggtaacaccattggggtttctactaatcgagttctctccttatgaaccttttatcttgtgagatctcctaacgcccataaccggcgttgttaacgtggcggcgacaacctgtctatatctcctctgtgtggtgcgtcaccgttacaaaaacccttccactacggcgtatatcctttgactataaccattaacaacggcgcgtccatggtcgtcaactcgactatcatcaccg

SEQ ID NO: 7350 - DNA, 636 bp, Aspergillus oryzae
  misc_feature (1)...(636): n = A,T,C or G
ccactatatacccaatatgcgtgtctccctaaccaccatcttctcctccctgctctgtaccgtcttggtctcatcccaggacctcgacaccttcgacaagaaatgtgtcgagaattatggtgttccatcagcagaccctgttcccggctctttctccaatgacgactgtacggatgtcgacgggacacgtggtgccatacaaactgctgtagacaaactcggtgatatgaatatttacgctgtcaccaagcaggttgtgaacggtattaactatgtcatctttgttactcgcaacgaacgaacatatcgagttcctgtttaccaagatctgacaggaacctattctcttcaggaagaagaaatctgctacaccgacggtccgccgcctgcacaaatcaagccgttggattgcggttattaatcccttcaaagctcccattcgatgacagtactgtatgtggaagagtggcgcgatatcgtccaccttgagaccacctaccaatctctcttacggccaagaaacattcgggctaccacttcagggctgtgttacaaaggaagctctcttctggctgccttggtagagggctttccttataaaagcttggctgttcatccccactcgatatgggaatn

SEQ ID NO: 7351 - DNA, 659 bp, Aspergillus oryzae
tttttctcccttgtcccctgtcgcaacagaaatgagagccaagaagacgagcccatctctggctgccctcttccccttttggcttgatacaaaagccactaagctctatccaccatccacttcttaccgtacgttttgccgccattgtcttctcacctctgagatgctgccactaacacgagtatcgccctctgaatgtcactttttctggtttctgctctcgcctgggccctatctgctctatgcctgtggattctagcaaccctctagaattcttatgggaaatttatttcctcgtctacctctgacgagctcccattctccactcattgattctgggattatcctacgattcacgcttgagtatgtggggttgatggaggatggggcatgcatacccacgggtgctcgtgtgcgtgcattttgactgaatttaagtgcgtttctacagtccacaaaacctctaatacaatcttgtaccatccgcgaaaaccttagtaataatgccaagcaattcaacttgggtaactcttcaaatcctaccaggaatcttcctgttaaaacgggaacaggcagcagatcaagcccaatcctacacctctcgagcttcccggccatgttccaaatagtcaaattaagccaaatttctgcggcaatgt

SEQ ID NO: 7352 - DNA, 628 bp, Aspergillus oryzae
acattgcatacgcagtatacctcgacgccttggggggcattgttcgttagtgctgaggggttcaccccgcgggcttcatcatagattcgacattcggccctagcgctgctcgcgaaatggggactgttggcccatatataccgtctcccacctcgtccgccctggcctggtgcaacattgtcatcaattgcttcaggtgaactccgaaattaaaattacaaagtgcaccatgcgggctcagatcttaaaaactattgctgctctggatgccatctatcctgaggcatttggcggagccgaagtggaacgcctacaattgcgcgctgcattacgttgactgctcgcccgattggaaacaccctatgagcgcacctggggcttctgcttcaaacatccggctgtctttgccgctctgcagatattcatcaacgtgggcctttggaaatcttggacaaccgctggagggggtgagaagtctatccaacgagtggtataattgactactacacccgttgatacaacctgttgcgacggctctccacttgctaacagctttcaacggggttgacgaatcatcgtaagacacattttaaccgactggcgtcttcgacgctatcggcgacgagag

SEQ ID NO: 7353 - DNA, 665 bp, Aspergillus oryzae
  misc_feature (1)...(665): n = A,T,C or G
ccgccgtgcgttattatggaattaaagtaagaaaatgatgcaagaaaatggtttaaccatgaatgcaggaaatgcaatgataaacgaaagaaaggcccgctgtccctaacggtgagaagcgagtttccacctgccgcccccccaggacaagattccttcctggatagcccagtcacgtagagcaatgtcctctttctctgaatccagagcgacatcacccttctcgtaatggcgaccaacgtgctccatccgttggttccaactttgaaagccagcgaactcctctccacagaagccacatgcgctgcgtgagggcggtcggcgttgttcatgccagcaccgagtgcgcaccgcctccagcgtcgcatcaaattgttgtttctcctcctcggtggcttgtttagacttggcccagggcgcgtgcatccgacgctggtgctgggtgaagagatctttgcggttgaagtcattggtgcagctcataggtctgcctttgctcggattgttaacgttgcactggcccacatcacagcgataaaatcctagctggacatgctgtgatgtcacatgtcgcttccactcattcttagangttaaagagctagtgcatccatagcgagagaaggtgcaaacaaaggtttcgtcggngccgggtgcctttctgg

SEQ ID NO: 7354 - DNA, 648 bp, Aspergillus oryzae
  misc_feature (1)...(648): n = A,T,C or G
caagcatcagctcaatatctttcaatttcactataactctttatcattgagtcagtatcaacaacatgaaggccccttactttatcgcttttcttgccgccgccgtctcggcgcagaatgctttcattggacttcctaagaaagaccaggagatcactgcaggagagaatctagttgttcaggttcagcgcccgaactctttaactggttccgaggagatgggtgtcgcaattggcgtggcatcctgccccgaaagaccctgcatggctccgaaagacacactgggcactctgctctataacgggcccttcaagcccgagtaccacgatagctcgcctccttatcagaacttcaccgtgacgatcccagactccatagccaagggagacgcacagatcaacgtcgcccatgtggcaattgtcggggcgagcgcatggccatatttagacctgctcaatcagactgttgttgttgcttagattttgtgtggaggttgtctgcttgttcctgcttgtataggctcttcgcgggactggcgagttgtatattcattcattaattttctttggatttaanttcgtggcttttattttgggattgtcggtcctgantantgtgatttgaaatttgcggagaaatcgttagcta

SEQ ID NO: 7355 - DNA, 668 bp, Aspergillus oryzae
  misc_feature (1)...(668): n = A,T,C or G
cgtgggccccactgatgtaatgtatcacaccggatctgaatacccaggctttcatgataatgacctggatctcacacatccccaagatttcaacccatactccatgatggacttgactgcttatgatgatgtctccggccaaagcgggaaccagtcctgcactgatgatgcgctgtctagccacagctctcacacagacgacagccacctggctgctagcgatgcttggaattccatggtgacagataccagaaactaccacggatcaccacttgaacaattttcttccagcatgtttcaccccgttcccgtctctcnccctttgacggaagcgagtaatgatgtctctgttacttcctcatgttcccacaccggatacccatcgtttatgacccacgaggatgccatgttgaaggatgttacaaccactcccgttggnagccatggtatcaatctaggagacccgttgttcccgctcacgccgccgctcgcggaacaggacccaaacaagtaagtcnccctttgactcccatttacgtantgatcatgtcttggaatgatcctaatcnnactatcccctcaantagaacatccggggttctaagaatgcacgtagaccagctcttcagaccccacaatcccagacccaggttaagcagggaccagat

SEQ ID NO: 7356 - DNA, 627 bp, Aspergillus oryzae
  misc_feature (1)...(627): n = A,T,C or G
caaatattgactattcttttggcaaatagcagctttgatcatggacttttcgacaagaaatacttctgataggctacttgagctcgccgatctcgtcacccgcctcccacgatttcttttgaacttgattgatttaataaactggctgcgaggcctccctccttatggtggttaaagagaaacttgacgaatgaccgcgcccgcccgcctgatattgcaccggcaaacatggaaaatcaagtatgttcgagaggatggttcttctagtaccattacacgtcttgtctgttgaagcataggtgcctgggaactctgactagctcacgacgggcgaggcactggtcgctggtttggtttcgaggtcgacaggccttcatgatatctttcgaaatggtggcaatggatactggttgttctgctcttgaagtcacgctgtactatgttataggtccctttgtgactgggagaaaatatccatgtccgttttctagcctttcatggacaactcattggatttgctttttcgggaagtatattttggtagtggttggtttttgtgcttcgcttttatgtatgacctaatcctgacagactctaaaaggcattgcntgcccttcttgtaacgca

SEQ ID NO: 7357 - DNA, 655 bp, Aspergillus oryzae
  misc_feature (1)...(655): n = A,T,C or G
cgatgatgccttcacatcctttgcatcgacaccagtcatctttagaaaaagtcctgaacttctcaaaacctttctcattaccaccccaccaaagtcaatcggcagccaaccttcttcaggtcttaattcagtgttatggccccgaaaggagtgcacgaaaaggttacaagccagcggcacttattaaggccacatatgagcatgtggtagctaaggatacatttttaacgttctttttctcgtcgatatacgaaaatctatgttcacagcctgctgatttgattgattctgatattacgattgtcttgacgttcttcgataactttacgtcttggagtccagacgagaagaacaaagcaaagagcgcgatcgaagaattcgctgattacatcattgagaatttcctccttccgctccgagcttcatctgtcaagactccgcaaccgacgcctgcatcattatccgcaatacaaacatctacgccctccggcacaccataccgtgtatctatcttgcgaaaaagttgccttgtgcgtgatcgctatcgntgcgtaatttctcgaaaatttgattagagcgaggctagaaaacgtttccagcagtatgggaagattgccaggacgaatgaagaatttaaattgataacgaatcaggg

SEQ ID NO: 7358 - DNA, 679 bp, Aspergillus oryzae
caacgttgccggccgaaacatccaccacggatggtagggtcaaacatagcgagcactctaactttgcactcggttcatcactacgtaatgtttccgtagcagcgcagctattcccgttcgatttcaagttgcagcgcacaattggaattcacagaggactgcgccaatcagaatcctctggaaacaagctcttccctgtgaaactacagttagattgcgtctcttttccttctttggactcgcattatatcaggaagcttcttcagctagatggtattatgagaggtcgaagatgggctttaccagaaacagacgatgccgttattcaaatagaaccgacaactgtgttgggattatcccaattaaatctcgagcgtacgggcagtctgagtcagtcatccgccaagttcataagaatgtggcgcataaattttctcacttcctttgaggctgctcatttcgctcgtgtctggcaccaaaagccgcttccaaagcttggaaatgaagatctccatgaacctagtccacacgtgaaagcggagtgcattttccgataaagatgctatgctatattgcggggccttgtcattggtgcataacgttccctcgaagccagcattggacttgaggcaaattaacttcgtaggtatactataaataattattctcttcacatcat

SEQ ID NO: 7359 - DNA, 463 bp, Aspergillus oryzae
ggcgatattcacacagctatgtccagtctctaagcattgtcacggcctgttcgccccagttcaaaccgttcctcgacagtctgcgctcaacggggatgcgccttggtggaatgacaagctacggtcactcacaaaagggatacggctcatactccgcttcgcgtgcccggagtcgaagaggcacagttcgcagtgacacgcatgagcttgtccccctacccatgcaggatacccaccaggctactgtaactatctcgacgccatcgctgggctgggatggggaaagtcagtcgagccaggcgcctattattcatgaaattaggacttggactgtgaccgaggtacggcgtagtttcgccgagaattccaagtgacgcggtcgcactctttaggtctcttttaatgttacggtacggagtaaatgttggaagatatgaatattatattaatgtctttccactcc

SEQ ID NO: 7360 - DNA, 624 bp, Aspergillus oryzae
  misc_feature (1)...(624): n = A,T,C or G
gacattcactgtttcgacatttgaacaagcgaagaatgctaactcaaggtggaagagcgcttttatacgcaacgcagttttctccactcattccaccacagcggaaaaactaaactcactagggctggtatctgaaattgtggaagaccagggacaactacgggccggcctggatgatttgctcatgcgactgaacaactctaggcctgctaaaccacgtgggtccagggagtttgcatggtcgacgagggcgggatgggatgcacaagctcatactcttgatacgactttcttcaaaatgatgaagcttgaggtcggtcaaggcgacatgaaagcatcctacagcggacgtaaagaggatttgaaacgtgcgttgaggagcgtttggggacaaggtcgacgacggagagagggaaagggcatatgaggatctgatcgctatggtgcatggtgtggatctatctcatagatcattagaaaatgacccggaagcatggttgtgacttctgctactcacaggagagcagatgagaaagatgtactatagaagaagtcatgaaacgactttgtatgccaaattaatgttagtgtttaaaaaaaaanaannaananaaaaaattttct

SEQ ID NO: 7361 - DNA, 256 bp, Aspergillus oryzae
  misc_feature (1)...(256): n = A,T,C or G
cgaatctgtcggaagaacccaagggctggccagattattggaagacttcaaggttcgcgtctctttggcgcctgtggagcacgttcagaccccgcacagtgacttccgccgtgattgaaatgagcagcacctccccgccaggccaaagatggtccttcggtacgacaaccatcaagaacgacctgcatacgatatttgccgcacgtgccgcccatgagaaggccattgggtcgctacggagggtgaaggggctgan

SEQ ID NO: 7362 - DNA, 255 bp, Aspergillus oryzae
cctgaccatatacaggcgtccaagtcaggcacttggccctggtatataccttcgtttcattgatataccctttctttgtaaagaaacatctttttctagcccctctagcagaggcttaatatcgctcattacaacttcagaagcagtacaagatcgccaccatgagatttcttctgtctttcctgattaccttgtcgatcgcctgtggtgtgctttcacttccatcgggctcaaagtctcaactcaaaggcaggt

SEQ ID NO: 7363 - DNA, 649 bp, Aspergillus oryzae
  misc_feature (1)...(649): n = A,T,C or G
gttgatttccctcttgtgattatgcatgagctactgctcttcgcctcggtccccgcgcaccagcaccatgagctgctacaacagctggccgggttgacggccatgcagccccgtcaccgcttagagaggcgtctgatcttcaaggcctatcggaaaccagggctgatcaatacccgtgtgggtgccagtcaagacttgcaaggcaatgaaatgcagcgtctgaataagatgctgaacggtggcatgttctatacacaagtggtcggaccggtttccgaggccgactttggtgcccaatcttccgctgcctcatcgggtgaccctgatgcgcccatgtctggaactgatactggtacaaactttgagtaccacccttacagttatgagaatcaaccctggaagctggagtttagagatatccccgaggcggngactcgttccgccgtgaccacccggctgatggccagcgctagtttgcccaagggcgatattaccacccctatgaacgcctggnggtatagttttgtcacggagtacgtggtagagggggatgtctttattctgaatgatatcgtcatttacctacatcgagttctgcattatcctgcagagagctctggatcacatgaaccgcggcgacagttacctc

SEQ ID NO: 7364 - DNA, 548 bp, Aspergillus oryzae
  misc_feature (1)...(548): n = A,T,C or G
cgaggcagagcagtgcagcgggaggtcacagtggtggcagccggcccatcagcccctcggccgacagggagctcagccgcaattctcaacggatgaccatgaatggctattaacggcgcacgagagcgtcaaggatagatctcaatgctccatggagtaagccgtccataccagttgtttccatacataggtgcacatgcagacaacttaggggcagtgtcgagcatcccttcatcttttctttttacttcatacataactccacttttataccagcatgttcttacagatatccttttaacttctgatttactcttggcttacttcgttgcctattttgctatccccagcacgggaagcgggtgcctctattccgttttctacaattgagattgtcattgcagaccagaaagcggctagcaatgatagcgctggcatcatttttattgtctcatgtacttaaattccttaattatcattactccatgagggaaatacagttgatacaacgaanaananaannnnnnnnnnnnnnnnnnaannnnnna

SEQ ID NO: 7365 - DNA, 761 bp, Aspergillus oryzae
  misc_feature (1)...(761): n = A,T,C or G
cgaggggtatggtgtggcctgaactatgagtcgggaacctgggggaaatgtatgacaagagccattatcgccgaaacaactcttgaaggcaccgcagcaccagaggtncgtcatatgtnagaatgtgcctatttcatnggagaaactgggctactgggggttcagaaacggcaaagtctgagcagccctcatnctctattcgtatattacgtcctggcagatttcgagggtccctatgagtcgaccagtcaaagaatcatgggcgcaagccttttggcaacttatttagctcangcccgacatttccgggaacgacgcccatatttgttggacggtccatggacccgagattcctataccgctcgaagggatgtgcgaaaagtgcccttcgaaaaaggctggtgggctaaggaagtttaaacttccgaccttgtcgaagaggaaaagaatcttatcgcaagttcctttggcggggttctcttcccaaaaaaacggtgggccagagggatgttgatctggagaatggaccggagggccttggttagccggggaggtatttatcggtagcttagctaacgcctaaaacaaatcgaagttcttggatccacgtcatgggaggggtaatggacggatatggtgtgagagcctttttcgggaagttcagggaaatggttccgaacacagcgcatgcgctctcctaaaggtaagcagtagccgttccgtttgcgtagggtgtagggtctcggtaagactataggccc

SEQ ID NO: 7366 - DNA, 660 bp, Aspergillus oryzae
  misc_feature (1)...(660): n = A,T,C or G
gaagtcggactggatacctgacaattgcaacccaaaaatggctgaccctatatcggtgattggcacagttgcagctgtcttgcaactagcacagagcgcctgcaaagccgccctaggactttataattcctgctcggttgttcagaatgcaccacaagaaattatctcgatcagccgggatgtccatgcattctacatgacaatttccaacctcgaaagctcactccgcagcgacgaagtggcaaccgttgtaaacggagatgtgcagataatgttgacactagaaaccctcaagatcccgattgagaatttttccaaggcctctgaggctataatggaaaaacttatcccacatctcaactgataggacatcgcanatccanagaggatgatttagccgtnggaatgtgaagtggtgcttcgaacggaaagagatctctgctttgggggcagatttggagcganaaaagaactctcatgactgctatagcgattgcacattttctgggttacctgaanaccngtgcgncctcgtgncccactatcatagtccaagganggctgacatggatgacgatctcgcctcgtctgtggtganatacactgcatcgattcgtgancgcganagccaaggggactttggcntcancgagggactcn

SEQ ID NO: 7367 - DNA, 637 bp, Aspergillus oryzae
  misc_feature (1)...(637): n = A,T,C or G
tgtttatcgactgactgatttctgtgaaaccaccttaactcttccagctacggaaacgctagtgggatctactccgtaatggcagcgacatcgtacagttttcgagtaggcagacatgtttcgccggcggtctgcatactaattaagtctcggaatatcagtcccacaaagatggggatagtcacagtcattccggtcacagttcgcaacattgccaaagctctaagagcggggactatcttgctttcttgctgtcccccaagttgtggccgtatctgagcacttccatgccatatctaatgaaatgagctgacttagaccaaaatcctggcgagtgaaccgagcgccctgagtttcatttaccagccaatcccaccaattcagtgatagataacacgcacatggctgggggttatgacctggtctacatcatctacgaacccacccgatgtctgcgacaaaaccgcccagtgagactagacgaagagaatatcacagcagaaagtacctgatatgagaccgagaatgaaagatagaatagccgagcgcgagacaagcttgatggattaccaatgagtcaagcccagaacgggtttctgaagatggctgaggtcttagaccgtatccagcccggaan

SEQ ID NO: 7368 - DNA, 677 bp, Aspergillus oryzae
  misc_feature (1)...(677): n = A,T,C or G
gcacactgtcagggcgttttttgatcatgggtcctaatatgaaatatgcggggcggacggatatggacctcacgcccgatatctaacacaccccagatctgaccgatgaagcatccactgtacctactgcagcagtgagcaccaattccaacccccacgatgatgctggctacaaccccgatattgaccgcgatggcattaatgcagatgacgcgcgcgctcacttactcggggctaccgttgatgcgcgcgatgtcaatatctacgacagtatcggtacgaaacggaaagcatatatgagcaggagtcggccacgccaaacagatgagaatggcttgtgagaatgagggacttcaggcgacagcgaatatgagggtttggacagaagacttgctcgtcttcgcatataaaatggaagaactgtaggatgacatggctgtctccctgactggatgcaatgtcaatgaacccctagctgatctcatggaacgtactgacgaccgcatgctcnaattaagatccggcgacgagcatggctatagcttctacacgagcgcattacggccggactacgcagacgcgatacttttcagaaggatctcttaaactatcgctgatgaccatcactatggcgatggaccgactgaaaaaggggaaaaataacacttccccaaagn

SEQ ID NO: 7369 - DNA, 661 bp, Aspergillus oryzae
  misc_feature (1)...(661): n = A,T,C or G
cgccccaggctnccggtcgtatcgagtttacatcagcgactgggctgggcctctttggagtatggtcgcttcacccctacctccagctgaccaactgaaggctttgcggatgtatgtcaagaatgttgaagatgaactacagcgacataatgagctccgaccggccatgggtttagctttttctcccagacatccgaatgccacaaagtccatggccaattgggagcgtgaatcattgtacttgctgcgagagaacaggaagtttcgcacatacattgagaatctacagaaggcactctacctcaaaaataaaatatatgctttccgcgaggagagcttcccttccacaagtggatgaaaaatacatgggacgccttattccaactataacttatggaatttatgaaaacgtgtgtatgcgatatcttaagcatttgaacattctgttgcgcttttcttataagaagtatgtggaggttccatcatctcctggtaataagaaaactattcctttcttcggactattttgccccttccttttggataccgagttttttctaatactttaaaaacatctacaagaaaattctctattggggctaactagggtaaaataaggttggagttccttaagggggggtaatataaaaattcttaaacc

SEQ ID NO: 7370 - DNA, 247 bp, Aspergillus oryzae
  misc_feature (1)...(247): n = A,T,C or G
gtagtcggctgttgtcagtttcactaagccgttgggttgaatgccagttattgcttggcatctgtatagcaggcattccgtccgtccatggtctagcgcggcattggacgggcgatagcgaggtttcgcatcggatctaagcacattccgattcgatagcattctgagggtgttcggagtcttggaacaatgctgggaccgggatatgacatgtacgataacgaacaatgaacggaaatggcanang

SEQ ID NO: 7371 - DNA, 651 bp, Aspergillus oryzae
  misc_feature (1)...(651): n = A,T,C or G
catgccaagcaatgctggagtagcccagagagtttgttccttgtcgtggaagaggtggaaagaaagtgccaggagcaaatcaagatctctaattcattactattgaatgcgactggtcagggaagacgggaggatctatcaacagcccgttctttgctagagatgaaatttcactgggtgtttgctggaatatgtggtctaggcctactctatacctcagtactgagaacaaggcttatcgaaggaaaaaatgacggggacccggatatccaatctaacgaatccctccaaatcgtcgaccaagtcgccggaagcgtgaatagccctcccgatgctccaggccagtatctatcgggatttctcaaacgatttggagaagtctatccgcagcaactcgtgcgcgtgcttgagtcgttcctcgagtgtgccgaagtgcaaattgacggcattgcattcaatgccccacttcaacaggtagtctatgggatcgtttttgtgtgcaagaacctggtcgaaaacaacttcgtgcaagtacgggttttcggacgtctagctcgcaatcacgagaagcagctggcgctgtttcctaagtgtgcgagatgtattcgtcagatggcagtcgagccgtggaaatcgacanaatctgctttt

SEQ ID NO: 7372 - DNA, 664 bp, Aspergillus oryzae
ggatgggggtgcgcactgagctttatatcagtatctgaacagaaaactgcaatccgatacgacctatactgctcgaagaatgacagctcttgtttccagatagttgcggataaattggccgaacttgtggaggagagagcccgggaactagaaacagagtatcaagagtcattcatatctgtgcccccaagtcttcacactgaagagatagttaatatttcccccttctcttcttctttcgtgaggttattatgttctccatgagcgctgaaaaaactccgcctgagtagcatttcaaaagaatattctcgactgcctcgaagctcatgtcaagctggagaaagcgcagggagccgaagtgtttccagcgatgagaaaaccaagggagaattccaggtttcagcaagctgaacaactctgcaaggaacttgactgtaagagcgagttcagaggaaaagatctcgcatgggtaacgcgcagatgctttgcattttcttttattctggttgattgactttttcttggttgcgttcgcattgtccctaccacccttggacagacgttactccgtatagcgtcattaccgaacgtgtcagttggaatcttggcaccgttgttgccatctggtcaatagatagcttattaaataatattcccagtcctc

SEQ ID NO: 7373 - DNA, 161 bp, Aspergillus oryzae
ccgctgatgctcactcatggaaggttgttgaaaacgcccctgcagccaatgacccaacccagccggctaccatcccatgggtggtggcaagaaatcgtgataacgtggagaaggagaaggcgttatagaaaaggcttttgccattgcttccaaacgggtgg

SEQ ID NO: 7374 - DNA, 683 bp, Aspergillus oryzae
  misc_feature (1)...(683): n = A,T,C or G
ctccacgcaaaagtcgacttcattcgctcccattcaggctcaattttgagtacaacgccatgccttctgacaaggtggaaaagaagcgcaagcgcgcttcgaacggccacgaacggccgagtaaaaagcccgacctcgaatttcaagatctacctcctctcgcggccagcgtggtcaacgatgatagtgaattggctccagtgatcataaccacccccggtgtgaacgtgccccaaaaccttcatttaaaaccatacctcaaggaccgagcagatggctctttatcaggtcgctccacacggaacaagggcattgtctcgtccgaactactcctgcagacttcggagcatccaaagatggatttcgtgggtcgcgaggccgaagacgacgccgattcgcagttaaagcattacatcgccgttgtggatcccgaaaagaaaagctggcagtttgttgaggtgcggaaggtgactcttcgtggagcagtgaggagaacaaaggctgctgcagatgaagaggangaggttgagagtgaagatgaggagatgaaaacgatgcgcgctcaacgcacagaactcaccaatacattcggtactaagcagtcccgcaaagcagcgcagtccatggccgaaaatgcccaactctccaatgcccccgctggtgctgcctncgncgcagaatct

SEQ ID NO: 7375 - DNA, 660 bp, Aspergillus oryzae
gattttgcttctttcagtttttatgtactctcttgtctaaataaagaattccaaagacatccagaacgatgaatctctcaccgcttacataacagtggtcctcgactcgccgcgccagtccaatcgcaaggaaccccgaaacaacagcccaacgccattacggcgctgatgcgctgtctttctgcgcttcattcttgcatctgcactttcgccaccaattgagtcgccttgtcttctgcccgactccagttgttgcggtggaaaggagtgaccgcactttcagtgcttcccgcaagtgtagtccctgactcaaccagactatacaaatctattctgcggcgatcgtatatatacatgtacatgcagagagacaggcccggtttgacataaattacattcgcgacgagaacgatcattgacttttacatgcatattacatgttgccacatattaaatttttccccgccctactgcttcgtatacaaacccacagcatcaaaagcgtcccgatccggcaaggaaaccagcaaacctgcccggtgtctaccggaggagacgctattccttgcgctaactccatctcaacttctggaaccctttgggcttatcggctttcggtaatcgggtgggccttttttgcctggctattgtggggacaaa

SEQ ID NO: 7376 - DNA, 610 bp, Aspergillus oryzae
cgaggctctctcaaataccaaactactctacgactttcattatttcgaactatccagttcataccaatccctccacaaccatgtctccctgcagctgcaactgctgctccggcaactgcaactcctgctcttgcagcgactgcaagcactaaatgcatcacccctgacaccgatccaacaatcctcaagacaagaaccatgtcgcaaacgacgatgatcccgtgacttcccttctatccatcgacgagcggcaccagtgaggatgggatgaagtgcagtgttctctccttctttctttgttacttatcttcctcggggatagaagttgggtggaaatgcgcgtataaatgatggtgatgatgagggctttatcttttacttctcggcttactttttgaacatacttttttgcttctgaaaaatagcaatactaataatagtagatattcgtcttaagaataaaatactattctcatcatcatataagataacataataaacattcttggaggtcctatcaaaatatcattaaaaggcgcctattatcacctttaggagatcatatttcaattaatatggccctatgtttaaacaatatatgactcgggac

SEQ ID NO: 7377 - DNA, 674 bp, Aspergillus oryzae
  misc_feature (1)...(674): n = A,T,C or G
cccacacctgcggatttcattccctcgacccacacaatggcttcaatgctaccaactcgggcggccaggaccatcgcctgttccgcatgccgcactatcgtttgtcctagcacgattggatccgcctccctcctccgtcgtggtctgtcgacatccaccgagcagacaccagtcgattatgcagacaagcctcgatggtcctatactcctcccagtgcaaaggctcccttcagcttgcgattgaatagcaagagacgtgattacccagtcaacaccgatccgcaggtccttgacgaattctacatccgcatgctgggcaatgatggtgacaagctcctttcggacgaaaccaaatggcttgctgtgacgcacaagagtttcgaccagggtcgaagaggattcaatgaccgtctggctttcttangacgacggatcgttgagttacaggcttctttggccatggtgcagagccccggaagtgctgcattcaccgcttgccctgatgagtttgaccgtgtgcccttcacgcacccggcatttgangggcctggagaacctcacccgtcacaagaattacctgataagcaaagcacagctttgcgagcctgcgcanaagtatgagcctgcaaaggtgcctgagatggagtcctcggaagccccaacaccttgccagg

SEQ ID NO: 7378 - DNA, 598 bp, Aspergillus oryzae
  misc_feature (1)...(598): n = A,T,C or G
cgaggtttctttgttccgtgacgggggtttatttattggaatttatcgcagtgaaacagatagggaaataagaaggacagcacggaagaataaatccgccaagaaaaggcaccgaaaccgcgggggaaagataaggcaaacacgcaatcacctcttcaatcaaacttcaactatcgtcaactaaagcacgttggtggaattgtcctgggttcgccggttgtcggaatttgctaaggtctcgacgatggagggatacggcactatctcaaatttgaccataacgagggttggcctgcagtggtcacctgctctggaggaatttctttttttatcccgagtgtcatcacctcctgaatttgtatggtgaacggctcttcgcggctccatctgtaaaattatcctttcttctccaccccctcagccctactaggctatgttctatcgttctaattggtggagaacgaccatgtgggggtgttgtcaggcaaccatattttgaccaatggtgggagacgatgggggtttgctcggtttgtctgtttctctgtcgtaccgtccatgatacctgtattgtatttatgtaactgagtcagatgtn

SEQ ID NO: 7379 - DNA, 649 bp, Aspergillus oryzae
gggattattcacattcccttccacaaaaccatgattctcttcccacgatactatctgtttgagataggtgatcaagcctggtgtcccgaatggatgagagcatacatccaatcatatctaacccgcgtctggaatctgcatatcccgccattcagcaacgcccctccagcaggggtagcagcagaccttattctcggacacataaaagatccggattctttcacattcgttgatctttgtgcgggtgcaggcgggccgattggaacgcttgagcacgttttgaatgagaagcttagagcggaaggcaagtcagcggcgcgatttgttctcacggatctgcatcctcgagtggaagaatggtctgcgattagtagacgtcgggagaatatctcgttcgttagtgagcctatggatgctgcgaaatgtgagagagtggcaccgacaaaccggaaggagtgcagattcttcaatttatgtttcaccattttgatgatttgctgcgtcgactatattgcgaaagccacagagtctgctgattttttataattttcgattttgccagcgcatttcccatcggtgctaacaaccccggtatgcctccctttctttctggatacccctttggcggacagaaattttcttttggatt

SEQ ID NO: 7380 - DNA, 657 bp, Aspergillus oryzae
cccggaaggtaatcccataattcctttcttcggtgtccccggatattaatccattcaaccattacaaacattcgccctgccacttctctatgtgcttgtctgcgcccacgctttcacactccgagaccgttcgcttcgttggccgcgttgccaacacttgctttgtttccctggatacccacgacgacttgactggtgtctatttccaagggactaccgcgctggctggatctcgggttgtatcgtctacccggcttcccgaatcctccgtcgacaaggtgaattggctaggggtccttggtccgtcctgaacaaaggcggacggtaatttgctgcttttgagcatacagtgcgatcagtcaagtccagccggctgagcagaagtaggatctatcgtgaaaaaaatactacttgataggtctcgcaagtgcatagccgctgattcatgacttgatgggtgtgatattcttcggttacacattgtgcttatcggcgcctttacgcttttggatctatcggcaatttgggtgtgacggtccccttttcggataatctttggataaacgacgccaggtaaatggaagtcataaagctatagtgaaaaaaaccaatggagatgttaacacatttcaggatgaactttcggcggggactctc

SEQ ID NO: 7381 - DNA, 661 bp, Aspergillus oryzae
  misc_feature (1)...(661): n = A,T,C or G
cattatcttccaaaaagacatgtgcgcttactgaagagagcgtctacacatcatgtggacatctcgagtacgacagcccgtgacaaatattgtcaccgtctcacgtcgccttgctaggagtgctcggcctgccgtcattccttggagaagaggctatgccagttatggccctaatgcatatgaacagtctgggtcctcttcacgttggcttaagacttctttgggccttgcgggaacaggcgctgctgcttttctcgtctacacctacgcgacactcgataaaagtcaagccggaagtcatgcagacacaaagggtctctcacaggcgacagagcaactggactcgcagtatgtgcaccacaaatgaagcttaaaaagccctgccgtgtatttatggggcacaaattccattcgtgtggtggaccccaactccaaggagactgtactcaaaacccctcgaagacttcattatttggacggtcaggggctaagggacctcaacctttttgacaactttggttcatcaattgctggaaatggagaccttattcaacggggaaagggatatttaaagcccggctttaaacccacaagaactttggccggaaagaactttaccttgcttgccagtgtaaaacaaccagattcttggccttgacgn

SEQ ID NO: 7382 - DNA, 654 bp, Aspergillus oryzae
  misc_feature (1)...(654): n = A,T,C or G
tagtgacctatgcccttcccactcgttatggatttacatgagtttatacagagattattcttgaaaatactacaggctatttcgcccggaaacaatataacaagaatgctcttagcatctcagatgagcgtttgtctgaacaacaaaaaggaagcgagaaacttttccctgctcttccttccccttccccttttcttatccccgcccttcctcttttgtctattatttttctccttgaagggccttaataactatgaacaaggtaatcttaacaacggctcactcgtgcgaagaccaatcaattcatggcgggcccggtgcttgtctgaggaaggatatcagattgtgagttgatatgcatgaaaacgcagtgctcacagaataagaaattacacttgctgtcagtcaaccgtatcgcggagtagtgagacatcangcccgccattgtaatagtcgcagaatgggacagtctttctgtggaggttgacattcgtccgtctgtgtggcagtggtacagagcacttcgtacacagtatatacggagtagtcgtcatgattaaagggctgtctttggctcggctgtacctttactcatagatttttgttgacagaagcctattatagacgcagccagttagagaacacgatatcctg

SEQ ID NO: 7383 - DNA, 297 bp, Aspergillus oryzae
cggacgaacattccagtcgtcgctagccaggaatgttcgtccgttttatatcgcggagaggatccatgacaggcgcaaatctgcatagatagagtggcccatgcctttgcaatggtttgatggagtccgtagacaaagcaaatcgaggcctccttgttgatgctttaccagagcgtccttagagcctccttcgtacaattgtaccatcttaaggttttaatatgtaggacgcgaccatgatatatacaatcctcaaacggcgatggagaacgacttcgagatcatgatgtctacaac

SEQ ID NO: 7384 - DNA, 816 bp, Aspergillus oryzae
  misc_feature (1)...(816): n = A,T,C or G
gcccttttgaattcttaagctctgccttaagcctggtgcccaacctcgattccattattaccggccgccatggggctgaatttcggcccaaggaaacggcacctcaatttcaatcattatagctctttaaaacagcaagtcaggagcttgctaaaattgcgtctagctttgctggagaggtaaaagaactagtgaagaggagaaagcatactgtcattctagaaaggcaaaagcttttgtcacatgccgaatccatgaaatcagagttatgggccaccggcaagttgagaaataaaaccacattcattagaaatatacagttattcttcagacccccagaggaatcaaagctagacaacccgccagtccgccaaaggaagaagttaactcgcgagcgatctgaaagaattcggaacctaacgccagatgggacaatcacatgggccgctgcttttattcccagtgtttgggattcgaaccatttatcgaagagcactttcgacttcgttgttgaattcctggattcgcaccatccacgtcgatggcctgctcaagtatacgaagtgttggatacactancagctgagcaaccactccgagatttccccgaattcaagaattcttgatatcggtgaatagaagtgcagaagatgctcgaaaggaagacccatcttgtatacaacaaacttgaccaaggtcgnattgcgtccctgaagttcaccggcctgccccagaaagcatcgaaatggcatttctcggttccccctcccaggtggatgaactccttgaaactttttcttcttcaacttttggcct

SEQ ID NO: 7385 - DNA, 644 bp, Aspergillus oryzae
gtcgtttcaattatcgcagtgaatcggatcgatcaacgcctgcacacaaagagacagatcaaccggttgtttttttttctttttttcgactcctctcaaaggggggaaggaaaaccatcagaattctcctatttacacgttaacccagttcaagagttgccttgagcgagtggatcggtagctgtcatgccaagaggagatttgaaacacttccgaggctcactgggaaaaaaagaggttgcccctgatgtggttcgtacaaatagttcgacatgttcaaacacaatctacccacccaagaaggaatgtgagcagactaatgtatgtgtggaagttgcatccatccattccccatattctttgtcttcgcttttcattcgcaccaccgctgatcaccttggggatccaatgatgcaatgacccgaaaaatcaaggttccaattcaagggatcaactgggaatatttcttttttgtctcaatgtctcccctcactcagctccacttggtagccatggaagaagttcggtccaactgtagatcggggcctagagcaacgccggtttccgaccagagccactcatgaagacccaagagcttggccgttgaagccccccgactactatttgcttctgaatgatggaag

SEQ ID NO: 7386 - DNA, 696 bp, Aspergillus oryzae
ggttatcagccagctatcagcatttttcttcttttcggtgatccaactcgctctacaaccaactacatcatcatgtattcttgtgccaattatcctcgcggttgccgtggccgcgttaatattcaaggaggaaaatgcgccgattgtgtgcaactgaaactccgtcgaccatcatctacgtccccctttgcccagtcacgagattaccggagagcgttgccctcggagatcttgaatgactccccttacagggcgatcgctcgggaattgctgtaaacctgcgatactgcttctaaaccgagacggcacgaaagacctccaggacttcgaccggatatccagggtcctgcaggttgggactgagtcccagagacctttcacgcccgtctcaatcacggcacctgtctttccttaacctagtcaattatgctctgacttgatgcattgttgggagttgatcgatcatcggattcttataccatatacaagggcggctttctcgatattactggaccggcggttcaagcactgcgattattattattcatctctctcatttttcttttgggggaatatgcgagacaaactgggtacgggatgggtgatttccctaatcagctgctggaaaggcgaattggaatttttcctaaaaggcataccccgggggaatagaacgcacaaccatgaatctgctgg

SEQ ID NO: 7387 - DNA, 655 bp, Aspergillus oryzae
cacctctcctttctgtccctgcgagcagttgcgggttttcgttctctatttttgattcttggcagagatcctgtgggtttcttgcgactagtttttggtttacttttgacagctgcaagactttgaaatctgggaaaaaaatggactggttaacctaaccaactttttaacattcttttcgttgccagccgacctgtggcattccacccctccaacctttcaagttccaatcaggattattggttcttggaaccggcctcttaaccaaagaatgaattctttggggcggtccttgatccgcaattccattggcttcttgctggcgtgaagagaagaccggcaccagggcattggcttattcattcccttggcctaaacattaataggaatctccgatcgaatcataaattcctggatctcttgttgcccccctgtgcctgatcattacattgtgggctgtgaccaatttactgggaaccctttcttttttataccgtgattggggctcttactctttttggtgtgccgggctcgcatttaatttccaaatttttgaatttcctctggggcccaaaaaatttttttttttttattttccggcctccaattaaaaaaaccttttggtacccagagaccccctctttgtgggtgccgg

SEQ ID NO: 7388 - DNA, 360 bp, Aspergillus oryzae
ccagctgctgagcagaagcagcccctccctccagccgtcgaagagaaaaaggaaggaggcgcagacagtcactaggattagttgagcatcatcgtggctccatcgtttctgccacgtccccggaggaaaaagcgaaggtcgctcaggatatccgtaagtcgatttccggcggtcatgcagagatgctggagtcgttgcgcgacgaccaggcgcagaaagctggtcaggaggaaaccattgatgaagagtcagaaagtggcgaggctgtcgaggatgctatgaatcgaaaggcaaagaaaccaggttctagttgaacggcccatgataggtcttcgttgaactgccgctgattgctttatg

SEQ ID NO: 7389 - DNA, 700 bp, Aspergillus oryzae
cctttgcataccagtgaatatggccagtacttcatggttgccaaagtccgagcgtagtgcagtggagccggtggatcacggcgttatggccggagatgagaagctacagcgcaaaaggacacagaacaggttgaaccagagagcgcgcagacttcgtcttcgagacaaggatcaagcccatataaccgccaacccgcgtccattccgagtctatcgttggcggcttgaggatgaaagtcaaaccacgtcaggcgcaagcagcaagcatctgaaccatggcccagccccgaacaacacagagtggagtgagcactccgcaccttatctttccgttgcaccattctcaatccccaacaaagtgcagagggttttgcatgggtcgtctgagacggaagtttccctacctgctgaccacttgctacatctgattcagtttaacgtgctgcgaggagtccaccatgctaaggttatcctggccgggtcatccgcgttcatcatcccaggcattgagaaaaatgagatccgccccggccacctttggtttctcggtacttccatgtattacgcgacaaggcccgggctccctgagagtctaattccgacgtcgttgcaaatggatattgaacacgcgacctggatcaacttcttgccaattccacggatgcgagataatttgattgcccacgaaaactgttttgat

SEQ ID NO: 7390 - DNA, 547 bp, Aspergillus oryzae
ccatactatgcactgcgaatatgtacctctacgactactaatgttagtcatgtccttggtgctccatcggcaatagatacatctcgctgtttggctggtgaacaccccattgctgagccacacaaactccaacgccatgactcgccagccatgaatcctcaagacagtgccgtttggcgctggcttcgtgatgtgccttgcgcaacagtagctaccccaccagatacagcgccgtctacgccattaggtgatttgatacggaaaaggactatgaccaccagatctacgagtcctgcgaagcgccagaggattcttgacgataatgtaagtgcctcggggactgtggttacacatcttaccgagagcacaaggctttcctatcggtcgccttctagcccgctctagccgatatcagaaggatgagagtgcatggtgcaccaaggtggtctatcctatgttacaccttgcatctaagggcagtatgcttaaagcggagaacgtgcaaccccaaacgacaacttggaacttgttcccgacatgccgaaaa

SEQ ID NO: 7391 - DNA, 303 bp, Aspergillus oryzae
ggaagggtaaatactttaggcgtcaacccggaaattgacccactgacgcagattgtcaccttaaggtcggccaaaatagcatctttaccaactcgtcccgcgccgccagctgaaaactagggcaaggaatatcctgagagagcatcgacggcacagtttccttgccgaaaaacggcaagagatcttcgagaacaaggtttaccacatgctcttaaatcacaggccttgctaaatactttttccaactttctattctcctcagattcgctagataactaatcttgacggaacagctgtagcgac

SEQ ID NO: 7392 - DNA, 726 bp, Aspergillus oryzae
  misc_feature (1)...(726): n = A,T,C or G
gatatgacagctttttaccgaagttcgcacgaggtatctctctcggtcaccaagaaaggagcgagacgttcattatgcttgacctggaaactttgcggggttcctgcggcggttcattcctattcttgctaatttccagctttaacgcactacgtatgcacctaacggccaatccggtgtctgtgtgtctgtcacggaggagtggtggcaaagttgaactactcctgtttcgagattttccgtgcaataatatccttctgcctggggtcggtagaagtccacttatgccacaatgggcccaaatcagccccctacagctgcggcgaaatgcagacgacggctgtttggaacccatctggttcaacgctaccacttttgcccttattctgactgggcaatttgaccccgtaagctcgtggggaaggttatctaacgtcgaattacgagagccaaggaattttacgacgtactacatccttgagcctttcctcctcaattcccccgcagcctaagattacattcgtggccttacttttcttggcatggaacctcgtgtccagagttttcaggaaccaccacaccacatccagggctcagaagtccattaggttttttttttacttcatatntgatcgtccggaacggtgcccctgtacggtgttccaaagttggtcagtaaacttactactgcttagtccattcagacctgtggagtcagtccctttc

SEQ ID NO: 7393 - DNA, 634 bp, Aspergillus oryzae
aacatatgtatgtccgacttttttgtattctcgtaaccttgggatgaatctatcatccaagttttgaattaaaaaggaacgaagtagcaagagggaacagacaaaagaattgccaacacgaaacacgctgagtacagtcggtctcctgatatgcgtcgcaaccaattctttgcggaaatccaaggttttccttgacgataaacgatcttgggacagaagccaatcaagttcatcatgtggaactccaagaattccctacccatgattgataccctgacttttggaaggagcactggggcagtggtaggtccccaagcgaagcgggaaggcagcagcccctagacctttgtggtttgctttccaggaaacagatggcttaatgatgaaaaccaaccgttaagcctctgcctgacgcgagaaagacgcttcacagaactgaacctgtcgggtttcccaaacaggaatagcttggctgtgagaaagagataaacgggcttgcgaacaggatcccacgagttctcgcagggtgaatcaagggatgacgtttttgagctcgggaatatgacttcttttggtttcttttaggggcttcgggactcgggttgacctaaagctttctgccggaggattggtt

SEQ ID NO: 7394 - DNA, 676 bp, Aspergillus oryzae
gaagacaaagactatctaatctcttttgagaaatcggggacccttgttacaattgccactgtccgtcacaaggaggtcttgcagttagcgtgtctcaatccccatctcaagcaagttagtccttggtaatttcgccaatcaataaccccaaccggggaatcccaatccaaaaaggcccaactcaatttgaaacttacaaaatttccaattgcccggaataatgaattcggaaataatccaaacttttacaacaaaaggaccttaaaaaatcctggttaacttcaacttaataaggaatataatcaactccaattacccctcctttacaaccggaaaaggcttgccccctaaaatggtcgaaaaaatccaacttgaaatggttgcttatggctaaggaaaaatatggggtctggaggtctccatatcctcaattcgaataaccctcttccgagatatggctagaaaatacacacatatgttaacggccccctttgaatacgacaggttcaatgtccccctgtgatagcgagactctgctgtaaaaccctgtcataatccccggacactaacccgttattcacgggtgtgcatacaatcgcccccctgctacatatgtctcctgatcatctgtcagtggcaaatattctgtcatttaagacccgtaataaacgccccc

SEQ ID NO: 7395 - DNA, 61 bp, Aspergillus oryzae
cgaggaaccttagggtttgcttttatttatctaggtaatataccaagtttagagaacgttt

SEQ ID NO: 7396 - DNA, 647 bp, Aspergillus oryzae
cgttccgggtatttagcggcgtggatggtcaaggggatatccttggccatgacttgatgaacccctatgtgcttctccgagatgaagcaagagtacagaaggttgggccgagtccgccgccatctaccaaatccaagagtatcagcggtaccacgtggaactcagcgcctgagttcttaggctatgtggatgatattctcgaacaacgctcccaaggtgctcttctacagccccccgagactcctcttgaaaagcgcccaagccacgacctgtcgttgggcccgctgtcctgcaaggatgctattgatctcgcgattctgcgaagcaaccaggctcttaactcgtcacgcagccccaatcgatttgagattgcacgcaatgggcatcggattgccgttgtggtgctcaatcgaccagctcatcgtttaggggaaaccatcattgctacggtgaactttgcctgtaccgcgctatcctgctatgcggttcgggccacgctagagacatcggagatagtgactgggtcattagcagtgcggtctggcgcaagtatccgccgtgccactcgaaagtacatgcttgcttattcgaaacaccctgtttccacgcgaggcgctttagccctgctatcccatctatggccctct

SEQ ID NO: 7397 - DNA, 670 bp, Aspergillus oryzae
ggccccaggagcaatggagcgcagagcgacggcggataccagtcgacagaatccgcatcatcggcaacatctccaacggacacagcaggccactactccagcggggatgaacagcggcagcatggccagacacgtaattcatgacttgatacaaccggccagagtcgactgcaatggacacgtttggctcaggaacgggattatggatttgatttctcttctattgtttttccaaggcgggcatgtctggagaatttgatttatttaatttgttttcccctcttcatcttcaggcgctgtatcgatagtgcgttgaatggggacaggccttcttttgatatacctggtgttcttatgcatttttggcgtctctcgcacacgttgatgcacatggtcgagtccgtgtatgcatgtgccatgtctcaaacgcgtgggtcaagagactggattctttcttgtcgttctggattaatatatcgcttttatccgttgaatagtcaatgtgttggatgtgttgatctttcacatttccgcccgatggaggaaggaggaagaagagaatttatgggaggtggttatgtttcatttaaattcctgcatgtcgcgggcacatgttttggtggcccacaatgggatggtcacactgcagtccaaatgaagcatagctgct

SEQ ID NO: 7398 - DNA, 53 bp, Aspergillus oryzae
tgggggaacccttgagggtttgcttaggacctgacccaaagggctctgaaagc

SEQ ID NO: 7399 - DNA, 691 bp, Aspergillus oryzae
  misc_feature (1)...(691): n = A,T,C or G
ggaggcaacatcgatatacagagcatcanatcacatggctatgctgggccaagatacttccctgccggaggtttcaggtagataaccctcacgggctcttgtctgtgacataatgctacactacctaagtactatgtccgcttattgaaatatatatggtggagtcttatgaaaaagatgccctaactgtccaggtcacagccactttcaccttcgattatatttccggccagccaacatgattatattcactccattcgtacaagtagatgtatcacgcagcgtgtactattggcgtattatctcttatcaaatcatgtcctatggaacttatggcagcttaaatattgtggatcaacatgtactcttgagttcctaccacgcgcaattgaaatgaacatggtgctttgcatcgaaaataaaaaaaaatacacattactctttttaatatacctatttataacatctgatattatatatttattctggggccgtttaacatttttttaagggccaataattaatattttttgaccccttaaatttatccgccttcacaccaatttgtttatccagaaagagaggggttaacacccatgaggtctagcccattgttaatttttcaagatcatgaaaaaaaaaaaaactattattatcatacaattatatttttatctatcacaatacctct

SEQ ID NO: 7400 - DNA, 101 bp, Aspergillus oryzae
ggggcaatactttaaaagggccaaatcagcaatgatggatacaggattggctgaggggggacacatttttgtattttcctaatttctttcctataatactt

SEQ ID NO: 7401 - DNA, 856 bp, Aspergillus oryzae
  misc_feature (1)...(856): n = A,T,C or G
gcggtaccttggttagtggtagcacattacgataccatcaaatcaaactagccacggcatatgccgtgctcgccgtaattggcatgctaatggcagctgcgaatatgcttttcgcgctgacccgtggccatcatttgagacgagggatcctcttccccgctatcatactcctaatcctatcgtcactgggaatgacggttctcgacctcgccaaccacatcattatcgattacctacaagcagaatatataagcaagggaatcgacgcatataaccgctccttggaggctcagaatttcctggggtatttcttctactcagtgacctttctcatggctcttcttgtcgcctcgtcgaagcaattatccgataatacctctaccgggcctgttaagcacctccagaaccaacagaagtatcctggggtctcgcaggctcaacagccttatcgggcttatcggccacagggtcaggcgaagatgcacaatggttatcagtagtctctgttgtgttgaggtatgcggagtttggtagggctttatggtagtgaatgagtgtggactagatgctagagtctacttggtgggtgcgtgatagagatggtttattcgtgtggtgcttgcaggtggatatattatgatataatgtctttcttttgtggtttgatcgctttgcgagtttcttgatataccccaataccctgatgctgagtttgaagatagctttgctttgattcntnnnnnanaaannnnnnnnnnnnnnnnnnnnnnnnnnnnnnnnnnnnnnnnnnnnnnnnaaattcttggggccgttcaaccttgcttttaaagggccgcttcttgaaattagttttgcc

SEQ ID NO: 7402 - DNA, 2061 bp, Tricoderma reesei
  misc_feature (1)...(2061): n = A,T,C or G
aagggggccnaagnaaattcccctttcccaagggggnaaaggaaacntttgggttaaccaaacccnaattccnttttttttnggaagggggccaaccaagnaaaaaacccccaaaatttaggnttccaaaaacncccggcggggggaacctaatgagctagtagcgcaanntcnncgaatcggtctatcgatncggtccgnggcggactcaggagactnacttgtacaccatcttttgaggcacagaaacccaatagtcaaccgcggactgcgcatcatgtatcggaagttggccgtcatctcggccttcttggccacagctcgtgctcagtcggcctgcactctccaatcggagactcacccgcctctgacatggcagaaatgctcgtctggtggcacgtgcactcaacagacaggctccgtggtcatcgacgccaactggcgctggactcacgctacgaacagcagcacgaactgctacgatggcaacacttggagctcgaccctatgtcctgacaacgagacctgcgcgaagaactgctgtctggacggtgccgcctacgcgtccacgtacggagttaccacgagcggtaacagcctctccattggctttgtcacccagtctgcgcagaagaacgttggcgctcgcctttaccttatggcgagcgacacgacctaccaggaattcaccctgcttggcaacgagttctctttcgatgttgatgtttcgcagctgccgtgcggcttgaacggagctctctacttcgtgtccatggacgcggatggtggcgtgagcaagtatcccaccaacaccgntggcgccaagtacggcacggggtactgtgacagccagtgtccccgcgatctgaagttcatcaatggccaggccaacgttgagggctgggagccgtcatccaacaacgcgaacacgggcattggaggacacggaagctgctgctctgagatggatatctgggaggccaactccatctccgaggctcttaccccccacccttgcacgactgtcggccaggagatctgcgagggtgatgggtgcggcggaacttactccgataacagatatggcggcacttgcgatcccgatggctgcgactggaacccataccgcctgggcaacaccagcttctacggccctggctcaagctttaccctcgataccaccaagaaattgaccgttgtcacccagttcgagacgtcgggtgccatcaaccgatactatgtccagaatggcgtcactttccagcagcccaacgccgagcttggtagttactctggcaacgagctcaacgatgattactgcacagctgaggaggcagaattcggcggatcctctttctcagacaagggcggcctgactcagttcaagaaggctacctctggcggcatggttctggtcatgagtctgtgggatgattactacgccaacatgctgtggctggactccacctacccgacaaacgagacctcctccacacccggtgccgtgcgcggaagctgctccaccagctccggtgtccctgctcaggtcgaatctcagtctcccaacgccaaggtcaccttctccaacatcaagttcggacccattggcagcaccggcaaccctagcggcggcaacccttccggcggaaacccgctggaccaccaccacccgncgccaagccactaccactggaagctntccggacctacccagtctcactacgggcagtgcggcggtattggctacagcggccccacggtctgcgccagcggnacaacttgccaggtcctgaacccttactactnttnagtgcctgtaaaagcttccgtggcgaaagcctgacccaccggtagaattcttggngagcccgtattatgacggnggggggagcttacattgggccccgggggattaattttttttggatctacttctggaccctttttnaaaatataccgggcaacttatnttttacttgganaagccgnctgnnttngggnatttgcnaaattgaaaccgtggggtcaaaacttnnaaatttttttttttnaaaaaaaaan

SEQ ID NO: 7403 - DNA, 3241 bp, Tricoderma reesei
  misc_feature (1)...(3241): n = A,T,C or G
gcgacgtgagcacacctgcaactatactatggcagtcacccgagactcagacaacggtcgaagacgcaatcgagattgcagatctgacgcaaactggccgtcaagatgctgctggtccagagccagaagccgagagccgtagcctcgacaaagcgatgtacttgaagctcatcagcgctggcttctccttcttcgtcgccggagtcaacgatggagccataggggctttgataccctatttcatccgtgactacaatgttaccaccgcaatcgtgtccagcgtctacggcgccaacttcctcggctggctctttgccgcattaccaatacccacctccgcagtatctcgaccttggcgccatgctcgccctcggagccgcattccagatcgccgctcacgccctccggtcctgggaacctcccttcggactctttgtcgtcacgttttggctcgtgagcgtcggccaggccttccaggacacgcacgcaaactcgtgggttgccagcgccgtccaaagggcgcgcatcgctggctggcgtttatccatgccatgtacatggcgggctgcctcgtcggcccgtttgtctcgacggcggtggcttcggcgggagaggtcttcgcgggggtacttggttctatacgtttcccgttgggggctcggagtgatgaaatctcgttttgacgtgtgttgcatttccgggacacgctcgggctttcagcggaagaactttgcgagcgaagagtcaaggacgaacacttggtgaaactgctgctgcttgagccgagcaacgaagcagtatcgagaaacaaggaggcgacgcagctcatcaagaagacggcgtccacgcccagcgtctggctgctcagcctcttcttcttcttctacctcggctcggtgctcacggcgggcggctgggtcgtcgagtacctggtcaacgtgaggcacggcaatctttcgcagatgggatacgtgccggcgggcttcaacggcggcggtctcctggggcggttgctgctcgctgagccaacacataggtttggcgagcgccggatggtgtttctgtatgttggtgcgtcgatcggcctgcagctcatcttctggttggtgccgaacattgtcgccgcatcaattgccgtcagtcttatcggcttctttacaggaccgctgtttccgactggcatctccctgggctcgaaattgtttccgtcagacattcactccaccgcgctgccgctggtttttgtctttgcccagctgggaggatccctgtttcccatcatcacgggagttgtctctgccgatgccggcgtcaaagtgctgcagcccatgctgattgccctcctgacggttacggcgattagctggctacttgtgccgtcgccaaagacttcnaatgccgagctgcatcaagagtagtggtgactgataccgcgatccctttacttatggcacgcagacggaggcatcnatggccagnttgggagtgcatattgaacgggcagcgcgtacaagcgcccctatcaagcaattgatgttttactgcaggtggagatgtttaaaggcactcgacattgggatanatgatgtgtttttttctcactagctactgatcgacaaagaccatccatgtgaattatagtatcgctggcaacaatccatcagtggtcatttgcggtctaccgacctgcgacagacaaccacaaagtagccaaagactccgccaaccggnanccacaccatcgcacatcattgtttgaagccggtcacgaaagccttacaaggaacgatgggtttgcgtttgtaaaagctgcacaaagtaggcttggaacccaagcaccagcttnaggcgccggttgcaaggcatctgggagcgcncagtggaagtcaaatcgtggcgcactgctgtcgctggtgccgtcacactcgccggcctggcttgacccagacaaacgaatccagcaacgagtccccagtgtttgcggatgggcgaataccaaatccggtgccgatcacattgcaccagtctccccactgttgctgtccggtaggctgctttcccgatcgaccttgatcagtgatgaagaaggcgttggaccagccgtgattggcaagaagaggtccaatagcgtgaatgtacagcttctcgttgtagacagcgttgccttgcgtgtacgatggggggctggtaatgttccacccgttgtagttggcgacattggttgccaatccgcgaagagctctcggagacgatgcattcttgtaaacatttgcaaatagctgagcggccgggtcttggtttgccggccagccaagccatcctgcatggccagcgtccaaatacatcgcaacatttggaaggttcagctgtgtgacggcgtagttgatgcactcaaggtaggctgactgagcattggcacactttggagtaccgaggttggtcaccaggttggcaanagagtcaggctcaataaccagaagggtccggatatcggaatattccacgacaatttgacgaatggtgtcgatatagttcttatatttggcgacgccaccatcggcaatagagtattcgccattcgaggcaagggcagcgcaatcgcgatccggcaagtcatacaccacaaactgtccggcatagttaccgccattcttgttggcggtgcggatgtcggccaaggtttgctccatgagaggggtcttgtcaagagtatctagccacataaaagagggaacctttgcgacagctgctgcagcagtggccatggctccagtcaagctaggaatagcgaggctgctaacttcagaggcgtaatatgcattggcccaaggagtgaccccaacaaaagggttgcctgaatacgtagcggttcccgatccgactggaggtactctggtagtagtagaaccaggtggaggcgtcgcggagctcgaccgggatgttgtgggggatactcgagaagtcgtcgacgcggcgcgcgtggacgagcttgagcttgcagcgccgggaagacactgggagtaatagtcgttggagtagacgcatgtgcttccggaagcacagcaagtcggacccgaccaattctggccaccacattggccccagacgcttgagcaagcttgccgctcctctagaggcacactagctgcgagtgtggccagcgtagccagcgtggtgagaatgccgacaatcatggtgcaatacacagagggtgatcttacaagcctcttcaggtagctgc

SEQ ID NO: 7404 - DNA, 2361 bp, Tricoderma reesei
  misc_feature (1)...(2361): n = A,T,C or G
caaacaatcatcacacgcacacttcacttctcctacacactcttcacacgctttttcctttttttcctttttttctagttctcacacacacatcacacacacacaatggctgctagtatgggaccagccgtcggtatcgacctgggtactacctactcatgcgtcggtatcttccgtgaggaccgatgtgatatcatcgccaacgaccagggtaaccgaacgacgccctcgttcgttgccttcaccgacaccgagcgtctgattggtgatgccgccaagaaccaggtcgccatgaacccccagaacaccgtctttcgacgccaagcggttgattggccgcaagttcgccgaccctgaggtccaggccgacatgaagcacttccccttcaaggtcatcgacaagaactccaagcccgtcatcgaggttgagttcaagggcgagaagaagaccttcacccccgaggagatctcctccatggtcctgaccaagatgcgtgagaccgccgaggcctaccttggtaccaccgtcaacaacgccgtcatcaccgtccccgcctacttcaacgacagccagcgtcaggctaccaaggacgccggtctcattgccggcctcaacgtcctgcgtatcatcaacgagcccaccgccgctgccatcgcctacggccttgacaagaaggtcgagggcgagcgcaacgtgctcatcttcgatctcggtggtggtaccttcgatgtgtccctcctgaccattgaggagggtatcttcgaggtcaagtccactgccggtgacactcacttgggtggtgaggacttcgacaaccgtctggtcaaccacttcgtcaacgagttcaagcgcaagcacaagaaggatctgtccaccaacgctcgtgctctccgccgtctccgcactgcctgcgagcgtgctaagcgaactctgtcttcgtctgcccagacctcgattgagatcgactccctgtacgagggtatcgactactacacctccatcactcgtgcccgtttcgaggagctgtgccaggatctcttccgatccaccatccagcccgtcgaccgtgtccttgccgatgccaagatcgacaagtctcaggtccacgagatcgtcctcgtcggtggctccacccgtattccccgcattccagaagctcatcaccgactacttcaacggcaaggagcccaacaagtccatcaaccccgatgaggctgtcgcctacggtgccgccgtccaggcccgccatcctgtctggtgacaccacttccaagtccaccaacgagatcctgcttctcgatgtcgctcccctgtcttctcggtatcgagaactgctggtggcatgatgaccaagctcatcccccgcaacacccaccattcccaccaaagaagtccgaggtcttctccactttttccgacaaccaacctggtggtgctcatccaggtctacgagggtgagcgccagcgcaccaaggacaacaacctgctcggcaagttcgagcttaccggcatcccccctgcgcctcgtggtgttccccagatcgaggtcaccttcgacgtttgatgccaacggtatcatgaaccgtctctgccgtcgagaagggcactggcaaagtccaacaagattgtcatcaccaacgacaagggccgcctgtccaaggaggagattgagcgcatgctgtctgacgccgagaagtacaaggaggaggacgaggctgaggccaagcgtgtcagcgccaagaacggcctcgagtcgtacgcctactctctccgcaacaccctcaacgaccccaaggtcgatgagaaagattgaggccgccgacaaggagacgctcaagtctgagattgacaagatcgtccagtggcttcgatgaacaaccaagcaggccttctacttggaggagttccgaagtcttcacccagaaaggagccttggaagggtgtcgccaaccccatcatgatgaagttctacggagctggtggtgagggtggcatgccccggtggcatgcccggcggtgccggtggcttccctggcgctggcggcgctcctcaccagggtggcgatgacggccctaccgtcgaggaggtcgactaaatgcacaacaagcccttttgatnccccaaacatcatcagacttgancctncaagcttggtaacgcgtctacgatgtgtgnaggcctantntaggggatcaanggcatgatgcatgattaaattctttcctttgntctcatttgctttttccgcactancatttcacggatatnaagggtaaaaaancttggncgggttggccctggttntgtactttaatgagttntacgttttnaanggaaccaatccttaatgggttnattt

SEQ ID NO: 7405 - DNA, 1933 bp, Tricoderma reesei
  misc_feature (1)...(1933): n = A,T,C or G
ncgcgccgatncggcacgagggcatgcctgagttggagttgattatctgagcgaggagttgcgtgtttgtctttttcaaagagtcttggtcattgacacgctttggttttatctcgaacttgcttacggtccgaagcacgaacaacaacaagacggagaacaaagagaagaggaagaagaagaagaagaaggaagaagaaggaaaagaagaaagaaagaaggaaaaaaacagagagacggcaagcatgttgcccaaggactttcagtgggggttcgccacggctgcctaccagatcgagggcgccgtcgaccaggacggccgcggccccagcattctggggacacgttctgcgcncagcccnggcaagatcgccgacggctncgtcgggccgtgacggcgtgccgacttcgtacaaccgcacggccganggacattgcgctgctcaagtcgctcggggccaagagctaccgnttctccatctcgtggtcgcgcatcatccccgagggcggncgcggcgatgccgtnaaccaggcgggcatcgaccactacgtcaagttcgtcgacgacctgctcgacgccggcatcacgcccttcatcaccctcttccactgggacctgcccgagggcctgcatcagcggtacggggggctgctgaaccgcaccgagttcccgctcgactttgaaaactacgccccgcgtcatgttcagggcgcttgcccaaggtgcgcaactggatcaccttcaacgagccgctgtgctcggccatcccgggctacggctccggcaccttcgcccccggccggcagagcacctcggagccgtggaccgtcggccacaacatcctcgtcgcccacggccgcgccgtcaaggcgtaccgcgacgacttcaagcccgccagcggcgacggccagatcggcatcgtcctcaacggcgacttcacctacccctgggacgccgccgacccggccgacaaggaggcggccgagcggcgcctcgagttcttcacggcctggttcgcggatcccatctacttgggcgactacccggcgtcgatgcgcaaagcaagctgggcgaccggctgccgacctttacgcccgaggaagcgcgccctcgtccacggctccaacgacttttacggcatgaaccactacacgtccaactacatccgcaccgaagctcgcccgcttcgccgacgacaccgtcggcaacgtcgacgtgctcttcaccaacaagcagggcaactgcatcggccccgagacgcagtcccctggctgcgccccttgtgccgccggntttncgcganttctnggtgtggatcagcaaganggacnggtacccgcccattntacgtgacgganaacggnacgaagcattaagggcgagagcgacttgccaaaggagaaagaattntcgaagatgacttcagggtcaagtactataacaagtacatccgtgccatgggtacccgccgtggagctggacggggtcaaacgtcaaagggtactttgcctggtcgctcatggacaactttgagggggcggacggctacgtaaaaaggtttggggttacctatggggattatgaaaaatgggaagaaacggttcccaaagaaaagcgcaaagagcttgaagccgctgtttgacgagctgattgcggcggcgtgatggaaaaagtttttgagttgatgatacctgcaaagggatgctgaagatgatgatgatgtatgaacacgaaagggatagtattatagcaagctaggataacctgatgcttcttcaaaggggaaattgatatataaacatgcatatataatgaatcaaacaggacaatgtcggaggaaaaacgagggtgagagaatggacagaccgatggacgcatcaagaatggggtatgatagctgcatttatttggctggttgctattgaaaaaaaa

SEQ ID NO: 7406 - DNA, 1090 bp, Tricoderma reesei
  misc_feature (1)...(1090): n = A,T,C or G
aacgcagctnttctcgccgccctgtcggctctcctgcccacggccctggngcanaacaatcaaacatacgccaactactctgctcagggccagcctgatctctaccccgagacacttgccacgctcacactctcgttccccgactgcgaacatggccccctcaagaacaatctcgtntgtgactcatcggccggntatgtagagcgagcccaggccctcatctcgctcttcaccctcgaggagctcattctcaacacgcaaaactcgggccccggcgtgcctcgcctgggttttccgaactaccaagtctggaatgaggctctgcacggcttggaccgcgccaacttcgccaccaagggcggccagttcgaatgggcgacctcgttccccatgcccatcctcactacggcggccctcaaccgcacattgatccaccagattgccgacatcatctcgacccaagctcgagcattcagcaacaagcgggccgttacggtctcgacgtctatgcgccaaaacgtcaatgggcttccgaagccccttttggggccgtggccaggagacgcccggcgaagacgcctttttcctcagctccgcctatacttacgagtacatcacgggcatccagggtggcgtcgaccctgagcacctnaaggttgccgccacggtgaagcactttgccggatacgacctcgagaactggaacaaccagtcccgtctcggtttcgacgccatcataactcagcaggacctctccgaatactacactccccagttcctcgctgcggcccgttatgcaaagtcacgcagcttgatgtgcgcatacaacttcgtcaacggcgtgcccaactgtgccaaacaagcttctttctgnagacgcttttgcgcganaactggnggnttcccgaatggggatacgtcttcgtccgattgcgatgccgtttacaacgttttcaacccttatgaactaccccagccaccaattcgtttagccggcggcagtttaattgggaaccgggaccgaatttcgaatgggggtcagaattaccccggggcacttaaaccatgtttttggggcnggaaaattccc

SEQ ID NO: 7407 - DNA, 1451 bp, Tricoderma reesei
  misc_feature (1)...(1451): n = A,T,C or G
ggtgcggccctgcaaggctctcgcccccgagtacgaggaggcggccacgactctcaaggacaagagcatcaagctcgccaaggtcgactgtgtcgaggaggctgacctctgcaaggagcatggagttgagggctaccccacgctcaaggtcttccgtggcctcgataaggtcgctccctacactggtccccgcaaggctgacggcatcacctcctacatggtgaaacagtccctgcctgccgtctccgccctcaccaaggataccctcgaggacttcaaganccgcgacaaggtcgtcctggtcgcctacatcgccgccgatgacaaggccttcaacgagaccttcactgctctggccaacgagctgcgtgacacctacctntttggtggcgtcaacgatgctgccgttgctgaggctgagggcgtaaagttcccttccattgnctctacaagtccttcgacgagggcaagaacgttttaacgagaaagttcgatgctgaggccattccaactttgctcaaggtgccgccactcccctcgttggcgaagttggccctgagacctacgccggctacatgtctgccggtatccctctggcttacatcttcgccgagaccgccgaggagcgtgagaacctggccaagaccctcaagcccgtcgccgagaagtacaagggcaagatcaacttcgccaccatcgacgccaagaactttggctcgcacgccggcaacatcaacctcaagaccgacaagttccccgcctttgccattcacgacattgagaagaacctcaagttcccctttgaccagtccaaggagatcaccgagaaggacattgccgcctttgtcgacggcttctcctctggcaagattgaggccagcatcaagtccgagcccatccccgagacccaggagggccccgtcaccgttgtcgttgcccactcttacaaggacattgtccttgacgacaagaaggacgtcctgattgagttctacgctccctggtgcggtcactgcaaggctctcgcccccaagtacgatgagctcgccagcctgtatgccaagagcgacttcaaaggacaanggttgtcatcgccnaaggttgatgccactggcaacgacgtnccncgacgagatccaaggcttntcccaccatcaagcntntaccccgnccggtgacaagaagaaaccccgtnaccntaacagcggnggcccgnacttggttgaaggacnttnattcgaagtttnatnaaaggagaaacnggcaaggtacaaaggggccgggcgttcgaaaatcccccgcccgaagcccacccgaggaggtgaggtttccagtncaaggctttgagaggcaagggtttcgngngactacgaanggttgtnaanaatcccaaaaattggngggaaagaaaaaaacaaatggtaattggggtttggttttgacanaaaaat

SEQ ID NO: 7408 - DNA, 1242 bp, Tricoderma reesei
  misc_feature (1)...(1242): n = A,T,C or G
gctttgtttctttcacaaaaaaatgatccagaagctttccaacctccttgtcaccgcactggcggtggctactggcgttgtcggacatggacatattaatgacattgtcatcaacggggtgtggtatcaggcctatgatcctacaacgtttccatacgagtcaaacccccccatagtagtgggctggacggctgccgaccttgacaacggcttcgtttcacccgacgcataccaaaaccctgacatcatctgccacaagaatgctacgaatgccaaggggcacgcgtctgtcaaggccggagacactattctcttccagtgggtgccagttccatggccgcaccctggtcccattgtcgactacctggccaactgcaatggtgactgcgagaccgttgacaagacgacgcttgagttcttcaagatcgatggcgttggtctcctcagcggcggggatccgggcacctgggcctnagacgtgctgatctccaacaacaacacctgggtcgtcaagatccccgacaatcttgcgccaggcaattacgtgctccgccacgaagatcatcgcgttacacagcgccgggcaggcaaacggcgctcaaaactacccccagtgcttcaacattggccgtcttaaggctcgggtttttttgcaagcccagcggcgttctagggaccgacctttatcacgcgacggaccctgggtgtttctcatcaacattttacaccaacccgnttcaacttacatnattccctggaacctaccgngggtattaaggccttgccaacgangtgttgcccaggggangttnccctgcgggnaacgggccaaccggccaggcgccnatttttttcttggaaggcggtangcgggcccgaccagcaagaaccacgacaacngcgaggacgacgcangcctnaagcangcccaacttttacgccttccgcaaccacgtcggcacctgctggcggccaacccanacttttgtcnggcagtgtggtggcagnggntacagcgggcctactcgatgcgcgccggcagccacttgctctaccttgaacccctactacgcccagtgccttaactaganggcatcacngngggtctttggaactttgaggacacacgccggctnatgctttctanaactgangtagttgttcggggcaaggaggaataatcttttacatatactggacttgaatcttgacnatgtacttctggatttcactanatgaagt

SEQ ID NO: 7409 - DNA, 923 bp, Tricoderma reesei
  misc_feature (1)...(923): n = A,T,C or G
tgggatatcagcaattgccatttctgacctgtataggttttcctatgcgtcattcctataagagacacgctctttcgtcggcccgtagatatcagattggtattcagtcgcacagacgaagcctctgctcgataatatctccccgtcatcgacaatgaacaagtccgtggctccattgctgcttgcagcgtccatactatatggcggcgccgctgcacagcagactgtctggggccagtgtggaggtattggttggagcggacctacgaattgtgctcctggctcagcttgttcgaccctcaatccttattatgcgcaatgtattccgggagccactactatcaccacttcgacccggccaccatccggtccaaccaccaccaccagggctacctcaacaagctcatcaactccacccacgagctctggggtccgatttgccggcgttaacatcgcgggttttgactttggctgtaccacagatggcacttgcgttacctcgaaggtttatcctccgttgaagaacttcaccggctcaaacaactaccccgatggcatcggccagatgcagcacttcgtcaacgacgacgggatgactattttccgcttacctgtcggatggcagtacctcgtcaacaacaatttgggcgggaatcttgattccacgagcatttccaagtatgatcagcttgttcaggggtgcctgtctntgggcgcatactgcatcgtcgacatccacaattatgctcgatggaacggggggatcattggtcanggcggccctactaatgctcaattcacgagcctttggtcgcaagttggcatcaaaagtacgcatnttaatcgangggngnggttcggcatnatgaatgaaccccacgacgtgaacattaacacctggggttgcncgggctaanagggtg

SEQ ID NO: 7410 - DNA, 991 bp, Tricoderma reesei
  misc_feature (1)...(991): n = A,T,C or G
caactactattgcaattcttcttcacgtgggcatctattcgtatcttacacaagggcgctgcaactaattgacttgatcttccatctcgtgtcttgcttgtaaccatcgtgaccatgaaggcaactctggttctcggctccctcattgtaggcgccgtttccgcgtacaaggccaccaccacgcgctactacgatgggcaggagggtgcttgcggatgcggctcgagctccggcgcattcccgtggcagctcggcatcggcaacggagtctacacggctgccggctcccaggctctcttcgacacggccggagcttcatggtgcggcgccggctgcggtaaatgctaccagctcacctcgacgggccaggcgccctgctccagctgcggcacgggcggtgctgctggccagagcatcatcgtcatggtgaccaacctgtgcccgaacaatgggaacgcgcagtggtgcccggtggtcggcggcaccaaccaatacggctacagctaccatttcgacatcatggcgcagaacgagatctttggagacaatgtcgtcgtcgactttgagcccattgcttgccccgggcaggctgcctctgactgggggacgtgcctttgcgtgggacaagcaagaagacggatcccacgcccgtncttcggcaacgacacgggctcaactcttcccgggagctcgccgcagcgacatcgtcgagtccgccgtctggcggcggcaagcaaacgctctatggccaatgtggaggtgccggttggacgggacctaccacgtgccaggccccanggacctgcaaggttaaaaaccangtggtacntccagtgtctttncttgangaaggcccaangaatagcccatggtcttcttctanccattctttccnggcgtcangtctggatcttgncttattttaaatcaaggtcaagtccaatattgtattccagaagataataaaattattgtatattattagcaagtn

SEQ ID NO: 7411 - DNA, 1005 bp, Tricoderma reesei
  misc_feature (1)...(1005): n = A,T,C or G
acancgtacnaatgcttggattcagtttcactgctgttgaccacggccatcctggccattgcccggctcgtcgccgcccagcaaccgggtaccagcacccccgaggtccatcccaagttgacaacctacaagtgtacaaagtccggggggtgcgtggcccaggacacctcggtggtccttgactggaactaccgctggatgcacgacgcaaactacaactcgtgcaccgtcaacggcggcgtcaacaccacgctctgccctgacgaggcgacctgtggcaagaactgcttcatcgagggcgtcgactacgccgctcgggcgtcacgacctcgggcagcagcctcaccatgaaccagtacatgcccagcagctctggcggctacagcagcgtctctcctcggctgtatctcctggactctgacggtgagtacgtgatgctgaagctcaacggcaggagctgagcttcgacgtcgacctctctgctctgccgtgtggagagaacggctcgctctacctgtctcagatggacgagaacnggggcgccaaccaagtataacacgggcggtgccaactacgggagcgggtactgggatgctcagtgccccgttcagacatggaggaacnggacccttaacactagccaccaaggnttttggtgcaacgaagatggatatcntgganggcaactngagggcgaatgcttgaccccttacttttggacnggcacggctgnganttttgccggtngngggttnaaccctatnggaagnggttcaaaagttattacggccccggaaataccgtgacaccttcaaaaactttaccttattaccannttaanacgggnaacggttngccttgggnaaccttgggagctttacccgcaagtctcacaaaacggggtnaaaatcccancgccaagccnggggggaaataatttgtcttgcccgtccgcttaactacgggggcttgcncattggnaaggccttaanaacggatgggntt

SEQ ID NO: 7412 - DNA, 868 bp, Tricoderma reesei
  misc_feature (1)...(868): n = A,T,C or G
gttacaagagccaaaatgccttcagtcaaagaaacacttactcttttgctgagccaagctttccttgccactggcagcccagtagatggagagaccgttgtgaagcgacaatgcccggcgattcacgtcttcggcgcccgtgaaacgacagtgagtcagggatatggctcgtccgctaccgttgtaaacttggtcatccaagcccatcccggaaccacatccgaggcaattgtctacccggcgtgcggtggtcaggcttcatgtggcggcatcagctatgctaactcagttgtgaacggaaccaacgcccgcggcggnggnaatcaacaactttcacaactcttgccggacactcaacttggtgttggtcggatactcgcanggtgctcaaatcttcgataatgccctntgcggangangcgatcctggtgaangaattaccaacactgctgccccctaactgcgggagcagtttccgctgttaaagcacaatctttcatgggaaacctcgaaacattcatggnctgcctataacgtcggaacctgtactaccaagggttcgacccccgtccgggtggctttgtctgtccancgcgtccaaaatcaagtttactgngatgccgaaaccgtactgntggacccggaaatgaccccaacgttaaccaaggtaccggccaggantccgggcaagaagcttttggttttattaacaagccaagtttttttagggggttttaaacccccggcggggggccgaccaggaccttcanggccaaccagganaaaaaatnggaacttttctgggccaaattaaaanttattggggggtnangcggaggccangnttggaccggtcttacccaagtga

SEQ ID NO: 7413 - DNA, 1478 bp, Tricoderma reesei
  misc_feature (1)...(1478): n = A,T,C or G
nngacctgaagaggcgcctcgaggatgccatcaacgccggcaaccaccagcgggccgccgatctcaagtacggcgccatccaagagcaggaggcgctgattaggaagttggaggagaagaagaacgctgcagatgtcgccctcaacgccagcggcgagaacactgtcatggtcaccgacatcgtgacggctgataacatcaatgagatcgttgccaagtggaccggcattcccgtcacccgactccgcacatcagagaaggagaagcttatccagatggaaaaggtcctcagcaaggttgtcgttggccagaaggaggctgtccagtctgtcgccaacgccatccgactccagcgctctggcctcagcaaccccaaccagccgccagcttcctcttctgtggtccttcgggtactgcaagacgctcctaccaaggcgctggccgagttcctgtttgacgaccccaaggccatgatccgttcgacatgtccgagtaccaggagcggcactcgctgacccgtatgattggtgcttccgccaggatattgtcggccacgacgctggtggccagctgactgaggcactccgacgcaagccattctccatcctgctgttcgacgaagtggagaaggcagccaaggaaatcctgacagtgcttctccagctcatggatgacggccgcatcacggatggccagggcagagtcattgactgcaagaactgcattgtcgtcatgacctccaacctgggagccgagtacctcgtccgccctggcgtgaaggagggtaaggtggatgccaacaccaaggagctggtgatgggcgctctccgcaactacttcctgcccgagttcttgaaccgtatcaactcggtcgtcatcttcaacagactgacgcgcaaggagattcgcaagattgtcgacttgcgtatcagcgagatccagaagcgtctggaagacaacggccgcaagggtaccatctcggtctcggaagangccaaggactacttgggcaacgccngctactcgcccgcatacggngctcgtccactggctcggttgattgagaaggaggtgctcaacaaactcgccattctcatcttcgcaacgccatccgcgacggcgaaacggcgcgcgtggagcttgatgacaacaagattgttgtgttgtcgaaccaccccgacagcggaacagatgatgatgacgaaaacatgtttgatgaagangatgttgaggatgtgattggagaaggacatggatgaagacatttttgaattaaaacacccgaaaattganggggggaccaaatttgacttgaaagggttgatgactgaaaaatttgaaaaagtcttaattgtttcattgatttacanggcattaccggagttaagggatctggcaaagcatggtttgtttgantggggttttanttaangggtcctttaccctangggtnnaaangaaatgaatttttattaaat

SEQ ID NO: 7414 - DNA, 850 bp, Tricoderma reesei
  misc_feature (1)...(850): n = A,T,C or G
ctagtcaagaacaacacagctctcacgctacatcacacaaaccgtcaaaatgggtaaggaggacaagactcacatcaacgtggtcgtcatcggccacgtcgactccggcaagtctaccaccactggtcacttgatctaccagtgcggtggtatcgacaagcgtaccattgagaagttcgagaaggaagccgccgaactcggcaagggttccttcaagtacgcgtggggttcttgacaagctcaaggccgagcgtgagcgtggtatcaccatcgacattgccctctgggaagttcgagactcccaagtactatgtcaccgtcattgacgctcccggccaccgtgacttcatcaagaacatgatcactggtacttcccaagccgactgcgctatcctcatcatcgctgccgggactggtgagttcgaaggctggtatcttcaaggatggccagacccgtgagcacgctctgctcgcctacaccctgggtgtcaaagcagctcatcgtcgcatcaacaagatggacactgccactgggccgaggctcggtaccaggaaatcatcaanggagactttcaacttcattaagaaggtcggnttcaacccaanggccgtggntttcgtccccatnttcggntttaacggngacaacatgcttaccccttcaccaactggccctgggtacaanggcttgggaaaaaggaaaccaaggttggcaagttaaccgggaaaaaccttcnttgaggccattganttcattgagnccccccaagcgttccacgggacaancccctgggttttnccttcaagangtttacaaaancggggggtttggaaaagttcccgtcggccg

SEQ ID NO: 7415 - DNA, 898 bp, Tricoderma reesei
  misc_feature (1)...(898): n = A,T,C or G
acgttctccgaatcgtcaacgaacccaccgctgccgctatcgcctatggtctggacaagaccgacggtgagcgccagatcattgtctacgatctcggtggtggtacctttgatgtttctctcctgtccattgacaatggcgtcttcgaggtcttggctaccgccggtgacacccaccttggtggtgaggactttgaccagcgcattatcaactacctggccaaggcctacaacaagaagaacaacgtcgacatctccaaggacctcaaggccatgggcaagctcaagcgtgaagccgaaaaggccaagcgtaccctctcttccagatgagcactcgtatcgaaatcgaggccttcttcgagggcaacgacttctccgagactctcacccgggccaagttcgaggagctcaacatggacctcttcaagaagaccctgaagcctgtcgagcaggttctcaaggacgccaacgtcaagaagagcgaggttgacgacatcgttctggtcggcggttccacccgtatcccaaggttcagtctcttatcgangagtactttaacggcaagaaggcttncaagggtatcaaccccgacgaggctgttgctttcggtgcccgccgtccaagccggtgtcctttntggtgaagaaaggnacccgatgacattggtcttatggacgtnaaccccttgactnttggtatcnaaccactggcggagtcatgaccaactnattcccgnacacccccatcccaatcgcaaaaccanatnttttgactgtggcgataccaccccgtcgtcctgatncaggtttttanggngagcgttccatgaccaaggcaacaacttctgggcaatttnacttacggnattcctcttgcccccccggggtccccaaattgng

SEQ ID NO: 7416 - DNA, 852 bp, Tricoderma reesei
  misc_feature (1)...(852): n = A,T,C or G
aaatcctcagatacaaaatggctcccatcaaggtcggcatcaacggcttcggccgaattggacgtatcgtcttccgcaacgctgttgagcaccccgagatcgaggtcgtcgccgtcaacgaccccttcatcgagaccagctatgctgcctacatgctcaagtatgactcctcccacggtctcttcaagggcgacgttaccgtcgacggcaaggacctcgtcgtcaacggcaagaaaggttcgcttctacaccgagcgtgaccctgncaacatcaagtggagcgaagactggtgccgagtacattgtcgagtccaccggtgtcttcaccaccaccgagaaggccaaggctcacttgggttggcggtgccaagaaggtcatcatctctgccccttctgccgatgccccatgtacgtgatgggcgtcaacgagaaggactacgacggctccgccgatgtcatctncaacgcctnttgcaccaccaactggcttggctcccttcgccaaggtcatccacgacaactacggnatcgntganggtcttatgaccaccgtccattcttacaccggcacccaaaanaccgttgacggtcctccgcaaggactggcgccggtggccgtggtgcttgcccaaaaattattcccancaacaattggtgcccgccaaggttgtcggcaaggtattcccttgnttaaanggaagcttaccggnatgtccattcgtgtccctaccgncaacgtttccgtggtcnanttgaccgtccnccttgaaaaggggncttctacgacgagatnccganaccttnaaaaaggttgccgnnggtcccttaaagggaatttgggcttaaaccaaa

SEQ ID NO: 7417 - DNA, 695 bp, Tricoderma reesei
  misc_feature (1)...(695): n = A,T,C or G
atccccaaggagggcctggagcgcgaccccaactggttgacgcgcaacggcctcaacctcgactccttcaggagaaagcactatggccccggcatcgtggagcttgagcgccccatgaaggcgcgccatctgcacatgattgccattggaggctctatcggtgctggtttcttcgtcggctcgggtggtgctctgagcaaaggtggtcccggttctctctttgtcgacttcctcattgtcggtatcatgatgttcaacgtcgtgtacgccctcggtgaactcgctatcatgtaccccgtctctggttccttctacacgtactctgctcgattcatcgaccccgcgtggggttttgccatgggctggaactatgtcctgcagtgggctgccgtgcttccgcttgagttgaccgtctgtggtatcacgattgggtactggaatagcgacatctccgtggctgctggatctccgtcttnctcgcaccatcattatcatcaacgtgttcngagccctgggctacctgaagaagagttttgggcgtcgtgctttaacttcggagcgaccgtcgtcttcatgancaatggccgcgtccttggctgcggnggcggtccttngacggncgtacaacnatactggggcgctcgntactggtacnaccccgngcctttaagaacggtttaagggcttttgggccc

SEQ ID NO: 7418 - DNA, 737 bp, Tricoderma reesei
  misc_feature (1)...(737): n = A,T,C or G
cattcactgcacccgatgtgtccgattcgccaacgacattgccggtgcccctgagcttggctcaactggccgtggcaacgacctgcagattggcacttacctggagaagaacctggattcggagctgtctggcaacgtcatcgatttctgccccgttggtgccctgacctccaagccgtatgccttccgagctcgtccttgggagctgaagcacaccgagtccattgacgtcctggacggcctgggctccaacatccgtgtcgattctcgtggtcttcaggtcatgcgcattcttcctcgactgaacgacgacgtcaacgangaagtggatcaacgacaagacgcgattcgcttgcgacggnctcagactcagcgactgactgtgcccctgattcgaagggaaggccgattcgagaatgccgactggaggaggctttgaccgtcatcgccaagggcgtaccagcagaccaaccctnagggcaacgagttcaagatattgccggcgcgctgactgaagtagagtctntcgtcgtcgccaaggacatgggcaaacaagcttggggtctgagaaccttgccctggatacccccacccggcagcaagccccttgttnacggaatngacgtgcggtcgaactaccttttcaacttccaaanctgggggcattcgaggaggctganttgcatgcttattcgtcgggagnaaccccganacgaaggccgccgtctgnacgcttc

SEQ ID NO: 7419 - DNA, 833 bp, Tricoderma reesei
  misc_feature (1)...(833): n = A,T,C or G
tcgaggttgagtcctctgacaccatcgacaacgtcaagtccaagatccagagacaaggagggcatccctccgtgaccagcaagccactcatctttgctggaaagcagcttgaggacggccgaaccctctccgactacaacatccacaaggagtctacactccacctggtcctccgtcttcgcggtggtatgcagattttcgtcaagaccctcacaggaaagaccatcaccctggaggtcgagtcatctgatactatcgacaacgtcaagtccaagattcaggacaaggagggtattcctccagaccagcagcgcctgattttcgctggtaagcagctggaagacggccgcactctgagcgactacaacattcagaaggagagcaccctgcacttggtcctccgtctccgtggtggtatgcagatctttgtcaagacactgacgggtaagacgattaccctggaagtggaatcatctgatccatcgacaacgtcaagtcaaagattcaggacaaggagggtattccgnctgaccaacagcgcttgatctttgctggtaacagtttggaagacggtcgtaccctgagcgactccacatccagaaggagacactntgnacctggttntccgtttcggggcggcagtaaacccacttctntttacgangnacttttatgattgggtggacnactcggcgtttttgggaattctaggcaaatatgggaacttggccatttgcagggggcattaatatnttatggtaaccnccctttgggggttgcctaaattggngggccncctcaataccaatnttggnccggtttanaaaaaaaaa

SEQ ID NO: 7420 - DNA, 691 bp, Tricoderma reesei
  misc_feature (1)...(691): n = A,T,C or G
tgtcttctgagaagcctcaaaaggtcctgggcatgccgcccttcgtggccgacttcctgatgggtggtgtttccgctgccgtctccaagaccgccgctgcccccatcgagcgtgtcaagctcctcatccagaaccaggatgagatgatcaagtccggtcgtctcgaccgccgctacgccggtatcaccgactgcttcaagcgtaccgccgccgatgagggtgtcctgtccctgtggcgtcgtaacactgccaacgtcatccgatacttccctacccaggccctgaactttgctttccgtgacaagttcaagaagatgttcggcttcaagaaggaccgtgatggctacggcatgtggatgctcggtaacctgcctctggtggtgctgctggtgccacttctatgcttttcgtctactctctggattacgcccgtacccgtctggcaacgatgccaagagcgccaaagaagggtggtgagcgccagttcaacggtctcgttgacgtctaccgcaagaccctcgcctntgacggtattgccggtctgtaccgtggtttcatgccctccgtcgctggtatcatcgnttaccgtggtctctacttcggcatgtacgactccatcaaagcccgtcttctggtcgggactctccagacaacttccttggctntttcgttntcggtggngcgtcacact

SEQ ID NO: 7421 - DNA, 828 bp, Tricoderma reesei
  misc_feature (1)...(828): n = A,T,C or G
ggaccccggcctggatcacaagcaggtccgagccttggacacgtactggcagcagctgcgtctgctgtactctccgttcgaggctcaccttgccgggcccgaccccgaggtgtacgagcacgagattcccggtggccagttgaccaacatgatgttccaggcttcgcagctgggtctcggatcgaagtggctcgagaccaagaaggcctacgaacaggccaacgacctgcttggcgatatcgtcaaggtcacccccacctccaaggttngtcngtgaccttgcccagttcatggtgtcaacaaagctgtccccgaagacgtcaaggcttcgcgcttccgagctcgactttcccgaagtcagtgctcgagttcttcgangggctgatgggcaacccttacggcggcttncccgagcctnttccgacaaacgcccttcgtggacgacggaagctcgacaaagcgccctggcctctacctcgaacctgtcgactttgtcaaggncaagccgtgaaatgggcaagaagtttggcgcgcccgtnaccgagtgcgacattgcctcgtacgtcatgtaccccaaggcttttgaggactacaaagaaagatcacccgacaagttttggcgaacttgtcggtcctgccgacaaggtcttccttgcttgacccgagattggtgaggagttaacgtncaagntcgaaaaagggaaaggtccttattttgaacttcttnntttttggtnctttgaacgaagcanaccggtntncgggaggnttttttcaaangaaccgggnaggtccgcaaggtaaccgtcttcnaaaanaaagntgccg

SEQ ID NO: 7422 - DNA, 637 bp, Tricoderma reesei
  misc_feature (1)...(637): n = A,T,C or G
gcgctgtgtcttctccatcttcttcgtcttcttcctgtcgttcgttcctctgatagtgcaggagttgactgagcgtggtatctggagggccctgagtcgtttcctgaagcagttcctctcgctttcaccgttctttgaaatcttcgtctgtcagatttacgcgaactctgtacagcagaacatttcgtttggcggtgccagatatatcggaacaggtcgtggttttgccaccgctcgcattccctttggcgtcttgtattcccgattcgccgccccgtcaatctatttcggcgctcggttgttgatgatgcttctgtttgcgaccgtcaccgcctggcagcccgcgctcgtctacttctggatcaccctgctcggattgacaatctcgcccttcctgtacaacccgcatcaattcgcatggaccgacttcttcattgactaccgtgactacctccgttggctgtcgcgtggtaactctcgctcgcacgcttcttcgtggatcgcgttttgccgactgncccctatncgagtcactggttacaagcgcaagaacctgggcgatgcctcggccaactgtcgggcgatgtcccaaacaagccattaaccaacatttnttcacggaatttcacccgttctg

SEQ ID NO: 7423 - DNA, 633 bp, Tricoderma reesei
catctggtacaccggcaaacccgtctacgagtttggcacgtggtctcttctacaccaccttcaaggagactctcgccagccaccccaagagcctcaagttcaacacctcatcgatcctctctgctcctcaccccggatacacttacagcgagcagattcccgtcttcaccttcgaggccaacatcaagaactcgggcaagacggagtccccatatacggccatgctgtttgttcgcacaagcaacgctggcccaaccccgtacccgaacaaagtggctcggtcggattcgaccgacttgccgacatcaagcctggtcactcttccaaagctcaacatgcccatccctgtcaagtgctctcgcccgtgttgattctcacggaaaccggattgtataccccggcaaggatgagctagccttgaacaccgaccgaagtctgtgaaagcttgagtttgaattggtgggagaagaagtaacgattgagaactggccgttggaggagcaacagatcaaggatgctacacctgacgcataagggttttaatgatgttgttatgacaaaccggtagaggagttaatgatggaataggaagaggccatagttttctgtttgcaaaccatttttgccattgcg

SEQ ID NO: 7424 - DNA, 1110 bp, Tricoderma reesei
  misc_feature (1)...(1110): n = A,T,C or G
gagagccgcatcaaggaggtcatcaagaagcactccgagttcatcagctaccccatctacctccacgtcaagaaggaggtcgagaaggaggttcccgatgaggaggctgctgaggaggagaagcccgccgaggagggcgaggacaagaagcccaaggtcgaggaggtcgacgacgacgaggaggacaaggagaagaagaagaagaccaagaaggtcaaggagaccaccatncgaggaggaggagctcaacaagcagaagcccatctggactcgcaacccccaggacatcacccaggaggagtacgccgccttctacaagtccctgtccaacgactgggaggaccacctgggtgtcaagcacttctccgtcgagggtcagctcgagttccgcgccatcctcttcgtccccaagcgtgctccctttgacctggttcgagaccaagaagaccaagaacaacatcaagctctacgttccgccgcgtcttcatcaccgacgacgccacccgacctcatccccgagtggctcagcttcgtcaagggtgttgtcgactcttgaggatctgcccctcaaccttgtctcgtgagactcttcaacagaacaagatcatgaaggtcatcaagaagaacattgtcaagaagtccctggagctctttcaggagattgccgaggacaaggancagttcgacaagttctacagcgncttnttcaagacattaagctcggtattcacgaagacttccanaaccgcgccacccttggccaaagcttctgcgcttnaactcgaccaagtntggcgatgagatgacctnttntgaccgattacgtacttcgcatgcccgagcacccagaaagaacatttactacatcactggcgaagtcccttaaaggcccgtccagaagtcttcccttcctggacgcttttcaaggccaaggggctttcganggtccttctttnctccgtcgacccccattggacgagtacccccattggacccagcttcaaagggagtttncgagggacaaagaaaggctgggttcgacattcaaccaaagggactttcgaagccttctgagggaagaacccgaagggangganaaaagaaaagggc

SEQ ID NO: 7425 - DNA, 735 bp, Tricoderma reesei
  misc_feature (1)...(735): n = A,T,C or G
ggggcccgaccacgttttcctacctgacgtcaagcaacccctccagcgtcaatggatggtcgtcaccacagcctctcttctccggcagtatctcaggctccagcccgctggatcagacggtcattggcgacagcacgaacatgtatctgttcttcgcgggggacgacgggaaaatctacagggcgagcatgcctatcggtaacttccccggaagcttcggttcgacgtcaacggtggtcctgagcgatgaaaggaacaatctgtttgaggcagttcaggtctataccgtctcagggcagaagcaatatctcatgattgtcgaggcaataggcgcaaatggccggtatttccggtccttcacaagcgacaaacctcggcggcacatggactccgcaagccaccagcgaaagtcagcccgtttgccggtaaggcaaacaagtggcgctcctggacaaacgacatcagtcatggtgatctaattcgtagcaaccctgatcagacaatgactatcgacccttgcaatctgcagttcttgtccaaggggaaaagcgacaaactntggcggngactaccggctnttgcctatcgaccagggctggtactttcaacgctgancgtccgcaaatttcatagaaaatgcgccacaacaaagacgttatatgtgccgagtctataaatcgaaggacgtacaagantttggtggcaaaccgggaataataccaagcatgtatggga

SEQ ID NO: 7426 - DNA, 982 bp, Tricoderma reesei
  misc_feature (1)...(982): n = A,T,C or G
nttagccgcattcggccgaggaacaaaagtcaactcaatcgtaacctatccaaataaaagccaaataccacactctcctgcccatcatgagccctcccgccgccgtctcgcccccccagcgaaccgctgaactcgtcaccccgtccaagatggccgttgcccagccgcagcagcacctcgaggcccaggccaagtccgtctcggacatgttcggccagtgggactcgttcaccttctcgcccatccgcgagtcccaggtgtcgcgcgccatgacccgccgctacttcgaggacctcgaccgctacgccgagtccgacattgtcatcatcggcgccggctcctgcggcctcagcaccgcctacgtcctcggcacccagcgcccggacctcaagattgccatcatcgaggcctccgtctcccccggcggcggtgcctggctgggcggccagctcttctccgcatggtcatgcgcaagcctgccgatgccttctccgcgagattggcgtcccgtacgaggacgagggcaactacgtcgtcgtcaagcacgccgcctcttcacctncaccatcatggccaaggtgctgcagctacccaacgtcaagctcttcaacgccacctgcgtcgaagacctcatcacccgcccctctgccgagggcgtgcgcatcgccggtgtcgtcaccaactggaccctcgtctccatgcaccacgacgaccaagtcctgcatggaccccaacaccatcaacgcgccccttgtcatctcaccaccggcacgacggcccatgggtgccttttgggtcaaagcgccttgtaagatgggnccgatcnanaagcttggcggcattgcccggcctcgacatgaacagggctgaggatgccattgtcaaaaacacccgtgagggtgttccggcctgattgtcggangaatggacttgtctgagattgacggacccacccgcatgggtctactttggngcatggcct

SEQ ID NO: 7427 - DNA, 584 bp, Tricoderma reesei
cgctggtgctcgtcgcaattcatctctttgcctggaaatgattggcaatctgctggggctttcatatccgatggcagtgcagccgccctgtctcaagtcacgaacccggatgggtcaacaacgaatctgatttttgacgtgcacaaatacttggacttcagacaactccgggtactcacgccgaatgtactacaaaataacattgacgggcgccttttctcccgctttgccacttggctccgacagaacaatcgccaggctatcctgacagaaaccggtgggggcaacgttcagtcctgcatacaagacatgtgccagcaaatccaatatctcaaccagaactcagatgtctatcttggctatgttggttggggtgccggatcatttgatagcaccgtatgtcctgacggaaacaccgactggcagtggtaactcatggacggacacatccttggtcagctcgtgtctcgcaaagaaagtagcactctgagctgaatgcagaaagcctcgcaacggtttgtatctcgctatcaaacatagtagctactctatgaggctgctgttctcatttcagctttatatag

SEQ ID NO: 7428 - DNA, 846 bp, Tricoderma reesei
  misc_feature (1)...(846): n = A,T,C or G
cgtcactttccagcagcccaacgtcgagcttggtagttactctggcaacgagctcaacgatgattactgcacagctgaggaggcagaattcggcggatcctctttctcagacaagggcggcctgactcagttcaagaaggctacctctggcggcatggttctggtcatgagtctgtgggatgattactacgccaacatgctgtggctggactccacctacccgacaaacgagacctcctccacacccggtgccgtgcgcggaagctgctccaccagctccggtgtccctgctcaggtcgaatctcagtctcccaacgccaaggtcaccttctccaacatcaagttcggacccattggcagcaccggcaaccctagcggcggcaaccctcccggcggaaacccgcctggcaccaccaccacccgccgccagccactaccactggaagctctcccggacctacccagtctcactacggccagtgcggcggtattggctacagcggccccacggtctgcgccagcggcacaacttgccaggtcctgaacccttactactctcagtgcctgtaaagctccgtggcgaaagcctgacgcaccggtagattcttggtgagcccgtatcatgacggcggcgggagctacatggccccgggtgatttatttttttggatctacttctgacccttttcaaatatacgggcaactcatctttcactggagatgcggnctgcttggtattgcgatgttgtcaagcttggcaaattgnggctttcgaaaacacaaaacgattccttagtagccatgcattttaagataaccggaatagaagaaagaggaaatttaaaa

SEQ ID NO: 7429 - DNA, 1152 bp, Tricoderma reesei
  misc_feature (1)...(1152): n = A,T,C or G
acgtcgacgccggtggatacaccatgccgctcatcgcagagacgctccaaaaggccaacagcttccgccagcagtttggcatcgagcagaacaagacgtggaacgacatggcgtccaacgtcctggttcttcgcgagaacggggtgacgctcgagttcacggccatgaacggaaccgcagtggtcaagcaggccgatgtgattatgctcacctaccccctgagttacggcaccaactacagtgcgcaagatgctctcaacgacctcgactactatgccaacaagcaatcgcccgacggaccggccatgacatatgcctttcttctccatcgtcggccaacgaaatctctcccttcgggctgctcggcctacacgtacgcgcaaaacgccttcaaagccctacgtccgcgcccccttctaccagatattccgaacagctcaatcgacgatgccagcgtcaacnggcggcacgcaaccttggcctacccggttcctaaccggccaccgggcggcgcccaccaaggtcgtcctcttttgggctacctcggcctccggctggtgccagacgacgtcatccacatcgagcccaacctgccccctcagatcccgtatctgagatacaggacgttttactggcgcggctggcccatctcggcctggtccaactacacgcacacgacccttagccgcgccgccggcgttgctgcgctcgagggggcggaccaagcggtttgctcgcaagcccatcccatccacgccggccccgaacaggacccaacaagcgtaccggctgcccgtcaagggctccgtcgtgatccccaacaaagcagatcggctctaacagacatacgccggcaacctggtgcagtgccacgccggcagctttccaacgactacgtgccgggccaagttncccattggccgncgtcgatggcgccacgtntaccaagtgggnaagcccgcttccgccgacaaggtaagttcattcaccggngtaattggaaaaggaggacgtgggatttttggngtcgggcttcatttcaatgggccaggccccttccgtnaacgccaccgtattttcacaacaaggccttggggatcttgcacggggttggcttcgggcaaaacacaaattcaagtcaaaaccggaact

SEQ ID NO: 7430 - DNA, 565 bp, Tricoderma reesei
  misc_feature (1)...(565): n = A,T,C or G
cctgctcaccgaggcccccatcaaccccaagtccaaccgtgagaagatgacccagatcgtcttcgagacattcaacgctcccgccttctatgtctccatccaggccgttctgtccctgtacgcttccggtcgtaccaccggtatcgtgctcgactccggtgacggtgtcacccacgttgtccccatctacgagggtttcgctcttcctcacgccattgctcgtgttgacatggctggtcgtgatcttaccgactacctgatgaagatcctggctgagccgtggttacaccttctccaccaccgccgagcgagaaatcgtccgtgacatcaaggagaagctctgctacgtcgcctcgacttcgagcaggagatccagaccgncgccagagctccagcttggagaagtcctacgagcttcccgacggccaggtcataccattggcaacgagcgattccgtgctcctgangctctcttncagccttctgtctgggtcttgagagcggtggtatcacgtcaccactttcaactcatcatgaagtgcgacgtcgacgttcgaaangacct

SEQ ID NO: 7431 - DNA, 814 bp, Tricoderma reesei
  misc_feature (1)...(814): n = A,T,C or G
cgtccagtgcctcagcggcagccctgccaacctccaggtctaccaggccatcatgcctccccacggccgtctcatgggccttgacctcccccacggtggccacttgagccacggttaccagactccccagcgaaagatctctgctgtctctacctacttcgagaccatgccctaccgtgtcaacctggagaccggcatcatcgactatgaccagctccagcagaacgccctcctgtaccgcccaaggtcctcgtcgccggtacttctgcttactgccgtctgattgattacgagcgcatgcgcaagatcgccgactctgttggcgcctacctcgttgtcgatatggctcacatctccggtctcatcgccgccgaggccatcccctcccccttccagtgggctgacattgcaccaccaccacccacaagtctctccgtggcctcgtggtgccatgatcttcttccgcaagggcgtncgctccgtcgaccctaagactggaaggagacgctctacgacctggaggaccccatcaacttcttcgtcttccccggcaccagggcggccccacaaccacaccatnccggtctggctgtcgcctnaagcaggctcagacccccgagttcaagggctacagganaaggtcgttttcaacgccaaaacctngagncaagttaaggagctcggcacaacttgttgccacggactgacagccacatggtctggttgaactttgtaagttnaacttcaccggnggcccgtgttganaccgtcttgacaanacaaaattggctgnaaaaagaacgccattcccgga

SEQ ID NO: 7432 - DNA, 709 bp, Tricoderma reesei
  misc_feature (1)...(709): n = A,T,C or G
tcctcaagcccggtatggtcgttaccttcgctccctccaacgtcaccactgaagtcaagtcngtcgagatgcaccacgagcagctcgctgagggccagcctggtgacaacgttggtttcaacgtgaagaacgtttccgtcanggaaatccgccgtggcaacgttgccggtgactccaagaacgacccccccatgggcgcccgcttctttcaccgcccaggtcatcgtcatgaaccaccccggccaggtcggtgccggctacgcccccgtcctcgactgccacactgcccacattgcctgcaagtttcgccgagctcctagagaagaatcgaccgccgtaccggtaaggctaccgagtctgcccccaagttcatcaagtctggtgactccgcatcgtcaagatgatcccctccaagcccatgtgcgttgaggctttcaccgactaccctcccctgggtcgtttcgccgtccgtgacatgcgccagaccgtcgctgtcggtgtcatcaagggccgtcgagaaagtcctctgccgccgncggcaaggtcaccaaagtccgntgccaaaggccggcaagaaataaagcgatcccatcatcaacacctgatgttctggggtncctcgtgagggttctcaggtgggcaccaccatgcgctcacttntacgacgaaacgatcaatggtgctatgcatgaacactcgactattaatt

SEQ ID NO: 7433 - DNA, 686 bp, Tricoderma reesei
  misc_feature (1)...(686): n = A,T,C or G
atgagatcaagctgatttcgggcagctcccacccggagctcagtgctctggtcgctaatcgactcggcattaacattgccaacacgatgagcctcaactactccaaccaggaaaccagtgtttccattggcgagtcggtccgggacgaagacgtcttcatcctccagtcgacggctccgggagacgtcaacgacggcctcatggagctgctcatcatgatccacgcctgccgaactgcctcggccaggcgcatcacggccgtcatccccaactacccttatgcgcgtcaggacaagaaggacaagtcccgcgcgcccatcagcgctaggttgattgccaacatgctgcaggtctccggctgcaaccatgtcataactatggacctgcatgcctcccagatccagggcttctttaacgttcccgtagataacttgtacgccgaaccgtccgtctccggtggatcaagcgagaacctagacgttgagaactgcgtcattgtatccccggacgcgggcggtgccaagcgtgccaccttgcttgccgatcgctnaacacccggatttgctctgattcacaaggagcgtccccgaccaacgtcgtgggccgatggttcttgtcggtgatgtccggacaaggnggctttcttgnggatgacattgggggaacctgcggaactttgggcaagg

SEQ ID NO: 7434 - DNA, 885 bp, Tricoderma reesei
  misc_feature (1)...(885): n = A,T,C or G
ctcgattacccttacgttccgaaatacctgagacgtctctgtcccccttgttcaagatgctgtcacgaagctctcttaggaccgctcaggtcctccgtgctgctgcccagccgcagcagctgacccgatcgttcgccaccgtccagtccgacatcttcaagccggccaagttcggcggcaagtacaccgtcacgctgatccccggagacggcatcggaggcgaggtggccgagtcggtcaagaccatcttcaaggccgacaacgtgcccgtcgagtgggagcagattgaggtgtcgggcgtggaggagagcgcgctgcgcaccgaggaggccttccgcgagagcgtcgcctcgctcaagcgcaacaagctgggcctcaagggcatcctgcacacgcccgtcaagccggtccggccaccagagcttcaacgtggccatgcgccaggagctcgacatctacgccagcatctcgctcatcaagaacatccccggctacgagacgcgccacaaggacgtcgacctgtgcatcatccgcgagaacaccgagggcgagtactcgggcctcgagcaccagagcgtgcccggcgtcgtcgagtcgcttcaagatcatcacccgcgcccaagtcggagcgcatcgnaaagttcgccttcgcctttggcctcgccaacgggcggaaagaaggtaacttgcattcacaanggcaacattatgaagtcgccgacgnctttttcgagcaactttcaaccagaaccggcaaggagtaccnganccttgaggtcaacgacatgattgtcgacaacgccttcattgcaggccggtttccgccccagcagtttgangtcntggtatgcccaacctgncgggggatcntgtccacattgggcc

SEQ ID NO: 7435 - DNA, 697 bp, Tricoderma reesei
  misc_feature (1)...(697): n = A,T,C or G
ctcccgtcaagtggaacctgcccaagctctggggtatgtccgtcctcctcggcactgtcctcgccattggtacctggattgccctcaccaccatgtacgctggtggccagaacggcggtatcgtccagaacttcggtaacattgatgaggtcgtcttccttgagatctccctcactgagaactggctcatcttcatcacccgtgccaacggccccttctggtcttccatcccctcttggcagctcagcggtgccatcctggtcgtcgacatcattgctaccctgttctgtgtcttcggttggttcattggcgaggacaccagcatcgtcgctgttgtccgtatctggatcttctccttcggtatcttcgccatcatgggtggtctctactacttcctccagggaagcactggcttcgacaacctcatgcacggcaagtcccccaagcagaaccagaagcagcgttcattggaagactttgtcgtttctctgcagcgtgtttccacccagcacgaaaagtctcagtaaatacgctctattacatacccgccgatcggttggtcngcatgtttccgttttcatgttnaattttatgtatgagtcgtatctgaagatggactcgtctgcacggatgaaaagcaacttttcatacccctatgatggctgatagacagctaatgaanacaagtnaaatgtcc

SEQ ID NO: 7436 - DNA, 570 bp, Tricoderma reesei
  misc_feature (1)...(570): n = A,T,C or G
ngtacnatgactttaagnnccttcctattgtcctgctggctccagtggttcacgtcaccttgaantcgtgtctggacctgggcattacgttctacatgacgatgccctgcaagctcatcgacttgagcaacggcatgatccccgntctcgagaacagggccacgccgtntctcgcagacgttaccaagtcgtttgagattctccttgcggaagacaacactgtcaaccagaaactggctgtgaagattctcgaaaagtaccaccatgttgtcaccgttgtcggcaatggctgggaggctgtcgaggctgtgaagcagaanaagtttgatgtgatcctcatggacgtgcagatgcccatcatggggaggattcgaggccactggcaagatccgcagtacgaacgtggnatgggaacacacaggaccccccattatcgccctcacggnacacgccatgatgggngatcgncaaaagtgcattcaagcccagatggacantttctgtcccagccgctggaagcaaaccccagcttattccagnaccatttttcaagtngtgccacncttggga

SEQ ID NO: 7437 - DNA, 707 bp, Tricoderma reesei
  misc_feature (1)...(707): n = A,T,C or G
gcctcccaagaaggcggttgtcgaggagaagatccctctgggacgacctggcaacaacttgaagagcggcattgtcggcctcgccaacgtcggcaaatccaccctcttccaggccatcacaaagtgcaatcttggcaacccagctaacttcccctatgccaccatcgagcccgaggaagctcgcgtcattgtccccgatgagcgattcgactggctcgttgagaaatacaagcccaagtcacaagtccccgccaacttgaccgtctacgatattgctggtcttacccgcggatcttcacaggagctggtctcggaaactctttcctgtcccacatccgagccgtcgacgccatcttccaggttgtccgatgcttcgacgatgccgagattattcacgtcgagggcgatgtcaaccccacccgtgatctggacatcatcagcgangagctgcgactcaaggatattgagtttgtggagaangctctggangctcaaaagaagaagacccgcatgggtggccagagtctggagctgaagaagggcaagatcgagcaggagattatcgagaagatccttggncttggcttcangacggnaaggaaattcgcaagggcnactggacccccaaggagatcganggcattaaccttttgttcttctgacgggcaagccgggtgnctacctngtnaactgnctganaaggacta

SEQ ID NO: 7438 - DNA, 880 bp, Tricoderma reesei
  misc_feature (1)...(880): n = A,T,C or G
ggtgctgaccttttgcagaagagaagtggtcttcacagctaaatttctctttcctcacccatctcgaaactctttgcgcagaggcgaggctgtacccaatggctgaacaactgatcctcaaaggtaccctcgagggccacaatgngctgggtcaccagcttggccacctccatggagaaccccaacatgctcctgtctggtagccgagacaagaccctgatcatctggaacctcacccgcgacgagactcagtacggctaccccaagcgatcgctcaagggccactcccacattgtgtccgactgcgtgatctcctccgacggcgcctacgctctgtctgcctcctgggacaagaccctccgcctgtgggagctcgccactggcaccaccacccgaagattcgtcggccacaccaacgacgttctctccgtctccttctccgccgacaaccgacagatcgtctccggctctcgtgaccgaaccatcaagctgtgggaacaccctcggtgactgcaagtacaccatcaccgacaagggccacactgagtgggtttcctgcgttccgattcaagccccaacccccagaaccccgtcattgtcttcagcggttgggacaagctggtcaaggggttggggaagctcttcacctgcaagctgcagaccgaccacattcggccacacccggctacatcaacaaccggcaaccatcttcccccgatggnttntttttgcgccctncggngggaanggaccgggaccacccattgcttntggganctggaacgaattncaagccacctgggactttttttcaaggnccancgaacgnaaaatcnaccccctcgtttttttttcaaaccgaanttggttttggctgctc

SEQ ID NO: 7439 - DNA, 749 bp, Tricoderma reesei
  misc_feature (1)...(749): n = A,T,C or G
tgacgtactcgagaccttggccagccgacgctcctttgacctcgaccaaccatccgcctcgatcgccactcgaccatcttgcatctctccagagcctcagagcctgctttcgtctcctgtcccaacagcaaacgcaacaccaaccgcccatcatgaaccctgaatacgactacctcttcaagctcctcctcatcggtgactccggtgttggaaagtcttgtctgctgctgcgattcgccgatgacacctacaccgagtcctacatctccaccatcggtgttgactttaaaattcgaacgatagagctcgacggcaagactgtgaagctgcagatttgggacaccgccggccaggagcgtttccgaaccatcacctcttnctactaccgcgggcgcacggnatctgcgtcgtctacgacgtcactgatatggactccttcaacaacgtcaaagcaagtggctttaggagatcgaccggtatgccaccgagggcgtcaacaaagttgctcgtaggcacaagagcgatatgtncgacaaagaaggnggttgagtacaccggtggcaaagaattcgctgacaggcctgggcattcccttcttgagaccttcggcaagaacgcagcaacgtcgaagcagggtttnttgaccatggntcgncagataaggagcgcattgggcaccacgacggcaacaacacgaaacccagcgtggacgtcggncaagggccagggcgttggnaactttttcaaga

SEQ ID NO: 7440 - DNA, 754 bp, Tricoderma reesei
  misc_feature (1)...(754): n = A,T,C or G
ggcctcggcggtcagcaagatgacgggcatcaccttcaagacggcgcccaacaagttcgaggcgctggccgcccacgacgccatcgtccaggcccacggcagcctcaacaccctggccggctccctcaccaagattgcgcaggacatccgatacctgggcagcggtccccggtgcggcctcggcgagctgattctgcccgagaacgagcccggcagcagcatcatgcccggcaaggtcaaccccacgcagtgcgaggccctgaccatggtctgcgcccaggtcatgggcaacaacgtcgccacgaccattggcggcatgaacggccagtttgagctcaacgtgtacaagcctctgatgattcgcaacctgctgcacagctcgcgcattctggccgacggcatgcgctcgtttgaggagcacctggtcaagggcctgcaggccaacgaggagaagattgccagcatcatgaaggagtcgctcatgctggtgacgtgcctcaaccccaagattggctacgacatggccagcaaggttgccaagaacgcgcacaagaagggcctgacgctcaacagagtgccatggagcttcaagcgcttacggagcangagtttgatgaactcgttaagcccgactcatggtcaagcccaagancgtgtnaanggaagcaaaaaaaaaggggcgtgtgtacaagtacaacaacctaaataataccatgggacggggttnttgaggaagcttctttganaaaaaaaa

SEQ ID NO: 7441 - DNA, 874 bp, Tricoderma reesei
  misc_feature (1)...(874): n = A,T,C or G
ccctctctgtccatcaaccgtgacacccctgcctggaacaccgagctgttcgaccgctacaaggccgtcgtcgacgagatgtcccagtaccccaacgtcatcggctacttcgccggtaacgaggtgagcaacgccaagaacaacactggcgcctccgcctacgtcaaggccgctgtccgcgacaccaaggcctacatcaagtccaagaagtaccgctggcagggtgtcggctacgccgccaacgacgatgtcgacattcgtgccgagattgccgactacttcaactgcggtgaccaggatgaggctatcgacttctggggctacaacatctactcgtggtgtggcagagctccatgcaaaagtccggctacgacgagcagaccaccttcttctccaactactctgtccccgtcttcttcgccgagtacggctgcaacctgcccagcggcgccgctgcccgtatcttccaggagactgctgctctgtactctgacgagatgaccaaggtctttagcggtggtattgtctacatgtactttgaggaggacaacgactatggtctcgtcaaggtcaacaacggcgccgtctccaagctcaaggacttcagcgctctccagaaccaggttaccaaggccgaccccaagggtgttgacgccgatgactacaagcccaccaacaagcccgccagctggcctggccttgaccgacnactgggaaggccatcaacaagccttcccccacccctgatgccagcctttgcacttgcattgcagagctctctgtgctgcgtttacgcccgacgaccttgacaccaaggactttggcgacatcttcggctttatctgcggcaagtccccgaggtctgcgctggcat

SEQ ID NO: 7442 - DNA, 718 bp, Tricoderma reesei
  misc_feature (1)...(718): n = A,T,C or G
ctctggtgacaaggtcctggtcgccgcctactcccacgagctgagggcctacggcatcaaccacggcctgaccaactggtccgccgcctacgccaccggtctcctgatcgcccgccgtgtcctcagcaagctcggcctcgacaaggactttgtcggtgtcgaggaggccgacggtgagttcaccctcaccgaggccgccgagaccgagaacggcgagcgccgccccttcaaggccttccttgacgtcggtcttgcccgcacctccaccggtgcccgtgtctttggtgccctcaagggcgcctccgacggcggcatcctcgtcccccactccgagaagcgattccccggctacgacattgagagcaaggagctggacgccgagaccctccgcaagtacatctacggcggcacgtcgccgagtacatggagactctggccgacgacgatgaggagcgctacaccagccagttcgccaagtacatcgaggacgatgttgaggccgacggcctcgaggacctctacaccgaggcccacaaggccatccgcgaggaccccttcaagaaggttgagggtgaagggcgaaaaaaaaaacaaggaggaattggaanggcatctncaagaagtacaaganttgcagactttncaaggccgagaaagnttgccaacgtncaggccaaagatccanaagatcctggttgatgaataaaaaaaaaaaatt

SEQ ID NO: 7443 - DNA, 517 bp, Tricoderma reesei
  misc_feature (1)...(517): n = A,T,C or G
acacngtntgcaaggttgacccccatgaacantctggagcaccnagtctacatcnagaangatggcgtgcccatatcccccttccacgacatcccgctctttgccaaccaggagcagaccatcctgaacatggtcgtcgagatccctcgctggaccaatgctaagcttgagatctccaaggaggagcttctcaaccccatcaagcaggacgtcaagaanggcaagcttcgctatgtccgcaactgcttcccccacaagggctacctctggaactacggtgccttccctcagacctgggaagaccccaacactgtccaccccgagaccaangccaagggtgacaacgaccctntcgacgtctgcgagatccggcgagctngttggctacccccggcaggtcaagcacgtcaaggtnctcggtgtcatggncttctngaccangaggagactgactggaacgtnattgtattgacgtcaacgaccccctggcccccaagctgaacgatgttgacgacgt

SEQ ID NO: 7444 - DNA, 821 bp, Tricoderma reesei
  misc_feature (1)...(821): n = A,T,C or G
nagaagaagaccgtggaccctttcacccgaaaggactggtactntatcaaggctcctaaccccttcaacatccgagatgttggcaagaccctggtgaaccggacgaccggtctcaagaacgccaacgatgctctcaagggccgcatcgtcgaggtctctctcgccgacctccagaaggacgaggaccactcattccgcaaggtccgcctccgcatcgacgaggtccagggcaagaactgcctggaccaanttccacggacttgacttcacatccgacaagctccgatccntcgtccgcaagtggcagacgctcattgaggccaacatcaccggtcaagaccaccgatgactaccttnatccgcttttcgccattgccttaccaagcgacgccccaaccagatcaagaagaccacctacgctggttttttcccagatccgcgccatccgacgcaagatgaccgactttattcaagcgcgaggcttcaagntgnacccttacccaagtnggtttccaagtggattcccgaagttttccggccgcgaaatcgaaaagtccacccagggnatttacccccttcanaacgttcacatccgcaaggttaactgnttgaaggntccaagttcgactgggcgccctganggttttcacngggagtttgggaccgacnaccagggncaaaaggttganccggaattnaangacctgttttggataagnntgaaaaannggttatgtgtaaaaaaataaaaggcccggggaacccttgcaagtcattcggcctanncttttccagtanttttaatggggtaacacccatag

SEQ ID NO: 7445 - DNA, 663 bp, Tricoderma reesei
  misc_feature (1)...(663): n = A,T,C or G
gattgcttaggacggcaatagtttttattgtcgaggcaagatgcagattttcgtcaagaccctcacggggaagacgatcacccttgaggtggagtcttccgacaccatcgacaacgtcaagtccaagatccaggacaaggagggcatccccccggaccagcagcgcctgatctttgccggcaagcagctcgaggatggccgcaccctgagcgactacaacatccagaaggagagcaccctccacctggtcctgcgcctgcgtggtggtgccaagaagaggaagaagaaggtctacaccacccccaagaagatcaagcacaagcgcaagaagaccaagttggctgtcctcaagtactacaaggtcagcaacgatggtaacatcgagcgccttcgccgcgagtgcccctccgacacctgcggtgccggtgtcttcatggctgccatgcctgaccgtcagtactgtggtcgctgccacctgacctacgtcttcgacaaagcagtagacgacaaccaaactcaaaaaaacctnttacaaaaaatggaaaaatgaattttgtggattggacagctggagccatgggactgccataacatacaaagggcgttgatgtagcatanagagcacattcngcggcttntggtaatgaatgcttgatttgagac

SEQ ID NO: 7446 - DNA, 640 bp, Tricoderma reesei
  misc_feature (1)...(640): n = A,T,C or G
cagccctggttttgttggtctggccatgtcgtatgctcttcagattacgacttcccttaactggatcgtccgtcaaacggtcgaggtcgagaccaacattgtctctgtcgagcgagtgcttgaatacgcgcgactgcccagcgaggcacctgatatcattcccagcaagcggcctcctgtcaactggcctagcaagggcgaggtggactttaagaattacagcacgcgttatcgtgagggcttggatttggtgttgaagaatatcaacctcgatattaagtcacacgagaagattggcgtcgtcggccgaactggtgctggcaagtcatcgctgacactggctcttttccgactgattgagcccgtgaccggccatatcgacattgatggcctcaacaccttcactattggcttgcttgatctccggcgacngcttgccattattccgcaagacgcagctcttttcgagggtctggtcgagacaatctcgacccnggccatgtacacgacgatagcgaactctggagcgtactagacatgctcgttgaaggattacgtattcagcttagaaggaggcctcgagccaagatccacgaaggaggctccaccttttacaagggcaacgccagctngttttttt

SEQ ID NO: 7447 - DNA, 874 bp, Tricoderma reesei
  misc_feature (1)...(874): n = A,T,C or G
caaccaccaaacactctcccaaacaatctccttcacacaaacacataacaaaataataccccgtgatcgagaaatcaacacccctcttttccctttcctagcaaaagtcacagatttccgttgatacccgcaaccatggccgaaactttcgagttccaggctgagatctctcagcttctctccctcatcatcaacaccgtctactccaacaaggaaatcttcctgcgagaacttgtctccaacgcctccgatgccttggacaagatccgctacaaggcgctgtccgaccccagccagctcgacactggcaaggacctgcgcatcgacatcatccccaacaaggaggccaagaccctgaccatccgggataccggtattggtatgaccaaggctgaccttgtcaacaacctgggtaccattgcccgctccggaaccaagcagttcatggaggccctgactgccggtgccgacgtgtccatgattggtcagtttggtgttggtttctacttctgcctacctggtcgccgacccgcgtcaagcgtcatcttcaagcacaacgatgacgaagcagtacatctgggaatccagcgccggtggcaccttcaacatcaccctcgacaccgagggcgaaccgtcttcggtcgtggtacccgccatcgtccttccacctcaaagggacgaagcaggcccgactacctgaacganaagcccgcatcaagggaggtnaatcnaagaaagcacttcngagtttattnagcntaccccaatcttaccttccacggttnaaagaaanggaaggtcngaagaaaaggaagggtttncccgaatggaaggaaaggcttggtttgaagggaagggaaaaaagcccccgccc

SEQ ID NO: 7448 - DNA, 799 bp, Tricoderma reesei
  misc_feature (1)...(799): n = A,T,C or G
ngtccatcggcacgaggcgcgacaacatccaccatgctgacctttaggcggctcttcaccaccgccatcgacctggtggtgggcctgctcttcttcgtcaagacggccgaggccgccaagggccccaagatcacccacaaggtcttcttcgacattgagcacggcgacgagaagctgggccgcatcgtcctgggcctgtacggcaagacggtccccgagacggccgagaacttccgggccctggccaaccggcgagaagggcttcggcttacgaagggcttcgaccttccaccgcgtcatcaagcagttaatgattcagggcggcgactttaccaagggcgatggcaccggtggcaagtcgatctacggcaacaagttcaaggacgagaacttcaagctgaagcacaccaagaagggcctgctgtccatggccaacgcgggacccgacaccaacggctcccagttcttcatcaccactgttgttacctcatggctcgacggccgacacgtcgtcttcggcgaggttctcgagggctacgacattgttgagaagattgaaaacgtccagaccggccccnggcgatcgnccagtgaagcccggtcaagattgccaagagcggcgagctggagggtccccccgaaaggtattcacgtcgagctctaaactgtctnactggctgcacacacgcactttgtacaacgcacacgcacacgcacacacaaaacacggggttttcaactntttccgtccctgncacttggtatgctgatgaatttgggtttgaaattcagagcttct

SEQ ID NO: 7449 - DNA, 340 bp, Tricoderma reesei
  misc_feature (1)...(340): n = A,T,C or G
accaatggcgtcatcccgactcgatntanaagagtccaatgccccaaagttgggaacgcctacatttggcttcgaaatggcggagggccttactattttgctctcacggcagtcaacaccaacggaccgggctcagtcaccaaaatcgagatcaagggcgcagacaccgacaactgggttgccttggtccatgacccaaactatacgagtagccgcccacaagaacgctatggcagttgggtaatcccacagggatcagggcccttaacttgcctgtnggaattcgtctgactagcccaacggggaacagattgngaatgaacannccttcaagaacttt

SEQ ID NO: 7450 - DNA, 697 bp, Tricoderma reesei
  misc_feature (1)...(697): n = A,T,C or G
cgccttttccttctccggcactgagttggtcggcctcgccgctgccgagtcagccaaccctacccgcaacatgcccggcggccatcaagcaggtcttctggcgtatcaccgtcttctacatcctcggcctcttcttcgtcggactgttggttgacagcaacgacccttcgctgctctcttcttctgcctactcggactccaaggcctccccctttgtgcttgtcggcaagtacgctggtctcaagggcttcgaatcacttaatgnaacctcggcaattctcgtttccgtcctggtccaatggcgtctctggtgtgtatggggggatctcgaaccctgactgccttgctcaacaaggctatgctccaagctcttcaactacattgacaaagtccggccgtcctctgccttcggtcatggcctcatnctgtgcnggttcatcgcgtacgtnacttgagcgccaccggcctggtgctttgactggctgntcgcatntttggcttgccggtctnttnacttggggcttcgtttgcctggccaaaatccgaattccgaatggctggaaggatnacgggcacattttnaagaaanccccnttaagggcggcgggggngntattggttttatntttggccttttcctttgnggtggtggccttattcgccaagttttancctggcatnaattggtggccccaat

SEQ ID NO: 7451 - DNA, 658 bp, Tricoderma reesei
  misc_feature (1)...(658): n = A,T,C or G
cgctgtcggcgccgcctaccttgccaagcagaaggccattgttcaaaagctcactgccatcgagtcgcttgctggtgtcgatatcctctgctctgacaagaccggtaccctcactgccaacaagctgtccatccgcgaccccttcgtctgcgagggccaggacgtcaactggatgatggctgttgccgctcttgcctcttcccacaacctcaagactctcgaccccatcgacaaggtcaccatcctgaccctcaagcgctaccccaaggctcgtgagatccttcagcagggctgggtcaccgagaagttcactcccttcgaccctgtctccaagcgaattaccgctgagtgccgtctcggcaaggacaagttcatctgcgccaagggtgcccccaaggcatcctcaagctcgcaacccccccgaggagctcgctccgtctaccgcgagaaggatcgtgagtttgcccgccgcggtttcgatctctgggtgtctgctataagaagaacgatgaggagtgggttctgctcggtctctgtccatgtcgaccccctcgtgaggataccgccagaccatctngaggctgccacttngtgtcccgtcaaaagnttacttggtgacgccatcgcatcgcnaggaacgtgcaaatgcttgccttcg

SEQ ID NO: 7452 - DNA, 875 bp, Tricoderma reesei
  misc_feature (1)...(875): n = A,T,C or G
gcnggtnctgggtccggattgttgcatantctnctcttgntctctctctcttntcttctctgcaacgcttataactctttttgcgcggggcatctgggaaaaccgtttcttcacacatctcttcttccacaatggctcgttcacggagctccctggccctcgggctgggcctgctctgctggatcacgctgctcttcgctcctctggcgtttgtcggaaaggccaatgccgcgagcgacgacgcggacaactacggcactgttatcggaattgatctcggaactacctacagctgcgtcggtgtgatgcagaagggcaaggttgagattctcgtcaacgaccagggtaaccgaatcactccctcctacgtggcctttaccgacgaggagcgtctggttggcnattccgccaagaaccaggccgtcgcaaccccaccaacaccgtctacgatgtcaagcgattgattggccgcaaattcgacgagaangagatccaggnccgacatcaagcacttcccctacaangtcattgagaagaacngcaaagcccgtcgttcaagttcaaggtnaacggncanaaaaagcagttacttccgangagatttttgcattgatttttggcangatgaagganggtgccgagttctnccttgggcaaaaaaggtacccacccccgtcggnaccgtccttgctactttaacgncacccagggaaggncacaaaggacgccggtccattggccngnttgaacgttttccgaatcgtnaccaaccacccgttggccgttttcnctttggttnggacaagaccaacgggaaccgccaaaaattggtttcaattcggggggggnccttgangtttttttctggcattgaa

SEQ ID NO: 7453 - DNA, 920 bp, Tricoderma reesei
  misc_feature (1)...(920): n = A,T,C or G
catcgcgagatacccgccccaagcagacacaatgaccaagccagagggactccccgagatgacgtaccggaacctgggacgctcaggtctccaggtctcgtccatctctctgggcggatggctcacgtacggtggccacgtcgaccgagagggcacatatgcctgcatgaaggccgcctacgactgcggcgtcaacttcttcgactgcgccgaggcctatgccgcgggcgaaagcgaaatcgtcatgggcgaggccatcaagaagtttggctggaagcgcaacgacttggtcatctccaccaagatctactggggccaaaacttcggcaccaaccccgtcaacaacgtcggcctgtctcgaaagcacattgtcgagggcgtcaatgcctcgctgaagcgtctcgatctcgagtacgtcgacctgatctacgcccaccgcccgaccgcaagacccccatggaggagacggtccgcgccttcaatcacatcatcgacacccggcaaggccttttactggggcacgtcagagtggacggccgtcgagatcgccgaggcatggcgcgtggcaaanaaggctgggccttatcggccccctgatggagcaaccccgcgtaccacatgctcaaccggcaaaaggnggagggagaattncaactttttgtaccgcgagcaccggctcgggcttgacaacctttttccccttggttcaaggcattctgtcgggcaagtacaaaaacgggattcccggacaattccgtttgcccggacagaggtcgccttngttgccggttattggaaaacggaccggaaaaggaaggtttgggangggccatttgnaaaggtcaacangntggaacccatttgncnaaaaactnggcgttaacaaancgctttggncctnggttggngcttaaaaacct

SEQ ID NO: 7454 - DNA, 676 bp, Tricoderma reesei
  misc_feature (1)...(676): n = A,T,C or G
ttaccacccaacagaaccagagcctctgaacccagatgccctttgcgcagctagtactcggtagccccggctcgggcaagagtacctactgcgatggcatgcaccagttcatgggcgccattgggcgcgcgtgctccgtcgtgaacctcgatcccgccaacgaccacacaaactacccttgcgctctcgatatccgcgacctggttaagctggaggacgttatgcgcgaagaccgcttggggccaaacggcggtattctatatgctctcgaagagctcgagaacaatttcgaatggctggaggaaggcctgaaagagcttggggaagactacttcctgttcgactgtcccggccaggtcgagctctacacgcatacaactcattacgaaacatcttttacaagctccaaaagactcttaaattcagatttgtctgcgtacatcttacggatagctattgccttacccagccatcctctatgtatccaacgtcctcctctcggttccgagccatgatccagatggacatgccacacgtcaatgtgctcaccaagatcgacaaggnagcatcgacgacgagctgcccttcacttggagtactacaccgacgtcgacgatctncatacctaacgccgtacttggaggccgaattccctgggatgcccaacgagaaattc

SEQ ID NO: 7455 - DNA, 869 bp, Tricoderma reesei
  misc_feature (1)...(869): n = A,T,C or G
cgacctcnagcagttccgcgccaacgagattgaaaagggccgcgtccagcagctgcagaagaagctcgaccagaagcgcgccaccctcgactggggcaccccgctcgagcagctgcccgtcgtcgactgggacgactttgtcgccgactccaagaatggcaaggccctcgtcgccattgccggcgtcatccacgacgtcggcgacttcatccgcgaccaccccggcggcaaggccctcatcaactcggccattggcaaggacgccacggccatcttcaacggcggcgtctacaaccactccaacgccgcccacaacctgctgtccacgatgcgcgtcggcgtcctgcgcggcggctgcgaggtggagatttggaagcgcgcccagttcgagaacaaggacgtcacgtacattaacgactctgccggccagcgcattgtgcgagccggatcccaggtcaccaaggttgcccaacccgttgccagcgccgatgccgcttgaagtggttgtgcatgagtgtgtagagagggaaaagcattgcaaagacgagacatgaagggttggggggtccatatcaatcaagacaaccgttgccttttcgtcttggttttgaatgcggaacaagacaagaaaaatcatgaattgggcgtttttgaggggatcatttttgtttttgttttttcaaaggggccttgttggattggagaggttgggtcaaaaaggggggttttcactttacttttctttctttttcaagccgtatggatgaagaagactagagcatcattccgcactcttttttatatcaatcaaagagagagcaacccactcaatgcatatacaactcatatatatatattaccattcaaac

SEQ ID NO: 7456 - DNA, 564 bp, Tricoderma reesei
  misc_feature (1)...(564): n = A,T,C or G
ccnacatgnccatcatgctgcagtncgccctgtcctccaacgtcttcttgatcagccagatgctctactctcgcttctccgagaacctcctggtccgtcttttcggtgtgtgggaggccaaggacggcacctctcagctccacgcggtctctggtctcgtctactacatgtctcctcccctcaacttcaaggatgctctgctcgaccccatccacaccgccgtctacatcatctacatgctcggtgcctgcgccctcttctccaagacctggattgaggtctctggctccagccctcgcgacgttgccaagcagctcaaggaccagggacttgtcatggccggacaccgcgaccagagcatgtacaaggagctcaagcgcatcatccccactgccgctgcctttggcggtgcctgcattggtgccctgtccgttgcagcgacctgatgggcgctcttggctccggtaccggtacccttctcgctgtcaccatcatctacngctactttgaaattgntggcaaggagggtgaccttnttcggaatgaagggcatgattatgggtt

SEQ ID NO: 7457 - DNA, 648 bp, Tricoderma reesei
  misc_feature (1)...(648): n = A,T,C or G
ccncgggggcaagctcaagatgaccctgggtctccccgtcggtgccgtcatgaactgcgccgacaactcgggtgcccgcaacctgtacatcatctccgtcaagggtatcggtgcccgcctgaaccgcctgcccgccggcggtgtcggcgacatggtcatggccaccgtcaagaagggaaagcctgagctgcgaaagaaggtccaccctgccgtcattgtccgacagtccaagccctggaagcgattcgacggtgttttcctgtacttcgaggacaacgctggtgttatcgtcaaccccaagggtgagatgaagggctctgccatcaccggccccgtcggcaaggaggctgctgagctgtggccccgtattgcagcaactccggtgtcgtcatgtaaagggtgtttttttcaaacgaaaggaggaagggagttttttttttatatcaagaggaagaanaaaagaaacacaatgacccaagttcctcgatgcgaacttatagaanccgtggaaagttctttttcttctcaccttcccaccctccctttttctccccaaaccctggtttttctattctaatttctttggtcgtatggganaaaactggctnttgaggggagaaaaagangagaaaaaaaaaagccgggaaa

SEQ ID NO: 7458 - DNA, 735 bp, Tricoderma reesei
  misc_feature (1)...(735): n = A,T,C or G
cattcccctcggcggcaggctggatcccgtcaacgaggagggaattgagttttacagcaaactgattgacgccctgttgaggcggggtatcacgccttgggtgactttgtaccactgggatctgcctcaggcgcttcacgatcgctatggaggctggctcaacgtggaagaggtccagctggactttgagcggtatgcgaggttgtgctttgaacgttttggggaccgagtccagaactggatcaccatcaacgaaccctggattcaggccatctatggatatgccaccggcagcaacgccccgggcaggagcagcattaacaagcactccaccgagggcaacactgccactgagccgtggctcgctggaaaggcccagatcatgagccatgcccgcgccgtggccgtctacagcagggactttcgcccctcgcaaaagggccagatcggcatctcgctcaacggcgactactatgagccctgggacagcaatgagcctcgggacaaggaggctgctgagcgacggatggaatttcacattggctggtttgccaatcccatcttcttgaagaaggactattcnagaaagcatgaagaagcaacttggggcgagaggctttcaacccttacttcccgcggacttttgccatccttnaatgccggagagaaccgactttctaccgggcatggaaattacctaccccaatccccagnttcgccgccgcccaancttaa

SEQ ID NO: 7459 - DNA, 708 bp, Tricoderma reesei
  misc_feature (1)...(708): n = A,T,C or G
caacctcctgggcaagttcgagcttaccggcattcctcctgccccccgcggtgtcccccagattgaggtttccttcgagttggatgccaacggtatcctcaaggtctccgctcacgacaagggcaccggcaagcaggagtccatcaccatcaccaacgacaagggccgtctcacccaggaggagattgaccgcatggttgccgaggccgagaagttcgcncgaggaggacaaggctacccgtgagcgcatcgaggcccgtaacggtctttgagaactacgccttcagcctgaagaaccaggtcaatgacgaagagggcctcgggcggcaaganttgacgaaggaggacaaggagaactattaagtttgaagccagtcaaggcacttgctattccgagtggctcgaggacaacggcaccgacgtaacactttgaccaaaggactttgaggagcagaaggagaagctgtccaacgtcgctaccccatcaccttcaagatgtaccanggtgctggtggcttcgangacgatggcgactttcacgacgaattgtaaaaaattaaaaaaanggaaattattgatgcatagatacttattagangaccaaagaagttnccaggtggtatcgtccggttatgacccggtgtgntttcagtcnttgtaaagttcgaatgcacttttgatngtataaatcataaatgaatcttgncc

SEQ ID NO: 7460 - DNA, 674 bp, Tricoderma reesei
acggccggcagtggcgtcgttatatacttcaggaaagaaggtcgcgctcttggagaggtgaccaagtacctggtatacaacgctcgcaagcgaggcgaggaccgagcatcagactactttatgcgcaccgagaacattgccggcgtcaaggacatgcgcttccaggctctaatgccagacattctccactggctgggcatcaagaagattgatcggatgctgagcatgagcaacatgaaacacgatgccattgttggccagggaattcccatccatgagagagtggaactcccggaggagctcatccccgccgattcgagagttgagattgacgccaagatcactgctggctacttcacctctggcaaacgattgactgctgaagagttgcagtcggtacagggcaggatgtgggaagatattgaccactaaatcggacttgcccgagcaagaagtcgtcatggggcaagagttggtttctttgcgtcattgtgcggttgttacctagggcctgtgtctcgcttttgtcgggagttcggttgtggaatgtacgcgtagttctttaaaccgagctgaatctgcagcccatgctttcattcagacccgtccagatagactcactagatccttctggtagacactaggtaacaactttgaacaactgccccccggaa

SEQ ID NO: 7461 - DNA, 617 bp, Tricoderma reesei
  misc_feature (1)...(617): n = A,T,C or G
tcgccgttcgccttccactctcactctctgccagcgactatcttgctctgtccaagcatcaactggcatctctaggccaactacaaccgcacaatcagtcaagatgtttatggcaagatctgaatacgaccggggaatcaacaccttctcccccgagggtcgtcttttccaggtggaatactcactcgaggctatcaagctcgggtcgaccgccattggaattgccacatccgagggcgtcatcctcggcgtcgagaagcgcgtcacatcctccctcctcgaaacctctccgtcgaaaagattgtcgaaatcgacccgccacatcggctgcgccatgtccggcttaggccgatgccaggtccatgatcgagcacgcccgtgtcgagtgccagagccacgccttcaactacaacgaagtcctnagcgtcgagagctgactcaggccatctgcgatctggcctgcgcttcggaaagggtgccgacngagaggagaccatcatgagcccggccttttggtgtcgcgctctcatcgncnggttcgacgaaaacnggccttnagttgtttcacgcagagccaacngggaccttntatcgattcgacgccaaggttattggct

SEQ ID NO: 7462 - DNA, 552 bp, Tricoderma reesei
  misc_feature (1)...(552): n = A,T,C or G
aacagccagtcgtcaccatggcccgaggaatcaagaagcaccagaagcgccttagcgccccctcccactggctgttggacaagctgtccggcctctacgcccccaagccttctcccggtcctcacaagctccgcgactgcatgcccctgatcgtcttcatccgaaaccgcctcaagtatgctctcaactaccgcgagaccaaggccatcatgatgcagcgcctggtcaaggtcgacgccaaggtccgcacccgacatcacctaccccgccggcttcatggacgtcatcaccatcgagaagactggcgagaacttccgctcatctacgacaccaagggccgcttcaccgtcaccgnatccaggccgaggaggccgagtacaagctgggcaaaggtcaagcgcgttcaagctcggccgtggtggaatcccattcttggttacgcaccgatgcgagaaccatcccgctccctgaccccctgatcaaggtaacgacaccgttcaagattgaccttgncacccggaangatcacccgacttnattcaagtttcggaa

SEQ ID NO: 7463 - DNA, 1479 bp, Tricoderma reesei
  misc_feature (1)...(1479): n = A,T,C or G
gtcatctatctctgttgtnttggctcttctgggccatagngctgcatggtcatacgccaccaagtctcaatacagggctaacatcaagatcaatgcccgccagacctatcagacgatgattggagggggttgttcgggcgcctttggtattgcttgtcagcaattcgggtcttctggtctgtcgcctgagaaccaacagaaggttacccagattctcttcgatgagaacattggcggcctgtctattgttcggaatgatatcggctcctcgccaggaaccaccattttgccaacctgtcccgcgacgccgcaagacaagttcgactatgtgtgggatggcaagtgacaactgccagtttaacctcaccaaaacagctctcaaatacaatccgaacctttacgtttacgcggatgcctggtccgtcccggctgcatgaagacggtcgggactgagaacctcggagggcaaatctgcggtgtgcgaggaaccgattgcaaacacgactggcgccaagcatatgccgattatctcgtacaatatgtccgcttctataaagaagaangcatcgatatctccttctaggcgcctggaacgagccagacttcaacccctttacctacgagagcatgctttccgacggatatcaagccaaagaactttttgganggtctntatcctacgctcaagaagggtttcccaaaagtagacgtaactgntgcgatgcaactggngcccgccaagagagaaacattntttatgagctccagcaggcngggtggcgaagaagatactttgacattgcgacatggcacaactaccaaagcaacccagagcgcccattcaacgcccggtggaaagccaaacantacagactggagtgggcaaatggcacgggtccatggaacagcacctgggattatagcggccaacttgctgagggcctccaatgggcattatatatgcacaacgcgtttgtcaacagcgacacctcaggctacacgcactggtggtgtgcacagaacaccaacggcgacaacgccctcatccgccttgatcgcgacagctacgaggtgtcggctcgcctttgggcttttgcccaatacttccgctttgcccggcccggatctgtccgcattggtgcaacaagcgacgtcgagaacgtctatgtgaccgcatatgtcaacaagaatggaaccgttgctattcccgtcatcaacgccgtcactttccttacgaccttacaatcgatctggagggtatcaagaagangaagctgagcgaagtacttgacggacaatagccacaacgtcaccttgcaaagtcngtacaaaggtctctggtagcaagtcttgaaggtgactggtgagcccaaaagcgatgaaaacttttttggttggagtaagaactcgtacgggacgatgggaagtgtcgtgaccgtgtatctttttttacataggccgaatcgacgtttgccgtcn

SEQ ID NO: 7464 - DNA, 568 bp, Tricoderma reesei
  misc_feature (1)...(568): n = A,T,C or G
actacnataccccgtcccgaagcctngctccccatctttcctccctccgctcgagacgaaanccagcgcaagagtcgctgcgccttcaacatgggcaacaccaccagcaccgtgctggacaacatcgtccagggctccaactttgacagagaagaggtcgaccggttaagaaaacgatttatgaagctcgacaaggataactctggcacgatcgagcgtgacgaattcctcagccttcctcagatctcctccaacccgttgcacacgcatgattgccattttcgatgangacggcggcggcgacgtcnacttcaagagttcgttttcgggccttgagcgccttcagcaagcaannggcaacaaangagcagaagctgcagttcnccttcaangtgtccgacattgaccgcgaccggttcattnacaacggngagcttttcatcgtccttaagatgatggngggcagcaacctnaaggacaancagctgcaccagaatgtcgncaagaccattatggaggcnggactttgacaaggaccgnaaaaattagctttgnngagttaccaaga

SEQ ID NO: 7465 - DNA, 664 bp, Tricoderma reesei
  misc_feature (1)...(664): n = A,T,C or G
ccaagctctaaaccatggccggaacacaacattgtcgtttttgggggcgatcactgcggcccggaggtggttgtttatgcgttcaatgtttttaagacgatctgatcatcttacccctaacaagttcaatctcaaggaccacctcctcggcgggtgctccatcgacaagaccggctcccccctcacagacgaagctctcgccgccgccaagtccgccgacgccgtccttctcggagccattggcggtccggaatggggcaccggcgccgttcgtccggagcagggtctgctgaagctgcgcaaggagatgggcacctacggtaacctccggccctgcttcttcgcctccgatgccctcgtcgaggcctctcccctcaaggcctccgtcgtccgcggaacagactttatcatcgtccgcgagcttacgggtggcatttactttggcgaagcgcaaggaagatgatggatccggcgaggcgtgggatacggagccgtactcccgcccagagatcgaancgtgttgcgcgattgggtggatacctcgcccgcggtagangagaaacgactggttacctcgctggacaaggcgaatgtgctagcgacanggcaggcttttggcgaaagggtatggatgaaggggttccaagcttgaattnccagatct

SEQ ID NO: 7466 - DNA, 966 bp, Tricoderma reesei
  misc_feature (1)...(966): n = A,T,C or G
cttttgtgatacccccatttctttgcattctctctttttcctctttttagaaacttgaccgcgaaaatcccacaaaaaagatgcagcgcgcattggcttcccgtgcccgcgcctcggccctgtccggcgcttacaagtatcgatctggtggcagcctcggccagcaggttcggttcgctcacaaggagctcaagtttggtgtttgagggccgtgcccgctctgctggccggtgccgataattcacatggcaaggtctgttgctacgactcatggtaccaagtgagacgaaatgacaacatctgagtccagcaatgtcgagctctcccaagattaccacaggacggtgtcacccgtcgccaaggccatctccctcaaggacaaagttcgagaacctgggcgccaagctgatccaggatgtcgcctccaaaaccaacgagactgccggtgacggaaccaccagtgccaccgtcctgggcccgccgccatcttctccgagacccgtcaagaacgttgccgccggcttgcaaccccatggacctgcgccgaggcatccaggctgccgtcgacgccgtcgtcgactaccttgcagaagaacacccgcgacatcaccaccaagcgaaggaggnttgcgcaaggtcgccactatcaagtgccaacggcgaccaccacgtcggcaaagctgattgccaacgccatggagaaggtcggcaaggagggtgtcatcaccgtcaaggagggcaagangctgcaggacgagctcgaggtgacngagggtatgcgattcgacccgcggatacgtcttcccctacttcataccgacgccaagtccgccaaggttgagtttgagaaccccttgatctgctcttcgagaagaagatttcggccgtccaaggacatcattccccgccttngaggcctttaccancttccgccgccccttgtattcatcgccgangacatttgac

SEQ ID NO: 7467 - DNA, 527 bp, Tricoderma reesei
  misc_feature (1)...(527): n = A,T,C or G
caaggtcatcattgagcggtactacccccgcctgaccctcgacttcgagaccaacaagcgcatctgcgatgagattgccatcattgcttccaagcgcctgcgcaacaagattgccggttacaccacccacttgatgaagcgcattcagcgaggacccgtccgtggtatctccttcaagcttcaggaagaggagcgtgagcgcaaggaccagttcgtccccgaggtctccgctctcgacttctccgaggctggccagctggacgtcgacaacgagaccaaggacctgctcaagcacctcggcttngactncatccccaccaacgtcatcccgtctnccangctcaggctccngagcgtgggccagcgacgattcggcgaccggccttcgncgngactaaaaagcttttttacctttttttttgggggatattnggggtntttgggtttggaacatttttgcangntggcgtcttaagaagggnatgagtgcatagatttcgcacaaaaagaaanaacttttttccccc

SEQ ID NO: 7468 - DNA, 760 bp, Tricoderma reesei
  misc_feature (1)...(760): n = A,T,C or G
ggcctctggaaggtcgacaatgccgtgtgcgcggacaccgtgtacaacgccatcaaggccggataccgcctgtttgacggtgcctgtgactatggcaacgaaaaggagtgcggcgagggcgtngcccgcgccatcaaggacggcctcgtgaagcgcgaggacctcttcatcgtgtccaagctgtggcagacgttccacgacgaggacaaggtcgagcccatcacgcgccgncagctggccgactggcagattgactacttcgacctcttctcgtccacttccccgccgcctcgagtacgtcgaccccagcgtgcgctacccgcccggctggttctacgacggcaaaagcgaggtgcgctggaacaagacgacgacgctgcagcagacctggggcgccatggagcgcctcgtcgacaagggcctcgcccgcagcatcggcgttttaaactaccaggcccagtccgtctacgacgccctcatctacgccccgcatcaaacccgccacccttcagatcgagcaccacccgtaccttcagcagcccgacctngttagnctcgccaagaccgagggcatcgttcgtcacccgctactcgtnctttggccccacggcttnatggacttcgacattgnctcgncgaagagcgtngcgcccttatggacagccccgtcatnaaggccttggcgacaagcaccgccgnacgcctggccaggtcctttttggattgggccacccaacgaaggnattcgncgtattcccaa

SEQ ID NO: 7469 - DNA, 837 bp, Tricoderma reesei
  misc_feature (1)...(837): n = A,T,C or G
ngangcgccgattcggcacgaggcgcctcaacctcctttacgactccccgattctattcacagcccgccaaaatgcccaacaccaaggtttacttcgacatcgcctggaagggcccggtcttcaaggacggccgcgccaccaacgagatcaaggagcaaaccggtcgcatcaacttcaacctctttgacgacgttgtccccaagaccgccgagaacttccgcgctctctgcaccggcgagaagggcttcggctacaagggctcttctttccaccgcatcatccccaacttcatgctccagggtggtgacttcacccgcggtaacggcactggcggcaagtccatctacggcgagaagtttgccgatgagaacttccagctgaagcacgaccgccccggtctgcttgtccatggccaacgctggctcccaacaccaaaccggctcccaagttcttcatcaccaccggccgtcaccttcctggttgaaacggccgccacgtcgtctttcggccgaaggttgcccgacaaanggagttccattgggcttgntcgtccaggcccctttcaagggccacccggnccgtggaatgacngcaaggtcaagtacgaaccccgcccaccattgtcgacagcggtgtnctgtaagctttgtgcaagttggcaagaatgcttttgcatgtccgtgtggtggcaaagtttgggtncatgaagccatcgtgggcnggttaaacaaggggctttaacgcttcanaaagactataaaagtacctngncctattctttanccaaacatttacggggctgnaaacatataaaaaaaaacacatntggtggcttc

SEQ ID NO: 7470 - DNA, 670 bp, Tricoderma reesei
  misc_feature (1)...(670): n = A,T,C or G
atcaccaccaccaagaagggttccattacctccgtccaggccgtctacgtccctgctgacgatttgaccgatcctgcccccgccaccaccttcgctcacttggacgccaccactgtcttgtctcgtggtatctccgagctgggtatctaccccgccgtcgaccctcttgactcaacgtcccgtatgcttgacccccgtatcgtcggcaggagcactaccagaccgccacccgcgtccagcagatcctccaggagtacaagggtctgcaaagatatcattgccattctgggtatggacgaactgtccgaaagccgacaaagcttaccgtcgagncgtccccgaaagatccaagcgttttcttcagccaagccctttacccgtcgcccaagtctttacttggtattcgagggcaagcttcgtcgnaccttaaaggacaccattggccttctttaagggcattcttaacggngagggtgacagcctgcccgangctgcttntacatgggtggcgactggctttcggcaaggccaagggtgagaaaaatnttggcggagttggaaaaaaactaaaaaaggcccaactagcttcntccaanaactgggagtagtccggcctgtgtatagactatatagnagttaaaacagctntctgattgnaaganttggtttc

SEQ ID NO: 7471 - DNA, 771 bp, Tricoderma reesei
  misc_feature (1)...(771): n = A,T,C or G
tggccgggtattccggtatctcgtatgctgcgcaagccccgagtccggctacgtatagcagcgacggtaactttcgactcaccggtcacatccatgattacccgctggcaaatgggagctcgccctcatggggagtctcgctggcctcgccttcgaaccagttccagcttcagctctcgcagcccatcttcaagcaaagcgatttgcgatatcctgtgcttgagcctctgctgcctcacctgggaaacatcctccccgtgtctttggcgtgcgatctgattgacctgtacttctcctcgtcttcatcagcacagatgcacccaatgtccccatacgttctgggcttcgtcttccggaagcgctccttcttgcaccccacgaacccacgaaggtgccagcccgcgctgcttgcgagcatgctgtgggtggcggcacagactagcgaagcgtccttcttgacgagcctgccgtcggcgaggaacaaggtctgcagaagctgctcgagctgaccgttgggcttcttcagccctgatccacaccggcaccaacaggccgtttccaagactagccccgtcgtcggtgctgttgcctgggagttcttggggtgggcatgccgggctcgctgaacatggattnctggcccggcgaaacggggctttttggggcatagggagccttgacgaacgtcatcacctatgtgcacttcgcacggtcgtttcgggcaangagtacaagggcgccagcctggcggnggngggggggcggnattgg

SEQ ID NO: 7472 - DNA, 829 bp, Tricoderma reesei
  misc_feature (1)...(829): n = A,T,C or G
acgacccttgcccgctgcgttcctggtgaagggctgcaggattagagtcccctcgaaacagcaaacatgggtatttctcgcgactcccgccacaagcgctcggctaccggtgctaagagggccacctaccgcaagaagagggcgttcgagaagggtcgccagccctccaacacccgtatcggtaccaagagaatccacctggtccgcacccgtggtggtaaccgcaagttccgtgccctccgtctcgagtccggtaacttctcctggggttccgagggtatttcccgcaagacccgtgtcatcgttgtcgcctaccacccctccaacaacgagctggtccgtaccaacaccctgaccaagtcggccgtcgtcaaaattgatgctgctcctttccgtcaatgggtaccgaggcccactacggccagcccattcggccgcagacgccagcagaagaccgagaccactgaggagaagaagaacaacagcgttgtgaaaaagcaagcttgagcgcttcgcccgagagcggcaanggtcgagtccgccatcgagagacagttcgagggccggtcgtctctaccccgtcatttgcttccccgcctggccagancggtcgtgtttgaccggtacatccttggagggtggangacttgctttntaccanaaggctntcaggaagtaaaaaaaggaaatcgtgttgtnaaaaggnggtattggagtttcagcaatttttccaaaaacatttattgatctntggggcactaccggtgcattgngtgtagagctnttaactttcaancaattggaatganccttcgttntgttttggccg

SEQ ID NO: 7473 - DNA, 542 bp, Tricoderma reesei
  misc_feature (1)...(542): n = A,T,C or G
gcccgacgaccacggncccagtcntcctttcacaatggcttngcgacctaccgtctccatcatcggcaaagatggtgctccctctggagctacccacaccattcccgccgtcttcgccagccctatccgaccggatatcgtgaagcaggttcacactggcatggccaagaacaagcgccagccttatgccgtcagcgagaaggctggtcaccagacctntgctgagacttggggaactggacgtgctgttgccgtatcccccgtgtctctggtccggtacccaccgtgctggtcaggccgactttggtaacatgtgccgatccggncgcatgttccccctaccaagatctggcgcaagtggcacgtcaaggtcaaccagngccagaagcgatatgctacctgctctgcctggctgcttccgctccgccctatntgtccccgtggncaccaggtcatgaccatncccgangttcccctggttgngactctgntctcgntgagggcagctccgtcgcccgacctctgcnncctcgccttcttaa

SEQ ID NO: 7474 - DNA, 702 bp, Tricoderma reesei
  misc_feature (1)...(702): n = A,T,C or G
taccaatgccttactngtgnatgcnacctaacnntgactatntacccctacnaggncaccngtcgngcttcggntccggtctgcacggnttgggccttcaccgtccgccagttcgccgtccgctacgccaagaagtttggtgttgacaagaacaagatgatggagcgtctctggggcgacaactacttcaacccccacaccaagaagtggaccaagaacggcacctacgagggcaaagcagctcgagcgtgccttcaaccagttcatcctcgaccccatcttcaagatcttctccgccgtcatgaacttcaagaaggacgagatcaccaccctgctcgagaagctcaacctnccctacccccgatgaccgttccaaggagggcaagcaagctgctcaaggccgtcatgcgcactttctgccgctgccgactccctgctggagatgatgatcctncacctgcctctccgtcaccgccagaagtaccgtgtcgagaccctgtacganggtcccatggacgacgaggccgccattggtatccgtgactgcgaccctaagggacctnttcatgctctacgtctccaagatggtgcccaccttccgacaagggccggtttttacgcctttngncggtgtnttntccggtatnggtccgctccggncttaanggtccggattccangggcccaacttacaccccccgg

SEQ ID NO: 7475 - DNA, 861 bp, Tricoderma reesei
  misc_feature (1)...(861): n = A,T,C or G
cgctcgctcgctcgtcgctcatcgactcgcctctccgaccttcaaacctccaaccagccagctccagctctttcctgcgaggcacctcatttcccgggcgtggtgcggcttccttacttctatccgactacccattctctgctcctctcatttcacgccttttgctcgccacaatccgtcagccctcgacgaccgcttctataaccccctccccttcaaccttgacttcgtggctactagactgctgcgccgcgaccgaataacaaccaggccgaacctcgattcaggcagatacagcttcacaggagaagctttcagctactacgcagacgacgactcgcagaagacgcatcatagacattcgcagcaatggcggacccacgcaattcgtcatcctactcggttgtgccgcaactgcagtataacaccgtgagcggtgtcaatggtccgctggtcattgtcgagaacgtcaaattcccgcgatacaatgagatcgtcacgcttacgctgccgacggtacngagagaaatggacaggttctggaagctcgaggtgaccgagctgtcgtncangtctttgagggtacttccggnatcgatgtgaagaanacccgggtcaagttcaccggncagaacttnaacttggngtntcggaggacatgctngggccggatntttgatggatctggacgcgccatcgacaagggncccaagggctgccggaagagtacctngacattaacgggaggnccattaaccctttttccgagaataccccgaggaaatgatgggaacggattttgggcattgacccatgaacttgatcgttcgnggaaaaanattccattttttcggcttcggg

SEQ ID NO: 7476 - DNA, 742 bp, Tricoderma reesei
  misc_feature (1)...(742): n = A,T,C or G
tgccccccaagaaggtcgccgctcccaaggagaacatctccctgggcccctctgcccgcgatggcgagctcgtctttggcgttgcccgtatcttcgcctccttcaacgacaccttcgtccacgtcaccgatctgtccggccgtgaaaccatcacccgtgtcaccggtggaatgaaggtcaaggccgaccgtgacgagtcctccccctacgctgccatgttggctgctcaaggacgtcgccgcccgctgcaaggagcttgggcatcaaacgctctgcacatcaaagaatccgcgccacccggtgggtnaacnggtacccaagacccccggtcccggtgcccagtctgctctccgcgccctggcccgtgccggcatgaagatcggccgcattgaggacgttactcctaccccctccgactctactcgcagaaagggtggtcgcgtggtcgtcgtctgtaaatatcgtatttttatttctacaaaacaaacgaaatggaataccngatttacaagtgtctggcaacactttggactggattcaangcacgagtttcgctatctggttctttcatgcggcgctganaaaaaacgangagaacggccttgaagcctggtctccaactctattatgctttgcgctgggttgntcattctcctnatactangangaagatgtgacttaatgtcaatgcagtacacagttacgaattcnccgaagaangntatgaaangtcgtttcctgc

SEQ ID NO: 7477 - DNA, 860 bp, Tricoderma reesei
  misc_feature (1)...(860): n = A,T,C or G
cgaggccgttctcgcaggcaaaccaccggaaaatcttcaccctctcgctcaatcacaagcacacaatcagacacaatgtcgggagtcaagagcgctctgccgacccacctctcgcccaacgctgaggacaatggcttcgagcagcgtcaccatggcaagactcgcagccacatggccttcgagaacacctcgaccaacgtcgctgccgctcagatgcgaaatgccctgaccaacctcgccgagaccgtcaaggaccccaaggagaagaagctgttcgagacggaaatggacaacttctttgccctcttccgacgatacctcaacgacaaggccaagggaaatgcggtcgactgggatcgcattgcccctcccgccagggccaggtcgtcgactacgangatctcgccaacagcgaagtctgtccagttcctgaacaagctcgccgtcctcaagctcaacggtggtctgggtaccttcatgggctgcgtcggaccaagttccgtcatcgaggtccgtgacggnattgtcctttctcgacctgtccgtccgcagatcgagtaccttaaccgcaccctacggcgtcaacgtgccctttattcttgattgaacttcgttcaacacaacgatgacaccgccgncatnattaaaaaagtccgangggcacaacgggggacattcttnactttcaaccagtcaaganacccccgaatntacaagactngnttgttggcccgtccccaattctacaattgcccattaacgaaggggnacccccccggancggggacgttttnantttttttnanttcgggttcttaacaaattgtngaggggngatttaaaacnttttctgtccacgt

SEQ ID NO: 7478 - DNA, 691 bp, Tricoderma reesei
  misc_feature (1)...(691): n = A,T,C or G
caacgtcaagattactgatttcggtttctgtgccaagttgacggaggccaagtccaagagagcgaccatggtcggaacgccctactggatggcgccggaagttgtcaagcagaaagaatacggccccaaggtcgatatctggtctctgggcatcatggcgattgagatgattgagtctgagccgccatacctcaacgaggagccattgaaggccctgtacctcatcgccaccaacggaacaccccgcctcaagaagcccgagaagctcagcaaggagctcaaagccttcctctccgtctgcctgtgcgtcgacgtcaagagtcgagcgtctgcggacgagcttttggctcatgacttcctccagcacggcaagcggccttgcaagcctggcagagctcttggctttcaagcgcaatgcgaaataaacggagcagtgctgaattcgcgagtatgagtgagaaaaagagaagaagagtcttgtcaattcttctgatgtttgatggcctccgcgtccccttgctgtgccattactggacgagcagtggctggccatgtgaaagccttgagaatcattcttcttttctnggngcattggcggtntttcttcttctttttttctattngggtgactttgcntctacacacttnttggtctacncatgcctgcaagttgngcggnccccattttttt

SEQ ID NO: 7479 - DNA, 1489 bp, Tricoderma reesei
  misc_feature (1)...(1489): n = A,T,C or G
atcaacgacccgacactgatccgcggcgtgggtaccaagtttggccagggcgagggcgagccgcaaggcatgctgtttctgccgccgggcaagaagacgtcgggcgagagcgtccacattgaccaggtcctgagtcccgaggaaatccgcatcaagcggccgttcaagacgcagctggcgcttcagcagctcacagggcgcgacgacattgacgaggagggcccgcttcaccaacaagtccatcaacggcccggcaccgggataccaagggaccaagttcaagctcgcgccccataccgaccagaccaaggtgtacgaagnccgtctttgcgcgcctgaggaacggcggctgtgtcggcatttttcccgaaggcggcagccacgatcgctccagctgctccccttgaaaggccggcgtggccatcatggcgctgggagcgctggccgangcgcccgactgcggtctnaagattgtgcccgtgggcatgaactactttncaccgcacaagttccggtcccgcgcccgtcatcgagttttggcgcgcccgttttgagatcccgcgccacctggtggancatgtaccgcaacaaccaagccgccgagaaggccattcggccaggtccttcgacaccgtctacaaagccctcagcttccgtcaccggtttaagctccggactacgacacccttgatgatgatccaagcggcgncggcggctctacaaccccacggccaagaaacttgccgctggccgggtggtggtggagctgaaccgccgcctggccctgggctacgagcgctacaagaacgacgagaggataaccagcctgtccaagagtgtcaaggagtacaactcgcagctgcgctatctcaacctnagggaccaccaggtgcagtacgccaccatgtccatctggaaggtcattgngctcttcatctaccgctccatcaagctgctgatcctcttcctntgcacgggtcccgggctccttctgttctcgcccgtcttcgtggccacgaaaatcattaagcaggcaaaaggccaaaggcggcgctggcgaaccttcgactgtcaaagatcccggngggccgccgaatgtcattgggcccacgtnggnaagaatttnttggttcggccttgcnggactgggccgcccnaacgcttgtacccacttttttaacttcgaatcaattcggtccntggttgggaaggggccattngggtanccgaacccggttttttttnggggggcnttacntttggncccgggaaatngggnattgnccccccttggaatccctngggggggtancttttttggcggaaaaattgggggttgggccntgggnattgggtcaattattccaanttggngggggctttcnggtttcngcnaagggtcgggattggacatttttnaagtccnttggggccgntngggggttttgctnggttccggcctccantttaaatttccaactaaacaggg

SEQ ID NO: 7480 - DNA, 530 bp, Tricoderma reesei
  misc_feature (1)...(530): n = A,T,C or G
gcgatacctggacacctacctgcacgtgtacaagggctactacttcaccggtgatggtgccgctcgtgaccacgagggattctactggatccgcggccgtgtcgacgacgtcgtnaacgtcagcggtcaccgtctgtcaacggccgagattgaggctgctctgatcgagcaccactcagtcgccgaggctgncgtcgtttggtgtctcggacgagctgaccggtcaggccgtcaacgccttcgttgccctcaaggatggcaacgacgccaacgatgcgctgccaaggagctcgtctgcangttcgaaagancatcggtccttttgccgcgcccaaggcttgtctttattcattgggcgaatcttncnccaagacgccgaaagtgggaaagaattattgccncccgcaattttnganaaaaaggtgcttggcttggccaaaggaaggantcanacctggggcgaatggttntttcnccgcttggccgggaatcccttttggntgggggggaacaaanaaacaattnggccc

SEQ ID NO: 7481 - DNA, 900 bp, Tricoderma reesei
  misc_feature (1)...(900): n = A,T,C or G
ncggnacgaggccntgntctctgcaacaccacgctctcttctctcacgatacagagaaggcaaataaaaacacaacctttattctacacctgtctctcaattagtcaatattctctcctcgcacattcacaatgagctcctctcttgaccagctcaaggccactggcaccgttgtcgtctctgacactggtgactttgctgccatcgccaagtacaagccccaggatgccaccaccaacccctccctcatcctggccgcctccaagaagcccgagtacgccaagctgatagacgtcgccatcgactacgccaagcagaagggcggcgacattgagcagcaggtcgacgatgccctcgaccgcntgctggtcgagttcggcaaggagattctcaagattgttcccggcaaggtctccaccgangtcgacgcccggttctcctttgacaccaaggcctctgtcgacaaggccctccacattatcgagctctacaaggagctcgggcatccccaaggagccgcgtcctcatcaagatcgcctccacctgggangggcatcaaggctcgccgagatcctgcagcgcgaccacggnatcaactgcaacctgacgctcatgttctcctgcccaagccatcggcgcccgccgaggccggcgccttcctatttccccttcgtggccgatctcactggttaaggcagcaccaagaaggactattcaaggaggaagaccccggtgtcgcttccgcaagaacattttaactctacaanaaagttgntacaaaacattgtatgggtgcttcgttccgcacacgggcgaaaataccaactcgttgggtggagatacctggacatttttccaactggttgaggagttcttaattcaccgagcccgtcccaaaat

SEQ ID NO: 7482 - DNA, 781 bp, Tricoderma reesei
  misc_feature (1)...(781): n = A,T,C or G
cggggaaagcggctcagtacgtcgcccagatggcctctgcgctgcagtaccttcaccggaagcacgtcatccaccgcgacatcaagcccgagaacatcctggtgggcatccacggggaaatcaaaatctccgactttggctggagcgtgcacgcccccaacagcaggcgcaagacgctgtgcggtaccctcgattacctgcccccggagatgatcaagcccggctcttcggacaactactacaacgaaaaggtcgacctgtggagcttgggagtgttgacatacgagttccttgtcggcgaggctccctttgaagatacgcctgtcatgacgcagcggagaattgcccgtgcggacatgcaaattcccaagtttgtcagccccgaggctgctgatctcatctcaagactcttggtccttgaccccgagaatcgaattcctcttgacgaggtccagcgccatccttggattatcaagcactgcgtcaaaggggagcgagctaccaaccgcgagaagcactcctaatctgcgacttgacacatactctcgatctgttttacgtctccgattgctgagtttggaaatcttgtgagagagttgaacggtctctggagttgggtttgtgagattgatatgggataatacgangagtcgacggagtttcctatccgttatctttttacttctttctgggtctttacagggcgggaaacacaagcgagtcagtcgaattagtcttttcgtttnggggnatcttttaattacattgcaagttacattcc

SEQ ID NO: 7483 - DNA, 885 bp, Tricoderma reesei
  misc_feature (1)...(885): n = A,T,C or G
ntttntcaccaaagggttaagagagggactgtcaaaacggctgaagatacacctggtctttaagtcttgggaatttttttttttttttctttttcaactcacttgaacctcccaacttacacagcagccaattacagaagacgcccagccatgcatcagcaaaccctcctcgccaccctcgcggcgagtctcgctgctcttccttttgctcaggcgggcttctattcgaagagctctcccgtgctgcaagtagacgccaagtcgtacgaccgcctcatcacaaagtcgaatcatacctctattgtcgaattctacgccccctggtgcggccactgccaaaacctcaagcccgcctacgaaaaggccgcccgcaccctcgacggcctggccaaggtcgccgccgtcgactgcgacgacgacgccaacaaggccctntgcggttcctcggcgtcaagggcttccccaccctnaaagatcgtccgccccggcaagaagcccggccgcccgtcgtcgangactaccanggcagcgcaccgcgggcgccattgccgacgccgtcgtcgccaagatcaacaaccacgtcgtcaaagctgacggacaaggacattgatgcctttntggaaaaaggacggngacaagccnaangccatnttgttcacggnaaagggaactacnagtgcccttntgaggaccttgntattgatttttncgacgcccgngaccattggncaaggtncgnaaaaaggaaaaggttgccgtncaaanggttccggattnttttggttccttcntttnggcctaatccccggaggggggaanggaacccgttgttttacagcggggancttaanaagaaagganatnggtcgagtttcttaancangg

SEQ ID NO: 7484 - DNA, 873 bp, Tricoderma reesei
  misc_feature (1)...(873): n = A,T,C or G
ctcctcagccaaactcttggaacaacgaggtacgtatggcctttggtcaccgctgacggcgataccgacatggcaggatgacgccttttattgtggccggggacagcaatcgtcgacgccggcccggatgatgagcgaacaatgtcgatgggatcagaacgcgccgtgatgctgctgcatcgcgctgctgctgttccctgcgagcacacgtccttcttcgatggccggcgtttggcgatacgctgcttttcctctttccccttcggcaatgagcgggctgaaccctcgtcgacggatcgctgagggcactctccatgctcatgggccactccgagtctaacgtcgcttgtgtggcagatacctcatttccaaacccgacttgagaatctcctctcgacaccaaataccgccaaaatggtccgcacttccgttctccacgacgccctcaactccatcaacaatgccgagaaggccggcaagcgtcaggtcctgatccgacctagctccaaggtcattgtcaagttcctgcaggtcatgcagcgccacggctacattggcgagttcgaggaggtcgacgaccaccgntctggcaagattgtcgtccancttaacggccgtctnaacaagactggtgtcatcttcccccgctacaacgtccgcctggccgatcttcnanaagtgggtcgtnagctgctgctgcccgcaagtncggctatgtcatnctnaccacctntgntggtatnatggaccacgaggaggcccgacnaaagcacgttgccggcaagaacattggcttttttttattanaacaaacaaaaaccaaaatttgggngnagagaggaatcnttaacaaaaaagacgggttnggcaaaa

SEQ ID NO: 7485 - DNA, 852 bp, Tricoderma reesei
  misc_feature (1)...(852): n = A,T,C or G
tcagatcaatcatggctgccgaaagcgaaaagcaaacatttttcgagcccattggcgcaaaggcgcagggcctctcagctgccacaaatggcaccgttgacgaggacgacgtcaagcccgtggacgagatcgaatccctctgcatgaactgccacaagaatggcatcacaagacttctccttacccagatcccttacttccgcgaggtcgtcatcatgtccttctcctgcgaccactgcaacttccagaacaacgagatccagccggccggaaccattcagcccaagggcacgcactacgagctgcgactgaccgacctcgccgacttctctcgccaggtcgtcaagtccgacacccgccaccgtcaagtttatcgagatcgacctcgagattcccgcaggccgcggccagctgacaaatgtcgagggcctgcttaccggcgtcgttgacgatttggagatgggacaggaggagcgaaaagagaaagcccccgaggtctacgagaaggtggcagaaatcatcaagaagtgcagggccatgctggcaggagagtcattccccttccgcgtctacgttcgacgatcccgccggcaactctttatcgcacccgacctcaaggacggtgttggcaagtgggagaagcacgagtatgcgcgaacgcccgacagaacgccgccttcggcttgcaaacagcgatggcatgcanaggacnggctgaaaaccccggcttaccgaggacggngagattttccaaacgaagtntacagtttccccnccattgccccgggtggntgcccaaatgcccganacacatgaaaaagggtggaattccccctttaaagcagggggggg

SEQ ID NO: 7486 - DNA, 542 bp, Tricoderma reesei
  misc_feature (1)...(542): n = A,T,C or G
tcctctcttgtcgttgccttggttggtatcgccagctcatgggccctttggaggaatccatcaacgcaaacataactgaacgcggacccaacacacgaggttgctgggaggacacaatgctgtccgacgtgcggccataaactacaaccaagactacaccaccggcggagatgttgtttacacgcactcgaacaccggctttgcagtcaactggtcttatcccaatgactttgtcgtgggcgtgggctggaaccctggtggatctgctcccatcaatttcagcggcaactttggcgtcggcagtggcgtcggcctgctctctgtctacggctggagcactaacccccttgtcgagtactatgtcgtggaaaacaactttggctttttcctctggcggcacggtgaagggcaagcgtcaccaagcgacggatcgagctacacgaactgggagaacaccccgcgtgaaccaacctttccatcgtcggcacngngacgttcaactaatacatttcgatnccgaacttcaaganatcgaatggcac

SEQ ID NO: 7487 - DNA, 526 bp, Tricoderma reesei
  misc_feature (1)...(526): n = A,T,C or G
cggcgatgtcatttggatcccgactaccatctgctgcttgtgcccggcatgatccgcaagaagctgcccgaggccaagattggcttcttcttgcacgttgccttcccctcgtccgaagtcttccgctgcttggctgtccggaaggagctcctcgagggcatgctgggcgccaatctcattggcttccagatccaggagtacacgaggcacttcttgctcacctgcagcccgcatcctcaccgtcgaggccacgccggagggcatccagctagaggaccggttcgtcgatgtggtgcacaacgccattggcattgaccccgtcagcctcaacaagcaccgcgaggaaaacgaggtcaagaagtggttggccgtcatgcangaacgctaccagggcaagaagctcatttgttgcgcgagacaaagctcgaccacgtgcgaggcgtccggcanaagttgttggcataccagctgttnctgaataagaatccggaatggcgcgagaacactgtnctgatcaagtggcgct

SEQ ID NO: 7488 - DNA, 726 bp, Tricoderma reesei
  misc_feature (1)...(726): n = A,T,C or G
nctaaacaccgcaaagatggncgncatgttcatgccaaaacccgctcatgaacgggcccaactattccttctcagatgtgcccaagacggcccacggcgagcctcgacagcaccgcttcaacccctactccgacaatggcggctctacgctggccatctccggcgccgactttaccatcatggcgggcgatacccgtcacaccagcggctacagcatcaactcccggatggctcccaangtcttcaagatcggtggcaccactgccacccaggaagatgccaccatcgtcctgtctgtctgtggatttgccgcanacggcgaggccctgcgcgatcgtctggacaccgtctgcaagatctaccgtaccgacacggcaagcccatgtcgctcaacgcctgtgctaagcggctgtctaccatcctctaccagaagcgattcttcccatactatacgcatgccatgctcggtggtcttgacgaggaagggcaaagggtgcagtctactcctacgacccggntggaagctacnancgagagcagtgccganctggcggtgctgcngcagtttgatcatgcccttcttggacaaccaggtcaacttcaagaccaatacatcccggcagcggagagggccacgaactgaacgananggagcgtcnncctttgacaaggcaaaaggtgagnttttgtaangatgctttgacngggttggggagcgtacattga

SEQ ID NO: 7489 - DNA, 585 bp, Tricoderma reesei
  misc_feature (1)...(585): n = A,T,C or G
tcgccgagctcgagaacactggcgccatccttgacaccggcacctctctcaacgtcctcccctcgggcctcgccgagctcctgaacgctgagattggcgccaagaagggctttggcggtcagtacactgttgactgctccaagcgtgattccctccccgacatcaccttcagcctggccggctccaagtacagccttcccgccagcgactacatcattgagatgtctggcaactgcatttcgtccttccagggcatggacttcccgagcccgtgggccccctggtcattctgggtgatgctttcttgcgccgctactactccgtctacgaccttggcagggacgccgttggtcttgccaaggccaaataaaagcangtagacctttgcgaagtgtgtgtgtatctaagaagtgcacatnctgtatgtttgcagaatgctgggtaagttttggntatttgggcagtttgagagcggaagacagtcctactgntgcggangagtctggatcaagaatgcaacgtcgnttatgtaataactataatggagactggccgtcgtctgctgncgntatttggttcggggtc

SEQ ID NO: 7490 - DNA, 833 bp, Tricoderma reesei
  misc_feature (1)...(833): n = A,T,C or G
cccgcttgcttcagcttctctcgaggcaatttggcgataaaaagctcttcattagcctgttgctattgcttctcgttctcctccatcctcactcttatcctcaccctagatctcgtctctccaccctccgccatgagcatccaaactgtccagttcgagcccttccaggaccagaagcccggaacttctggcctgngaaagaaggtcaccgtcttcagaagccgcactacagcgagtccttcatcccagcatccttctgtccatccctgagggcgctgagggcgcttttctcgtcattggtggtgatggccgcttctggaaccccgaggtcattcaactgattgcaagatcagcgccgcgtacggngtcaagaagctgctcatcggccagaacggnatcctgtccactcccgcaccagccatgtcatccgctgcgcaaggccactggcggcatcctgntaccgngagccacaaccccggcggccccagaacgacttcgggatnaagtacaacctgtccaacggcggcccgccccgagtccgtgaccaacaagatctacgagacgtccaagagcttgacctcgtacaagatcgcctcgatccccgatatcgacatcttcaccattggcaccaacacctatggctcctngaggtcgagatcatcgatagcaccgccganttacgtcgccatgctcaaggacatntttcgacttcgacaccatcaagaagttcttttcttccaccccgactttaagancctgtttgacggctgnacggggtacgggcccntacggaaaggcantttcgaaaaggacttgggcttacggngcctgca

SEQ ID NO: 7491 - DNA, 530 bp, Tricoderma reesei
  misc_feature (1)...(530): n = A,T,C or G
ntncgcgttcgccgagggctgcatcgtcgccatggacctgtccgtcctggccctcagcatcgtcaagcagggcgaggccgacatccccggnctgaccgacgtngtccagcccaagcgcctcggccccaagcgagccaccaagatccgcaagttcttcaacctcaccaaggatgacgatgtccgcaagtacgtcatccgacgagaggtccagcccaagggcgagggcaagaagccttacaccaaggctcccaagatccagagactggtcaccccccagcgcctgcagcacaagcgccaccgtctcgctctcaagcgccgcaggccgagaaggtnaaggacgaggccaacgagtacgcccagatcctggccaagcgtgtcgncgaggccaaggccnacanggtcgatgnccgcaagcgacgagcaagctccatgcacaaaataanggggttttcgttcgggcgttttntttttataatngaatngtaaaaaaaagggggggangggggaaaatcccattcnttnataccttt

SEQ ID NO: 7492 - DNA, 698 bp, Tricoderma reesei
  misc_feature (1)...(698): n = A,T,C or G
tgctcctcacatactccctctctaggtattgcagcctcacagctgtcacactgtcacaatggcggcgcaggtcatctccaactctggccacgatgatatgattcacgatgccgtcctcgactactatggccgaaagctggcgacatgctccagcgaccggacaatcaagatcttcgagattgaaggcgagacacaacgcttggtcgagactctgaagggtcacgaaggcgctgtatggtgcgtcgctgggcgcatcccaagtacggcaacatcctggcatcggctggctacgacggaaaggtcttcatctggaaagaacagggcacccagaacaagcagccagtggcagcgaatctacgacttccccctgcacaaggcctcggtcaacatcgtctcgtggtccccccacgaaggccggctgcctctcgctgcgcgtnctccgacggnaaacgtnagcgtctcgagttcaaaggacaacagccgtcgccacgtcacatttccccgccaccggctnggcgtcacttccgcttcttgggcgccccgncaccacgcccgggagcaatnngtcagcaagcgcccgggnccccggcccacnggcaaccggcggttcntacccgcnggntttacaaccttataangaattnggccttttgaccttgtttccaancgtcaacaaganggcgaggntttgacgggcc

SEQ ID NO: 7493 - DNA, 581 bp, Tricoderma reesei
  misc_feature (1)...(581): n = A,T,C or G
accagctcctggatcatgctccgtctcgcccagtacccgcacgtcgtcgaggatctctaccaggaacagatccgggtcctgggcgccgatctgcctcccctccagtacgaacacctcgccaagctgcccctctgccaggccatcgtcaaggagacgctgcgtctcaacgcccccatccactccatcatgcgcaaggtcaagcagccgatgcccgtccccggaaccaaatacgtcatccccacgtcccacgtcctcctcgccgcgcccggcgtcagcggctccgaccccaactacttccccaaccccgagatgtgggacccctaccgctggctgcccggctctccaacgccccggttgatggtcccgaaacgacgaggaggaggaaaaggtcgactacggctacggcatcgtcagcaaggggcgccgcctcgccgtatctccctttggcgcgggccgccaccgatgcatcgggcgagcactttgccaacctgcagctgcagacaattgtctgcgangtggtgcgactgttcaagctgacaatgtggacggnagcaacaacattgtcggcaccgactacgcct

SEQ ID NO: 7494 - DNA, 577 bp, Tricoderma reesei
  misc_feature (1)...(577): n = A,T,C or G
naggagctggccagcaccctnnagaacagcagcctnttcgaggaacaccccgagtaccgcaccgntctggccgtctgctccatccccgagcgagtcctgcagttccgcgtcacctgggaggacgacaagggccagctgcgcgtcaaccgcggctaccgcgtgcagttcaacttttgcgctgggcccctacaagggcggtctccggttccatcccaccgtcaacctgtccattctnaagtttttggcttgaagcaaatcttnaagaatgccttgactggcctnacatgggtggtggnagggcggcgccgactttgacccaaggcaagtcggacaacgagatccgggcttctgcagctttatgcgcactgtcgcccaattgcgccgacacggacgtgcccgccgcgacattggcgtntcggccggaaaatggatcatgttggcgcgtcccgcaggcgaggaacaagtttgagggcgtctgacggcaaggccttacttgggccggagtctgatcaactganggcactgntacggctngtntactacgtcgaacacatgttcaagacgccggccacggttc

SEQ ID NO: 7495 - DNA, 600 bp, Tricoderma reesei
caacaacttggatatcgccatacaaacatctacagcattcaacaacaacccgtcacaatggatcccttagagagcatgtcaactggcggtcctctgcccaaggactttaacgccgaagatgcgggcaacatggaggatatggagaagcagtttgccgtcaaagtcgtgcagcacatggccacctactggtccatcctcgaaaaggtcaagggctcgagcctgcgactgaccaagatcgacgacgagatctacgagcacctcaaggaggcctttcccgagttcgacccggcggccacgatcgacgaggaccagatgaagagcaagacgggcaaggagaggtggcgcgagttcatgatgaagtacgagaagaaggtggacgactacaacttcggcaccatggtgcgcaacaacgccaaggccgagtacgagcaggacacgaccatctttgtccctaggatgcagttctatgcgattgagattgctcgaaacaagcacggcctcaacgactggatatacgaaaaggcgcaggaggaaaaggcgcaggaggagaagaaggactctaaatagataccccgaaaatctagcaaaaatgggaaatcc

SEQ ID NO: 7496 - DNA, 632 bp, Tricoderma reesei
  misc_feature (1)...(632): n = A,T,C or G
ngntttttcccgccgccctcctgcccgcccgccagctcacggcctcgctgtgagagacattttcccgagatgctcagcgccgctcttcggaggcgtatcctcgcgcccacccaccaggccctgcgaagtggcttcacggngcacgtcgtccgctactatgcctccttcccgagccaccaggtgatcaagatgccggccctgtcgcccacaatgcaggctggcaacattggcgcctggcagaagaagcccggcgacaccatcgcccccggcgaggtgctggtcgagatcgagacggataaggcgcagatggactttgagttccaggaggagggcgtcattgccaagatcctcaaggaggctggtgagaaggacgtcgcttgtcggcacccccatcgctgtccttgtcgaggagggaaccgacatctccgccttcgagaagttctctntggaggatgctggcggcgacgcccgctcctgctgccccaaagaaggagtctgaacccgctcctcagtccacccccgcgtntgcccctnagaacaccggccttctgaacagtaccgctttcaaagggcaggcttgcaganctggtctcgaccgtntggccaacgcttgntcttgccgccatncgcct

SEQ ID NO: 7497 - DNA, 822 bp, Tricoderma reesei
  misc_feature (1)...(822): n = A,T,C or G
gcggacttgaccaagcggctgggaaacttgtttggaggctcacaagatgtcaagaaccacccgtggtttgccgaggttacgtgggaccgattggcacgcaaggacattgatgctccgtatacgccgccggtcaaggcaggatccggcgacgccagccagtttgaccgataccccgaggaccccgaaaagtacgggggtccgggcggtcctgacgaatatggcaacttgtttcccgacttttgagtatatcaacaacgttcgaatcgaggcatacgcgggcacgttgacgactgacgatgaggctttgagcgtgtggcctgagtggaaagcaaaaggagcatgtttgcctttatttcttttggggtttgggatgtaaaagaggtgggctgctgggcccgtttgcttggttgcatctcngtgatgggctctgcattggagaatgggtttctttctctctatctctctctatggaaagggcggttcgatcggtcatgggggggctcttttgacctggagtctgtgtcngaaaacgtgtattggggaggaaangggaactgtgtttgctgctgcaangccaaatctgtctcgccggtaccaactatccncccacctggatatccatcttttattctttttcccctgtngtggttgtccctttttctgctttggtccttctcttgggctatgatggccaaaaagggaatnaaaggggggacncttatttaaggtccttgggggtcttgtatactttttttgacctggaagggccncatgtncaaggaacttnacccaaaaggtgggctttgnatgtgccttttatta

SEQ ID NO: 7498 - DNA, 795 bp, Tricoderma reesei
  misc_feature (1)...(795): n = A,T,C or G
tctgaggtcttcaactttgagcacggtcgtgaggagctgctggagctgatcaagctggccaacgaaagcagccactccgcgcgggacttcaccgccaaaggagaacggggtgcttggtgggcggagcgacaggctctcgactctcgacttaagaagctcttagtcacaatcgagacgacttggctgggagggttcaagggcatattctcgcagcatcgcagactgggggacctgctggcacgcttccagcgggatttccaccaaatgctggacaggactctgccttctcgaaacaagagccgagccaagaagatgacgacgaagacggatacggtaaacttggatcccagaattctcgacttgtttattggcctcggcaaccctaccgacccggacaccgactttgacgaggccatgaatgacctgctctactttgtggtggatatcctgcagttttcacggcgaagcgaaatgcttacgacgaaatcgattttgacagcatgggtgctagagacgtacgatgccctgcgcgcatatcacaatgctggccagctctccaanagagagaggaagggcgcgcacaacggtgcttgttctcgacaaagctgctgcatgcttttcccctgggaggtcgcttgcccttgcatgggaccggccttttcggtgtcttcgggtgcctttncttcccatggtctttcgcnagctaattganggaaggctgggcattaggtcccacaagccgcatnaacangggccacttttntgttnggcnaggggttggcccataccgtcctt

SEQ ID NO: 7499 - DNA, 2283 bp, Tricoderma reesei
  misc_feature (1)...(2283): n = A,T,C or G
ccggcgaaactcagctccaacatggcttgaccaactgatgctgccaggccttcattcgtgctgcgacgcttcgcctgttcggccctattgacaagggccatttcctcgatagttactcgcccaaatcgcctggggaaggatcacacgcggcaagggaacgaggacacgagatagacataaaagcggtagcaccccctggccatccagactgcaacctcgccattcnnatcngctcttctctcctcaccccatcacaactcgccagttcccttgactctccttcacctcagaagaaagggggcgttttgtgcagcaattgctttccttcaacgctgcctccccgactgaagcgctgtctctggcccagaggctagagattacccgtaacaatgggcgagaaagaagacattcacgctcacgaggagctcgaccatggagagatcaggaccaaggtcgtgaccggacacgaggcctttgaggaggccatgatgaaggagccgcccaaggcctggaccaaggctcaggtcctcgtctacagcttctccatcattgccttcttctgcagcaccatgaacggctacgacggctcgctcatcaacaacctgctgcagaacccctggttcaaggccaagtacactgtgggaaacgacggcatctgggccggcattgtgtcttccatgtaccagattggtggtgtcgtcgcccttccctttgtcggccctgccattgacggctttggccgccgaatcggcatgctgttgggtgccatcctcattgtcgtcggcaccatcatccagggtctgtcaaactcgcagggccagttcatgggcggccgctttctgcttggattcggcgtcttcattgcagcggcagcgggccccatgtacgtggttgagattaaccaccctgcataccgtggacgcgttggcgccatgtacaacactctctggttctcgggtgccatcatctcggccggtgccgctcgaggcggcctcaacgtcggaggcgactactcgtggcgactcatcacctggctccaggccctcttctccggcctcatcatcatcttctgcatgttcctgcccgagtccccccgctggctctacgtgcaccacaagaaggacgccgccaaggctgtgctcaccaagtatcatggcaacggaaaccccgactccgtctgggtccagctccagctcttcgagtatgagcagctcctcaacatggacggcgccgataagcgctggtgggattaccgggcgctcttccgctcgcgcgccgccgtctaccgtctgttgtgcaacgtcaccatcaccatttttggccagtgggctggcaatgcggttctttcctacttcctcggctccgtcctcgatacggccggctacacgggcaccattgcgcaggccaacatcacgctcatcaacaactgccagcagttcgcctgggccattctgggcgccttcctggtcgaccgcgttggtcgtcgccccttgctgctcttctcctttgctgcctgcaccgtggtctggctgggcatgacggttgcctcatccgaatttgcgcagtcgttcatcggaaatgacgccaacggcgatcccatctacagcaaccccagcgcttccaaggctgcctggccatgatcttcatctttggtgccgtctactctgtgggcatcactcctctgcaggccctgtatcccgtcgaggtgctcttctttgagatgcgcgccaagggcatggccttttccagctttgccaccaacgctgctggactcctgaaccagtttgcatggcccgtgtccatggacaagattggctggaagacgtacattatctttaccatctgggatctcgtccagacggttgtcgtctactttttcattcccgagaccaagggacgcactttggaagagcttgacgaaatcttcgaggccaagaacccggtcaagacgtcgacgacgaagaaggccgtggccgtggacagccacggngacattgtcaatatcgagaaggcttaatgccacggacttttacttgcggcacgatactataccactatatcaagaatatctgggcagttgtgcgcanggcttggggctgtgagctgatgttttgtttcgatggttccttgtcagggcagaggaaacaactttggttgctattttaagctggtacttttgtttccgctgataattgngaaatatgagggtgaggggagaaccaaaaagagaagccctaaggatgcagcatgaatctgcaactggccccccagaaaaacaattca

SEQ ID NO: 7500 - DNA, 713 bp, Tricoderma reesei
  misc_feature (1)...(713): n = A,T,C or G
ggaaccgcctgcagaacgtcgacccctggatggtcgagacggcccagaacccgcgcgcgtacctggccgggtggaacatgaacaccaacaactggctgcgcaactacatttacctgcgcgtgacgccccgcggcaagaagcccggcttccgcgccagcatgacgacctttgtcacgagcgccttttggcacggcttctacccgggctactacctcagctttatgctggccagtctgattcagacgtcagccaagaacttccgccggcacgtccgcccctttttcctcgatcccatcacgggcaaccccacgcccaagaaaaagtactacgacttcgccacgtacctcgtcacccagcttaccttttccttcacgacgctgcccttcctcatcctcagcttcaaggagtcggtccgcgcctggtcccacgtctacttttacgcctttatctggaccacggcgtcgctcgccttctttgcgtcccccggcaaggcgctgctcaggaagaagctcgagagccgcagggcaaggccagcgcgcggttaagcggacgacgagcagcgagagcctntcgggcagggagcccattctgggcatnttcaaggatccagaagggggacattgncgangctgtcaatgagtttanggcgggagttgcgtcgatgcanaaaaagaggacctttgaaaagggaaggggggggggggggggggggg

SEQ ID NO: 7501 - DNA, 799 bp, Tricoderma reesei
  misc_feature (1)...(799): n = A,T,C or G
gcagcatgagcttcctcaagactaggaacccgccaattccccagcgccgccatggctcactcgccgtcctcatcgtcagccgctgacgaccccgccgaaaacacggccgacgaggaagattccgaagactactgcaagggcggctaccaccccgtccagattggcgaaaagttcaaggacggcaagtacaccgttgtgcgcaagctgggctggggccacttctcgaccgtctggctgtcgcgggacaacaccaacggcaaacacgtcgcgctcaaggtggtgcgatccgccacccactacaccgagacggtcgtcgacgagatcaagctgtcaataagattgtgcaggccaaccccaaccaccccggccgcaagcacgttngtcagcctgctcgactcgtttgagcacaagggccccaacggacccacatgtgcatggtctttgaggtgctgggcgagaattntgctgggcctcatcaaagagatggaacacccgcggcattcccattgcccnttggtnaagcaaatnccaagcaaggtcctgntcgggcttgactaccttgcaccgngagtgcgggattattcacacccgacctnaagcccnaanaacgttcttgattgaattgganacgtgacaagattgtcaagaaggtcttaaacccgnaacccccacaaggaaacaatccaaccggccgccganactaggaccttaatacttgcagccagccgttgccttttcttttaaggccanttnaccccanaaccttttcctttnatacttttangggaantttcggggg

SEQ ID NO: 7502 - DNA, 529 bp, Tricoderma reesei
  misc_feature (1)...(529): n = A,T,C or G
ncatngagcagaaggaggagtccaagggctncgacaagcacgttgccaccatcaaggagtaccgcagcaagatcgagctcgagctcgagaaggtctgcgaggatgtcctcaacgtcctggacactagcctnatccccaacgccgccactggcgagtccaaggtcttttaccacaagatgaagggtgactaccacccgctaccttgccgagttcgcctctggcgagaagcgcaaggtcgctgcactgccgctcacgaggcctacaaagaacgctaccgacgttgcccagaccgagctgacttccactaccccatccgctgggtcttgccctnaactttttcgngttctacacgagatnctcaattccccgaccgngcttggcaccttggcaagcaggcctttgatgatgccatcgccgaacttcgantttccttttntganggagtccttaccggggacaggactttttattattgcangtttctggcgtganaaccttganccctgngggaattttatttcccacaagc

SEQ ID NO: 7503 - DNA, 379 bp, Tricoderma reesei
  misc_feature (1)...(379): n = A,T,C or G
ngaggactttgaccagngcattatcaactacctggccaaggcctacaacaagaagaacaacgtcgacatctccaaggacctcaaggccatgggcaagctcaagcgtgaagccgaaaaggccangcgtaccctctcttcccagatnancactcgtatcgaaatcgacggcctttttcgagggcaacacttnttccgagattttacccgggccaagttcgaggagctcaacatggacctttttaaaaaaaccctgaaccctgtcgaacaangttttnaaggacgccaacgtaaanaagagcgaangttgacnacatcgttntggtcggcggttcnccccgtttccccaanggttcantctnttatcgangagtcctttacc

SEQ ID NO: 7504 - DNA, 708 bp, Tricoderma reesei
  misc_feature (1)...(708): n = A,T,C or G
ntnggccgattcggcacgaggcctggtctgccttccttctctcccctatacttcttttcttctctctctctcttctctttcttctcatcttcagagaaaaatcatatctttgtgtctccaaagcagatcaaccggttcttctttggattttccaactcttacaacctaacgactttttaacgtctcttttattttttacctaatacccatacttcaaaatggctggtggtgacgctaagaagggtgccaacctcttcaagacccgttgtgcccagtgccacaccgtcgaggccaacggcggccacaagatcggccctgccctgcacggcctcttcggccgcaagaccggctccgccgagggctactcctacacccgacgccaacaagcaggccnggcatcacctgggaggagaagaccctgttcgagtacctcgagaaccccaagaagtacatccccggcaccaagatggcctttgggcggcctgaagaaggagaaggaccgcaacgacctgatggctacctcaaggaccctaccaaataaaccaagaaggaaaacgaagagtatgaagaaaagtaatgacaagacatttcgatagacggggtgcggcgattgtactatagacacagacacagcttagaatagtcgaagcaccatcactgtgcttgtccattaatacccaacttccgcttttttttgggcgaaaaaaa

SEQ ID NO: 7505 - DNA, 883 bp, Tricoderma reesei
  misc_feature (1)...(883): n = A,T,C or G
gaagatcaaagcacagaaaatggccagctcaattcttcgaggaagggcgctgggggcggtgcgccagtcgcgctgcttcagctctactcccaggcagtgtgctgccgacgtcaagagtctcggtgtcctcggcgccggccagatgggcctgggaattgctcttgttgctgcgcaaaaggcacaggtcccagtgactcttgtcgatgcctccgagcaggcgctgagtaaaggcattgcgtttgccgagaagctgctggccaaggatgtgtccaagtccaagattactcaggaacaggccgaccaggctcgctcgctgctcaagccgagcaccaagattgaggacttctcctctgtcgacttcatcatcgaggctgtgcccgagattccccagctcaagtttgacatcttcagcaagctggccaagattgccccctctcacgcaatcctggcaaccaacacgtcttcaatctccattacacgcattgctgcggccactactaccgatcctaacgacacctcggcttcatctcgagtggtctcactcacttcatgaacccngtccccgtccagaagggcgttgagattatcagcggactgcaaaccancaaggagactctcgacacggccggtgagttctgcaagaagatgggcaagatcacgtncgtntcgggcgactnttccgggttcctcgccaacagaatcttatgccctacatnaacganggcatnatttgcctgganacgggcgttggcgacagaaacttcatcgatgccattatgaaaaaanggnaccaactncccatggggaccactgnaacttggaaactttattcggccttganactgcttgggtattaatgaanggttttcttacggagacgggg

SEQ ID NO: 7506 - DNA, 402 bp, Tricoderma reesei
  misc_feature (1)...(402): n = A,T,C or G
ntancggccantcgcacgaggcgtcactgttcccgcttacttcaacgatgcccagcgccagagcaccaaggacgccggtcagatcgctggtctcaacgttctccgtgtcgtcaacgagcccactgctgccgctcttgcctatggtttggagaaggaggctgaccgcgtggtcgccgtctacgatcttggtggtggtactttcgatatctctatcctggagatccagaacggtgtcttcgaggtcanagtntaccaacggtgacacccaccttggtggtnaggatttcgacatccacctggttncgccaccatggttttccnnagttcaagaagacttccggcattggaccttnttttgggcgaccngcatngttatccaancggtnttcnggttganggctt

SEQ ID NO: 7507 - DNA, 669 bp, Tricoderma reesei
  misc_feature (1)...(669): n = A,T,C or G
ctgcgagttccccgttctgaagatcttcggattcggtgacggatcagaagacatcaacggccccgctggagacgttctctatgcatcctacctctccatggcccgcgccggccttgcctctttggagatgtgggatcccaagagccagaaatggggacaggcacacagccaggctcgcttctccattctcaaatctttcctcgaggccggcgacgacttctgcaagctggactacaccaaggatgacctttctgatttgactattaagctggacaggtccaagattctcacagctggccgcgacgctgttgcaagtaccttcagaagcttcacgtttacaagtcaactgccgacgtcgagactggcaccaagttttacaccgacatgagcaccgttggcttggactttggggtcaaaggtccgccaagtggttcttgataacaagcagccacgcaaagtctttgtccaggccaacactaccctggatgaagcacggactctgtgtcgatcaagcactacgatgctacgcttntgggaatgattcanagttgggccgacaggaacctgtaaaacagtgaagttactacaagcatatccgaaatgagcgacgtgccatgacattgatcaaatcatnttcagaatatacaagatcccttttccaagaggaga

SEQ ID NO: 7508 - DNA, 944 bp, Tricoderma reesei
  misc_feature (1)...(944): n = A,T,C or G
ctgtcgtatttgctggccgattcgatggcagggacgtcgccgtcaagagaatgacgattcagttctacgacattgccacgccgagaaactaagttgctgcgcgagagtgacgaccaccccaatgtcattcggtattactcacaagtgcagcgaggcgacttcctgtatattgccttggaacgctgcgctgcttcattggcagatgtcattgaaaagccgtatgcctttggtgaattggccaaggctggacaaaaggacctaccgggcgtcttgtaccaaatcaccaacggcatcagccacttgcactctctgcggattgttcatcgagacttgaagcctcaaaacatcttggtcaacttggacaaggacggnagaccaaggctcttggtgtcggactttggcctgtgtnagaaactggaggatagacagtcttcgttcggagcaacgacaggcccagccgcttggaacgtcgggatggcgtgccccccgaactgcttntcgatgacgaccggacaagaatcccggancccatcgatagcagtaccgccacaagcnggcttttcacacccattccttcgtgggggaaaacccccaaacttcgctttttcccaaatggganggggcgaagcccacgnangggcccattngaccattntttcttcccctttgggnccttggnctttctttcttaccgnggcttcnccaaatgggatccccacccgtttngacttgggggcgacaagaatttttgccgggaaggnggaacaatttgaaaanggggaaacnacccaccctccnatccaattnggaccctttntgggcnaatttttgccttacnaaangcccaaggatctggattgngttccttgcttccaaggcctttttcccaaggggaannaacccgantttcngaaaaagggccntggcccccntttttttttttn

SEQ ID NO: 7509 - DNA, 896 bp, Tricoderma reesei
  misc_feature (1)...(896): n = A,T,C or G
tcatccccctcncatcggatccgncnctcgttagagcagattaagcataaagaagcctncggagactntacactcctctgccatgccctgcnatactccttcaagtccatcgcctactanatctcntcgcgcgaccctcgtnaacctgacgggcctcgccggctccgccaacgtcaccggcgacgaccagaagaagctcgacgtcatctccaacgacctcttcatcgaggccatgcgctcctgcggcaaagtcgccatgctcgtgtccgaagaggaggagaaggagattcacttcccgcaggccctcggcgcgcgctacattgtctcgtgcgaccccatcgacggctcgtccaacctcgacgcgggagtttctgtcggcacaatcttcgccatccacaagatccccgacggcgtcgacgtcgcccgcaaggagcacatnctcaaggccggcaccgagctcgtcgccgccggcttcacaatgtacggcgcctccgccagctcgtcatgaccatcaagggcaagcaccgtcaacggcttcaccctcgacaacggcatcggcgagttcatcctcnccacccgacatgcgcatnccccgttccgccacatctacttcgtcaacgaggggcaactcgctctatggggaggaccacaccatccggntacttcaactncctcaagcaggcccaggacgaccggnaagcccttacagcgccccgttacattggcagcatnggtcgccgatgccttaccggaccctggttctacggangnatttttggctaaccggcgaacaagaaaaagccccaaagggcaagcttcgtatctttaccaatgcccnncccattgggcttgggggttganaatgccgggggccancccgttgatancaaatngat

SEQ ID NO: 7510 - DNA, 626 bp, Tricoderma reesei
  misc_feature (1)...(626): n = A,T,C or G
gcgattcgccgtccgcaactctggcgctacggccgttgtcgagggtgtcggtgaccacggttgcgagtacatgactggtggacgagttgtcatcctcggcagcactggccgcaactttgctgcgggtatgtctggcggtattgcgtacgtgctggacatcaacaaggacttcgtctccaagctcaacaccgagatggtcgagtacgggccccttacggatcccgttgagattgcctacgttcgcggtctcattgaggaccaccaccactacacgggctctgagcgcgcggcacgcatcctggtcgacttcaaccgcgccctgcctcgattcgtcaaggtccttcccacggactacaagcgtgtgcttgaggaggaggctgccaaggctgcgaggccaagccgtgcccgagtacaacctgcctgccatttccggggtgcaccactccaagaaggaggacaangcttgccaagctccaggatatggaggaggccattggcgacaagctcggccgagaagaagaagagggctntggtgctcgacaagaccaanggcttnatgaagtaccctcgccgtaccgaaaagtaccgctttgtcgccactcgaatcaagggactgggccgaaatt

SEQ ID NO: 7511 - DNA, 1103 bp, Tricoderma reesei
  misc_feature (1)...(1103): n = A,T,C or G
gcggccttggcctcgatttgcaaaagccaggaacccttgttgttgcttctttgaactcttggtggccagatgctcagctgtttcggtcgaccgactctgggacaacatggagcccgatctgggcgtgggcgagctatccgactgagacctattactacagcatctcaactcccaaagcaccgtggatcaagaacaactttatcgatgtgacgagcgagtcaccgtccgatggtctnatcaagcgcctcggctggatgattgagtctntcgagattgacccacccgacagcaannactggcttttacggcaccggaatgacaatntttggcggccacgatttcaccaactgggacacgcgcccacaatgtggtcaatccaattacttggcagacgggattcgaaggaatttttccgttcaaggacctggccttttcacccggggggaagcgagcttttggccgcaagtccggagacgancaacgggtttaccttttgcccagcagaaacgaccttgggacattgccgcagacggtttgggcaactcccacatgggccacctcgacgaagcgtcgactacgccgggaactcggtcaagagccgttcgtccgcgtcggcaacaccggccggcacgcaacaaggtggccatttttttccgaacggcgggcgccgacgtnggaagcaattcgaactaacgctggntccgaacaccgtttccattgaaacggcggcgcggtggcctattcggccgacggcgacacgatcctctggtcgaccgcctcgtccggcgtgcagcgctcgcagttccagggcagctttgcctccgtctcgagcctgcccgcgggcgccgtcatcgnctcggacaagaagaccaacagcgtnttctacgccggctccggatcgaccttttacgtcagcaaggacaccggcagcaagctttnacgcgccgggccncaagctgggcaancgnaagggacgaatccgggaataatcgnttgttnacccgaaccacccggggggcacgtttgtattgttttcgaaccgaccgttggggantatttccggttccanaanaactttggggcacgnaaccntttggggccaa

SEQ ID NO: 7512 - DNA, 501 bp, Tricoderma reesei
  misc_feature (1)...(501): n = A,T,C or G
ngacaacatccagggcattaccaagcctgctatccgacgtctcgcccgtcgtggtggtgtcaagcgtatctctgccatgatctacgaggagacccgcggtgttctcaagtccttcctcgagggcgtcatccgcgacgccgtcacctacaccgagcacgccaagcgcaagaccgtcacctcgctcgacgttgtctacgcccttaagcgacagggccgcaccctctacggtttcggtggttaaagtaccccggaacaaacagacaaaacaaaacgcgtcttggggtttccttttatatgctgctgctgcggcgcgcgtcttcaccaagggggcgatttgtggagctggggttatctgtgcaaataacatggactcttctgtactttcgatcgattggccgttggggggaaatgggtttatgaangangcgtcatggtagacgacccttgttacatgacaatatcacacgaatacaactacgataatctttccnaaaaaaaaaa

SEQ ID NO: 7513 - DNA, 692 bp, Tricoderma reesei
  misc_feature (1)...(692): n = A,T,C or G
tnaagcgcgacangcaatgggcgcatcatcccgccttcattccccgtcgttccatcgcgcctgcagcagctggctgaattgcggcgccacagcaaagacaatgagaacctcgacgagtacgacctcatcgtcatcggcgcgggcgcgacgggcgctggaattgcgcttgacgccgtgactcgaggcctcaangtggccgttgtcgatcgcgatgacttcgcggcgggcaccagcttcnaagagcaccaaactggtccacggcgggcgtgccnctatcttcaaaaanggctgtcatgnaacttggactactcccagcttnagctgggtnatngaaggcgcttgancgaaccgcaagacctttnttgacgattccgcctcacctttccaactcgcttccaattctgtggcttntcgacactggctgcaagctccatacatgtgggatcggacaaangcctacgacctgntcgntggctcacanggnctttgagggctcttatttnatgagcaaaagcaanggtattgcaaatttcccttntgttgcccangacaacttggtcngngccctggtctactacgatngccagcacaacnattcccgaatgaaacgtttntttcccatgactgcccaactgtacngggctcccgttttaaccatgttgangtacggcttggatnaaaacncaaccggc

SEQ ID NO: 7514 - DNA, 255 bp, Tricoderma reesei
  misc_feature (1)...(255): n = A,T,C or G
ccctcgaccaagatcctcaccttctaccgcaaacagccgtttgacctcgaggcccgctacgcaaacgttgaagagcttcctggcaaaacgaacccttggattggccgcttctccgtgaagggcgtcaaagccnacggcaaggaagacttcatgatttgcaagctcaaggcccgagtcaacatccacggngtgttgaaccgtggagaacggatactatgtcnaggaccaggaggtngaggaggaggtcaaggacga

SEQ ID NO: 7515 - DNA, 518 bp, Tricoderma reesei
  misc_feature (1)...(518): n = A,T,C or G
nttccnttgcactatncagnacacaangacatnatggccnctacaaagagctccaatgacaagtactcggtcatnctgccgacgtacaacgagcgcaagaacctccccattgtggcctggctgctgaaccgcactttcacagagcaccaactcgattgggaactcatcatcgtcgacgacggttcgcccgacggacccaaacgtcgccaaccagntcgtcaaggcctacgcccccacgtcgtcctcaagattcgttccggaaagntgggcttnggaccgcttacgtccaccggcttgnagttcgtacggcaacttcgtcatatatggacgccgacttaaccaccacccaagttatncccgnaatgattgccngcanaaaagggcactaccaaatngtaaccgggacgcgttacgcgggcaacggnggggtttttcggttgggacttgaagcgcaagttcgtnagccgngggccaacttgttcgccgacaccgtcttcgacccggggtaaggacttgac

SEQ ID NO: 7516 - DNA, 571 bp, Tricoderma reesei
  misc_feature (1)...(571): n = A,T,C or G
nccacgcaacagcaacaacaccagcgctgccgccgtcgctcgactacgctctgcatccacgatcgcttattcgcctacatttcccactcccctcctcccgccgccgacgtccgtcttctccctcctctgaacgccttattctctcaaaatggccgacgctccgtacgatccctacgttcccaaggccggcgccgaccagtccggcggccagtcgcgcacgcaggcgcttcaaggtgaaatcgacgcaacggtccaagtgatgcgaaagaacattgaaaacgtggctcagcgtggtgaccgcctggacgtcctgcaagacaagaccgataacctggcggaatccgcacagggcttccgccggggcgcaaaccgagtgcgaaagcagatgtggtggaaggacatgaagatgcgcgtctgcatcgttgttggaatcatcctcctcctggttgtcattatcgttccatcagtcgttgncacccgttaattacttacaacttttcttggttggttgccatgatttacgaggtcctttgacgagtaccanaccaagttggtttnggacggcaacggc

SEQ ID NO: 7517 - DNA, 452 bp, Tricoderma reesei
  misc_feature (1)...(452): n = A,T,C or G
naagcagattcctngtctnctgggtcctggtctgtccaaggncggcaagttccccactnccgtctnccacgccgacgacctctctggcaagatcaacgaggtcaagtccaccatcaagttccagctgaagaagggtctctgcatgggtgtcgcgtcggcaacgttggcatggagcaggagcagctgatcggcaacatcatgcttgccatcaactacctcgtcttcctctgaagaanggctggcaagaacgttggaaagccttaccatcaangcttccatgtctccccctaagcgcctctactaaacangtcgtggcctttttttttttctaacctntnttggtgngggggnggtcaaaactttatctgacttntttgagctattgccgcgaccgnttttgagaataacatnggntttcaataaatnaataccccgaaccaaanggaatttcc

SEQ ID NO: 7518 - DNA, 678 bp, Tricoderma reesei
  misc_feature (1)...(678): n = A,T,C or G
cctgcgtttcgccgtgacgtgttcttcaaggccgccgacttgatccagcagaagagcggcgagctggccgacatcatggcgaacgagacgggggccacccttccctgggctctcttcaacctcaagacggcgggcgagctgattcgggacgctgccagccgcatctctgccattgaagggtcgttcccatccctggcagatcccagcagcagtggcatcgtgctgcgagagccttatggcgttgtcttgtctatcgctccatggaacgctccctacatcctacccacccgcgccattgtcggccctgctgccgccggcaacaccgtcgtcttgaaagcctcagagcacgcccccgcgtgcatgagggctctcgtgtccgtcttccacgaggcgggagtgcccagcggcgtcatgaacatgattgcccacgaccgcgactncgcagccgagatcaccacggcgctcatcgncaaccccacgtcagaaaggtcaacttcacggcagcaccggcgtcgggcgcgttatcnggangctcgcaggcnacacttaagcccgtcatctggactcggcggaaggcgccggcattgtgtgggangacgcggactggacctggcggccacaatgcgccatcgggcgttcttcacggnggcanaatntgatgtcgacgaaaaaatattg

SEQ ID NO: 7519 - DNA, 287 bp, Tricoderma reesei
  misc_feature (1)...(287): n = A,T,C or G
ntncggcacgagggccccccgacgtcctcaaggccctcggccccgagtggatcgtgcccctcgtcgccgtcctggtccactccaacaacaccaccgagaacggcagcatnttcgaggccggcgctggccacatggccaagctgcgctgggagcggtccagcggcctgctgntcaaggccgacgactcgtacacgcccggcgccattctgaagcaagtggaacaaggtcgtcgacttctccaacccccagtacccctcgggccccaacgacttcatgaccctgctgga

SEQ ID NO: 7520 - DNA, 613 bp, Tricoderma reesei
  misc_feature (1)...(613): n = A,T,C or G
nccgantcgcacgaggggacgaggacgccggcacgggcgccgacaacttcagggtcaagcgctacatcagcaagtacaccatcaacccggcgctggcgcagggcttcgcgcacctngtcggcagcgtcnaggtcggcaagctggcggacctggtggtgtgggatccggccgtggttcggcaccaagccttcactcgtcatcaagagcggcctcattgccctggctcanatgggcgatcccaacgcctccatccncaccgnccagcccatcatcgnccgccccatgttcgncccncctcgtcccgcaagaccagcgtcctcttcgtcttcgggccgccgtcccgtcagcctcgggccgcncgtncaagtcctaccggccttgngcaagcgcgtagaggcccgcaaagggctgccgctccgtcaggaaagcgcgacatgcgctttcaacgacgccatgccnaggatgaangtcnacccggagagctaacttngtcgaaggcggacgggaaaggnngtgcgctgnccgaacnccggngacgaaggtttgcccgcttaccgcangccttggtattattgtaattggattngcgttcagnaaaccggggaaaaaatgg

SEQ ID NO: 7521 - DNA, 807 bp, Tricoderma reesei
  misc_feature (1)...(807): n = A,T,C or G
actctctagctgaacaaattatctgcgcaaacatggttcgccggactgctctgctggcccttggggctctctcaacgctctatatggcccaaatctcagacgacttcgagtcgggctgggatcagactaaatggcccatttcggcaccagactgtaaccagggcggcaccgtcagcctcgacaccacagtagcccacagcggcagcaactccatgaaggtcgttggtggccccaatggctactgtggacacatcttcttcggcactacccaggtgccaactggggatgtatatgtcagagcttggattcggcttcagactgctctcggcagcaaccacgtcacattcatcatcatgccagacaccgntcagggagggaagcacctccgaattggtggccaaagccaagttctcgactacaaccgcgagtccgacgatgccactcttccggacctgtctcccaacggcattgcctccaccgtcactctgctaccnggcgccgttccagtgcttcnagtaccacctgggcacttgacggaaccatcgagacgtggctcaacggcagnctcatcccgggcatgaccgtgggccctggcgtcgnacaatccaaacgacgcttggcttggacgaagggccaagcttttatttccggagatcaccggtgtcaacttttggcttggganggcctacagcgganacgtaaacaacccgtctggttcgangacatctcgattgngtcgacccngcgtgggatgcggccccggcagccccggcggtcctggaagctcgacgactgggcnangcagca

SEQ ID NO: 7522 - DNA, 413 bp, Tricoderma reesei
  misc_feature (1)...(413): n = A,T,C or G
acaaccagacgatcatcagcaaccacttccgcaaggattggcagagacgggttcgcacccactttgaccagcccggccgaaagtctcggagacgcactgctcgtcaggccaaggctgctgccctcgctcctcgtcccgtcgacaagctgcgccccgtcgtgcgatgccctaccattaggtacaaccgccgggtccgcgccggtcgtggtttcaccctcaccgagctcaaggaggccggtatctccaagtccctggctcccaccatcggcatcgccgtcgacttccgccgccagaacctgagcgaggagaagcctngccgccaacgtggcccgctcaaggnctacaaaggagcgcctcatcctctgcccgcaagtccaacgccccnaagaagggtgacaccangaccgacgtct

SEQ ID NO: 7523 - DNA, 588 bp, Tricoderma reesei
  misc_feature (1)...(588): n = A,T,C or G
atccaggcctggtacggcggnaacgagacgggcaactccattgccgacgtcgtctttggcgactacaacccctcgggcaagctgtccctcagcttccccaagcgcctgcaggacaaccccgcgtttctcaacttccgcaccgaggccgggcgcacgctgtacggcgaggacgtctacgtcgggtacaggtactacgagtttgccgacaaggacgtcaatttcccctttggccacggcctgtcctacaccactttttgcctttttccaatctcttccggggtcttaacaanggacggnaaagcttgaagccgtggttccctnttccgnggaaagaaacaaccnggcttcngtgccccnggcgcaacaaggtggggcccaagcttnttacgttaaagccnccttccnaagccgggccaagaaatnaanccggccccgttcaanggagcttnaaaggggcttttcgcaaaagggtcgaactggcaagcccccgggggaaaaacnaaaggncgggngaacaattcganggagccanggaanaaagtnccgttcncttgnggtatttttggatgnaaggaagccggggaatca

SEQ ID NO: 7524 - DNA, 768 bp, Tricoderma reesei
  misc_feature (1)...(768): n = A,T,C or G
ctatctccttcgtcctctccctacttgacacattcttccttctcctgccgccctctttttccggcttgcgcagctctcttcttcgccctccgccgtcgccgcatcgactctcaatttccagtttccaggcagtcgcgcgtctaagccacagcgtcgttctgtgtcgcaactcttgccaacatgtcggaccatgagtttggcggaagcaacgatgacctatcgctgccaaagctaccgttcagaagattgtcagcgaaatattgccaccgcagacaggcgtctntttcgcaaggaggctcgtgacctgctcatagaatgctgtgtcgagttcatcaccctnatcttgtccgaggccaacgagatcttngagaaggaagcgaaaaagaccattgcctgcgaccacataccaaggcgctagaacgcctgggcttttccgactacgtgcccgccgtgctggaggcggcggccgaacacaaggaaacgcaaaaggggcgagagaaaaaggcagacaagtttgccaacaagcgggctgtctatggaggagctcgctcggctgcaggaaagcaattcgncgcggncagacagcgccacacatgatggaatttgcttttttcttttttcttttcngtgatattgggggggaagaaggcgtcacacggtgggcattactaggcgttttatacacggttggtganggttggtaaggtaacaggtcagacttttttgatttgggccttcattccccggagtnggttnttaagttatatt

SEQ ID NO: 7525 - DNA, 729 bp, Tricoderma reesei
  misc_feature (1)...(729): n = A,T,C or G
aaggcaattcctctgggctccatcaaattcattggtacctccacagcgcaggatgactggttctcactgggcatcggatctccgcaggaagcagaccctcttatgaactgcgtgttcaagacggaaatgtttacccagatgcagcgtgccatgccgggaggcttcaacctcaagatcggcgagacgattgaatacgcaaagaagccgggcaagatgcagcangtcaaggttctcaaggactctcagcagcgggctgactactacaagagcggcgcgatccacacgcagccaggagagcctccaaattcggtatcaaagccgatgcccaaggccaagcccgtgccgccgcggccatcaccagaggcaagctcatcaagcccggtggtncgggaggcaggccgtccagaatcaccgccacccgcaacactcagccgagatcaacgggcaccggtaccaggagcgttctccgccgccgccgttcttggtggcatagtatcggatcatcatcggcctcatcgaacgcgggcccgtcggcaagcacaagcacattgagctcgtcgacgcatcaaatccccgttgtcggaaatgccataaccggtcnaacagcccgccagaaaccagtcaggcagcgctngacgccgcttcttcgccgcccttcttgnccttctgntgttaagccaanatatggccaagngttatatnattctccngccagaaggaaacgacttg

SEQ ID NO: 7526 - DNA, 471 bp, Tricoderma reesei
  misc_feature (1)...(471): n = A,T,C or G
gacggcaatcaggtgggcgtccaccaccctcttgctgctgccacaagcggtgctgcagctacaattgccagcgatgctttcatgaatccattcgacgtcatcaagcagcgcatgcagatgcaagagtctcgcaagatgtatcgctccatggtcgactgcgccaagtacgtctaccgaaacgagggcatcggcgccttctacatcttctacccgaccacgctgtccatgaccgttcccttnacggccctccagttcctcgcctacnaatccatctccacccgcatgaacccgcaaaaagcatacgatcccgtcacgcactgtntcgcccggancccgttgccggtggcttcccgctggtctgaccacncccatggacgtcatcaagaccatcctacaaacgagaggcacgttcttcgacccccaagtncgaaacgtcagcngcttnattggaangctgcaagctgctgtata

SEQ ID NO: 7527 - DNA, 776 bp, Tricoderma reesei
  misc_feature (1)...(776): n = A,T,C or G
tcatgttcnctcgctcgaatccagcgcagggccttctctgcctctgcccgcaacctctccaaggttgctgtcctcggcgctgccggtggcattggccagcctctctctctcctgctcaagctcaacacccgtgtcaccagagcttgctctgtacgacatccgtggcaggacccggtgtcgacgccgacatcttcacacggtacaacaccaagtccctcgtcaagggctatgaggccactcccagcggcctcgcacgccgccctcaaggggctctcgacatcagtcactgatcctccgccggcagtacttcccgcaagcnccggcatgacctcgtgacgacctcttcgaaaaccaacgcctncnatcggtccgaaaccttgaccaaggctggtgcccgnagtttcccccccaaggccaagctgctcatcatcttcaaccccgtcaacttcacgtcccatctgcgccgaggtcttnaaggncccgcggcgtctacnacccaagaagctntttcgcgtnccaccctcgacgtcgtccgcgccagccgtttcgtnttcganatcaagggcaccgaccccaaggacgagaacataaccgtcgtcgggggcaattccggggtnacattgtccccttttnagcaaaacaancaccccgagctttcttcaacgccgagcttgtaaaccgcgtcantttcgnggggacaaggttttaaggcaaaggacggggccggttccncaaccttttcatgggcttttgccggggccnatnggccaattttt

SEQ ID NO: 7528 - DNA, 645 bp, Tricoderma reesei
  misc_feature (1)...(645): n = A,T,C or G
cttgcgcagtgaatcattgttccacggatacgcaaactggggactgcatctcttacgtcggatcaccttgggcaacaggcgaaactacttcaggccagatcaaatcaagatggcgtcacaattgctacccctcgaactcatcgacaagtgtgtcggatctcggatatgggtcatcatgaagggcgataaggagttcagcggcaccctcctgggctttgacgactacgtcaacatggtgctggaggacgtgacggaattcgactacaccggaaaccacacaaagcttcccaagatcctgctcaacggcaataatatctgcatgttgattccaggaggagaagggccagtcggtgccacggcttaaggatatcatcgggtcacgcatatctcaagtgcatgccggatcaccatggaaagcgaacatccctctacggcatatgccatgcattgtggcgcgcagcgcgcatgctgtgactggactactgcggttcggcgaagattgaacaagttttatcttgttggggcatatccagttccgtgactggtttgncttaattctcattatggcatactgnatgttttaagtagaataaaaacatntaacgaaanttattctccgcggctnaaacgatgccgaaaaccatt

SEQ ID NO: 7529 - DNA, 346 bp, Tricoderma reesei
  misc_feature (1)...(346): n = A,T,C or G
nttntgcgccctnttngacgccnagaagctgtctatctgcggtgaggagagtttcggcaccggcagcgaccacatccgtgagaaggatggtctgtgggccatcgtcnnctggctgaacatcatcgccgncctgggtgtccagaaccttgaggttacccctttnatcaagcagatccacaaggacttctggaancagtacggccgcncattcttatcagatacngactacgagaatgtngactntgtnggtgcnaacaaggtcgttgggcnagctttgangcttttggtanaaggaccccaaattttgtngggccaagcnaccatttggtgagccggcactcgttat

SEQ ID NO: 7530 - DNA, 684 bp, Tricoderma reesei
  misc_feature (1)...(684): n = A,T,C or G
gngnacatacggaacgacgccaaagcccgcttctccgtcnccagcggcctctggggccagattgccaacttcgccttcatccagctcgacgtcatgcccaagctctggtcctggaccggcgacctgctgctccggtacgcgcccgcgcgcttcacgggcgagatctcgcactccatcgtcttcgtcttcgccttcatgctcatccagcaggggctcagcctgccgacccgcatctacagcacctttgtcctcgaggagaagtttggcttcaacaagcagacgcccggcctcttcatctccgacatggtcaagaccaacctgctcacggccgtcctcatgcccccgatcctcgccggtttnctcaagatcatccagaagacgggctcgcagtttgtcttctacacctgggtctttactgccggcatccagctcctgatgactaccctctaccccaccttcatccaaccctgttcaacaagctctcccccctcgaggacggngagcttcaagaccaangtcaatgaattggcgggccgcttcaagttccccctgcacgaactgtatgtcattgatggtagcaagcgcagncntcacttcaacgcctttttctacnggcttccgtggaaagaagcacattggtatnntacgataccgctttttggnaaagttcgagncttgaagagg

SEQ ID NO: 7531 - DNA, 903 bp, Tricoderma reesei
  misc_feature (1)...(903): n = A,T,C or G
cacaaaccaacaatcacaactcacgcgcacaaacgcttcaaaagcctcaacaaccactcaaaccacacactctaccacacaacaacaatcaaaatgtctctccgcaacttctacgctcccgagtcctccttcactcccctcttccgactcctggaggacttcgacaactacacccgcgaaaacagcgacacccagagctcaacccgccgcacaatcgcccactggcagcccaagttcgacgtccgggaaaccggcgaggcctatgagctgcacggcgagctccctggcgtgaacaaggaggacgtcaccatcgagttcaccgacgagcagtccatccagatccgcggcaaggtcgagcgcacctacacggccggcactcctcctgccggcgccatcacggaatccggcgagaaagagaacaaggagggttccgacaacaagagccaggtcgctaagtccggctcgcccaagcagaagcccgccgactctgccaaatactggctcactgagcgcagcgttggcgagttctctcgctccttcagcttccccaaccgtgtcaaccaggacggtgtgacggctagcttcaaggacggcatcctcagcgttgtcgtccccaaggcggccaagcccgagcctcgccgcatcccgtctcttaagaagctccacgaagcatttcatctacgttttgtcactccttacttaacggatattggtctggaggaggaataactgcatggaagtggcgtttgtaatttcaagttctgcgatggataccccttagtgtaaaggggcgagaaatgggttttgtcngagttgcatgtttggtttgagcgtctttcacctttaacgatatccaactctgttagtcgactaatagagcattaatttcccnaaaaaccaacc

SEQ ID NO: 7532 - DNA, 893 bp, Tricoderma reesei
  misc_feature (1)...(893): n = A,T,C or G
ctcgtgcttctgcagctcaggcatcgattgggtctgcccacgctgtcacgatgtttctcacgctgggtctggccatgctcctgacagcgacggtctttcttctcggtaccaaggcccagccttccgttgccggcatgatatcaccaaaagtcatgatcgtatccatgcccgaagcccaggtatggtacgacaactttccccagtccggcctgggcaacctcacctcgcaagccatcgccgcccaggcctctccatgctctttccatgggtcttttgtacggagacaggcagcgtctgtcagatgaccgtcggcgaaggtgaaatcaactcggccgtctccatgaccgcctcatcctctccggcagcttcaacctgacgcagacgtactttctcctggccggcatcgcaggggtcaatcctcggtacgcaaccattggcagcgcggcctttgctcgatacgctgtccaggttgctcttcagtacgagattgattcccgatctctcccgacgactggctacgggctacatcccctatggccgngcccatccgtttgagtatccctgcatcacatacggcacccgaggtcttcgagctcaacgtggacctgcgagacgcccgccatgccctttgnccaacnggcacagnttttagaccnaccgcgacccgaaaagataccgncttctgttttcggacatgggcgccgtcgnacaanacggccgtgatgcccccagcgtggtcaatgcgaaagcgccacaagggacgtntactattngggaggccggntgngcaagcttttgaaaaaactaacggccttgtggaccaanggaccggcgngtattggattgacccccagaaggacaatgnnaccttgaggngttgtgccggcaancnt

SEQ ID NO: 7533 - DNA, 968 bp, Tricoderma reesei
  misc_feature (1)...(968): n = A,T,C or G
aggagctggacaaggccaagttcgagctcgaacaagcgcagagaagcggcaactttgctcgagcctctgagcttcgcttcggcgtcatccccgatctcgagcagaaactgccgtccgacaaggaaattcagcaaagctctgacaacagcacgctcatccacgactcagtgaccgccgacgacattgccaatgtcgtgtctcgcatcaccggcattcccgtctcgaagctcacttcgggacatattgagaagcttgtccacatggaggacattctgcgggaatccgtcaagggacaggacgacgccatcaaagccgtcttccaacgccgtgcggctccagcgggccggcctcagccggcgagaaccggccccctnggcctaattctttcttccttcggacccgacttgggcgtttgggcaagancnggagcttngggcaaagaaaagcttgggcccaaacttttccttctttctctggaanccggaaattcagccccggtcggttccngggttctggaacattgggtcggggaaatttnccaggagaagcacaccatctctcgcctcattggcgctccgtccggctatgttggatacgaagatgctgggcagntgacggaagcggtgcgtngcaagccgtatgcggtccttttgttcgacgagttcgaaaaagcgcaccgcgacatttntgctctgcttntccaggttctcgacgagggttaccttnccgatgcgcagggccacaaggtcgacttcangaacaccatcatcgtcctacctccacctgggagcngatatcctcgtcggccanaaccactgcaccngtacaaggaggacgcccaacggcgacattgacccatcggtccggcaagcaagtattggacngtggtcggcgtccgnttacccgncagagnttctnaaacngattcgactccttcatnatctttnaaagcggcttggccaagaagc

SEQ ID NO: 7534 - DNA, 785 bp, Tricoderma reesei
  misc_feature (1)...(785): n = A,T,C or G
nnatggtcangctgaacaagaacctntcctcctcccggagcaagagccgtgccgctcacttcaaggccggctccggccagcgccgtgtcatcatgagcgctccccttagcaaggagctgcgcgagaagtacaacgttcgcagcatccccatccgcaaggacgacgaggtcaccatcgtccgtggctccaacaagggccgtgagggcaaggtcacctccgtctaccgcctcaagtacgtgatccacgtcgagcgcgtcacccgcgacaaggccagcggccagagcgtnccctgggcatccacccctccaacgtccgtcatcaccaagctcaagctcgacaaggaccggtgagaagcatcctggcccgctccaaggtcngccgtgagctccgcgtcccaacaagatctctgcttaaatcttctctgatttaagcggatgaatctgggagcaaaaagaaaagaaaaaactggttgagacgangagatgaacactttttttttcgacacgaaacacactcaacacaggggggtttttttcccccatgtgatgcattccacggcaaacaatgataccggggcaaggaaatgggcacaaattangtatattcccggcgtttttaagcgatnccccgagncccaccacttttttcanctgcaggtcggcgcggganttttttnttcaagcngggtagatcgaaccaaattcganaattttaccaattctnnatgggccgtttcnccaactttgccgttggggngaaatgctccatggganggggttccccga

SEQ ID NO: 7535 - DNA, 769 bp, Tricoderma reesei
  misc_feature (1)...(769): n = A,T,C or G
ngccgcaaagccgccgcccttcacggcaagggagacttgctcggcgcaaacgatgcctacgagaccggtctcaagcacgaccccgacaatgcgcagctcaagagcggcctggcctctgttgagaaggccatgcagcaggaagctggcggcggactcgacccgactggtggcattggcaagatgttcaaggacccccagctgatccagaaacttgcctccaaccccaagacgagctccttcctggccgaccccgccttcatggccaagctgcagcagatccagcagaaccccctcaactcccaagacctctttagcgaccccaggatgatccaggtgctgggcgtcctcatgggcgtcgacatggagatgcgggacaagcccccctgagggcgcccagacctacaatgtgtccgaagatacacccatgcctgacgctcccaagaagcagccgagcccaagaaggagcccacgcccgaacccganccgttcgacgaagangcgctggaaaagaagaagaagaaggaagaggccgacaaggagaaggcgctcggcaccganaactacaagaagcgcaactttgacccgcatttgagcactacaagcanggctgggagattacaaggacatnacctacttgaacaacctnggngcgggcttatttgagaanggggantacgacaagtgttttgaaaacttgccaaaaggcctttgacganggncgacagatntacccgactttaaacttattcgccaaancttccncccgatt

SEQ ID NO: 7536 - DNA, 641 bp, Tricoderma reesei
  misc_feature (1)...(641): n = A,T,C or G
caaagtgcatgtgctcacggaacttcacttttgcttcttctctcaaactccaaccagcttccggtagctgctgcatcgccatcttgcccgtctgcagtccgtctgctgtccccctgaacctcccctgcatcaccaaaagacatgtcgtgcccgcatctcgactctgtcgagctcaagccgccgactcccgcccagtcggtgtacaaggaagactgcacgcaatgcttcgactcgattgacagccccggcggcctcgatgtctgcctccagtgcttcaacggtggctgtaccggagatagggagcactcgccgcttcacaatgcagtctggagtcacccgcttgccctcaacattcgccgcactcgaaagacggttcaccgcgatgaaccacctgccaagatgacgaagctcgccatcgccgncgagaccgaagaagatcgatacgacactgccctgaccgcaagtgcatcgagtgccaaaaggagctggacctgacaaacgccaagttggcccccgtagtcgatggcattctcaaggcgcacaccttctcgcgaaaggaagangtgaaggcgtgggagcangagctcacgacatgtgagcacatctgaccttgcagagcacccaccccgcaagatcgagca

SEQ ID NO: 7537 - DNA, 724 bp, Tricoderma reesei
  misc_feature (1)...(724): n = A,T,C or G
cattcgtactccaacccaacagccctctccttgtgagaatcccagccttttcatctacatcgcgacaaccagagacagcgcgcgacaacaagagagaggacacaagcaaccatggcgtccacggcgaaataccagcccgccccccagcaggaacccgacgacgactacacgcaagcaccgcccgcctacggcaccgcagcgtcctcgtcgcaccacgatcctggcctgtttgctgagccgcgcagcagcgacgacaacatccccgacgacttcaagtttggaggctctgtcgccgaagccaccgtcgacatccgcaaccagttcgtccgcaaggtctacagcatcctcaccgtccagctcgttgcgaccgccgccctgagctccatcagcttnttcaagcgatgcgtacaagtcgtggatccagagccaccccgggctcgtttgggcatctttctttggcgccatgatcttcatgggcctcacctactggaagcgcaaaatcgtatcccacaaaccttcttcttcctcggcctttttcacccttcacaagaggcctacttccattcttccgtcaatcgtctccttcttaccaagaaccttccattcgtccttcaaacggccaccgttcttnaccggccgggaatttttcgtcntttcctcaacccttntttcggcctggccagnacaaaagttaccgaactttaacncttnatggggatggccc

SEQ ID NO: 7538 - DNA, 499 bp, Tricoderma reesei
  misc_feature (1)...(499): n = A,T,C or G
gcttataccgagttcttcttttttttctttcttcgtgtacattcacagccgcaaccatgattatttacaaggacatcatcaccgacgacgagatcatctcggactcgtatgacctcaaggaggtcgacggcatcgtctacgaggccgactgcgccatgattaccgagggcgccgtccacgtcgacaccggtgccaatgcttcgccgaggaggccgaggagggtgttgaggataccgaggtcaaggtcaacaacatcgtccactctttccgtctccagtccaccagcttcgacaagaagggctacctgtcctacctcaagggctacatgaaggctgtcaaggccgccttcagganaagggtgctttcccccgaagaccattactgcctttcgaagaagggtgcccagacctacgttaaaggagaancctggttgcccaaacttcaanggacttttgagtttttacacttggcgaattccantgaacccccgatgggaaag

SEQ ID NO: 7539 - DNA, 764 bp, Tricoderma reesei
  misc_feature (1)...(764): n = A,T,C or G
cgggaagtgagcgacatgctctccaacgtcgagtacctcaaacgctctcttgagcaatgcagagaggtgatcgtggcatcgctgcagagcgagagggcccgcgaaggtgccaagccaccaaagggtccttacgaagaagaccaagacgtccccatgtatggagactccatcaagccaccatatggcatgacggaagtcaaaaagcgccgagggcgcgctgctcctcctggccgatgccacagctgcaatcgcatcgacacaccagaatggagacggggacccgatggtgccagaacgctgtgcaatgcctgcggcctccactacgcaaagctcgagcgtaagcgccagctggaagcaagggcattacgccctaagcccgaggagcgaagctagagcgcggctcgcattcgagagcctcgacgagatctttgcatccttttgcaccgtgcttcctgatccttgcaaggcgtggggactctggagcagcgagcgcattcatgatcccaagaaacgatgaacattttctgagtcaaagaaaccaaaatcttttgcagatcaaaatacccatttcatttattcgagggcctcgcattgagggttttactggacatgtgtctttttgaatgccgggatacctttcttttcggcttttctttcttaccctttttcacttggacttggggcggnacattcgccagggcattgcanggcgttcacttatatatacaccatatatacctccaaggctctngggcaactttttc

SEQ ID NO: 7540 - DNA, 530 bp, Tricoderma reesei
  misc_feature (1)...(530): n = A,T,C or G
gagtcatcaagactcccggcggcgacctccgagttcttcacatcaagaagcgcggcactgcccccaagtgcggtgactgcggcgccaagctccctggtgtccccgctctccgcccccgcgagtactcccagatctccaagcccaagaagaccgtccagcgcgcctacggtggttcccgatgcggtggctgcgtccgtgaccggattgtncgcgccttcctgatcgaggagcagaagattgtcaaagaaggttatgaaaggagcaggagggcgagccagaagaagaaataaacaaacattttttcccaccacttagacaaaaaaaatattttcgacttgatggacttggctttctgtgcgggatggcaaggaactcttgggggtttggttcattggtttggtgttcattagggcaaaaaccggactgcatgaaacattatggccganccancccatnggccggtctgntgctgtctttaaggacttgctttcctcttgggggatctaatgggaacgaacattcaagttggn

SEQ ID NO: 7541 - DNA, 548 bp, Tricoderma reesei
  misc_feature (1)...(548): n = A,T,C or G
ctgcccaagacgctcaagtttatgtgccacaacggcgccggctacgaccaaatcgacgtccaggcctgcacagcccacaacgtccacgtctccaacacgcccacggccgtcgacgccgccaccgccgacgtgaccatctggntcntcatcggcgccctgcgcaacctgcccattggcatccacgccctgcgcgccggcaagtggcggcggttccccgccgcccgccttgggccacgaccccgagggcaagatcctcggnatcctgggcatgggcggnatcgggccgcaacgtcgccgaaaaggcccgcgcctttggcatgagggatccgntaccacaaccgtcccgcctgagccccgagctcgaaggagggcgccgagtacgtcgatttcgagacgcttgttccgggagagcgatgtcctgagcttgaacctgcctctcaaccctagcacccgccantccatcgccgccccccaattcggccntnatgaaagcccggcattcgtcatcgtnaaacacccgcccgggggngccggtnatgggacgaagg

SEQ ID NO: 7542 - DNA, 667 bp, Tricoderma reesei
  misc_feature (1)...(667): n = A,T,C or G
gtctcctggtctgactaccatcacctctttggcctcaccctcgactgagcagcttgacgagcctcagcaccttttgggaccctcaattgcccgctataacatctcttattcctctccctagcagggccgttatcccctctcccctctccgtcaagccccctctgccgccctcactttcaaaatgatgctgtccactcttcgagttgcgagcaggcgagctgtcgccctgcgccctgcgaccctgaggctcaccagccgtgctgcctgtctacctggatcaacgttccccagggccctcctgatgccattcttggtattaccgaagccttcaaggccgacaagttcgagcagaagatcaacctcggcgttggcgcataccgtgacgatgctggcaagccttacgtnctcccctcggttcgcgaggccgagaggaagattgtcgacgccaagctgaacaaggagtacgccggcataccggtgtcccgagttcccccctctggccgcaagttggcctacggaccaaccagtccgtcctcgaccgcgttggcattaccagacatctccgnaccggtgccctgcgcgttggtgctgccttcttggagcgcttttactnngggtgacaagaagatcttnatccccaacccttgggggccaaccacaaagggcg

SEQ ID NO: 7543 - DNA, 471 bp, Tricoderma reesei
  misc_feature (1)...(471): n = A,T,C or G
gtgcggcccctgcgcgcccgctacaaccccgagatcggcgacctggtcgtcggccgcatcgtcgaggtccaggccaagcggtggcgcgtcgacgtcgccgccgcgcagctcgccatcctgcaaatctccgccatcaacctccccggcggcatcctccgcaagcgcaccgagacggacgagctccagatccggagcttcttcgccgagggcgacctgctcgtcgccgaggtccaacagctgcaccaggacggngccgcagcctgacacgcgcagnctnaagtacgggaagcttcgcaacggcgtgtttgtcgccgttnggggcacgggaggaagcgcccgcgtggtgcgcttcaagcgccaacttgtggaccatggaanacggcaacnggcgggggaaaaattgacgttttgttgggcgtcaacngatacattttggatcaacaagcacgtggaaaacgaacttttggncga

SEQ ID NO: 7544 - DNA, 701 bp, Tricoderma reesei
  misc_feature (1)...(701): n = A,T,C or G
gagccatcgcgacattgagacgggtcacggtcgaggaagacttttactaacgcaactctcgcaaatcacatcgaaacttcaagatgtcgtcgggaaaagtcaagactgcccagctctggggcaagaacaaggaggagttggccaagcagctctctgagctcaaggctgaactcggccagctccgcatccagaaggttgcctcctccggctccaagctgaacaagatccacgacctgcgaaagtccatcgctcgtgtcttgaccgtcaccaacgccactcagcgaaaccagctccgcctcttctacaagaaggccaagtacctgcctctcgacctccgccccaagcagacccgtgccatccgacgccgattatcacctgaggacaaggcccgtgttctggagaagactaagaagcgcaacacccacttccctcagcgcaagttcgccatcaaggcctaaatgttttaattgtgctttggaatgcgaagggacgtctgggtagaatggggcattgaggcgcagcatgctttttccacttgaacaacagggctcgaattgcatcgcatggctcaagggggaattcggtctgaattggacttgcttttcccggttgggcctcggtctgggacgggaggcgtnctggatggctggctaggtcgacagtctataccaacaaaaaaaatgaggcacgatctacaaaag

SEQ ID NO: 7545 - DNA, 496 bp, Tricoderma reesei
  misc_feature (1)...(496): n = A,T,C or G
accacatgcaatggcgagcccagcgtcaagtatcggggcatcttcattaacgacgagtgccccggcatggacagctgggttcatgaaaagtttggtcccaagtttgatgccaacttttaccactacgtctttgagcttctcttgcgcctcaaggcgaatttcatgtggccggccatgtggcgaggatatccgtatcccggacgatcctttttcgtggatgaccccaagaaccaggagctggccgatacctatggcattgtgattggcacctcgcaccatgagccgatgcagagggccatgaacgantggtccactactcagcccgaangcacctggaactgggataaaaacaaagaaaagatcacacagtntttcgaagaangagcccagaaggccgtgccctaccagttctactttaacatggggatccaagcgaaagcgaatgtgcccatnaaaaggaggcgatcccgntaagatcctncccgaagtgctggat

SEQ ID NO: 7546 - DNA, 878 bp, Tricoderma reesei
  misc_feature (1)...(878): n = A,T,C or G
cgcgcgccgttccgagggaagagagcgcagtccccttcccaccaaggaggagtctcccgagacaaagaaggctccggtggatgctgctgccgccgccgccgccgctgctgccaagatcaacgcccagctgcaagctcgaaaggctcctcagcatgtcgacgtccccccgatcaagtcctcaagcggaacccctgccgacggcggcgatcaggagatgaagaaggagatgtatgttgccgatggcgacttcatccaagacatcgaagtcaacgacctgcgcaatcgctacttgttgaccaagggctcgacccaggaaatgattcgaaatgaaaccggtgccgacgttacgacccgtggcagctattacccaaacaaaagcatggccactgcggcgaaccctcccttgtatctccatatcacgagtacaaccaaggctggccttgaagccgccgtggaaaagatcaatgagcttatcaagcaagagctccctcaactggtcgacgagcgtcgattccgacgtcgagatcaggagcctcagcccgccagttgagcgagacgaatatggtcgacggaaatggcccgaggagaagattcccattgacctcgaacctgttcacgggttcaacctgcgagctcaggtagtcggtcatggcggtgcctacgtgaagcacattccaacaagaaacccggatgtgtgtncagatcaanggccggcggttccgntaccttcgaacancccccattntgagaccgatgagaacatgtttcttcatgtcaccggaccttgcccaaacatggttgcaaaggccaaggacntttgtganggatctgattgccacgtncaanggacaatacnaggatttaaaggcccttccccg

SEQ ID NO: 7547 - DNA, 873 bp, Tricoderma reesei
  misc_feature (1)...(873): n = A,T,C or G
ccccacagaaagccatggacggggcgacgatatgatccaagctcccccggtagcagcccgtacttctgggtccagttcgtcatgaggcgtgtgcgtgctcgataacggccattcgagtacataaataatggtggccctgcgtcacctcgctcggccgtccttgctctccatctctcctcgctgttcacgaatatcgcactcgattcgctcagctcaacactcgattcacaacccaattcaccaccaccactactccccccgattcttcagcatcacccgcaaacatgtcttccggaaggaccgtcaccctcaacaccggctacaagatcccccagatcgggttacggnacctggcaggccgttcccggcgaggtcggcgctggtgtctttgaaggccctcaaggttggctaccgccacctcgacctggccaaggtctacggcaaccaaaaagangttggtgagggcatcaagaagntnttggttgaggtccccggnctgaacgcgangatatttttcatcacctccaagtgnggaacaactccacaagcccgaggacgtcgagcccgctnttcacgacaccttggccgacnttggcctcgactaccttgacctntacctnatccactggcccgttgcctttgttccggcgcccnactntttcccaagtccgaggaccggttcgangggcaagntnaaacaagaatgngtcctttgnccaaaactggaanggcatgaacccaactggccaaaatccaaggtccgttccgcgggggtttcaactttaccattgaacacctcgncccctnattgaaggcccccggngtgtcccnncgtaaaccaaaacangcgcaaccccgcttcccaacaagcct

SEQ ID NO: 7548 - DNA, 528 bp, Tricoderma reesei
  misc_feature (1)...(528): n = A,T,C or G
ngccnatctncgccaaggcgcagggccncttatgtgnaccacatnatcaacctngacaagctgaggtcactcntccccaccgagacccgtaacgcctacgtctccggcgagaagaaggacaccgtccccgtcctcgacctcctgcccctgggctactccaagctgctcggcaagggccgcattcccgaaatccccctggttgtccgcgcgcgatgggtcagcaagctcgctgagcagaagatcaaggaggctggtggtgtcgtcgagctggttgcgtaaatggcatttgaaaaagaatcaacatgctggtgtgtgctggagtaaggcttgtggatttggaaccgggcactttttctcaaaggtggaaaatagaaatcccttcgcctttcaaccccaaatgtataccgagacaaagtggtcttctttttttggggaacaagaagggattggggttggtcggctacgaacattgcatcaggggactctttaacggagtttgttaacgaatgaaaaattaaaaaattcgcc

SEQ ID NO: 7549 - DNA, 615 bp, Tricoderma reesei
  misc_feature (1)...(615): n = A,T,C or G
ntaancgcatcancaccaccaaaaatgactggcaccatccaccacatcgaatgcgtggagcagctcgacgccctcctcgcctccaccacctacgtcgccgtcgacttctacgccgactggtgcccgccctgcaaggccattgcccccatctaccagaccctcgccgacaagcactccgtcgacaagcacctcgcctttgcaaaggtcaacgtcgaccacgtccaggacgtcgccgcccgctacggcatcaccgccatgcccaccttcctcttctttaaggagggccagcaggtcgccgtcaacggcaagcccatgatccagggcgccgatcccaagagcctgggtgctgccgtcgagaagctgagcggactggcgcagaagagggtcgaggaggccaacgctgcgtctgcttaagcgacaacagtttctgggtggacgataagccatctnaaacgacgatgaagaacaaaatgtgatagggttatggaacatagaggggggatatttatgcaaatataggcgcatgggactatgtcatggcaatangcagagcggncttcttgcaatttcgaattacngtatataatctttattcacaggattactgngaaaaaa

SEQ ID NO: 7550 - DNA, 1090 bp, Tricoderma reesei
  misc_feature (1)...(1090): n = A,T,C or G
caagcaaacactttcagccgacaacaccacaactctttccaccaacgcactctccactactcctctaccactcttcaacaacaacaaacacacacacacacaaatccgcaacaatggcattcttccaccctcacaccttctaccaccccaccgagtcctcctcctcctccgcctccttcacgcctctcttccgcctccttgacgactacgacaactacagccgccagactggcaagtcttcatcatcgtcaacaacagccgctgcgccccgccgccagcagcagcagcagcagcaccagcagcaggtgccccagtggcagcccaagttcgacgtccgcgaggtcgactccgcctacgagctgcacggcgagcttcccggcgtcgccaaggaggccgtcgtcattgagttctcggatccccagacgctgctcatccgcggccggtcggagcgcacctacacggccggcacatcacctactgagagcaacaacaacaacaagaagagcgtgacagaggaggcttcttcgtcttcctcgcggaggaactcgtacaaggctaccgtggaggacgaggacgaggccagcgagcgcgagtcgggctacgaagtcgtcaccaccacgacggagaagaacaacaagaacaaggaggagaacaagaagcccgtcgacaaggccaagtactggcttaccgagcgcagcatcggcgagttcttgcgcagcttccactttcccacgctgggtggaccacgaggccgtcagcgcgagctttaacaacggnattctgagcattgttgtacccaaggcgaagaaancttgaggctcgtcgcattcagatcaactaagaaagggaagcaaaggatcgatggatctgcatttttataaacgaccaatggaaggatatgcgcacttttttgatttggcaggatggaaatggtaccggacatacttcgggattagcatatgataccatgcttgtcttttttctttgctcttttggggatttgccatagggagtttggaggatatattttggacttggggatcaatagaagatcattaatttcaaacanatgggataattttntgactgg

SEQ ID NO: 7551 - DNA, 895 bp, Tricoderma reesei
  misc_feature (1)...(895): n = A,T,C or G
ctgatgacgacgagcccccacgacgttaagacgacgacgacgaaccacgaacgccccgatagacggcctgtcaaatcttgcagtctctttacatctgaaagcgacttgagatcctccgaaacggttgagccgaaccggaacaagctgtatcgaatagtgtcgctgctgccgccatggaagaggccgcgcagacacagcccgctcccggagcgctgagttggcggctcagttcgcatcctatcacgctcttgacgtttctgggctttcgaatatcgagcgtgctcatatactttcttggattatggatcatcaagagcatgatcatgatcttcatcatcacaatcctcctgctcgccgccgacttctactacctcaagaacattgcgggccggcgcctcgtcggctccggtggtggaacgaggtggacccgcagacgggcgagtcgcagtgggtgtttgagagcctggagccgggcacgcggcagatcaatgcgacggacagccggttcttttggctggcgctgtacattcaacccgctgtggtgggtgctgatggcggtgcttggcgcttattcggctgcaggtttctgtggctgcctcttggtgcgattgcgcttgtnttaccattatnacacgctggcgttttnccgttgcgacaagnttaaccaggcgtcgaatttcctggaggcgctttttggtcacnaatttggcggcaacattgcgagcacttttgtgagccncattgttcaggngtaanaatgccccgggggaaaattccatgaaaatgaacggcnnggggggggggggggnggggaaaggggggaaangaacaaggggggggcccttttccnccaggggaaggntggnttttggttggccccttttcctggggtgnn

SEQ ID NO: 7552 - DNA, 710 bp, Tricoderma reesei
  misc_feature (1)...(710): n = A,T,C or G
gctggtcgtgaaatgacgcttcactttgagactttcgagactgtcgctttcgccgtgtccgttttggtcgtcacctacaccgtccaggatggcaagtccaactatctcgagggcgccatgctgctcggcctctacatcatcattgctgtcgccttctttgctacgccaggtgactttttggacaaggcaacggacctcgtcactggtggcaactaaaagccgagcgtcgaccatcatcatacaagtcgaatactaccatcctcggttggggatgatcactaccgacccgagaagaatacggccgtgacctgtgccgctatacctaaccacataacatctaccacctcatggacgaatggacgatccatattcaccaatcacaccaccgagacgaaagctcgagccgaacgtatcctgcttgactccccttttctatctatccgagtccttgtacaattattttcatgtctcgctgcaaacgcgaagaagctatttgatgatgccaaggagggaaaactttgcttgcttgatgtgacggaacaaaacgtgtgccccaagagcggggagacaaaactttcctgtgttcgtgcggcaagtccccgaagcgagattcngggaaattggggcaaacngatggcgtcgagtctctgcatgtttgattaaaaagctacnaactttgctttaaaagataatgatgacatttttcttgn

SEQ ID NO: 7553 - DNA, 523 bp, Tricoderma reesei
  misc_feature (1)...(523): n = A,T,C or G
tcgggcctcctgggggcggccagcagcgcggccaacacggtgcggccggaccggcagacgacgtacctggagaacatcaagagccagctggcgcggcccgtcttcacggccaacctcaagaagggcaagccgggcaactacaacttcgggtacatcaacggctccgagtacatcggccccatccagtacgccgccatcaacccgtcgtcgccgctgtgggaggtctccgtcaagcggctaccgcgtcggcagcaacgaacacaaaagtacgtgcccgcgcgtgtgggaacgccatcgccgacacgggcaccacgctgctggtcgtgcccaacgacattgtcaagcgcctactacgcccaaggtcaangggctcgacgttcagcaacgacgtcgggatgatgctcgtgccctgcgccgncacctgcccgactttgctttggctggcaataccgnggggtatcccnggttgtnataactacggccgatgaacaanangtactgttcggnggnatcaatcgtccga

SEQ ID NO: 7554 - DNA, 896 bp, Tricoderma reesei
  misc_feature (1)...(896): n = A,T,C or G
tcgtcggcatcgcgaggaacacgattgacaactttctcgacttcatcgagaggttcggcttcgtccccaacggcgctcgactgtactatctcaaccgctcgcagccgcctctgctgtcgagaatggtgaaagtctacatcgaccacacaaacgacaccgccatcctccgccgcgctctgcccctcctcgtcaaggaacacgaattctggacgaggaacaggaccgtcgacgtccgcgtcaacaacaagacctacgtcctcaaccagtacgccgtgcaaaacacgcagccccgtccggaatccttcagggaggacttccagaccgcaaacaaccgctcctactacgccgcctcgggcatcatctacccagcgacaaagcccctgaatgagtcgcagatcgaggagctgtacgcgaatctcgcgtcgggcgcggagagcggaaacgattacacggcgcgctggctcgcggatccgtccgatgccatgagggacgtctatttccgctccgcagctcaacaacaaggacattggtcccgtcgatctcaactcgatcctntacggnacgagcttgccatcgccaattctacaaccagacgggcaacaccacgggcgcccgcgaatggagcaatctcgctggcnacangagcgctttcattcangccgtnttntggaacgagacgctntttangtactttgactacaacttacttggtncttgcaaaacatttacgtcccgttgacaaggacccggggcttggacagganaccgttcgncnggcaaacaggtctttttcacggtgggcagttttacccntttggaccggggnccgggcctgataccttaggaaaaaccctttgccgtacgccattttttgacgggtnaanacttttggatac

SEQ ID NO: 7555 - DNA, 305 bp, Tricoderma reesei
  misc_feature (1)...(305): n = A,T,C or G
ncgantcgcacgaggccnagcgcaagctggcccgncgccggtgtcaagcccccgtctaccttccagaccttcatgggcatttaccgcaaggagggcatccgcggcatcaacaagggtgtcaacnccgtcgccatccggcagatgaccaantggggctcccagnttcggcctcagccncctggncgagggctgnatccgctcggtcacggggcaaggagaanagcgacaagctctccntcggagaaaaggtccttncccagcgctctnggcggtggtctaagtgcntggaaccagcccattgaggt

SEQ ID NO: 7556 - DNA, 711 bp, Tricoderma reesei
  misc_feature (1)...(711): n = A,T,C or G
cggcacgagggctgatcgctatggccgcaagtggccgtttatcgtcaacaacctgctgtttatcgctctggaattgggaaccggcttctgcaacacttacaagcagtttctcgcctgccgcgccctgtttggcatcgccatgggtggcctgtacggaaacgcagccgccacggctctggaagactgtccgcaagaggcccgtggtattatcagcggtatcctccagcaagggtacccctttggctatctnctanctgctgcttcgccgcggctcgtcaacaccacctngcacggatggggccccctgttctggttcggtgcctgccgccgttctctttatcgcttccggctgatgatgcccgaaacccaaacgtaccgcgagcgtgaaccgcatgcgcatngaggccggccgaagcaagaacaacgatganttccgtcggcaaggtcttcatcaccganggcaaaggttgcctcaagcgccactggatcctgttgacctacctcgntctgctcatggccngcttcaacttcatgaaccacggagccaggatctgtaccctaccatgctgacgaaccagcttcgtttagcgcggacaaggtcaccgtcacgcaagtcgtcgccaacctgggcgccatgaccgggggnaccctngttggattcatgaaccagtctntnggccgccgctttaacaatcgtctgntgctgcatcg

SEQ ID NO: 7557 - DNA, 875 bp, Tricoderma reesei
  misc_feature (1)...(875): n = A,T,C or G
tcctacgcctcccagccgcaccccagcgcctatccgcggacgacgacatcgagtcctcaaactgcggccctccgttcatccgccccttggaatcgccctcctcgatacccaaccagacgccgtagtttccgtgtgttgagaagagcgcaatagcgaagagcagaaaagaaaccggagacgagacgagataaacaattattatccatacacagacttcagcaccatggcccagaagcgtcttatgcaggagctgcagtctcttcagaaggagaaatgggtagacatcacaacagacgaggccaaccttctcaagtggaggatcggtctgtgggtggtcaatcctgacagcgttggcatggggctttctcaaggccgagatgagatttccgtccgactacccgtaccaaccaccagcgttcaagttcctcactcccaacatcatccacccgaacgtgtttccgacgggaacctttgnatcttcatccttcacagcccggcgaagacgagcagtccggtgaacttgcgagtgagcggtggaacgtcttcacggagtcgagtcagtccttcggtctgtcctcctttactggacgaccctgagatcaacttangcgggcaacgtcgacgntagtgtattatatcgaagacaatcgcgccgagtataactngttgggcaaaggccacgggtcngggngacccaaaagcatttcccggagggcgcgcatatgcctaccatgggntgaactggactccgcacctgtaaagccggtcgaggntgactcggacttttggaacatgttnanacaaggaaaaaaanntttggcggaagcaaagcgatgaaaanttggaggattttngggccaaaaaaaaggaaaaag

SEQ ID NO: 7558 - DNA, 391 bp, Tricoderma reesei
  misc_feature (1)...(391): n = A,T,C or G
nggcacgaggcgcaccatcacgctcgcccatcatgctgtctcgaagcatagttgccgtctcccgcatggcgccgatgcgccatttgcgcccgtcccccgtcttccgccagggcctcccgagcttggtacggtactatgcggacaagatcatccaggtcccgcccatggccgagtccatatccgagggaactctcaagcagttctccaaatccgttggcgactacgtcgagcangatgaggagattgccaccattgagacggacaagatcgatgtcgccgtcaacngcaacagaagccggagtcatcaaggagtttttcgtcaaggaggaggacacctgtgaccgttggccagggacttggtcccgtgtcgagactggcgggngagaagccc

SEQ ID NO: 7559 - DNA, 623 bp, Tricoderma reesei
  misc_feature (1)...(623): n = A,T,C or G
ngatggactacgacncggcncgtcaagatganctcagactactcgtncgacgancagggccagttnttccccttcttcatcctgaccgtcaccggcctggtcacccttcccttgacatacagcctcttccggaagagcaccgacaacgatgcgcttgcgccgcgcatctcgtcggattacaccatcaagcatggcgacgttgtagcgtcgctgcgggcggcgcagaagaggaagcagcgcaagatcaagcgggccatcttcgtcgtcctggggtgggctctcatggcgggcatggtgtatctgatcgtgacgacacaaaagatcattcctaagatttggaatccatatgatatcttgggaatttcagagtcggctacccgaaaaacaaatcaagtctcactacaagaggctgtccgtcaaattccaccccgacaaggtccgacccgatcccttcaagaacgagacgctggagatgctcaacgaccgatacgttgagcttaccaaagcataccaagccctcacggacgaagaagtacgaaacaactatattcaatacngncaccccgatggcaagcagaactttaacatcggcanttgcgcttgcctcagttcatnattcgaga

SEQ ID NO: 7560 - DNA, 598 bp, Tricoderma reesei
  misc_feature (1)...(598): n = A,T,C or G
actgttctcatcaccggctgcacgcctggaggcattgggcatgccctcgccctcgagtttcacagcagaggctgtcatgtcattgctaccgcacgcaacccggatgtcctcaagggcctcgctgccatgggcatgagcgccgtccagctcgatgtcaccaaccaggacagcatcaacgccgccagggacgaggtttcccacatcaccggtggcaagctcgacattctcgtcaacaacgccggccggacttacaccatcccccgcctcgacatcgagatagacgacgtccgccaaacctacgaagaccaacgtcttcngcccatgttcaccatcaangcctttgcccccttgctcatcgccgnccgcggcttcgtcgtcaacgtcttnctccatcagcttccatcagcgctacattttcggttccgtntacgccttcacaaagggcgccatnaacaagctactcgcgcgtcctgcgctcgagctcaagccctttggcgtccgcgtatggtcgcatggtcggcacccgtccgttccacattggcagcnaccgnaccggggcctgccgcacttggtntactgccgtaacantattcagcga

SEQ ID NO: 7561 - DNA, 488 bp, Tricoderma reesei
  misc_feature (1)...(488): n = A,T,C or G
ntagcgcgccgancgnacgaggcgctcgggtcgtcgcagccggagatatatgttgttgcgttncaggagatngtggagctgagcccgcagcagatcatgaacagcgacccgacgagaaagagcctctgggaggcggnggtgaaacgagccctgaaccagcgtcaggctgcccttggaggaaagaagtacgtgctgctactgagccggacagntcgtgggagcggcgttatgcatctttgtgaagtcctcatctcttgaccacatcaagaacgttganggaagtgtcnagaaaacaggcctttttgggatggctggaaacatgggagctgtttgctattcgggttcgactnccgcgaacactcaccttctggctttngtgacggcgcnatcttggccggctgggatttttncaactncgantgaagncgncaatcngccantcccnctaccaatttaacgggngggcnctggccgattntcagacggaa

SEQ ID NO: 7562 - DNA, 910 bp, Tricoderma reesei
  misc_feature (1)...(910): n = A,T,C or G
cttgtttgcgatttcctgctggttatattcacgtgaagcattggcgataagacgaacgcttgggaggggaagaaagagtcgcacgaacaacaaggacgacgcaacgagttcgatctgggatatcaaacaatgtccaacctcctcttcaaagcccgcggctccggcgcgcgcacttgcaaagagccagcacctntcgggctcgccaaagatccagcaatgccttgcggaaaggcgctcggcttcacacggttacctttggatcccggactgagcggccaaatgcccggaaagagcacagtcctcgaacatntaagccgaaatttccatgcgacgaagtccnctggcgcaaaaggacccgtacaaggcgctcggcgtgagcaagacggcgacnggccgccgagatcaaaaaggcatactacggcctggcgaaaaagttccacccggacaccaacaaggacccgacggcaaaggacaagttcggcgagatccaaaacgcctacgagatcctctccgaccccaagaaganggagcagtacgaccagttcggtgacgccagcttcgaccccaacgcccgccggaggcaatccctttgcttggcgcaactggcggcaatcctttcgcgggcttttggtgcgcagggcgggttcggaggcgggttcggtgggggattcaactttgaggacttgttttcggcctttggcggaggccgtcgatcgcattcttttcagcaggagatctggtgggcgacaacatcgaggcccatgtcacatcaactttattggaggcagncaagggcccagccanaccatnacctttttcccggggagtcggcaaaanattgttcggcaacggcttgaancttgcgcgcacggtcccggcccaaatttgacgaacggcncccggtcctttt

SEQ ID NO: 7563 - DNA, 338 bp, Tricoderma reesei
  misc_feature (1)...(338): n = A,T,C or G
ntttctccntcnacgattacngnccgtcaactgtaccaattggtagtgtngggtcgatcggtcgttcnttatnactggggataccaanactgcgtcatccgagctcttcttcgatggttccggcgatcattcttcacatgggtgaacaaccccccatgcccagtgtgcttgtcacccacaatcgcccaggggatgacagctccgactcccgaggagagagcttgcgccgcgcttcgagttgagctctaccgatgctccgncgagagctgcggtgcttatgaacgctttccacgttacggcnacgtgtggcgtctcgttgcanacccggagaggcccgc

SEQ ID NO: 7564 - DNA, 632 bp, Tricoderma reesei
  misc_feature (1)...(632): n = A,T,C or G
cgcagacgggcaagtgtaagaacaccctgatggcgcatacgggggccatcacctgctttcagcacgatggcccgcaaggtgattagcggcagcgagaagacggtcaagatgtgggacgtcaggacgggagagtgcgtgcaggatctcttgacggacctttccggggtgtggcaggtcaagtttgatggaaggcgatgcgttgctgccgtgcagagagacaacttgacctatgtggagattctcgacttcggcgccgttcgngatggacaccctcccgaagaacttggacgtcgcatcctcctgaatgaaccagaagttcgtgccatgattgaagaggaagtttgaagcccaaaagcgcgagtatgacttggtatccattttcccatgctttaagaaaaccaacaaaagccactgcggtttacgaaaaccaaanggagcagagaatgcatatataatcagcatttggtatggnatattggaancacgcatctgaagggcgatccgattctgcccttcggcggtttgttggtattatacatgcnctggcttgagaaccagtgtncncattacggactcttgggaggggggtgtggcaaggcnttggggctttaatgttttgtttngtttngtgg

SEQ ID NO: 7565 - DNA, 462 bp, Tricoderma reesei
  misc_feature (1)...(462): n = A,T,C or G
ngcgtgcgantcggcacgaggcgactcttcatctatcctgagctatcaacagctgcgacttgcccatttcctgcgcttccaaacaagattatctactgaatttcaggcttccatcgtcctctttttcaagctgatttgagcgagttgttatactgtgaagatgtctgcgcagaactcggccggtatccagaccctcctcgacgccgagagggaggcgtccaagattgtccagagggctcgagaattccgcaccaagcgcgtcaaggaggcccgcgacgaggccaatgcgggaaatcgccnagtacaaggctcgcaaggaagaagagtttaagaaatttngaatgccgagcacagcatggggcnacgaaggncgtccnagccaagaggcccacntagggagggcngaagangcntgaattngaagggtgatttnaactangggcggggccnanaaaagaaacc

SEQ ID NO: 7566 - DNA, 502 bp, Tricoderma reesei
  misc_feature (1)...(502): n = A,T,C or G
ncggcgntcggccgaggcgatgctgaaatcaaggactttttcagcttctgcggcaagatcaacgacatcaaggtcaccaccgagggcgagacgaaaagcgcagaggtnatnttcgagaaggagacggccatgaagactgccctgctgctgaacaacacacaactcggccccaaccacatcaccgtgtccagcgccactggcgactccgaggatgacggttcgcactttgcccactcgggcaacaatacggacgagattacncaggagatgaagccgcgcacccgcatcctggccgagtaccttgcccacgggtacgttgttggtgatgctggcgattcagngcgccatcganctcgaccagaagcacgggcgtttcgtcgcgctttctcaagnaccatccaaggacctcgacaagaaagtccnaggctcacggaccgcgccaagaccggtcgaccaganntacggtattacncaagcgcgccggcaacnttttttaactggg

SEQ ID NO: 7567 - DNA, 264 bp, Tricoderma reesei
  misc_feature (1)...(264): n = A,T,C or G
acacctgcaacagagtctttccncaagccagctctgccattaatacacccatgcgatacctngaacctcccaccgcgaccatgttgatcaaggtgcgaacgttgaccggcaaggagattgagctcgacattganctggactacaaggtgtcccagatcaaggaaaaggtcgaggagaaggagggcatcccgcccgtgcaacagcgcctcatccacggcggnaagcaaatgaccgacgacaagaccgcggccgatacaacctcgt

SEQ ID NO: 7568 - DNA, 704 bp, Tricoderma reesei
  misc_feature (1)...(704): n = A,T,C or G
ggagtcgatatgctcccgtcgcgaattggaggtcaatccttgcgtctggccgctttccgttccagttctgcccggtcctcgtcgctgaccttttctcccgcccaccgccctgctgctgctgggaaccgatactgcgcttcatcctcctcctcctcctcctccagcaacaacaacaacaccaccaccaccacttctggctcagtccctggtaccgtctntggaacaaacgcaaagacacccgctcgtctgcccggcatgcctgaacacgaccacgacgttgagcgctacctgcgcgaaaaccaccagcgcctnttcgagaacaacaggaaatgggctgccgagaggctnaagcaggaccccgagttcttcactcgctgtccgccggcagtcgcccgagtacctntggatcggctgcagtgattcgcgcatccccgccganggcatcacggggcttggggccggcgaagccttttggcaccgcaacatcgncaacatggtcatcaacaccgactnaacgtcatgaacgtaatcaactacgccggcgccacctnaaggtcaagcacattgtcgtctgcggcactacgggtgcgggggtgtaaaggccgcatgaccccaaggacatgggcctgnttaanccgtggntggcaacattcgcgacgtntancggcttcaacgaanaaggactggatgccattcccgaccaa

SEQ ID NO: 7569 - DNA, 580 bp, Tricoderma reesei
  misc_feature (1)...(580): n = A,T,C or G
cttcaacgtcggctgggccgagcgcggcgacggccgggcagacggccacggcaactcggtgccgcgcttccacattgcctggggcgccgggcccgaggtggtgcgcgtctttgcggatccggtgcgcagggcggncgacgagggcctcgtgacgttcaagttccggcaccaggtcgacgagctcgtcgtggacggcaccggncgggcggtcggngtcaggggcagcgtgctcgaggccgacnactcgcccnggggcgtccagacgtcgcgagccgtccgtngacttcgtttgagcttgcgccggcgcccgcccgtnattcgtnaccgttngggccggcattcggcggcaacaatngaaggcccgtcaaaaaanaaactgggccccgttcgaaccggccttgggggccncaaagggngccccgaacttttttttcgttnaaccgggggntggccccggcccaaccgtttngaacnggcccggaattgctttcnaaaaaatcaacccgaaaaaaaacgccccggggggcccaaaacctttnttaaaaancccgngaaaaaagggnatttggggcaattttaa

SEQ ID NO: 7570 - DNA, 747 bp, Tricoderma reesei
  misc_feature (1)...(747): n = A,T,C or G
gattgccgtctctcccgccgctgccctaccaggcagactcttccaacacctcgtcgccccgagtcgggtccattgcctcgtcaatcagctctcataccgggtctctgtcgtcgtatacctctgtttcatcgtcaaacggccccaagaccccgtctcccacgctgcccgcccaagccatcacggggccggccaccgccatcgtcagttacgacgcgatgaaccagagtgccgacatgtactacacacagcacatgtcagctgggcaacccccgccccctcagaccgttacttctggcggtctggcgcattactcgcaacaccagtctcaactgctgccccctgggccttcgtactccaacccggncccttacagccagtatggctacgccaacggcctgacgtcgnccccggccngaccctncgtcggtgntcaaataccatgggaaacccgtcgactgtcctgccctccatccccggcgtggctggccaggcccaatacgtcggattcnacaccacgggacagcagccgccccaggcatgaagcctcgtgtaccgccactctgtgggaggacgaaggcagctctgcttcaagtcgaggttcgangtatctgngtcgctnggcgagaagacaaccatatgatcaaacgggcacccaagtgctcaacgttgctgggaatgactcgggggncgtnaagaatggcntttttggaaagagccgaaaaaggttcnggaatngtcgntcaaaga

SEQ ID NO: 7571 - DNA, 398 bp, Tricoderma reesei
  misc_feature (1)...(398): n = A,T,C or G
nttcaacttnctgcccgccaccgncnacaagggcgccaagatnaactctgttcttaaagcagccacggcttcacgggcgcgcnttnttcgacctgtcaagggccctaccgccaangtctatgncgttgactgcaacgagggntttctggtcggtgccagngccggctatgatgtcaacaacgntggcntgaccngaacagcgccggcgtcaggtactncggtcngcagtacancnccgacatnaccggnaccgacaacatgaacaccttttgccgatnactattancacaaggtcnacagccatgtcaaggncgtgccaangcccctggacttcaaancancacaccgtcggctcataggtcncaagnaaaaccgcattgaccccggntcttctcnag

SEQ ID NO: 7572 - DNA, 553 bp, Tricoderma reesei
  misc_feature (1)...(553): n = A,T,C or G
gctctgtatgcgaagctctgctttctctcaacccataataccccggtcatagctggtctataagagagctcttcactcagcctcgtcttcgcgtttccaatcaattcgatcgatttcaaagcaaacagcaatccacaatggctgacgaagttcacgtcgctcccaacgagaaggagaccaacggtgtcgagcagacaaccaccccgcgccatggattcagacacagccaccacggcgacttcagcgagatgacccttggccaatatgctcaggcctttggtggtgctcttcagcctggtgcctggaggccatatgagcaccgaaagcttgccaaccctgctcctctgggtctttccgctttcgcctgaccacgtttgtctgtcggcattaacatgcacgctcgaggcgtctccgagcccaatgtcgntgtgtcctcgccttcggctatggcggtcttgtccaattgctcgctggcatgtgggaaaattgctgctggtaacacctttggtgccaccgcctgagctnttacggngggttctggatcttcgtacgg

SEQ ID NO: 7573 - DNA, 821 bp, Tricoderma reesei
  misc_feature (1)...(821): n = A,T,C or G
gaatgaanacttgatccggtggtcggaaaagggcgactccttcatcgtgctggacgaagacgaattcgccaaaacgctcatcccagaactgttcaagcacaacaactacgcgtcctttgtccggcaactcaacatgtacggcttccacaagtgcgtggggctctctgacaactcgatgcgcgcgagcgagcgcaagaacaagagcccgagcgagtattcgaatccgtactttcngcgaggacaccccaatctcctgtggctcatcaacaagcccaagagcggcggcaagtccaaaaaggggaacaagggccaggatggcgatggcgatagcgaggaggacggcgcccacgaagaggttgcaagcccaccagggagcgccggtgaccaacgcccgaagccgcccgttgccgccgtcgcangagcggaaccgtcgcctnttgcccaagaaggaaatggccttgttaaggaggagctgcaaaaggtgcgggagcagcagaagctnatacttcggcgccatcaacccgcctgcagcgcaacaacaacgaccttttacaaccaggccctatgttncanaaccagcacgancggcatcagaactcgatcaatgcgaatctcaactttttggccaacgtnttcaggaaaacgttcgaggatcagggggcgtcgcaaaaacgtcaccgacattcatnttcaagccttatggngaattanaaccaanagncccaacaccagggcagcgtggtggacttgggcnattttttcaagcccaaggnnaccccgggccaggaantnccaaaanctgttccgccgatnccccaagt

SEQ ID NO: 7574 - DNA, 1415 bp, Tricoderma reesei
  misc_feature (1)...(1415): n = A,T,C or G
gtgtaagtttccagctctctgttttggtgtgtcgtcgatgttgggagaggacgagatctcgaggacgatcactacgtggatgcttccacaacacggcctcgtctgcgcccagttcacgcatctacccctgcatctcgcgttgtcctcctctcctctcttgaatatcatgtccgaatctgcagaaactcccccataataccccaaaggcgcgatcctggctggatgcccacccccaggcggtgtcatggctcgccagctggcggagaggaaagggcccaaagacggcggaacgcaactcgacggccgtcgcctgtcgggaacgacggggacgcgtgtgtctgccagctgcaacggctcaacctttttcaggcgctgtggtgttcatcttgctcattcctctcgcctcggatcgccgagacctggtttcttcaacaccagcataccaagtcacttcgatcactcgctttctaggcccttgtttcgatccagtccgacgcttcttctcgtctctcgttcacatacattctcttcgtcctttccaaaccaagtcaagatgaagtactccgtcgctgctgtctcggccctcgttgccgttgctctcgccaagcccgagttcctcaactccaagttcgaggtccaggagggccagcccttcaccctcgagtactctggctgctctgacggctgcaccatcactctgcagaccggcaagagcaccgacctcaaggacgtcaaggttctgaccacctctgccaccggcagctccaccaccgtcaccctggaggacctnccctctggcacctacaacttcaagatcaccgacaaggagggccagagcaacttcagccagcagttccccttccagggcaccggtgtcgcctcgtccagcgctgccacctccgcaccagcgctgccgagtccaacacgggntgcttccaccaccaccgaggctgccaccagcaccaccgaggccgcttccaccacctcggaggagtccaccaccgtggtcaagaaccaaaactgctnacttcaccaccaccgaggcctngagcaccttnaccaccaccaccaccgtngccacttcacccacaagcacaacaccaccaccgntgctcccacaggttcggtttccaccaccacttggacaccacaccaccgttgcttcactcttaaaccccgccgtcacaccgttcttcccggaagcgccgccggcactttttttttccctggccctcgttggccggngtggcattggcattgccttcttcttttaattctgcagatgcanggctgggagggaaagggtgccatcccgatttgttcgcgctttaangcttttttctctggtaccggttaaatttaatatcttgaggcaangttgtgtcgctgctttttttttcttcttcaacaagcac

SEQ ID NO: 7575 - DNA, 444 bp, Tricoderma reesei
  misc_feature (1)...(444): n = A,T,C or G
acaccacgcgatatatccacaactctgagcccttgagctttgcataaactacacacaagatacccaacatgcctttcaccgcaagcgacatttgcaagatccttcttgccatcatcctgccgcccgtcggtgtcttcctcgagcgaggctgcggcgctgacttcctgatcaacatcctcctcacgatcctgggttacattcccggcatcatccacgctctgtacatcatactgaaatactaaacacgccgcccaccatcgtatccgcaaagctcaagccatgacgccccgtcgcttcacgccatgcacgcaccaccaaatttgcggtatctgaacgggcattgactggcgaaagtctttttaagaataccggttgccnacaagtgggaaggagtgggtngcccnggcttcacaaacggtgggcccgganattaaaccgccggtt

SEQ ID NO: 7576 - DNA, 786 bp, Tricoderma reesei
  misc_feature (1)...(786): n = A,T,C or G
caaagatctacaatcaaatcacacaaccatcatgggtgacaaacgactcaacgacctcctgcgatggagcatcgaacacatggaggccgactcgcctgtaaaccagccctccaacggatcccggccgccacccacgaccaacctgaccccggagattatggaggccctcatgggcggcccctccgacgccgagctgatgaaggccgccatggagatcatcaacgaccccgaggtcagcctggagaacaagctcatcgcctttgacaacttcgagcagctcatcgagaacctcgacaacgccaacaacattgccaacctcgacctctggaccccgctgctcgaccagcttgcgccacgaaggagaagcgaaatgcgcaaagatggccgcctgggtgcgtctggcaccgggccgttccaaaaaacaaccccccgcaccgccaggaaccgccttgcttgggccattgggccggggcntggccctcggcttgggtcgaaaaatgggcgctttaaagaaaaaaaagcccgaagatgtccggccaaggcgatttatgcgctgagctcnanccgtcaggaattaccagcctttcatgggatgcctgcacggatgaacttgaacaagcggggattttgctgntggcgtccaaaagttcgacgcttgccngaatattggaatgcttgttggacacccgtttantcccaacnggtctncaggaggaaaaaccgntcaaggaaataaccggtttcctggcaaccggtnnttcattagaagcataaccgaatcttatt

SEQ ID NO: 7577 - DNA, 907 bp, Tricoderma reesei
  misc_feature (1)...(907): n = A,T,C or G
atttcaaactttctnggtttttcctttctttctttctttaccatttaattatttatttatttatttatttatttatttattnacccattncttnggggcccccggggggaagcccatttcttttgggaaattcgggggaacccttgggcggttctttcggaatttngggtttggggcttccggggggnaatccggcttggctttggaacttggaagaaaaatcttncgaaaaacccggcaacttggcctggaaaaacggcaaatttggggaacttangaagaaacaagaattaaggaagaacaatantcggaccaggcctcaacaaatggcgaaacaaggcttttccccagaaacgggcggcttnttggagcggcatccagggcctcggcggctttcctccccgcgcatcggccctggcccggttctacagcatnaagggccgcggccgnctcccactcaaaacaagcggcctctgggacgcctcaagactcaccatcgagacgaccaagacgccccaaggcccttgaccaagcctgaggacctcgtcttcggcaagcaagttcaccgaccacatgctgggccattgagtggacaaaagaggacgggntggctggagcctcgcatcaccccctaccagaacctgtccctggacccgggccacctggcgtcttccactacgccttttgagtgcttcgagggcatgaaaggcctaccgggacaagaacggcgacatttcgctnttncgcccggacaagacattggcccncttcacaaagtcggngggccgcatcgccctgccaccttttgagccacnggcttatcgagctcatcgcaagctcacaaggtggacgcgcgntttatncccgcccaccgnggttactcggttgnactgcgccctacgcttat

SEQ ID NO: 7578 - DNA, 697 bp, Tricoderma reesei
  misc_feature (1)...(697): n = A,T,C or G
cctcgacgacgccgcgcgccagctgtggccctacaagttcggcctgctgtacagcgtcacgctggcgcccgacagcctgagcacggcgctggtggtgaccaacgagggcgacgagccgtttgagtgccagacgctgctgcacacgtatttccgagtttctgacattgcgtccgttcaggtcctcggcctcgaagactccccctaccacgacaaggtcgacggcgtcaagaacaagacgcagtcctcggaccccgtcaccttttccggcgagacggaccgcgtctacacaccggccaagggccccggccaccccgtcggtcatcaaccgaggccggcgtcgccaagttccgcgtcgtgcgcgacaaccttcgacgacgtggtggtgtggaacccctgggtcgacaaggccgcggccatggccgactttgagcccaaggaccggctggaagaaaatggtctgcgtcaaggcgggcgcggtgaactcgtggcaaaaactggagaaaggggatgcgtttgagggggcgcagacaatttacttgaaatgacggtccgtcgggggctatgtgtgtgaatctaccgnatacctgcatatattctcgcatttgatggaccatggtcctgagaaaaggcatttgagttcttttttaaatgttggcacagaatgaagcgtnttcnaaatgaaaagcatgtttgnttt

SEQ ID NO: 7579 - DNA, 288 bp, Tricoderma reesei
  misc_feature (1)...(288): n = A,T,C or G
ctcacctcatctcactccaacctcgtngtcacaaccacaaccaccacaatccaacatgtctgagcccgcccccctccgcctcggctccgtcgcccccaacttcaaggccgagacgacccagggccccattgacttccacgagttcatcggcaacaactgggtcgtcttcttctcccacccggaggacttcacccccgtgtgcaccaccgagctgggcgcctttgcnaagctgcagcccgagttcnagaagcgcggngtcaagctnatcggctgtccnccaacacggtc

SEQ ID NO: 7580 - DNA, 1142 bp, Tricoderma reesei
  misc_feature (1)...(1142): n = A,T,C or G
cgggactatgcancaccancaccacacgtnctncgacttnaccgttgtccacgagcacacttntgttgcccgtcccaagttccgtgaggagatcaagatcaccgaggaaatccgngagtctactccgcaagtccccgaacaatccgccaagatgggttactacgacgacgagggctcttaccactccctnaagcacggcgtcgcaagacgatcgacangctgctccctcatcaccaccaccataccaccacagtgatcaccaccaccacagtgaccatcatgaccataataacactacgatcacagagcaccgttgaagttgatgttgtcccgccacgatgctaatactcgtgacgcgcagctccccgcactgagtcgcaagcctcagactgtgtncatcccctggccacacattccgctgggtgacttctgatgctcagggncgaccatgccaggtcatccnatntcgaccttcgtccgcactggccagtacccgttaccttggtgttgacctnttcacnaacagctgcacgangagtccttctttatcttcaacccntgccccnagcggtggtggtcaaaccatgctcgggcccgtctttcaagcagtaccgcgttcttcgacatgggttgacggntaccttaaccgccattgaccgaaaccggggacgtaaacaagggccttaanggcattggancaagtncaaccttgtggtcttgttttgnaagcaaggcttttgaagttccggnccgngggaggcggtccggggttcttgggtccttaaangaacngggggggcattgaaccttgcnttgtttgaanaatgaaanggtcgttccaccgggttttttggncttggtaaaaccaattncttnttcgnatgnacattttttttcggggttttnaagggggggaagggggtttatttgggnccaattccatttccttatngggatantttccaaggcttcggaattaaaagccttggaattaatggggnaaaaaaaaacccccatnggggctttgggaggnggataccgtngggaaacnggtttgggnatttttttttgggaaacgggcttgggaatgtatttttgggtcattaaaggcaaaatgncccanttaaatnggattttncttt

SEQ ID NO: 7581 - DNA, 772 bp, Tricoderma reesei
  misc_feature (1)...(772): n = A,T,C or G
tccgcaacccatccccttcgcaaaacaaaaccccccccccaaacgaatctcgcgcagcatgtccctcaagaacgacgcattcccctcctccgaggccttcgacgccatcaacgccgccctcagcagcagcgaagccgaccgcaaggacgccatcaagaacggcaaggccgtctttgcattcaccctcaagaacaaggccggcgagacggccagctggcacattgacctcaaggagacgggcacagtcggcacaggcctgggcgagaatcccaccgtcaccctgactctctcagacgaggactttggcaagctcgtctccggcaaggcgcaggcccagcggctcttcatgtccggcaagctcaaggtcaagggcgacgtcatgaaggccaccaagatggagcccatcctgaagaagcccagaccaagtccaagttgtaagacgcgagaagctcaacgcgcacccaagcgcattatttcatatggaatcttctctcgggggggtgtacatacgacgaggggaaactgctggaaacgcaacgccccctttgaccgcaattcttgatttttttttttttttttgccttncttatgtatcataccaattccctggtgctggtcccactgaagttgcgtcntggggttaatncccccgcaaaaanaggaggcttgganaatgagggataagtggttcgagcttactttgccttatgaatgctggcatagacganaatcccattnttcgctnggtacgtttccancttggcttttggtt

SEQ ID NO: 7582 - DNA, 838 bp, Tricoderma reesei
  misc_feature (1)...(838): n = A,T,C or G
atcgcatcatatcgcatcgcgtcgcatcgcatcgcatcgcacacgatcgcccattgttatcgtcgactcgttgagcctgccccgagttcgcgctcacgtggggactttattcactgcgttgggcgctttgacggcacgcgaaatcctgtcctctctcttcatctcgtcttctcctcgactcggcgtcgccagcatgagatccttcgttcggccgggcgccctggctgcccttgtagctgcggcagatgtcgccgtcgcacagcagagcccgttttccatcgcatcaaccagcgacatcaaaaagacagcagccaccgtcgcctgggacatgctccagtactaccacggcaatgagtctggccagacgcccggcatcctgcccggccctccccctgctggcgattactactggtgggagggcggcgcaatgtgggggacgctcatcgactactggtacctcaccggcgacaccacgtacaacgacctnccatgcangccatccagttncagacgggcccgacgacgacttcacccgccaacgtgacgctgtcctgggcaacgacgaccaaggcttttggggcatgacgggcatctggccgccanganaaattncccganctttcggccgacaagccgaatggntggccttgcgcanggcgtttttaacacgcaggccacccccnacgtaccangacacgtgcggggggggctttgttggcanattcttccaccaaccnggaaacantacaanaacagattgccatggntggtttttaaatgggcnccnctgggttganaaccgggaaaacnaatanttgantgggccnaaaaaatggga

SEQ ID NO: 7583 - DNA, 757 bp, Tricoderma reesei
  misc_feature (1)...(757): n = A,T,C or G
aaaacatcaaacgcaatgtctcgcatcgctgcccccgtcgccaaactctcccgcgcgctgagctcctccgccgccgcctcccgcgccgccaacccgctgctcgtcgaagcggccacttacaacgccggcgccgccctcatgcccaagtacgccgagctgctgcgcaaccggaggaccaccaccaccaccatcaacaccgccgccattgagcactccgagtccacccgctccctcacaacaacccaccgcccaaccccccagccctccatcgccaaccgcccaagcctctcatgcagaccttttccacctcatcaacctcatcagcaacaacaccctccgcccacctcgacgccgccatcctccccagcttcgcctcctctcctcatcatcttcatcctcatcaacattcgcagacctcccccgcatgcccctnctccagacagctacgcaaccgcgcatcccgcccggccgcagatcccccgtttcatcgcagctcctcatcgtcgccgtcaaccccgacgccgtcgtcccgccacgcccctttctcgctcagcggcgtctcgaaccgtcgagctcaagttcgtcacgagccttgagcccgcaaggtcgacgaagcaggcggngagaacaagccaagggcatgattcgcgatctgtggaaggnattggtggangatgtcttgggcgcggggnaaggntttgggcaagtnganttgaagcgggggggcttgggctnaaanggggtaagggngaatttt

SEQ ID NO: 7584 - DNA, 740 bp, Tricoderma reesei
  misc_feature (1)...(740): n = A,T,C or G
ccccaacagcgagcagcaactcctcagccacagacagcattgcaatcctgcctgcatcttacgagcgcatcgtcaccatgagcggccccgtccatgtccagtccgacggcgagtggcagtcgctgctctccaagaactcggtcgtcgtcgcagatttctacgccgactggtgcggcccctgcaagatgattgctgccgcactttgagcgcctcgccaaggagcactcgcgcccgaacaaggtcgcctttgcaaaggtcaacgtcgacaaccaagccaacattgcccgcacgaatggcgtcacggccatgcccacgttcgtcatcttccacaacggctcgaccgtccagaccatccgcggcgccaacccgtccgccctgaccgaggccgtcacaaaggccgttgccctcgccgacggcggcaaggccgaagccgtcttcaagacccccggcaggacgctgggcggcgatggccccgtccccgctcagcgtcactggagcgtgacggtgctcctcaacgtccgtcatgatgctcgtccggactctacttcacgtccttattttcgattgatgccgtacaagggcgccggagctgtccatgttcaacccgaaaaagaaagcagccattcgcgggtgaaagccggcagcggntggangaccggcccaagcgggcagtgtccgaccgnaacaacagaggtcggctttaaaaactacagattgggattttttttttttcattgatt

SEQ ID NO: 7585 - DNA, 751 bp, Tricoderma reesei
  misc_feature (1)...(751): n = A,T,C or G
nncaacgccaaacacgatngggccgacgacnacgacatctgangagacctccttcgagctgccgcctccccagaccatctctaacaaggatggcaccaagacgatcatcacataccgatacaacgaccagggccagaaggtcaagacgactcgccgggtccgnacataacccaaaccgaacagtcaacccccgcgtcgccgcccggaaaacgtggcccaagttcggctgagcgcaaaggaccccccgggccntgcccccgacaccacctccgtcggcgagaacatnatcttccgcccagcgtctcgtnggcgcaaggatgccaaggaggangggcgccgacgccaacgctnaggccatgaaggacaagctcaangacaagaangtnaagtgccgtatntgcaacggcgagcactttacagccagatgtccttacaaggacaccatggcccttgttgganagacnaccgccgccgaggcgcccgttggtctgnagacnatctcggtgccgttgttgcgcttgncggggntggcaanaanggttcctacgtgccgcttgttttggtggcgaccgcggaaccggaaacccatgggtcggatcaaataccgggaaaagggacnnttttggacactgcgtgtaccaacgtttanaaatggcggaaaacaaaacttgcncaanttgttcnacgttttggncgtgttaccananttttcttcgccaangaccggnaaccggattggcanngggttttc

SEQ ID NO: 7586 - DNA, 404 bp, Tricoderma reesei
  misc_feature (1)...(404): n = A,T,C or G
tttggccgccgaacgctctatgttgtggggcaaggtatcttatgctccactctccttatcattgggattgtcaactctgcgacatctgccaaggatgccatatgggcagaagcagcgttatgcatcttctggctcctagtctatgctcttacagttggccctatcacgtattctatcgtgtccgagacatcgtccatccgtctgcgcccagagaccgtttcgctggcccgggcggcctatcagattatcaacgttgcatccaggtccttgagcccgtactttatgaaccccgaccgcttggaaacgcgtctggaaagaacngggttcttntggggcggnaccgctctgaacatgttatttgggcctattttcgacttccgaaaccaaaggacaacgttgaaaag

SEQ ID NO: 7587 - DNA, 619 bp, Tricoderma reesei
  misc_feature (1)...(619): n = A,T,C or G
caccaccaaaccancaaacatcttccccatgatctcatcatacagaacccaccactgggcgatataaaaagactgccgaattggcttcctctcggccaacatgcctctccagcangtactggccgacgncctgctcggcttcngcgcagtgacgcccgtccacgcccagggccgaggcgactggcaggctacgctgcccgactactacgccgacatctgccccgactatgcgctctactcaacctatccgcatcgtccctacagctcgggcccgcacgccctgccctaccagcggccgaacccgcggtgtcgcacgttccagtcggacgagatcgagagggtcattgaggaggtgacgtcnaggataaaggaccncgacctggcgcggctcttcgagaatgcgttcccctccacgacggacacgacggtcaagttccacacaaagggcggcaaggacgcgggctttgtccccgtccaggggcctncgntggaggacggtcgtgngaagggccgcagtcgttcatcatncggnggacattggtgcggagtggctgcgggactcgacgaacactgcggncgtccangcnctgccaaaangaccggncattttgactgattg

SEQ ID NO: 7588 - DNA, 369 bp, Tricoderma reesei
  misc_feature (1)...(369): n = A,T,C or G
ccgacgccctcgcgcaggccctccgcgcctacgtgatccagagccaaaacgccggcatcgagcggcacggcgtcttcaaggtggccgtctcgggcggctcgctgcccaagacgctggcgcaggccctgctggcgccctcgtcgggcccgggcgacgtcgtcgacttcaccaagtgggaaatcttcttcgccgacgagcgcgccgtgccgctggaccacgaagactccaactacgccctcgtcaaagaaggagctgctcgacaaagctgnccgccgaccagcagccgccngncgtgcacgccatcgacaacggnccacctngatgacgtccaggaaccttcgccgaccangtncgagcaaaacgcttcgt

SEQ ID NO: 7589 - DNA, 914 bp, Tricoderma reesei
  misc_feature (1)...(914): n = A,T,C or G
ctncatgncaataccattctttaaccaacctncgcatctataatcctaatcaagctccctcgagtttaattcctaatccgacaaaatgaagttcaccgtcgctgtcgctctcgccgccgctggcgtctctgccgtctacgtccctcctagcaacgttaccgtcgttaccgaggtcgtcgatgtctacaccacctactgccccttcgccacgcagatcacccacggctccaagacctacaccgtcactgagcccaccactctgaccatctctgactgcccctgcaccatcacccgcccggtcaccgtcaccagcagcgttgcctgctacacctgcggtgctgctgctcctactggtgctgtccccttccggcaacggcggngctcccccgggctttaacaaactccaccaatnaccacttcccaccccagggcttcctcctggccgggtgggcaaaccctttcccgccaagcacttggtgggtgggtggtcccntaaccgggttcctttcccggccggtccccccacntgggcggggnggcccagcaaggccgtcttttcgngccggtttggccngtatcgtcggctggccgtttcgtcctgnaaatcntgnaaatttcgacacctcgncaatataccggctacgaatttcttggttcaacgaattctgggaagtcgngggttcggnctncgttcatgaatctgatataagggggaaaaaccaagtggtngggatttaatctaatttttnggttacgtcgaacgggatggggggaaacgatatttaattttttnggatgtatanaanaatgggtttttttgggttaacnggacaatgcaannctcggggttnaagggaacttgaattttttttttgaacnccccaagggaaanaagnccaaaaatttgcttttgg

SEQ ID NO: 7590 - DNA, 294 bp, Tricoderma reesei
  misc_feature (1)...(294): n = A,T,C or G
tgaacgtctcgctcgtcgaggccggcaagcccaccgctgagcacctcaaggctcaccctctgggcaagttccctgccttccttggcgaggacggctttgctctgagcgagagcattgctattgccatctacgtcacctcccagaacgagaagaccacccttctcggcaaggaccaagcaggactacgcttccatcctgcgatggatgtccttcttcaantncgagatcgccccccaggtcggcacctggatcaaagntcctgaccggtgccctttcctacantaanaaggctgt

SEQ ID NO: 7591 - DNA, 279 bp, Tricoderma reesei
  misc_feature (1)...(279): n = A,T,C or G
gcatcaggtccccatcaccgacccttccacaaaccccgagcacctcaaactcctcgagaactggatgcgcagctacgagcccgacaggctctttgacgagagcggaaagcccattgcctccttgacctcgctgcccccgacaggcaaccgccgcatgagtgccaatcccgtcnccaacggcggtatcctcagaaagcccctggnngatgcccgacttcaaagaagtaccggtgttgcccgttnaagcacccttggcgcttggtcatgggattgcttagc

SEQ ID NO: 7592 - DNA, 297 bp, Tricoderma reesei
  misc_feature (1)...(297): n = A,T,C or G
ncgtcgttggtctggcccgttacaagtccaccnttttgcnaagcggcttcgtttttggcgccctgntgngctttaagcacatntacctttatntgncgccgggctacttttgttttcttttganggcgtctggctgtcnggnaaacggttttccgnatnaagcttttnantgggttaanttcgacttcggcttggcggnnttttgccgtggctttgcncctttggcttgatggggnaaaaatccccaacttgttaanccggttntttcctttttcccccgggttgggntatgcttct

SEQ ID NO: 7593 - DNA, 503 bp, Tricoderma reesei
  misc_feature (1)...(503): n = A,T,C or G
acctacgaacccgaattcgagcatcatagcaatgcagaggcgctggatgacgccggcgccgaaaccaggcgatgggccgctcatgtcgaggcgagctgatcgcgagcttcccgacgtcggccaagtctcccacggctggcgccgcaccctgcccatcttcctcatcgtcgtcgccgctgctccgtcacaatcttcaactaccaaaagtcctcgtcgcccatcatatcgtcgacgctctacgcgctgcgcaccaaccccgaggccaaccggttgntcggcggcgagatctacttcaagcaccagatcccctggatctcgggcgagatgaaccangtcaagggcccgcatcgacgtgagcttcgccgtgcgcgggaaaaancctcnggcgtgatgcngttcgcgagccatcggccgtcgcccaacgccttttcgaaacacngtctggagcttgacgatggatgacnggacngtggtggatctgctggatngcngggatccgttta

SEQ ID NO: 7594 - DNA, 718 bp, Tricoderma reesei
  misc_feature (1)...(718): n = A,T,C or G
caaggaaatattaaagggtccttcaaattcggcaaaatggcgcagaaactcacgttgcagtcgacgattaagctcaactcgggctaccatatgcccctgctcggctttggagtctaccaaacctccgcctctgtggctaccgacgtctgcaaagaagccctgaaaatcggctacagacacatcgactccgctnaacataccggaaccaaagnccctccgcaacaagcattggccgncgccggattccccgcttccgaaatcttntttaaccaccaagggtcccgtccggaaaaagcccttcggtaccaaaaacacgctcgaacctcgtcgacattgccctgcaggagacgcagctggccgtacctcgacctcgtcctcatccactcaccctacggncggatccgagaaccgcaagggcgcgtggaaggccctcgtcgagtctgtcganggccggcaaggtgcgctccattggcgtctccaactacggcgtgcaccaccttgacgaagctcgaggcatacatcaaggagctcaggccgagcgcggnggcgaagnttggcaagggcgggattctgtccgtcggccagtgggagattacccctggctgccgcgcgacgacatcgtgcagtggtgtcgcgcgcgtaacgtcgcttgttangcgtattgtcctattgtgcgcngcgaagcgctttggcgatccaaggtgggcgccgtggcgaa

SEQ ID NO: 7595 - DNA, 526 bp, Tricoderma reesei
  misc_feature (1)...(526): n = A,T,C or G
atcagtcctcgaaatgggctccacggcttttcccccgccgccggtcaacaccattgactggtccaacgtcggcttccgcgtccgcgaagtcaacggccacatcgaatcgacctactccctcaagacgggcacatggacgccgctcaagttcgtcgcggacccgtacatgcgcatccacggcatggccccggcgctcaactacggccagcaggcctacgaagggctcaaggccttccgcatgcccggcgacgccttcatcgcatcttccgcccgaccgcaacgccgtccgcatgcagcactcggccgaggtcgctgatgcgccgtccccgtcacctttctgaggccggaaagccgcgtcgcctaacgcggtacgtccccccacagacggcgccgcatgncatccggcganattacggtcnagcgccacttgggctgtcgggcccagagaactttgcgtttggatccacggcgtttacggtcgacccgtaagcgtttgtgaaattgacgncgccacgacgagagnaag

SEQ ID NO: 7596 - DNA, 1024 bp, Tricoderma reesei
  misc_feature (1)...(1024): n = A,T,C or G
ctccctaccctcacgccaggctataacgctcctttccagcttttttgcccgccagtcattcctttgtcttcttacgacaacccacactctttatttttaaaaaaccttcttcattccttctttctcctttcaaaaaaccccaagcaactaaaaataaacaaacaaacaaaccaaaccgtcaagatgaagttcactctgtccgcctctgccttcctggccctcgtcgcctcggccctcgcccagaccgccgactttgactccatcaccaaccctacccccaacgagatcctcactgccggccaggccctgaccatcgagtgggatgctcccgcaagtacgccgccggcaccgtctccatcgagctgatcggcggccctacccaggccacccagcaggtcctggctaccattgccaccggtgtcaagaacagcgccaagaccttcacctggaacgttgactctgccgttgccggccagaacttctacggcttcatcttccggctcgagagcgacccctccgtcttcagtactccaacccctttcacatcaaggcggntgaggtccacagcaagcagcagctcctctactcccgctgctcccgccacacctcgtcctctggcagctacggcaacctccttccggcggacaccaccaccaccgtaccaccttcgccggtgtcaagacggtcactctggcacccagtccactaccgaggcttccgtcgtcacacgcccgtctactttcttcggccgttactgatgtaccggtgtcctgaacgccaccaccaccggtcccttgccgaactcacattggtctccanttttaagcggcgccaagacttttcaaagcgttaccggctggctctcttctncaagtttccggtacgtcttccggcagccctgacaagacggtgggtgttctttgctcaacctgcatantggtcgcccttgccacaangtgggttgcgttggcgagtctggctggtgctttgggtgtantgttgaacggcaaataaaactgangta

SEQ ID NO: 7597 - DNA, 886 bp, Tricoderma reesei
  misc_feature (1)...(886): n = A,T,C or G
cgagccgactccaaccccgcccaagacaaacggcaacgctcccgcgacagcctcggcctcggcccatgcagacgaacacacttctctcctcaaccgaccagaccatcatggccgacgcggttcggactggtccggcttctcgccggcagtgccgcatctcctcgagccaccggctactccgcaaccgccgccgacggcattccagactgtcatgtggaactcggttgtcatcctcatggtgtgcggcgctggagttgctggctggttccttggcgaaagggcatncactggcgagaggccgccttcgaacgatgataactcccttgagttcaacacattgggtcagatctttgggtacatctgcgcggtgctctacattgcgtctcgaatgccgaactcatcctcaactggaggcgcaagacaactgaaggactgagcatgctcttcttcttatttgcctgctcggaaacacaatgtacgttctgtcattgncgtgtacgaaccacgctgcggggaaaaagcatgcgaccaacaaaagcaaggnggngttaccgnagatatatccttgtaaatntaactggctggctggcagcgccattacccttctgatggatctctgcgtctttggccagtactttattgtacaggacggaaggngaaaccaaacaaaacttccgccgaggacnaaattancgccattgacnacctttgggataaaaaacactgnttgatcaaaaatgaaagnttgcttccactatntaccanacaatttnaccctttccccttccggtntncgtttggtactttgggtncttttggttggnggttttctttggcnaanattttnggaaattgacttcaatgggnaatcntttttttttgtgtt

SEQ ID NO: 7598 - DNA, 404 bp, Tricoderma reesei
  misc_feature (1)...(404): n = A,T,C or G
nntcacaagnaccgncgattcgcacgnggctcagcgccgcatgaaggtcgacttcgtcgatgtcgagtatggcgaggacaaccttcccctctccgcagaggctgcctctcagaccgttgccctcaagaaggacggcgagctcctcgccccctccagcgccctgggtgcccccgacaagtctctcctgcaccgctctcagtcgcgtgctttcatgaccgacgatggcatgcccatgcccactgagttcttcctctctttctgaccctgctgcntcgntgagcacaccaagaaaggttctgtacctcgaggatgacgacattgcttcacatccacgagggcttccctaacattccaccgccttgaagaaaggcttgatgggcagcttccaaccgtncgnggcccat

SEQ ID NO: 7599 - DNA, 706 bp, Tricoderma reesei
  misc_feature (1)...(706): n = A,T,C or G
cttctctccctcttccttctcgtctttcgtctcattgtcgtctcttgcctgctatacccaaacttcctctctcgtagagcgtaacggaagacaaacaggcaatcccgtgtttatctgtctctcctcctcacaatgggcgcgcacaccgacagcggcgctgccatctatgatgcggcgttgcatcgtcgccaggccctcatgggcgccagtggagctcgcgctctggtcaagaactttcgagtcttcagcctggctgcctttgcctgtatcggcggtgtcttgtatggttacaatcagggcatgttctctggcgttctcgccatgccctctttcaagcagcacatgggagaatacgatcctttcgaccccaacgccagccanaccaagaagggttggttgacggccattctcgagctcggtgcctggtttggaactctgttttctggcttcatggccgagacgatctctcgcaaatacggaatcattgttgcctgctgcatctttatcattggnggttgttggtcangctttggtgccatttgatgctggtccgaatgccattctttggangcccgattcgtcacnggtatgggaagttcggcaancttatccatganttgggcccatttacaactccgangtggccccttcctgaggttcgangngctctcgntgcccttnaagaaatttggcaatctgctttcgg

SEQ ID NO: 7600 - DNA, 408 bp, Tricoderma reesei
  misc_feature (1)...(408): n = A,T,C or G
cattgtcgagaagctgcacaaggccggcatcctgtacatgaacatgattggccacgtcaagcacgtccagaagtgcatcgacgtcggcgtcgacatcatctgcgcccagggcggngagggcggcggccacacgggcgacatccccacgacggtcctcatccccgncgtcgtcgagatctgcagcaagcacaagtcgnccctgaccggcgggcccgtcnaggtcattgncgccggcggcattcacaacggccagcttgctggctgccgcgctcatgatgggcgcnaagcgccgtctgggtcggcacccgcttcatcttgacggacgaggccggcgcccccaagttngcacaangaaggncgtncgcaccgccggncacgatgacaanattcgacnattatnttcccggc

SEQ ID NO: 7601 - DNA, 796 bp, Tricoderma reesei
  misc_feature (1)...(796): n = A,T,C or G
cgcactttgtcgaggaatttctggacagcgcccgccccaagttcagttctggcgtcaagaccattgttcgagataccacggctcttttcaacgtagcgcccgcccgcctcacgattacgagaatcgcccccgacctcgcaggactggatcctaagcactactcgctcaccattgagggaacgcagtctctgcagtcggctctcgacgagagggccaccggcaaagagagcttttcgggccgcttcccaagtctattaagaccaagacttttgaatacggcgcaccgctccgagtcaagtggcgagcccccgcaaaccacagcaaggaagactggattggcctgtacatggtcacggacaatcgctctcgagaaacgacggaagtctcctctctcggtagatggacgcccacatgcactggcgcctacgatgcctcgacagcggagactagcattactgttccggaacatccagtgcccaaggccgatccttcagaccctgacatggtggagggcgaggttgttttccagggagacaagctgtggtggacgcaaggtgtctttgagttcagatatcaccatgatggacgcccactgtcatgagcatttcggacccgtttgagattcgcatcacaagtttacccgaanatgacgttgatgcttgatgtccctaccaanggccggcttgccaaaggntgtcgaatcggnttntgctacccattgnccaaaactgnttggacccgcgacgatgacattggnccagcactgggggatgaatcttttggnanccccggtgga
